United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 21

SEQ ID NO: 791994 - RNA, 18 nt, Mycobacterium avium subsp. paratuberculosis
ggcccgcucggcgggucg

SEQ ID NO: 791995 - RNA, 13 nt, Mycobacterium avium subsp. paratuberculosis
ggcccgcucgggc

SEQ ID NO: 791996 - RNA, 23 nt, Mycobacterium avium subsp. paratuberculosis
ggcccgcggggcguacgcgcugc

SEQ ID NO: 791997 - RNA, 19 nt, Mycobacterium avium subsp. paratuberculosis
ggcccgcguaaccggcggc

SEQ ID NO: 791998 - RNA, 20 nt, Mycobacterium avium subsp. paratuberculosis
ggcccgcguaaccggcggcg

SEQ ID NO: 791999 - RNA, 20 nt, Mycobacterium avium subsp. paratuberculosis
ggcccgcggcaucgucgggg

SEQ ID NO: 792000 - RNA, 12 nt, Mycobacterium avium subsp. paratuberculosis
ggcccgcggcgc

SEQ ID NO: 792001 - RNA, 16 nt, Mycobacterium avium subsp. paratuberculosis
ggcccgcgcggccgcc

SEQ ID NO: 792002 - RNA, 20 nt, Mycobacterium avium subsp. paratuberculosis
ggcccgcgcggccgccaggu

SEQ ID NO: 792003 - RNA, 14 nt, Mycobacterium avium subsp. paratuberculosis
ggcccgcgcggcgg

SEQ ID NO: 792004 - RNA, 15 nt, Mycobacterium avium subsp. paratuberculosis
ggcccgcgcggcggu

SEQ ID NO: 792005 - RNA, 17 nt, Mycobacterium avium subsp. paratuberculosis
ggcccgcgcggcggugu

SEQ ID NO: 792006 - RNA, 22 nt, Mycobacterium avium subsp. paratuberculosis
ggcccgcgcggcggugucggug

SEQ ID NO: 792007 - RNA, 19 nt, Mycobacterium avium subsp. paratuberculosis
ggccgccagguuggcggcg

SEQ ID NO: 792008 - RNA, 19 nt, Mycobacterium avium subsp. paratuberculosis
ggccgccaggaugucgucc

SEQ ID NO: 792009 - RNA, 18 nt, Mycobacterium avium subsp. paratuberculosis
ggccgccagcgcccgcgc

SEQ ID NO: 792010 - RNA, 14 nt, Mycobacterium avium subsp. paratuberculosis
ggccgccagccggu

SEQ ID NO: 792011 - RNA, 12 nt, Mycobacterium avium subsp. paratuberculosis
ggccgccagccg

SEQ ID NO: 792012 - RNA, 20 nt, Mycobacterium avium subsp. paratuberculosis
ggccgccccgaacagcgcca

SEQ ID NO: 792013 - RNA, 12 nt, Mycobacterium avium subsp. paratuberculosis
ggccgccccggc

SEQ ID NO: 792014 - RNA, 14 nt, Mycobacterium avium subsp. paratuberculosis
ggccgccccggccg

SEQ ID NO: 792015 - RNA, 16 nt, Mycobacterium avium subsp. paratuberculosis
ggccgccccggccgcg

SEQ ID NO: 792016 - RNA, 19 nt, Mycobacterium avium subsp. paratuberculosis
ggccgccccggccgcgcac

SEQ ID NO: 792017 - RNA, 20 nt, Mycobacterium avium subsp. paratuberculosis
ggccgccccggccgcgcacc

SEQ ID NO: 792018 - RNA, 14 nt, Mycobacterium avium subsp. paratuberculosis
ggccgcccagucgc

SEQ ID NO: 792019 - RNA, 22 nt, Mycobacterium avium subsp. paratuberculosis
ggccgcccagucgccgccgcgc

SEQ ID NO: 792020 - RNA, 14 nt, Mycobacterium avium subsp. paratuberculosis
ggccgcccagcccg

SEQ ID NO: 792021 - RNA, 23 nt, Mycobacterium avium subsp. paratuberculosis
ggccgcccagcccgcgccgagca

SEQ ID NO: 792022 - RNA, 16 nt, Mycobacterium avium subsp. paratuberculosis
ggccgccagcgcaccg

SEQ ID NO: 792023 - RNA, 17 nt, Mycobacterium avium subsp. paratuberculosis
ggccgcccacguagggg

SEQ ID NO: 792024 - RNA, 22 nt, Mycobacterium avium subsp. paratuberculosis
ggccgccauguacagaccccac

SEQ ID NO: 792025 - RNA, 15 nt, Mycobacterium avium subsp. paratuberculosis
ggccgccaucaccgc

SEQ ID NO: 792026 - RNA, 24 nt, Mycobacterium avium subsp. paratuberculosis
ggccgccaucgaucgggcgucgca

SEQ ID NO: 792027 - RNA, 14 nt, Mycobacterium avium subsp. paratuberculosis
ggccgccgccaccg

SEQ ID NO: 792028 - RNA, 20 nt, Mycobacterium avium subsp. paratuberculosis
ggccgccgcauaccgcccgc

SEQ ID NO: 792029 - RNA, 18 nt, Mycobacterium avium subsp. paratuberculosis
ggccgccgcccgcgcggc

SEQ ID NO: 792030 - RNA, 21 nt, Mycobacterium avium subsp. paratuberculosis
ggccgccgcccgcgcggcggc

SEQ ID NO: 792031 - RNA, 13 nt, Mycobacterium avium subsp. paratuberculosis
ggccgccgccgcg

SEQ ID NO: 792032 - RNA, 14 nt, Mycobacterium avium subsp. paratuberculosis
ggccgccgccgcgg

SEQ ID NO: 792033 - RNA, 17 nt, Mycobacterium avium subsp. paratuberculosis
ggccgccgccgcggccg

SEQ ID NO: 792034 - RNA, 18 nt, Mycobacterium avium subsp. paratuberculosis
ggccgccgccgcggccgc

SEQ ID NO: 792035 - RNA, 22 nt, Mycobacterium avium subsp. paratuberculosis
ggccgccgccgcggccgcggcg

SEQ ID NO: 792036 - RNA, 13 nt, Mycobacterium avium subsp. paratuberculosis
ggccgccgacgac

SEQ ID NO: 792037 - RNA, 16 nt, Mycobacterium avium subsp. paratuberculosis
ggccgccgacgacggc

SEQ ID NO: 792038 - RNA, 15 nt, Mycobacterium avium subsp. paratuberculosis
ggccgccgaucaaca

SEQ ID NO: 792039 - RNA, 14 nt, Mycobacterium avium subsp. paratuberculosis
ggccgccgacgucg

SEQ ID NO: 792040 - RNA, 22 nt, Mycobacterium avium subsp. paratuberculosis
ggccgccgacugugcgaugucg

SEQ ID NO: 792041 - RNA, 22 nt, Mycobacterium avium subsp. paratuberculosis
ggccgccgauucaaccccgcgc

SEQ ID NO: 792042 - RNA, 17 nt, Mycobacterium avium subsp. paratuberculosis
ggccgcccgcaccagca

SEQ ID NO: 792043 - RNA, 13 nt, Mycobacterium avium subsp. paratuberculosis
ggccgcccgcgcg

SEQ ID NO: 792044 - RNA, 22 nt, Mycobacterium avium subsp. paratuberculosis
ggccgcccgcuccugcaggccg

SEQ ID NO: 792045 - RNA, 18 nt, Mycobacterium avium subsp. paratuberculosis
ggccgcccgacccgucca

SEQ ID NO: 792046 - RNA, 21 nt, Mycobacterium avium subsp. paratuberculosis
ggccgcccgacccguccagca

SEQ ID NO: 792047 - RNA, 20 nt, Mycobacterium avium subsp. paratuberculosis
ggccgcccggcccaagaccc

SEQ ID NO: 792048 - RNA, 12 nt, Mycobacterium avium subsp. paratuberculosis
ggccgcccggcg

SEQ ID NO: 792049 - RNA, 22 nt, Mycobacterium avium subsp. paratuberculosis
ggccgcccggcgagcagcccgg

SEQ ID NO: 792050 - RNA, 14 nt, Mycobacterium avium subsp. paratuberculosis
ggccgcccggcgcg

SEQ ID NO: 792051 - RNA, 16 nt, Mycobacterium avium subsp. paratuberculosis
ggccgcccggcgcgcc

SEQ ID NO: 792052 - RNA, 20 nt, Mycobacterium avium subsp. paratuberculosis
ggccgcccggcgcgccgcag

SEQ ID NO: 792053 - RNA, 13 nt, Mycobacterium avium subsp. paratuberculosis
ggccgcccggucc

SEQ ID NO: 792054 - RNA, 23 nt, Mycobacterium avium subsp. paratuberculosis
ggccgcccgguccgggucgcuga

SEQ ID NO: 792055 - RNA, 15 nt, Mycobacterium avium subsp. paratuberculosis
ggccgcccguccggg

SEQ ID NO: 792056 - RNA, 23 nt, Mycobacterium avium subsp. paratuberculosis
ggccgcccguccgggccggccag

SEQ ID NO: 792057 - RNA, 14 nt, Mycobacterium avium subsp. paratuberculosis
ggccgcccgucggg

SEQ ID NO: 792058 - RNA, 15 nt, Mycobacterium avium subsp. paratuberculosis
ggccgccuggacgac

SEQ ID NO: 792059 - RNA, 19 nt, Mycobacterium avium subsp. paratuberculosis
ggccgccuggacgacgucg

SEQ ID NO: 792060 - RNA, 15 nt, Mycobacterium avium subsp. paratuberculosis
ggccgccuucacgac

SEQ ID NO: 792061 - RNA, 18 nt, Mycobacterium avium subsp. paratuberculosis
ggccgccuucacgaccgg

SEQ ID NO: 792062 - RNA, 16 nt, Mycobacterium avium subsp. paratuberculosis
ggccgccucgucgagc

SEQ ID NO: 792063 - RNA, 15 nt, Mycobacterium avium subsp. paratuberculosis
ggccgccugcccggg

SEQ ID NO: 792064 - RNA, 16 nt, Mycobacterium avium subsp. paratuberculosis
ggccgccugcccgggc

SEQ ID NO: 792065 - RNA, 19 nt, Mycobacterium avium subsp. paratuberculosis
ggccgccugcccgggcgcc

SEQ ID NO: 792066 - RNA, 21 nt, Mycobacterium avium subsp. paratuberculosis
ggccgccugcccgggcgccga

SEQ ID NO: 792067 - RNA, 22 nt, Mycobacterium avium subsp. paratuberculosis
ggccgccugcccgggcgccgag

SEQ ID NO: 792068 - RNA, 22 nt, Mycobacterium avium subsp. paratuberculosis
ggccgccucgaagucgccggcc

SEQ ID NO: 792069 - RNA, 13 nt, Mycobacterium avium subsp. paratuberculosis
ggccgccucacgc

SEQ ID NO: 792070 - RNA, 20 nt, Mycobacterium avium subsp. paratuberculosis
ggccgccucacgcagggcca

SEQ ID NO: 792071 - RNA, 17 nt, Mycobacterium avium subsp. paratuberculosis
ggccgccuccagcacgu

SEQ ID NO: 792072 - RNA, 20 nt, Mycobacterium avium subsp. paratuberculosis
ggccgccuccagcacgucgg

SEQ ID NO: 792073 - RNA, 23 nt, Mycobacterium avium subsp. paratuberculosis
ggccgccucccgcagcgccagcg

SEQ ID NO: 792074 - RNA, 13 nt, Mycobacterium avium subsp. paratuberculosis
ggccgccgugcug

SEQ ID NO: 792075 - RNA, 14 nt, Mycobacterium avium subsp. paratuberculosis
ggccgccgucgcca

SEQ ID NO: 792076 - RNA, 15 nt, Mycobacterium avium subsp. paratuberculosis
ggccgccgucgccac

SEQ ID NO: 792077 - RNA, 16 nt, Mycobacterium avium subsp. paratuberculosis
ggccgccgucgccacc

SEQ ID NO: 792078 - RNA, 23 nt, Mycobacterium avium subsp. paratuberculosis
ggccgccgucuucccagugccgc

SEQ ID NO: 792079 - RNA, 19 nt, Mycobacterium avium subsp. paratuberculosis
ggccgccggguggcggggc

SEQ ID NO: 792080 - RNA, 23 nt, Mycobacterium avium subsp. paratuberculosis
ggccgccggaaggucuuucgucg

SEQ ID NO: 792081 - RNA, 13 nt, Mycobacterium avium subsp. paratuberculosis
ggccgccggcggc

SEQ ID NO: 792082 - RNA, 20 nt, Mycobacterium avium subsp. paratuberculosis
ggccgccgggccggcggcca

SEQ ID NO: 792083 - RNA, 14 nt, Mycobacterium avium subsp. paratuberculosis
ggccgccggcaccg

SEQ ID NO: 792084 - RNA, 11 nt, Mycobacterium avium subsp. paratuberculosis
ggccgccggcc

SEQ ID NO: 792085 - RNA, 13 nt, Mycobacterium avium subsp. paratuberculosis
ggccgccggccag

SEQ ID NO: 792086 - RNA, 19 nt, Mycobacterium avium subsp. paratuberculosis
ggccgccgcuagucgccca

SEQ ID NO: 792087 - RNA, 21 nt, Mycobacterium avium subsp. paratuberculosis
ggccgccgcuagucgcccagc

SEQ ID NO: 792088 - RNA, 14 nt, Mycobacterium avium subsp. paratuberculosis
ggccgccgcggcgg

SEQ ID NO: 792089 - RNA, 16 nt, Mycobacterium avium subsp. paratuberculosis
ggccgccgcggcggca

SEQ ID NO: 792090 - RNA, 22 nt, Mycobacterium avium subsp. paratuberculosis
ggccgccgcggcggcaaguccg

SEQ ID NO: 792091 - RNA, 14 nt, Mycobacterium avium subsp. paratuberculosis
ggccgccgcgaccg

SEQ ID NO: 792092 - RNA, 13 nt, Mycobacterium avium subsp. paratuberculosis
ggccgccgcgacg

SEQ ID NO: 792093 - RNA, 19 nt, Mycobacterium avium subsp. paratuberculosis
ggccgccgcgacggccgcc

SEQ ID NO: 792094 - RNA, 18 nt, Mycobacterium avium subsp. paratuberculosis
ggccgccgccugagcccg

SEQ ID NO: 792095 - RNA, 18 nt, Mycobacterium avium subsp. paratuberculosis
ggccgccgcgcauccgca

SEQ ID NO: 792096 - RNA, 19 nt, Mycobacterium avium subsp. paratuberculosis
ggccgccgcgcauccgcac

SEQ ID NO: 792097 - RNA, 14 nt, Mycobacterium avium subsp. paratuberculosis
ggccgccgcgauac

SEQ ID NO: 792098 - RNA, 12 nt, Mycobacterium avium subsp. paratuberculosis
ggccgccgcgca

SEQ ID NO: 792099 - RNA, 15 nt, Mycobacterium avium subsp. paratuberculosis
ggccgcaacggcggu

SEQ ID NO: 792100 - RNA, 22 nt, Mycobacterium avium subsp. paratuberculosis
ggccgcaauacggugcccgccg

SEQ ID NO: 792101 - RNA, 17 nt, Mycobacterium avium subsp. paratuberculosis
ggccgcaaucggcgccg

SEQ ID NO: 792102 - RNA, 19 nt, Mycobacterium avium subsp. paratuberculosis
ggccgcaaucggcgccggc

SEQ ID NO: 792103 - RNA, 17 nt, Mycobacterium avium subsp. paratuberculosis
ggccgcacaccaccacg

SEQ ID NO: 792104 - RNA, 19 nt, Mycobacterium avium subsp. paratuberculosis
ggccgcacaccaccacgug

SEQ ID NO: 792105 - RNA, 16 nt, Mycobacterium avium subsp. paratuberculosis
ggccgcaccccacccg

SEQ ID NO: 792106 - RNA, 20 nt, Mycobacterium avium subsp. paratuberculosis
ggccgcaccccacccgcgcg

SEQ ID NO: 792107 - RNA, 22 nt, Mycobacterium avium subsp. paratuberculosis
ggccgcaccccacccgcgcgac

SEQ ID NO: 792108 - RNA, 15 nt, Mycobacterium avium subsp. paratuberculosis
ggccgcaccugaucg

SEQ ID NO: 792109 - RNA, 19 nt, Mycobacterium avium subsp. paratuberculosis
ggccgcaagcgaagccgug

SEQ ID NO: 792110 - RNA, 14 nt, Mycobacterium avium subsp. paratuberculosis
ggccgauucggcgc

SEQ ID NO: 792111 - RNA, 16 nt, Mycobacterium avium subsp. paratuberculosis
ggccgauucggcgccg

SEQ ID NO: 792112 - RNA, 17 nt, Mycobacterium avium subsp. paratuberculosis
ggccgauucggcgccgc

SEQ ID NO: 792113 - RNA, 19 nt, Mycobacterium avium subsp. paratuberculosis
ggccgauucggcgccgcga

SEQ ID NO: 792114 - RNA, 15 nt, Mycobacterium avium subsp. paratuberculosis
ggccgauggucagcu

SEQ ID NO: 792115 - RNA, 20 nt, Mycobacterium avium subsp. paratuberculosis
ggccgauggcccaggccgcg

SEQ ID NO: 792116 - RNA, 15 nt, Mycobacterium avium subsp. paratuberculosis
ggccgauggcgccca

SEQ ID NO: 792117 - RNA, 17 nt, Mycobacterium avium subsp. paratuberculosis
ggccgauggcgcccagc

SEQ ID NO: 792118 - RNA, 13 nt, Mycobacterium avium subsp. paratuberculosis
ggccgaugaccgc

SEQ ID NO: 792119 - RNA, 16 nt, Mycobacterium avium subsp. paratuberculosis
ggccgaugaccgcggc

SEQ ID NO: 792120 - RNA, 23 nt, Mycobacterium avium subsp. paratuberculosis
ggccgaugaccucgcacagcuug

SEQ ID NO: 792121 - RNA, 22 nt, Mycobacterium avium subsp. paratuberculosis
ggccgaugagccucagcgcgca

SEQ ID NO: 792122 - RNA, 20 nt, Mycobacterium avium subsp. paratuberculosis
ggccgaugaugaugccgccc

SEQ ID NO: 792123 - RNA, 22 nt, Mycobacterium avium subsp. paratuberculosis
ggccgaugaugaugccgcccau

SEQ ID NO: 792124 - RNA, 17 nt, Mycobacterium avium subsp. paratuberculosis
ggccgaucuugucgacc

SEQ ID NO: 792125 - RNA, 20 nt, Mycobacterium avium subsp. paratuberculosis
ggccgaucuugucgaccuug

SEQ ID NO: 792126 - RNA, 16 nt, Mycobacterium avium subsp. paratuberculosis
ggccgaucccggccac

SEQ ID NO: 792127 - RNA, 21 nt, Mycobacterium avium subsp. paratuberculosis
ggccgaucccggccacgucga

SEQ ID NO: 792128 - RNA, 16 nt, Mycobacterium avium subsp. paratuberculosis
ggccgacgcgccgucg

SEQ ID NO: 792129 - RNA, 21 nt, Mycobacterium avium subsp. paratuberculosis
ggccgacgcgccgucggccca

SEQ ID NO: 792130 - RNA, 13 nt, Mycobacterium avium subsp. paratuberculosis
ggccgacgccggc

SEQ ID NO: 792131 - RNA, 15 nt, Mycobacterium avium subsp. paratuberculosis
ggccgacgccggcca

SEQ ID NO: 792132 - RNA, 22 nt, Mycobacterium avium subsp. paratuberculosis
ggccgaucagcugcucggccac

SEQ ID NO: 792133 - RNA, 22 nt, Mycobacterium avium subsp. paratuberculosis
ggccgaucagguaguacaggug

SEQ ID NO: 792134 - RNA, 18 nt, Mycobacterium avium subsp. paratuberculosis
ggccgaucagugccgcgc

SEQ ID NO: 792135 - RNA, 20 nt, Mycobacterium avium subsp. paratuberculosis
ggccgaucagugccgcgcca

SEQ ID NO: 792136 - RNA, 14 nt, Mycobacterium avium subsp. paratuberculosis
ggccgaucaugguc

SEQ ID NO: 792137 - RNA, 18 nt, Mycobacterium avium subsp. paratuberculosis
ggccgaucauggucggcg

SEQ ID NO: 792138 - RNA, 21 nt, Mycobacterium avium subsp. paratuberculosis
ggccgaucauggucggcgacg

SEQ ID NO: 792139 - RNA, 16 nt, Mycobacterium avium subsp. paratuberculosis
ggccgacgcggccucg

SEQ ID NO: 792140 - RNA, 15 nt, Mycobacterium avium subsp. paratuberculosis
ggccgacgcuggccg

SEQ ID NO: 792141 - RNA, 23 nt, Mycobacterium avium subsp. paratuberculosis
ggccgacgaugaacagucggccg

SEQ ID NO: 792142 - RNA, 20 nt, Mycobacterium avium subsp. paratuberculosis
ggccgcacgcgaacaccaga

SEQ ID NO: 792143 - RNA, 17 nt, Mycobacterium avium subsp. paratuberculosis
ggccgcacggugcagca

SEQ ID NO: 792144 - RNA, 18 nt, Mycobacterium avium subsp. paratuberculosis
ggccgcacggugcagcag

SEQ ID NO: 792145 - RNA, 19 nt, Mycobacterium avium subsp. paratuberculosis
ggccgcacggugcagcagc

SEQ ID NO: 792146 - RNA, 18 nt, Mycobacterium avium subsp. paratuberculosis
ggccgcacguauccgcgg

SEQ ID NO: 792147 - RNA, 19 nt, Mycobacterium avium subsp. paratuberculosis
ggccgcacguauccgcggu

SEQ ID NO: 792148 - RNA, 17 nt, Mycobacterium avium subsp. paratuberculosis
ggccgcacgucccgccc

SEQ ID NO: 792149 - RNA, 20 nt, Mycobacterium avium subsp. paratuberculosis
ggccgcacugcaucucgacc

SEQ ID NO: 792150 - RNA, 13 nt, Mycobacterium avium subsp. paratuberculosis
ggccgcagcgacu

SEQ ID NO: 792151 - RNA, 12 nt, Mycobacterium avium subsp. paratuberculosis
ggccgcagcgca

SEQ ID NO: 792152 - RNA, 15 nt, Mycobacterium avium subsp. paratuberculosis
ggccgcagccgcgcg

SEQ ID NO: 792153 - RNA, 17 nt, Mycobacterium avium subsp. paratuberculosis
ggccgcagccgcgcggc

SEQ ID NO: 792154 - RNA, 21 nt, Mycobacterium avium subsp. paratuberculosis
ggccgcagccgcgcggccggc

SEQ ID NO: 792155 - RNA, 22 nt, Mycobacterium avium subsp. paratuberculosis
ggccgcagccgcgcggccggcc

SEQ ID NO: 792156 - RNA, 23 nt, Mycobacterium avium subsp. paratuberculosis
ggccgcagccgcgcggccggcca

SEQ ID NO: 792157 - RNA, 14 nt, Mycobacterium avium subsp. paratuberculosis
ggccgcagcaccac

SEQ ID NO: 792158 - RNA, 22 nt, Mycobacterium avium subsp. paratuberculosis
ggccgcagcaccaccucgugca

SEQ ID NO: 792159 - RNA, 13 nt, Mycobacterium avium subsp. paratuberculosis
ggccgcagcacgg

SEQ ID NO: 792160 - RNA, 19 nt, Mycobacterium avium subsp. paratuberculosis
ggccgcagcagcgaggccu

SEQ ID NO: 792161 - RNA, 22 nt, Mycobacterium avium subsp. paratuberculosis
ggccgcagcgggauuggcgcca

SEQ ID NO: 792162 - RNA, 13 nt, Mycobacterium avium subsp. paratuberculosis
ggccgcagcgugg

SEQ ID NO: 792163 - RNA, 21 nt, Mycobacterium avium subsp. paratuberculosis
ggccgcagcgugggcaccggc

SEQ ID NO: 792164 - RNA, 19 nt, Mycobacterium avium subsp. paratuberculosis
ggccgcagcucgcccagca

SEQ ID NO: 792165 - RNA, 14 nt, Mycobacterium avium subsp. paratuberculosis
ggccgcagcugcug

SEQ ID NO: 792166 - RNA, 12 nt, Mycobacterium avium subsp. paratuberculosis
ggccgcaggcgg

SEQ ID NO: 792167 - RNA, 17 nt, Mycobacterium avium subsp. paratuberculosis
ggccgcaggcggccagc

SEQ ID NO: 792168 - RNA, 18 nt, Mycobacterium avium subsp. paratuberculosis
ggccgcaggcggccagca

SEQ ID NO: 792169 - RNA, 15 nt, Mycobacterium avium subsp. paratuberculosis
ggccgcaggguggcc

SEQ ID NO: 792170 - RNA, 20 nt, Mycobacterium avium subsp. paratuberculosis
ggccgcaggguggccagcac

SEQ ID NO: 792171 - RNA, 22 nt, Mycobacterium avium subsp. paratuberculosis
ggccgcaggguggccagcaccg

SEQ ID NO: 792172 - RNA, 20 nt, Mycobacterium avium subsp. paratuberculosis
ggccgcagcgcaucgccggc

SEQ ID NO: 792173 - RNA, 22 nt, Mycobacterium avium subsp. paratuberculosis
ggccgcagcgcaucgccggcga

SEQ ID NO: 792174 - RNA, 18 nt, Mycobacterium avium subsp. paratuberculosis
ggccgcagcgcaucguug

SEQ ID NO: 792175 - RNA, 17 nt, Mycobacterium avium subsp. paratuberculosis
ggccgcagcgcccggca

SEQ ID NO: 792176 - RNA, 13 nt, Mycobacterium avium subsp. paratuberculosis
ggccgcagcgcga

SEQ ID NO: 792177 - RNA, 16 nt, Mycobacterium avium subsp. paratuberculosis
ggccgcagcgcgcggg

SEQ ID NO: 792178 - RNA, 17 nt, Mycobacterium avium subsp. paratuberculosis
ggccgcagcgcgcgggu

SEQ ID NO: 792179 - RNA, 16 nt, Mycobacterium avium subsp. paratuberculosis
ggccgcagcgcggcga

SEQ ID NO: 792180 - RNA, 23 nt, Mycobacterium avium subsp. paratuberculosis
ggccgccagcaguguccagucgg

SEQ ID NO: 792181 - RNA, 13 nt, Mycobacterium avium subsp. paratuberculosis
ggccgccagcagc

SEQ ID NO: 792182 - RNA, 14 nt, Mycobacterium avium subsp. paratuberculosis
ggccgccagcagca

SEQ ID NO: 792183 - RNA, 19 nt, Mycobacterium avium subsp. paratuberculosis
ggccgccagcaccucgcgg

SEQ ID NO: 792184 - RNA, 22 nt, Mycobacterium avium subsp. paratuberculosis
ggccgccagcaccucgcggcag

SEQ ID NO: 792185 - RNA, 14 nt, Mycobacterium avium subsp. paratuberculosis
ggccgccacggcgc

SEQ ID NO: 792186 - RNA, 14 nt, Mycobacterium avium subsp. paratuberculosis
ggccgccacgaugc

SEQ ID NO: 792187 - RNA, 12 nt, Mycobacterium avium subsp. paratuberculosis
ggccgccaccgc

SEQ ID NO: 792188 - RNA, 14 nt, Mycobacterium avium subsp. paratuberculosis
ggccgccaccgcca

SEQ ID NO: 792189 - RNA, 20 nt, Mycobacterium avium subsp. paratuberculosis
ggccgccaccaggcugaacg

SEQ ID NO: 792190 - RNA, 22 nt, Mycobacterium avium subsp. paratuberculosis
ggccgcaugucgaccucggcca

SEQ ID NO: 792191 - RNA, 22 nt, Mycobacterium avium subsp. paratuberculosis
ggccgccaccaacaucgacgug

SEQ ID NO: 792192 - RNA, 12 nt, Mycobacterium avium subsp. paratuberculosis
ggccgccaccag

SEQ ID NO: 792193 - RNA, 14 nt, Mycobacterium avium subsp. paratuberculosis
ggccgcauccagcg

SEQ ID NO: 792194 - RNA, 15 nt, Mycobacterium avium subsp. paratuberculosis
ggccgcauccagcgc

SEQ ID NO: 792195 - RNA, 17 nt, Mycobacterium avium subsp. paratuberculosis
ggccgcauccagcgccg

SEQ ID NO: 792196 - RNA, 20 nt, Mycobacterium avium subsp. paratuberculosis
ggccgcauccagcgccgcca

SEQ ID NO: 792197 - RNA, 14 nt, Mycobacterium avium subsp. paratuberculosis
ggccguagcgagcg

SEQ ID NO: 792198 - RNA, 23 nt, Mycobacterium avium subsp. paratuberculosis
ggccguagcggacgacggccagc

SEQ ID NO: 792199 - RNA, 16 nt, Mycobacterium avium subsp. paratuberculosis
ggccguagcggcucgc

SEQ ID NO: 792200 - RNA, 20 nt, Mycobacterium avium subsp. paratuberculosis
ggccguagcggcucgccacc

SEQ ID NO: 792201 - RNA, 18 nt, Mycobacterium avium subsp. paratuberculosis
ggccguagcguugccggc

SEQ ID NO: 792202 - RNA, 20 nt, Mycobacterium avium subsp. paratuberculosis
ggccguagcguugccggccg

SEQ ID NO: 792203 - RNA, 21 nt, Mycobacterium avium subsp. paratuberculosis
ggccguagcguugccggccga

SEQ ID NO: 792204 - RNA, 15 nt, Mycobacterium avium subsp. paratuberculosis
ggccgguuggcggcc

SEQ ID NO: 792205 - RNA, 15 nt, Mycobacterium avium subsp. paratuberculosis
ggccguaggucgggu

SEQ ID NO: 792206 - RNA, 19 nt, Mycobacterium avium subsp. paratuberculosis
ggccgucaucgccgacggu

SEQ ID NO: 792207 - RNA, 21 nt, Mycobacterium avium subsp. paratuberculosis
ggccgucaucgccgacgguga

SEQ ID NO: 792208 - RNA, 23 nt, Mycobacterium avium subsp. paratuberculosis
ggccgucaucgccgacggugagc

SEQ ID NO: 792209 - RNA, 22 nt, Mycobacterium avium subsp. paratuberculosis
ggccgucaucuccgacucgaug

SEQ ID NO: 792210 - RNA, 15 nt, Mycobacterium avium subsp. paratuberculosis
ggccguccaccacca

SEQ ID NO: 792211 - RNA, 13 nt, Mycobacterium avium subsp. paratuberculosis
ggccguccaccag

SEQ ID NO: 792212 - RNA, 23 nt, Mycobacterium avium subsp. paratuberculosis
ggccguccaccagaucgccccgc

SEQ ID NO: 792213 - RNA, 15 nt, Mycobacterium avium subsp. paratuberculosis
ggccguccacggcgg

SEQ ID NO: 792214 - RNA, 16 nt, Mycobacterium avium subsp. paratuberculosis
ggccguccacggcggu

SEQ ID NO: 792215 - RNA, 17 nt, Mycobacterium avium subsp. paratuberculosis
ggccguccagcgucugg

SEQ ID NO: 792216 - RNA, 22 nt, Mycobacterium avium subsp. paratuberculosis
ggccguccagcgucuggcagcc

SEQ ID NO: 792217 - RNA, 20 nt, Mycobacterium avium subsp. paratuberculosis
ggccgucacaggccgccugc

SEQ ID NO: 792218 - RNA, 17 nt, Mycobacterium avium subsp. paratuberculosis
ggccgucacgcuggcgu

SEQ ID NO: 792219 - RNA, 16 nt, Mycobacterium avium subsp. paratuberculosis
ggccguauacgccaga

SEQ ID NO: 792220 - RNA, 23 nt, Mycobacterium avium subsp. paratuberculosis
ggccguaucccaccacgaagucg

SEQ ID NO: 792221 - RNA, 23 nt, Mycobacterium avium subsp. paratuberculosis
ggccgucggccugcgcugcggcc

SEQ ID NO: 792222 - RNA, 14 nt, Mycobacterium avium subsp. paratuberculosis
ggccgucgcguucg

SEQ ID NO: 792223 - RNA, 11 nt, Mycobacterium avium subsp. paratuberculosis
ggccgucggcc

SEQ ID NO: 792224 - RNA, 14 nt, Mycobacterium avium subsp. paratuberculosis
ggccgucgcgcacc

SEQ ID NO: 792225 - RNA, 13 nt, Mycobacterium avium subsp. paratuberculosis
ggccgucgcggcg

SEQ ID NO: 792226 - RNA, 14 nt, Mycobacterium avium subsp. paratuberculosis
ggccgucgcggcgc

SEQ ID NO: 792227 - RNA, 15 nt, Mycobacterium avium subsp. paratuberculosis
ggccgucgcggcgcg

SEQ ID NO: 792228 - RNA, 21 nt, Mycobacterium avium subsp. paratuberculosis
ggccgucgcggcgcgggucgc

SEQ ID NO: 792229 - RNA, 12 nt, Mycobacterium avium subsp. paratuberculosis
ggccgucgcgca

SEQ ID NO: 792230 - RNA, 15 nt, Mycobacterium avium subsp. paratuberculosis
ggccgucgccgggcg

SEQ ID NO: 792231 - RNA, 23 nt, Mycobacterium avium subsp. paratuberculosis
ggccgucgccggucuccaugucg

SEQ ID NO: 792232 - RNA, 16 nt, Mycobacterium avium subsp. paratuberculosis
ggccgucgccucgccc

SEQ ID NO: 792233 - RNA, 13 nt, Mycobacterium avium subsp. paratuberculosis
ggccgucgaggcg

SEQ ID NO: 792234 - RNA, 17 nt, Mycobacterium avium subsp. paratuberculosis
ggccgucgaggcgcugc

SEQ ID NO: 792235 - RNA, 21 nt, Mycobacterium avium subsp. paratuberculosis
ggccgucgaggcgcugcagca

SEQ ID NO: 792236 - RNA, 23 nt, Mycobacterium avium subsp. paratuberculosis
ggccguccgggauaguucgccgc

SEQ ID NO: 792237 - RNA, 19 nt, Mycobacterium avium subsp. paratuberculosis
ggccgucgaacugcagccg

SEQ ID NO: 792238 - RNA, 23 nt, Mycobacterium avium subsp. paratuberculosis
ggccgucgaacugcagccggcca

SEQ ID NO: 792239 - RNA, 23 nt, Mycobacterium avium subsp. paratuberculosis
ggccgucaggagugcucggcguu

SEQ ID NO: 792240 - RNA, 17 nt, Mycobacterium avium subsp. paratuberculosis
ggccggugggcggcgcc

SEQ ID NO: 792241 - RNA, 14 nt, Mycobacterium avium subsp. paratuberculosis
ggccgggcuggcgc

SEQ ID NO: 792242 - RNA, 20 nt, Mycobacterium avium subsp. paratuberculosis
ggccgguugccuuuccgcgc

SEQ ID NO: 792243 - RNA, 21 nt, Mycobacterium avium subsp. paratuberculosis
ggccgguugccuuuccgcgcg

SEQ ID NO: 792244 - RNA, 22 nt, Mycobacterium avium subsp. paratuberculosis
ggccgguugccuuuccgcgcgg

SEQ ID NO: 792245 - RNA, 23 nt, Mycobacterium avium subsp. paratuberculosis
ggccgguugccuuuccgcgcggc

SEQ ID NO: 792246 - RNA, 13 nt, Mycobacterium avium subsp. paratuberculosis
ggccgguggcgac

SEQ ID NO: 792247 - RNA, 14 nt, Mycobacterium avium subsp. paratuberculosis
ggccggugcgccga

SEQ ID NO: 792248 - RNA, 18 nt, Mycobacterium avium subsp. paratuberculosis
ggccggugcgcgucagcc

SEQ ID NO: 792249 - RNA, 15 nt, Mycobacterium avium subsp. paratuberculosis
ggccggugcugucca

SEQ ID NO: 792250 - RNA, 19 nt, Mycobacterium avium subsp. paratuberculosis
ggccggugcuuggcguuga

SEQ ID NO: 792251 - RNA, 14 nt, Mycobacterium avium subsp. paratuberculosis
ggccggugauggug

SEQ ID NO: 792252 - RNA, 16 nt, Mycobacterium avium subsp. paratuberculosis
ggccgggcgcuggccg

SEQ ID NO: 792253 - RNA, 17 nt, Mycobacterium avium subsp. paratuberculosis
ggccgggcgcuggccgu

SEQ ID NO: 792254 - RNA, 18 nt, Mycobacterium avium subsp. paratuberculosis
ggccgggcgggcacccca

SEQ ID NO: 792255 - RNA, 13 nt, Mycobacterium avium subsp. paratuberculosis
ggccgggcuacca

SEQ ID NO: 792256 - RNA, 23 nt, Mycobacterium avium subsp. paratuberculosis
ggccgggcugcccaccaccaggg

SEQ ID NO: 792257 - RNA, 17 nt, Mycobacterium avium subsp. paratuberculosis
ggccgggccggcgguga

SEQ ID NO: 792258 - RNA, 15 nt, Mycobacterium avium subsp. paratuberculosis
ggccgggcagugcgc

SEQ ID NO: 792259 - RNA, 15 nt, Mycobacterium avium subsp. paratuberculosis
ggccgggcacgucga

SEQ ID NO: 792260 - RNA, 18 nt, Mycobacterium avium subsp. paratuberculosis
ggccgggcacgucgacgc

SEQ ID NO: 792261 - RNA, 23 nt, Mycobacterium avium subsp. paratuberculosis
ggccgggcacgucgacgcccugc

SEQ ID NO: 792262 - RNA, 20 nt, Mycobacterium avium subsp. paratuberculosis
ggccgggaucuggccgguga

SEQ ID NO: 792263 - RNA, 16 nt, Mycobacterium avium subsp. paratuberculosis
ggccgggaugccgccg

SEQ ID NO: 792264 - RNA, 18 nt, Mycobacterium avium subsp. paratuberculosis
ggccgggaugccgccggu

SEQ ID NO: 792265 - RNA, 23 nt, Mycobacterium avium subsp. paratuberculosis
ggccggcgggggcgcguccgcgg

SEQ ID NO: 792266 - RNA, 20 nt, Mycobacterium avium subsp. paratuberculosis
ggccggcgguggugccgccg

SEQ ID NO: 792267 - RNA, 12 nt, Mycobacterium avium subsp. paratuberculosis
ggccggcggugu

SEQ ID NO: 792268 - RNA, 13 nt, Mycobacterium avium subsp. paratuberculosis
ggccggcgguguc

SEQ ID NO: 792269 - RNA, 14 nt, Mycobacterium avium subsp. paratuberculosis
ggccggcggugucg

SEQ ID NO: 792270 - RNA, 15 nt, Mycobacterium avium subsp. paratuberculosis
ggccggcggugucgu

SEQ ID NO: 792271 - RNA, 19 nt, Mycobacterium avium subsp. paratuberculosis
ggccggcggugucguaguu

SEQ ID NO: 792272 - RNA, 14 nt, Mycobacterium avium subsp. paratuberculosis
ggccggcggcgucg

SEQ ID NO: 792273 - RNA, 22 nt, Mycobacterium avium subsp. paratuberculosis
ggccggcggcgucgugaccgac

SEQ ID NO: 792274 - RNA, 15 nt, Mycobacterium avium subsp. paratuberculosis
ggccggcggcggcca

SEQ ID NO: 792275 - RNA, 18 nt, Mycobacterium avium subsp. paratuberculosis
ggccggcggcggccagcg

SEQ ID NO: 792276 - RNA, 13 nt, Mycobacterium avium subsp. paratuberculosis
ggccggcggcggu

SEQ ID NO: 792277 - RNA, 15 nt, Mycobacterium avium subsp. paratuberculosis
ggccggcggcagugc

SEQ ID NO: 792278 - RNA, 15 nt, Mycobacterium avium subsp. paratuberculosis
ggccggcgcuggcgu

SEQ ID NO: 792279 - RNA, 11 nt, Mycobacterium avium subsp. paratuberculosis
ggccggcggac

SEQ ID NO: 792280 - RNA, 18 nt, Mycobacterium avium subsp. paratuberculosis
ggccggcggacgcggcca

SEQ ID NO: 792281 - RNA, 22 nt, Mycobacterium avium subsp. paratuberculosis
ggccggcgcggcggcgacgucg

SEQ ID NO: 792282 - RNA, 14 nt, Mycobacterium avium subsp. paratuberculosis
ggccggcgcggugc

SEQ ID NO: 792283 - RNA, 15 nt, Mycobacterium avium subsp. paratuberculosis
ggccgcuuuccaccc

SEQ ID NO: 792284 - RNA, 19 nt, Mycobacterium avium subsp. paratuberculosis
ggccgcuuuccaccccggc

SEQ ID NO: 792285 - RNA, 24 nt, Mycobacterium avium subsp. paratuberculosis
ggccgcuuuccaccccggcggucg

SEQ ID NO: 792286 - RNA, 19 nt, Mycobacterium avium subsp. paratuberculosis
ggccggaacagcugguccc

SEQ ID NO: 792287 - RNA, 16 nt, Mycobacterium avium subsp. paratuberculosis
ggccggacagaucgcc

SEQ ID NO: 792288 - RNA, 18 nt, Mycobacterium avium subsp. paratuberculosis
ggccggacagaucgccca

SEQ ID NO: 792289 - RNA, 13 nt, Mycobacterium avium subsp. paratuberculosis
ggccggacagcgg

SEQ ID NO: 792290 - RNA, 17 nt, Mycobacterium avium subsp. paratuberculosis
ggccggaccacccaggu

SEQ ID NO: 792291 - RNA, 13 nt, Mycobacterium avium subsp. paratuberculosis
ggccggaucagca

SEQ ID NO: 792292 - RNA, 22 nt, Mycobacterium avium subsp. paratuberculosis
ggccggaucagcagugccccgu

SEQ ID NO: 792293 - RNA, 14 nt, Mycobacterium avium subsp. paratuberculosis
ggccggaucccggu

SEQ ID NO: 792294 - RNA, 17 nt, Mycobacterium avium subsp. paratuberculosis
ggccggcaacgacccgu

SEQ ID NO: 792295 - RNA, 19 nt, Mycobacterium avium subsp. paratuberculosis
ggccggcaacgacccgucg

SEQ ID NO: 792296 - RNA, 18 nt, Mycobacterium avium subsp. paratuberculosis
ggccggaacgcccgaucu

SEQ ID NO: 792297 - RNA, 22 nt, Mycobacterium avium subsp. paratuberculosis
ggccggaucgaaaaggucgaac

SEQ ID NO: 792298 - RNA, 22 nt, Mycobacterium avium subsp. paratuberculosis
ggccggaucgaacuugaucacc

SEQ ID NO: 792299 - RNA, 22 nt, Mycobacterium avium subsp. paratuberculosis
ggccggaucgaauccggcggcg

SEQ ID NO: 792300 - RNA, 14 nt, Mycobacterium avium subsp. paratuberculosis
ggccggaucgcgca

SEQ ID NO: 792301 - RNA, 17 nt, Mycobacterium avium subsp. paratuberculosis
ggccggaaggucauagg

SEQ ID NO: 792302 - RNA, 22 nt, Mycobacterium avium subsp. paratuberculosis
ggccggccacgcucggcggcgc

SEQ ID NO: 792303 - RNA, 13 nt, Mycobacterium avium subsp. paratuberculosis
ggccggccagcac

SEQ ID NO: 792304 - RNA, 14 nt, Mycobacterium avium subsp. paratuberculosis
ggccggccagcagc

SEQ ID NO: 792305 - RNA, 21 nt, Mycobacterium avium subsp. paratuberculosis
ggccggccagcgcgcggccca

SEQ ID NO: 792306 - RNA, 14 nt, Mycobacterium avium subsp. paratuberculosis
ggccggccagcggg

SEQ ID NO: 792307 - RNA, 21 nt, Mycobacterium avium subsp. paratuberculosis
ggccggccagcgggucgugca

SEQ ID NO: 792308 - RNA, 13 nt, Mycobacterium avium subsp. paratuberculosis
ggccggccaccag

SEQ ID NO: 792309 - RNA, 15 nt, Mycobacterium avium subsp. paratuberculosis
ggccggccaccagcg

SEQ ID NO: 792310 - RNA, 16 nt, Mycobacterium avium subsp. paratuberculosis
ggccggccaccagcgg

SEQ ID NO: 792311 - RNA, 23 nt, Mycobacterium avium subsp. paratuberculosis
ggccggccaccagcggccggaac

SEQ ID NO: 792312 - RNA, 16 nt, Mycobacterium avium subsp. paratuberculosis
ggccggaaaggcguga

SEQ ID NO: 792313 - RNA, 16 nt, Mycobacterium avium subsp. paratuberculosis
ggccggcaggccgccc

SEQ ID NO: 792314 - RNA, 21 nt, Mycobacterium avium subsp. paratuberculosis
ggccggcagcggugccgcccg

SEQ ID NO: 792315 - RNA, 16 nt, Mycobacterium avium subsp. paratuberculosis
ggccggcagccggcca

SEQ ID NO: 792316 - RNA, 17 nt, Mycobacterium avium subsp. paratuberculosis
ggccggcagccggccac

SEQ ID NO: 792317 - RNA, 15 nt, Mycobacterium avium subsp. paratuberculosis
ggccggcagccggcg

SEQ ID NO: 792318 - RNA, 16 nt, Mycobacterium avium subsp. paratuberculosis
ggccggcagccggcgc

SEQ ID NO: 792319 - RNA, 21 nt, Mycobacterium avium subsp. paratuberculosis
ggccggcagccggcgcgguga

SEQ ID NO: 792320 - RNA, 23 nt, Mycobacterium avium subsp. paratuberculosis
ggccggcagccggcgcggugauu

SEQ ID NO: 792321 - RNA, 24 nt, Mycobacterium avium subsp. paratuberculosis
ggccggcagccggcgcggugauuc

SEQ ID NO: 792322 - RNA, 24 nt, Mycobacterium avium subsp. paratuberculosis
ggccggcacuaccgccucgccagc

SEQ ID NO: 792323 - RNA, 17 nt, Mycobacterium avium subsp. paratuberculosis
ggccggcacucgccucg

SEQ ID NO: 792324 - RNA, 14 nt, Mycobacterium avium subsp. paratuberculosis
ggccggcaccucga

SEQ ID NO: 792325 - RNA, 13 nt, Mycobacterium avium subsp. paratuberculosis
ggccggcacgaug

SEQ ID NO: 792326 - RNA, 22 nt, Mycobacterium avium subsp. paratuberculosis
ggccggcacgauggcgcggcgc

SEQ ID NO: 792327 - RNA, 21 nt, Mycobacterium avium subsp. paratuberculosis
ggccgcuggcguugagcacgc

SEQ ID NO: 792328 - RNA, 12 nt, Mycobacterium avium subsp. paratuberculosis
ggccgcuggccg

SEQ ID NO: 792329 - RNA, 21 nt, Mycobacterium avium subsp. paratuberculosis
ggccgcgcagcgugucggggu

SEQ ID NO: 792330 - RNA, 12 nt, Mycobacterium avium subsp. paratuberculosis
ggccgcgcagcu

SEQ ID NO: 792331 - RNA, 19 nt, Mycobacterium avium subsp. paratuberculosis
ggccgcgcagcucgacgac

SEQ ID NO: 792332 - RNA, 21 nt, Mycobacterium avium subsp. paratuberculosis
ggccgcgcagcucgacgaccu

SEQ ID NO: 792333 - RNA, 15 nt, Mycobacterium avium subsp. paratuberculosis
ggccgcgcagcucgg

SEQ ID NO: 792334 - RNA, 18 nt, Mycobacterium avium subsp. paratuberculosis
ggccgcgcagcucggggu

SEQ ID NO: 792335 - RNA, 17 nt, Mycobacterium avium subsp. paratuberculosis
ggccgcugcgcccagcg

SEQ ID NO: 792336 - RNA, 19 nt, Mycobacterium avium subsp. paratuberculosis
ggccgcugcgcccagcgcg

SEQ ID NO: 792337 - RNA, 19 nt, Mycobacterium avium subsp. paratuberculosis
ggccgcucgggugucgccg

SEQ ID NO: 792338 - RNA, 20 nt, Mycobacterium avium subsp. paratuberculosis
ggccgcucgggugucgccga

SEQ ID NO: 792339 - RNA, 23 nt, Mycobacterium avium subsp. paratuberculosis
ggccgcucgggugucgccgagcc

SEQ ID NO: 792340 - RNA, 24 nt, Mycobacterium avium subsp. paratuberculosis
ggccgcucgggugucgccgagccg

SEQ ID NO: 792341 - RNA, 21 nt, Mycobacterium avium subsp. paratuberculosis
ggccgcugaggaugguggugc

SEQ ID NO: 792342 - RNA, 13 nt, Mycobacterium avium subsp. paratuberculosis
ggccgcugcccgg

SEQ ID NO: 792343 - RNA, 14 nt, Mycobacterium avium subsp. paratuberculosis
ggccgcugcccggc

SEQ ID NO: 792344 - RNA, 18 nt, Mycobacterium avium subsp. paratuberculosis
ggccgcuucccacccggu

SEQ ID NO: 792345 - RNA, 21 nt, Mycobacterium avium subsp. paratuberculosis
ggccgcuggugaggucgcgca

SEQ ID NO: 792346 - RNA, 14 nt, Mycobacterium avium subsp. paratuberculosis
ggccgcugguggug

SEQ ID NO: 792347 - RNA, 15 nt, Mycobacterium avium subsp. paratuberculosis
ggccgcuggugguga

SEQ ID NO: 792348 - RNA, 17 nt, Mycobacterium avium subsp. paratuberculosis
ggccgcugguggugauc

SEQ ID NO: 792349 - RNA, 20 nt, Mycobacterium avium subsp. paratuberculosis
ggccgcugguggugaucacc

SEQ ID NO: 792350 - RNA, 18 nt, Mycobacterium avium subsp. paratuberculosis
ggccgcgcaccgccccgc

SEQ ID NO: 792351 - RNA, 11 nt, Mycobacterium avium subsp. paratuberculosis
ggccgcgcagc

SEQ ID NO: 792352 - RNA, 17 nt, Mycobacterium avium subsp. paratuberculosis
ggccgcgaugucggugg

SEQ ID NO: 792353 - RNA, 21 nt, Mycobacterium avium subsp. paratuberculosis
ggccgcgagcacgacgucgac

SEQ ID NO: 792354 - RNA, 13 nt, Mycobacterium avium subsp. paratuberculosis
ggccgcgaugucg

SEQ ID NO: 792355 - RNA, 15 nt, Mycobacterium avium subsp. paratuberculosis
ggccgcgaucgccaa

SEQ ID NO: 792356 - RNA, 21 nt, Mycobacterium avium subsp. paratuberculosis
ggccgcgaucgccaacgcgcu

SEQ ID NO: 792357 - RNA, 19 nt, Mycobacterium avium subsp. paratuberculosis
ggccgcgagcgcuaccgcg

SEQ ID NO: 792358 - RNA, 21 nt, Mycobacterium avium subsp. paratuberculosis
ggccgcgagcgcuaccgcgcu

SEQ ID NO: 792359 - RNA, 19 nt, Mycobacterium avium subsp. paratuberculosis
ggccgcgagcccggcgacg

SEQ ID NO: 792360 - RNA, 15 nt, Mycobacterium avium subsp. paratuberculosis
ggccgcgacgccgcc

SEQ ID NO: 792361 - RNA, 16 nt, Mycobacterium avium subsp. paratuberculosis
ggccgcgacgccgccg

SEQ ID NO: 792362 - RNA, 17 nt, Mycobacterium avium subsp. paratuberculosis
ggccgcgacgccgccgc

SEQ ID NO: 792363 - RNA, 20 nt, Mycobacterium avium subsp. paratuberculosis
ggccgcgacgccgccgccga

SEQ ID NO: 792364 - RNA, 16 nt, Mycobacterium avium subsp. paratuberculosis
ggccgcgacgcgcggu

SEQ ID NO: 792365 - RNA, 16 nt, Mycobacterium avium subsp. paratuberculosis
ggccgccuuggugauc

SEQ ID NO: 792366 - RNA, 22 nt, Mycobacterium avium subsp. paratuberculosis
ggccgcgaaaauaccgccggcc

SEQ ID NO: 792367 - RNA, 23 nt, Mycobacterium avium subsp. paratuberculosis
ggccgcgaaaauaccgccggccg

SEQ ID NO: 792368 - RNA, 13 nt, Mycobacterium avium subsp. paratuberculosis
ggccgcgacagcc

SEQ ID NO: 792369 - RNA, 15 nt, Mycobacterium avium subsp. paratuberculosis
ggccgcgacagccgg

SEQ ID NO: 792370 - RNA, 16 nt, Mycobacterium avium subsp. paratuberculosis
ggccgcgaacggcccg

SEQ ID NO: 792371 - RNA, 16 nt, Mycobacterium avium subsp. paratuberculosis
ggccgcgaagaugucg

SEQ ID NO: 792372 - RNA, 16 nt, Mycobacterium avium subsp. paratuberculosis
ggcgaacuugcuggcc

SEQ ID NO: 792373 - RNA, 18 nt, Mycobacterium avium subsp. paratuberculosis
ggcgaacuccagaucgcc

SEQ ID NO: 792374 - RNA, 23 nt, Mycobacterium avium subsp. paratuberculosis
ggcgaacuccagaucgccgccca

SEQ ID NO: 792375 - RNA, 14 nt, Mycobacterium avium subsp. paratuberculosis
ggcgaacgucgaug

SEQ ID NO: 792376 - RNA, 15 nt, Mycobacterium avium subsp. paratuberculosis
ggcgaacggccgcga

SEQ ID NO: 792377 - RNA, 13 nt, Mycobacterium avium subsp. paratuberculosis
ggcgaacucgacg

SEQ ID NO: 792378 - RNA, 18 nt, Mycobacterium avium subsp. paratuberculosis
ggcgaacugcaccagcac

SEQ ID NO: 792379 - RNA, 22 nt, Mycobacterium avium subsp. paratuberculosis
ggcgaagccggccccgcccggg

SEQ ID NO: 792380 - RNA, 13 nt, Mycobacterium avium subsp. paratuberculosis
ggcgaagccggcg

SEQ ID NO: 792381 - RNA, 22 nt, Mycobacterium avium subsp. paratuberculosis
ggcgaagcacgaccacacccgc

SEQ ID NO: 792382 - RNA, 12 nt, Mycobacterium avium subsp. paratuberculosis
ggcgaagccggc

SEQ ID NO: 792383 - RNA, 17 nt, Mycobacterium avium subsp. paratuberculosis
ggcgaaguuggucacca

SEQ ID NO: 792384 - RNA, 19 nt, Mycobacterium avium subsp. paratuberculosis
ggcgaaguuggucaccacc

SEQ ID NO: 792385 - RNA, 21 nt, Mycobacterium avium subsp. paratuberculosis
ggcgaauaaggggguagaugu

SEQ ID NO: 792386 - RNA, 13 nt, Mycobacterium avium subsp. paratuberculosis
ggcgaauccgggc

SEQ ID NO: 792387 - RNA, 14 nt, Mycobacterium avium subsp. paratuberculosis
ggcgaauccgggcc

SEQ ID NO: 792388 - RNA, 16 nt, Mycobacterium avium subsp. paratuberculosis
ggcgaaucugucgaug

SEQ ID NO: 792389 - RNA, 17 nt, Mycobacterium avium subsp. paratuberculosis
ggcgaaucugucgaugg

SEQ ID NO: 792390 - RNA, 17 nt, Mycobacterium avium subsp. paratuberculosis
ggcgaauccgagcaucg

SEQ ID NO: 792391 - RNA, 19 nt, Mycobacterium avium subsp. paratuberculosis
ggcgaauccgagcaucggg

SEQ ID NO: 792392 - RNA, 17 nt, Mycobacterium avium subsp. paratuberculosis
ggcgaauauuucgccga

SEQ ID NO: 792393 - RNA, 18 nt, Mycobacterium avium subsp. paratuberculosis
ggcgaauauuucgccgau

SEQ ID NO: 792394 - RNA, 12 nt, Mycobacterium avium subsp. paratuberculosis
ggcgaaguucgg

SEQ ID NO: 792395 - RNA, 15 nt, Mycobacterium avium subsp. paratuberculosis
ggcgaaguucggcau

SEQ ID NO: 792396 - RNA, 19 nt, Mycobacterium avium subsp. paratuberculosis
ggcgaaguugaucgguucg

SEQ ID NO: 792397 - RNA, 17 nt, Mycobacterium avium subsp. paratuberculosis
ggcgaagucgccggcca

SEQ ID NO: 792398 - RNA, 14 nt, Mycobacterium avium subsp. paratuberculosis
ggcgaaggucagau

SEQ ID NO: 792399 - RNA, 15 nt, Mycobacterium avium subsp. paratuberculosis
ggccuggucggccgg

SEQ ID NO: 792400 - RNA, 15 nt, Mycobacterium avium subsp. paratuberculosis
ggccuugucgugucg

SEQ ID NO: 792401 - RNA, 17 nt, Mycobacterium avium subsp. paratuberculosis
ggccuuguugcggcgca

SEQ ID NO: 792402 - RNA, 22 nt, Mycobacterium avium subsp. paratuberculosis
ggccuuguugcggcgcaccccg

SEQ ID NO: 792403 - RNA, 16 nt, Mycobacterium avium subsp. paratuberculosis
ggccuguccggucuuc

SEQ ID NO: 792404 - RNA, 24 nt, Mycobacterium avium subsp. paratuberculosis
ggccuggucgaacagcacgccggc

SEQ ID NO: 792405 - RNA, 14 nt, Mycobacterium avium subsp. paratuberculosis
ggcgaacgaccggg

SEQ ID NO: 792406 - RNA, 14 nt, Mycobacterium avium subsp. paratuberculosis
ggcgaacgacgucg

SEQ ID NO: 792407 - RNA, 15 nt, Mycobacterium avium subsp. paratuberculosis
ggcgaaccguucguc

SEQ ID NO: 792408 - RNA, 18 nt, Mycobacterium avium subsp. paratuberculosis
ggcgaaccguucgucguc

SEQ ID NO: 792409 - RNA, 22 nt, Mycobacterium avium subsp. paratuberculosis
ggcgaaccguucgucgucgcgc

SEQ ID NO: 792410 - RNA, 16 nt, Mycobacterium avium subsp. paratuberculosis
ggcgaacgcccggucg

SEQ ID NO: 792411 - RNA, 20 nt, Mycobacterium avium subsp. paratuberculosis
ggcgaacgcccggucgauga

SEQ ID NO: 792412 - RNA, 13 nt, Mycobacterium avium subsp. paratuberculosis
ggcgaacgcgacc

SEQ ID NO: 792413 - RNA, 23 nt, Mycobacterium avium subsp. paratuberculosis
ggcgaaccgcggcggcagcagcc

SEQ ID NO: 792414 - RNA, 16 nt, Mycobacterium avium subsp. paratuberculosis
ggcgaacccggcgccc

SEQ ID NO: 792415 - RNA, 19 nt, Mycobacterium avium subsp. paratuberculosis
ggcgaacccggcgcccggc

SEQ ID NO: 792416 - RNA, 17 nt, Mycobacterium avium subsp. paratuberculosis
ggcgaaccagggcagcc

SEQ ID NO: 792417 - RNA, 13 nt, Mycobacterium avium subsp. paratuberculosis
ggcgaacccgagc

SEQ ID NO: 792418 - RNA, 19 nt, Mycobacterium avium subsp. paratuberculosis
ggcgaacccgagcaccccg

SEQ ID NO: 792419 - RNA, 22 nt, Mycobacterium avium subsp. paratuberculosis
ggcgaacccgagcaccccggcg

SEQ ID NO: 792420 - RNA, 19 nt, Mycobacterium avium subsp. paratuberculosis
ggcgaaaacgccugcgccg

SEQ ID NO: 792421 - RNA, 17 nt, Mycobacterium avium subsp. paratuberculosis
ggcgaaauaacccaccc

SEQ ID NO: 792422 - RNA, 21 nt, Mycobacterium avium subsp. paratuberculosis
ggcgaaauaacccaccccgau

SEQ ID NO: 792423 - RNA, 20 nt, Mycobacterium avium subsp. paratuberculosis
ggcgaacaucuuggucagcc

SEQ ID NO: 792424 - RNA, 16 nt, Mycobacterium avium subsp. paratuberculosis
ggcgaacauggucgcc

SEQ ID NO: 792425 - RNA, 19 nt, Mycobacterium avium subsp. paratuberculosis
ggcgaacauggucgcccac

SEQ ID NO: 792426 - RNA, 18 nt, Mycobacterium avium subsp. paratuberculosis
ggcgaaccacgggucgcu

SEQ ID NO: 792427 - RNA, 20 nt, Mycobacterium avium subsp. paratuberculosis
ggcgaaccagcaugcgccag

SEQ ID NO: 792428 - RNA, 22 nt, Mycobacterium avium subsp. paratuberculosis
ggccugguacagcaccgccgcg

SEQ ID NO: 792429 - RNA, 20 nt, Mycobacterium avium subsp. paratuberculosis
ggccugguagcugagcagca

SEQ ID NO: 792430 - RNA, 17 nt, Mycobacterium avium subsp. paratuberculosis
ggccugcgggcgccggc

SEQ ID NO: 792431 - RNA, 17 nt, Mycobacterium avium subsp. paratuberculosis
ggccugcggcggccgca

SEQ ID NO: 792432 - RNA, 16 nt, Mycobacterium avium subsp. paratuberculosis
ggccugcgggacgccg

SEQ ID NO: 792433 - RNA, 20 nt, Mycobacterium avium subsp. paratuberculosis
ggccugcgggacgccguuga

SEQ ID NO: 792434 - RNA, 14 nt, Mycobacterium avium subsp. paratuberculosis
ggccugcgcggccg

SEQ ID NO: 792435 - RNA, 15 nt, Mycobacterium avium subsp. paratuberculosis
ggccugcgcggccgc

SEQ ID NO: 792436 - RNA, 16 nt, Mycobacterium avium subsp. paratuberculosis
ggccugcgcggccgcg

SEQ ID NO: 792437 - RNA, 18 nt, Mycobacterium avium subsp. paratuberculosis
ggccugcccggcggugcc

SEQ ID NO: 792438 - RNA, 19 nt, Mycobacterium avium subsp. paratuberculosis
ggccugcgacuucuacggc

SEQ ID NO: 792439 - RNA, 22 nt, Mycobacterium avium subsp. paratuberculosis
ggccugcgacuucuacggcggg

SEQ ID NO: 792440 - RNA, 13 nt, Mycobacterium avium subsp. paratuberculosis
ggccugccggccg

SEQ ID NO: 792441 - RNA, 14 nt, Mycobacterium avium subsp. paratuberculosis
ggccugccggccgc

SEQ ID NO: 792442 - RNA, 16 nt, Mycobacterium avium subsp. paratuberculosis
ggccugccggccgccg

SEQ ID NO: 792443 - RNA, 18 nt, Mycobacterium avium subsp. paratuberculosis
ggccugccggccgccgcg

SEQ ID NO: 792444 - RNA, 15 nt, Mycobacterium avium subsp. paratuberculosis
ggccugcccgccgcg

SEQ ID NO: 792445 - RNA, 16 nt, Mycobacterium avium subsp. paratuberculosis
ggccugcccgccgcgg

SEQ ID NO: 792446 - RNA, 21 nt, Mycobacterium avium subsp. paratuberculosis
ggccugcccgccgcggccgcu

SEQ ID NO: 792447 - RNA, 14 nt, Mycobacterium avium subsp. paratuberculosis
ggccugccaccgcg

SEQ ID NO: 792448 - RNA, 15 nt, Mycobacterium avium subsp. paratuberculosis
ggccugccaccgcga

SEQ ID NO: 792449 - RNA, 14 nt, Mycobacterium avium subsp. paratuberculosis
ggccugcagcgcgg

SEQ ID NO: 792450 - RNA, 17 nt, Mycobacterium avium subsp. paratuberculosis
ggccugcagcgcgguca

SEQ ID NO: 792451 - RNA, 14 nt, Mycobacterium avium subsp. paratuberculosis
ggccugcacccagg

SEQ ID NO: 792452 - RNA, 20 nt, Mycobacterium avium subsp. paratuberculosis
ggccugcacggugcgccggc

SEQ ID NO: 792453 - RNA, 14 nt, Mycobacterium avium subsp. paratuberculosis
ggccugcacgucgg

SEQ ID NO: 792454 - RNA, 19 nt, Mycobacterium avium subsp. paratuberculosis
ggccugcacgucggcgcgc

SEQ ID NO: 792455 - RNA, 20 nt, Mycobacterium avium subsp. paratuberculosis
ggccugcacgucggcgcgca

SEQ ID NO: 792456 - RNA, 19 nt, Mycobacterium avium subsp. paratuberculosis
ggccucgguggcgguggcc

SEQ ID NO: 792457 - RNA, 22 nt, Mycobacterium avium subsp. paratuberculosis
ggccucgguggcgguggccacg

SEQ ID NO: 792458 - RNA, 22 nt, Mycobacterium avium subsp. paratuberculosis
ggccucguggaaaucgagcgcg

SEQ ID NO: 792459 - RNA, 23 nt, Mycobacterium avium subsp. paratuberculosis
ggccucguugaccgggucgccga

SEQ ID NO: 792460 - RNA, 13 nt, Mycobacterium avium subsp. paratuberculosis
ggccugcaccacc

SEQ ID NO: 792461 - RNA, 16 nt, Mycobacterium avium subsp. paratuberculosis
ggccugcaccaccaca

SEQ ID NO: 792462 - RNA, 22 nt, Mycobacterium avium subsp. paratuberculosis
ggccugcaccaccacacccagc

SEQ ID NO: 792463 - RNA, 13 nt, Mycobacterium avium subsp. paratuberculosis
ggccucgucgacg

SEQ ID NO: 792464 - RNA, 15 nt, Mycobacterium avium subsp. paratuberculosis
ggccucgucgauguc

SEQ ID NO: 792465 - RNA, 14 nt, Mycobacterium avium subsp. paratuberculosis
ggccucgucgcgga

SEQ ID NO: 792466 - RNA, 14 nt, Mycobacterium avium subsp. paratuberculosis
ggccucgucggcga

SEQ ID NO: 792467 - RNA, 15 nt, Mycobacterium avium subsp. paratuberculosis
ggccucgucggcgag

SEQ ID NO: 792468 - RNA, 16 nt, Mycobacterium avium subsp. paratuberculosis
ggccucgucggcgagc

SEQ ID NO: 792469 - RNA, 17 nt, Mycobacterium avium subsp. paratuberculosis
ggccucgucggcgagca

SEQ ID NO: 792470 - RNA, 15 nt, Mycobacterium avium subsp. paratuberculosis
ggccucggcgaccgc

SEQ ID NO: 792471 - RNA, 16 nt, Mycobacterium avium subsp. paratuberculosis
ggccucggcgaccgcc

SEQ ID NO: 792472 - RNA, 13 nt, Mycobacterium avium subsp. paratuberculosis
ggccucggcgaug

SEQ ID NO: 792473 - RNA, 14 nt, Mycobacterium avium subsp. paratuberculosis
ggccucggcggccg

SEQ ID NO: 792474 - RNA, 16 nt, Mycobacterium avium subsp. paratuberculosis
ggccucggcgguggcc

SEQ ID NO: 792475 - RNA, 19 nt, Mycobacterium avium subsp. paratuberculosis
ggccucggcgguggccucg

SEQ ID NO: 792476 - RNA, 16 nt, Mycobacterium avium subsp. paratuberculosis
ggccucggcguccgcg

SEQ ID NO: 792477 - RNA, 21 nt, Mycobacterium avium subsp. paratuberculosis
ggccucggcguccgcggcgga

SEQ ID NO: 792478 - RNA, 14 nt, Mycobacterium avium subsp. paratuberculosis
ggccucggcgucga

SEQ ID NO: 792479 - RNA, 18 nt, Mycobacterium avium subsp. paratuberculosis
ggccucgggcgacgacgc

SEQ ID NO: 792480 - RNA, 19 nt, Mycobacterium avium subsp. paratuberculosis
ggccucgccggcgccgggc

SEQ ID NO: 792481 - RNA, 18 nt, Mycobacterium avium subsp. paratuberculosis
ggccucgcgcaaugccgc

SEQ ID NO: 792482 - RNA, 20 nt, Mycobacterium avium subsp. paratuberculosis
ggccucgcgcaaugccgccg

SEQ ID NO: 792483 - RNA, 16 nt, Mycobacterium avium subsp. paratuberculosis
ggccucgccgucgcga

SEQ ID NO: 792484 - RNA, 23 nt, Mycobacterium avium subsp. paratuberculosis
ggccucgccgucgcgaucgcggu

SEQ ID NO: 792485 - RNA, 20 nt, Mycobacterium avium subsp. paratuberculosis
ggccucgccguugccggccc

SEQ ID NO: 792486 - RNA, 12 nt, Mycobacterium avium subsp. paratuberculosis
ggccucgaugcg

SEQ ID NO: 792487 - RNA, 18 nt, Mycobacterium avium subsp. paratuberculosis
ggccucgcccagcgccgc

SEQ ID NO: 792488 - RNA, 19 nt, Mycobacterium avium subsp. paratuberculosis
ggccucgcccagcgccgcg

SEQ ID NO: 792489 - RNA, 20 nt, Mycobacterium avium subsp. paratuberculosis
ggccucgcccagcgccgcgg

SEQ ID NO: 792490 - RNA, 13 nt, Mycobacterium avium subsp. paratuberculosis
ggccucgaugucg

SEQ ID NO: 792491 - RNA, 17 nt, Mycobacterium avium subsp. paratuberculosis
ggccucgaugucgucga

SEQ ID NO: 792492 - RNA, 14 nt, Mycobacterium avium subsp. paratuberculosis
ggccuccaccggca

SEQ ID NO: 792493 - RNA, 22 nt, Mycobacterium avium subsp. paratuberculosis
ggccuccaccggcaaucgggac

SEQ ID NO: 792494 - RNA, 21 nt, Mycobacterium avium subsp. paratuberculosis
ggccuccagcuuugccagcag

SEQ ID NO: 792495 - RNA, 13 nt, Mycobacterium avium subsp. paratuberculosis
ggccuccaggcug

SEQ ID NO: 792496 - RNA, 14 nt, Mycobacterium avium subsp. paratuberculosis
ggccuccagccagc

SEQ ID NO: 792497 - RNA, 15 nt, Mycobacterium avium subsp. paratuberculosis
ggccuccagccagcg

SEQ ID NO: 792498 - RNA, 12 nt, Mycobacterium avium subsp. paratuberculosis
ggccuccagccg

SEQ ID NO: 792499 - RNA, 21 nt, Mycobacterium avium subsp. paratuberculosis
ggccuccagccgcgcggccgc

SEQ ID NO: 792500 - RNA, 14 nt, Mycobacterium avium subsp. paratuberculosis
ggccuccagccggc

SEQ ID NO: 792501 - RNA, 18 nt, Mycobacterium avium subsp. paratuberculosis
ggccuccagccggcggau

SEQ ID NO: 792502 - RNA, 14 nt, Mycobacterium avium subsp. paratuberculosis
ggccuccaccacca

SEQ ID NO: 792503 - RNA, 19 nt, Mycobacterium avium subsp. paratuberculosis
ggccuccaccaccaugucg

SEQ ID NO: 792504 - RNA, 21 nt, Mycobacterium avium subsp. paratuberculosis
ggccuccaccaccaugucguu

SEQ ID NO: 792505 - RNA, 20 nt, Mycobacterium avium subsp. paratuberculosis
ggccucaggcgucggucagc

SEQ ID NO: 792506 - RNA, 17 nt, Mycobacterium avium subsp. paratuberculosis
ggccucaccgcgggcca

SEQ ID NO: 792507 - RNA, 12 nt, Mycobacterium avium subsp. paratuberculosis
ggccgucggcgc

SEQ ID NO: 792508 - RNA, 14 nt, Mycobacterium avium subsp. paratuberculosis
ggccgucggcgccg

SEQ ID NO: 792509 - RNA, 16 nt, Mycobacterium avium subsp. paratuberculosis
ggccgucggcgccgcc

SEQ ID NO: 792510 - RNA, 17 nt, Mycobacterium avium subsp. paratuberculosis
ggccgucggcgccgccg

SEQ ID NO: 792511 - RNA, 20 nt, Mycobacterium avium subsp. paratuberculosis
ggccgucggcgccgccgagc

SEQ ID NO: 792512 - RNA, 24 nt, Mycobacterium avium subsp. paratuberculosis
ggccgucggcgccgccgagccgcg

SEQ ID NO: 792513 - RNA, 17 nt, Mycobacterium avium subsp. paratuberculosis
ggccgucggcgcggccg

SEQ ID NO: 792514 - RNA, 19 nt, Mycobacterium avium subsp. paratuberculosis
ggccgucggcgcggccgga

SEQ ID NO: 792515 - RNA, 22 nt, Mycobacterium avium subsp. paratuberculosis
ggccgucggcgcggccggaucg

SEQ ID NO: 792516 - RNA, 16 nt, Mycobacterium avium subsp. paratuberculosis
ggcugaacagcgcgcc

SEQ ID NO: 792517 - RNA, 18 nt, Mycobacterium avium subsp. paratuberculosis
ggcugaacagcgcgccga

SEQ ID NO: 792518 - RNA, 15 nt, Mycobacterium avium subsp. paratuberculosis
ggcucuucggcgccg

SEQ ID NO: 792519 - RNA, 18 nt, Mycobacterium avium subsp. paratuberculosis
ggcucuucggcgccgagc

SEQ ID NO: 792520 - RNA, 17 nt, Mycobacterium avium subsp. paratuberculosis
ggcucuuggcgaccucg

SEQ ID NO: 792521 - RNA, 16 nt, Mycobacterium avium subsp. paratuberculosis
ggcugacccgcccggg

SEQ ID NO: 792522 - RNA, 19 nt, Mycobacterium avium subsp. paratuberculosis
ggcugaccgacggcgacca

SEQ ID NO: 792523 - RNA, 18 nt, Mycobacterium avium subsp. paratuberculosis
ggcugaccgagcggcgcu

SEQ ID NO: 792524 - RNA, 20 nt, Mycobacterium avium subsp. paratuberculosis
ggcugaccgagcggcgcugc

SEQ ID NO: 792525 - RNA, 13 nt, Mycobacterium avium subsp. paratuberculosis
ggcugaccgccag

SEQ ID NO: 792526 - RNA, 17 nt, Mycobacterium avium subsp. paratuberculosis
ggcugaagaucaacagc

SEQ ID NO: 792527 - RNA, 15 nt, Mycobacterium avium subsp. paratuberculosis
ggcugaaccaccgcg

SEQ ID NO: 792528 - RNA, 16 nt, Mycobacterium avium subsp. paratuberculosis
ggcugaaccaccgcgc

SEQ ID NO: 792529 - RNA, 22 nt, Mycobacterium avium subsp. paratuberculosis
ggcugaaccaccgcgcccaccc

SEQ ID NO: 792530 - RNA, 16 nt, Mycobacterium avium subsp. paratuberculosis
ggcugaacgccagcag

SEQ ID NO: 792531 - RNA, 18 nt, Mycobacterium avium subsp. paratuberculosis
ggcugaacgccagcagcc

SEQ ID NO: 792532 - RNA, 22 nt, Mycobacterium avium subsp. paratuberculosis
ggcuccccgaccacaccggcgc

SEQ ID NO: 792533 - RNA, 18 nt, Mycobacterium avium subsp. paratuberculosis
ggcuccccggcgaucucg

SEQ ID NO: 792534 - RNA, 23 nt, Mycobacterium avium subsp. paratuberculosis
ggcuccccggcgaucucgagcau

SEQ ID NO: 792535 - RNA, 18 nt, Mycobacterium avium subsp. paratuberculosis
ggcucccagucccagcac

SEQ ID NO: 792536 - RNA, 20 nt, Mycobacterium avium subsp. paratuberculosis
ggcucacgacuccuggccga

SEQ ID NO: 792537 - RNA, 20 nt, Mycobacterium avium subsp. paratuberculosis
ggcucacguagucgaccggg

SEQ ID NO: 792538 - RNA, 13 nt, Mycobacterium avium subsp. paratuberculosis
ggcuccgcgcuga

SEQ ID NO: 792539 - RNA, 18 nt, Mycobacterium avium subsp. paratuberculosis
ggcuccggccgcgccggc

SEQ ID NO: 792540 - RNA, 15 nt, Mycobacterium avium subsp. paratuberculosis
ggcugaucucggcgg

SEQ ID NO: 792541 - RNA, 23 nt, Mycobacterium avium subsp. paratuberculosis
ggcugcacgucacgggccaggcg

SEQ ID NO: 792542 - RNA, 17 nt, Mycobacterium avium subsp. paratuberculosis
ggcugcaccagggcguc

SEQ ID NO: 792543 - RNA, 13 nt, Mycobacterium avium subsp. paratuberculosis
ggcugcagcagcg

SEQ ID NO: 792544 - RNA, 14 nt, Mycobacterium avium subsp. paratuberculosis
ggcugcagccgggc

SEQ ID NO: 792545 - RNA, 15 nt, Mycobacterium avium subsp. paratuberculosis
ggcugcagccgggcg

SEQ ID NO: 792546 - RNA, 19 nt, Mycobacterium avium subsp. paratuberculosis
ggcugcagcgacuggacca

SEQ ID NO: 792547 - RNA, 12 nt, Mycobacterium avium subsp. paratuberculosis
ggcugcagggcc

SEQ ID NO: 792548 - RNA, 15 nt, Mycobacterium avium subsp. paratuberculosis
ggcugcccaccacca

SEQ ID NO: 792549 - RNA, 15 nt, Mycobacterium avium subsp. paratuberculosis
ggcugaguucgguga

SEQ ID NO: 792550 - RNA, 17 nt, Mycobacterium avium subsp. paratuberculosis
ggcugaucagccggcga

SEQ ID NO: 792551 - RNA, 22 nt, Mycobacterium avium subsp. paratuberculosis
ggcugaucagccggcgagcgcg

SEQ ID NO: 792552 - RNA, 18 nt, Mycobacterium avium subsp. paratuberculosis
ggcugaggccgccccggc

SEQ ID NO: 792553 - RNA, 12 nt, Mycobacterium avium subsp. paratuberculosis
ggcugagcaccg

SEQ ID NO: 792554 - RNA, 14 nt, Mycobacterium avium subsp. paratuberculosis
ggcugagcaccggg

SEQ ID NO: 792555 - RNA, 16 nt, Mycobacterium avium subsp. paratuberculosis
ggcugagcagcucgcg

SEQ ID NO: 792556 - RNA, 21 nt, Mycobacterium avium subsp. paratuberculosis
ggcugacgcgaccgcgcggcg

SEQ ID NO: 792557 - RNA, 15 nt, Mycobacterium avium subsp. paratuberculosis
ggcugacgucgaagg

SEQ ID NO: 792558 - RNA, 14 nt, Mycobacterium avium subsp. paratuberculosis
ggcugacugccggc

SEQ ID NO: 792559 - RNA, 15 nt, Mycobacterium avium subsp. paratuberculosis
ggcugacugccggcg

SEQ ID NO: 792560 - RNA, 16 nt, Mycobacterium avium subsp. paratuberculosis
ggcugacugccggcga

SEQ ID NO: 792561 - RNA, 16 nt, Mycobacterium avium subsp. paratuberculosis
ggcugaccggcggugc

SEQ ID NO: 792562 - RNA, 17 nt, Mycobacterium avium subsp. paratuberculosis
ggcugaccggcggugcc

SEQ ID NO: 792563 - RNA, 20 nt, Mycobacterium avium subsp. paratuberculosis
ggcugaccggcggugccggc

SEQ ID NO: 792564 - RNA, 15 nt, Mycobacterium avium subsp. paratuberculosis
ggcugaccgucgacc

SEQ ID NO: 792565 - RNA, 16 nt, Mycobacterium avium subsp. paratuberculosis
ggcugaccgucgacca

SEQ ID NO: 792566 - RNA, 14 nt, Mycobacterium avium subsp. paratuberculosis
ggcugaccucgcgc

SEQ ID NO: 792567 - RNA, 18 nt, Mycobacterium avium subsp. paratuberculosis
ggcugaccucgcgcaccg

SEQ ID NO: 792568 - RNA, 19 nt, Mycobacterium avium subsp. paratuberculosis
ggcugaccucgcgcaccgg

SEQ ID NO: 792569 - RNA, 16 nt, Mycobacterium avium subsp. paratuberculosis
ggcugacgaucgucga

SEQ ID NO: 792570 - RNA, 13 nt, Mycobacterium avium subsp. paratuberculosis
ggcugaccagcgc

SEQ ID NO: 792571 - RNA, 14 nt, Mycobacterium avium subsp. paratuberculosis
ggcugacgccacgc

SEQ ID NO: 792572 - RNA, 18 nt, Mycobacterium avium subsp. paratuberculosis
ggcugcccggcccgccgc

SEQ ID NO: 792573 - RNA, 15 nt, Mycobacterium avium subsp. paratuberculosis
ggcugcccggcgccg

SEQ ID NO: 792574 - RNA, 19 nt, Mycobacterium avium subsp. paratuberculosis
ggcugcccggcgccggucg

SEQ ID NO: 792575 - RNA, 17 nt, Mycobacterium avium subsp. paratuberculosis
ggcugccccagggacca

SEQ ID NO: 792576 - RNA, 15 nt, Mycobacterium avium subsp. paratuberculosis
ggcugcccgacccgc

SEQ ID NO: 792577 - RNA, 22 nt, Mycobacterium avium subsp. paratuberculosis
ggcugcccgacccgcaccaccg

SEQ ID NO: 792578 - RNA, 18 nt, Mycobacterium avium subsp. paratuberculosis
ggcugcccagguccaccg

SEQ ID NO: 792579 - RNA, 21 nt, Mycobacterium avium subsp. paratuberculosis
ggcugcccgggcuguugacca

SEQ ID NO: 792580 - RNA, 12 nt, Mycobacterium avium subsp. paratuberculosis
ggcugcccgcga

SEQ ID NO: 792581 - RNA, 22 nt, Mycobacterium avium subsp. paratuberculosis
ggcugcccgcgacugucggcgc

SEQ ID NO: 792582 - RNA, 14 nt, Mycobacterium avium subsp. paratuberculosis
ggcugccucgacga

SEQ ID NO: 792583 - RNA, 15 nt, Mycobacterium avium subsp. paratuberculosis
ggcugccucgacgau

SEQ ID NO: 792584 - RNA, 15 nt, Mycobacterium avium subsp. paratuberculosis
ggcugccggccaagg

SEQ ID NO: 792585 - RNA, 16 nt, Mycobacterium avium subsp. paratuberculosis
ggcugccggccaaggc

SEQ ID NO: 792586 - RNA, 12 nt, Mycobacterium avium subsp. paratuberculosis
ggcugcgguugg

SEQ ID NO: 792587 - RNA, 16 nt, Mycobacterium avium subsp. paratuberculosis
ggcugcgguuggccgg

SEQ ID NO: 792588 - RNA, 15 nt, Mycobacterium avium subsp. paratuberculosis
ggcugcgggcaucgc

SEQ ID NO: 792589 - RNA, 19 nt, Mycobacterium avium subsp. paratuberculosis
ggcugcggcgagucccggc

SEQ ID NO: 792590 - RNA, 22 nt, Mycobacterium avium subsp. paratuberculosis
ggcugcggcgagucccggcgca

SEQ ID NO: 792591 - RNA, 20 nt, Mycobacterium avium subsp. paratuberculosis
ggcugcgcacguagcccagc

SEQ ID NO: 792592 - RNA, 23 nt, Mycobacterium avium subsp. paratuberculosis
ggcugcgcacguagcccagcgcg

SEQ ID NO: 792593 - RNA, 16 nt, Mycobacterium avium subsp. paratuberculosis
ggcugcuggucgacgu

SEQ ID NO: 792594 - RNA, 17 nt, Mycobacterium avium subsp. paratuberculosis
ggcugcuggucgacguc

SEQ ID NO: 792595 - RNA, 18 nt, Mycobacterium avium subsp. paratuberculosis
ggcugcuggucgacguca

SEQ ID NO: 792596 - RNA, 22 nt, Mycobacterium avium subsp. paratuberculosis
ggcugcuguucguccgugcugc

SEQ ID NO: 792597 - RNA, 21 nt, Mycobacterium avium subsp. paratuberculosis
ggcugcugcacgacgaccgcg

SEQ ID NO: 792598 - RNA, 17 nt, Mycobacterium avium subsp. paratuberculosis
ggcugcugcacgucgcc

SEQ ID NO: 792599 - RNA, 16 nt, Mycobacterium avium subsp. paratuberculosis
ggcugcucgaaccgcg

SEQ ID NO: 792600 - RNA, 17 nt, Mycobacterium avium subsp. paratuberculosis
ggcugcucgaaccgcga

SEQ ID NO: 792601 - RNA, 19 nt, Mycobacterium avium subsp. paratuberculosis
ggcugcucgcgcugccgcg

SEQ ID NO: 792602 - RNA, 14 nt, Mycobacterium avium subsp. paratuberculosis
ggcugcucggcggg

SEQ ID NO: 792603 - RNA, 21 nt, Mycobacterium avium subsp. paratuberculosis
ggcugcucggcgggcucgcgc

SEQ ID NO: 792604 - RNA, 20 nt, Mycobacterium avium subsp. paratuberculosis
ggcuggaaguucgcuggcgg

SEQ ID NO: 792605 - RNA, 23 nt, Mycobacterium avium subsp. paratuberculosis
ggcuggaaguucgcuggcggggc

SEQ ID NO: 792606 - RNA, 14 nt, Mycobacterium avium subsp. paratuberculosis
ggcuggcaucgucg

SEQ ID NO: 792607 - RNA, 23 nt, Mycobacterium avium subsp. paratuberculosis
ggcuggcaucgucggcgccggcg

SEQ ID NO: 792608 - RNA, 17 nt, Mycobacterium avium subsp. paratuberculosis
ggcuggcgugcggcgcg

SEQ ID NO: 792609 - RNA, 11 nt, Mycobacterium avium subsp. paratuberculosis
ggcuggcggcg

SEQ ID NO: 792610 - RNA, 13 nt, Mycobacterium avium subsp. paratuberculosis
ggcuggcggcgau

SEQ ID NO: 792611 - RNA, 13 nt, Mycobacterium avium subsp. paratuberculosis
ggcuggcggcaac

SEQ ID NO: 792612 - RNA, 13 nt, Mycobacterium avium subsp. paratuberculosis
ggcuggccguccg

SEQ ID NO: 792613 - RNA, 16 nt, Mycobacterium avium subsp. paratuberculosis
ggcuggccgucggcga

SEQ ID NO: 792614 - RNA, 14 nt, Mycobacterium avium subsp. paratuberculosis
ggcuggccgcacgg

SEQ ID NO: 792615 - RNA, 17 nt, Mycobacterium avium subsp. paratuberculosis
ggcuggccgagcggcug

SEQ ID NO: 792616 - RNA, 23 nt, Mycobacterium avium subsp. paratuberculosis
ggcuggccgagcggcugcugguc

SEQ ID NO: 792617 - RNA, 21 nt, Mycobacterium avium subsp. paratuberculosis
ggcuggccaggcuggcgucga

SEQ ID NO: 792618 - RNA, 20 nt, Mycobacterium avium subsp. paratuberculosis
ggcgugacacucggucaccg

SEQ ID NO: 792619 - RNA, 20 nt, Mycobacterium avium subsp. paratuberculosis
ggcgucuugaucucggcggc

SEQ ID NO: 792620 - RNA, 17 nt, Mycobacterium avium subsp. paratuberculosis
ggcgucguuggcgccgu

SEQ ID NO: 792621 - RNA, 20 nt, Mycobacterium avium subsp. paratuberculosis
ggcgucguuggcgccguccg

SEQ ID NO: 792622 - RNA, 18 nt, Mycobacterium avium subsp. paratuberculosis
ggcgucguggucgacgcc

SEQ ID NO: 792623 - RNA, 12 nt, Mycobacterium avium subsp. paratuberculosis
ggcgucgucguc

SEQ ID NO: 792624 - RNA, 21 nt, Mycobacterium avium subsp. paratuberculosis
ggcgucgucgucgcagugccc

SEQ ID NO: 792625 - RNA, 14 nt, Mycobacterium avium subsp. paratuberculosis
ggcgucgucgauga

SEQ ID NO: 792626 - RNA, 15 nt, Mycobacterium avium subsp. paratuberculosis
ggcgucgucgccgug

SEQ ID NO: 792627 - RNA, 20 nt, Mycobacterium avium subsp. paratuberculosis
ggcgucgucggcggcgacgu

SEQ ID NO: 792628 - RNA, 22 nt, Mycobacterium avium subsp. paratuberculosis
ggcgucucagucggccaccgcg

SEQ ID NO: 792629 - RNA, 23 nt, Mycobacterium avium subsp. paratuberculosis
ggcgucucagucggccaccgcga

SEQ ID NO: 792630 - RNA, 15 nt, Mycobacterium avium subsp. paratuberculosis
ggcgucucggcccga

SEQ ID NO: 792631 - RNA, 15 nt, Mycobacterium avium subsp. paratuberculosis
ggcgucucggcgucu

SEQ ID NO: 792632 - RNA, 20 nt, Mycobacterium avium subsp. paratuberculosis
ggcgucucggcgucucggcg

SEQ ID NO: 792633 - RNA, 19 nt, Mycobacterium avium subsp. paratuberculosis
ggcgucucgaugagcgaga

SEQ ID NO: 792634 - RNA, 15 nt, Mycobacterium avium subsp. paratuberculosis
ggcgucggccaccgc

SEQ ID NO: 792635 - RNA, 16 nt, Mycobacterium avium subsp. paratuberculosis
ggcgucggccaccgcg

SEQ ID NO: 792636 - RNA, 17 nt, Mycobacterium avium subsp. paratuberculosis
ggcgucggccaccgcgc

SEQ ID NO: 792637 - RNA, 21 nt, Mycobacterium avium subsp. paratuberculosis
ggcgucggccagcggcagcga

SEQ ID NO: 792638 - RNA, 20 nt, Mycobacterium avium subsp. paratuberculosis
ggcgucggccgggggcgcgg

SEQ ID NO: 792639 - RNA, 18 nt, Mycobacterium avium subsp. paratuberculosis
ggcgucggccugcccgcg

SEQ ID NO: 792640 - RNA, 22 nt, Mycobacterium avium subsp. paratuberculosis
ggcgucggccugcccgcgggug

SEQ ID NO: 792641 - RNA, 14 nt, Mycobacterium avium subsp. paratuberculosis
ggcgucggcgcgca

SEQ ID NO: 792642 - RNA, 14 nt, Mycobacterium avium subsp. paratuberculosis
ggcgucggccaccg

SEQ ID NO: 792643 - RNA, 16 nt, Mycobacterium avium subsp. paratuberculosis
ggcgucggcgacggcg

SEQ ID NO: 792644 - RNA, 14 nt, Mycobacterium avium subsp. paratuberculosis
ggcgucggcggccu

SEQ ID NO: 792645 - RNA, 16 nt, Mycobacterium avium subsp. paratuberculosis
ggcgucggcggccugc

SEQ ID NO: 792646 - RNA, 21 nt, Mycobacterium avium subsp. paratuberculosis
ggcgucggcggccugcucgca

SEQ ID NO: 792647 - RNA, 23 nt, Mycobacterium avium subsp. paratuberculosis
ggcgucggcggccugcucgcaga

SEQ ID NO: 792648 - RNA, 19 nt, Mycobacterium avium subsp. paratuberculosis
ggcgucggcgggcgugccg

SEQ ID NO: 792649 - RNA, 14 nt, Mycobacterium avium subsp. paratuberculosis
ggcgucggcggugg

SEQ ID NO: 792650 - RNA, 20 nt, Mycobacterium avium subsp. paratuberculosis
ggcgucggcguagggcagcc

SEQ ID NO: 792651 - RNA, 12 nt, Mycobacterium avium subsp. paratuberculosis
ggcgucggcguc

SEQ ID NO: 792652 - RNA, 22 nt, Mycobacterium avium subsp. paratuberculosis
ggcgucguaguugcggccggcg

SEQ ID NO: 792653 - RNA, 24 nt, Mycobacterium avium subsp. paratuberculosis
ggcgucguaguugcggccggcggu

SEQ ID NO: 792654 - RNA, 14 nt, Mycobacterium avium subsp. paratuberculosis
ggcgucguacagca

SEQ ID NO: 792655 - RNA, 13 nt, Mycobacterium avium subsp. paratuberculosis
ggcgucggugaug

SEQ ID NO: 792656 - RNA, 19 nt, Mycobacterium avium subsp. paratuberculosis
ggcgucggugaugccggac

SEQ ID NO: 792657 - RNA, 15 nt, Mycobacterium avium subsp. paratuberculosis
ggcgucggggcccuc

SEQ ID NO: 792658 - RNA, 20 nt, Mycobacterium avium subsp. paratuberculosis
ggcgucggggcccuccgcgg

SEQ ID NO: 792659 - RNA, 15 nt, Mycobacterium avium subsp. paratuberculosis
ggcgucgggaccguc

SEQ ID NO: 792660 - RNA, 20 nt, Mycobacterium avium subsp. paratuberculosis
ggcgucgggaccgucgcgca

SEQ ID NO: 792661 - RNA, 13 nt, Mycobacterium avium subsp. paratuberculosis
ggcgucgggccgg

SEQ ID NO: 792662 - RNA, 23 nt, Mycobacterium avium subsp. paratuberculosis
ggcgucggcgaucucggucaccg

SEQ ID NO: 792663 - RNA, 13 nt, Mycobacterium avium subsp. paratuberculosis
ggcgucggcgcgu

SEQ ID NO: 792664 - RNA, 19 nt, Mycobacterium avium subsp. paratuberculosis
ggcggucugcgcccgaucg

SEQ ID NO: 792665 - RNA, 15 nt, Mycobacterium avium subsp. paratuberculosis
ggcggucggugcgca

SEQ ID NO: 792666 - RNA, 12 nt, Mycobacterium avium subsp. paratuberculosis
ggcggucgcggu

SEQ ID NO: 792667 - RNA, 17 nt, Mycobacterium avium subsp. paratuberculosis
ggcggucgcggugccca

SEQ ID NO: 792668 - RNA, 15 nt, Mycobacterium avium subsp. paratuberculosis
ggcggucggacgcgg

SEQ ID NO: 792669 - RNA, 21 nt, Mycobacterium avium subsp. paratuberculosis
ggcgguccguucggcgguucg

SEQ ID NO: 792670 - RNA, 16 nt, Mycobacterium avium subsp. paratuberculosis
ggcggucgcgcagccg

SEQ ID NO: 792671 - RNA, 12 nt, Mycobacterium avium subsp. paratuberculosis
ggcggucgcgcc

SEQ ID NO: 792672 - RNA, 20 nt, Mycobacterium avium subsp. paratuberculosis
ggcggucgcgcgccggcgca

SEQ ID NO: 792673 - RNA, 13 nt, Mycobacterium avium subsp. paratuberculosis
ggcggucgccgaa

SEQ ID NO: 792674 - RNA, 13 nt, Mycobacterium avium subsp. paratuberculosis
ggcggucgaacgc

SEQ ID NO: 792675 - RNA, 14 nt, Mycobacterium avium subsp. paratuberculosis
ggcggucgaacgcg

SEQ ID NO: 792676 - RNA, 15 nt, Mycobacterium avium subsp. paratuberculosis
ggcggucgaacgcgg

SEQ ID NO: 792677 - RNA, 19 nt, Mycobacterium avium subsp. paratuberculosis
ggcggucgaacgcggcgcc

SEQ ID NO: 792678 - RNA, 20 nt, Mycobacterium avium subsp. paratuberculosis
ggcggucgaacgcggcgccg

SEQ ID NO: 792679 - RNA, 17 nt, Mycobacterium avium subsp. paratuberculosis
ggcggucgacacgaucg

SEQ ID NO: 792680 - RNA, 22 nt, Mycobacterium avium subsp. paratuberculosis
ggcggucccgcauguccggggu

SEQ ID NO: 792681 - RNA, 16 nt, Mycobacterium avium subsp. paratuberculosis
ggcggucccggcggac

SEQ ID NO: 792682 - RNA, 17 nt, Mycobacterium avium subsp. paratuberculosis
ggcgguccgcuccacca

SEQ ID NO: 792683 - RNA, 24 nt, Mycobacterium avium subsp. paratuberculosis
ggcgguccgcuccaccagcgcggu

SEQ ID NO: 792684 - RNA, 20 nt, Mycobacterium avium subsp. paratuberculosis
ggcggucgacuggucgucga

SEQ ID NO: 792685 - RNA, 21 nt, Mycobacterium avium subsp. paratuberculosis
ggcggucgacuggucgucgag

SEQ ID NO: 792686 - RNA, 21 nt, Mycobacterium avium subsp. paratuberculosis
ggcgucggacaugccggcgcc

SEQ ID NO: 792687 - RNA, 22 nt, Mycobacterium avium subsp. paratuberculosis
ggcgucggacaugccggcgccg

SEQ ID NO: 792688 - RNA, 19 nt, Mycobacterium avium subsp. paratuberculosis
ggcgucggagaugcgggcc

SEQ ID NO: 792689 - RNA, 17 nt, Mycobacterium avium subsp. paratuberculosis
ggcgucggagucgcugu

SEQ ID NO: 792690 - RNA, 19 nt, Mycobacterium avium subsp. paratuberculosis
ggcgucgcgcagcagcggg

SEQ ID NO: 792691 - RNA, 14 nt, Mycobacterium avium subsp. paratuberculosis
ggcgucgcggcgca

SEQ ID NO: 792692 - RNA, 13 nt, Mycobacterium avium subsp. paratuberculosis
ggcgucgcggucg

SEQ ID NO: 792693 - RNA, 15 nt, Mycobacterium avium subsp. paratuberculosis
ggcgucgcggucggc

SEQ ID NO: 792694 - RNA, 17 nt, Mycobacterium avium subsp. paratuberculosis
ggcgucgcggucggcgu

SEQ ID NO: 792695 - RNA, 20 nt, Mycobacterium avium subsp. paratuberculosis
ggcgucgccgcccccgauag

SEQ ID NO: 792696 - RNA, 13 nt, Mycobacterium avium subsp. paratuberculosis
ggcgucgccgccg

SEQ ID NO: 792697 - RNA, 14 nt, Mycobacterium avium subsp. paratuberculosis
ggcgucgccgccgg

SEQ ID NO: 792698 - RNA, 18 nt, Mycobacterium avium subsp. paratuberculosis
ggcgucgccgccggugcc

SEQ ID NO: 792699 - RNA, 19 nt, Mycobacterium avium subsp. paratuberculosis
ggcgucgccgccggugccg

SEQ ID NO: 792700 - RNA, 16 nt, Mycobacterium avium subsp. paratuberculosis
ggcggugaccggaucg

SEQ ID NO: 792701 - RNA, 15 nt, Mycobacterium avium subsp. paratuberculosis
ggcggugagccgcca

SEQ ID NO: 792702 - RNA, 18 nt, Mycobacterium avium subsp. paratuberculosis
ggcggugauccgcccggc

SEQ ID NO: 792703 - RNA, 21 nt, Mycobacterium avium subsp. paratuberculosis
ggcggugaucucgucggcggc

SEQ ID NO: 792704 - RNA, 20 nt, Mycobacterium avium subsp. paratuberculosis
ggcggugaugcgcgccgacg

SEQ ID NO: 792705 - RNA, 21 nt, Mycobacterium avium subsp. paratuberculosis
ggcggugaugcgcgccgacga

SEQ ID NO: 792706 - RNA, 14 nt, Mycobacterium avium subsp. paratuberculosis
ggcggugaccacgc

SEQ ID NO: 792707 - RNA, 17 nt, Mycobacterium avium subsp. paratuberculosis
ggcggucuuggcggcca

SEQ ID NO: 792708 - RNA, 20 nt, Mycobacterium avium subsp. paratuberculosis
ggcggucuuugccaucccgg

SEQ ID NO: 792709 - RNA, 21 nt, Mycobacterium avium subsp. paratuberculosis
ggcucaaaccguugaccacca

SEQ ID NO: 792710 - RNA, 21 nt, Mycobacterium avium subsp. paratuberculosis
ggcucaacacguccuggcgcc

SEQ ID NO: 792711 - RNA, 18 nt, Mycobacterium avium subsp. paratuberculosis
ggcucaacggccggcgcc

SEQ ID NO: 792712 - RNA, 20 nt, Mycobacterium avium subsp. paratuberculosis
ggcucacagcgcggcgguga

SEQ ID NO: 792713 - RNA, 16 nt, Mycobacterium avium subsp. paratuberculosis
ggcucacaugggcgcg

SEQ ID NO: 792714 - RNA, 16 nt, Mycobacterium avium subsp. paratuberculosis
ggcuagcgggcgcgca

SEQ ID NO: 792715 - RNA, 20 nt, Mycobacterium avium subsp. paratuberculosis
ggcuagcgggcgcgcagcca

SEQ ID NO: 792716 - RNA, 14 nt, Mycobacterium avium subsp. paratuberculosis
ggcuaucgcccggc

SEQ ID NO: 792717 - RNA, 15 nt, Mycobacterium avium subsp. paratuberculosis
ggcuaucgcccggcg

SEQ ID NO: 792718 - RNA, 16 nt, Mycobacterium avium subsp. paratuberculosis
ggcuaucgcccggcgc

SEQ ID NO: 792719 - RNA, 17 nt, Mycobacterium avium subsp. paratuberculosis
ggcuaucgcccggcgcc

SEQ ID NO: 792720 - RNA, 13 nt, Mycobacterium avium subsp. paratuberculosis
ggcguuucgugug

SEQ ID NO: 792721 - RNA, 20 nt, Mycobacterium avium subsp. paratuberculosis
ggcguuguugaggaacgcga

SEQ ID NO: 792722 - RNA, 16 nt, Mycobacterium avium subsp. paratuberculosis
ggcguuguggccaccg

SEQ ID NO: 792723 - RNA, 16 nt, Mycobacterium avium subsp. paratuberculosis
ggcguuuuugugggug

SEQ ID NO: 792724 - RNA, 17 nt, Mycobacterium avium subsp. paratuberculosis
ggcuaccugaccagcgg

SEQ ID NO: 792725 - RNA, 19 nt, Mycobacterium avium subsp. paratuberculosis
ggcuaccugaccagcggcg

SEQ ID NO: 792726 - RNA, 20 nt, Mycobacterium avium subsp. paratuberculosis
ggcuaccugaccagcggcgc

SEQ ID NO: 792727 - RNA, 23 nt, Mycobacterium avium subsp. paratuberculosis
ggcuagacgcgcaccagggccgc

SEQ ID NO: 792728 - RNA, 15 nt, Mycobacterium avium subsp. paratuberculosis
ggcuacucggacgcc

SEQ ID NO: 792729 - RNA, 18 nt, Mycobacterium avium subsp. paratuberculosis
ggcuacucggacgccggc

SEQ ID NO: 792730 - RNA, 17 nt, Mycobacterium avium subsp. paratuberculosis
ggcuagcagcuccgguc

SEQ ID NO: 792731 - RNA, 12 nt, Mycobacterium avium subsp. paratuberculosis
ggcguucgauug

SEQ ID NO: 792732 - RNA, 21 nt, Mycobacterium avium subsp. paratuberculosis
ggcguugggcgggaucgcggc

SEQ ID NO: 792733 - RNA, 15 nt, Mycobacterium avium subsp. paratuberculosis
ggcguucugcaccga

SEQ ID NO: 792734 - RNA, 17 nt, Mycobacterium avium subsp. paratuberculosis
ggcguucugcaccgacu

SEQ ID NO: 792735 - RNA, 14 nt, Mycobacterium avium subsp. paratuberculosis
ggcguucgccgagg

SEQ ID NO: 792736 - RNA, 18 nt, Mycobacterium avium subsp. paratuberculosis
ggcguucgacguccaccg

SEQ ID NO: 792737 - RNA, 19 nt, Mycobacterium avium subsp. paratuberculosis
ggcguucgacguccaccgg

SEQ ID NO: 792738 - RNA, 19 nt, Mycobacterium avium subsp. paratuberculosis
ggcguucaucguccacacc

SEQ ID NO: 792739 - RNA, 23 nt, Mycobacterium avium subsp. paratuberculosis
ggcguucaucguccacaccggga

SEQ ID NO: 792740 - RNA, 15 nt, Mycobacterium avium subsp. paratuberculosis
ggcgugcucgaucgc

SEQ ID NO: 792741 - RNA, 19 nt, Mycobacterium avium subsp. paratuberculosis
ggcgugcgaaugacgcgca

SEQ ID NO: 792742 - RNA, 13 nt, Mycobacterium avium subsp. paratuberculosis
ggcgugcgguugg

SEQ ID NO: 792743 - RNA, 17 nt, Mycobacterium avium subsp. paratuberculosis
ggcgugcgguuggcccg

SEQ ID NO: 792744 - RNA, 19 nt, Mycobacterium avium subsp. paratuberculosis
ggcgugcgguuggcccgcg

SEQ ID NO: 792745 - RNA, 20 nt, Mycobacterium avium subsp. paratuberculosis
ggcgugcgguuggcccgcgg

SEQ ID NO: 792746 - RNA, 21 nt, Mycobacterium avium subsp. paratuberculosis
ggcgugcgguuggcccgcggc

SEQ ID NO: 792747 - RNA, 14 nt, Mycobacterium avium subsp. paratuberculosis
ggcgugcggccgca

SEQ ID NO: 792748 - RNA, 22 nt, Mycobacterium avium subsp. paratuberculosis
ggcgugcggccgcagcgcccgg

SEQ ID NO: 792749 - RNA, 16 nt, Mycobacterium avium subsp. paratuberculosis
ggcgugcggcgcgguc

SEQ ID NO: 792750 - RNA, 19 nt, Mycobacterium avium subsp. paratuberculosis
ggcgugcggcgcggucgca

SEQ ID NO: 792751 - RNA, 13 nt, Mycobacterium avium subsp. paratuberculosis
ggcgugccggaca

SEQ ID NO: 792752 - RNA, 19 nt, Mycobacterium avium subsp. paratuberculosis
ggcgugccggacaccggca

SEQ ID NO: 792753 - RNA, 13 nt, Mycobacterium avium subsp. paratuberculosis
ggcgugccggccc

SEQ ID NO: 792754 - RNA, 18 nt, Mycobacterium avium subsp. paratuberculosis
ggcgugccggcccggcgg

SEQ ID NO: 792755 - RNA, 13 nt, Mycobacterium avium subsp. paratuberculosis
ggcgugccggcgg

SEQ ID NO: 792756 - RNA, 18 nt, Mycobacterium avium subsp. paratuberculosis
ggcgugccgaacggcgcu

SEQ ID NO: 792757 - RNA, 19 nt, Mycobacterium avium subsp. paratuberculosis
ggcgugacggucgaccucg

SEQ ID NO: 792758 - RNA, 12 nt, Mycobacterium avium subsp. paratuberculosis
ggcgugccgccc

SEQ ID NO: 792759 - RNA, 20 nt, Mycobacterium avium subsp. paratuberculosis
ggcgugccgcccggaccgcg

SEQ ID NO: 792760 - RNA, 17 nt, Mycobacterium avium subsp. paratuberculosis
ggcgugacgcucgacgg

SEQ ID NO: 792761 - RNA, 21 nt, Mycobacterium avium subsp. paratuberculosis
ggcgugacgcucgacggccgg

SEQ ID NO: 792762 - RNA, 23 nt, Mycobacterium avium subsp. paratuberculosis
ggcgugacgcucgacggccggcg

SEQ ID NO: 792763 - RNA, 18 nt, Mycobacterium avium subsp. paratuberculosis
ggcgugacgcucgaggcc

SEQ ID NO: 792764 - RNA, 19 nt, Mycobacterium avium subsp. paratuberculosis
ggcgugacgcucgaggccc

SEQ ID NO: 792765 - RNA, 21 nt, Mycobacterium avium subsp. paratuberculosis
ggcgugacgcucgaggccccg

SEQ ID NO: 792766 - RNA, 19 nt, Mycobacterium avium subsp. paratuberculosis
ggcgugacgcucgccggcg

SEQ ID NO: 792767 - RNA, 23 nt, Mycobacterium avium subsp. paratuberculosis
ggcgugacgcucgccggcggccg

SEQ ID NO: 792768 - RNA, 17 nt, Mycobacterium avium subsp. paratuberculosis
ggcgugacgcucggccg

SEQ ID NO: 792769 - RNA, 22 nt, Mycobacterium avium subsp. paratuberculosis
ggcgugacgcucggcgccgcgg

SEQ ID NO: 792770 - RNA, 20 nt, Mycobacterium avium subsp. paratuberculosis
ggcgugacgcucggcgccgg

SEQ ID NO: 792771 - RNA, 20 nt, Mycobacterium avium subsp. paratuberculosis
ggcgugacgcucggcggccg

SEQ ID NO: 792772 - RNA, 22 nt, Mycobacterium avium subsp. paratuberculosis
ggcgugaccggcugcucgcgcu

SEQ ID NO: 792773 - RNA, 23 nt, Mycobacterium avium subsp. paratuberculosis
ggcgugacaggguaacccgggac

SEQ ID NO: 792774 - RNA, 23 nt, Mycobacterium avium subsp. paratuberculosis
ggcuugaugaugcugucggugaa

SEQ ID NO: 792775 - RNA, 17 nt, Mycobacterium avium subsp. paratuberculosis
ggcuuucggcgccaaca

SEQ ID NO: 792776 - RNA, 19 nt, Mycobacterium avium subsp. paratuberculosis
ggcuuuugcgucugcucgc

SEQ ID NO: 792777 - RNA, 16 nt, Mycobacterium avium subsp. paratuberculosis
gggaagggcuccccgg

SEQ ID NO: 792778 - RNA, 14 nt, Mycobacterium avium subsp. paratuberculosis
gggaagggcccggg

SEQ ID NO: 792779 - RNA, 16 nt, Mycobacterium avium subsp. paratuberculosis
gggaagcuggugguga

SEQ ID NO: 792780 - RNA, 14 nt, Mycobacterium avium subsp. paratuberculosis
gggaaacgcgucgc

SEQ ID NO: 792781 - RNA, 13 nt, Mycobacterium avium subsp. paratuberculosis
gggaaucacgccc

SEQ ID NO: 792782 - RNA, 23 nt, Mycobacterium avium subsp. paratuberculosis
gggaaucacgccccaggcgcccu

SEQ ID NO: 792783 - RNA, 15 nt, Mycobacterium avium subsp. paratuberculosis
gggaaucccacccgc

SEQ ID NO: 792784 - RNA, 19 nt, Mycobacterium avium subsp. paratuberculosis
gggaaucccacccgcaacg

SEQ ID NO: 792785 - RNA, 22 nt, Mycobacterium avium subsp. paratuberculosis
gggaaucccacccgcaacgcug

SEQ ID NO: 792786 - RNA, 21 nt, Mycobacterium avium subsp. paratuberculosis
gggaauccuggccgaugguca

SEQ ID NO: 792787 - RNA, 15 nt, Mycobacterium avium subsp. paratuberculosis
gggaaugcggcuggg

SEQ ID NO: 792788 - RNA, 23 nt, Mycobacterium avium subsp. paratuberculosis
gggaauuggcaccggaccgccga

SEQ ID NO: 792789 - RNA, 17 nt, Mycobacterium avium subsp. paratuberculosis
gggaaugucgcgcagca

SEQ ID NO: 792790 - RNA, 16 nt, Mycobacterium avium subsp. paratuberculosis
gggaauuccggcgcga

SEQ ID NO: 792791 - RNA, 16 nt, Mycobacterium avium subsp. paratuberculosis
gggacagcgucaccaa

SEQ ID NO: 792792 - RNA, 13 nt, Mycobacterium avium subsp. paratuberculosis
ggcuggucggccu

SEQ ID NO: 792793 - RNA, 16 nt, Mycobacterium avium subsp. paratuberculosis
ggcugguccggaaccg

SEQ ID NO: 792794 - RNA, 16 nt, Mycobacterium avium subsp. paratuberculosis
ggcuggucacccacug

SEQ ID NO: 792795 - RNA, 20 nt, Mycobacterium avium subsp. paratuberculosis
ggcuggucacccacuggcgg

SEQ ID NO: 792796 - RNA, 23 nt, Mycobacterium avium subsp. paratuberculosis
ggcuggucacccacuggcggccg

SEQ ID NO: 792797 - RNA, 14 nt, Mycobacterium avium subsp. paratuberculosis
ggcugggcgaagcc

SEQ ID NO: 792798 - RNA, 16 nt, Mycobacterium avium subsp. paratuberculosis
ggcugggucaccacgg

SEQ ID NO: 792799 - RNA, 22 nt, Mycobacterium avium subsp. paratuberculosis
ggcuggguccgauugcccgacu

SEQ ID NO: 792800 - RNA, 22 nt, Mycobacterium avium subsp. paratuberculosis
ggcuggguggacaccuuggcgg

SEQ ID NO: 792801 - RNA, 17 nt, Mycobacterium avium subsp. paratuberculosis
ggcuucguacggcccgg

SEQ ID NO: 792802 - RNA, 21 nt, Mycobacterium avium subsp. paratuberculosis
ggcuucgggaucagcgggacg

SEQ ID NO: 792803 - RNA, 20 nt, Mycobacterium avium subsp. paratuberculosis
ggcuuggugggcgccggcgu

SEQ ID NO: 792804 - RNA, 17 nt, Mycobacterium avium subsp. paratuberculosis
ggcuugaaaguccgccg

SEQ ID NO: 792805 - RNA, 19 nt, Mycobacterium avium subsp. paratuberculosis
ggcuugaaaguccgccgac

SEQ ID NO: 792806 - RNA, 20 nt, Mycobacterium avium subsp. paratuberculosis
ggcuugaaaguccgccgaca

SEQ ID NO: 792807 - RNA, 17 nt, Mycobacterium avium subsp. paratuberculosis
ggcuugaccggcucgcc

SEQ ID NO: 792808 - RNA, 14 nt, Mycobacterium avium subsp. paratuberculosis
gggauuggcggcca

SEQ ID NO: 792809 - RNA, 19 nt, Mycobacterium avium subsp. paratuberculosis
gggaugucgucgggcgcgg

SEQ ID NO: 792810 - RNA, 22 nt, Mycobacterium avium subsp. paratuberculosis
gggaugucgucgggcgcggugu

SEQ ID NO: 792811 - RNA, 15 nt, Mycobacterium avium subsp. paratuberculosis
gggaugucuagccgc

SEQ ID NO: 792812 - RNA, 18 nt, Mycobacterium avium subsp. paratuberculosis
gggaugucuagccgccga

SEQ ID NO: 792813 - RNA, 22 nt, Mycobacterium avium subsp. paratuberculosis
gggauggucgauccacucccgc

SEQ ID NO: 792814 - RNA, 13 nt, Mycobacterium avium subsp. paratuberculosis
gggauggugagcc

SEQ ID NO: 792815 - RNA, 21 nt, Mycobacterium avium subsp. paratuberculosis
gggauggugcgccgggucgcg

SEQ ID NO: 792816 - RNA, 17 nt, Mycobacterium avium subsp. paratuberculosis
gggaucggaccgcacca

SEQ ID NO: 792817 - RNA, 18 nt, Mycobacterium avium subsp. paratuberculosis
gggaucggaccgcaccac

SEQ ID NO: 792818 - RNA, 19 nt, Mycobacterium avium subsp. paratuberculosis
gggaucggaccgcaccacc

SEQ ID NO: 792819 - RNA, 16 nt, Mycobacterium avium subsp. paratuberculosis
gggaucggccggcgag

SEQ ID NO: 792820 - RNA, 13 nt, Mycobacterium avium subsp. paratuberculosis
gggaucggcgccc

SEQ ID NO: 792821 - RNA, 15 nt, Mycobacterium avium subsp. paratuberculosis
gggaucggcgcccac

SEQ ID NO: 792822 - RNA, 19 nt, Mycobacterium avium subsp. paratuberculosis
gggaucggcgcccaccgcg

SEQ ID NO: 792823 - RNA, 12 nt, Mycobacterium avium subsp. paratuberculosis
gggaucggcggc

SEQ ID NO: 792824 - RNA, 13 nt, Mycobacterium avium subsp. paratuberculosis
gggaucggcggcg

SEQ ID NO: 792825 - RNA, 15 nt, Mycobacterium avium subsp. paratuberculosis
gggaucggcggggcg

SEQ ID NO: 792826 - RNA, 14 nt, Mycobacterium avium subsp. paratuberculosis
gggauccucgccgc

SEQ ID NO: 792827 - RNA, 17 nt, Mycobacterium avium subsp. paratuberculosis
gggauccucgccgcggg

SEQ ID NO: 792828 - RNA, 23 nt, Mycobacterium avium subsp. paratuberculosis
gggauccgccugcgcgggcgcgg

SEQ ID NO: 792829 - RNA, 22 nt, Mycobacterium avium subsp. paratuberculosis
gggaucgaucccgucggccauc

SEQ ID NO: 792830 - RNA, 19 nt, Mycobacterium avium subsp. paratuberculosis
gggaucgcgcagccgcggu

SEQ ID NO: 792831 - RNA, 15 nt, Mycobacterium avium subsp. paratuberculosis
gggaucacgucggcg

SEQ ID NO: 792832 - RNA, 17 nt, Mycobacterium avium subsp. paratuberculosis
gggaucagccguaccga

SEQ ID NO: 792833 - RNA, 18 nt, Mycobacterium avium subsp. paratuberculosis
gggauccagcggcggccu

SEQ ID NO: 792834 - RNA, 19 nt, Mycobacterium avium subsp. paratuberculosis
gggaucagcuccucgcgga

SEQ ID NO: 792835 - RNA, 22 nt, Mycobacterium avium subsp. paratuberculosis
gggaucaggaugacgccgcggu

SEQ ID NO: 792836 - RNA, 22 nt, Mycobacterium avium subsp. paratuberculosis
gggaucccgaaaccgucgacca

SEQ ID NO: 792837 - RNA, 17 nt, Mycobacterium avium subsp. paratuberculosis
gggacgucgucguccca

SEQ ID NO: 792838 - RNA, 15 nt, Mycobacterium avium subsp. paratuberculosis
gggacgugucggggu

SEQ ID NO: 792839 - RNA, 13 nt, Mycobacterium avium subsp. paratuberculosis
gggacguugaugu

SEQ ID NO: 792840 - RNA, 16 nt, Mycobacterium avium subsp. paratuberculosis
gggacugcagcgcggu

SEQ ID NO: 792841 - RNA, 21 nt, Mycobacterium avium subsp. paratuberculosis
gggacugcgccggggccgcgg

SEQ ID NO: 792842 - RNA, 22 nt, Mycobacterium avium subsp. paratuberculosis
gggacugcgccggggccgcggc

SEQ ID NO: 792843 - RNA, 13 nt, Mycobacterium avium subsp. paratuberculosis
gggacuccgggga

SEQ ID NO: 792844 - RNA, 15 nt, Mycobacterium avium subsp. paratuberculosis
gggacuccggggacg

SEQ ID NO: 792845 - RNA, 14 nt, Mycobacterium avium subsp. paratuberculosis
gggacguccgcgcg

SEQ ID NO: 792846 - RNA, 16 nt, Mycobacterium avium subsp. paratuberculosis
gggacgggggugccga

SEQ ID NO: 792847 - RNA, 16 nt, Mycobacterium avium subsp. paratuberculosis
gggacgggucggcggc

SEQ ID NO: 792848 - RNA, 14 nt, Mycobacterium avium subsp. paratuberculosis
gggacgggucggug

SEQ ID NO: 792849 - RNA, 16 nt, Mycobacterium avium subsp. paratuberculosis
gggacgggucgguggu

SEQ ID NO: 792850 - RNA, 19 nt, Mycobacterium avium subsp. paratuberculosis
gggacgcugaacagcccga

SEQ ID NO: 792851 - RNA, 14 nt, Mycobacterium avium subsp. paratuberculosis
gggacggccagcag

SEQ ID NO: 792852 - RNA, 24 nt, Mycobacterium avium subsp. paratuberculosis
gggacgccguugacaccgggugcg

SEQ ID NO: 792853 - RNA, 14 nt, Mycobacterium avium subsp. paratuberculosis
gggacgccacggcg

SEQ ID NO: 792854 - RNA, 17 nt, Mycobacterium avium subsp. paratuberculosis
gggacgacggcgccgcc

SEQ ID NO: 792855 - RNA, 20 nt, Mycobacterium avium subsp. paratuberculosis
gggacgaucugcgucaugga

SEQ ID NO: 792856 - RNA, 15 nt, Mycobacterium avium subsp. paratuberculosis
gggcagcaccagcgg

SEQ ID NO: 792857 - RNA, 14 nt, Mycobacterium avium subsp. paratuberculosis
gggcagcacccgca

SEQ ID NO: 792858 - RNA, 17 nt, Mycobacterium avium subsp. paratuberculosis
gggcagcacccgcaccg

SEQ ID NO: 792859 - RNA, 21 nt, Mycobacterium avium subsp. paratuberculosis
gggcacuuaacaccucgccuc

SEQ ID NO: 792860 - RNA, 14 nt, Mycobacterium avium subsp. paratuberculosis
gggcagcagcacca

SEQ ID NO: 792861 - RNA, 18 nt, Mycobacterium avium subsp. paratuberculosis
gggcagcagcaccagcgc

SEQ ID NO: 792862 - RNA, 22 nt, Mycobacterium avium subsp. paratuberculosis
gggcagcagcaccagcgccgcg

SEQ ID NO: 792863 - RNA, 19 nt, Mycobacterium avium subsp. paratuberculosis
gggcagaucgucggcacug

SEQ ID NO: 792864 - RNA, 15 nt, Mycobacterium avium subsp. paratuberculosis
gggcagaugcccgcu

SEQ ID NO: 792865 - RNA, 17 nt, Mycobacterium avium subsp. paratuberculosis
gggcagcaaccggguca

SEQ ID NO: 792866 - RNA, 23 nt, Mycobacterium avium subsp. paratuberculosis
gggcagcaccucgcgcgcgagcc

SEQ ID NO: 792867 - RNA, 13 nt, Mycobacterium avium subsp. paratuberculosis
gggcagcucggcg

SEQ ID NO: 792868 - RNA, 15 nt, Mycobacterium avium subsp. paratuberculosis
gggcagcucggcggg

SEQ ID NO: 792869 - RNA, 23 nt, Mycobacterium avium subsp. paratuberculosis
gggcagcgaauacaccguccagc

SEQ ID NO: 792870 - RNA, 14 nt, Mycobacterium avium subsp. paratuberculosis
gggcagcgccacca

SEQ ID NO: 792871 - RNA, 14 nt, Mycobacterium avium subsp. paratuberculosis
gggcagcgcgacca

SEQ ID NO: 792872 - RNA, 19 nt, Mycobacterium avium subsp. paratuberculosis
gggcagcgcgaccagcccg

SEQ ID NO: 792873 - RNA, 19 nt, Mycobacterium avium subsp. paratuberculosis
gggcagcgcgauccgcgcg

SEQ ID NO: 792874 - RNA, 13 nt, Mycobacterium avium subsp. paratuberculosis
gggcagcgcggcc

SEQ ID NO: 792875 - RNA, 15 nt, Mycobacterium avium subsp. paratuberculosis
gggcagcgcggccag

SEQ ID NO: 792876 - RNA, 16 nt, Mycobacterium avium subsp. paratuberculosis
gggcagcgcggccagc

SEQ ID NO: 792877 - RNA, 17 nt, Mycobacterium avium subsp. paratuberculosis
gggcagcgcggccagca

SEQ ID NO: 792878 - RNA, 14 nt, Mycobacterium avium subsp. paratuberculosis
gggcagcggcccca

SEQ ID NO: 792879 - RNA, 22 nt, Mycobacterium avium subsp. paratuberculosis
gggcagccgcuuggccgggcgg

SEQ ID NO: 792880 - RNA, 13 nt, Mycobacterium avium subsp. paratuberculosis
gggcagccggcgc

SEQ ID NO: 792881 - RNA, 17 nt, Mycobacterium avium subsp. paratuberculosis
gggcagccggcgcccgc

SEQ ID NO: 792882 - RNA, 20 nt, Mycobacterium avium subsp. paratuberculosis
gggcagccgucgaugccggc

SEQ ID NO: 792883 - RNA, 16 nt, Mycobacterium avium subsp. paratuberculosis
gggcagcagcgcccac

SEQ ID NO: 792884 - RNA, 14 nt, Mycobacterium avium subsp. paratuberculosis
gggcagcagcucga

SEQ ID NO: 792885 - RNA, 19 nt, Mycobacterium avium subsp. paratuberculosis
gggcagcagcuuggcgaag

SEQ ID NO: 792886 - RNA, 19 nt, Mycobacterium avium subsp. paratuberculosis
gggcagccacgcgcaacca

SEQ ID NO: 792887 - RNA, 14 nt, Mycobacterium avium subsp. paratuberculosis
gggcagccagcccg

SEQ ID NO: 792888 - RNA, 20 nt, Mycobacterium avium subsp. paratuberculosis
gggcagcccagguaaucgaa

SEQ ID NO: 792889 - RNA, 16 nt, Mycobacterium avium subsp. paratuberculosis
gggcagccccagcgag

SEQ ID NO: 792890 - RNA, 13 nt, Mycobacterium avium subsp. paratuberculosis
gggcagcccgccg

SEQ ID NO: 792891 - RNA, 17 nt, Mycobacterium avium subsp. paratuberculosis
gggcagcccgccgacca

SEQ ID NO: 792892 - RNA, 14 nt, Mycobacterium avium subsp. paratuberculosis
gggcaccgcgaacg

SEQ ID NO: 792893 - RNA, 22 nt, Mycobacterium avium subsp. paratuberculosis
gggcaccagcgacagcacccgc

SEQ ID NO: 792894 - RNA, 14 nt, Mycobacterium avium subsp. paratuberculosis
gggcaccggcaccg

SEQ ID NO: 792895 - RNA, 15 nt, Mycobacterium avium subsp. paratuberculosis
gggcaccggcaccgc

SEQ ID NO: 792896 - RNA, 20 nt, Mycobacterium avium subsp. paratuberculosis
gggcaccacguccaccagca

SEQ ID NO: 792897 - RNA, 11 nt, Mycobacterium avium subsp. paratuberculosis
gggcaccagca

SEQ ID NO: 792898 - RNA, 21 nt, Mycobacterium avium subsp. paratuberculosis
gggcaccagcagcgcgacgcc

SEQ ID NO: 792899 - RNA, 17 nt, Mycobacterium avium subsp. paratuberculosis
gggcaccgacggccgca

SEQ ID NO: 792900 - RNA, 22 nt, Mycobacterium avium subsp. paratuberculosis
gggcaccgacggccgcacccca

SEQ ID NO: 792901 - RNA, 15 nt, Mycobacterium avium subsp. paratuberculosis
gggcaacagcgcgcc

SEQ ID NO: 792902 - RNA, 22 nt, Mycobacterium avium subsp. paratuberculosis
gggcaacagcgcgccggccggc

SEQ ID NO: 792903 - RNA, 17 nt, Mycobacterium avium subsp. paratuberculosis
gggcaaccacagcggcg

SEQ ID NO: 792904 - RNA, 20 nt, Mycobacterium avium subsp. paratuberculosis
gggcaccccugccgccaccg

SEQ ID NO: 792905 - RNA, 19 nt, Mycobacterium avium subsp. paratuberculosis
gggcacccgcgcgucgcgc

SEQ ID NO: 792906 - RNA, 22 nt, Mycobacterium avium subsp. paratuberculosis
gggcacccgcgcgucgcgcagc

SEQ ID NO: 792907 - RNA, 17 nt, Mycobacterium avium subsp. paratuberculosis
gggcacccggcgcggcc

SEQ ID NO: 792908 - RNA, 19 nt, Mycobacterium avium subsp. paratuberculosis
gggcacccggcgcggccgc

SEQ ID NO: 792909 - RNA, 23 nt, Mycobacterium avium subsp. paratuberculosis
gggcacccggcgcggccgcccag

SEQ ID NO: 792910 - RNA, 11 nt, Mycobacterium avium subsp. paratuberculosis
gggcaccgacg

SEQ ID NO: 792911 - RNA, 20 nt, Mycobacterium avium subsp. paratuberculosis
gggcacgacggucagcacgc

SEQ ID NO: 792912 - RNA, 22 nt, Mycobacterium avium subsp. paratuberculosis
gggcaccgucgucgcaccggca

SEQ ID NO: 792913 - RNA, 15 nt, Mycobacterium avium subsp. paratuberculosis
gggcacgcgcgcccg

SEQ ID NO: 792914 - RNA, 18 nt, Mycobacterium avium subsp. paratuberculosis
gggcacgcgcgcccggca

SEQ ID NO: 792915 - RNA, 20 nt, Mycobacterium avium subsp. paratuberculosis
gggcacgguguagcugcggg

SEQ ID NO: 792916 - RNA, 20 nt, Mycobacterium avium subsp. paratuberculosis
gggcacguccagcccgcgcc

SEQ ID NO: 792917 - RNA, 14 nt, Mycobacterium avium subsp. paratuberculosis
gggcacgucggcca

SEQ ID NO: 792918 - RNA, 19 nt, Mycobacterium avium subsp. paratuberculosis
gggcacgucggccaggauc

SEQ ID NO: 792919 - RNA, 20 nt, Mycobacterium avium subsp. paratuberculosis
gggcgagaccgucggugcgg

SEQ ID NO: 792920 - RNA, 15 nt, Mycobacterium avium subsp. paratuberculosis
gggcgagccgacagu

SEQ ID NO: 792921 - RNA, 18 nt, Mycobacterium avium subsp. paratuberculosis
gggcgacuucguuggugg

SEQ ID NO: 792922 - RNA, 18 nt, Mycobacterium avium subsp. paratuberculosis
gggcgacuucuucgccgg

SEQ ID NO: 792923 - RNA, 14 nt, Mycobacterium avium subsp. paratuberculosis
gggcgacuccggcg

SEQ ID NO: 792924 - RNA, 15 nt, Mycobacterium avium subsp. paratuberculosis
gggcgacuccggcgc

SEQ ID NO: 792925 - RNA, 17 nt, Mycobacterium avium subsp. paratuberculosis
gggcgacuccggcgccg

SEQ ID NO: 792926 - RNA, 23 nt, Mycobacterium avium subsp. paratuberculosis
gggcgacuccggcgccggucagc

SEQ ID NO: 792927 - RNA, 19 nt, Mycobacterium avium subsp. paratuberculosis
gggcgacgucgucgcccac

SEQ ID NO: 792928 - RNA, 13 nt, Mycobacterium avium subsp. paratuberculosis
gggcgacggcggc

SEQ ID NO: 792929 - RNA, 14 nt, Mycobacterium avium subsp. paratuberculosis
gggcgacggcggcg

SEQ ID NO: 792930 - RNA, 15 nt, Mycobacterium avium subsp. paratuberculosis
gggcgacggcggcga

SEQ ID NO: 792931 - RNA, 20 nt, Mycobacterium avium subsp. paratuberculosis
gggccuggcgcuccagccac

SEQ ID NO: 792932 - RNA, 22 nt, Mycobacterium avium subsp. paratuberculosis
gggcgaccuugcgcagccggca

SEQ ID NO: 792933 - RNA, 12 nt, Mycobacterium avium subsp. paratuberculosis
gggcgacgccgc

SEQ ID NO: 792934 - RNA, 14 nt, Mycobacterium avium subsp. paratuberculosis
gggcgacgccgcgg

SEQ ID NO: 792935 - RNA, 13 nt, Mycobacterium avium subsp. paratuberculosis
gggcgauccgcag

SEQ ID NO: 792936 - RNA, 23 nt, Mycobacterium avium subsp. paratuberculosis
gggcgauccgcaggccgucgccg

SEQ ID NO: 792937 - RNA, 15 nt, Mycobacterium avium subsp. paratuberculosis
gggcgaucagcccgc

SEQ ID NO: 792938 - RNA, 18 nt, Mycobacterium avium subsp. paratuberculosis
gggcgaucagcccgccca

SEQ ID NO: 792939 - RNA, 21 nt, Mycobacterium avium subsp. paratuberculosis
gggcgaucgacaccagcgugu

SEQ ID NO: 792940 - RNA, 14 nt, Mycobacterium avium subsp. paratuberculosis
gggcgaucuccagc

SEQ ID NO: 792941 - RNA, 16 nt, Mycobacterium avium subsp. paratuberculosis
gggcgagcuggccgcc

SEQ ID NO: 792942 - RNA, 19 nt, Mycobacterium avium subsp. paratuberculosis
gggcgagcuggccgcccac

SEQ ID NO: 792943 - RNA, 16 nt, Mycobacterium avium subsp. paratuberculosis
gggcgaguacaccucg

SEQ ID NO: 792944 - RNA, 18 nt, Mycobacterium avium subsp. paratuberculosis
gggcgauaaccucggcgg

SEQ ID NO: 792945 - RNA, 20 nt, Mycobacterium avium subsp. paratuberculosis
gggcgauaaccucggcggcg

SEQ ID NO: 792946 - RNA, 21 nt, Mycobacterium avium subsp. paratuberculosis
gggcgauaaccucggcggcgg

SEQ ID NO: 792947 - RNA, 14 nt, Mycobacterium avium subsp. paratuberculosis
gggcgaucaccgcg

SEQ ID NO: 792948 - RNA, 15 nt, Mycobacterium avium subsp. paratuberculosis
gggcgaucaccgcgg

SEQ ID NO: 792949 - RNA, 18 nt, Mycobacterium avium subsp. paratuberculosis
gggcgaucaccgcggcca

SEQ ID NO: 792950 - RNA, 18 nt, Mycobacterium avium subsp. paratuberculosis
gggcgcgcugucgacgcg

SEQ ID NO: 792951 - RNA, 17 nt, Mycobacterium avium subsp. paratuberculosis
gggcgcggcgcaccgag

SEQ ID NO: 792952 - RNA, 12 nt, Mycobacterium avium subsp. paratuberculosis
gggcgcgggauc

SEQ ID NO: 792953 - RNA, 12 nt, Mycobacterium avium subsp. paratuberculosis
gggcgcgggcgg

SEQ ID NO: 792954 - RNA, 14 nt, Mycobacterium avium subsp. paratuberculosis
gggcgcggaccgca

SEQ ID NO: 792955 - RNA, 21 nt, Mycobacterium avium subsp. paratuberculosis
gggcgaucucgauggccacgc

SEQ ID NO: 792956 - RNA, 22 nt, Mycobacterium avium subsp. paratuberculosis
gggcgaucucuucgaugccggu

SEQ ID NO: 792957 - RNA, 20 nt, Mycobacterium avium subsp. paratuberculosis
gggcgcgccggcgcgcagcc

SEQ ID NO: 792958 - RNA, 13 nt, Mycobacterium avium subsp. paratuberculosis
gggcgcgcgccgg

SEQ ID NO: 792959 - RNA, 13 nt, Mycobacterium avium subsp. paratuberculosis
gggcgcgcgcgcc

SEQ ID NO: 792960 - RNA, 16 nt, Mycobacterium avium subsp. paratuberculosis
gggcgcgcgcgccacg

SEQ ID NO: 792961 - RNA, 18 nt, Mycobacterium avium subsp. paratuberculosis
gggcgcgcugggcuaacg

SEQ ID NO: 792962 - RNA, 17 nt, Mycobacterium avium subsp. paratuberculosis
gggcggauuggugccga

SEQ ID NO: 792963 - RNA, 21 nt, Mycobacterium avium subsp. paratuberculosis
gggcggauuggugccgaucac

SEQ ID NO: 792964 - RNA, 13 nt, Mycobacterium avium subsp. paratuberculosis
gggcggcaccgau

SEQ ID NO: 792965 - RNA, 13 nt, Mycobacterium avium subsp. paratuberculosis
gggcggcaccgcu

SEQ ID NO: 792966 - RNA, 22 nt, Mycobacterium avium subsp. paratuberculosis
gggcggcaccgcugccggccga

SEQ ID NO: 792967 - RNA, 22 nt, Mycobacterium avium subsp. paratuberculosis
gggcggcagcagcugcgucggc

SEQ ID NO: 792968 - RNA, 16 nt, Mycobacterium avium subsp. paratuberculosis
gggcggacugcccgac

SEQ ID NO: 792969 - RNA, 23 nt, Mycobacterium avium subsp. paratuberculosis
gggcggacugcccgaccgcgccg

SEQ ID NO: 792970 - RNA, 18 nt, Mycobacterium avium subsp. paratuberculosis
gggcgcugagcacggugg

SEQ ID NO: 792971 - RNA, 19 nt, Mycobacterium avium subsp. paratuberculosis
gggcgcggcggcaaccagc

SEQ ID NO: 792972 - RNA, 21 nt, Mycobacterium avium subsp. paratuberculosis
gggcgcgucguagccggcacg

SEQ ID NO: 792973 - RNA, 22 nt, Mycobacterium avium subsp. paratuberculosis
gggcgcgucguagccggcacgc

SEQ ID NO: 792974 - RNA, 19 nt, Mycobacterium avium subsp. paratuberculosis
gggcgcgugcacaccggcc

SEQ ID NO: 792975 - RNA, 17 nt, Mycobacterium avium subsp. paratuberculosis
gggcgcguccgcgggcg

SEQ ID NO: 792976 - RNA, 16 nt, Mycobacterium avium subsp. paratuberculosis
gggcgggaucgcggcg

SEQ ID NO: 792977 - RNA, 18 nt, Mycobacterium avium subsp. paratuberculosis
gggcggcguccucgacca

SEQ ID NO: 792978 - RNA, 14 nt, Mycobacterium avium subsp. paratuberculosis
gggcggcgacgucg

SEQ ID NO: 792979 - RNA, 13 nt, Mycobacterium avium subsp. paratuberculosis
gggcggcgaugcg

SEQ ID NO: 792980 - RNA, 13 nt, Mycobacterium avium subsp. paratuberculosis
gggcggcggcugg

SEQ ID NO: 792981 - RNA, 22 nt, Mycobacterium avium subsp. paratuberculosis
gggcggcggcugggccgcggcg

SEQ ID NO: 792982 - RNA, 15 nt, Mycobacterium avium subsp. paratuberculosis
gggcggcgggcgaag

SEQ ID NO: 792983 - RNA, 13 nt, Mycobacterium avium subsp. paratuberculosis
gggcggcgguacc

SEQ ID NO: 792984 - RNA, 14 nt, Mycobacterium avium subsp. paratuberculosis
gggcggugaccacg

SEQ ID NO: 792985 - RNA, 16 nt, Mycobacterium avium subsp. paratuberculosis
gggcgguccgcuccac

SEQ ID NO: 792986 - RNA, 18 nt, Mycobacterium avium subsp. paratuberculosis
gggcgguccgcuccacca

SEQ ID NO: 792987 - RNA, 15 nt, Mycobacterium avium subsp. paratuberculosis
gggcggucgcgcagc

SEQ ID NO: 792988 - RNA, 22 nt, Mycobacterium avium subsp. paratuberculosis
gggcggucgcgucgucggcggg

SEQ ID NO: 792989 - RNA, 14 nt, Mycobacterium avium subsp. paratuberculosis
gggcgggcugcggg

SEQ ID NO: 792990 - RNA, 15 nt, Mycobacterium avium subsp. paratuberculosis
gggcgggcagcacca

SEQ ID NO: 792991 - RNA, 12 nt, Mycobacterium avium subsp. paratuberculosis
gggcgggccgca

SEQ ID NO: 792992 - RNA, 13 nt, Mycobacterium avium subsp. paratuberculosis
gggcggcgcggcg

SEQ ID NO: 792993 - RNA, 15 nt, Mycobacterium avium subsp. paratuberculosis
gggcggcgcggcgca

SEQ ID NO: 792994 - RNA, 17 nt, Mycobacterium avium subsp. paratuberculosis
gggcggcgcggcgcagc

SEQ ID NO: 792995 - RNA, 18 nt, Mycobacterium avium subsp. paratuberculosis
gggcggcgcggcgcagcg

SEQ ID NO: 792996 - RNA, 15 nt, Mycobacterium avium subsp. paratuberculosis
gggcggcgcggcggu

SEQ ID NO: 792997 - RNA, 12 nt, Mycobacterium avium subsp. paratuberculosis
gggcggcgcgcg

SEQ ID NO: 792998 - RNA, 17 nt, Mycobacterium avium subsp. paratuberculosis
gggcggcgcgcgccagc

SEQ ID NO: 792999 - RNA, 18 nt, Mycobacterium avium subsp. paratuberculosis
gggcggcgcgcgccagcg

SEQ ID NO: 793000 - RNA, 12 nt, Mycobacterium avium subsp. paratuberculosis
gggcggcgcgcu

SEQ ID NO: 793001 - RNA, 12 nt, Mycobacterium avium subsp. paratuberculosis
gggcggcggcca

SEQ ID NO: 793002 - RNA, 13 nt, Mycobacterium avium subsp. paratuberculosis
gggcggcggccac

SEQ ID NO: 793003 - RNA, 22 nt, Mycobacterium avium subsp. paratuberculosis
gggcggcggccaccucgccgca

SEQ ID NO: 793004 - RNA, 19 nt, Mycobacterium avium subsp. paratuberculosis
gggcggcggccuccggaug

SEQ ID NO: 793005 - RNA, 13 nt, Mycobacterium avium subsp. paratuberculosis
gggcggcgcaguc

SEQ ID NO: 793006 - RNA, 20 nt, Mycobacterium avium subsp. paratuberculosis
gggcggcgccgaacucggcg

SEQ ID NO: 793007 - RNA, 14 nt, Mycobacterium avium subsp. paratuberculosis
gggcggcgccgcgg

SEQ ID NO: 793008 - RNA, 14 nt, Mycobacterium avium subsp. paratuberculosis
gggcggcgccggca

SEQ ID NO: 793009 - RNA, 17 nt, Mycobacterium avium subsp. paratuberculosis
gggcggcgacaucgccg

SEQ ID NO: 793010 - RNA, 18 nt, Mycobacterium avium subsp. paratuberculosis
gggcggcgaacaccagca

SEQ ID NO: 793011 - RNA, 12 nt, Mycobacterium avium subsp. paratuberculosis
gggcggccggcu

SEQ ID NO: 793012 - RNA, 21 nt, Mycobacterium avium subsp. paratuberculosis
gggcggccaccaacggcagca

SEQ ID NO: 793013 - RNA, 13 nt, Mycobacterium avium subsp. paratuberculosis
gggcggccgaucc

SEQ ID NO: 793014 - RNA, 13 nt, Mycobacterium avium subsp. paratuberculosis
gggcggccgccgg

SEQ ID NO: 793015 - RNA, 21 nt, Mycobacterium avium subsp. paratuberculosis
gggcggccgccgggccggcgg

SEQ ID NO: 793016 - RNA, 15 nt, Mycobacterium avium subsp. paratuberculosis
gggcggccggccagu

SEQ ID NO: 793017 - RNA, 19 nt, Mycobacterium avium subsp. paratuberculosis
gggcggcccgcacggccgc

SEQ ID NO: 793018 - RNA, 20 nt, Mycobacterium avium subsp. paratuberculosis
gggcggcccggguggacgcc

SEQ ID NO: 793019 - RNA, 16 nt, Mycobacterium avium subsp. paratuberculosis
gggcggcagggccagc

SEQ ID NO: 793020 - RNA, 18 nt, Mycobacterium avium subsp. paratuberculosis
gggcggcagggccagcac

SEQ ID NO: 793021 - RNA, 18 nt, Mycobacterium avium subsp. paratuberculosis
gggcggccagccgcgcgg

SEQ ID NO: 793022 - RNA, 13 nt, Mycobacterium avium subsp. paratuberculosis
gggcggccagcgu

SEQ ID NO: 793023 - RNA, 19 nt, Mycobacterium avium subsp. paratuberculosis
gggcggauccccgcgcugg

SEQ ID NO: 793024 - RNA, 15 nt, Mycobacterium avium subsp. paratuberculosis
gggcggcaucgcgcc

SEQ ID NO: 793025 - RNA, 17 nt, Mycobacterium avium subsp. paratuberculosis
gggcggcaucgcgccgc

SEQ ID NO: 793026 - RNA, 18 nt, Mycobacterium avium subsp. paratuberculosis
gggcggcaucgcgccgca

SEQ ID NO: 793027 - RNA, 19 nt, Mycobacterium avium subsp. paratuberculosis
gggcggcaucgcgcgcggc

SEQ ID NO: 793028 - RNA, 15 nt, Mycobacterium avium subsp. paratuberculosis
gggccgcggcgccgu

SEQ ID NO: 793029 - RNA, 14 nt, Mycobacterium avium subsp. paratuberculosis
gggccgcggcucgc

SEQ ID NO: 793030 - RNA, 13 nt, Mycobacterium avium subsp. paratuberculosis
gggccgcggcggu

SEQ ID NO: 793031 - RNA, 19 nt, Mycobacterium avium subsp. paratuberculosis
gggccgcggcgucgggaug

SEQ ID NO: 793032 - RNA, 12 nt, Mycobacterium avium subsp. paratuberculosis
gggccgcgcggg

SEQ ID NO: 793033 - RNA, 13 nt, Mycobacterium avium subsp. paratuberculosis
gggccgcggccgc

SEQ ID NO: 793034 - RNA, 14 nt, Mycobacterium avium subsp. paratuberculosis
gggccgcggccggc

SEQ ID NO: 793035 - RNA, 15 nt, Mycobacterium avium subsp. paratuberculosis
gggccgcggccggca

SEQ ID NO: 793036 - RNA, 19 nt, Mycobacterium avium subsp. paratuberculosis
gggccgcuggccgccccga

SEQ ID NO: 793037 - RNA, 18 nt, Mycobacterium avium subsp. paratuberculosis
gggccgcuacgccgaggc

SEQ ID NO: 793038 - RNA, 18 nt, Mycobacterium avium subsp. paratuberculosis
gggccggacacggcugca

SEQ ID NO: 793039 - RNA, 13 nt, Mycobacterium avium subsp. paratuberculosis
gggccgggcaccg

SEQ ID NO: 793040 - RNA, 16 nt, Mycobacterium avium subsp. paratuberculosis
gggccggcgccggugc

SEQ ID NO: 793041 - RNA, 17 nt, Mycobacterium avium subsp. paratuberculosis
gggccggcggcggccag

SEQ ID NO: 793042 - RNA, 18 nt, Mycobacterium avium subsp. paratuberculosis
gggccggcggcggccagc

SEQ ID NO: 793043 - RNA, 18 nt, Mycobacterium avium subsp. paratuberculosis
gggccggcgggggcgcgu

SEQ ID NO: 793044 - RNA, 13 nt, Mycobacterium avium subsp. paratuberculosis
gggccggcgcccg

SEQ ID NO: 793045 - RNA, 13 nt, Mycobacterium avium subsp. paratuberculosis
gggccggcgccga

SEQ ID NO: 793046 - RNA, 16 nt, Mycobacterium avium subsp. paratuberculosis
gggccggcgccgaagc

SEQ ID NO: 793047 - RNA, 12 nt, Mycobacterium avium subsp. paratuberculosis
gggccggccgcc

SEQ ID NO: 793048 - RNA, 15 nt, Mycobacterium avium subsp. paratuberculosis
gggccggccgcccgc

SEQ ID NO: 793049 - RNA, 12 nt, Mycobacterium avium subsp. paratuberculosis
gggccggccgga

SEQ ID NO: 793050 - RNA, 18 nt, Mycobacterium avium subsp. paratuberculosis
gggccggacggugacgcc

SEQ ID NO: 793051 - RNA, 20 nt, Mycobacterium avium subsp. paratuberculosis
gggccggcacuucgaucauc

SEQ ID NO: 793052 - RNA, 12 nt, Mycobacterium avium subsp. paratuberculosis
gggccggcagcc

SEQ ID NO: 793053 - RNA, 15 nt, Mycobacterium avium subsp. paratuberculosis
gggcgacaucggcac

SEQ ID NO: 793054 - RNA, 19 nt, Mycobacterium avium subsp. paratuberculosis
gggcgaccaccacggccgc

SEQ ID NO: 793055 - RNA, 20 nt, Mycobacterium avium subsp. paratuberculosis
gggcgaccaccacggccgca

SEQ ID NO: 793056 - RNA, 21 nt, Mycobacterium avium subsp. paratuberculosis
gggcgaccaccacggccgcag

SEQ ID NO: 793057 - RNA, 13 nt, Mycobacterium avium subsp. paratuberculosis
gggcgaccacguc

SEQ ID NO: 793058 - RNA, 16 nt, Mycobacterium avium subsp. paratuberculosis
gggcgaccaugccgcg

SEQ ID NO: 793059 - RNA, 20 nt, Mycobacterium avium subsp. paratuberculosis
gggcgaccccggccaggauc

SEQ ID NO: 793060 - RNA, 14 nt, Mycobacterium avium subsp. paratuberculosis
gggcgaccugcggg

SEQ ID NO: 793061 - RNA, 19 nt, Mycobacterium avium subsp. paratuberculosis
gggcgaccuggacgccgca

SEQ ID NO: 793062 - RNA, 17 nt, Mycobacterium avium subsp. paratuberculosis
gggcgaccuggugcucg

SEQ ID NO: 793063 - RNA, 18 nt, Mycobacterium avium subsp. paratuberculosis
gggcgaccuggugcucga

SEQ ID NO: 793064 - RNA, 21 nt, Mycobacterium avium subsp. paratuberculosis
gggcgaaucugucgauggcgg

SEQ ID NO: 793065 - RNA, 20 nt, Mycobacterium avium subsp. paratuberculosis
gggcgacaccccgcgaguca

SEQ ID NO: 793066 - RNA, 16 nt, Mycobacterium avium subsp. paratuberculosis
gggccugcagcaccag

SEQ ID NO: 793067 - RNA, 17 nt, Mycobacterium avium subsp. paratuberculosis
gggccugcagcaccagg

SEQ ID NO: 793068 - RNA, 13 nt, Mycobacterium avium subsp. paratuberculosis
gggccucgccgcu

SEQ ID NO: 793069 - RNA, 22 nt, Mycobacterium avium subsp. paratuberculosis
gggccugcucgcuugccagccg

SEQ ID NO: 793070 - RNA, 13 nt, Mycobacterium avium subsp. paratuberculosis
gggccugcgcgcc

SEQ ID NO: 793071 - RNA, 15 nt, Mycobacterium avium subsp. paratuberculosis
gggccugcgcgccga

SEQ ID NO: 793072 - RNA, 18 nt, Mycobacterium avium subsp. paratuberculosis
gggccugcggcgcggcca

SEQ ID NO: 793073 - RNA, 19 nt, Mycobacterium avium subsp. paratuberculosis
gggccugcggcgcggccac

SEQ ID NO: 793074 - RNA, 14 nt, Mycobacterium avium subsp. paratuberculosis
gggccugcggcggc

SEQ ID NO: 793075 - RNA, 16 nt, Mycobacterium avium subsp. paratuberculosis
gggccugcggcggccg

SEQ ID NO: 793076 - RNA, 16 nt, Mycobacterium avium subsp. paratuberculosis
gggccuaggaccccgg

SEQ ID NO: 793077 - RNA, 13 nt, Mycobacterium avium subsp. paratuberculosis
gggccuccaccag

SEQ ID NO: 793078 - RNA, 18 nt, Mycobacterium avium subsp. paratuberculosis
gggccuccaccagcggcg

SEQ ID NO: 793079 - RNA, 14 nt, Mycobacterium avium subsp. paratuberculosis
gggccuccagccag

SEQ ID NO: 793080 - RNA, 22 nt, Mycobacterium avium subsp. paratuberculosis
gggccuccagccagcgcgcgau

SEQ ID NO: 793081 - RNA, 15 nt, Mycobacterium avium subsp. paratuberculosis
gggccuccggcggca

SEQ ID NO: 793082 - RNA, 18 nt, Mycobacterium avium subsp. paratuberculosis
gggcagcucgucggcgcg

SEQ ID NO: 793083 - RNA, 20 nt, Mycobacterium avium subsp. paratuberculosis
gggcagcucgucggcgcgcc

SEQ ID NO: 793084 - RNA, 22 nt, Mycobacterium avium subsp. paratuberculosis
gggcagcucgucggcgcgccac

SEQ ID NO: 793085 - RNA, 13 nt, Mycobacterium avium subsp. paratuberculosis
gggcagcgguguc

SEQ ID NO: 793086 - RNA, 17 nt, Mycobacterium avium subsp. paratuberculosis
gggcaggcggcgcgcca

SEQ ID NO: 793087 - RNA, 21 nt, Mycobacterium avium subsp. paratuberculosis
gggcaggcggcgcgccagcgu

SEQ ID NO: 793088 - RNA, 15 nt, Mycobacterium avium subsp. paratuberculosis
gggcaggcccgagcc

SEQ ID NO: 793089 - RNA, 23 nt, Mycobacterium avium subsp. paratuberculosis
gggcaggccgggauagagcaccg

SEQ ID NO: 793090 - RNA, 23 nt, Mycobacterium avium subsp. paratuberculosis
gggcagcuuccgccucggcgagg

SEQ ID NO: 793091 - RNA, 16 nt, Mycobacterium avium subsp. paratuberculosis
gggcaggcacgguguc

SEQ ID NO: 793092 - RNA, 21 nt, Mycobacterium avium subsp. paratuberculosis
gggcaucaucgcuacacccca

SEQ ID NO: 793093 - RNA, 15 nt, Mycobacterium avium subsp. paratuberculosis
gggcccgcagccgcu

SEQ ID NO: 793094 - RNA, 20 nt, Mycobacterium avium subsp. paratuberculosis
gggcagugcacgacgaccgc

SEQ ID NO: 793095 - RNA, 22 nt, Mycobacterium avium subsp. paratuberculosis
gggcagugcacgacgaccgcgu

SEQ ID NO: 793096 - RNA, 20 nt, Mycobacterium avium subsp. paratuberculosis
gggcaguuccuugcgcagca

SEQ ID NO: 793097 - RNA, 13 nt, Mycobacterium avium subsp. paratuberculosis
gggcaguugccgg

SEQ ID NO: 793098 - RNA, 18 nt, Mycobacterium avium subsp. paratuberculosis
gggcaguugccggccauc

SEQ ID NO: 793099 - RNA, 21 nt, Mycobacterium avium subsp. paratuberculosis
gggcagguucauccccgcggc

SEQ ID NO: 793100 - RNA, 17 nt, Mycobacterium avium subsp. paratuberculosis
gggcagggaauucagcc

SEQ ID NO: 793101 - RNA, 21 nt, Mycobacterium avium subsp. paratuberculosis
gggcagggggacgaaccagug

SEQ ID NO: 793102 - RNA, 16 nt, Mycobacterium avium subsp. paratuberculosis
gggccgccgcggccac

SEQ ID NO: 793103 - RNA, 17 nt, Mycobacterium avium subsp. paratuberculosis
gggccgccgcggccaca

SEQ ID NO: 793104 - RNA, 17 nt, Mycobacterium avium subsp. paratuberculosis
gggccgccgcggcggca

SEQ ID NO: 793105 - RNA, 14 nt, Mycobacterium avium subsp. paratuberculosis
gggccgccggccgc

SEQ ID NO: 793106 - RNA, 15 nt, Mycobacterium avium subsp. paratuberculosis
gggccgccggguggc

SEQ ID NO: 793107 - RNA, 18 nt, Mycobacterium avium subsp. paratuberculosis
gggccgccgucgccacca

SEQ ID NO: 793108 - RNA, 13 nt, Mycobacterium avium subsp. paratuberculosis
gggccgaacgaug

SEQ ID NO: 793109 - RNA, 20 nt, Mycobacterium avium subsp. paratuberculosis
gggccgaagccgacaccggg

SEQ ID NO: 793110 - RNA, 13 nt, Mycobacterium avium subsp. paratuberculosis
gggccgcccgcug

SEQ ID NO: 793111 - RNA, 20 nt, Mycobacterium avium subsp. paratuberculosis
gggccgcccggcgcgccgca

SEQ ID NO: 793112 - RNA, 12 nt, Mycobacterium avium subsp. paratuberculosis
gggccgccgagc

SEQ ID NO: 793113 - RNA, 19 nt, Mycobacterium avium subsp. paratuberculosis
gggccgccgaugcgcccgc

SEQ ID NO: 793114 - RNA, 20 nt, Mycobacterium avium subsp. paratuberculosis
gggccgccgaugcgcccgcu

SEQ ID NO: 793115 - RNA, 21 nt, Mycobacterium avium subsp. paratuberculosis
gggccgccgaugcgcccgcug

SEQ ID NO: 793116 - RNA, 22 nt, Mycobacterium avium subsp. paratuberculosis
gggccgccgcauaccgcccgcg

SEQ ID NO: 793117 - RNA, 14 nt, Mycobacterium avium subsp. paratuberculosis
gggccgccgcgaua

SEQ ID NO: 793118 - RNA, 20 nt, Mycobacterium avium subsp. paratuberculosis
gggcccgggaugggccugga

SEQ ID NO: 793119 - RNA, 23 nt, Mycobacterium avium subsp. paratuberculosis
gggcccucggacgggagacgcug

SEQ ID NO: 793120 - RNA, 18 nt, Mycobacterium avium subsp. paratuberculosis
gggcccggguggcgucca

SEQ ID NO: 793121 - RNA, 19 nt, Mycobacterium avium subsp. paratuberculosis
gggcccggucgucgccgga

SEQ ID NO: 793122 - RNA, 13 nt, Mycobacterium avium subsp. paratuberculosis
gggcccgucccca

SEQ ID NO: 793123 - RNA, 22 nt, Mycobacterium avium subsp. paratuberculosis
gggcccguccccaccaccgaca

SEQ ID NO: 793124 - RNA, 20 nt, Mycobacterium avium subsp. paratuberculosis
gggcccgucgccggcgcgca

SEQ ID NO: 793125 - RNA, 21 nt, Mycobacterium avium subsp. paratuberculosis
gggcccgucgccggcgcgcag

SEQ ID NO: 793126 - RNA, 16 nt, Mycobacterium avium subsp. paratuberculosis
gggcccgccgucgacc

SEQ ID NO: 793127 - RNA, 17 nt, Mycobacterium avium subsp. paratuberculosis
gggcccgccgucgacca

SEQ ID NO: 793128 - RNA, 20 nt, Mycobacterium avium subsp. paratuberculosis
gggcccgcucaccugcggcc

SEQ ID NO: 793129 - RNA, 16 nt, Mycobacterium avium subsp. paratuberculosis
gggcccgcugcagcgc

SEQ ID NO: 793130 - RNA, 15 nt, Mycobacterium avium subsp. paratuberculosis
gggcccggcccggcg

SEQ ID NO: 793131 - RNA, 13 nt, Mycobacterium avium subsp. paratuberculosis
gggcccggccgcc

SEQ ID NO: 793132 - RNA, 15 nt, Mycobacterium avium subsp. paratuberculosis
gggcccggccgccag

SEQ ID NO: 793133 - RNA, 16 nt, Mycobacterium avium subsp. paratuberculosis
gggcccggccgccagc

SEQ ID NO: 793134 - RNA, 21 nt, Mycobacterium avium subsp. paratuberculosis
gggcccgcccgcagcggcggu

SEQ ID NO: 793135 - RNA, 13 nt, Mycobacterium avium subsp. paratuberculosis
gggcccgcgcacc

SEQ ID NO: 793136 - RNA, 17 nt, Mycobacterium avium subsp. paratuberculosis
gggcccgcgcaccguca

SEQ ID NO: 793137 - RNA, 13 nt, Mycobacterium avium subsp. paratuberculosis
gggcccgcgccgc

SEQ ID NO: 793138 - RNA, 19 nt, Mycobacterium avium subsp. paratuberculosis
gggcccgcgcggcgguguc

SEQ ID NO: 793139 - RNA, 14 nt, Mycobacterium avium subsp. paratuberculosis
gggcccgcgggauc

SEQ ID NO: 793140 - RNA, 22 nt, Mycobacterium avium subsp. paratuberculosis
ggcgaauuccccguagucaccc

SEQ ID NO: 793141 - RNA, 21 nt, Mycobacterium avium subsp. paratuberculosis
ggcgacaacaggcgaccucgg

SEQ ID NO: 793142 - RNA, 20 nt, Mycobacterium avium subsp. paratuberculosis
ggcgaugccuuccucggcgc

SEQ ID NO: 793143 - RNA, 21 nt, Mycobacterium avium subsp. paratuberculosis
ggcgaugcgcacgucggccgc

SEQ ID NO: 793144 - RNA, 23 nt, Mycobacterium avium subsp. paratuberculosis
ggcgaugcgcacgucggccgcca

SEQ ID NO: 793145 - RNA, 14 nt, Mycobacterium avium subsp. paratuberculosis
ggcgaaugcggcca

SEQ ID NO: 793146 - RNA, 21 nt, Mycobacterium avium subsp. paratuberculosis
ggcgaauucggugaucgcggu

SEQ ID NO: 793147 - RNA, 15 nt, Mycobacterium avium subsp. paratuberculosis
ggcgaugcgcggccc

SEQ ID NO: 793148 - RNA, 16 nt, Mycobacterium avium subsp. paratuberculosis
ggcgaugcggcccggc

SEQ ID NO: 793149 - RNA, 20 nt, Mycobacterium avium subsp. paratuberculosis
ggcgaugcggcccggccacu

SEQ ID NO: 793150 - RNA, 13 nt, Mycobacterium avium subsp. paratuberculosis
ggcgaugcggguc

SEQ ID NO: 793151 - RNA, 18 nt, Mycobacterium avium subsp. paratuberculosis
ggcgaugcgggucacggu

SEQ ID NO: 793152 - RNA, 21 nt, Mycobacterium avium subsp. paratuberculosis
ggcgaugcgggucacggucag

SEQ ID NO: 793153 - RNA, 21 nt, Mycobacterium avium subsp. paratuberculosis
ggcgcaaccaacucgcgaugu

SEQ ID NO: 793154 - RNA, 23 nt, Mycobacterium avium subsp. paratuberculosis
ggcgauuaggucgguggccacca

SEQ ID NO: 793155 - RNA, 19 nt, Mycobacterium avium subsp. paratuberculosis
ggcgauguugaccacccgc

SEQ ID NO: 793156 - RNA, 22 nt, Mycobacterium avium subsp. paratuberculosis
ggcgauguaggacgccgcaccg

SEQ ID NO: 793157 - RNA, 13 nt, Mycobacterium avium subsp. paratuberculosis
ggcgaugucgucg

SEQ ID NO: 793158 - RNA, 16 nt, Mycobacterium avium subsp. paratuberculosis
ggcgaugucgucgacg

SEQ ID NO: 793159 - RNA, 17 nt, Mycobacterium avium subsp. paratuberculosis
ggcgaugucgucgacgc

SEQ ID NO: 793160 - RNA, 15 nt, Mycobacterium avium subsp. paratuberculosis
ggcgaugugaucgcg

SEQ ID NO: 793161 - RNA, 17 nt, Mycobacterium avium subsp. paratuberculosis
ggcgaugugaucgcggc

SEQ ID NO: 793162 - RNA, 15 nt, Mycobacterium avium subsp. paratuberculosis
ggcgauggcgucggc

SEQ ID NO: 793163 - RNA, 16 nt, Mycobacterium avium subsp. paratuberculosis
ggcgauggcgucggcc

SEQ ID NO: 793164 - RNA, 18 nt, Mycobacterium avium subsp. paratuberculosis
ggcgauggugaugcggau

SEQ ID NO: 793165 - RNA, 15 nt, Mycobacterium avium subsp. paratuberculosis
ggcgauggugccgcc

SEQ ID NO: 793166 - RNA, 16 nt, Mycobacterium avium subsp. paratuberculosis
ggcgauggugccgccg

SEQ ID NO: 793167 - RNA, 17 nt, Mycobacterium avium subsp. paratuberculosis
ggcgauggugccgccgg

SEQ ID NO: 793168 - RNA, 17 nt, Mycobacterium avium subsp. paratuberculosis
ggcgaugguggcgcugc

SEQ ID NO: 793169 - RNA, 21 nt, Mycobacterium avium subsp. paratuberculosis
ggcgaugguggcgcugccgag

SEQ ID NO: 793170 - RNA, 23 nt, Mycobacterium avium subsp. paratuberculosis
ggcgaugguggcgcugccgagca

SEQ ID NO: 793171 - RNA, 13 nt, Mycobacterium avium subsp. paratuberculosis
ggcgauggugggc

SEQ ID NO: 793172 - RNA, 14 nt, Mycobacterium avium subsp. paratuberculosis
ggcgauggcggcgu

SEQ ID NO: 793173 - RNA, 15 nt, Mycobacterium avium subsp. paratuberculosis
ggcgauggcgcggcc

SEQ ID NO: 793174 - RNA, 15 nt, Mycobacterium avium subsp. paratuberculosis
ggcgauggcccgcug

SEQ ID NO: 793175 - RNA, 23 nt, Mycobacterium avium subsp. paratuberculosis
ggcgauggcccgcugcgccgacu

SEQ ID NO: 793176 - RNA, 22 nt, Mycobacterium avium subsp. paratuberculosis
ggcgcaaucggggccgacccgc

SEQ ID NO: 793177 - RNA, 13 nt, Mycobacterium avium subsp. paratuberculosis
ggcgcacagaucg

SEQ ID NO: 793178 - RNA, 22 nt, Mycobacterium avium subsp. paratuberculosis
ggcgcacaacgaggcccggacg

SEQ ID NO: 793179 - RNA, 21 nt, Mycobacterium avium subsp. paratuberculosis
ggcgcaccgugucgucgcuga

SEQ ID NO: 793180 - RNA, 23 nt, Mycobacterium avium subsp. paratuberculosis
ggcgcacaacccggacagcgcga

SEQ ID NO: 793181 - RNA, 21 nt, Mycobacterium avium subsp. paratuberculosis
ggcgcacgcagugccgcacca

SEQ ID NO: 793182 - RNA, 15 nt, Mycobacterium avium subsp. paratuberculosis
ggcgcacggcgccca

SEQ ID NO: 793183 - RNA, 18 nt, Mycobacterium avium subsp. paratuberculosis
ggcgcacggcgcccaggu

SEQ ID NO: 793184 - RNA, 13 nt, Mycobacterium avium subsp. paratuberculosis
ggcgcacggugcc

SEQ ID NO: 793185 - RNA, 17 nt, Mycobacterium avium subsp. paratuberculosis
ggcgcacggugcccguc

SEQ ID NO: 793186 - RNA, 14 nt, Mycobacterium avium subsp. paratuberculosis
ggcgcaacaccgga

SEQ ID NO: 793187 - RNA, 12 nt, Mycobacterium avium subsp. paratuberculosis
ggcgcagcgccg

SEQ ID NO: 793188 - RNA, 14 nt, Mycobacterium avium subsp. paratuberculosis
ggcgcagcgccgcg

SEQ ID NO: 793189 - RNA, 17 nt, Mycobacterium avium subsp. paratuberculosis
ggcgcagcgccgcgccg

SEQ ID NO: 793190 - RNA, 19 nt, Mycobacterium avium subsp. paratuberculosis
ggcgcagcgccgcgccgac

SEQ ID NO: 793191 - RNA, 19 nt, Mycobacterium avium subsp. paratuberculosis
ggcgcagcgccgucucgac

SEQ ID NO: 793192 - RNA, 13 nt, Mycobacterium avium subsp. paratuberculosis
ggcgcagccgguc

SEQ ID NO: 793193 - RNA, 14 nt, Mycobacterium avium subsp. paratuberculosis
ggcgcagccgguca

SEQ ID NO: 793194 - RNA, 14 nt, Mycobacterium avium subsp. paratuberculosis
ggcgcagccggcca

SEQ ID NO: 793195 - RNA, 20 nt, Mycobacterium avium subsp. paratuberculosis
ggcgcagcgcacgucgccgc

SEQ ID NO: 793196 - RNA, 15 nt, Mycobacterium avium subsp. paratuberculosis
ggcgcagcccgagcg

SEQ ID NO: 793197 - RNA, 13 nt, Mycobacterium avium subsp. paratuberculosis
ggcgcagcccggc

SEQ ID NO: 793198 - RNA, 16 nt, Mycobacterium avium subsp. paratuberculosis
ggcgcagcccggcggu

SEQ ID NO: 793199 - RNA, 13 nt, Mycobacterium avium subsp. paratuberculosis
ggcgcagccagcg

SEQ ID NO: 793200 - RNA, 14 nt, Mycobacterium avium subsp. paratuberculosis
ggcgcagccagcgg

SEQ ID NO: 793201 - RNA, 15 nt, Mycobacterium avium subsp. paratuberculosis
ggcgcagccagcucg

SEQ ID NO: 793202 - RNA, 18 nt, Mycobacterium avium subsp. paratuberculosis
ggcgcagccagcucggcg

SEQ ID NO: 793203 - RNA, 13 nt, Mycobacterium avium subsp. paratuberculosis
ggcgcagcacggc

SEQ ID NO: 793204 - RNA, 16 nt, Mycobacterium avium subsp. paratuberculosis
ggcgcagcacggccac

SEQ ID NO: 793205 - RNA, 18 nt, Mycobacterium avium subsp. paratuberculosis
ggcgcagaugaccggccu

SEQ ID NO: 793206 - RNA, 22 nt, Mycobacterium avium subsp. paratuberculosis
ggcgcagaagcuaacgccagcu

SEQ ID NO: 793207 - RNA, 16 nt, Mycobacterium avium subsp. paratuberculosis
ggcgcacguggcugac

SEQ ID NO: 793208 - RNA, 22 nt, Mycobacterium avium subsp. paratuberculosis
ggcgcacguggcugaccgacgg

SEQ ID NO: 793209 - RNA, 21 nt, Mycobacterium avium subsp. paratuberculosis
ggcgcacuccaucacgaccuc

SEQ ID NO: 793210 - RNA, 20 nt, Mycobacterium avium subsp. paratuberculosis
ggcgcagaaaaaggccgccg

SEQ ID NO: 793211 - RNA, 23 nt, Mycobacterium avium subsp. paratuberculosis
ggcgcagaaaugggccaugccgg

SEQ ID NO: 793212 - RNA, 20 nt, Mycobacterium avium subsp. paratuberculosis
ggcgccaacaacucagaaca

SEQ ID NO: 793213 - RNA, 19 nt, Mycobacterium avium subsp. paratuberculosis
ggcgccaacaacucgacgc

SEQ ID NO: 793214 - RNA, 20 nt, Mycobacterium avium subsp. paratuberculosis
ggcgccaacaacucgacgcu

SEQ ID NO: 793215 - RNA, 11 nt, Mycobacterium avium subsp. paratuberculosis
ggcgcaugcca

SEQ ID NO: 793216 - RNA, 12 nt, Mycobacterium avium subsp. paratuberculosis
ggcgcaucagcg

SEQ ID NO: 793217 - RNA, 15 nt, Mycobacterium avium subsp. paratuberculosis
ggcgcaucagcgggg

SEQ ID NO: 793218 - RNA, 17 nt, Mycobacterium avium subsp. paratuberculosis
ggcgcauaccagcgcug

SEQ ID NO: 793219 - RNA, 20 nt, Mycobacterium avium subsp. paratuberculosis
ggcgcauaccagcgcuggua

SEQ ID NO: 793220 - RNA, 21 nt, Mycobacterium avium subsp. paratuberculosis
ggcgcagucgaucucgucgca

SEQ ID NO: 793221 - RNA, 23 nt, Mycobacterium avium subsp. paratuberculosis
ggcgcaguucgaccggcaccagc

SEQ ID NO: 793222 - RNA, 22 nt, Mycobacterium avium subsp. paratuberculosis
ggcgcaguccagggugguggug

SEQ ID NO: 793223 - RNA, 18 nt, Mycobacterium avium subsp. paratuberculosis
ggcgcagguccggcagcg

SEQ ID NO: 793224 - RNA, 23 nt, Mycobacterium avium subsp. paratuberculosis
ggcgcaggugaucaaagccggug

SEQ ID NO: 793225 - RNA, 16 nt, Mycobacterium avium subsp. paratuberculosis
ggcgcagguccacccg

SEQ ID NO: 793226 - RNA, 17 nt, Mycobacterium avium subsp. paratuberculosis
ggcgcagguccacccgc

SEQ ID NO: 793227 - RNA, 18 nt, Mycobacterium avium subsp. paratuberculosis
ggcgcagguccacccgcc

SEQ ID NO: 793228 - RNA, 19 nt, Mycobacterium avium subsp. paratuberculosis
ggcgcagguuguccagccg

SEQ ID NO: 793229 - RNA, 13 nt, Mycobacterium avium subsp. paratuberculosis
ggcgcaggcgcgc

SEQ ID NO: 793230 - RNA, 17 nt, Mycobacterium avium subsp. paratuberculosis
ggcgcagggcggccggc

SEQ ID NO: 793231 - RNA, 19 nt, Mycobacterium avium subsp. paratuberculosis
ggcgcagggcggccggcca

SEQ ID NO: 793232 - RNA, 20 nt, Mycobacterium avium subsp. paratuberculosis
ggcgcagggcggccggccag

SEQ ID NO: 793233 - RNA, 16 nt, Mycobacterium avium subsp. paratuberculosis
ggcgcagggcguucga

SEQ ID NO: 793234 - RNA, 22 nt, Mycobacterium avium subsp. paratuberculosis
ggcgcagggcguucgacgucca

SEQ ID NO: 793235 - RNA, 17 nt, Mycobacterium avium subsp. paratuberculosis
ggcgcaggaggcggcca

SEQ ID NO: 793236 - RNA, 23 nt, Mycobacterium avium subsp. paratuberculosis
ggcgcagcucgcgcagcuggccg

SEQ ID NO: 793237 - RNA, 12 nt, Mycobacterium avium subsp. paratuberculosis
ggcgcagcucgu

SEQ ID NO: 793238 - RNA, 15 nt, Mycobacterium avium subsp. paratuberculosis
ggcgcagcucgucgu

SEQ ID NO: 793239 - RNA, 17 nt, Mycobacterium avium subsp. paratuberculosis
ggcgcagcucgucgugg

SEQ ID NO: 793240 - RNA, 18 nt, Mycobacterium avium subsp. paratuberculosis
ggcgcagcucgucguggg

SEQ ID NO: 793241 - RNA, 15 nt, Mycobacterium avium subsp. paratuberculosis
ggcgcagcgucucga

SEQ ID NO: 793242 - RNA, 23 nt, Mycobacterium avium subsp. paratuberculosis
ggcgcagcgcgucgcgcccggcg

SEQ ID NO: 793243 - RNA, 13 nt, Mycobacterium avium subsp. paratuberculosis
ggcgcccagaucg

SEQ ID NO: 793244 - RNA, 19 nt, Mycobacterium avium subsp. paratuberculosis
ggcgcccagaucggccagc

SEQ ID NO: 793245 - RNA, 20 nt, Mycobacterium avium subsp. paratuberculosis
ggcgcccagaucggccagcc

SEQ ID NO: 793246 - RNA, 21 nt, Mycobacterium avium subsp. paratuberculosis
ggcgcccagaucggccagcca

SEQ ID NO: 793247 - RNA, 20 nt, Mycobacterium avium subsp. paratuberculosis
ggcgcccagaugccgccgcc

SEQ ID NO: 793248 - RNA, 21 nt, Mycobacterium avium subsp. paratuberculosis
ggcgcccagcaaacccagcac

SEQ ID NO: 793249 - RNA, 12 nt, Mycobacterium avium subsp. paratuberculosis
ggcgcccagcac

SEQ ID NO: 793250 - RNA, 16 nt, Mycobacterium avium subsp. paratuberculosis
ggcgccaugcgccgcg

SEQ ID NO: 793251 - RNA, 22 nt, Mycobacterium avium subsp. paratuberculosis
ggcgccaugaacggcggggccu

SEQ ID NO: 793252 - RNA, 14 nt, Mycobacterium avium subsp. paratuberculosis
ggcgccagcggccg

SEQ ID NO: 793253 - RNA, 21 nt, Mycobacterium avium subsp. paratuberculosis
ggcgccagccguucccggcag

SEQ ID NO: 793254 - RNA, 13 nt, Mycobacterium avium subsp. paratuberculosis
ggcgccaggccgg

SEQ ID NO: 793255 - RNA, 19 nt, Mycobacterium avium subsp. paratuberculosis
ggcgccagcccgcccagcg

SEQ ID NO: 793256 - RNA, 13 nt, Mycobacterium avium subsp. paratuberculosis
ggcgccauccgca

SEQ ID NO: 793257 - RNA, 15 nt, Mycobacterium avium subsp. paratuberculosis
ggcgccauccgcagc

SEQ ID NO: 793258 - RNA, 19 nt, Mycobacterium avium subsp. paratuberculosis
ggcgccauccgcagcccgu

SEQ ID NO: 793259 - RNA, 21 nt, Mycobacterium avium subsp. paratuberculosis
ggcgccauccgccacccgcug

SEQ ID NO: 793260 - RNA, 18 nt, Mycobacterium avium subsp. paratuberculosis
ggcgccagccgcaccgcg

SEQ ID NO: 793261 - RNA, 15 nt, Mycobacterium avium subsp. paratuberculosis
ggcgccagcccgccg

SEQ ID NO: 793262 - RNA, 14 nt, Mycobacterium avium subsp. paratuberculosis
ggcgccagcccggu

SEQ ID NO: 793263 - RNA, 18 nt, Mycobacterium avium subsp. paratuberculosis
ggcgccagcccggugauc

SEQ ID NO: 793264 - RNA, 21 nt, Mycobacterium avium subsp. paratuberculosis
ggcgccagcccggugaucgcc

SEQ ID NO: 793265 - RNA, 11 nt, Mycobacterium avium subsp. paratuberculosis
ggcgccagccg

SEQ ID NO: 793266 - RNA, 12 nt, Mycobacterium avium subsp. paratuberculosis
ggcgccagcacc

SEQ ID NO: 793267 - RNA, 16 nt, Mycobacterium avium subsp. paratuberculosis
ggcgccagcaccucga

SEQ ID NO: 793268 - RNA, 16 nt, Mycobacterium avium subsp. paratuberculosis
ggcgccacugccgccg

SEQ ID NO: 793269 - RNA, 20 nt, Mycobacterium avium subsp. paratuberculosis
ggcgccacugccgccgccca

SEQ ID NO: 793270 - RNA, 22 nt, Mycobacterium avium subsp. paratuberculosis
ggcgccacugccgccgcccagg

SEQ ID NO: 793271 - RNA, 23 nt, Mycobacterium avium subsp. paratuberculosis
ggcgccacuucuccacgccgacg

SEQ ID NO: 793272 - RNA, 17 nt, Mycobacterium avium subsp. paratuberculosis
ggcgccaccggcuggcc

SEQ ID NO: 793273 - RNA, 20 nt, Mycobacterium avium subsp. paratuberculosis
ggcgccaccggcuggccgga

SEQ ID NO: 793274 - RNA, 20 nt, Mycobacterium avium subsp. paratuberculosis
ggcgccaccggguaaguguc

SEQ ID NO: 793275 - RNA, 17 nt, Mycobacterium avium subsp. paratuberculosis
ggcgccacgaccagcgg

SEQ ID NO: 793276 - RNA, 23 nt, Mycobacterium avium subsp. paratuberculosis
ggcgccacgacugcgcggccggc

SEQ ID NO: 793277 - RNA, 16 nt, Mycobacterium avium subsp. paratuberculosis
ggcgccacgcacaccg

SEQ ID NO: 793278 - RNA, 19 nt, Mycobacterium avium subsp. paratuberculosis
ggcgccacgcacaccgcgc

SEQ ID NO: 793279 - RNA, 22 nt, Mycobacterium avium subsp. paratuberculosis
ggcgccacgcuggcgugacgcu

SEQ ID NO: 793280 - RNA, 14 nt, Mycobacterium avium subsp. paratuberculosis
ggcgccaccagcca

SEQ ID NO: 793281 - RNA, 22 nt, Mycobacterium avium subsp. paratuberculosis
ggcgccaccagccacaccgccg

SEQ ID NO: 793282 - RNA, 21 nt, Mycobacterium avium subsp. paratuberculosis
ggcgccacaacuggucgugcu

SEQ ID NO: 793283 - RNA, 17 nt, Mycobacterium avium subsp. paratuberculosis
ggcgccacagcagcacc

SEQ ID NO: 793284 - RNA, 20 nt, Mycobacterium avium subsp. paratuberculosis
ggcgccacagcagcaccagc

SEQ ID NO: 793285 - RNA, 21 nt, Mycobacterium avium subsp. paratuberculosis
ggcgccacagcagcaccagcg

SEQ ID NO: 793286 - RNA, 23 nt, Mycobacterium avium subsp. paratuberculosis
ggcgccacagcagcaccagcgcg

SEQ ID NO: 793287 - RNA, 14 nt, Mycobacterium avium subsp. paratuberculosis
ggcgccacagccgg

SEQ ID NO: 793288 - RNA, 19 nt, Mycobacterium avium subsp. paratuberculosis
ggcgccacagccggggauc

SEQ ID NO: 793289 - RNA, 12 nt, Mycobacterium avium subsp. paratuberculosis
ggcgcccacccg

SEQ ID NO: 793290 - RNA, 12 nt, Mycobacterium avium subsp. paratuberculosis
ggcgcccaccgc

SEQ ID NO: 793291 - RNA, 16 nt, Mycobacterium avium subsp. paratuberculosis
ggcgcccaccgcggcg

SEQ ID NO: 793292 - RNA, 19 nt, Mycobacterium avium subsp. paratuberculosis
ggcgcccaccgcggcgcgc

SEQ ID NO: 793293 - RNA, 20 nt, Mycobacterium avium subsp. paratuberculosis
ggcgcccaccgcggcgcgcg

SEQ ID NO: 793294 - RNA, 23 nt, Mycobacterium avium subsp. paratuberculosis
ggcgcccaccgcggcgcgcggcc

SEQ ID NO: 793295 - RNA, 22 nt, Mycobacterium avium subsp. paratuberculosis
ggcgcccacggccaccacggca

SEQ ID NO: 793296 - RNA, 14 nt, Mycobacterium avium subsp. paratuberculosis
ggcgcccacagcag

SEQ ID NO: 793297 - RNA, 14 nt, Mycobacterium avium subsp. paratuberculosis
ggcgcccagcggcg

SEQ ID NO: 793298 - RNA, 12 nt, Mycobacterium avium subsp. paratuberculosis
ggcgcccagcgu

SEQ ID NO: 793299 - RNA, 14 nt, Mycobacterium avium subsp. paratuberculosis
ggcgcccagcgucu

SEQ ID NO: 793300 - RNA, 23 nt, Mycobacterium avium subsp. paratuberculosis
ggcgcccagcguggucacccgca

SEQ ID NO: 793301 - RNA, 22 nt, Mycobacterium avium subsp. paratuberculosis
ggcgcccaggggucccaggugg

SEQ ID NO: 793302 - RNA, 22 nt, Mycobacterium avium subsp. paratuberculosis
ggcgcccagguccaccagguga

SEQ ID NO: 793303 - RNA, 21 nt, Mycobacterium avium subsp. paratuberculosis
ggcgcccgaucggcacccgca

SEQ ID NO: 793304 - RNA, 21 nt, Mycobacterium avium subsp. paratuberculosis
ggcgcccgcaggccgcgagcc

SEQ ID NO: 793305 - RNA, 23 nt, Mycobacterium avium subsp. paratuberculosis
ggcgcccgcaggccgcgagcccg

SEQ ID NO: 793306 - RNA, 20 nt, Mycobacterium avium subsp. paratuberculosis
ggcgccccgacaucgccauc

SEQ ID NO: 793307 - RNA, 15 nt, Mycobacterium avium subsp. paratuberculosis
ggcgcccccgcgacg

SEQ ID NO: 793308 - RNA, 16 nt, Mycobacterium avium subsp. paratuberculosis
ggcgccccgcccgcga

SEQ ID NO: 793309 - RNA, 14 nt, Mycobacterium avium subsp. paratuberculosis
ggcgccccgcuggu

SEQ ID NO: 793310 - RNA, 20 nt, Mycobacterium avium subsp. paratuberculosis
ggcgccccgcugguagcugc

SEQ ID NO: 793311 - RNA, 15 nt, Mycobacterium avium subsp. paratuberculosis
ggcgccccggcgcug

SEQ ID NO: 793312 - RNA, 15 nt, Mycobacterium avium subsp. paratuberculosis
ggcgccccagcuccu

SEQ ID NO: 793313 - RNA, 17 nt, Mycobacterium avium subsp. paratuberculosis
ggcgccccagcuccucg

SEQ ID NO: 793314 - RNA, 22 nt, Mycobacterium avium subsp. paratuberculosis
ggcgccccagcuccucggcccc

SEQ ID NO: 793315 - RNA, 23 nt, Mycobacterium avium subsp. paratuberculosis
ggcgccccagcuccucggcccca

SEQ ID NO: 793316 - RNA, 15 nt, Mycobacterium avium subsp. paratuberculosis
ggcgcccugcgagcc

SEQ ID NO: 793317 - RNA, 17 nt, Mycobacterium avium subsp. paratuberculosis
ggcgcccugcgagcccg

SEQ ID NO: 793318 - RNA, 17 nt, Mycobacterium avium subsp. paratuberculosis
ggcgcccuucccggucg

SEQ ID NO: 793319 - RNA, 16 nt, Mycobacterium avium subsp. paratuberculosis
ggcgcccuucggcgcc

SEQ ID NO: 793320 - RNA, 13 nt, Mycobacterium avium subsp. paratuberculosis
ggcgcccugcgcg

SEQ ID NO: 793321 - RNA, 22 nt, Mycobacterium avium subsp. paratuberculosis
ggcgcccuccacgucgucggac

SEQ ID NO: 793322 - RNA, 19 nt, Mycobacterium avium subsp. paratuberculosis
ggcgcccucgaugcgcacc

SEQ ID NO: 793323 - RNA, 16 nt, Mycobacterium avium subsp. paratuberculosis
ggcgcccugcacccag

SEQ ID NO: 793324 - RNA, 21 nt, Mycobacterium avium subsp. paratuberculosis
ggcgcccugcacccagccgug

SEQ ID NO: 793325 - RNA, 15 nt, Mycobacterium avium subsp. paratuberculosis
ggcgcccgucacgcu

SEQ ID NO: 793326 - RNA, 15 nt, Mycobacterium avium subsp. paratuberculosis
ggcgcccucgccggc

SEQ ID NO: 793327 - RNA, 16 nt, Mycobacterium avium subsp. paratuberculosis
ggcgcccucgccggcg

SEQ ID NO: 793328 - RNA, 18 nt, Mycobacterium avium subsp. paratuberculosis
ggcgcccucgccggcggc

SEQ ID NO: 793329 - RNA, 13 nt, Mycobacterium avium subsp. paratuberculosis
ggcgcccucggcg

SEQ ID NO: 793330 - RNA, 14 nt, Mycobacterium avium subsp. paratuberculosis
ggcgcccggccggu

SEQ ID NO: 793331 - RNA, 16 nt, Mycobacterium avium subsp. paratuberculosis
ggcgcccggcgcgcca

SEQ ID NO: 793332 - RNA, 17 nt, Mycobacterium avium subsp. paratuberculosis
ggcgcccggcgcgccac

SEQ ID NO: 793333 - RNA, 14 nt, Mycobacterium avium subsp. paratuberculosis
ggcgcccggcagcc

SEQ ID NO: 793334 - RNA, 15 nt, Mycobacterium avium subsp. paratuberculosis
ggcgcccggcccagc

SEQ ID NO: 793335 - RNA, 20 nt, Mycobacterium avium subsp. paratuberculosis
ggcgcccggcccagccgcug

SEQ ID NO: 793336 - RNA, 12 nt, Mycobacterium avium subsp. paratuberculosis
ggcgcccgcggc

SEQ ID NO: 793337 - RNA, 16 nt, Mycobacterium avium subsp. paratuberculosis
ggcgcccgcggccucc

SEQ ID NO: 793338 - RNA, 17 nt, Mycobacterium avium subsp. paratuberculosis
ggcgcccgcggcgcgca

SEQ ID NO: 793339 - RNA, 16 nt, Mycobacterium avium subsp. paratuberculosis
ggcgcccgcuccggcg

SEQ ID NO: 793340 - RNA, 17 nt, Mycobacterium avium subsp. paratuberculosis
ggcgcccgcuccggcgg

SEQ ID NO: 793341 - RNA, 19 nt, Mycobacterium avium subsp. paratuberculosis
ggcgcccgcuccggcggac

SEQ ID NO: 793342 - RNA, 19 nt, Mycobacterium avium subsp. paratuberculosis
ggcgccgccggcgucgacg

SEQ ID NO: 793343 - RNA, 20 nt, Mycobacterium avium subsp. paratuberculosis
ggcgccgccggcgucgacgu

SEQ ID NO: 793344 - RNA, 12 nt, Mycobacterium avium subsp. paratuberculosis
ggcgccgccggu

SEQ ID NO: 793345 - RNA, 13 nt, Mycobacterium avium subsp. paratuberculosis
ggcgccgccgguc

SEQ ID NO: 793346 - RNA, 19 nt, Mycobacterium avium subsp. paratuberculosis
ggcgccgccgagccgcggg

SEQ ID NO: 793347 - RNA, 19 nt, Mycobacterium avium subsp. paratuberculosis
ggcgccgccgaccgcccgc

SEQ ID NO: 793348 - RNA, 17 nt, Mycobacterium avium subsp. paratuberculosis
ggcgccgcagcaggugc

SEQ ID NO: 793349 - RNA, 18 nt, Mycobacterium avium subsp. paratuberculosis
ggcgccgcagcggcgccg

SEQ ID NO: 793350 - RNA, 16 nt, Mycobacterium avium subsp. paratuberculosis
ggcgccgccacggcac

SEQ ID NO: 793351 - RNA, 17 nt, Mycobacterium avium subsp. paratuberculosis
ggcgccgcccaccagca

SEQ ID NO: 793352 - RNA, 14 nt, Mycobacterium avium subsp. paratuberculosis
ggcgccgcccggcg

SEQ ID NO: 793353 - RNA, 13 nt, Mycobacterium avium subsp. paratuberculosis
ggcgccgcccggg

SEQ ID NO: 793354 - RNA, 14 nt, Mycobacterium avium subsp. paratuberculosis
ggcgccgaucgcgc

SEQ ID NO: 793355 - RNA, 15 nt, Mycobacterium avium subsp. paratuberculosis
ggcgccgaucgcgcg

SEQ ID NO: 793356 - RNA, 20 nt, Mycobacterium avium subsp. paratuberculosis
ggcgccgaucgcgcgcagga

SEQ ID NO: 793357 - RNA, 20 nt, Mycobacterium avium subsp. paratuberculosis
ggcgccgagcgucacgcugg

SEQ ID NO: 793358 - RNA, 21 nt, Mycobacterium avium subsp. paratuberculosis
ggcgccgaggaucuugaucgc

SEQ ID NO: 793359 - RNA, 12 nt, Mycobacterium avium subsp. paratuberculosis
ggcgccgagcac

SEQ ID NO: 793360 - RNA, 20 nt, Mycobacterium avium subsp. paratuberculosis
ggcgccgagcacgaacgcgg

SEQ ID NO: 793361 - RNA, 20 nt, Mycobacterium avium subsp. paratuberculosis
ggcgccgacgggcccgcgcc

SEQ ID NO: 793362 - RNA, 16 nt, Mycobacterium avium subsp. paratuberculosis
ggcgccgacggccagc

SEQ ID NO: 793363 - RNA, 20 nt, Mycobacterium avium subsp. paratuberculosis
ggcgccgacggccagcagga

SEQ ID NO: 793364 - RNA, 19 nt, Mycobacterium avium subsp. paratuberculosis
ggcgccgacgaucccggcg

SEQ ID NO: 793365 - RNA, 21 nt, Mycobacterium avium subsp. paratuberculosis
ggcgccgacgaucccggcgag

SEQ ID NO: 793366 - RNA, 16 nt, Mycobacterium avium subsp. paratuberculosis
ggcgccgacgaugcug

SEQ ID NO: 793367 - RNA, 20 nt, Mycobacterium avium subsp. paratuberculosis
ggcgccgacgacgucgcgca

SEQ ID NO: 793368 - RNA, 17 nt, Mycobacterium avium subsp. paratuberculosis
ggcgccgacagucgcgg

SEQ ID NO: 793369 - RNA, 13 nt, Mycobacterium avium subsp. paratuberculosis
ggcgccgaccccc

SEQ ID NO: 793370 - RNA, 18 nt, Mycobacterium avium subsp. paratuberculosis
ggcgccgacccccgccgc

SEQ ID NO: 793371 - RNA, 17 nt, Mycobacterium avium subsp. paratuberculosis
ggcgccgaagcccgcag

SEQ ID NO: 793372 - RNA, 19 nt, Mycobacterium avium subsp. paratuberculosis
ggcgccgaagcccgcagcg

SEQ ID NO: 793373 - RNA, 23 nt, Mycobacterium avium subsp. paratuberculosis
ggcgccgaaugccacgccgaugg

SEQ ID NO: 793374 - RNA, 16 nt, Mycobacterium avium subsp. paratuberculosis
ggcgccgaaccgggug

SEQ ID NO: 793375 - RNA, 21 nt, Mycobacterium avium subsp. paratuberculosis
ggcgccgaaccgggugacgac

SEQ ID NO: 793376 - RNA, 15 nt, Mycobacterium avium subsp. paratuberculosis
ggcgccgaacgucga

SEQ ID NO: 793377 - RNA, 23 nt, Mycobacterium avium subsp. paratuberculosis
ggcgccgaacgucgagcgcggcc

SEQ ID NO: 793378 - RNA, 22 nt, Mycobacterium avium subsp. paratuberculosis
ggcgccgaacucggcgccgccg

SEQ ID NO: 793379 - RNA, 17 nt, Mycobacterium avium subsp. paratuberculosis
ggcgcccuuggccuccg

SEQ ID NO: 793380 - RNA, 13 nt, Mycobacterium avium subsp. paratuberculosis
ggcgccgucgggg

SEQ ID NO: 793381 - RNA, 20 nt, Mycobacterium avium subsp. paratuberculosis
ggcgccgucggugggggcca

SEQ ID NO: 793382 - RNA, 14 nt, Mycobacterium avium subsp. paratuberculosis
ggcgccgucgccga

SEQ ID NO: 793383 - RNA, 14 nt, Mycobacterium avium subsp. paratuberculosis
ggcgccgucgccgc

SEQ ID NO: 793384 - RNA, 22 nt, Mycobacterium avium subsp. paratuberculosis
ggcgccgucgaggaauccgguc

SEQ ID NO: 793385 - RNA, 20 nt, Mycobacterium avium subsp. paratuberculosis
ggcgccgguuuccaggacga

SEQ ID NO: 793386 - RNA, 22 nt, Mycobacterium avium subsp. paratuberculosis
ggcgccgguuuccaggacgaug

SEQ ID NO: 793387 - RNA, 16 nt, Mycobacterium avium subsp. paratuberculosis
ggcgccguccgcggcg

SEQ ID NO: 793388 - RNA, 23 nt, Mycobacterium avium subsp. paratuberculosis
ggcgccguccgcggcggccagga

SEQ ID NO: 793389 - RNA, 18 nt, Mycobacterium avium subsp. paratuberculosis
ggcgccguuguaggccgc

SEQ ID NO: 793390 - RNA, 19 nt, Mycobacterium avium subsp. paratuberculosis
ggcgccguuguaggccgcg

SEQ ID NO: 793391 - RNA, 22 nt, Mycobacterium avium subsp. paratuberculosis
ggcgccgugcaggaugaccgcg

SEQ ID NO: 793392 - RNA, 19 nt, Mycobacterium avium subsp. paratuberculosis
ggcgccgugccgcgcggcg

SEQ ID NO: 793393 - RNA, 21 nt, Mycobacterium avium subsp. paratuberculosis
ggcgccgguuuucggcguguc

SEQ ID NO: 793394 - RNA, 22 nt, Mycobacterium avium subsp. paratuberculosis
ggcgccgguuuucggcgugucg

SEQ ID NO: 793395 - RNA, 19 nt, Mycobacterium avium subsp. paratuberculosis
ggcgccguaggccgcgcug

SEQ ID NO: 793396 - RNA, 15 nt, Mycobacterium avium subsp. paratuberculosis
ggcgccguagguggc

SEQ ID NO: 793397 - RNA, 16 nt, Mycobacterium avium subsp. paratuberculosis
ggcgccguagguggcc

SEQ ID NO: 793398 - RNA, 20 nt, Mycobacterium avium subsp. paratuberculosis
ggcgccguauuggcaggcga

SEQ ID NO: 793399 - RNA, 23 nt, Mycobacterium avium subsp. paratuberculosis
ggcgccguauuggcaggcgaugu

SEQ ID NO: 793400 - RNA, 14 nt, Mycobacterium avium subsp. paratuberculosis
ggcgccgucaaugg

SEQ ID NO: 793401 - RNA, 14 nt, Mycobacterium avium subsp. paratuberculosis
ggcgccggcggcca

SEQ ID NO: 793402 - RNA, 12 nt, Mycobacterium avium subsp. paratuberculosis
ggcgccggugcc

SEQ ID NO: 793403 - RNA, 18 nt, Mycobacterium avium subsp. paratuberculosis
ggcgccggugccgcagcc

SEQ ID NO: 793404 - RNA, 13 nt, Mycobacterium avium subsp. paratuberculosis
ggcgccggucgac

SEQ ID NO: 793405 - RNA, 16 nt, Mycobacterium avium subsp. paratuberculosis
ggcgccggucgacgcg

SEQ ID NO: 793406 - RNA, 16 nt, Mycobacterium avium subsp. paratuberculosis
ggcgccggucggcgga

SEQ ID NO: 793407 - RNA, 16 nt, Mycobacterium avium subsp. paratuberculosis
ggcgccggucguagcg

SEQ ID NO: 793408 - RNA, 19 nt, Mycobacterium avium subsp. paratuberculosis
ggcgccggugaagaucgcc

SEQ ID NO: 793409 - RNA, 20 nt, Mycobacterium avium subsp. paratuberculosis
ggcgccggugaagcgggaca

SEQ ID NO: 793410 - RNA, 22 nt, Mycobacterium avium subsp. paratuberculosis
ggcgccuucuuggccgcgcccu

SEQ ID NO: 793411 - RNA, 20 nt, Mycobacterium avium subsp. paratuberculosis
ggcgccuucuuggcggcggu

SEQ ID NO: 793412 - RNA, 19 nt, Mycobacterium avium subsp. paratuberculosis
ggcgccuugaaccggcugg

SEQ ID NO: 793413 - RNA, 24 nt, Mycobacterium avium subsp. paratuberculosis
ggcgccugcgagcacacccucacc

SEQ ID NO: 793414 - RNA, 15 nt, Mycobacterium avium subsp. paratuberculosis
ggcgccucggcgccu

SEQ ID NO: 793415 - RNA, 20 nt, Mycobacterium avium subsp. paratuberculosis
ggcgccucggcgccucggcg

SEQ ID NO: 793416 - RNA, 21 nt, Mycobacterium avium subsp. paratuberculosis
ggcgccucggcgccucggcgu

SEQ ID NO: 793417 - RNA, 19 nt, Mycobacterium avium subsp. paratuberculosis
ggcgccucgaugcgggugu

SEQ ID NO: 793418 - RNA, 16 nt, Mycobacterium avium subsp. paratuberculosis
ggcgccuaccgggugg

SEQ ID NO: 793419 - RNA, 23 nt, Mycobacterium avium subsp. paratuberculosis
ggcgccuaccggguggccagcac

SEQ ID NO: 793420 - RNA, 14 nt, Mycobacterium avium subsp. paratuberculosis
ggcgccuccgcccg

SEQ ID NO: 793421 - RNA, 13 nt, Mycobacterium avium subsp. paratuberculosis
ggcgccucgccga

SEQ ID NO: 793422 - RNA, 14 nt, Mycobacterium avium subsp. paratuberculosis
ggcgccucgccgac

SEQ ID NO: 793423 - RNA, 16 nt, Mycobacterium avium subsp. paratuberculosis
ggcgccucgccgaccu

SEQ ID NO: 793424 - RNA, 14 nt, Mycobacterium avium subsp. paratuberculosis
ggcgccgguaucga

SEQ ID NO: 793425 - RNA, 19 nt, Mycobacterium avium subsp. paratuberculosis
ggcgccgguaucgagcacc

SEQ ID NO: 793426 - RNA, 22 nt, Mycobacterium avium subsp. paratuberculosis
ggcgccgguaucgagcaccagc

SEQ ID NO: 793427 - RNA, 23 nt, Mycobacterium avium subsp. paratuberculosis
ggcgccgguaucgagcaccagca

SEQ ID NO: 793428 - RNA, 14 nt, Mycobacterium avium subsp. paratuberculosis
ggcgccggucagcg

SEQ ID NO: 793429 - RNA, 15 nt, Mycobacterium avium subsp. paratuberculosis
ggcgccggucagcgg

SEQ ID NO: 793430 - RNA, 19 nt, Mycobacterium avium subsp. paratuberculosis
ggcgccggucagcggcaac

SEQ ID NO: 793431 - RNA, 22 nt, Mycobacterium avium subsp. paratuberculosis
ggcgccgggucauccccgugcg

SEQ ID NO: 793432 - RNA, 23 nt, Mycobacterium avium subsp. paratuberculosis
ggcgccgggucauccccgugcgg

SEQ ID NO: 793433 - RNA, 21 nt, Mycobacterium avium subsp. paratuberculosis
ggcgccggcguccagcgccgc

SEQ ID NO: 793434 - RNA, 14 nt, Mycobacterium avium subsp. paratuberculosis
ggcgccggcuccgc

SEQ ID NO: 793435 - RNA, 12 nt, Mycobacterium avium subsp. paratuberculosis
ggcgccggcggu

SEQ ID NO: 793436 - RNA, 19 nt, Mycobacterium avium subsp. paratuberculosis
ggcgccggcggucagcuca

SEQ ID NO: 793437 - RNA, 20 nt, Mycobacterium avium subsp. paratuberculosis
ggcgccggcggucagcucag

SEQ ID NO: 793438 - RNA, 13 nt, Mycobacterium avium subsp. paratuberculosis
ggcgccggcgucc

SEQ ID NO: 793439 - RNA, 12 nt, Mycobacterium avium subsp. paratuberculosis
ggcgccggcggc

SEQ ID NO: 793440 - RNA, 13 nt, Mycobacterium avium subsp. paratuberculosis
ggcgccggcgcgc

SEQ ID NO: 793441 - RNA, 14 nt, Mycobacterium avium subsp. paratuberculosis
ggcgccggcgcgca

SEQ ID NO: 793442 - RNA, 14 nt, Mycobacterium avium subsp. paratuberculosis
ggcgccggcgcggg

SEQ ID NO: 793443 - RNA, 18 nt, Mycobacterium avium subsp. paratuberculosis
ggcgccggcgcguccgga

SEQ ID NO: 793444 - RNA, 16 nt, Mycobacterium avium subsp. paratuberculosis
ggcgccggccggcgcg

SEQ ID NO: 793445 - RNA, 20 nt, Mycobacterium avium subsp. paratuberculosis
ggcgccggccggcgcgugcg

SEQ ID NO: 793446 - RNA, 14 nt, Mycobacterium avium subsp. paratuberculosis
ggcgccggccguca

SEQ ID NO: 793447 - RNA, 18 nt, Mycobacterium avium subsp. paratuberculosis
ggcgccggccgucacgcu

SEQ ID NO: 793448 - RNA, 19 nt, Mycobacterium avium subsp. paratuberculosis
ggcgccggccgucacgcug

SEQ ID NO: 793449 - RNA, 15 nt, Mycobacterium avium subsp. paratuberculosis
ggcgccggccggcgc

SEQ ID NO: 793450 - RNA, 14 nt, Mycobacterium avium subsp. paratuberculosis
ggcgccggccgaca

SEQ ID NO: 793451 - RNA, 13 nt, Mycobacterium avium subsp. paratuberculosis
ggcgccgcgcgcc

SEQ ID NO: 793452 - RNA, 14 nt, Mycobacterium avium subsp. paratuberculosis
ggcgccggccgccg

SEQ ID NO: 793453 - RNA, 13 nt, Mycobacterium avium subsp. paratuberculosis
ggcgccggcccgc

SEQ ID NO: 793454 - RNA, 19 nt, Mycobacterium avium subsp. paratuberculosis
ggcgccggcccgcggcgga

SEQ ID NO: 793455 - RNA, 17 nt, Mycobacterium avium subsp. paratuberculosis
ggcgccggccagcggcu

SEQ ID NO: 793456 - RNA, 14 nt, Mycobacterium avium subsp. paratuberculosis
ggcgccggccagcg

SEQ ID NO: 793457 - RNA, 12 nt, Mycobacterium avium subsp. paratuberculosis
ggcgccggccag

SEQ ID NO: 793458 - RNA, 13 nt, Mycobacterium avium subsp. paratuberculosis
ggcgccggccagc

SEQ ID NO: 793459 - RNA, 18 nt, Mycobacterium avium subsp. paratuberculosis
ggcgccggccagcaccac

SEQ ID NO: 793460 - RNA, 16 nt, Mycobacterium avium subsp. paratuberculosis
ggcgccggccagcacg

SEQ ID NO: 793461 - RNA, 20 nt, Mycobacterium avium subsp. paratuberculosis
ggcgccggccagcacggcca

SEQ ID NO: 793462 - RNA, 16 nt, Mycobacterium avium subsp. paratuberculosis
ggcgccggcauccagc

SEQ ID NO: 793463 - RNA, 22 nt, Mycobacterium avium subsp. paratuberculosis
ggcgccggcaucgaccgcccgc

SEQ ID NO: 793464 - RNA, 18 nt, Mycobacterium avium subsp. paratuberculosis
ggcgccggaggccagcuc

SEQ ID NO: 793465 - RNA, 19 nt, Mycobacterium avium subsp. paratuberculosis
ggcgccggaggccagcucg

SEQ ID NO: 793466 - RNA, 20 nt, Mycobacterium avium subsp. paratuberculosis
ggcgccggaugggcgcacga

SEQ ID NO: 793467 - RNA, 19 nt, Mycobacterium avium subsp. paratuberculosis
ggcgccgcgguagcggacc

SEQ ID NO: 793468 - RNA, 14 nt, Mycobacterium avium subsp. paratuberculosis
ggcgccgcggucgc

SEQ ID NO: 793469 - RNA, 17 nt, Mycobacterium avium subsp. paratuberculosis
ggcgccgcguaccagcg

SEQ ID NO: 793470 - RNA, 20 nt, Mycobacterium avium subsp. paratuberculosis
ggcgccgcguaccagcgcca

SEQ ID NO: 793471 - RNA, 13 nt, Mycobacterium avium subsp. paratuberculosis
ggcgccgcggccg

SEQ ID NO: 793472 - RNA, 13 nt, Mycobacterium avium subsp. paratuberculosis
ggcgccgcggcgc

SEQ ID NO: 793473 - RNA, 14 nt, Mycobacterium avium subsp. paratuberculosis
ggcgccgcggcggc

SEQ ID NO: 793474 - RNA, 18 nt, Mycobacterium avium subsp. paratuberculosis
ggcgccgcgggcgccgua

SEQ ID NO: 793475 - RNA, 20 nt, Mycobacterium avium subsp. paratuberculosis
ggcgccgcggcccugcagcg

SEQ ID NO: 793476 - RNA, 15 nt, Mycobacterium avium subsp. paratuberculosis
ggcgccgcgcagcca

SEQ ID NO: 793477 - RNA, 19 nt, Mycobacterium avium subsp. paratuberculosis
ggcgccgcgcagccagacc

SEQ ID NO: 793478 - RNA, 13 nt, Mycobacterium avium subsp. paratuberculosis
ggcgccgcgaccc

SEQ ID NO: 793479 - RNA, 14 nt, Mycobacterium avium subsp. paratuberculosis
ggcgccgcgacccc

SEQ ID NO: 793480 - RNA, 23 nt, Mycobacterium avium subsp. paratuberculosis
ggcgccgcgaccccggaccgcgg

SEQ ID NO: 793481 - RNA, 20 nt, Mycobacterium avium subsp. paratuberculosis
ggcggcugccucgacgaugg

SEQ ID NO: 793482 - RNA, 15 nt, Mycobacterium avium subsp. paratuberculosis
ggcggcucggcggcg

SEQ ID NO: 793483 - RNA, 19 nt, Mycobacterium avium subsp. paratuberculosis
ggcggcucgggggugucgu

SEQ ID NO: 793484 - RNA, 21 nt, Mycobacterium avium subsp. paratuberculosis
ggcggcgcuggucggcgggca

SEQ ID NO: 793485 - RNA, 17 nt, Mycobacterium avium subsp. paratuberculosis
ggcggcgcugccccagc

SEQ ID NO: 793486 - RNA, 19 nt, Mycobacterium avium subsp. paratuberculosis
ggcggcgcucagcgcggcg

SEQ ID NO: 793487 - RNA, 22 nt, Mycobacterium avium subsp. paratuberculosis
ggcggcgcgugcgccgcggcgg

SEQ ID NO: 793488 - RNA, 17 nt, Mycobacterium avium subsp. paratuberculosis
ggcggcugugaucgcug

SEQ ID NO: 793489 - RNA, 15 nt, Mycobacterium avium subsp. paratuberculosis
ggcggcugaagcgcu

SEQ ID NO: 793490 - RNA, 15 nt, Mycobacterium avium subsp. paratuberculosis
ggcggcugggccgcg

SEQ ID NO: 793491 - RNA, 17 nt, Mycobacterium avium subsp. paratuberculosis
ggcggcugggccgcggc

SEQ ID NO: 793492 - RNA, 18 nt, Mycobacterium avium subsp. paratuberculosis
ggcggcugggccgcggcg

SEQ ID NO: 793493 - RNA, 13 nt, Mycobacterium avium subsp. paratuberculosis
ggcggggcguugc

SEQ ID NO: 793494 - RNA, 13 nt, Mycobacterium avium subsp. paratuberculosis
ggcgggggagccg

SEQ ID NO: 793495 - RNA, 21 nt, Mycobacterium avium subsp. paratuberculosis
ggcgggggauccgccugcgcg

SEQ ID NO: 793496 - RNA, 13 nt, Mycobacterium avium subsp. paratuberculosis
ggcggggguucga

SEQ ID NO: 793497 - RNA, 12 nt, Mycobacterium avium subsp. paratuberculosis
ggcggggcgucu

SEQ ID NO: 793498 - RNA, 15 nt, Mycobacterium avium subsp. paratuberculosis
ggcggggcgucucga

SEQ ID NO: 793499 - RNA, 14 nt, Mycobacterium avium subsp. paratuberculosis
ggcggggcccgggc

SEQ ID NO: 793500 - RNA, 18 nt, Mycobacterium avium subsp. paratuberculosis
ggcggggccuccaccagc

SEQ ID NO: 793501 - RNA, 20 nt, Mycobacterium avium subsp. paratuberculosis
ggcggggcgccgacagucgc

SEQ ID NO: 793502 - RNA, 20 nt, Mycobacterium avium subsp. paratuberculosis
ggcgggccuugagcaccgcg

SEQ ID NO: 793503 - RNA, 12 nt, Mycobacterium avium subsp. paratuberculosis
ggcgggcgaagc

SEQ ID NO: 793504 - RNA, 20 nt, Mycobacterium avium subsp. paratuberculosis
ggcgggcgaaguagccggcg

SEQ ID NO: 793505 - RNA, 19 nt, Mycobacterium avium subsp. paratuberculosis
ggcgggccgguccccggcg

SEQ ID NO: 793506 - RNA, 15 nt, Mycobacterium avium subsp. paratuberculosis
ggcgggccucgccgc

SEQ ID NO: 793507 - RNA, 12 nt, Mycobacterium avium subsp. paratuberculosis
ggcgggccggcg

SEQ ID NO: 793508 - RNA, 15 nt, Mycobacterium avium subsp. paratuberculosis
ggcgggccagcucga

SEQ ID NO: 793509 - RNA, 19 nt, Mycobacterium avium subsp. paratuberculosis
ggcgggccagcucgaacac

SEQ ID NO: 793510 - RNA, 22 nt, Mycobacterium avium subsp. paratuberculosis
ggcgggccagcucgucgagccg

SEQ ID NO: 793511 - RNA, 13 nt, Mycobacterium avium subsp. paratuberculosis
ggcgggccaggcg

SEQ ID NO: 793512 - RNA, 14 nt, Mycobacterium avium subsp. paratuberculosis
ggcgggccaggcgg

SEQ ID NO: 793513 - RNA, 17 nt, Mycobacterium avium subsp. paratuberculosis
ggcgggccagucgccgc

SEQ ID NO: 793514 - RNA, 20 nt, Mycobacterium avium subsp. paratuberculosis
ggcgggccagucgccgcgca

SEQ ID NO: 793515 - RNA, 13 nt, Mycobacterium avium subsp. paratuberculosis
ggcgggcccgggc

SEQ ID NO: 793516 - RNA, 12 nt, Mycobacterium avium subsp. paratuberculosis
ggcgggcccguc

SEQ ID NO: 793517 - RNA, 13 nt, Mycobacterium avium subsp. paratuberculosis
ggcgggcccgucg

SEQ ID NO: 793518 - RNA, 15 nt, Mycobacterium avium subsp. paratuberculosis
ggcgggcccgucgcc

SEQ ID NO: 793519 - RNA, 19 nt, Mycobacterium avium subsp. paratuberculosis
ggcgggcccgucgccggcg

SEQ ID NO: 793520 - RNA, 23 nt, Mycobacterium avium subsp. paratuberculosis
ggcgggcccgucgccggcgcgca

SEQ ID NO: 793521 - RNA, 21 nt, Mycobacterium avium subsp. paratuberculosis
ggcgggccgcaauacggugcc

SEQ ID NO: 793522 - RNA, 15 nt, Mycobacterium avium subsp. paratuberculosis
ggcgggccgccaggu

SEQ ID NO: 793523 - RNA, 23 nt, Mycobacterium avium subsp. paratuberculosis
ggcgggcagcaccagcggcacca

SEQ ID NO: 793524 - RNA, 13 nt, Mycobacterium avium subsp. paratuberculosis
ggcgggccagcuc

SEQ ID NO: 793525 - RNA, 20 nt, Mycobacterium avium subsp. paratuberculosis
ggcgggcaggcccgagcccg

SEQ ID NO: 793526 - RNA, 13 nt, Mycobacterium avium subsp. paratuberculosis
ggcgggcaggccg

SEQ ID NO: 793527 - RNA, 16 nt, Mycobacterium avium subsp. paratuberculosis
ggcggucaccaaggcg

SEQ ID NO: 793528 - RNA, 19 nt, Mycobacterium avium subsp. paratuberculosis
ggcggucaggccgucucga

SEQ ID NO: 793529 - RNA, 13 nt, Mycobacterium avium subsp. paratuberculosis
ggcgguccaccac

SEQ ID NO: 793530 - RNA, 20 nt, Mycobacterium avium subsp. paratuberculosis
ggcgguccaccaccacaccc

SEQ ID NO: 793531 - RNA, 15 nt, Mycobacterium avium subsp. paratuberculosis
ggcgguccaccgacg

SEQ ID NO: 793532 - RNA, 23 nt, Mycobacterium avium subsp. paratuberculosis
ggcgguccaccgacgccacgucg

SEQ ID NO: 793533 - RNA, 19 nt, Mycobacterium avium subsp. paratuberculosis
ggcgguccaguacaccgcg

SEQ ID NO: 793534 - RNA, 22 nt, Mycobacterium avium subsp. paratuberculosis
ggcggucaacacgaagccggug

SEQ ID NO: 793535 - RNA, 13 nt, Mycobacterium avium subsp. paratuberculosis
ggcgguaucggug

SEQ ID NO: 793536 - RNA, 15 nt, Mycobacterium avium subsp. paratuberculosis
ggcgguaugcccggg

SEQ ID NO: 793537 - RNA, 17 nt, Mycobacterium avium subsp. paratuberculosis
ggcggucagcaccguca

SEQ ID NO: 793538 - RNA, 21 nt, Mycobacterium avium subsp. paratuberculosis
ggcggucagcaccgucaccgc

SEQ ID NO: 793539 - RNA, 16 nt, Mycobacterium avium subsp. paratuberculosis
ggcgggguggccacca

SEQ ID NO: 793540 - RNA, 21 nt, Mycobacterium avium subsp. paratuberculosis
ggcggggugugcggcacggcg

SEQ ID NO: 793541 - RNA, 16 nt, Mycobacterium avium subsp. paratuberculosis
ggcgggguccacgcag

SEQ ID NO: 793542 - RNA, 24 nt, Mycobacterium avium subsp. paratuberculosis
ggcggggucgaaguccugcgccgc

SEQ ID NO: 793543 - RNA, 21 nt, Mycobacterium avium subsp. paratuberculosis
ggcgggugaggacgcccggcg

SEQ ID NO: 793544 - RNA, 18 nt, Mycobacterium avium subsp. paratuberculosis
ggcgggucgucgaugccc

SEQ ID NO: 793545 - RNA, 13 nt, Mycobacterium avium subsp. paratuberculosis
ggcgggucuguga

SEQ ID NO: 793546 - RNA, 19 nt, Mycobacterium avium subsp. paratuberculosis
ggcgggucugugaccacgg

SEQ ID NO: 793547 - RNA, 14 nt, Mycobacterium avium subsp. paratuberculosis
ggcgggucacucga

SEQ ID NO: 793548 - RNA, 14 nt, Mycobacterium avium subsp. paratuberculosis
ggcgggucagcagc

SEQ ID NO: 793549 - RNA, 19 nt, Mycobacterium avium subsp. paratuberculosis
ggcggguagaaccagcccg

SEQ ID NO: 793550 - RNA, 22 nt, Mycobacterium avium subsp. paratuberculosis
ggcgguaccgaacgacgagccg

SEQ ID NO: 793551 - RNA, 23 nt, Mycobacterium avium subsp. paratuberculosis
ggcggguugcugagccgccgagc

SEQ ID NO: 793552 - RNA, 17 nt, Mycobacterium avium subsp. paratuberculosis
ggcggguaugucggcga

SEQ ID NO: 793553 - RNA, 21 nt, Mycobacterium avium subsp. paratuberculosis
ggcggguguauucgcccaccc

SEQ ID NO: 793554 - RNA, 23 nt, Mycobacterium avium subsp. paratuberculosis
ggcggguguauucgcccaccccg

SEQ ID NO: 793555 - RNA, 15 nt, Mycobacterium avium subsp. paratuberculosis
ggcggauucucgcuc

SEQ ID NO: 793556 - RNA, 20 nt, Mycobacterium avium subsp. paratuberculosis
ggcggauucucgcucugccg

SEQ ID NO: 793557 - RNA, 20 nt, Mycobacterium avium subsp. paratuberculosis
ggcggauuggugccgaucac

SEQ ID NO: 793558 - RNA, 21 nt, Mycobacterium avium subsp. paratuberculosis
ggcggauuggugccgaucacc

SEQ ID NO: 793559 - RNA, 19 nt, Mycobacterium avium subsp. paratuberculosis
ggcggcaaaacgcugggcg

SEQ ID NO: 793560 - RNA, 22 nt, Mycobacterium avium subsp. paratuberculosis
ggcggcaaaacgcugggcgccg

SEQ ID NO: 793561 - RNA, 18 nt, Mycobacterium avium subsp. paratuberculosis
ggcggccagggcggcgcc

SEQ ID NO: 793562 - RNA, 23 nt, Mycobacterium avium subsp. paratuberculosis
ggcggcaaccagcuccggcaacg

SEQ ID NO: 793563 - RNA, 17 nt, Mycobacterium avium subsp. paratuberculosis
ggcggaucggcccgauc

SEQ ID NO: 793564 - RNA, 15 nt, Mycobacterium avium subsp. paratuberculosis
ggcggaucgcgugcg

SEQ ID NO: 793565 - RNA, 18 nt, Mycobacterium avium subsp. paratuberculosis
ggcggaucgcgugcguca

SEQ ID NO: 793566 - RNA, 16 nt, Mycobacterium avium subsp. paratuberculosis
ggcggaucagcaccga

SEQ ID NO: 793567 - RNA, 20 nt, Mycobacterium avium subsp. paratuberculosis
ggcggaucagcaccgacgcg

SEQ ID NO: 793568 - RNA, 15 nt, Mycobacterium avium subsp. paratuberculosis
ggcggauggcgcccu

SEQ ID NO: 793569 - RNA, 18 nt, Mycobacterium avium subsp. paratuberculosis
ggcggaucuucucgcugc

SEQ ID NO: 793570 - RNA, 20 nt, Mycobacterium avium subsp. paratuberculosis
ggcggaucuucucgcugcuc

SEQ ID NO: 793571 - RNA, 14 nt, Mycobacterium avium subsp. paratuberculosis
ggcggccggccagc

SEQ ID NO: 793572 - RNA, 14 nt, Mycobacterium avium subsp. paratuberculosis
ggcggccggagccg

SEQ ID NO: 793573 - RNA, 16 nt, Mycobacterium avium subsp. paratuberculosis
ggcggccggcccggcc

SEQ ID NO: 793574 - RNA, 21 nt, Mycobacterium avium subsp. paratuberculosis
ggcggccggcccggcccgacg

SEQ ID NO: 793575 - RNA, 12 nt, Mycobacterium avium subsp. paratuberculosis
ggcggccggccg

SEQ ID NO: 793576 - RNA, 13 nt, Mycobacterium avium subsp. paratuberculosis
ggcggccggccgc

SEQ ID NO: 793577 - RNA, 14 nt, Mycobacterium avium subsp. paratuberculosis
ggcggccggccgcg

SEQ ID NO: 793578 - RNA, 18 nt, Mycobacterium avium subsp. paratuberculosis
ggcggccggccgcgccca

SEQ ID NO: 793579 - RNA, 20 nt, Mycobacterium avium subsp. paratuberculosis
ggcggccggccgcgcccauc

SEQ ID NO: 793580 - RNA, 13 nt, Mycobacterium avium subsp. paratuberculosis
ggcggccggcgcc

SEQ ID NO: 793581 - RNA, 15 nt, Mycobacterium avium subsp. paratuberculosis
ggcggccggcgccga

SEQ ID NO: 793582 - RNA, 19 nt, Mycobacterium avium subsp. paratuberculosis
ggcggccggcgccgaccga

SEQ ID NO: 793583 - RNA, 15 nt, Mycobacterium avium subsp. paratuberculosis
ggcggccggcggcag

SEQ ID NO: 793584 - RNA, 17 nt, Mycobacterium avium subsp. paratuberculosis
ggcggccgcgucggcgg

SEQ ID NO: 793585 - RNA, 12 nt, Mycobacterium avium subsp. paratuberculosis
ggcggccgcgaa

SEQ ID NO: 793586 - RNA, 18 nt, Mycobacterium avium subsp. paratuberculosis
ggcggccgcgacggacca

SEQ ID NO: 793587 - RNA, 19 nt, Mycobacterium avium subsp. paratuberculosis
ggcggccgcgagcccggcg

SEQ ID NO: 793588 - RNA, 14 nt, Mycobacterium avium subsp. paratuberculosis
ggcggccccgggcg

SEQ ID NO: 793589 - RNA, 20 nt, Mycobacterium avium subsp. paratuberculosis
ggcggccccgguagccagca

SEQ ID NO: 793590 - RNA, 17 nt, Mycobacterium avium subsp. paratuberculosis
ggcggcccgaccagcgg

SEQ ID NO: 793591 - RNA, 12 nt, Mycobacterium avium subsp. paratuberculosis
ggcggcccgcac

SEQ ID NO: 793592 - RNA, 14 nt, Mycobacterium avium subsp. paratuberculosis
ggcggcccagaucg

SEQ ID NO: 793593 - RNA, 17 nt, Mycobacterium avium subsp. paratuberculosis
ggcggcccagaucgcgg

SEQ ID NO: 793594 - RNA, 18 nt, Mycobacterium avium subsp. paratuberculosis
ggcggcccagaucgcggu

SEQ ID NO: 793595 - RNA, 12 nt, Mycobacterium avium subsp. paratuberculosis
ggcggcccgcau

SEQ ID NO: 793596 - RNA, 14 nt, Mycobacterium avium subsp. paratuberculosis
ggcggcccgccgga

SEQ ID NO: 793597 - RNA, 15 nt, Mycobacterium avium subsp. paratuberculosis
ggcggcccgccucgg

SEQ ID NO: 793598 - RNA, 18 nt, Mycobacterium avium subsp. paratuberculosis
ggcggcccgccucggcgg

SEQ ID NO: 793599 - RNA, 12 nt, Mycobacterium avium subsp. paratuberculosis
ggcggcccgcgc

SEQ ID NO: 793600 - RNA, 20 nt, Mycobacterium avium subsp. paratuberculosis
ggcggcccgcgcgggguccc

SEQ ID NO: 793601 - RNA, 23 nt, Mycobacterium avium subsp. paratuberculosis
ggcggccgccgggccggcggcca

SEQ ID NO: 793602 - RNA, 17 nt, Mycobacterium avium subsp. paratuberculosis
ggcggccaucgccgcgg

SEQ ID NO: 793603 - RNA, 21 nt, Mycobacterium avium subsp. paratuberculosis
ggcggccaucucgugcccggg

SEQ ID NO: 793604 - RNA, 17 nt, Mycobacterium avium subsp. paratuberculosis
ggcggccauucaucgcg

SEQ ID NO: 793605 - RNA, 21 nt, Mycobacterium avium subsp. paratuberculosis
ggcggccauucaucgcgcacc

SEQ ID NO: 793606 - RNA, 22 nt, Mycobacterium avium subsp. paratuberculosis
ggcggccauucaucgcgcacca

SEQ ID NO: 793607 - RNA, 16 nt, Mycobacterium avium subsp. paratuberculosis
ggcggccauggucgcg

SEQ ID NO: 793608 - RNA, 20 nt, Mycobacterium avium subsp. paratuberculosis
ggcggccauggucgcggccg

SEQ ID NO: 793609 - RNA, 17 nt, Mycobacterium avium subsp. paratuberculosis
ggcggccugagccgccg

SEQ ID NO: 793610 - RNA, 16 nt, Mycobacterium avium subsp. paratuberculosis
ggcggccucggugcuc

SEQ ID NO: 793611 - RNA, 14 nt, Mycobacterium avium subsp. paratuberculosis
ggcggccugcgcca

SEQ ID NO: 793612 - RNA, 15 nt, Mycobacterium avium subsp. paratuberculosis
ggcggccguggucga

SEQ ID NO: 793613 - RNA, 18 nt, Mycobacterium avium subsp. paratuberculosis
ggcggcgacgucgacggc

SEQ ID NO: 793614 - RNA, 22 nt, Mycobacterium avium subsp. paratuberculosis
ggcggcgacgucgacggcagcg

SEQ ID NO: 793615 - RNA, 19 nt, Mycobacterium avium subsp. paratuberculosis
ggcggcgacgugaucggcg

SEQ ID NO: 793616 - RNA, 20 nt, Mycobacterium avium subsp. paratuberculosis
ggcggcgacgugaucggcgg

SEQ ID NO: 793617 - RNA, 19 nt, Mycobacterium avium subsp. paratuberculosis
ggcggcgacgugccggcgg

SEQ ID NO: 793618 - RNA, 21 nt, Mycobacterium avium subsp. paratuberculosis
ggcggcgacgugccggcggca

SEQ ID NO: 793619 - RNA, 21 nt, Mycobacterium avium subsp. paratuberculosis
ggcggccugcgcgucgucgcc

SEQ ID NO: 793620 - RNA, 16 nt, Mycobacterium avium subsp. paratuberculosis
ggcggccugcggcggc

SEQ ID NO: 793621 - RNA, 20 nt, Mycobacterium avium subsp. paratuberculosis
ggcggccugcggcggcaacg

SEQ ID NO: 793622 - RNA, 13 nt, Mycobacterium avium subsp. paratuberculosis
ggcggccgggugu

SEQ ID NO: 793623 - RNA, 14 nt, Mycobacterium avium subsp. paratuberculosis
ggcggccgucgcgc

SEQ ID NO: 793624 - RNA, 23 nt, Mycobacterium avium subsp. paratuberculosis
ggcggccggggggaggucgcgga

SEQ ID NO: 793625 - RNA, 19 nt, Mycobacterium avium subsp. paratuberculosis
ggcggccgggccgcggcgg

SEQ ID NO: 793626 - RNA, 15 nt, Mycobacterium avium subsp. paratuberculosis
ggcggcgcgggcgcc

SEQ ID NO: 793627 - RNA, 14 nt, Mycobacterium avium subsp. paratuberculosis
ggcggcgcgcaggc

SEQ ID NO: 793628 - RNA, 14 nt, Mycobacterium avium subsp. paratuberculosis
ggcggcgcgccagc

SEQ ID NO: 793629 - RNA, 16 nt, Mycobacterium avium subsp. paratuberculosis
ggcggcgcgccagcgu

SEQ ID NO: 793630 - RNA, 14 nt, Mycobacterium avium subsp. paratuberculosis
ggcggcgcggcggu

SEQ ID NO: 793631 - RNA, 13 nt, Mycobacterium avium subsp. paratuberculosis
ggcggcgcggcgg

SEQ ID NO: 793632 - RNA, 19 nt, Mycobacterium avium subsp. paratuberculosis
ggcggcgcggaucucgcgc

SEQ ID NO: 793633 - RNA, 15 nt, Mycobacterium avium subsp. paratuberculosis
ggcggcgcggcagga

SEQ ID NO: 793634 - RNA, 13 nt, Mycobacterium avium subsp. paratuberculosis
ggcggcgcggccc

SEQ ID NO: 793635 - RNA, 14 nt, Mycobacterium avium subsp. paratuberculosis
ggcggcgcggcgca

SEQ ID NO: 793636 - RNA, 12 nt, Mycobacterium avium subsp. paratuberculosis
ggcggcgcgcug

SEQ ID NO: 793637 - RNA, 22 nt, Mycobacterium avium subsp. paratuberculosis
ggcggcgcgcugcaggcccggg

SEQ ID NO: 793638 - RNA, 18 nt, Mycobacterium avium subsp. paratuberculosis
ggcggcgcgccggccgga

SEQ ID NO: 793639 - RNA, 14 nt, Mycobacterium avium subsp. paratuberculosis
ggcggcgcgcgcca

SEQ ID NO: 793640 - RNA, 16 nt, Mycobacterium avium subsp. paratuberculosis
ggcggcgcgcgccagc

SEQ ID NO: 793641 - RNA, 16 nt, Mycobacterium avium subsp. paratuberculosis
ggcggcgaugaucggg

SEQ ID NO: 793642 - RNA, 12 nt, Mycobacterium avium subsp. paratuberculosis
ggcggcgaugcg

SEQ ID NO: 793643 - RNA, 13 nt, Mycobacterium avium subsp. paratuberculosis
ggcggcgaugucg

SEQ ID NO: 793644 - RNA, 16 nt, Mycobacterium avium subsp. paratuberculosis
ggcggcgauccggccg

SEQ ID NO: 793645 - RNA, 19 nt, Mycobacterium avium subsp. paratuberculosis
ggcggcgauccggccggcg

SEQ ID NO: 793646 - RNA, 20 nt, Mycobacterium avium subsp. paratuberculosis
ggcggcgauccggccggcgg

SEQ ID NO: 793647 - RNA, 19 nt, Mycobacterium avium subsp. paratuberculosis
ggcggcgagcugaucggcg

SEQ ID NO: 793648 - RNA, 17 nt, Mycobacterium avium subsp. paratuberculosis
ggcggcgaucaccgccg

SEQ ID NO: 793649 - RNA, 18 nt, Mycobacterium avium subsp. paratuberculosis
ggcggcgaucaccgccgc

SEQ ID NO: 793650 - RNA, 22 nt, Mycobacterium avium subsp. paratuberculosis
ggcggcgaucaccgccgcggcg

SEQ ID NO: 793651 - RNA, 13 nt, Mycobacterium avium subsp. paratuberculosis
ggcggcgaucgag

SEQ ID NO: 793652 - RNA, 15 nt, Mycobacterium avium subsp. paratuberculosis
ggcggcgaucgccgc

SEQ ID NO: 793653 - RNA, 16 nt, Mycobacterium avium subsp. paratuberculosis
ggcggcgaucgccgcg

SEQ ID NO: 793654 - RNA, 17 nt, Mycobacterium avium subsp. paratuberculosis
ggcggcgaucgccgcga

SEQ ID NO: 793655 - RNA, 21 nt, Mycobacterium avium subsp. paratuberculosis
ggcggcgaucgccgcgaacaa

SEQ ID NO: 793656 - RNA, 19 nt, Mycobacterium avium subsp. paratuberculosis
ggcggcgaucggcgcggcg

SEQ ID NO: 793657 - RNA, 13 nt, Mycobacterium avium subsp. paratuberculosis
ggcggcgaguccg

SEQ ID NO: 793658 - RNA, 17 nt, Mycobacterium avium subsp. paratuberculosis
ggcggcgaguccggcca

SEQ ID NO: 793659 - RNA, 20 nt, Mycobacterium avium subsp. paratuberculosis
ggcggcgaggacgucgucga

SEQ ID NO: 793660 - RNA, 21 nt, Mycobacterium avium subsp. paratuberculosis
ggcggcgaggacgucgucgac

SEQ ID NO: 793661 - RNA, 13 nt, Mycobacterium avium subsp. paratuberculosis
ggcggccugcugc

SEQ ID NO: 793662 - RNA, 22 nt, Mycobacterium avium subsp. paratuberculosis
ggcggccugcuucucgccgucg

SEQ ID NO: 793663 - RNA, 22 nt, Mycobacterium avium subsp. paratuberculosis
ggcgcuggaucugcccgaccug

SEQ ID NO: 793664 - RNA, 13 nt, Mycobacterium avium subsp. paratuberculosis
ggcgcuggccgcg

SEQ ID NO: 793665 - RNA, 23 nt, Mycobacterium avium subsp. paratuberculosis
ggcgcuggccgcgaacggcccgc

SEQ ID NO: 793666 - RNA, 15 nt, Mycobacterium avium subsp. paratuberculosis
ggcgcugcucggagg

SEQ ID NO: 793667 - RNA, 21 nt, Mycobacterium avium subsp. paratuberculosis
ggcgcucccgauggcucgcgg

SEQ ID NO: 793668 - RNA, 21 nt, Mycobacterium avium subsp. paratuberculosis
ggcgcuccagcgggcggcggu

SEQ ID NO: 793669 - RNA, 22 nt, Mycobacterium avium subsp. paratuberculosis
ggcgcuccagcgggcggcggug

SEQ ID NO: 793670 - RNA, 19 nt, Mycobacterium avium subsp. paratuberculosis
ggcgcugcgcgguggcgcg

SEQ ID NO: 793671 - RNA, 16 nt, Mycobacterium avium subsp. paratuberculosis
ggcgcucagcgcggcg

SEQ ID NO: 793672 - RNA, 21 nt, Mycobacterium avium subsp. paratuberculosis
ggcgcucagcgcggcgggcca

SEQ ID NO: 793673 - RNA, 14 nt, Mycobacterium avium subsp. paratuberculosis
ggcgcucagcggca

SEQ ID NO: 793674 - RNA, 16 nt, Mycobacterium avium subsp. paratuberculosis
ggcgcucaucaggcgg

SEQ ID NO: 793675 - RNA, 19 nt, Mycobacterium avium subsp. paratuberculosis
ggcgcucaucaggcggccg

SEQ ID NO: 793676 - RNA, 14 nt, Mycobacterium avium subsp. paratuberculosis
ggcgcucagcgcgg

SEQ ID NO: 793677 - RNA, 22 nt, Mycobacterium avium subsp. paratuberculosis
ggcgcgucgcugggcagccguc

SEQ ID NO: 793678 - RNA, 15 nt, Mycobacterium avium subsp. paratuberculosis
ggcgcgucgguaauc

SEQ ID NO: 793679 - RNA, 13 nt, Mycobacterium avium subsp. paratuberculosis
ggcgcucaccgcg

SEQ ID NO: 793680 - RNA, 12 nt, Mycobacterium avium subsp. paratuberculosis
ggcgcgugcgcc

SEQ ID NO: 793681 - RNA, 16 nt, Mycobacterium avium subsp. paratuberculosis
ggcgcgugcgccgcgg

SEQ ID NO: 793682 - RNA, 13 nt, Mycobacterium avium subsp. paratuberculosis
ggcgcgugcgcga

SEQ ID NO: 793683 - RNA, 22 nt, Mycobacterium avium subsp. paratuberculosis
ggcgcgucguagccggcacgca

SEQ ID NO: 793684 - RNA, 22 nt, Mycobacterium avium subsp. paratuberculosis
ggcgcgucguagucgcucggcg

SEQ ID NO: 793685 - RNA, 16 nt, Mycobacterium avium subsp. paratuberculosis
ggcgcgucguccgaca

SEQ ID NO: 793686 - RNA, 12 nt, Mycobacterium avium subsp. paratuberculosis
ggcgcgucgagg

SEQ ID NO: 793687 - RNA, 22 nt, Mycobacterium avium subsp. paratuberculosis
ggcgcgucgaggucgucgggcg

SEQ ID NO: 793688 - RNA, 15 nt, Mycobacterium avium subsp. paratuberculosis
ggcgcgucgaucgcg

SEQ ID NO: 793689 - RNA, 16 nt, Mycobacterium avium subsp. paratuberculosis
ggcgcgucgaucgcgu

SEQ ID NO: 793690 - RNA, 20 nt, Mycobacterium avium subsp. paratuberculosis
ggcggaggccugcgcggccg

SEQ ID NO: 793691 - RNA, 21 nt, Mycobacterium avium subsp. paratuberculosis
ggcggaggucauggcgaccgc

SEQ ID NO: 793692 - RNA, 23 nt, Mycobacterium avium subsp. paratuberculosis
ggcggaggucauggcgaccgcga

SEQ ID NO: 793693 - RNA, 22 nt, Mycobacterium avium subsp. paratuberculosis
ggcggacgauguccgccggccg

SEQ ID NO: 793694 - RNA, 14 nt, Mycobacterium avium subsp. paratuberculosis
ggcggaccggcggc

SEQ ID NO: 793695 - RNA, 17 nt, Mycobacterium avium subsp. paratuberculosis
ggcggaccgucgguguc

SEQ ID NO: 793696 - RNA, 14 nt, Mycobacterium avium subsp. paratuberculosis
ggcggacggcaccg

SEQ ID NO: 793697 - RNA, 15 nt, Mycobacterium avium subsp. paratuberculosis
ggcggacggcaccga

SEQ ID NO: 793698 - RNA, 12 nt, Mycobacterium avium subsp. paratuberculosis
ggcggacggcga

SEQ ID NO: 793699 - RNA, 14 nt, Mycobacterium avium subsp. paratuberculosis
ggcggacgggacca

SEQ ID NO: 793700 - RNA, 19 nt, Mycobacterium avium subsp. paratuberculosis
ggcggacggucccgacgcu

SEQ ID NO: 793701 - RNA, 22 nt, Mycobacterium avium subsp. paratuberculosis
ggcggacucggcgaagucauca

SEQ ID NO: 793702 - RNA, 16 nt, Mycobacterium avium subsp. paratuberculosis
ggcggacugcccgacc

SEQ ID NO: 793703 - RNA, 17 nt, Mycobacterium avium subsp. paratuberculosis
ggcggacugcccgaccg

SEQ ID NO: 793704 - RNA, 18 nt, Mycobacterium avium subsp. paratuberculosis
ggcggacugcccgaccgc

SEQ ID NO: 793705 - RNA, 21 nt, Mycobacterium avium subsp. paratuberculosis
ggcggacugcccgaccgcgcc

SEQ ID NO: 793706 - RNA, 22 nt, Mycobacterium avium subsp. paratuberculosis
ggcggaucaguaccggcgaugc

SEQ ID NO: 793707 - RNA, 14 nt, Mycobacterium avium subsp. paratuberculosis
ggcggauccagcac

SEQ ID NO: 793708 - RNA, 21 nt, Mycobacterium avium subsp. paratuberculosis
ggcggauccagcaccgccacg

SEQ ID NO: 793709 - RNA, 16 nt, Mycobacterium avium subsp. paratuberculosis
ggcggauccccgcgcu

SEQ ID NO: 793710 - RNA, 17 nt, Mycobacterium avium subsp. paratuberculosis
ggcggauccccgcgcug

SEQ ID NO: 793711 - RNA, 18 nt, Mycobacterium avium subsp. paratuberculosis
ggcggauccccgcgcugg

SEQ ID NO: 793712 - RNA, 20 nt, Mycobacterium avium subsp. paratuberculosis
ggcggagucguagucgaugc

SEQ ID NO: 793713 - RNA, 15 nt, Mycobacterium avium subsp. paratuberculosis
ggcggacaucgccuc

SEQ ID NO: 793714 - RNA, 19 nt, Mycobacterium avium subsp. paratuberculosis
ggcggacaucgccucggcg

SEQ ID NO: 793715 - RNA, 20 nt, Mycobacterium avium subsp. paratuberculosis
ggcggacaucgccucggcgu

SEQ ID NO: 793716 - RNA, 14 nt, Mycobacterium avium subsp. paratuberculosis
ggcggacccagcuc

SEQ ID NO: 793717 - RNA, 17 nt, Mycobacterium avium subsp. paratuberculosis
ggcgcuucugcgccggu

SEQ ID NO: 793718 - RNA, 20 nt, Mycobacterium avium subsp. paratuberculosis
ggcgcuugaccucgccgagc

SEQ ID NO: 793719 - RNA, 23 nt, Mycobacterium avium subsp. paratuberculosis
ggcgcuugaccucgccgagcagc

SEQ ID NO: 793720 - RNA, 15 nt, Mycobacterium avium subsp. paratuberculosis
ggcgcuugacgaacg

SEQ ID NO: 793721 - RNA, 15 nt, Mycobacterium avium subsp. paratuberculosis
ggcgcuggccgcggc

SEQ ID NO: 793722 - RNA, 13 nt, Mycobacterium avium subsp. paratuberculosis
ggcgcgaccaggu

SEQ ID NO: 793723 - RNA, 15 nt, Mycobacterium avium subsp. paratuberculosis
ggcgcgacaccgcgg

SEQ ID NO: 793724 - RNA, 18 nt, Mycobacterium avium subsp. paratuberculosis
ggcgcgacaccgcggcga

SEQ ID NO: 793725 - RNA, 20 nt, Mycobacterium avium subsp. paratuberculosis
ggcgcgaagguggcgccggu

SEQ ID NO: 793726 - RNA, 17 nt, Mycobacterium avium subsp. paratuberculosis
ggcgcgaaucccggccu

SEQ ID NO: 793727 - RNA, 16 nt, Mycobacterium avium subsp. paratuberculosis
ggcgcgaaucgcuucc

SEQ ID NO: 793728 - RNA, 19 nt, Mycobacterium avium subsp. paratuberculosis
ggcgcgcgccgcccccgcg

SEQ ID NO: 793729 - RNA, 20 nt, Mycobacterium avium subsp. paratuberculosis
ggcgcgcgccgcccccgcgg

SEQ ID NO: 793730 - RNA, 13 nt, Mycobacterium avium subsp. paratuberculosis
ggcgcgaacagcg

SEQ ID NO: 793731 - RNA, 21 nt, Mycobacterium avium subsp. paratuberculosis
ggcgcgcgcgccccagccccu

SEQ ID NO: 793732 - RNA, 14 nt, Mycobacterium avium subsp. paratuberculosis
ggcgcgacggucac

SEQ ID NO: 793733 - RNA, 17 nt, Mycobacterium avium subsp. paratuberculosis
ggcgcgacggucacgcu

SEQ ID NO: 793734 - RNA, 20 nt, Mycobacterium avium subsp. paratuberculosis
ggcgcggcccaguucgcacc

SEQ ID NO: 793735 - RNA, 16 nt, Mycobacterium avium subsp. paratuberculosis
ggcgcggccagcugaa

SEQ ID NO: 793736 - RNA, 15 nt, Mycobacterium avium subsp. paratuberculosis
ggcgcggccaccccg

SEQ ID NO: 793737 - RNA, 13 nt, Mycobacterium avium subsp. paratuberculosis
ggcgcggcaucgg

SEQ ID NO: 793738 - RNA, 17 nt, Mycobacterium avium subsp. paratuberculosis
ggcgcgcggccgcgacu

SEQ ID NO: 793739 - RNA, 20 nt, Mycobacterium avium subsp. paratuberculosis
ggcgcggcagggccaggccg

SEQ ID NO: 793740 - RNA, 18 nt, Mycobacterium avium subsp. paratuberculosis
ggcgcggauggguggcga

SEQ ID NO: 793741 - RNA, 14 nt, Mycobacterium avium subsp. paratuberculosis
ggcgcggaucguca

SEQ ID NO: 793742 - RNA, 23 nt, Mycobacterium avium subsp. paratuberculosis
ggcgcggaucgucaccgaccccu

SEQ ID NO: 793743 - RNA, 17 nt, Mycobacterium avium subsp. paratuberculosis
ggcgcgcggggccggcg

SEQ ID NO: 793744 - RNA, 19 nt, Mycobacterium avium subsp. paratuberculosis
ggcgcgcggggccggcgcg

SEQ ID NO: 793745 - RNA, 12 nt, Mycobacterium avium subsp. paratuberculosis
ggcgcgcggugg

SEQ ID NO: 793746 - RNA, 21 nt, Mycobacterium avium subsp. paratuberculosis
ggcgcgcguauuccagcgcca

SEQ ID NO: 793747 - RNA, 17 nt, Mycobacterium avium subsp. paratuberculosis
ggcgcgcuaacggcgcg

SEQ ID NO: 793748 - RNA, 16 nt, Mycobacterium avium subsp. paratuberculosis
ggcgcggagccggccg

SEQ ID NO: 793749 - RNA, 17 nt, Mycobacterium avium subsp. paratuberculosis
ggcgcggagccggccgc

SEQ ID NO: 793750 - RNA, 15 nt, Mycobacterium avium subsp. paratuberculosis
ggcgcggagcgucgc

SEQ ID NO: 793751 - RNA, 15 nt, Mycobacterium avium subsp. paratuberculosis
ggcgcgcgccgauca

SEQ ID NO: 793752 - RNA, 22 nt, Mycobacterium avium subsp. paratuberculosis
ggcgcguccauggucgagccgc

SEQ ID NO: 793753 - RNA, 21 nt, Mycobacterium avium subsp. paratuberculosis
ggcgcguccggaggugccggc

SEQ ID NO: 793754 - RNA, 22 nt, Mycobacterium avium subsp. paratuberculosis
ggcgcguccggaggugccggcc

SEQ ID NO: 793755 - RNA, 22 nt, Mycobacterium avium subsp. paratuberculosis
ggcgcguaaaggaugucgccgc

SEQ ID NO: 793756 - RNA, 15 nt, Mycobacterium avium subsp. paratuberculosis
ggcgcgguugucguu

SEQ ID NO: 793757 - RNA, 16 nt, Mycobacterium avium subsp. paratuberculosis
ggcgcgguugaccgcc

SEQ ID NO: 793758 - RNA, 23 nt, Mycobacterium avium subsp. paratuberculosis
ggcgcgguugcgguugucgguca

SEQ ID NO: 793759 - RNA, 19 nt, Mycobacterium avium subsp. paratuberculosis
ggcgcggugugggcgaugg

SEQ ID NO: 793760 - RNA, 13 nt, Mycobacterium avium subsp. paratuberculosis
ggcgcggugcgcc

SEQ ID NO: 793761 - RNA, 16 nt, Mycobacterium avium subsp. paratuberculosis
ggcgcggugcucggcg

SEQ ID NO: 793762 - RNA, 17 nt, Mycobacterium avium subsp. paratuberculosis
ggcgcggugcucggcgc

SEQ ID NO: 793763 - RNA, 14 nt, Mycobacterium avium subsp. paratuberculosis
ggcgcggucggugg

SEQ ID NO: 793764 - RNA, 17 nt, Mycobacterium avium subsp. paratuberculosis
ggcgcggucgcaggccg

SEQ ID NO: 793765 - RNA, 14 nt, Mycobacterium avium subsp. paratuberculosis
ggcgcggucgaaaa

SEQ ID NO: 793766 - RNA, 14 nt, Mycobacterium avium subsp. paratuberculosis
ggcgcggggcgcga

SEQ ID NO: 793767 - RNA, 16 nt, Mycobacterium avium subsp. paratuberculosis
ggcgcgggggcggccu

SEQ ID NO: 793768 - RNA, 20 nt, Mycobacterium avium subsp. paratuberculosis
ggcgcgggucgcuggccgcg

SEQ ID NO: 793769 - RNA, 16 nt, Mycobacterium avium subsp. paratuberculosis
ggcgcgggcggcaggu

SEQ ID NO: 793770 - RNA, 20 nt, Mycobacterium avium subsp. paratuberculosis
ggcgcgggcggcgucggcga

SEQ ID NO: 793771 - RNA, 13 nt, Mycobacterium avium subsp. paratuberculosis
ggcgcggggccac

SEQ ID NO: 793772 - RNA, 16 nt, Mycobacterium avium subsp. paratuberculosis
ggcgcgggcgcccucc

SEQ ID NO: 793773 - RNA, 13 nt, Mycobacterium avium subsp. paratuberculosis
ggcgcgggaucgg

SEQ ID NO: 793774 - RNA, 17 nt, Mycobacterium avium subsp. paratuberculosis
ggcgcgggaucggugcc

SEQ ID NO: 793775 - RNA, 18 nt, Mycobacterium avium subsp. paratuberculosis
ggcgcggccggugcgcgu

SEQ ID NO: 793776 - RNA, 19 nt, Mycobacterium avium subsp. paratuberculosis
ggcgcggcuuuuggcgucg

SEQ ID NO: 793777 - RNA, 17 nt, Mycobacterium avium subsp. paratuberculosis
ggcgcgggccagcagca

SEQ ID NO: 793778 - RNA, 13 nt, Mycobacterium avium subsp. paratuberculosis
ggcgcgggccgca

SEQ ID NO: 793779 - RNA, 13 nt, Mycobacterium avium subsp. paratuberculosis
ggcgcgggccgcg

SEQ ID NO: 793780 - RNA, 12 nt, Mycobacterium avium subsp. paratuberculosis
ggcgcggccgcc

SEQ ID NO: 793781 - RNA, 13 nt, Mycobacterium avium subsp. paratuberculosis
ggcgcggccgccc

SEQ ID NO: 793782 - RNA, 19 nt, Mycobacterium avium subsp. paratuberculosis
ggcgcggccgcccagcccg

SEQ ID NO: 793783 - RNA, 23 nt, Mycobacterium avium subsp. paratuberculosis
ggcgcggccgcccagcccgcgcc

SEQ ID NO: 793784 - RNA, 14 nt, Mycobacterium avium subsp. paratuberculosis
ggcgcggcccggcc

SEQ ID NO: 793785 - RNA, 19 nt, Mycobacterium avium subsp. paratuberculosis
ggcgcggcccggcccgcug

SEQ ID NO: 793786 - RNA, 13 nt, Mycobacterium avium subsp. paratuberculosis
gcgaccaccacgg

SEQ ID NO: 793787 - RNA, 18 nt, Mycobacterium avium subsp. paratuberculosis
gcgaccaccacggccgca

SEQ ID NO: 793788 - RNA, 23 nt, Mycobacterium avium subsp. paratuberculosis
gcgaccacauaccgggacaucgu

SEQ ID NO: 793789 - RNA, 13 nt, Mycobacterium avium subsp. paratuberculosis
gcgaccaccggcc

SEQ ID NO: 793790 - RNA, 15 nt, Mycobacterium avium subsp. paratuberculosis
gcgaccaccggccga

SEQ ID NO: 793791 - RNA, 19 nt, Mycobacterium avium subsp. paratuberculosis
gcgaccaccucggcgacga

SEQ ID NO: 793792 - RNA, 14 nt, Mycobacterium avium subsp. paratuberculosis
gcgacauuggccgc

SEQ ID NO: 793793 - RNA, 17 nt, Mycobacterium avium subsp. paratuberculosis
gcgacauuggccgcgcg

SEQ ID NO: 793794 - RNA, 22 nt, Mycobacterium avium subsp. paratuberculosis
gcgacauuggccgcgcgcaggc

SEQ ID NO: 793795 - RNA, 23 nt, Mycobacterium avium subsp. paratuberculosis
gcgaccaaugcccugaccccggu

SEQ ID NO: 793796 - RNA, 13 nt, Mycobacterium avium subsp. paratuberculosis
gcgaccacaccgc

SEQ ID NO: 793797 - RNA, 15 nt, Mycobacterium avium subsp. paratuberculosis
gcgaccacaccgccg

SEQ ID NO: 793798 - RNA, 16 nt, Mycobacterium avium subsp. paratuberculosis
gcgaccacaccgccgg

SEQ ID NO: 793799 - RNA, 20 nt, Mycobacterium avium subsp. paratuberculosis
gcgaccacaccgccggccac

SEQ ID NO: 793800 - RNA, 21 nt, Mycobacterium avium subsp. paratuberculosis
gcgaccacaccgccggccacg

SEQ ID NO: 793801 - RNA, 21 nt, Mycobacterium avium subsp. paratuberculosis
gcgaccacaccgucgacgacg

SEQ ID NO: 793802 - RNA, 14 nt, Mycobacterium avium subsp. paratuberculosis
gcgacaggucggcg

SEQ ID NO: 793803 - RNA, 18 nt, Mycobacterium avium subsp. paratuberculosis
gcgacaggucggcggucg

SEQ ID NO: 793804 - RNA, 20 nt, Mycobacterium avium subsp. paratuberculosis
gcgacaggucggcggucgcg

SEQ ID NO: 793805 - RNA, 23 nt, Mycobacterium avium subsp. paratuberculosis
gcgacaggucggcggucgcggug

SEQ ID NO: 793806 - RNA, 17 nt, Mycobacterium avium subsp. paratuberculosis
gcgacccgcucgacgcg

SEQ ID NO: 793807 - RNA, 21 nt, Mycobacterium avium subsp. paratuberculosis
gcgacccgcucgacgcgcacc

SEQ ID NO: 793808 - RNA, 18 nt, Mycobacterium avium subsp. paratuberculosis
gcgacccgcacgaugccg

SEQ ID NO: 793809 - RNA, 21 nt, Mycobacterium avium subsp. paratuberculosis
gcgacccgcacgaugccgcgc

SEQ ID NO: 793810 - RNA, 15 nt, Mycobacterium avium subsp. paratuberculosis
gcgaccccggaccgc

SEQ ID NO: 793811 - RNA, 13 nt, Mycobacterium avium subsp. paratuberculosis
gcgaccccggcca

SEQ ID NO: 793812 - RNA, 14 nt, Mycobacterium avium subsp. paratuberculosis
gcgaccccggccag

SEQ ID NO: 793813 - RNA, 12 nt, Mycobacterium avium subsp. paratuberculosis
gcgacccggccg

SEQ ID NO: 793814 - RNA, 22 nt, Mycobacterium avium subsp. paratuberculosis
gcgacccggccgagcgcgccga

SEQ ID NO: 793815 - RNA, 13 nt, Mycobacterium avium subsp. paratuberculosis
gcgacccgggccg

SEQ ID NO: 793816 - RNA, 14 nt, Mycobacterium avium subsp. paratuberculosis
gcgacccgggccgc

SEQ ID NO: 793817 - RNA, 16 nt, Mycobacterium avium subsp. paratuberculosis
gcgacccgggccgcca

SEQ ID NO: 793818 - RNA, 21 nt, Mycobacterium avium subsp. paratuberculosis
gcgacccgggccgccacggcg

SEQ ID NO: 793819 - RNA, 16 nt, Mycobacterium avium subsp. paratuberculosis
gcgacccaggccgccg

SEQ ID NO: 793820 - RNA, 18 nt, Mycobacterium avium subsp. paratuberculosis
gcgacccaggccgccgcc

SEQ ID NO: 793821 - RNA, 19 nt, Mycobacterium avium subsp. paratuberculosis
gcgacccaggccgccgcca

SEQ ID NO: 793822 - RNA, 22 nt, Mycobacterium avium subsp. paratuberculosis
gcgacccaggccgccgccaccg

SEQ ID NO: 793823 - RNA, 23 nt, Mycobacterium avium subsp. paratuberculosis
gcgacccaggccgccgccaccgu

SEQ ID NO: 793824 - RNA, 13 nt, Mycobacterium avium subsp. paratuberculosis
gcgacccaggccg

SEQ ID NO: 793825 - RNA, 14 nt, Mycobacterium avium subsp. paratuberculosis
gcgaccacgaccgg

SEQ ID NO: 793826 - RNA, 22 nt, Mycobacterium avium subsp. paratuberculosis
gcgacccccggugucugaccuc

SEQ ID NO: 793827 - RNA, 19 nt, Mycobacterium avium subsp. paratuberculosis
gcgaccccgccgucgacgc

SEQ ID NO: 793828 - RNA, 13 nt, Mycobacterium avium subsp. paratuberculosis
gcgaccccguucg

SEQ ID NO: 793829 - RNA, 17 nt, Mycobacterium avium subsp. paratuberculosis
gcgaccccguucgccga

SEQ ID NO: 793830 - RNA, 18 nt, Mycobacterium avium subsp. paratuberculosis
gcgaccccguucgccgac

SEQ ID NO: 793831 - RNA, 18 nt, Mycobacterium avium subsp. paratuberculosis
gcgaccccuacgggcgca

SEQ ID NO: 793832 - RNA, 22 nt, Mycobacterium avium subsp. paratuberculosis
gcgaccccuacgggcgcaccgc

SEQ ID NO: 793833 - RNA, 17 nt, Mycobacterium avium subsp. paratuberculosis
gcgaccccuccaacggc

SEQ ID NO: 793834 - RNA, 20 nt, Mycobacterium avium subsp. paratuberculosis
gcgaccccuccaacggccgc

SEQ ID NO: 793835 - RNA, 21 nt, Mycobacterium avium subsp. paratuberculosis
gcgaccccuccaacggccgca

SEQ ID NO: 793836 - RNA, 21 nt, Mycobacterium avium subsp. paratuberculosis
gcgacaggaaccuggucgggg

SEQ ID NO: 793837 - RNA, 15 nt, Mycobacterium avium subsp. paratuberculosis
gcgacaccgcggcga

SEQ ID NO: 793838 - RNA, 19 nt, Mycobacterium avium subsp. paratuberculosis
gcgacaccgcggcgacguc

SEQ ID NO: 793839 - RNA, 17 nt, Mycobacterium avium subsp. paratuberculosis
gcgacagcgcgucggcc

SEQ ID NO: 793840 - RNA, 21 nt, Mycobacterium avium subsp. paratuberculosis
gcgacaccccgcgagucaccg

SEQ ID NO: 793841 - RNA, 22 nt, Mycobacterium avium subsp. paratuberculosis
gcgacaccccgcgagucaccgg

SEQ ID NO: 793842 - RNA, 16 nt, Mycobacterium avium subsp. paratuberculosis
gcgacacccgcgacga

SEQ ID NO: 793843 - RNA, 12 nt, Mycobacterium avium subsp. paratuberculosis
gcgacaccggcg

SEQ ID NO: 793844 - RNA, 14 nt, Mycobacterium avium subsp. paratuberculosis
gcgacaccggcgug

SEQ ID NO: 793845 - RNA, 15 nt, Mycobacterium avium subsp. paratuberculosis
gcgacaccggcguga

SEQ ID NO: 793846 - RNA, 11 nt, Mycobacterium avium subsp. paratuberculosis
gcgacaccgca

SEQ ID NO: 793847 - RNA, 12 nt, Mycobacterium avium subsp. paratuberculosis
gcgacaccacgg

SEQ ID NO: 793848 - RNA, 14 nt, Mycobacterium avium subsp. paratuberculosis
gcgacaccaggucg

SEQ ID NO: 793849 - RNA, 15 nt, Mycobacterium avium subsp. paratuberculosis
gcgacaccaggucga

SEQ ID NO: 793850 - RNA, 16 nt, Mycobacterium avium subsp. paratuberculosis
gcgacacccagcggcg

SEQ ID NO: 793851 - RNA, 19 nt, Mycobacterium avium subsp. paratuberculosis
gcgacacccagcggcgcgg

SEQ ID NO: 793852 - RNA, 21 nt, Mycobacterium avium subsp. paratuberculosis
gcgacacccagcggcgcggcc

SEQ ID NO: 793853 - RNA, 18 nt, Mycobacterium avium subsp. paratuberculosis
gcgacaaggucgaccgcg

SEQ ID NO: 793854 - RNA, 16 nt, Mycobacterium avium subsp. paratuberculosis
gcgacaacgggccgcc

SEQ ID NO: 793855 - RNA, 15 nt, Mycobacterium avium subsp. paratuberculosis
gcgacaacguggugu

SEQ ID NO: 793856 - RNA, 23 nt, Mycobacterium avium subsp. paratuberculosis
gcgacaacguggugugcaccagc

SEQ ID NO: 793857 - RNA, 13 nt, Mycobacterium avium subsp. paratuberculosis
gcgaagcucgacg

SEQ ID NO: 793858 - RNA, 14 nt, Mycobacterium avium subsp. paratuberculosis
gcgaagcucgacga

SEQ ID NO: 793859 - RNA, 19 nt, Mycobacterium avium subsp. paratuberculosis
gcgaagcguuucagcaacc

SEQ ID NO: 793860 - RNA, 17 nt, Mycobacterium avium subsp. paratuberculosis
gcgaagcuaaaccccac

SEQ ID NO: 793861 - RNA, 23 nt, Mycobacterium avium subsp. paratuberculosis
gcgaagcuaaaccccacggccgc

SEQ ID NO: 793862 - RNA, 19 nt, Mycobacterium avium subsp. paratuberculosis
gcgaagcgaaagacguuga

SEQ ID NO: 793863 - RNA, 13 nt, Mycobacterium avium subsp. paratuberculosis
gcgaagccggcgu

SEQ ID NO: 793864 - RNA, 15 nt, Mycobacterium avium subsp. paratuberculosis
gcgaagccggcguca

SEQ ID NO: 793865 - RNA, 14 nt, Mycobacterium avium subsp. paratuberculosis
gcgaagccggcccc

SEQ ID NO: 793866 - RNA, 18 nt, Mycobacterium avium subsp. paratuberculosis
gcgaagccggccccgccc

SEQ ID NO: 793867 - RNA, 20 nt, Mycobacterium avium subsp. paratuberculosis
gcgaccgaggucgacgcccc

SEQ ID NO: 793868 - RNA, 17 nt, Mycobacterium avium subsp. paratuberculosis
gcgaccgcaggucgaug

SEQ ID NO: 793869 - RNA, 18 nt, Mycobacterium avium subsp. paratuberculosis
gcgaccuguuuggccagc

SEQ ID NO: 793870 - RNA, 22 nt, Mycobacterium avium subsp. paratuberculosis
gcgaccuguuuggccagccagu

SEQ ID NO: 793871 - RNA, 22 nt, Mycobacterium avium subsp. paratuberculosis
gcgaccgccggacaccaccgcg

SEQ ID NO: 793872 - RNA, 23 nt, Mycobacterium avium subsp. paratuberculosis
gcgaccgccggacaccaccgcgg

SEQ ID NO: 793873 - RNA, 22 nt, Mycobacterium avium subsp. paratuberculosis
gcgaccgccgcguacagccagc

SEQ ID NO: 793874 - RNA, 13 nt, Mycobacterium avium subsp. paratuberculosis
gcgaccgccgcua

SEQ ID NO: 793875 - RNA, 14 nt, Mycobacterium avium subsp. paratuberculosis
gcgaccgcccgggc

SEQ ID NO: 793876 - RNA, 16 nt, Mycobacterium avium subsp. paratuberculosis
gcgaccgcccgggcca

SEQ ID NO: 793877 - RNA, 17 nt, Mycobacterium avium subsp. paratuberculosis
gcgaccgcccgggccag

SEQ ID NO: 793878 - RNA, 12 nt, Mycobacterium avium subsp. paratuberculosis
gcgaccgccgcc

SEQ ID NO: 793879 - RNA, 14 nt, Mycobacterium avium subsp. paratuberculosis
gcgaccgccgccgc

SEQ ID NO: 793880 - RNA, 15 nt, Mycobacterium avium subsp. paratuberculosis
gcgaccgccgccgcg

SEQ ID NO: 793881 - RNA, 16 nt, Mycobacterium avium subsp. paratuberculosis
gcgacgacaccaccgu

SEQ ID NO: 793882 - RNA, 21 nt, Mycobacterium avium subsp. paratuberculosis
gcgacgacaccaccgugcugg

SEQ ID NO: 793883 - RNA, 15 nt, Mycobacterium avium subsp. paratuberculosis
gcgacgacaccgugu

SEQ ID NO: 793884 - RNA, 14 nt, Mycobacterium avium subsp. paratuberculosis
gcgacgaagccggu

SEQ ID NO: 793885 - RNA, 15 nt, Mycobacterium avium subsp. paratuberculosis
gcgacgaagccggug

SEQ ID NO: 793886 - RNA, 17 nt, Mycobacterium avium subsp. paratuberculosis
gcgacgaagccggugcc

SEQ ID NO: 793887 - RNA, 19 nt, Mycobacterium avium subsp. paratuberculosis
gcgacgaagccggugccca

SEQ ID NO: 793888 - RNA, 16 nt, Mycobacterium avium subsp. paratuberculosis
gcgacgaagucgacgg

SEQ ID NO: 793889 - RNA, 17 nt, Mycobacterium avium subsp. paratuberculosis
gcgacgaagucgacggc

SEQ ID NO: 793890 - RNA, 21 nt, Mycobacterium avium subsp. paratuberculosis
gcgaccuugcgcagccggcag

SEQ ID NO: 793891 - RNA, 18 nt, Mycobacterium avium subsp. paratuberculosis
gcgaccuugcggcgcgau

SEQ ID NO: 793892 - RNA, 20 nt, Mycobacterium avium subsp. paratuberculosis
gcgacgaacagcaccgccac

SEQ ID NO: 793893 - RNA, 22 nt, Mycobacterium avium subsp. paratuberculosis
gcgacgaacagcaccgccacgg

SEQ ID NO: 793894 - RNA, 15 nt, Mycobacterium avium subsp. paratuberculosis
gcgacgaaccuggcu

SEQ ID NO: 793895 - RNA, 21 nt, Mycobacterium avium subsp. paratuberculosis
gcgacgaaccuggcugccugg

SEQ ID NO: 793896 - RNA, 22 nt, Mycobacterium avium subsp. paratuberculosis
gcgacgaaccuggcugccuggu

SEQ ID NO: 793897 - RNA, 15 nt, Mycobacterium avium subsp. paratuberculosis
gcgacgaacgccggc

SEQ ID NO: 793898 - RNA, 16 nt, Mycobacterium avium subsp. paratuberculosis
gcgacgaacgccggca

SEQ ID NO: 793899 - RNA, 22 nt, Mycobacterium avium subsp. paratuberculosis
gcgacgaacgcuuccagcacca

SEQ ID NO: 793900 - RNA, 23 nt, Mycobacterium avium subsp. paratuberculosis
gcgacgaacgcuuccagcaccac

SEQ ID NO: 793901 - RNA, 20 nt, Mycobacterium avium subsp. paratuberculosis
gcgacgaagcagcucgcgua

SEQ ID NO: 793902 - RNA, 22 nt, Mycobacterium avium subsp. paratuberculosis
gcgacgaauccggugaccgccu

SEQ ID NO: 793903 - RNA, 21 nt, Mycobacterium avium subsp. paratuberculosis
gcgacgaccgcaccgaccagc

SEQ ID NO: 793904 - RNA, 14 nt, Mycobacterium avium subsp. paratuberculosis
gcgacgaccgccug

SEQ ID NO: 793905 - RNA, 13 nt, Mycobacterium avium subsp. paratuberculosis
gcgacgaccucgc

SEQ ID NO: 793906 - RNA, 16 nt, Mycobacterium avium subsp. paratuberculosis
gcgacgaccucgcccg

SEQ ID NO: 793907 - RNA, 18 nt, Mycobacterium avium subsp. paratuberculosis
gcgacgaccucgcccgcc

SEQ ID NO: 793908 - RNA, 20 nt, Mycobacterium avium subsp. paratuberculosis
gcgacgaccucgcccgccgc

SEQ ID NO: 793909 - RNA, 23 nt, Mycobacterium avium subsp. paratuberculosis
gcgacgaccucgcccgccgcgac

SEQ ID NO: 793910 - RNA, 21 nt, Mycobacterium avium subsp. paratuberculosis
gcgacgagagcggaucggcgg

SEQ ID NO: 793911 - RNA, 21 nt, Mycobacterium avium subsp. paratuberculosis
gcgacgaugaagacccgccgg

SEQ ID NO: 793912 - RNA, 16 nt, Mycobacterium avium subsp. paratuberculosis
gcgacgagcgggccga

SEQ ID NO: 793913 - RNA, 21 nt, Mycobacterium avium subsp. paratuberculosis
gcgacgauaucggccgcgggg

SEQ ID NO: 793914 - RNA, 22 nt, Mycobacterium avium subsp. paratuberculosis
gcgacgauaucggccgcggggc

SEQ ID NO: 793915 - RNA, 21 nt, Mycobacterium avium subsp. paratuberculosis
gcgacgaucaccuuguugcgg

SEQ ID NO: 793916 - RNA, 18 nt, Mycobacterium avium subsp. paratuberculosis
gcgacgaucagcagccgg

SEQ ID NO: 793917 - RNA, 19 nt, Mycobacterium avium subsp. paratuberculosis
gcgacgaucagcagccggg

SEQ ID NO: 793918 - RNA, 21 nt, Mycobacterium avium subsp. paratuberculosis
gcgacgaucagcagccgggcc

SEQ ID NO: 793919 - RNA, 22 nt, Mycobacterium avium subsp. paratuberculosis
gcgacgaggugaugccguccag

SEQ ID NO: 793920 - RNA, 23 nt, Mycobacterium avium subsp. paratuberculosis
gcgacgaggugaugccguccagc

SEQ ID NO: 793921 - RNA, 12 nt, Mycobacterium avium subsp. paratuberculosis
gcgacgcaccuc

SEQ ID NO: 793922 - RNA, 17 nt, Mycobacterium avium subsp. paratuberculosis
gcgacgcaccucggccg

SEQ ID NO: 793923 - RNA, 20 nt, Mycobacterium avium subsp. paratuberculosis
gcgacgcaccucggccgggu

SEQ ID NO: 793924 - RNA, 21 nt, Mycobacterium avium subsp. paratuberculosis
gcgacgcacgaaaccgcgugg

SEQ ID NO: 793925 - RNA, 16 nt, Mycobacterium avium subsp. paratuberculosis
gcgacgaugccggccg

SEQ ID NO: 793926 - RNA, 21 nt, Mycobacterium avium subsp. paratuberculosis
gcgacgaugccggccgggacg

SEQ ID NO: 793927 - RNA, 17 nt, Mycobacterium avium subsp. paratuberculosis
gcgacgaugccggcguc

SEQ ID NO: 793928 - RNA, 18 nt, Mycobacterium avium subsp. paratuberculosis
gcgacgaugccggcgucg

SEQ ID NO: 793929 - RNA, 19 nt, Mycobacterium avium subsp. paratuberculosis
gcgacgaugccggcgucgu

SEQ ID NO: 793930 - RNA, 12 nt, Mycobacterium avium subsp. paratuberculosis
gcgacgaugccg

SEQ ID NO: 793931 - RNA, 16 nt, Mycobacterium avium subsp. paratuberculosis
gcgacgaugcggccgu

SEQ ID NO: 793932 - RNA, 19 nt, Mycobacterium avium subsp. paratuberculosis
gcgacgaugcggccguugg

SEQ ID NO: 793933 - RNA, 13 nt, Mycobacterium avium subsp. paratuberculosis
gcgacgauggcca

SEQ ID NO: 793934 - RNA, 22 nt, Mycobacterium avium subsp. paratuberculosis
gcgacgaugucgacccgcggcg

SEQ ID NO: 793935 - RNA, 23 nt, Mycobacterium avium subsp. paratuberculosis
gcgacgcccacugguaaccgccc

SEQ ID NO: 793936 - RNA, 13 nt, Mycobacterium avium subsp. paratuberculosis
gcgacgcccaggu

SEQ ID NO: 793937 - RNA, 21 nt, Mycobacterium avium subsp. paratuberculosis
gcgacgccacggggcugcggg

SEQ ID NO: 793938 - RNA, 23 nt, Mycobacterium avium subsp. paratuberculosis
gcgacgccagcaccuucgggccg

SEQ ID NO: 793939 - RNA, 15 nt, Mycobacterium avium subsp. paratuberculosis
gcgacgccagcggca

SEQ ID NO: 793940 - RNA, 17 nt, Mycobacterium avium subsp. paratuberculosis
gcgacgccagcggcagc

SEQ ID NO: 793941 - RNA, 22 nt, Mycobacterium avium subsp. paratuberculosis
gcgacgccagcggcagcgccag

SEQ ID NO: 793942 - RNA, 18 nt, Mycobacterium avium subsp. paratuberculosis
gcgacgccaugucgaugu

SEQ ID NO: 793943 - RNA, 14 nt, Mycobacterium avium subsp. paratuberculosis
gcgacgccggcgag

SEQ ID NO: 793944 - RNA, 19 nt, Mycobacterium avium subsp. paratuberculosis
gcgacgccgucauccccau

SEQ ID NO: 793945 - RNA, 20 nt, Mycobacterium avium subsp. paratuberculosis
gcgacgccgucauccccauc

SEQ ID NO: 793946 - RNA, 13 nt, Mycobacterium avium subsp. paratuberculosis
gcgacgccgucgg

SEQ ID NO: 793947 - RNA, 14 nt, Mycobacterium avium subsp. paratuberculosis
gcgacgccgccgcc

SEQ ID NO: 793948 - RNA, 13 nt, Mycobacterium avium subsp. paratuberculosis
gcgacgccgccgu

SEQ ID NO: 793949 - RNA, 15 nt, Mycobacterium avium subsp. paratuberculosis
gcgacgccgccgucg

SEQ ID NO: 793950 - RNA, 18 nt, Mycobacterium avium subsp. paratuberculosis
gcgacgccgacgcccagc

SEQ ID NO: 793951 - RNA, 21 nt, Mycobacterium avium subsp. paratuberculosis
gcgacgccgcgcagcggggcg

SEQ ID NO: 793952 - RNA, 19 nt, Mycobacterium avium subsp. paratuberculosis
gcgacgccgcgcuggccgg

SEQ ID NO: 793953 - RNA, 15 nt, Mycobacterium avium subsp. paratuberculosis
gcgacgcgcucggcg

SEQ ID NO: 793954 - RNA, 19 nt, Mycobacterium avium subsp. paratuberculosis
gcgacgcggugagcgcgcc

SEQ ID NO: 793955 - RNA, 20 nt, Mycobacterium avium subsp. paratuberculosis
gcgacgcggugagcgcgccg

SEQ ID NO: 793956 - RNA, 17 nt, Mycobacterium avium subsp. paratuberculosis
gcgacgcgaucgaggug

SEQ ID NO: 793957 - RNA, 21 nt, Mycobacterium avium subsp. paratuberculosis
gcgacgcgaucgaggugaugu

SEQ ID NO: 793958 - RNA, 19 nt, Mycobacterium avium subsp. paratuberculosis
gcgacgccgugcuuccauu

SEQ ID NO: 793959 - RNA, 23 nt, Mycobacterium avium subsp. paratuberculosis
gcgacgcgcaugcccuggacgag

SEQ ID NO: 793960 - RNA, 13 nt, Mycobacterium avium subsp. paratuberculosis
gcgacgcucaggc

SEQ ID NO: 793961 - RNA, 18 nt, Mycobacterium avium subsp. paratuberculosis
gcgacgcucaggcgucca

SEQ ID NO: 793962 - RNA, 23 nt, Mycobacterium avium subsp. paratuberculosis
gcgacgcucaggcguccagccag

SEQ ID NO: 793963 - RNA, 11 nt, Mycobacterium avium subsp. paratuberculosis
gcgacgcggcu

SEQ ID NO: 793964 - RNA, 17 nt, Mycobacterium avium subsp. paratuberculosis
gcgacgcgggauugccg

SEQ ID NO: 793965 - RNA, 17 nt, Mycobacterium avium subsp. paratuberculosis
gcgacgcugagcgccag

SEQ ID NO: 793966 - RNA, 17 nt, Mycobacterium avium subsp. paratuberculosis
gcgacgcugccggggcg

SEQ ID NO: 793967 - RNA, 21 nt, Mycobacterium avium subsp. paratuberculosis
gcgacgcugccggggcgcagc

SEQ ID NO: 793968 - RNA, 13 nt, Mycobacterium avium subsp. paratuberculosis
gcgaguagcugcc

SEQ ID NO: 793969 - RNA, 18 nt, Mycobacterium avium subsp. paratuberculosis
gcgaggugggcaccagcu

SEQ ID NO: 793970 - RNA, 15 nt, Mycobacterium avium subsp. paratuberculosis
gcgaggugucgacgc

SEQ ID NO: 793971 - RNA, 19 nt, Mycobacterium avium subsp. paratuberculosis
gcgaggaauugcgcuacgg

SEQ ID NO: 793972 - RNA, 22 nt, Mycobacterium avium subsp. paratuberculosis
gcgaggaucgcgaugucgacgg

SEQ ID NO: 793973 - RNA, 14 nt, Mycobacterium avium subsp. paratuberculosis
gcgaggacgucguc

SEQ ID NO: 793974 - RNA, 15 nt, Mycobacterium avium subsp. paratuberculosis
gcgagucgagcaccg

SEQ ID NO: 793975 - RNA, 20 nt, Mycobacterium avium subsp. paratuberculosis
gcgagucgagguugaugccg

SEQ ID NO: 793976 - RNA, 13 nt, Mycobacterium avium subsp. paratuberculosis
gcgagucaccggc

SEQ ID NO: 793977 - RNA, 19 nt, Mycobacterium avium subsp. paratuberculosis
gcgagucaccggcucgcgg

SEQ ID NO: 793978 - RNA, 14 nt, Mycobacterium avium subsp. paratuberculosis
gcgaguccggccag

SEQ ID NO: 793979 - RNA, 18 nt, Mycobacterium avium subsp. paratuberculosis
gcgagucgaagccgucca

SEQ ID NO: 793980 - RNA, 22 nt, Mycobacterium avium subsp. paratuberculosis
gcgagucgaagccguccaggcc

SEQ ID NO: 793981 - RNA, 23 nt, Mycobacterium avium subsp. paratuberculosis
gcgagucgaagccguccaggccg

SEQ ID NO: 793982 - RNA, 21 nt, Mycobacterium avium subsp. paratuberculosis
gcgagucgaagccguggcagg

SEQ ID NO: 793983 - RNA, 18 nt, Mycobacterium avium subsp. paratuberculosis
gcgagucgaaggcgcggg

SEQ ID NO: 793984 - RNA, 14 nt, Mycobacterium avium subsp. paratuberculosis
gcgagucccggcgc

SEQ ID NO: 793985 - RNA, 18 nt, Mycobacterium avium subsp. paratuberculosis
gcgagucccggcgcacca

SEQ ID NO: 793986 - RNA, 21 nt, Mycobacterium avium subsp. paratuberculosis
gcgagucccggcgcaccaggc

SEQ ID NO: 793987 - RNA, 14 nt, Mycobacterium avium subsp. paratuberculosis
gcgagucaucgcca

SEQ ID NO: 793988 - RNA, 15 nt, Mycobacterium avium subsp. paratuberculosis
gcgagucaucgccac

SEQ ID NO: 793989 - RNA, 18 nt, Mycobacterium avium subsp. paratuberculosis
gcgagucaucgccacccg

SEQ ID NO: 793990 - RNA, 19 nt, Mycobacterium avium subsp. paratuberculosis
gcgagucaucgccacccgc

SEQ ID NO: 793991 - RNA, 18 nt, Mycobacterium avium subsp. paratuberculosis
gcgaguccagccagccgc

SEQ ID NO: 793992 - RNA, 20 nt, Mycobacterium avium subsp. paratuberculosis
gcgaguccagccagccgcgc

SEQ ID NO: 793993 - RNA, 22 nt, Mycobacterium avium subsp. paratuberculosis
gcgaguccagccagccgcgccg

SEQ ID NO: 793994 - RNA, 20 nt, Mycobacterium avium subsp. paratuberculosis
gcgagcuuguccugcaccga

SEQ ID NO: 793995 - RNA, 21 nt, Mycobacterium avium subsp. paratuberculosis
gcgagcuuguccugcaccgac

SEQ ID NO: 793996 - RNA, 20 nt, Mycobacterium avium subsp. paratuberculosis
gcgaggaccgagaugaagac

SEQ ID NO: 793997 - RNA, 16 nt, Mycobacterium avium subsp. paratuberculosis
gcgaggaacccgaccg

SEQ ID NO: 793998 - RNA, 17 nt, Mycobacterium avium subsp. paratuberculosis
gcgaggaacccgaccgc

SEQ ID NO: 793999 - RNA, 18 nt, Mycobacterium avium subsp. paratuberculosis
gcgaggaacccgaccgcg

SEQ ID NO: 794000 - RNA, 15 nt, Mycobacterium avium subsp. paratuberculosis
gcgaggaaguccggc

SEQ ID NO: 794001 - RNA, 17 nt, Mycobacterium avium subsp. paratuberculosis
gcgaggaaguccggcgc

SEQ ID NO: 794002 - RNA, 18 nt, Mycobacterium avium subsp. paratuberculosis
gcgaggaaguccggcgcg

SEQ ID NO: 794003 - RNA, 18 nt, Mycobacterium avium subsp. paratuberculosis
gcgagcgaggccaucauc

SEQ ID NO: 794004 - RNA, 17 nt, Mycobacterium avium subsp. paratuberculosis
gcgagcugccggcggcc

SEQ ID NO: 794005 - RNA, 15 nt, Mycobacterium avium subsp. paratuberculosis
gcgagcugcuucguc

SEQ ID NO: 794006 - RNA, 20 nt, Mycobacterium avium subsp. paratuberculosis
gcgagcugcuucgucgccgg

SEQ ID NO: 794007 - RNA, 12 nt, Mycobacterium avium subsp. paratuberculosis
gcgagcgcacca

SEQ ID NO: 794008 - RNA, 13 nt, Mycobacterium avium subsp. paratuberculosis
gcgagcgcagcag

SEQ ID NO: 794009 - RNA, 14 nt, Mycobacterium avium subsp. paratuberculosis
gcgagcgcagcgcc

SEQ ID NO: 794010 - RNA, 15 nt, Mycobacterium avium subsp. paratuberculosis
gcgagcgcagcgcca

SEQ ID NO: 794011 - RNA, 18 nt, Mycobacterium avium subsp. paratuberculosis
gcgagcgcagcgccaggc

SEQ ID NO: 794012 - RNA, 19 nt, Mycobacterium avium subsp. paratuberculosis
gcgauagccaucagaacgc

SEQ ID NO: 794013 - RNA, 23 nt, Mycobacterium avium subsp. paratuberculosis
gcgauagccggugaucgcggcgc

SEQ ID NO: 794014 - RNA, 18 nt, Mycobacterium avium subsp. paratuberculosis
gcgauaaccucggcggcg

SEQ ID NO: 794015 - RNA, 22 nt, Mycobacterium avium subsp. paratuberculosis
gcgauaaccucggcggcggcgc

SEQ ID NO: 794016 - RNA, 14 nt, Mycobacterium avium subsp. paratuberculosis
gcgagugccggcca

SEQ ID NO: 794017 - RNA, 15 nt, Mycobacterium avium subsp. paratuberculosis
gcgagugccggccag

SEQ ID NO: 794018 - RNA, 16 nt, Mycobacterium avium subsp. paratuberculosis
gcgagugccggccagc

SEQ ID NO: 794019 - RNA, 14 nt, Mycobacterium avium subsp. paratuberculosis
gcgagucgcggauc

SEQ ID NO: 794020 - RNA, 18 nt, Mycobacterium avium subsp. paratuberculosis
gcgagucgaugaccucgc

SEQ ID NO: 794021 - RNA, 21 nt, Mycobacterium avium subsp. paratuberculosis
gcgagucgaugaccucgcgcc

SEQ ID NO: 794022 - RNA, 22 nt, Mycobacterium avium subsp. paratuberculosis
gcgagucgaugaccucgcgccc

SEQ ID NO: 794023 - RNA, 20 nt, Mycobacterium avium subsp. paratuberculosis
gcgagugggugaaggccugg

SEQ ID NO: 794024 - RNA, 17 nt, Mycobacterium avium subsp. paratuberculosis
gcgagugguaccgggug

SEQ ID NO: 794025 - RNA, 20 nt, Mycobacterium avium subsp. paratuberculosis
gcgagugguaccggguggcc

SEQ ID NO: 794026 - RNA, 21 nt, Mycobacterium avium subsp. paratuberculosis
gcgagugguaccggguggccg

SEQ ID NO: 794027 - RNA, 16 nt, Mycobacterium avium subsp. paratuberculosis
gcgaguucgaccucca

SEQ ID NO: 794028 - RNA, 20 nt, Mycobacterium avium subsp. paratuberculosis
gcgaguucgaccuccacccg

SEQ ID NO: 794029 - RNA, 22 nt, Mycobacterium avium subsp. paratuberculosis
gcgaguucgaccuccacccgcu

SEQ ID NO: 794030 - RNA, 21 nt, Mycobacterium avium subsp. paratuberculosis
gcgaguucgaugacgucgcgc

SEQ ID NO: 794031 - RNA, 15 nt, Mycobacterium avium subsp. paratuberculosis
gcgaguucgccugcu

SEQ ID NO: 794032 - RNA, 21 nt, Mycobacterium avium subsp. paratuberculosis
gcgaguucugguaggcggccg

SEQ ID NO: 794033 - RNA, 22 nt, Mycobacterium avium subsp. paratuberculosis
gcgaguucugguaggcggccgg

SEQ ID NO: 794034 - RNA, 13 nt, Mycobacterium avium subsp. paratuberculosis
gcgacggcggcga

SEQ ID NO: 794035 - RNA, 22 nt, Mycobacterium avium subsp. paratuberculosis
gcgacggcggcgaagacgucgg

SEQ ID NO: 794036 - RNA, 18 nt, Mycobacterium avium subsp. paratuberculosis
gcgacucguuggccggcu

SEQ ID NO: 794037 - RNA, 15 nt, Mycobacterium avium subsp. paratuberculosis
gcgacggcgccugau

SEQ ID NO: 794038 - RNA, 15 nt, Mycobacterium avium subsp. paratuberculosis
gcgacggcgcccgcc

SEQ ID NO: 794039 - RNA, 16 nt, Mycobacterium avium subsp. paratuberculosis
gcgacggcgcccgccc

SEQ ID NO: 794040 - RNA, 12 nt, Mycobacterium avium subsp. paratuberculosis
gcgacggcccgc

SEQ ID NO: 794041 - RNA, 14 nt, Mycobacterium avium subsp. paratuberculosis
gcgacggcccgccg

SEQ ID NO: 794042 - RNA, 16 nt, Mycobacterium avium subsp. paratuberculosis
gcgacggcccgccgga

SEQ ID NO: 794043 - RNA, 13 nt, Mycobacterium avium subsp. paratuberculosis
gcgacggcccggu

SEQ ID NO: 794044 - RNA, 17 nt, Mycobacterium avium subsp. paratuberculosis
gcgacggcccgguccag

SEQ ID NO: 794045 - RNA, 21 nt, Mycobacterium avium subsp. paratuberculosis
gcgacggcccgguccaguugu

SEQ ID NO: 794046 - RNA, 17 nt, Mycobacterium avium subsp. paratuberculosis
gcgacggccggggccag

SEQ ID NO: 794047 - RNA, 19 nt, Mycobacterium avium subsp. paratuberculosis
gcgacggccggggccagca

SEQ ID NO: 794048 - RNA, 16 nt, Mycobacterium avium subsp. paratuberculosis
gcgacggccucgccgu

SEQ ID NO: 794049 - RNA, 18 nt, Mycobacterium avium subsp. paratuberculosis
gcgacggccucgccgucg

SEQ ID NO: 794050 - RNA, 19 nt, Mycobacterium avium subsp. paratuberculosis
gcgacggccucgccgucgc

SEQ ID NO: 794051 - RNA, 21 nt, Mycobacterium avium subsp. paratuberculosis
gcgacggccucgccgucgcga

SEQ ID NO: 794052 - RNA, 16 nt, Mycobacterium avium subsp. paratuberculosis
gcgacgcugguggccu

SEQ ID NO: 794053 - RNA, 18 nt, Mycobacterium avium subsp. paratuberculosis
gcgacgcugguggccugc

SEQ ID NO: 794054 - RNA, 17 nt, Mycobacterium avium subsp. paratuberculosis
gcgacggccagcgcggc

SEQ ID NO: 794055 - RNA, 14 nt, Mycobacterium avium subsp. paratuberculosis
gcgacggcgaacgg

SEQ ID NO: 794056 - RNA, 13 nt, Mycobacterium avium subsp. paratuberculosis
gcgacggcgacca

SEQ ID NO: 794057 - RNA, 15 nt, Mycobacterium avium subsp. paratuberculosis
gcgacggcgacgacc

SEQ ID NO: 794058 - RNA, 17 nt, Mycobacterium avium subsp. paratuberculosis
gcgacggcgacgaccgu

SEQ ID NO: 794059 - RNA, 17 nt, Mycobacterium avium subsp. paratuberculosis
gcgacggcgacggccag

SEQ ID NO: 794060 - RNA, 18 nt, Mycobacterium avium subsp. paratuberculosis
gcgacggcgacggccaga

SEQ ID NO: 794061 - RNA, 15 nt, Mycobacterium avium subsp. paratuberculosis
gcgacggcgacggcg

SEQ ID NO: 794062 - RNA, 13 nt, Mycobacterium avium subsp. paratuberculosis
gcgacggcgagcc

SEQ ID NO: 794063 - RNA, 18 nt, Mycobacterium avium subsp. paratuberculosis
gcgacggcgagccgggcc

SEQ ID NO: 794064 - RNA, 19 nt, Mycobacterium avium subsp. paratuberculosis
gcgagaaaaucgcccgcga

SEQ ID NO: 794065 - RNA, 20 nt, Mycobacterium avium subsp. paratuberculosis
gcgacuucguugguggucga

SEQ ID NO: 794066 - RNA, 23 nt, Mycobacterium avium subsp. paratuberculosis
gcgacuucguugguggucgacgc

SEQ ID NO: 794067 - RNA, 14 nt, Mycobacterium avium subsp. paratuberculosis
gcgacuucuacggc

SEQ ID NO: 794068 - RNA, 15 nt, Mycobacterium avium subsp. paratuberculosis
gcgacuucuacggcg

SEQ ID NO: 794069 - RNA, 20 nt, Mycobacterium avium subsp. paratuberculosis
gcgacuucuacggcgggccg

SEQ ID NO: 794070 - RNA, 22 nt, Mycobacterium avium subsp. paratuberculosis
gcgacuucuacggcgggccggc

SEQ ID NO: 794071 - RNA, 18 nt, Mycobacterium avium subsp. paratuberculosis
gcgacuugaccagcagcu

SEQ ID NO: 794072 - RNA, 17 nt, Mycobacterium avium subsp. paratuberculosis
gcgacuugccgccggcg

SEQ ID NO: 794073 - RNA, 20 nt, Mycobacterium avium subsp. paratuberculosis
gcgacuugccgccggcgcag

SEQ ID NO: 794074 - RNA, 22 nt, Mycobacterium avium subsp. paratuberculosis
gcgacuugccgccggcgcaguc

SEQ ID NO: 794075 - RNA, 14 nt, Mycobacterium avium subsp. paratuberculosis
gcgacuugguggcc

SEQ ID NO: 794076 - RNA, 17 nt, Mycobacterium avium subsp. paratuberculosis
gcgacuugguggccagc

SEQ ID NO: 794077 - RNA, 21 nt, Mycobacterium avium subsp. paratuberculosis
gcgacuugguggccagcacca

SEQ ID NO: 794078 - RNA, 23 nt, Mycobacterium avium subsp. paratuberculosis
gcgacuugguggccagcaccacg

SEQ ID NO: 794079 - RNA, 20 nt, Mycobacterium avium subsp. paratuberculosis
gcgacugcaggugacggaug

SEQ ID NO: 794080 - RNA, 15 nt, Mycobacterium avium subsp. paratuberculosis
gcgacugucggcgcc

SEQ ID NO: 794081 - RNA, 16 nt, Mycobacterium avium subsp. paratuberculosis
gcgacugucggcgccc

SEQ ID NO: 794082 - RNA, 17 nt, Mycobacterium avium subsp. paratuberculosis
gcgacugucggcucgcc

SEQ ID NO: 794083 - RNA, 20 nt, Mycobacterium avium subsp. paratuberculosis
gcgacugggugcucccgcca

SEQ ID NO: 794084 - RNA, 21 nt, Mycobacterium avium subsp. paratuberculosis
gcgacugggugcucccgccaa

SEQ ID NO: 794085 - RNA, 13 nt, Mycobacterium avium subsp. paratuberculosis
gcgacugcacccg

SEQ ID NO: 794086 - RNA, 23 nt, Mycobacterium avium subsp. paratuberculosis
gcgacugcacccgaacggaccgg

SEQ ID NO: 794087 - RNA, 14 nt, Mycobacterium avium subsp. paratuberculosis
gcgagaaccggcgc

SEQ ID NO: 794088 - RNA, 15 nt, Mycobacterium avium subsp. paratuberculosis
gcgagaaccggcgca

SEQ ID NO: 794089 - RNA, 16 nt, Mycobacterium avium subsp. paratuberculosis
gcgagaaccggcgcag

SEQ ID NO: 794090 - RNA, 16 nt, Mycobacterium avium subsp. paratuberculosis
gcgagaagucgccgac

SEQ ID NO: 794091 - RNA, 14 nt, Mycobacterium avium subsp. paratuberculosis
gcgagcacggcacg

SEQ ID NO: 794092 - RNA, 20 nt, Mycobacterium avium subsp. paratuberculosis
gcgagcacggcacgcccguu

SEQ ID NO: 794093 - RNA, 18 nt, Mycobacterium avium subsp. paratuberculosis
gcgagcagacacaaaagc

SEQ ID NO: 794094 - RNA, 20 nt, Mycobacterium avium subsp. paratuberculosis
gcgagcagacacaaaagcac

SEQ ID NO: 794095 - RNA, 20 nt, Mycobacterium avium subsp. paratuberculosis
gcgagcagacacaaaagcgc

SEQ ID NO: 794096 - RNA, 18 nt, Mycobacterium avium subsp. paratuberculosis
gcgagcagacgcaaaaac

SEQ ID NO: 794097 - RNA, 18 nt, Mycobacterium avium subsp. paratuberculosis
gcgagcagacgcaaaagc

SEQ ID NO: 794098 - RNA, 19 nt, Mycobacterium avium subsp. paratuberculosis
gcgagcagacgcaaaagcc

SEQ ID NO: 794099 - RNA, 23 nt, Mycobacterium avium subsp. paratuberculosis
gcgagcagacgcaaaagccccgc

SEQ ID NO: 794100 - RNA, 16 nt, Mycobacterium avium subsp. paratuberculosis
gcgagcaggccgaggc

SEQ ID NO: 794101 - RNA, 16 nt, Mycobacterium avium subsp. paratuberculosis
gcgagcagcagcgcgg

SEQ ID NO: 794102 - RNA, 17 nt, Mycobacterium avium subsp. paratuberculosis
gcgagcagcagcgcggu

SEQ ID NO: 794103 - RNA, 19 nt, Mycobacterium avium subsp. paratuberculosis
gcgagcagcagcgcggugc

SEQ ID NO: 794104 - RNA, 23 nt, Mycobacterium avium subsp. paratuberculosis
gcgagcagcagcgcggugccgac

SEQ ID NO: 794105 - RNA, 16 nt, Mycobacterium avium subsp. paratuberculosis
gcgagcagcccggcga

SEQ ID NO: 794106 - RNA, 17 nt, Mycobacterium avium subsp. paratuberculosis
gcgagcagcccggcgaa

SEQ ID NO: 794107 - RNA, 16 nt, Mycobacterium avium subsp. paratuberculosis
gcgagcagccgggugc

SEQ ID NO: 794108 - RNA, 13 nt, Mycobacterium avium subsp. paratuberculosis
gcgagcagcgccc

SEQ ID NO: 794109 - RNA, 13 nt, Mycobacterium avium subsp. paratuberculosis
gcgagcagcgcga

SEQ ID NO: 794110 - RNA, 18 nt, Mycobacterium avium subsp. paratuberculosis
gcgagcagcgcgaugccg

SEQ ID NO: 794111 - RNA, 21 nt, Mycobacterium avium subsp. paratuberculosis
gcgagcagcgcgaugccggcc

SEQ ID NO: 794112 - RNA, 23 nt, Mycobacterium avium subsp. paratuberculosis
gcgagcagcgcgaugccggccag

SEQ ID NO: 794113 - RNA, 21 nt, Mycobacterium avium subsp. paratuberculosis
gcgagcagcugcagcgucggg

SEQ ID NO: 794114 - RNA, 20 nt, Mycobacterium avium subsp. paratuberculosis
gcgagcagacgcgaaagcac

SEQ ID NO: 794115 - RNA, 21 nt, Mycobacterium avium subsp. paratuberculosis
gcgagccggagccuugcuggc

SEQ ID NO: 794116 - RNA, 20 nt, Mycobacterium avium subsp. paratuberculosis
gcgagccggcacgcgcgccg

SEQ ID NO: 794117 - RNA, 12 nt, Mycobacterium avium subsp. paratuberculosis
gcgagccggccc

SEQ ID NO: 794118 - RNA, 14 nt, Mycobacterium avium subsp. paratuberculosis
gcgagccggcccgg

SEQ ID NO: 794119 - RNA, 16 nt, Mycobacterium avium subsp. paratuberculosis
gcgagccggcccgggg

SEQ ID NO: 794120 - RNA, 18 nt, Mycobacterium avium subsp. paratuberculosis
gcgagccggcccggggug

SEQ ID NO: 794121 - RNA, 15 nt, Mycobacterium avium subsp. paratuberculosis
gcgagccagcugcgc

SEQ ID NO: 794122 - RNA, 21 nt, Mycobacterium avium subsp. paratuberculosis
gcgagcccgcaaaucagccga

SEQ ID NO: 794123 - RNA, 15 nt, Mycobacterium avium subsp. paratuberculosis
gcgagcccggccagu

SEQ ID NO: 794124 - RNA, 23 nt, Mycobacterium avium subsp. paratuberculosis
gcgagcccggccaguccggcagc

SEQ ID NO: 794125 - RNA, 12 nt, Mycobacterium avium subsp. paratuberculosis
gcgagcccggcg

SEQ ID NO: 794126 - RNA, 13 nt, Mycobacterium avium subsp. paratuberculosis
gcgagcccggcga

SEQ ID NO: 794127 - RNA, 22 nt, Mycobacterium avium subsp. paratuberculosis
gcgagccgaaacggugcccgca

SEQ ID NO: 794128 - RNA, 14 nt, Mycobacterium avium subsp. paratuberculosis
gcgagccgagcacg

SEQ ID NO: 794129 - RNA, 19 nt, Mycobacterium avium subsp. paratuberculosis
gcgagccgagcacgcagcc

SEQ ID NO: 794130 - RNA, 12 nt, Mycobacterium avium subsp. paratuberculosis
gcgagccgagcc

SEQ ID NO: 794131 - RNA, 13 nt, Mycobacterium avium subsp. paratuberculosis
gcgagccaccucg

SEQ ID NO: 794132 - RNA, 18 nt, Mycobacterium avium subsp. paratuberculosis
gcgagcagggcgggcagg

SEQ ID NO: 794133 - RNA, 12 nt, Mycobacterium avium subsp. paratuberculosis
gcgaaagcaccc

SEQ ID NO: 794134 - RNA, 17 nt, Mycobacterium avium subsp. paratuberculosis
gcgaaaggcccaccgcu

SEQ ID NO: 794135 - RNA, 14 nt, Mycobacterium avium subsp. paratuberculosis
gcgaaagcgucggc

SEQ ID NO: 794136 - RNA, 15 nt, Mycobacterium avium subsp. paratuberculosis
gcgaaagcgucggcu

SEQ ID NO: 794137 - RNA, 14 nt, Mycobacterium avium subsp. paratuberculosis
gcgaaagcccaggc

SEQ ID NO: 794138 - RNA, 21 nt, Mycobacterium avium subsp. paratuberculosis
gcgaaagcccaggcccggcac

SEQ ID NO: 794139 - RNA, 13 nt, Mycobacterium avium subsp. paratuberculosis
gcgaaacccccgg

SEQ ID NO: 794140 - RNA, 15 nt, Mycobacterium avium subsp. paratuberculosis
gcgaaacccccggga

SEQ ID NO: 794141 - RNA, 22 nt, Mycobacterium avium subsp. paratuberculosis
gcgaaacaacgcaaugcgucgc

SEQ ID NO: 794142 - RNA, 18 nt, Mycobacterium avium subsp. paratuberculosis
gcgaaacaccaagcacca

SEQ ID NO: 794143 - RNA, 19 nt, Mycobacterium avium subsp. paratuberculosis
gcgaacaccucggcgaugc

SEQ ID NO: 794144 - RNA, 17 nt, Mycobacterium avium subsp. paratuberculosis
gcgaacaccucggugau

SEQ ID NO: 794145 - RNA, 17 nt, Mycobacterium avium subsp. paratuberculosis
gcgaacacgucggccag

SEQ ID NO: 794146 - RNA, 21 nt, Mycobacterium avium subsp. paratuberculosis
gcgaacacgucggccagcgcg

SEQ ID NO: 794147 - RNA, 15 nt, Mycobacterium avium subsp. paratuberculosis
gcgaacagcagcacc

SEQ ID NO: 794148 - RNA, 19 nt, Mycobacterium avium subsp. paratuberculosis
gcgaacagcagcacccggg

SEQ ID NO: 794149 - RNA, 19 nt, Mycobacterium avium subsp. paratuberculosis
gcgaacagcgaagccacgg

SEQ ID NO: 794150 - RNA, 20 nt, Mycobacterium avium subsp. paratuberculosis
gcgaaagugcuacugccgac

SEQ ID NO: 794151 - RNA, 17 nt, Mycobacterium avium subsp. paratuberculosis
gcgaaaucggugaagcc

SEQ ID NO: 794152 - RNA, 20 nt, Mycobacterium avium subsp. paratuberculosis
gcgaacaccagaugccgcuc

SEQ ID NO: 794153 - RNA, 22 nt, Mycobacterium avium subsp. paratuberculosis
gcgaacaccagaugccgcucgg

SEQ ID NO: 794154 - RNA, 24 nt, Mycobacterium avium subsp. paratuberculosis
gcgaacaccagaugccgcucggcg

SEQ ID NO: 794155 - RNA, 13 nt, Mycobacterium avium subsp. paratuberculosis
gcgaacaccagcc

SEQ ID NO: 794156 - RNA, 19 nt, Mycobacterium avium subsp. paratuberculosis
gcgaacaccagcccggccg

SEQ ID NO: 794157 - RNA, 20 nt, Mycobacterium avium subsp. paratuberculosis
gcgaacaccagcccggccga

SEQ ID NO: 794158 - RNA, 21 nt, Mycobacterium avium subsp. paratuberculosis
gccuugcagccgcugccgcac

SEQ ID NO: 794159 - RNA, 17 nt, Mycobacterium avium subsp. paratuberculosis
gccuugccgacgacguc

SEQ ID NO: 794160 - RNA, 18 nt, Mycobacterium avium subsp. paratuberculosis
gccuugccgacgacgucg

SEQ ID NO: 794161 - RNA, 15 nt, Mycobacterium avium subsp. paratuberculosis
gccuuuccgcgcggc

SEQ ID NO: 794162 - RNA, 20 nt, Mycobacterium avium subsp. paratuberculosis
gccuuugacguucgcguuga

SEQ ID NO: 794163 - RNA, 21 nt, Mycobacterium avium subsp. paratuberculosis
gccuugcgcccacaguccgcc

SEQ ID NO: 794164 - RNA, 16 nt, Mycobacterium avium subsp. paratuberculosis
gcgaaaauggcugccc

SEQ ID NO: 794165 - RNA, 20 nt, Mycobacterium avium subsp. paratuberculosis
gcgaaaauggcugcccggca

SEQ ID NO: 794166 - RNA, 22 nt, Mycobacterium avium subsp. paratuberculosis
gcgaaaaucggugguguacuuc

SEQ ID NO: 794167 - RNA, 22 nt, Mycobacterium avium subsp. paratuberculosis
gcgaaaauaccgccggccgcgc

SEQ ID NO: 794168 - RNA, 16 nt, Mycobacterium avium subsp. paratuberculosis
gcgaaaaccagcaccg

SEQ ID NO: 794169 - RNA, 19 nt, Mycobacterium avium subsp. paratuberculosis
gcgaaaaaacggcggcgga

SEQ ID NO: 794170 - RNA, 20 nt, Mycobacterium avium subsp. paratuberculosis
gcgaaaaaacggcggcggaa

SEQ ID NO: 794171 - RNA, 17 nt, Mycobacterium avium subsp. paratuberculosis
gcgaaaacgccugcgcc

SEQ ID NO: 794172 - RNA, 13 nt, Mycobacterium avium subsp. paratuberculosis
gcgaacucaggcg

SEQ ID NO: 794173 - RNA, 22 nt, Mycobacterium avium subsp. paratuberculosis
gcgaacucgcggcgggucagca

SEQ ID NO: 794174 - RNA, 18 nt, Mycobacterium avium subsp. paratuberculosis
gcgaacucgucgacgccc

SEQ ID NO: 794175 - RNA, 15 nt, Mycobacterium avium subsp. paratuberculosis
gcgaacugcaccagc

SEQ ID NO: 794176 - RNA, 16 nt, Mycobacterium avium subsp. paratuberculosis
gcgaacugcaccagca

SEQ ID NO: 794177 - RNA, 22 nt, Mycobacterium avium subsp. paratuberculosis
gcgaacugcaccagcacgacac

SEQ ID NO: 794178 - RNA, 18 nt, Mycobacterium avium subsp. paratuberculosis
gcgaacgggcuggccagg

SEQ ID NO: 794179 - RNA, 15 nt, Mycobacterium avium subsp. paratuberculosis
gcgaacgggucgggg

SEQ ID NO: 794180 - RNA, 17 nt, Mycobacterium avium subsp. paratuberculosis
gcgaacgggugaccggc

SEQ ID NO: 794181 - RNA, 19 nt, Mycobacterium avium subsp. paratuberculosis
gcgaacgggugaccggcgg

SEQ ID NO: 794182 - RNA, 15 nt, Mycobacterium avium subsp. paratuberculosis
gcgaacgggugcggc

SEQ ID NO: 794183 - RNA, 16 nt, Mycobacterium avium subsp. paratuberculosis
gcgaacgggugcggcg

SEQ ID NO: 794184 - RNA, 17 nt, Mycobacterium avium subsp. paratuberculosis
gcgaacgggugcggcgc

SEQ ID NO: 794185 - RNA, 22 nt, Mycobacterium avium subsp. paratuberculosis
gcgaacgggugcggcgcucggu

SEQ ID NO: 794186 - RNA, 19 nt, Mycobacterium avium subsp. paratuberculosis
gcgaacgucgaugucacgu

SEQ ID NO: 794187 - RNA, 17 nt, Mycobacterium avium subsp. paratuberculosis
gcgaacgucucgcggga

SEQ ID NO: 794188 - RNA, 24 nt, Mycobacterium avium subsp. paratuberculosis
gcgaacgucucgcgggaguggccg

SEQ ID NO: 794189 - RNA, 22 nt, Mycobacterium avium subsp. paratuberculosis
gcgaacggccaguccaggccgc

SEQ ID NO: 794190 - RNA, 18 nt, Mycobacterium avium subsp. paratuberculosis
gcgaacggcccgccgccg

SEQ ID NO: 794191 - RNA, 21 nt, Mycobacterium avium subsp. paratuberculosis
gcgaacggcccgccgccggcg

SEQ ID NO: 794192 - RNA, 24 nt, Mycobacterium avium subsp. paratuberculosis
gcgaacggcccgccgccggcggcg

SEQ ID NO: 794193 - RNA, 19 nt, Mycobacterium avium subsp. paratuberculosis
gcgaacgcgccccgccggg

SEQ ID NO: 794194 - RNA, 15 nt, Mycobacterium avium subsp. paratuberculosis
gcgaacggcaacggc

SEQ ID NO: 794195 - RNA, 19 nt, Mycobacterium avium subsp. paratuberculosis
gcgaacggcaacggcggcg

SEQ ID NO: 794196 - RNA, 19 nt, Mycobacterium avium subsp. paratuberculosis
gcgaacgcgcggucgucgc

SEQ ID NO: 794197 - RNA, 15 nt, Mycobacterium avium subsp. paratuberculosis
gcgaacgcgccggug

SEQ ID NO: 794198 - RNA, 22 nt, Mycobacterium avium subsp. paratuberculosis
gcgaacgcggcugaucagccgg

SEQ ID NO: 794199 - RNA, 20 nt, Mycobacterium avium subsp. paratuberculosis
gcgaacgcgguuuugaugcc

SEQ ID NO: 794200 - RNA, 19 nt, Mycobacterium avium subsp. paratuberculosis
gcgaagaccagcgugucgc

SEQ ID NO: 794201 - RNA, 17 nt, Mycobacterium avium subsp. paratuberculosis
gcgaacuugcuggccga

SEQ ID NO: 794202 - RNA, 16 nt, Mycobacterium avium subsp. paratuberculosis
gcgaagaugucgccgu

SEQ ID NO: 794203 - RNA, 13 nt, Mycobacterium avium subsp. paratuberculosis
gcgaagcaggcca

SEQ ID NO: 794204 - RNA, 15 nt, Mycobacterium avium subsp. paratuberculosis
gcgaagcaggccagg

SEQ ID NO: 794205 - RNA, 16 nt, Mycobacterium avium subsp. paratuberculosis
gcgaagacgucggcgc

SEQ ID NO: 794206 - RNA, 18 nt, Mycobacterium avium subsp. paratuberculosis
gcgaagacgucggcgcgg

SEQ ID NO: 794207 - RNA, 19 nt, Mycobacterium avium subsp. paratuberculosis
gcgaagacgucggcgcggu

SEQ ID NO: 794208 - RNA, 15 nt, Mycobacterium avium subsp. paratuberculosis
gcgaagagcggcacg

SEQ ID NO: 794209 - RNA, 16 nt, Mycobacterium avium subsp. paratuberculosis
gcgaagagcggcacga

SEQ ID NO: 794210 - RNA, 19 nt, Mycobacterium avium subsp. paratuberculosis
gcgaagagcggcacgaucg

SEQ ID NO: 794211 - RNA, 17 nt, Mycobacterium avium subsp. paratuberculosis
gcgaagaacgacgccac

SEQ ID NO: 794212 - RNA, 13 nt, Mycobacterium avium subsp. paratuberculosis
gcgaacugccggc

SEQ ID NO: 794213 - RNA, 18 nt, Mycobacterium avium subsp. paratuberculosis
gcgaacuucaggcccuca

SEQ ID NO: 794214 - RNA, 20 nt, Mycobacterium avium subsp. paratuberculosis
gcgaacagugcacugccgac

SEQ ID NO: 794215 - RNA, 15 nt, Mycobacterium avium subsp. paratuberculosis
gcgaacaucgccagc

SEQ ID NO: 794216 - RNA, 14 nt, Mycobacterium avium subsp. paratuberculosis
gcgaacaucgccag

SEQ ID NO: 794217 - RNA, 19 nt, Mycobacterium avium subsp. paratuberculosis
gcgaacagcgcggccacca

SEQ ID NO: 794218 - RNA, 21 nt, Mycobacterium avium subsp. paratuberculosis
gcgaacagcgcggccaccacg

SEQ ID NO: 794219 - RNA, 14 nt, Mycobacterium avium subsp. paratuberculosis
gcgaacagccacgg

SEQ ID NO: 794220 - RNA, 13 nt, Mycobacterium avium subsp. paratuberculosis
gcgaacagcgccg

SEQ ID NO: 794221 - RNA, 11 nt, Mycobacterium avium subsp. paratuberculosis
gcgaacagcgg

SEQ ID NO: 794222 - RNA, 15 nt, Mycobacterium avium subsp. paratuberculosis
gcgaacaggcccugc

SEQ ID NO: 794223 - RNA, 12 nt, Mycobacterium avium subsp. paratuberculosis
gcgaacccacac

SEQ ID NO: 794224 - RNA, 22 nt, Mycobacterium avium subsp. paratuberculosis
gcgaacccacacguugagcccg

SEQ ID NO: 794225 - RNA, 17 nt, Mycobacterium avium subsp. paratuberculosis
gcgaacccgagcacccc

SEQ ID NO: 794226 - RNA, 18 nt, Mycobacterium avium subsp. paratuberculosis
gcgaacccgagcaccccg

SEQ ID NO: 794227 - RNA, 15 nt, Mycobacterium avium subsp. paratuberculosis
gcgaaccagggcagc

SEQ ID NO: 794228 - RNA, 19 nt, Mycobacterium avium subsp. paratuberculosis
gcgaaccagggcagccagc

SEQ ID NO: 794229 - RNA, 11 nt, Mycobacterium avium subsp. paratuberculosis
gcgaaccacgg

SEQ ID NO: 794230 - RNA, 15 nt, Mycobacterium avium subsp. paratuberculosis
gcgaacauggcggcc

SEQ ID NO: 794231 - RNA, 16 nt, Mycobacterium avium subsp. paratuberculosis
gcgaacauggcggcca

SEQ ID NO: 794232 - RNA, 18 nt, Mycobacterium avium subsp. paratuberculosis
gcgaacauggcggccagc

SEQ ID NO: 794233 - RNA, 22 nt, Mycobacterium avium subsp. paratuberculosis
gcgaacauggucgcccacaccg

SEQ ID NO: 794234 - RNA, 17 nt, Mycobacterium avium subsp. paratuberculosis
gcgaacaugguggucga

SEQ ID NO: 794235 - RNA, 18 nt, Mycobacterium avium subsp. paratuberculosis
gcgaaccagcaugcgcca

SEQ ID NO: 794236 - RNA, 19 nt, Mycobacterium avium subsp. paratuberculosis
gcgaaccagcaugcgccag

SEQ ID NO: 794237 - RNA, 23 nt, Mycobacterium avium subsp. paratuberculosis
gcgaaccagcaugcgccagagcg

SEQ ID NO: 794238 - RNA, 15 nt, Mycobacterium avium subsp. paratuberculosis
gcgaaccagcgcccg

SEQ ID NO: 794239 - RNA, 16 nt, Mycobacterium avium subsp. paratuberculosis
gcgaaccagcgcccgc

SEQ ID NO: 794240 - RNA, 17 nt, Mycobacterium avium subsp. paratuberculosis
gcgaaccgcggcggcag

SEQ ID NO: 794241 - RNA, 22 nt, Mycobacterium avium subsp. paratuberculosis
gcgaaccgggacagccgcgccg

SEQ ID NO: 794242 - RNA, 14 nt, Mycobacterium avium subsp. paratuberculosis
gcgaaccgggccag

SEQ ID NO: 794243 - RNA, 22 nt, Mycobacterium avium subsp. paratuberculosis
gcgaaccgggccaggaugaccg

SEQ ID NO: 794244 - RNA, 16 nt, Mycobacterium avium subsp. paratuberculosis
gcgaaccgggcccgua

SEQ ID NO: 794245 - RNA, 15 nt, Mycobacterium avium subsp. paratuberculosis
gcgaaccgacauagg

SEQ ID NO: 794246 - RNA, 18 nt, Mycobacterium avium subsp. paratuberculosis
gcgaacccggcgcccggc

SEQ ID NO: 794247 - RNA, 23 nt, Mycobacterium avium subsp. paratuberculosis
gcgaacccgccagggcgacgccg

SEQ ID NO: 794248 - RNA, 14 nt, Mycobacterium avium subsp. paratuberculosis
gcgaacgaccgggu

SEQ ID NO: 794249 - RNA, 21 nt, Mycobacterium avium subsp. paratuberculosis
gcgaacgacgaccucccccga

SEQ ID NO: 794250 - RNA, 14 nt, Mycobacterium avium subsp. paratuberculosis
gcgaacgacgucga

SEQ ID NO: 794251 - RNA, 21 nt, Mycobacterium avium subsp. paratuberculosis
gcgaacgacgucgagguguug

SEQ ID NO: 794252 - RNA, 17 nt, Mycobacterium avium subsp. paratuberculosis
gcgaacgccucgguggu

SEQ ID NO: 794253 - RNA, 23 nt, Mycobacterium avium subsp. paratuberculosis
gcgaacgccucgguggucgacga

SEQ ID NO: 794254 - RNA, 13 nt, Mycobacterium avium subsp. paratuberculosis
gcgaacgcgaccu

SEQ ID NO: 794255 - RNA, 24 nt, Mycobacterium avium subsp. paratuberculosis
gccuucacgaccggcagcaccggc

SEQ ID NO: 794256 - RNA, 17 nt, Mycobacterium avium subsp. paratuberculosis
gccuucacgcuggccuc

SEQ ID NO: 794257 - RNA, 22 nt, Mycobacterium avium subsp. paratuberculosis
gccuucacgcuggccuccagcu

SEQ ID NO: 794258 - RNA, 12 nt, Mycobacterium avium subsp. paratuberculosis
gccuucaucacc

SEQ ID NO: 794259 - RNA, 14 nt, Mycobacterium avium subsp. paratuberculosis
gccugugcgacggc

SEQ ID NO: 794260 - RNA, 19 nt, Mycobacterium avium subsp. paratuberculosis
gccugugcgacggcgucgg

SEQ ID NO: 794261 - RNA, 20 nt, Mycobacterium avium subsp. paratuberculosis
gccugugcgacggcgucggc

SEQ ID NO: 794262 - RNA, 19 nt, Mycobacterium avium subsp. paratuberculosis
gccuugaugaacgccucga

SEQ ID NO: 794263 - RNA, 22 nt, Mycobacterium avium subsp. paratuberculosis
gccuugacgacggccaccgcga

SEQ ID NO: 794264 - RNA, 21 nt, Mycobacterium avium subsp. paratuberculosis
gccuugacgaguuccaccucg

SEQ ID NO: 794265 - RNA, 15 nt, Mycobacterium avium subsp. paratuberculosis
gccuugacgucgggu

SEQ ID NO: 794266 - RNA, 18 nt, Mycobacterium avium subsp. paratuberculosis
gccuugagaacgucgcgu

SEQ ID NO: 794267 - RNA, 13 nt, Mycobacterium avium subsp. paratuberculosis
gccuugaccacgg

SEQ ID NO: 794268 - RNA, 16 nt, Mycobacterium avium subsp. paratuberculosis
gccuucuucucgacgu

SEQ ID NO: 794269 - RNA, 15 nt, Mycobacterium avium subsp. paratuberculosis
gccuucuuggccgcg

SEQ ID NO: 794270 - RNA, 17 nt, Mycobacterium avium subsp. paratuberculosis
gccuucuuggccgcgcc

SEQ ID NO: 794271 - RNA, 14 nt, Mycobacterium avium subsp. paratuberculosis
gccuucuuggccgg

SEQ ID NO: 794272 - RNA, 17 nt, Mycobacterium avium subsp. paratuberculosis
gccuucuuggcggcggc

SEQ ID NO: 794273 - RNA, 15 nt, Mycobacterium avium subsp. paratuberculosis
gccuucuugaccgca

SEQ ID NO: 794274 - RNA, 21 nt, Mycobacterium avium subsp. paratuberculosis
gccuugaacgcguccgacggc

SEQ ID NO: 794275 - RNA, 18 nt, Mycobacterium avium subsp. paratuberculosis
gccuucuggaagccuggc

SEQ ID NO: 794276 - RNA, 17 nt, Mycobacterium avium subsp. paratuberculosis
gccuucuucgccgcagc

SEQ ID NO: 794277 - RNA, 19 nt, Mycobacterium avium subsp. paratuberculosis
gccuucuucgccggggccu

SEQ ID NO: 794278 - RNA, 17 nt, Mycobacterium avium subsp. paratuberculosis
gccuggcuccccggcga

SEQ ID NO: 794279 - RNA, 14 nt, Mycobacterium avium subsp. paratuberculosis
gccugguggcccag

SEQ ID NO: 794280 - RNA, 16 nt, Mycobacterium avium subsp. paratuberculosis
gccugguucgacguga

SEQ ID NO: 794281 - RNA, 18 nt, Mycobacterium avium subsp. paratuberculosis
gccugguuggucaauccg

SEQ ID NO: 794282 - RNA, 17 nt, Mycobacterium avium subsp. paratuberculosis
gccuggcggcgacccgg

SEQ ID NO: 794283 - RNA, 18 nt, Mycobacterium avium subsp. paratuberculosis
gccuggcggcgacccgga

SEQ ID NO: 794284 - RNA, 17 nt, Mycobacterium avium subsp. paratuberculosis
gccuggcgaacucgcgc

SEQ ID NO: 794285 - RNA, 20 nt, Mycobacterium avium subsp. paratuberculosis
gccuggcgcagggcguucga

SEQ ID NO: 794286 - RNA, 23 nt, Mycobacterium avium subsp. paratuberculosis
gccugucaguuugcgcgacgggc

SEQ ID NO: 794287 - RNA, 18 nt, Mycobacterium avium subsp. paratuberculosis
gccugucggucguacguc

SEQ ID NO: 794288 - RNA, 17 nt, Mycobacterium avium subsp. paratuberculosis
gccuguccgaccagcgg

SEQ ID NO: 794289 - RNA, 19 nt, Mycobacterium avium subsp. paratuberculosis
gccuggccaccucgacggc

SEQ ID NO: 794290 - RNA, 21 nt, Mycobacterium avium subsp. paratuberculosis
gccuggccaccucgacggcgu

SEQ ID NO: 794291 - RNA, 23 nt, Mycobacterium avium subsp. paratuberculosis
gccuggcccaaaaacaucgucaa

SEQ ID NO: 794292 - RNA, 19 nt, Mycobacterium avium subsp. paratuberculosis
gccuggcccagacaggccg

SEQ ID NO: 794293 - RNA, 22 nt, Mycobacterium avium subsp. paratuberculosis
gccuggcccagacaggccggcc

SEQ ID NO: 794294 - RNA, 16 nt, Mycobacterium avium subsp. paratuberculosis
gccuggcccagccgcg

SEQ ID NO: 794295 - RNA, 17 nt, Mycobacterium avium subsp. paratuberculosis
gccuggcccagccgcgu

SEQ ID NO: 794296 - RNA, 19 nt, Mycobacterium avium subsp. paratuberculosis
gccuggcccagccgcguca

SEQ ID NO: 794297 - RNA, 12 nt, Mycobacterium avium subsp. paratuberculosis
gccuggccacgu

SEQ ID NO: 794298 - RNA, 12 nt, Mycobacterium avium subsp. paratuberculosis
gccugcucgaag

SEQ ID NO: 794299 - RNA, 20 nt, Mycobacterium avium subsp. paratuberculosis
gccugcucgcagauggucgg

SEQ ID NO: 794300 - RNA, 23 nt, Mycobacterium avium subsp. paratuberculosis
gccugcucgcuugccagccgggc

SEQ ID NO: 794301 - RNA, 22 nt, Mycobacterium avium subsp. paratuberculosis
gccugcggcgcggccaccccgg

SEQ ID NO: 794302 - RNA, 20 nt, Mycobacterium avium subsp. paratuberculosis
gccugcugcccauccaggcc

SEQ ID NO: 794303 - RNA, 18 nt, Mycobacterium avium subsp. paratuberculosis
gccugcggcggccgcagc

SEQ ID NO: 794304 - RNA, 18 nt, Mycobacterium avium subsp. paratuberculosis
gccugcggcccagcguag

SEQ ID NO: 794305 - RNA, 14 nt, Mycobacterium avium subsp. paratuberculosis
gccugcgcggccgc

SEQ ID NO: 794306 - RNA, 18 nt, Mycobacterium avium subsp. paratuberculosis
gccugcgcggccgcgucg

SEQ ID NO: 794307 - RNA, 19 nt, Mycobacterium avium subsp. paratuberculosis
gccugcgcggccgcgucgg

SEQ ID NO: 794308 - RNA, 15 nt, Mycobacterium avium subsp. paratuberculosis
gccugcggcaacagc

SEQ ID NO: 794309 - RNA, 15 nt, Mycobacterium avium subsp. paratuberculosis
gccugcgcggcggcg

SEQ ID NO: 794310 - RNA, 13 nt, Mycobacterium avium subsp. paratuberculosis
gccugcgcgucgu

SEQ ID NO: 794311 - RNA, 18 nt, Mycobacterium avium subsp. paratuberculosis
gccugcgcugcggccaau

SEQ ID NO: 794312 - RNA, 21 nt, Mycobacterium avium subsp. paratuberculosis
gccugcgacuucuacggcggg

SEQ ID NO: 794313 - RNA, 13 nt, Mycobacterium avium subsp. paratuberculosis
gccugcgcccaca

SEQ ID NO: 794314 - RNA, 13 nt, Mycobacterium avium subsp. paratuberculosis
gccugcgcgccga

SEQ ID NO: 794315 - RNA, 14 nt, Mycobacterium avium subsp. paratuberculosis
gccugcgcgaccuc

SEQ ID NO: 794316 - RNA, 19 nt, Mycobacterium avium subsp. paratuberculosis
gccugcgcgaccucuucgc

SEQ ID NO: 794317 - RNA, 14 nt, Mycobacterium avium subsp. paratuberculosis
gccugcgcgaucgc

SEQ ID NO: 794318 - RNA, 18 nt, Mycobacterium avium subsp. paratuberculosis
gccugcgccuuggccucg

SEQ ID NO: 794319 - RNA, 22 nt, Mycobacterium avium subsp. paratuberculosis
gccugcgccuuggccucggugg

SEQ ID NO: 794320 - RNA, 18 nt, Mycobacterium avium subsp. paratuberculosis
gccugcgagcacacccuc

SEQ ID NO: 794321 - RNA, 21 nt, Mycobacterium avium subsp. paratuberculosis
gccugccggaugccgcgcggc

SEQ ID NO: 794322 - RNA, 17 nt, Mycobacterium avium subsp. paratuberculosis
gccugccggccgccgcg

SEQ ID NO: 794323 - RNA, 23 nt, Mycobacterium avium subsp. paratuberculosis
gccugccuccacgucaccgacgc

SEQ ID NO: 794324 - RNA, 12 nt, Mycobacterium avium subsp. paratuberculosis
gccugccggcgc

SEQ ID NO: 794325 - RNA, 22 nt, Mycobacterium avium subsp. paratuberculosis
gccugcccuugaagcgcagauc

SEQ ID NO: 794326 - RNA, 15 nt, Mycobacterium avium subsp. paratuberculosis
gccucgcuaaucgcc

SEQ ID NO: 794327 - RNA, 22 nt, Mycobacterium avium subsp. paratuberculosis
gccgugaguguugaagccgcgg

SEQ ID NO: 794328 - RNA, 14 nt, Mycobacterium avium subsp. paratuberculosis
gccgugagauccag

SEQ ID NO: 794329 - RNA, 18 nt, Mycobacterium avium subsp. paratuberculosis
gccgugagauccagcagc

SEQ ID NO: 794330 - RNA, 20 nt, Mycobacterium avium subsp. paratuberculosis
gccgugagauccagcagcca

SEQ ID NO: 794331 - RNA, 14 nt, Mycobacterium avium subsp. paratuberculosis
gccgugaccggcga

SEQ ID NO: 794332 - RNA, 15 nt, Mycobacterium avium subsp. paratuberculosis
gccgugaccggcgau

SEQ ID NO: 794333 - RNA, 14 nt, Mycobacterium avium subsp. paratuberculosis
gccgugaugccggg

SEQ ID NO: 794334 - RNA, 15 nt, Mycobacterium avium subsp. paratuberculosis
gccgugacgccgauc

SEQ ID NO: 794335 - RNA, 13 nt, Mycobacterium avium subsp. paratuberculosis
gccgugaucggcc

SEQ ID NO: 794336 - RNA, 15 nt, Mycobacterium avium subsp. paratuberculosis
gccgugaucggccag

SEQ ID NO: 794337 - RNA, 17 nt, Mycobacterium avium subsp. paratuberculosis
gccgugaucggccagcc

SEQ ID NO: 794338 - RNA, 20 nt, Mycobacterium avium subsp. paratuberculosis
gccgugaucucgugccgcac

SEQ ID NO: 794339 - RNA, 23 nt, Mycobacterium avium subsp. paratuberculosis
gccgugaucucgugccgcacccg

SEQ ID NO: 794340 - RNA, 15 nt, Mycobacterium avium subsp. paratuberculosis
gccgugaucuggugg

SEQ ID NO: 794341 - RNA, 16 nt, Mycobacterium avium subsp. paratuberculosis
gccgugaucugguggg

SEQ ID NO: 794342 - RNA, 19 nt, Mycobacterium avium subsp. paratuberculosis
gccgugaucuucgugcuca

SEQ ID NO: 794343 - RNA, 15 nt, Mycobacterium avium subsp. paratuberculosis
gccgucucgucggcc

SEQ ID NO: 794344 - RNA, 21 nt, Mycobacterium avium subsp. paratuberculosis
gccgucuucccagugccgcag

SEQ ID NO: 794345 - RNA, 16 nt, Mycobacterium avium subsp. paratuberculosis
gccgucuuccgggcca

SEQ ID NO: 794346 - RNA, 19 nt, Mycobacterium avium subsp. paratuberculosis
gccgucuuccgggccaccg

SEQ ID NO: 794347 - RNA, 17 nt, Mycobacterium avium subsp. paratuberculosis
gccgucguugcgggcgg

SEQ ID NO: 794348 - RNA, 20 nt, Mycobacterium avium subsp. paratuberculosis
gccgucgucagccgggccag

SEQ ID NO: 794349 - RNA, 14 nt, Mycobacterium avium subsp. paratuberculosis
gccgucucgucggc

SEQ ID NO: 794350 - RNA, 19 nt, Mycobacterium avium subsp. paratuberculosis
gccgucuccucgaccagcg

SEQ ID NO: 794351 - RNA, 18 nt, Mycobacterium avium subsp. paratuberculosis
gccgucucgaccacccgg

SEQ ID NO: 794352 - RNA, 19 nt, Mycobacterium avium subsp. paratuberculosis
gccgucucgaccacccggc

SEQ ID NO: 794353 - RNA, 15 nt, Mycobacterium avium subsp. paratuberculosis
gccgucucgacccgg

SEQ ID NO: 794354 - RNA, 19 nt, Mycobacterium avium subsp. paratuberculosis
gccgucucgacccgggcca

SEQ ID NO: 794355 - RNA, 20 nt, Mycobacterium avium subsp. paratuberculosis
gccgucucgacccgggccag

SEQ ID NO: 794356 - RNA, 18 nt, Mycobacterium avium subsp. paratuberculosis
gccgucucgagccggcgc

SEQ ID NO: 794357 - RNA, 19 nt, Mycobacterium avium subsp. paratuberculosis
gccgucucgagccggcgca

SEQ ID NO: 794358 - RNA, 22 nt, Mycobacterium avium subsp. paratuberculosis
gccgugaacugugcggugcggc

SEQ ID NO: 794359 - RNA, 18 nt, Mycobacterium avium subsp. paratuberculosis
gccgugacauugggggcu

SEQ ID NO: 794360 - RNA, 17 nt, Mycobacterium avium subsp. paratuberculosis
gccgugaaccggcguug

SEQ ID NO: 794361 - RNA, 18 nt, Mycobacterium avium subsp. paratuberculosis
gccgugaaccggcguugc

SEQ ID NO: 794362 - RNA, 16 nt, Mycobacterium avium subsp. paratuberculosis
gccgucugguccaccg

SEQ ID NO: 794363 - RNA, 17 nt, Mycobacterium avium subsp. paratuberculosis
gccgucugguccaccgg

SEQ ID NO: 794364 - RNA, 19 nt, Mycobacterium avium subsp. paratuberculosis
gccgucgugcucgagcauc

SEQ ID NO: 794365 - RNA, 19 nt, Mycobacterium avium subsp. paratuberculosis
gccgucguggguauccgcc

SEQ ID NO: 794366 - RNA, 22 nt, Mycobacterium avium subsp. paratuberculosis
gccgucguggguauccgccgcc

SEQ ID NO: 794367 - RNA, 23 nt, Mycobacterium avium subsp. paratuberculosis
gccgucguggguauccgccgcca

SEQ ID NO: 794368 - RNA, 22 nt, Mycobacterium avium subsp. paratuberculosis
gccgucgugguggccgcgaaaa

SEQ ID NO: 794369 - RNA, 22 nt, Mycobacterium avium subsp. paratuberculosis
gccgucguucuccauccgggcg

SEQ ID NO: 794370 - RNA, 17 nt, Mycobacterium avium subsp. paratuberculosis
gccgucguugacgcccu

SEQ ID NO: 794371 - RNA, 13 nt, Mycobacterium avium subsp. paratuberculosis
gccgucgucgagg

SEQ ID NO: 794372 - RNA, 20 nt, Mycobacterium avium subsp. paratuberculosis
gccgucgucgaggccgaacc

SEQ ID NO: 794373 - RNA, 20 nt, Mycobacterium avium subsp. paratuberculosis
gccgucgucggacaccagca

SEQ ID NO: 794374 - RNA, 15 nt, Mycobacterium avium subsp. paratuberculosis
gccgucgucgucggc

SEQ ID NO: 794375 - RNA, 16 nt, Mycobacterium avium subsp. paratuberculosis
gccgucgucgucggcc

SEQ ID NO: 794376 - RNA, 17 nt, Mycobacterium avium subsp. paratuberculosis
gccgucgucgucggccg

SEQ ID NO: 794377 - RNA, 20 nt, Mycobacterium avium subsp. paratuberculosis
gccgucgucgucggccgggc

SEQ ID NO: 794378 - RNA, 22 nt, Mycobacterium avium subsp. paratuberculosis
gccgucgucgucggccgggccg

SEQ ID NO: 794379 - RNA, 19 nt, Mycobacterium avium subsp. paratuberculosis
gccgucgucgugcaccacg

SEQ ID NO: 794380 - RNA, 20 nt, Mycobacterium avium subsp. paratuberculosis
gccgucgucgugcaccacga

SEQ ID NO: 794381 - RNA, 22 nt, Mycobacterium avium subsp. paratuberculosis
gccgucgucgugcaccacgacg

SEQ ID NO: 794382 - RNA, 23 nt, Mycobacterium avium subsp. paratuberculosis
gccgucgucguuguuggcggcgg

SEQ ID NO: 794383 - RNA, 19 nt, Mycobacterium avium subsp. paratuberculosis
gccgucguauucgacggcg

SEQ ID NO: 794384 - RNA, 22 nt, Mycobacterium avium subsp. paratuberculosis
gccgucguauucgacggcgacc

SEQ ID NO: 794385 - RNA, 23 nt, Mycobacterium avium subsp. paratuberculosis
gccgucguauucgacggcgacca

SEQ ID NO: 794386 - RNA, 15 nt, Mycobacterium avium subsp. paratuberculosis
gccgucggcauccac

SEQ ID NO: 794387 - RNA, 19 nt, Mycobacterium avium subsp. paratuberculosis
gccgucgucgagcaccacc

SEQ ID NO: 794388 - RNA, 22 nt, Mycobacterium avium subsp. paratuberculosis
gccgucgucgagcaccacccgg

SEQ ID NO: 794389 - RNA, 12 nt, Mycobacterium avium subsp. paratuberculosis
gccgucggccag

SEQ ID NO: 794390 - RNA, 13 nt, Mycobacterium avium subsp. paratuberculosis
gccgucggccagc

SEQ ID NO: 794391 - RNA, 14 nt, Mycobacterium avium subsp. paratuberculosis
gccgucggccagca

SEQ ID NO: 794392 - RNA, 18 nt, Mycobacterium avium subsp. paratuberculosis
gccgucggccagcagcgc

SEQ ID NO: 794393 - RNA, 20 nt, Mycobacterium avium subsp. paratuberculosis
gccgucggccagcagcgcgu

SEQ ID NO: 794394 - RNA, 19 nt, Mycobacterium avium subsp. paratuberculosis
gccgucgguguccaggucg

SEQ ID NO: 794395 - RNA, 17 nt, Mycobacterium avium subsp. paratuberculosis
gccgucgguuucggucg

SEQ ID NO: 794396 - RNA, 22 nt, Mycobacterium avium subsp. paratuberculosis
gccgucgguuucggucgcggug

SEQ ID NO: 794397 - RNA, 16 nt, Mycobacterium avium subsp. paratuberculosis
gccgucgcgcucgacg

SEQ ID NO: 794398 - RNA, 20 nt, Mycobacterium avium subsp. paratuberculosis
gccgucgcgcucgacgaugu

SEQ ID NO: 794399 - RNA, 15 nt, Mycobacterium avium subsp. paratuberculosis
gccgucgcguucgac

SEQ ID NO: 794400 - RNA, 21 nt, Mycobacterium avium subsp. paratuberculosis
gccgucgcuguuggcgacggc

SEQ ID NO: 794401 - RNA, 12 nt, Mycobacterium avium subsp. paratuberculosis
gccgucgcccgg

SEQ ID NO: 794402 - RNA, 13 nt, Mycobacterium avium subsp. paratuberculosis
gccgucgcccgga

SEQ ID NO: 794403 - RNA, 17 nt, Mycobacterium avium subsp. paratuberculosis
gccgucgcgcaccaccu

SEQ ID NO: 794404 - RNA, 15 nt, Mycobacterium avium subsp. paratuberculosis
gccgucgcgcaccgc

SEQ ID NO: 794405 - RNA, 16 nt, Mycobacterium avium subsp. paratuberculosis
gccgucgcgccaggac

SEQ ID NO: 794406 - RNA, 15 nt, Mycobacterium avium subsp. paratuberculosis
gccgucgcggcgcgg

SEQ ID NO: 794407 - RNA, 12 nt, Mycobacterium avium subsp. paratuberculosis
gccgucgcggga

SEQ ID NO: 794408 - RNA, 22 nt, Mycobacterium avium subsp. paratuberculosis
gccgucgcgggaaucccacccg

SEQ ID NO: 794409 - RNA, 23 nt, Mycobacterium avium subsp. paratuberculosis
gccgucgcgggaaucccacccgc

SEQ ID NO: 794410 - RNA, 20 nt, Mycobacterium avium subsp. paratuberculosis
gccgucgcgggagagcgcgg

SEQ ID NO: 794411 - RNA, 17 nt, Mycobacterium avium subsp. paratuberculosis
gccgucgcgggcgucgg

SEQ ID NO: 794412 - RNA, 21 nt, Mycobacterium avium subsp. paratuberculosis
gccgucgcgggcgucgggcag

SEQ ID NO: 794413 - RNA, 22 nt, Mycobacterium avium subsp. paratuberculosis
gccgucgcgggcgucgggcagc

SEQ ID NO: 794414 - RNA, 13 nt, Mycobacterium avium subsp. paratuberculosis
gccgucgcgggug

SEQ ID NO: 794415 - RNA, 14 nt, Mycobacterium avium subsp. paratuberculosis
gccgucgcgcacca

SEQ ID NO: 794416 - RNA, 15 nt, Mycobacterium avium subsp. paratuberculosis
gccgucgccaccacc

SEQ ID NO: 794417 - RNA, 18 nt, Mycobacterium avium subsp. paratuberculosis
gccgucgccaccaccgcg

SEQ ID NO: 794418 - RNA, 19 nt, Mycobacterium avium subsp. paratuberculosis
gccgucgccaccaccgcgc

SEQ ID NO: 794419 - RNA, 13 nt, Mycobacterium avium subsp. paratuberculosis
gccgucgccaccg

SEQ ID NO: 794420 - RNA, 21 nt, Mycobacterium avium subsp. paratuberculosis
gccgucgccaccgagucgcgc

SEQ ID NO: 794421 - RNA, 14 nt, Mycobacterium avium subsp. paratuberculosis
gccgucgcaucagc

SEQ ID NO: 794422 - RNA, 17 nt, Mycobacterium avium subsp. paratuberculosis
gccgucgcaucagcucg

SEQ ID NO: 794423 - RNA, 22 nt, Mycobacterium avium subsp. paratuberculosis
gccgucgcaucagcucggcagc

SEQ ID NO: 794424 - RNA, 14 nt, Mycobacterium avium subsp. paratuberculosis
gccgucgcaccgcc

SEQ ID NO: 794425 - RNA, 24 nt, Mycobacterium avium subsp. paratuberculosis
gccgucgcacuagguccggcgcga

SEQ ID NO: 794426 - RNA, 12 nt, Mycobacterium avium subsp. paratuberculosis
gccgucgccacc

SEQ ID NO: 794427 - RNA, 15 nt, Mycobacterium avium subsp. paratuberculosis
gccgucgaugccggc

SEQ ID NO: 794428 - RNA, 20 nt, Mycobacterium avium subsp. paratuberculosis
gccgucgaugccggcgacga

SEQ ID NO: 794429 - RNA, 17 nt, Mycobacterium avium subsp. paratuberculosis
gccguaucccaccacga

SEQ ID NO: 794430 - RNA, 23 nt, Mycobacterium avium subsp. paratuberculosis
gccggugugaucgagcaccagcg

SEQ ID NO: 794431 - RNA, 15 nt, Mycobacterium avium subsp. paratuberculosis
gccggugugcagcca

SEQ ID NO: 794432 - RNA, 21 nt, Mycobacterium avium subsp. paratuberculosis
gccggugugcagccacccguc

SEQ ID NO: 794433 - RNA, 14 nt, Mycobacterium avium subsp. paratuberculosis
gccgguguucggcg

SEQ ID NO: 794434 - RNA, 20 nt, Mycobacterium avium subsp. paratuberculosis
gccgguguucggcgccagcc

SEQ ID NO: 794435 - RNA, 22 nt, Mycobacterium avium subsp. paratuberculosis
gccgguguucggcgccagccgc

SEQ ID NO: 794436 - RNA, 16 nt, Mycobacterium avium subsp. paratuberculosis
gccgguguugccgacg

SEQ ID NO: 794437 - RNA, 18 nt, Mycobacterium avium subsp. paratuberculosis
gccgguguugccgacggc

SEQ ID NO: 794438 - RNA, 19 nt, Mycobacterium avium subsp. paratuberculosis
gccgguguugccgacggcg

SEQ ID NO: 794439 - RNA, 22 nt, Mycobacterium avium subsp. paratuberculosis
gccgguguugccgacggcgccg

SEQ ID NO: 794440 - RNA, 22 nt, Mycobacterium avium subsp. paratuberculosis
gccgucacccagaucgcccggg

SEQ ID NO: 794441 - RNA, 14 nt, Mycobacterium avium subsp. paratuberculosis
gccgucacaggccg

SEQ ID NO: 794442 - RNA, 15 nt, Mycobacterium avium subsp. paratuberculosis
gccgucacaggccgc

SEQ ID NO: 794443 - RNA, 19 nt, Mycobacterium avium subsp. paratuberculosis
gccgucacaccgcggccag

SEQ ID NO: 794444 - RNA, 21 nt, Mycobacterium avium subsp. paratuberculosis
gccgucacaccgcggccagcg

SEQ ID NO: 794445 - RNA, 20 nt, Mycobacterium avium subsp. paratuberculosis
gccguaucggccccggccga

SEQ ID NO: 794446 - RNA, 16 nt, Mycobacterium avium subsp. paratuberculosis
gccguauucgccgacg

SEQ ID NO: 794447 - RNA, 23 nt, Mycobacterium avium subsp. paratuberculosis
gccguccacgggucgccguggcc

SEQ ID NO: 794448 - RNA, 19 nt, Mycobacterium avium subsp. paratuberculosis
gccguccaccagaucgccc

SEQ ID NO: 794449 - RNA, 13 nt, Mycobacterium avium subsp. paratuberculosis
gccguccacccgg

SEQ ID NO: 794450 - RNA, 15 nt, Mycobacterium avium subsp. paratuberculosis
gccguccacccggcc

SEQ ID NO: 794451 - RNA, 16 nt, Mycobacterium avium subsp. paratuberculosis
gccguccacccggccc

SEQ ID NO: 794452 - RNA, 17 nt, Mycobacterium avium subsp. paratuberculosis
gccguccacccggccca

SEQ ID NO: 794453 - RNA, 16 nt, Mycobacterium avium subsp. paratuberculosis
gccgucacugcacgca

SEQ ID NO: 794454 - RNA, 19 nt, Mycobacterium avium subsp. paratuberculosis
gccgucacugcacgcacgg

SEQ ID NO: 794455 - RNA, 21 nt, Mycobacterium avium subsp. paratuberculosis
gccgucacugcacgcacggcg

SEQ ID NO: 794456 - RNA, 19 nt, Mycobacterium avium subsp. paratuberculosis
gccgucacugucggcgcgg

SEQ ID NO: 794457 - RNA, 20 nt, Mycobacterium avium subsp. paratuberculosis
gccgucacugucggcgcgga

SEQ ID NO: 794458 - RNA, 22 nt, Mycobacterium avium subsp. paratuberculosis
gccgucacugucggcgcggacg

SEQ ID NO: 794459 - RNA, 20 nt, Mycobacterium avium subsp. paratuberculosis
gccgucacgcuggcgugacg

SEQ ID NO: 794460 - RNA, 22 nt, Mycobacterium avium subsp. paratuberculosis
gccgucacggaucgcccacccg

SEQ ID NO: 794461 - RNA, 23 nt, Mycobacterium avium subsp. paratuberculosis
gccgucacggaucgcccacccgc

SEQ ID NO: 794462 - RNA, 14 nt, Mycobacterium avium subsp. paratuberculosis
gccgucacgcccgu

SEQ ID NO: 794463 - RNA, 20 nt, Mycobacterium avium subsp. paratuberculosis
gccgucacguucaccaccgg

SEQ ID NO: 794464 - RNA, 14 nt, Mycobacterium avium subsp. paratuberculosis
gccgucaccggcug

SEQ ID NO: 794465 - RNA, 21 nt, Mycobacterium avium subsp. paratuberculosis
gccgucaccggcugcccgacc

SEQ ID NO: 794466 - RNA, 14 nt, Mycobacterium avium subsp. paratuberculosis
gccgucaccucgag

SEQ ID NO: 794467 - RNA, 15 nt, Mycobacterium avium subsp. paratuberculosis
gccgucaccgccagg

SEQ ID NO: 794468 - RNA, 18 nt, Mycobacterium avium subsp. paratuberculosis
gccgucaccgccaggacc

SEQ ID NO: 794469 - RNA, 13 nt, Mycobacterium avium subsp. paratuberculosis
gccguccagccgu

SEQ ID NO: 794470 - RNA, 18 nt, Mycobacterium avium subsp. paratuberculosis
gccguccagccgugcggc

SEQ ID NO: 794471 - RNA, 16 nt, Mycobacterium avium subsp. paratuberculosis
gccguccagcaacgcc

SEQ ID NO: 794472 - RNA, 17 nt, Mycobacterium avium subsp. paratuberculosis
gccguccagcaacgccg

SEQ ID NO: 794473 - RNA, 14 nt, Mycobacterium avium subsp. paratuberculosis
gccguccagcagca

SEQ ID NO: 794474 - RNA, 21 nt, Mycobacterium avium subsp. paratuberculosis
gccguccagcagcagcgcgcg

SEQ ID NO: 794475 - RNA, 22 nt, Mycobacterium avium subsp. paratuberculosis
gccguccagcagcagcgcgcgg

SEQ ID NO: 794476 - RNA, 23 nt, Mycobacterium avium subsp. paratuberculosis
gccguccagcagcagcgcgcggu

SEQ ID NO: 794477 - RNA, 15 nt, Mycobacterium avium subsp. paratuberculosis
gccguccagcgucac

SEQ ID NO: 794478 - RNA, 20 nt, Mycobacterium avium subsp. paratuberculosis
gccguccagcgucuggcagc

SEQ ID NO: 794479 - RNA, 17 nt, Mycobacterium avium subsp. paratuberculosis
gccguccagcuccgccg

SEQ ID NO: 794480 - RNA, 18 nt, Mycobacterium avium subsp. paratuberculosis
gccguccagcuccgccga

SEQ ID NO: 794481 - RNA, 19 nt, Mycobacterium avium subsp. paratuberculosis
gccguccagcuccgccgac

SEQ ID NO: 794482 - RNA, 19 nt, Mycobacterium avium subsp. paratuberculosis
gccguccagcucgcguucg

SEQ ID NO: 794483 - RNA, 14 nt, Mycobacterium avium subsp. paratuberculosis
gccguccggggccg

SEQ ID NO: 794484 - RNA, 17 nt, Mycobacterium avium subsp. paratuberculosis
gccguccggggccggug

SEQ ID NO: 794485 - RNA, 14 nt, Mycobacterium avium subsp. paratuberculosis
gccguccggggugu

SEQ ID NO: 794486 - RNA, 22 nt, Mycobacterium avium subsp. paratuberculosis
gccguccgggguguaggcgucg

SEQ ID NO: 794487 - RNA, 13 nt, Mycobacterium avium subsp. paratuberculosis
gccguccgggucc

SEQ ID NO: 794488 - RNA, 14 nt, Mycobacterium avium subsp. paratuberculosis
gccguccggguccg

SEQ ID NO: 794489 - RNA, 15 nt, Mycobacterium avium subsp. paratuberculosis
gccguccggguccgg

SEQ ID NO: 794490 - RNA, 16 nt, Mycobacterium avium subsp. paratuberculosis
gccguccgggugcggg

SEQ ID NO: 794491 - RNA, 18 nt, Mycobacterium avium subsp. paratuberculosis
gccguccgggugcgggcu

SEQ ID NO: 794492 - RNA, 24 nt, Mycobacterium avium subsp. paratuberculosis
gccguccggguucgacgccucggu

SEQ ID NO: 794493 - RNA, 13 nt, Mycobacterium avium subsp. paratuberculosis
gccguccgccggc

SEQ ID NO: 794494 - RNA, 14 nt, Mycobacterium avium subsp. paratuberculosis
gccguccgccggcu

SEQ ID NO: 794495 - RNA, 15 nt, Mycobacterium avium subsp. paratuberculosis
gccguccgccggcug

SEQ ID NO: 794496 - RNA, 13 nt, Mycobacterium avium subsp. paratuberculosis
gccguccgcggcg

SEQ ID NO: 794497 - RNA, 15 nt, Mycobacterium avium subsp. paratuberculosis
gccguccgcggcggc

SEQ ID NO: 794498 - RNA, 17 nt, Mycobacterium avium subsp. paratuberculosis
gccguccgcggcggcca

SEQ ID NO: 794499 - RNA, 14 nt, Mycobacterium avium subsp. paratuberculosis
gccguccaggccgc

SEQ ID NO: 794500 - RNA, 19 nt, Mycobacterium avium subsp. paratuberculosis
gccguccaggcgccauugu

SEQ ID NO: 794501 - RNA, 14 nt, Mycobacterium avium subsp. paratuberculosis
gccguccggccacg

SEQ ID NO: 794502 - RNA, 13 nt, Mycobacterium avium subsp. paratuberculosis
gccguccggccgg

SEQ ID NO: 794503 - RNA, 14 nt, Mycobacterium avium subsp. paratuberculosis
gccguccggccggu

SEQ ID NO: 794504 - RNA, 13 nt, Mycobacterium avium subsp. paratuberculosis
gccguccggcggc

SEQ ID NO: 794505 - RNA, 14 nt, Mycobacterium avium subsp. paratuberculosis
gccguccggcggca

SEQ ID NO: 794506 - RNA, 16 nt, Mycobacterium avium subsp. paratuberculosis
gccguccgggaacacg

SEQ ID NO: 794507 - RNA, 24 nt, Mycobacterium avium subsp. paratuberculosis
gccguccgggauaguucgccgccg

SEQ ID NO: 794508 - RNA, 18 nt, Mycobacterium avium subsp. paratuberculosis
gccguccgggcacccgac

SEQ ID NO: 794509 - RNA, 19 nt, Mycobacterium avium subsp. paratuberculosis
gccguccgggcacccgacg

SEQ ID NO: 794510 - RNA, 20 nt, Mycobacterium avium subsp. paratuberculosis
gccgucgaaggccgggcugg

SEQ ID NO: 794511 - RNA, 15 nt, Mycobacterium avium subsp. paratuberculosis
gccgucgaccacgaa

SEQ ID NO: 794512 - RNA, 13 nt, Mycobacterium avium subsp. paratuberculosis
gccgucgaccagc

SEQ ID NO: 794513 - RNA, 13 nt, Mycobacterium avium subsp. paratuberculosis
gccgucgaccccg

SEQ ID NO: 794514 - RNA, 16 nt, Mycobacterium avium subsp. paratuberculosis
gccgucgaccccgccg

SEQ ID NO: 794515 - RNA, 20 nt, Mycobacterium avium subsp. paratuberculosis
gccgucgaccccgccggccc

SEQ ID NO: 794516 - RNA, 22 nt, Mycobacterium avium subsp. paratuberculosis
gccgucgagggggagcaggacg

SEQ ID NO: 794517 - RNA, 16 nt, Mycobacterium avium subsp. paratuberculosis
gccgucgaucgcccgc

SEQ ID NO: 794518 - RNA, 19 nt, Mycobacterium avium subsp. paratuberculosis
gccgucgaucuugacgugg

SEQ ID NO: 794519 - RNA, 22 nt, Mycobacterium avium subsp. paratuberculosis
gccgucgauccacccaccggca

SEQ ID NO: 794520 - RNA, 18 nt, Mycobacterium avium subsp. paratuberculosis
gccgucgaucaccugcgg

SEQ ID NO: 794521 - RNA, 21 nt, Mycobacterium avium subsp. paratuberculosis
gccgucgaaacggcugcugcg

SEQ ID NO: 794522 - RNA, 13 nt, Mycobacterium avium subsp. paratuberculosis
gccguccuugacg

SEQ ID NO: 794523 - RNA, 14 nt, Mycobacterium avium subsp. paratuberculosis
gccguccuuggccg

SEQ ID NO: 794524 - RNA, 22 nt, Mycobacterium avium subsp. paratuberculosis
gccguccuuggccgccagcacc

SEQ ID NO: 794525 - RNA, 16 nt, Mycobacterium avium subsp. paratuberculosis
gccguccuugucgcgc

SEQ ID NO: 794526 - RNA, 18 nt, Mycobacterium avium subsp. paratuberculosis
gccguccuugucgcgcac

SEQ ID NO: 794527 - RNA, 16 nt, Mycobacterium avium subsp. paratuberculosis
gccguccuuggucaca

SEQ ID NO: 794528 - RNA, 20 nt, Mycobacterium avium subsp. paratuberculosis
gccguccuuggucacaaagc

SEQ ID NO: 794529 - RNA, 23 nt, Mycobacterium avium subsp. paratuberculosis
gccguccuuggucacaaagcccg

SEQ ID NO: 794530 - RNA, 22 nt, Mycobacterium avium subsp. paratuberculosis
gccguccugagguauucgucga

SEQ ID NO: 794531 - RNA, 18 nt, Mycobacterium avium subsp. paratuberculosis
gccguccucgcgucgcgc

SEQ ID NO: 794532 - RNA, 20 nt, Mycobacterium avium subsp. paratuberculosis
gccguccucgcgucgcgcgg

SEQ ID NO: 794533 - RNA, 14 nt, Mycobacterium avium subsp. paratuberculosis
gccguccucggccg

SEQ ID NO: 794534 - RNA, 19 nt, Mycobacterium avium subsp. paratuberculosis
gccguccucggccgccacc

SEQ ID NO: 794535 - RNA, 22 nt, Mycobacterium avium subsp. paratuberculosis
gccguccucggccgccaccgcc

SEQ ID NO: 794536 - RNA, 14 nt, Mycobacterium avium subsp. paratuberculosis
gccguugaucaggg

SEQ ID NO: 794537 - RNA, 18 nt, Mycobacterium avium subsp. paratuberculosis
gccguugauugaccaucc

SEQ ID NO: 794538 - RNA, 19 nt, Mycobacterium avium subsp. paratuberculosis
gccguugauugcgcccgcc

SEQ ID NO: 794539 - RNA, 23 nt, Mycobacterium avium subsp. paratuberculosis
gccguugauugcgcccgccgaac

SEQ ID NO: 794540 - RNA, 16 nt, Mycobacterium avium subsp. paratuberculosis
gccguucuugcgggug

SEQ ID NO: 794541 - RNA, 16 nt, Mycobacterium avium subsp. paratuberculosis
gccguugaccccgacg

SEQ ID NO: 794542 - RNA, 19 nt, Mycobacterium avium subsp. paratuberculosis
gccguugaccccgacggcg

SEQ ID NO: 794543 - RNA, 21 nt, Mycobacterium avium subsp. paratuberculosis
gccguugaccccgacggcgcc

SEQ ID NO: 794544 - RNA, 17 nt, Mycobacterium avium subsp. paratuberculosis
gccguugaccgcggcga

SEQ ID NO: 794545 - RNA, 14 nt, Mycobacterium avium subsp. paratuberculosis
gccguugaccggcc

SEQ ID NO: 794546 - RNA, 15 nt, Mycobacterium avium subsp. paratuberculosis
gccguugaccggccg

SEQ ID NO: 794547 - RNA, 13 nt, Mycobacterium avium subsp. paratuberculosis
gccguugacggug

SEQ ID NO: 794548 - RNA, 14 nt, Mycobacterium avium subsp. paratuberculosis
gccguugacggugu

SEQ ID NO: 794549 - RNA, 21 nt, Mycobacterium avium subsp. paratuberculosis
gccguugacuuugccguucca

SEQ ID NO: 794550 - RNA, 15 nt, Mycobacterium avium subsp. paratuberculosis
gccguugagcgugga

SEQ ID NO: 794551 - RNA, 17 nt, Mycobacterium avium subsp. paratuberculosis
gccguugccggcccgca

SEQ ID NO: 794552 - RNA, 17 nt, Mycobacterium avium subsp. paratuberculosis
gccguugccgccgcgcg

SEQ ID NO: 794553 - RNA, 21 nt, Mycobacterium avium subsp. paratuberculosis
gccguugccgccgcgcgcggc

SEQ ID NO: 794554 - RNA, 14 nt, Mycobacterium avium subsp. paratuberculosis
gccguugcgccagc

SEQ ID NO: 794555 - RNA, 13 nt, Mycobacterium avium subsp. paratuberculosis
gccguugccaggc

SEQ ID NO: 794556 - RNA, 18 nt, Mycobacterium avium subsp. paratuberculosis
gccguugccaggccgcga

SEQ ID NO: 794557 - RNA, 21 nt, Mycobacterium avium subsp. paratuberculosis
gccgugcucggcggcgggguc

SEQ ID NO: 794558 - RNA, 22 nt, Mycobacterium avium subsp. paratuberculosis
gccgugcucggcggcggggucg

SEQ ID NO: 794559 - RNA, 16 nt, Mycobacterium avium subsp. paratuberculosis
gccgugcugccggaac

SEQ ID NO: 794560 - RNA, 13 nt, Mycobacterium avium subsp. paratuberculosis
gccgugcggcguu

SEQ ID NO: 794561 - RNA, 20 nt, Mycobacterium avium subsp. paratuberculosis
gccgugcggcguucggugcc

SEQ ID NO: 794562 - RNA, 16 nt, Mycobacterium avium subsp. paratuberculosis
gccgugcgcgucgaca

SEQ ID NO: 794563 - RNA, 14 nt, Mycobacterium avium subsp. paratuberculosis
gccgugcggcggcg

SEQ ID NO: 794564 - RNA, 19 nt, Mycobacterium avium subsp. paratuberculosis
gccgugcggcggcggcggu

SEQ ID NO: 794565 - RNA, 21 nt, Mycobacterium avium subsp. paratuberculosis
gccgugcggcggcggcggucc

SEQ ID NO: 794566 - RNA, 14 nt, Mycobacterium avium subsp. paratuberculosis
gccgugcgccccgc

SEQ ID NO: 794567 - RNA, 13 nt, Mycobacterium avium subsp. paratuberculosis
gccgugcgccagc

SEQ ID NO: 794568 - RNA, 17 nt, Mycobacterium avium subsp. paratuberculosis
gccgugcgccagcgacc

SEQ ID NO: 794569 - RNA, 20 nt, Mycobacterium avium subsp. paratuberculosis
gccgugcgccagcgaccgca

SEQ ID NO: 794570 - RNA, 22 nt, Mycobacterium avium subsp. paratuberculosis
gccgugcgccagcgaccgcagg

SEQ ID NO: 794571 - RNA, 14 nt, Mycobacterium avium subsp. paratuberculosis
gccgugcagcaccu

SEQ ID NO: 794572 - RNA, 19 nt, Mycobacterium avium subsp. paratuberculosis
gccgugcagcaccucgaag

SEQ ID NO: 794573 - RNA, 23 nt, Mycobacterium avium subsp. paratuberculosis
gccgugcagcaccucgaagccga

SEQ ID NO: 794574 - RNA, 19 nt, Mycobacterium avium subsp. paratuberculosis
gccgugcagcacgccgcgg

SEQ ID NO: 794575 - RNA, 20 nt, Mycobacterium avium subsp. paratuberculosis
gccgugcaccgucgccggcg

SEQ ID NO: 794576 - RNA, 21 nt, Mycobacterium avium subsp. paratuberculosis
gccgugcaccgucgccggcgg

SEQ ID NO: 794577 - RNA, 20 nt, Mycobacterium avium subsp. paratuberculosis
gccgugcacgaacaggguga

SEQ ID NO: 794578 - RNA, 16 nt, Mycobacterium avium subsp. paratuberculosis
gccgugcacgccgucg

SEQ ID NO: 794579 - RNA, 17 nt, Mycobacterium avium subsp. paratuberculosis
gccgugccgguggaaca

SEQ ID NO: 794580 - RNA, 13 nt, Mycobacterium avium subsp. paratuberculosis
gccgugccguggu

SEQ ID NO: 794581 - RNA, 14 nt, Mycobacterium avium subsp. paratuberculosis
gccuagugccgggg

SEQ ID NO: 794582 - RNA, 14 nt, Mycobacterium avium subsp. paratuberculosis
gccuaggaccccgg

SEQ ID NO: 794583 - RNA, 16 nt, Mycobacterium avium subsp. paratuberculosis
gccuaggaccccggcu

SEQ ID NO: 794584 - RNA, 16 nt, Mycobacterium avium subsp. paratuberculosis
gccuaggacgccgccc

SEQ ID NO: 794585 - RNA, 16 nt, Mycobacterium avium subsp. paratuberculosis
gccuacuugcggccgc

SEQ ID NO: 794586 - RNA, 17 nt, Mycobacterium avium subsp. paratuberculosis
gccuacuugcggccgcg

SEQ ID NO: 794587 - RNA, 19 nt, Mycobacterium avium subsp. paratuberculosis
gccuacuugcggccgcgac

SEQ ID NO: 794588 - RNA, 20 nt, Mycobacterium avium subsp. paratuberculosis
gccuacuugcggccgcgacg

SEQ ID NO: 794589 - RNA, 21 nt, Mycobacterium avium subsp. paratuberculosis
gccuacuugcguugcgcggcg

SEQ ID NO: 794590 - RNA, 16 nt, Mycobacterium avium subsp. paratuberculosis
gccuagccuuggccgc

SEQ ID NO: 794591 - RNA, 21 nt, Mycobacterium avium subsp. paratuberculosis
gccuagccuuggccgcaggcg

SEQ ID NO: 794592 - RNA, 18 nt, Mycobacterium avium subsp. paratuberculosis
gccguuguaggccgcgcg

SEQ ID NO: 794593 - RNA, 16 nt, Mycobacterium avium subsp. paratuberculosis
gccguugucgaguucg

SEQ ID NO: 794594 - RNA, 20 nt, Mycobacterium avium subsp. paratuberculosis
gccguugggcacgguguagc

SEQ ID NO: 794595 - RNA, 17 nt, Mycobacterium avium subsp. paratuberculosis
gccguugggccagcggc

SEQ ID NO: 794596 - RNA, 20 nt, Mycobacterium avium subsp. paratuberculosis
gccguugggccagcggcgcc

SEQ ID NO: 794597 - RNA, 15 nt, Mycobacterium avium subsp. paratuberculosis
gccguuggccuggua

SEQ ID NO: 794598 - RNA, 17 nt, Mycobacterium avium subsp. paratuberculosis
gccguugcucucggccu

SEQ ID NO: 794599 - RNA, 23 nt, Mycobacterium avium subsp. paratuberculosis
gccguugcucucggccucccggu

SEQ ID NO: 794600 - RNA, 16 nt, Mycobacterium avium subsp. paratuberculosis
gccguugcgccagcgg

SEQ ID NO: 794601 - RNA, 17 nt, Mycobacterium avium subsp. paratuberculosis
gccguugcggcccacgg

SEQ ID NO: 794602 - RNA, 17 nt, Mycobacterium avium subsp. paratuberculosis
gccguugcgggucggcg

SEQ ID NO: 794603 - RNA, 18 nt, Mycobacterium avium subsp. paratuberculosis
gccguugcgggucggcgu

SEQ ID NO: 794604 - RNA, 21 nt, Mycobacterium avium subsp. paratuberculosis
gccguugcgggugucgccggu

SEQ ID NO: 794605 - RNA, 15 nt, Mycobacterium avium subsp. paratuberculosis
gccucgcccucggug

SEQ ID NO: 794606 - RNA, 17 nt, Mycobacterium avium subsp. paratuberculosis
gccucgcccagcgccgc

SEQ ID NO: 794607 - RNA, 19 nt, Mycobacterium avium subsp. paratuberculosis
gccucgcccagcgccgcgg

SEQ ID NO: 794608 - RNA, 20 nt, Mycobacterium avium subsp. paratuberculosis
gccucgcccagcgccgcggc

SEQ ID NO: 794609 - RNA, 23 nt, Mycobacterium avium subsp. paratuberculosis
gccucgcccagcgccgcggcgaa

SEQ ID NO: 794610 - RNA, 20 nt, Mycobacterium avium subsp. paratuberculosis
gccucgccacugggcgucgg

SEQ ID NO: 794611 - RNA, 16 nt, Mycobacterium avium subsp. paratuberculosis
gccucgaugucgucga

SEQ ID NO: 794612 - RNA, 15 nt, Mycobacterium avium subsp. paratuberculosis
gccucgaugcggccg

SEQ ID NO: 794613 - RNA, 15 nt, Mycobacterium avium subsp. paratuberculosis
gccucgaucagcgcg

SEQ ID NO: 794614 - RNA, 16 nt, Mycobacterium avium subsp. paratuberculosis
gccucgaucagcgcga

SEQ ID NO: 794615 - RNA, 18 nt, Mycobacterium avium subsp. paratuberculosis
gccucgaucaucaccacc

SEQ ID NO: 794616 - RNA, 19 nt, Mycobacterium avium subsp. paratuberculosis
gccucgaucaucaccaccg

SEQ ID NO: 794617 - RNA, 22 nt, Mycobacterium avium subsp. paratuberculosis
gccucgaucaucaccaccgccg

SEQ ID NO: 794618 - RNA, 17 nt, Mycobacterium avium subsp. paratuberculosis
gccucgaucaacgccgg

SEQ ID NO: 794619 - RNA, 13 nt, Mycobacterium avium subsp. paratuberculosis
gccucgaucagag

SEQ ID NO: 794620 - RNA, 23 nt, Mycobacterium avium subsp. paratuberculosis
gccucgcgcaucagcaccuccgg

SEQ ID NO: 794621 - RNA, 18 nt, Mycobacterium avium subsp. paratuberculosis
gccucgcgcaaugccgcc

SEQ ID NO: 794622 - RNA, 20 nt, Mycobacterium avium subsp. paratuberculosis
gccucgcgcaaugccgccgc

SEQ ID NO: 794623 - RNA, 21 nt, Mycobacterium avium subsp. paratuberculosis
gccucgcgcaaugccgccgcg

SEQ ID NO: 794624 - RNA, 22 nt, Mycobacterium avium subsp. paratuberculosis
gccucgcgcaaugccgccgcga

SEQ ID NO: 794625 - RNA, 16 nt, Mycobacterium avium subsp. paratuberculosis
gccucgcgcagcgcgu

SEQ ID NO: 794626 - RNA, 19 nt, Mycobacterium avium subsp. paratuberculosis
gccucgcgcagcgcgucgg

SEQ ID NO: 794627 - RNA, 17 nt, Mycobacterium avium subsp. paratuberculosis
gccucgccguugccggc

SEQ ID NO: 794628 - RNA, 19 nt, Mycobacterium avium subsp. paratuberculosis
gccucgccguugccggccc

SEQ ID NO: 794629 - RNA, 20 nt, Mycobacterium avium subsp. paratuberculosis
gccucgccguugccggcccg

SEQ ID NO: 794630 - RNA, 21 nt, Mycobacterium avium subsp. paratuberculosis
gccucgccguugccggcccgc

SEQ ID NO: 794631 - RNA, 17 nt, Mycobacterium avium subsp. paratuberculosis
gccucgccuacacagcc

SEQ ID NO: 794632 - RNA, 13 nt, Mycobacterium avium subsp. paratuberculosis
gccucgccggcgc

SEQ ID NO: 794633 - RNA, 18 nt, Mycobacterium avium subsp. paratuberculosis
gccucgccggcgccgggc

SEQ ID NO: 794634 - RNA, 16 nt, Mycobacterium avium subsp. paratuberculosis
gccucgccgggcccgc

SEQ ID NO: 794635 - RNA, 15 nt, Mycobacterium avium subsp. paratuberculosis
gccuccgcgcgcggc

SEQ ID NO: 794636 - RNA, 18 nt, Mycobacterium avium subsp. paratuberculosis
gccuccgcgcgcggcccg

SEQ ID NO: 794637 - RNA, 21 nt, Mycobacterium avium subsp. paratuberculosis
gccuccggauggcggucgcgc

SEQ ID NO: 794638 - RNA, 22 nt, Mycobacterium avium subsp. paratuberculosis
gccuccggauggcggucgcgcc

SEQ ID NO: 794639 - RNA, 16 nt, Mycobacterium avium subsp. paratuberculosis
gccuccggcaguacgc

SEQ ID NO: 794640 - RNA, 18 nt, Mycobacterium avium subsp. paratuberculosis
gccuccggcaguacgcgc

SEQ ID NO: 794641 - RNA, 22 nt, Mycobacterium avium subsp. paratuberculosis
gccuccggcaguacgcgccggc

SEQ ID NO: 794642 - RNA, 12 nt, Mycobacterium avium subsp. paratuberculosis
gccuccggcggc

SEQ ID NO: 794643 - RNA, 13 nt, Mycobacterium avium subsp. paratuberculosis
gccuccggcggca

SEQ ID NO: 794644 - RNA, 21 nt, Mycobacterium avium subsp. paratuberculosis
gccuccggagugacgucgcgc

SEQ ID NO: 794645 - RNA, 23 nt, Mycobacterium avium subsp. paratuberculosis
gccuccgggaaggcggccgcgaa

SEQ ID NO: 794646 - RNA, 15 nt, Mycobacterium avium subsp. paratuberculosis
gccuccgucagcgcc

SEQ ID NO: 794647 - RNA, 18 nt, Mycobacterium avium subsp. paratuberculosis
gccuccgucagcgccgcc

SEQ ID NO: 794648 - RNA, 19 nt, Mycobacterium avium subsp. paratuberculosis
gccuccgucagcgccgccc

SEQ ID NO: 794649 - RNA, 21 nt, Mycobacterium avium subsp. paratuberculosis
gccuccgucagcgccgcccgc

SEQ ID NO: 794650 - RNA, 17 nt, Mycobacterium avium subsp. paratuberculosis
gccuccgugcuggccgg

SEQ ID NO: 794651 - RNA, 21 nt, Mycobacterium avium subsp. paratuberculosis
gccucagcagcugcuggcgug

SEQ ID NO: 794652 - RNA, 18 nt, Mycobacterium avium subsp. paratuberculosis
gccuccgcccgggugcag

SEQ ID NO: 794653 - RNA, 16 nt, Mycobacterium avium subsp. paratuberculosis
gccuccgcgaucagcu

SEQ ID NO: 794654 - RNA, 17 nt, Mycobacterium avium subsp. paratuberculosis
gccuccgcgaucagcuc

SEQ ID NO: 794655 - RNA, 12 nt, Mycobacterium avium subsp. paratuberculosis
gccucaccgcgg

SEQ ID NO: 794656 - RNA, 16 nt, Mycobacterium avium subsp. paratuberculosis
gccucaccgcgggcca

SEQ ID NO: 794657 - RNA, 15 nt, Mycobacterium avium subsp. paratuberculosis
gccucaccccagcgc

SEQ ID NO: 794658 - RNA, 17 nt, Mycobacterium avium subsp. paratuberculosis
gccucaccccagcgcga

SEQ ID NO: 794659 - RNA, 19 nt, Mycobacterium avium subsp. paratuberculosis
gccucgaacaucggcacgu

SEQ ID NO: 794660 - RNA, 17 nt, Mycobacterium avium subsp. paratuberculosis
gccuccucggugaccuc

SEQ ID NO: 794661 - RNA, 14 nt, Mycobacterium avium subsp. paratuberculosis
gccuccucggugag

SEQ ID NO: 794662 - RNA, 18 nt, Mycobacterium avium subsp. paratuberculosis
gccuccuccucgcugccg

SEQ ID NO: 794663 - RNA, 23 nt, Mycobacterium avium subsp. paratuberculosis
gccuccuccucgcugccggccgg

SEQ ID NO: 794664 - RNA, 14 nt, Mycobacterium avium subsp. paratuberculosis
gccucgaaggcgcc

SEQ ID NO: 794665 - RNA, 20 nt, Mycobacterium avium subsp. paratuberculosis
gccucgaggaucgcggccac

SEQ ID NO: 794666 - RNA, 21 nt, Mycobacterium avium subsp. paratuberculosis
gccucgaggaucgcggccacg

SEQ ID NO: 794667 - RNA, 16 nt, Mycobacterium avium subsp. paratuberculosis
gccucgagcgcccggg

SEQ ID NO: 794668 - RNA, 21 nt, Mycobacterium avium subsp. paratuberculosis
gccucgacgauugucggggcc

SEQ ID NO: 794669 - RNA, 22 nt, Mycobacterium avium subsp. paratuberculosis
gccucgacgauugucggggccg

SEQ ID NO: 794670 - RNA, 15 nt, Mycobacterium avium subsp. paratuberculosis
gccucgagcaacggc

SEQ ID NO: 794671 - RNA, 19 nt, Mycobacterium avium subsp. paratuberculosis
gccucgagcaacggccgca

SEQ ID NO: 794672 - RNA, 20 nt, Mycobacterium avium subsp. paratuberculosis
gccucgagcaccacggcccg

SEQ ID NO: 794673 - RNA, 16 nt, Mycobacterium avium subsp. paratuberculosis
gccucgaccagcaccg

SEQ ID NO: 794674 - RNA, 14 nt, Mycobacterium avium subsp. paratuberculosis
gccucgaccaggcu

SEQ ID NO: 794675 - RNA, 22 nt, Mycobacterium avium subsp. paratuberculosis
gccucgaccaggcuuggcccgc

SEQ ID NO: 794676 - RNA, 23 nt, Mycobacterium avium subsp. paratuberculosis
gccggugaaaccggcgccgaagc

SEQ ID NO: 794677 - RNA, 17 nt, Mycobacterium avium subsp. paratuberculosis
gccggucuuggacagca

SEQ ID NO: 794678 - RNA, 19 nt, Mycobacterium avium subsp. paratuberculosis
gccggucuuggacagcagc

SEQ ID NO: 794679 - RNA, 23 nt, Mycobacterium avium subsp. paratuberculosis
gccggucuuggacagcagcagcu

SEQ ID NO: 794680 - RNA, 19 nt, Mycobacterium avium subsp. paratuberculosis
gccggucuugggcucggcg

SEQ ID NO: 794681 - RNA, 16 nt, Mycobacterium avium subsp. paratuberculosis
gccggucuuguagucg

SEQ ID NO: 794682 - RNA, 22 nt, Mycobacterium avium subsp. paratuberculosis
gccggucuuguagucgaccacc

SEQ ID NO: 794683 - RNA, 23 nt, Mycobacterium avium subsp. paratuberculosis
gccggucuuguagucgaccaccc

SEQ ID NO: 794684 - RNA, 18 nt, Mycobacterium avium subsp. paratuberculosis
gccggucgucggggcauc

SEQ ID NO: 794685 - RNA, 19 nt, Mycobacterium avium subsp. paratuberculosis
gccggucgucggggcaucg

SEQ ID NO: 794686 - RNA, 24 nt, Mycobacterium avium subsp. paratuberculosis
gccggucugggcgaccaugccgcg

SEQ ID NO: 794687 - RNA, 13 nt, Mycobacterium avium subsp. paratuberculosis
gccggugaccgcg

SEQ ID NO: 794688 - RNA, 19 nt, Mycobacterium avium subsp. paratuberculosis
gccggugaccgcgccggug

SEQ ID NO: 794689 - RNA, 23 nt, Mycobacterium avium subsp. paratuberculosis
gccggugaccugcagcgccuugg

SEQ ID NO: 794690 - RNA, 19 nt, Mycobacterium avium subsp. paratuberculosis
gccggugaacacgaacggc

SEQ ID NO: 794691 - RNA, 19 nt, Mycobacterium avium subsp. paratuberculosis
gccggugaagaucagcgcg

SEQ ID NO: 794692 - RNA, 17 nt, Mycobacterium avium subsp. paratuberculosis
gccggugaagaucgccc

SEQ ID NO: 794693 - RNA, 19 nt, Mycobacterium avium subsp. paratuberculosis
gccggugaagaucgcccgc

SEQ ID NO: 794694 - RNA, 23 nt, Mycobacterium avium subsp. paratuberculosis
gccggugaagaucgcccgccgcg

SEQ ID NO: 794695 - RNA, 20 nt, Mycobacterium avium subsp. paratuberculosis
gccggugaaugucguagcgg

SEQ ID NO: 794696 - RNA, 12 nt, Mycobacterium avium subsp. paratuberculosis
gccggugacggu

SEQ ID NO: 794697 - RNA, 13 nt, Mycobacterium avium subsp. paratuberculosis
gccggugacgguc

SEQ ID NO: 794698 - RNA, 14 nt, Mycobacterium avium subsp. paratuberculosis
gccggugacgguca

SEQ ID NO: 794699 - RNA, 22 nt, Mycobacterium avium subsp. paratuberculosis
gccggugacggucaggguguug

SEQ ID NO: 794700 - RNA, 14 nt, Mycobacterium avium subsp. paratuberculosis
gccggugaccacgc

SEQ ID NO: 794701 - RNA, 19 nt, Mycobacterium avium subsp. paratuberculosis
gccggugacuccuccucgg

SEQ ID NO: 794702 - RNA, 23 nt, Mycobacterium avium subsp. paratuberculosis
gccggugacuccuccucggccag

SEQ ID NO: 794703 - RNA, 12 nt, Mycobacterium avium subsp. paratuberculosis
gccggugagcac

SEQ ID NO: 794704 - RNA, 19 nt, Mycobacterium avium subsp. paratuberculosis
gccggugagcacgaccgcc

SEQ ID NO: 794705 - RNA, 15 nt, Mycobacterium avium subsp. paratuberculosis
gccggugaucgcggc

SEQ ID NO: 794706 - RNA, 18 nt, Mycobacterium avium subsp. paratuberculosis
gccggugaucgcggcgcu

SEQ ID NO: 794707 - RNA, 19 nt, Mycobacterium avium subsp. paratuberculosis
gccggugaucgcggcgcug

SEQ ID NO: 794708 - RNA, 16 nt, Mycobacterium avium subsp. paratuberculosis
gccggugaucggucug

SEQ ID NO: 794709 - RNA, 13 nt, Mycobacterium avium subsp. paratuberculosis
gccggugaucucc

SEQ ID NO: 794710 - RNA, 19 nt, Mycobacterium avium subsp. paratuberculosis
gccggugaucucccgugcg

SEQ ID NO: 794711 - RNA, 11 nt, Mycobacterium avium subsp. paratuberculosis
gccggugauga

SEQ ID NO: 794712 - RNA, 22 nt, Mycobacterium avium subsp. paratuberculosis
gccggugaugaacgcgccgucg

SEQ ID NO: 794713 - RNA, 23 nt, Mycobacterium avium subsp. paratuberculosis
gccggugaugaacgcgccgucgu

SEQ ID NO: 794714 - RNA, 17 nt, Mycobacterium avium subsp. paratuberculosis
gccggugaugacgucgc

SEQ ID NO: 794715 - RNA, 19 nt, Mycobacterium avium subsp. paratuberculosis
gccggugaugacgucgccc

SEQ ID NO: 794716 - RNA, 23 nt, Mycobacterium avium subsp. paratuberculosis
gccggugaugacgucgcccaccc

SEQ ID NO: 794717 - RNA, 20 nt, Mycobacterium avium subsp. paratuberculosis
gccggugauggugaucucgc

SEQ ID NO: 794718 - RNA, 21 nt, Mycobacterium avium subsp. paratuberculosis
gccggugcaccacgaugaagc

SEQ ID NO: 794719 - RNA, 14 nt, Mycobacterium avium subsp. paratuberculosis
gccggugcagcacc

SEQ ID NO: 794720 - RNA, 20 nt, Mycobacterium avium subsp. paratuberculosis
gccggugcagcaccucgauc

SEQ ID NO: 794721 - RNA, 18 nt, Mycobacterium avium subsp. paratuberculosis
gccggugcagcacgugcg

SEQ ID NO: 794722 - RNA, 20 nt, Mycobacterium avium subsp. paratuberculosis
gccggugcaguacgcaucgg

SEQ ID NO: 794723 - RNA, 14 nt, Mycobacterium avium subsp. paratuberculosis
gccggugccgacga

SEQ ID NO: 794724 - RNA, 17 nt, Mycobacterium avium subsp. paratuberculosis
gccggugccgacgauga

SEQ ID NO: 794725 - RNA, 13 nt, Mycobacterium avium subsp. paratuberculosis
gccggugccacgg

SEQ ID NO: 794726 - RNA, 18 nt, Mycobacterium avium subsp. paratuberculosis
gccggugccgccggcgca

SEQ ID NO: 794727 - RNA, 12 nt, Mycobacterium avium subsp. paratuberculosis
gccggugccgca

SEQ ID NO: 794728 - RNA, 15 nt, Mycobacterium avium subsp. paratuberculosis
gccggugccgcagcc

SEQ ID NO: 794729 - RNA, 20 nt, Mycobacterium avium subsp. paratuberculosis
gccggugccgcagccguccc

SEQ ID NO: 794730 - RNA, 16 nt, Mycobacterium avium subsp. paratuberculosis
gccggugccgcccauc

SEQ ID NO: 794731 - RNA, 13 nt, Mycobacterium avium subsp. paratuberculosis
gccggugccgccg

SEQ ID NO: 794732 - RNA, 15 nt, Mycobacterium avium subsp. paratuberculosis
gccggugccgccggc

SEQ ID NO: 794733 - RNA, 19 nt, Mycobacterium avium subsp. paratuberculosis
gccggugucggggucgucg

SEQ ID NO: 794734 - RNA, 23 nt, Mycobacterium avium subsp. paratuberculosis
gccggugucggggucgucgacgg

SEQ ID NO: 794735 - RNA, 20 nt, Mycobacterium avium subsp. paratuberculosis
gccggugucggugcgacccg

SEQ ID NO: 794736 - RNA, 22 nt, Mycobacterium avium subsp. paratuberculosis
gccggugguuuugcggcccugc

SEQ ID NO: 794737 - RNA, 17 nt, Mycobacterium avium subsp. paratuberculosis
gccgguggugcaccggu

SEQ ID NO: 794738 - RNA, 12 nt, Mycobacterium avium subsp. paratuberculosis
gccggugguguc

SEQ ID NO: 794739 - RNA, 15 nt, Mycobacterium avium subsp. paratuberculosis
gccggugggcggcgc

SEQ ID NO: 794740 - RNA, 17 nt, Mycobacterium avium subsp. paratuberculosis
gccggugggcggcgccc

SEQ ID NO: 794741 - RNA, 20 nt, Mycobacterium avium subsp. paratuberculosis
gccggugggcggcgcccgac

SEQ ID NO: 794742 - RNA, 21 nt, Mycobacterium avium subsp. paratuberculosis
gccggugggcggcgcccgaca

SEQ ID NO: 794743 - RNA, 20 nt, Mycobacterium avium subsp. paratuberculosis
gccgguggucccggucagcg

SEQ ID NO: 794744 - RNA, 13 nt, Mycobacterium avium subsp. paratuberculosis
gccgguggcggcc

SEQ ID NO: 794745 - RNA, 17 nt, Mycobacterium avium subsp. paratuberculosis
gccgguggcggccacga

SEQ ID NO: 794746 - RNA, 22 nt, Mycobacterium avium subsp. paratuberculosis
gccgguggcggccacgaucgcg

SEQ ID NO: 794747 - RNA, 14 nt, Mycobacterium avium subsp. paratuberculosis
gccgguggcggcga

SEQ ID NO: 794748 - RNA, 19 nt, Mycobacterium avium subsp. paratuberculosis
gccgguggcggcgacaucg

SEQ ID NO: 794749 - RNA, 20 nt, Mycobacterium avium subsp. paratuberculosis
gccgguggacgaggugaccg

SEQ ID NO: 794750 - RNA, 20 nt, Mycobacterium avium subsp. paratuberculosis
gccgguggagauggccagca

SEQ ID NO: 794751 - RNA, 23 nt, Mycobacterium avium subsp. paratuberculosis
gccgguggagauggccagcacca

SEQ ID NO: 794752 - RNA, 22 nt, Mycobacterium avium subsp. paratuberculosis
gccgguggauauuucgcggccg

SEQ ID NO: 794753 - RNA, 19 nt, Mycobacterium avium subsp. paratuberculosis
gccggugcugcucgagggc

SEQ ID NO: 794754 - RNA, 17 nt, Mycobacterium avium subsp. paratuberculosis
gccgguggcagcccggc

SEQ ID NO: 794755 - RNA, 14 nt, Mycobacterium avium subsp. paratuberculosis
gccgguggccgccg

SEQ ID NO: 794756 - RNA, 13 nt, Mycobacterium avium subsp. paratuberculosis
gccgguggccgcg

SEQ ID NO: 794757 - RNA, 14 nt, Mycobacterium avium subsp. paratuberculosis
gccgguggccgcga

SEQ ID NO: 794758 - RNA, 19 nt, Mycobacterium avium subsp. paratuberculosis
gccgguggccgcgaacggg

SEQ ID NO: 794759 - RNA, 14 nt, Mycobacterium avium subsp. paratuberculosis
gccgguggccgcgc

SEQ ID NO: 794760 - RNA, 13 nt, Mycobacterium avium subsp. paratuberculosis
gccggugcugacc

SEQ ID NO: 794761 - RNA, 15 nt, Mycobacterium avium subsp. paratuberculosis
gccggugcugacccg

SEQ ID NO: 794762 - RNA, 17 nt, Mycobacterium avium subsp. paratuberculosis
gccggugcugacccggu

SEQ ID NO: 794763 - RNA, 23 nt, Mycobacterium avium subsp. paratuberculosis
gccggugcuggucaugccgucga

SEQ ID NO: 794764 - RNA, 14 nt, Mycobacterium avium subsp. paratuberculosis
gccggugcugucca

SEQ ID NO: 794765 - RNA, 20 nt, Mycobacterium avium subsp. paratuberculosis
gccggugcuguccacaucgg

SEQ ID NO: 794766 - RNA, 19 nt, Mycobacterium avium subsp. paratuberculosis
gccgguggaauucuggccg

SEQ ID NO: 794767 - RNA, 22 nt, Mycobacterium avium subsp. paratuberculosis
gccgguggaauucuggccgacc

SEQ ID NO: 794768 - RNA, 23 nt, Mycobacterium avium subsp. paratuberculosis
gccgguggaauucuggccgaccg

SEQ ID NO: 794769 - RNA, 19 nt, Mycobacterium avium subsp. paratuberculosis
gccgguggacaggugcauc

SEQ ID NO: 794770 - RNA, 15 nt, Mycobacterium avium subsp. paratuberculosis
gccggugcgccgacc

SEQ ID NO: 794771 - RNA, 15 nt, Mycobacterium avium subsp. paratuberculosis
gccggugcguccgcc

SEQ ID NO: 794772 - RNA, 17 nt, Mycobacterium avium subsp. paratuberculosis
gccggugcguccgccgg

SEQ ID NO: 794773 - RNA, 19 nt, Mycobacterium avium subsp. paratuberculosis
gccggugcguccgccggcg

SEQ ID NO: 794774 - RNA, 20 nt, Mycobacterium avium subsp. paratuberculosis
gccggugcgugaugaccagg

SEQ ID NO: 794775 - RNA, 16 nt, Mycobacterium avium subsp. paratuberculosis
gccggugcggucggcg

SEQ ID NO: 794776 - RNA, 20 nt, Mycobacterium avium subsp. paratuberculosis
gccggugcggucggcgucgu

SEQ ID NO: 794777 - RNA, 13 nt, Mycobacterium avium subsp. paratuberculosis
gccggugcggucg

SEQ ID NO: 794778 - RNA, 22 nt, Mycobacterium avium subsp. paratuberculosis
gccggugcggaugaagugcgcc

SEQ ID NO: 794779 - RNA, 14 nt, Mycobacterium avium subsp. paratuberculosis
gccggugcgcguca

SEQ ID NO: 794780 - RNA, 13 nt, Mycobacterium avium subsp. paratuberculosis
gccggugcggccg

SEQ ID NO: 794781 - RNA, 14 nt, Mycobacterium avium subsp. paratuberculosis
gccggugcggccgc

SEQ ID NO: 794782 - RNA, 16 nt, Mycobacterium avium subsp. paratuberculosis
gccggugcggccgcga

SEQ ID NO: 794783 - RNA, 19 nt, Mycobacterium avium subsp. paratuberculosis
gccggugcggccgcgaucg

SEQ ID NO: 794784 - RNA, 14 nt, Mycobacterium avium subsp. paratuberculosis
gccggugccguuga

SEQ ID NO: 794785 - RNA, 16 nt, Mycobacterium avium subsp. paratuberculosis
gccggugcgagccgcu

SEQ ID NO: 794786 - RNA, 16 nt, Mycobacterium avium subsp. paratuberculosis
gccggucauccgggcc

SEQ ID NO: 794787 - RNA, 23 nt, Mycobacterium avium subsp. paratuberculosis
gccggucauccgggccaccacca

SEQ ID NO: 794788 - RNA, 17 nt, Mycobacterium avium subsp. paratuberculosis
gccggucauaggccgcg

SEQ ID NO: 794789 - RNA, 18 nt, Mycobacterium avium subsp. paratuberculosis
gccggucauaggccgcgc

SEQ ID NO: 794790 - RNA, 19 nt, Mycobacterium avium subsp. paratuberculosis
gccggucauaggccgcgca

SEQ ID NO: 794791 - RNA, 14 nt, Mycobacterium avium subsp. paratuberculosis
gccggucagcgacg

SEQ ID NO: 794792 - RNA, 19 nt, Mycobacterium avium subsp. paratuberculosis
gccggucagcgacgagagc

SEQ ID NO: 794793 - RNA, 22 nt, Mycobacterium avium subsp. paratuberculosis
gccggucagcgcgacaucgccg

SEQ ID NO: 794794 - RNA, 16 nt, Mycobacterium avium subsp. paratuberculosis
gccggucagcggcaac

SEQ ID NO: 794795 - RNA, 23 nt, Mycobacterium avium subsp. paratuberculosis
gccggucagcggcaacacgccgg

SEQ ID NO: 794796 - RNA, 14 nt, Mycobacterium avium subsp. paratuberculosis
gccggucagcacca

SEQ ID NO: 794797 - RNA, 20 nt, Mycobacterium avium subsp. paratuberculosis
gccggucagcacgucgguca

SEQ ID NO: 794798 - RNA, 22 nt, Mycobacterium avium subsp. paratuberculosis
gccggucagcacgucggucagc

SEQ ID NO: 794799 - RNA, 15 nt, Mycobacterium avium subsp. paratuberculosis
gccgguccagccgcc

SEQ ID NO: 794800 - RNA, 16 nt, Mycobacterium avium subsp. paratuberculosis
gccgguccagccgccg

SEQ ID NO: 794801 - RNA, 21 nt, Mycobacterium avium subsp. paratuberculosis
gccgguccagccgccgcgugg

SEQ ID NO: 794802 - RNA, 19 nt, Mycobacterium avium subsp. paratuberculosis
gccgguccagugccggcga

SEQ ID NO: 794803 - RNA, 20 nt, Mycobacterium avium subsp. paratuberculosis
gccgguccaugugccgcauc

SEQ ID NO: 794804 - RNA, 14 nt, Mycobacterium avium subsp. paratuberculosis
gccgguccccggcg

SEQ ID NO: 794805 - RNA, 15 nt, Mycobacterium avium subsp. paratuberculosis
gccgguccccggcga

SEQ ID NO: 794806 - RNA, 16 nt, Mycobacterium avium subsp. paratuberculosis
gccgguccccggcgac

SEQ ID NO: 794807 - RNA, 17 nt, Mycobacterium avium subsp. paratuberculosis
gccgguccccggcgacc

SEQ ID NO: 794808 - RNA, 21 nt, Mycobacterium avium subsp. paratuberculosis
gccgguccccggcgaccaccc

SEQ ID NO: 794809 - RNA, 13 nt, Mycobacterium avium subsp. paratuberculosis
gccgguccggccc

SEQ ID NO: 794810 - RNA, 17 nt, Mycobacterium avium subsp. paratuberculosis
gccgguccggcccuggu

SEQ ID NO: 794811 - RNA, 13 nt, Mycobacterium avium subsp. paratuberculosis
gccgguccggcgg

SEQ ID NO: 794812 - RNA, 14 nt, Mycobacterium avium subsp. paratuberculosis
gccgguccggcggc

SEQ ID NO: 794813 - RNA, 22 nt, Mycobacterium avium subsp. paratuberculosis
gccgguccggcggcaccacccg

SEQ ID NO: 794814 - RNA, 16 nt, Mycobacterium avium subsp. paratuberculosis
gccgguccgaccagcg

SEQ ID NO: 794815 - RNA, 17 nt, Mycobacterium avium subsp. paratuberculosis
gccgguccgaccagcgg

SEQ ID NO: 794816 - RNA, 19 nt, Mycobacterium avium subsp. paratuberculosis
gccgguccgaccagcggcc

SEQ ID NO: 794817 - RNA, 15 nt, Mycobacterium avium subsp. paratuberculosis
gccgguccgaccgcc

SEQ ID NO: 794818 - RNA, 21 nt, Mycobacterium avium subsp. paratuberculosis
gccgguccgaccgccaccacc

SEQ ID NO: 794819 - RNA, 22 nt, Mycobacterium avium subsp. paratuberculosis
gccgguccgaccgccaccaccc

SEQ ID NO: 794820 - RNA, 14 nt, Mycobacterium avium subsp. paratuberculosis
gccgguccgacggc

SEQ ID NO: 794821 - RNA, 16 nt, Mycobacterium avium subsp. paratuberculosis
gccgguccgacggcug

SEQ ID NO: 794822 - RNA, 20 nt, Mycobacterium avium subsp. paratuberculosis
gccgguccgacggcugcggu

SEQ ID NO: 794823 - RNA, 20 nt, Mycobacterium avium subsp. paratuberculosis
gccgguccgaucguccggcg

SEQ ID NO: 794824 - RNA, 22 nt, Mycobacterium avium subsp. paratuberculosis
gccgguccgaucguccggcgcc

SEQ ID NO: 794825 - RNA, 12 nt, Mycobacterium avium subsp. paratuberculosis
gccgguccgccc

SEQ ID NO: 794826 - RNA, 14 nt, Mycobacterium avium subsp. paratuberculosis
gccggucggcggaa

SEQ ID NO: 794827 - RNA, 17 nt, Mycobacterium avium subsp. paratuberculosis
gccggucguagcgucgg

SEQ ID NO: 794828 - RNA, 21 nt, Mycobacterium avium subsp. paratuberculosis
gccggucuccaugucgucggc

SEQ ID NO: 794829 - RNA, 22 nt, Mycobacterium avium subsp. paratuberculosis
gccggucuccaugucgucggcg

SEQ ID NO: 794830 - RNA, 15 nt, Mycobacterium avium subsp. paratuberculosis
gccggucucgaaacg

SEQ ID NO: 794831 - RNA, 23 nt, Mycobacterium avium subsp. paratuberculosis
gccggucucgaaacggaugggcg

SEQ ID NO: 794832 - RNA, 16 nt, Mycobacterium avium subsp. paratuberculosis
gccggucucgaacacg

SEQ ID NO: 794833 - RNA, 23 nt, Mycobacterium avium subsp. paratuberculosis
gccggucucgaacacgccgucgu

SEQ ID NO: 794834 - RNA, 14 nt, Mycobacterium avium subsp. paratuberculosis
gccggucgccgaug

SEQ ID NO: 794835 - RNA, 13 nt, Mycobacterium avium subsp. paratuberculosis
gccggucggcccg

SEQ ID NO: 794836 - RNA, 23 nt, Mycobacterium avium subsp. paratuberculosis
gccggucgcccccucggccgguc

SEQ ID NO: 794837 - RNA, 12 nt, Mycobacterium avium subsp. paratuberculosis
gccggucgccga

SEQ ID NO: 794838 - RNA, 13 nt, Mycobacterium avium subsp. paratuberculosis
gccggucgggaug

SEQ ID NO: 794839 - RNA, 14 nt, Mycobacterium avium subsp. paratuberculosis
gccggucgggaugg

SEQ ID NO: 794840 - RNA, 16 nt, Mycobacterium avium subsp. paratuberculosis
gccggucgggauggcg

SEQ ID NO: 794841 - RNA, 19 nt, Mycobacterium avium subsp. paratuberculosis
gccggucggguugcgcgga

SEQ ID NO: 794842 - RNA, 18 nt, Mycobacterium avium subsp. paratuberculosis
gccggucggucagucgcg

SEQ ID NO: 794843 - RNA, 14 nt, Mycobacterium avium subsp. paratuberculosis
gccggucggucggc

SEQ ID NO: 794844 - RNA, 15 nt, Mycobacterium avium subsp. paratuberculosis
gccggucggucggcc

SEQ ID NO: 794845 - RNA, 18 nt, Mycobacterium avium subsp. paratuberculosis
gccggucggucggccgca

SEQ ID NO: 794846 - RNA, 21 nt, Mycobacterium avium subsp. paratuberculosis
gccggucggucggccgcacgu

SEQ ID NO: 794847 - RNA, 14 nt, Mycobacterium avium subsp. paratuberculosis
gccggucgccgggc

SEQ ID NO: 794848 - RNA, 12 nt, Mycobacterium avium subsp. paratuberculosis
gccggucgccug

SEQ ID NO: 794849 - RNA, 12 nt, Mycobacterium avium subsp. paratuberculosis
gccggucgcgca

SEQ ID NO: 794850 - RNA, 14 nt, Mycobacterium avium subsp. paratuberculosis
gccggucgcgcauc

SEQ ID NO: 794851 - RNA, 20 nt, Mycobacterium avium subsp. paratuberculosis
gccggucgaugucggcgaac

SEQ ID NO: 794852 - RNA, 14 nt, Mycobacterium avium subsp. paratuberculosis
gccggucgcaggug

SEQ ID NO: 794853 - RNA, 18 nt, Mycobacterium avium subsp. paratuberculosis
gccggucccgcggcggcg

SEQ ID NO: 794854 - RNA, 19 nt, Mycobacterium avium subsp. paratuberculosis
gccggucccguugaucucg

SEQ ID NO: 794855 - RNA, 21 nt, Mycobacterium avium subsp. paratuberculosis
gccgguccgugcacggccaac

SEQ ID NO: 794856 - RNA, 13 nt, Mycobacterium avium subsp. paratuberculosis
gccgguccuggcc

SEQ ID NO: 794857 - RNA, 22 nt, Mycobacterium avium subsp. paratuberculosis
gccgguccuggccaacucgacc

SEQ ID NO: 794858 - RNA, 18 nt, Mycobacterium avium subsp. paratuberculosis
gccgguccugggccuccg

SEQ ID NO: 794859 - RNA, 22 nt, Mycobacterium avium subsp. paratuberculosis
gccgguccugggccuccggcgg

SEQ ID NO: 794860 - RNA, 23 nt, Mycobacterium avium subsp. paratuberculosis
gccgguccugggccuccggcggc

SEQ ID NO: 794861 - RNA, 16 nt, Mycobacterium avium subsp. paratuberculosis
gccggucgaacgccag

SEQ ID NO: 794862 - RNA, 17 nt, Mycobacterium avium subsp. paratuberculosis
gccggucgaacgccagc

SEQ ID NO: 794863 - RNA, 24 nt, Mycobacterium avium subsp. paratuberculosis
gccggucgaacgccagcgccgcaa

SEQ ID NO: 794864 - RNA, 12 nt, Mycobacterium avium subsp. paratuberculosis
gccggucgacgc

SEQ ID NO: 794865 - RNA, 23 nt, Mycobacterium avium subsp. paratuberculosis
gccggucgacgcggggcggcggc

SEQ ID NO: 794866 - RNA, 16 nt, Mycobacterium avium subsp. paratuberculosis
gccggucgaggucgcc

SEQ ID NO: 794867 - RNA, 19 nt, Mycobacterium avium subsp. paratuberculosis
gccggucgaggucgccgac

SEQ ID NO: 794868 - RNA, 14 nt, Mycobacterium avium subsp. paratuberculosis
gccggucaccgguc

SEQ ID NO: 794869 - RNA, 21 nt, Mycobacterium avium subsp. paratuberculosis
gccggucaccggucgcguuga

SEQ ID NO: 794870 - RNA, 17 nt, Mycobacterium avium subsp. paratuberculosis
gccgguaucgagcacca

SEQ ID NO: 794871 - RNA, 19 nt, Mycobacterium avium subsp. paratuberculosis
gccgguaugcgaucgcguc

SEQ ID NO: 794872 - RNA, 23 nt, Mycobacterium avium subsp. paratuberculosis
gccggucacgcugaucgaccggu

SEQ ID NO: 794873 - RNA, 20 nt, Mycobacterium avium subsp. paratuberculosis
gccggucacggcgucggcgu

SEQ ID NO: 794874 - RNA, 22 nt, Mycobacterium avium subsp. paratuberculosis
gccgguauuggccacgcuggcg

SEQ ID NO: 794875 - RNA, 13 nt, Mycobacterium avium subsp. paratuberculosis
gccggucaccuug

SEQ ID NO: 794876 - RNA, 18 nt, Mycobacterium avium subsp. paratuberculosis
gccgguagccgcucgccc

SEQ ID NO: 794877 - RNA, 19 nt, Mycobacterium avium subsp. paratuberculosis
gccgguagccgcucgccca

SEQ ID NO: 794878 - RNA, 16 nt, Mycobacterium avium subsp. paratuberculosis
gccgguagagcgccag

SEQ ID NO: 794879 - RNA, 15 nt, Mycobacterium avium subsp. paratuberculosis
gccgguagaucagcg

SEQ ID NO: 794880 - RNA, 15 nt, Mycobacterium avium subsp. paratuberculosis
gccgguaggccgcgc

SEQ ID NO: 794881 - RNA, 16 nt, Mycobacterium avium subsp. paratuberculosis
gccgguaggccgcgcc

SEQ ID NO: 794882 - RNA, 17 nt, Mycobacterium avium subsp. paratuberculosis
gccgguaggccgcgccg

SEQ ID NO: 794883 - RNA, 18 nt, Mycobacterium avium subsp. paratuberculosis
gccgguaggccgcgccga

SEQ ID NO: 794884 - RNA, 17 nt, Mycobacterium avium subsp. paratuberculosis
gccgguaggccugcguc

SEQ ID NO: 794885 - RNA, 14 nt, Mycobacterium avium subsp. paratuberculosis
gccgguaggcgcgg

SEQ ID NO: 794886 - RNA, 15 nt, Mycobacterium avium subsp. paratuberculosis
gccgguaggcgcggg

SEQ ID NO: 794887 - RNA, 17 nt, Mycobacterium avium subsp. paratuberculosis
gccgguaggcggccagc

SEQ ID NO: 794888 - RNA, 19 nt, Mycobacterium avium subsp. paratuberculosis
gccgguaggcggccagcgc

SEQ ID NO: 794889 - RNA, 17 nt, Mycobacterium avium subsp. paratuberculosis
gccgguagggccgguca

SEQ ID NO: 794890 - RNA, 17 nt, Mycobacterium avium subsp. paratuberculosis
gccgguauacccccggu

SEQ ID NO: 794891 - RNA, 23 nt, Mycobacterium avium subsp. paratuberculosis
gccgguauacccccggugaaggu

SEQ ID NO: 794892 - RNA, 19 nt, Mycobacterium avium subsp. paratuberculosis
gccgguaaugggcgaucga

SEQ ID NO: 794893 - RNA, 13 nt, Mycobacterium avium subsp. paratuberculosis
gccgguaccgccg

SEQ ID NO: 794894 - RNA, 22 nt, Mycobacterium avium subsp. paratuberculosis
gccgguaccgccggccaggcga

SEQ ID NO: 794895 - RNA, 14 nt, Mycobacterium avium subsp. paratuberculosis
gccgguacggccga

SEQ ID NO: 794896 - RNA, 17 nt, Mycobacterium avium subsp. paratuberculosis
gccgguacggccgacgc

SEQ ID NO: 794897 - RNA, 22 nt, Mycobacterium avium subsp. paratuberculosis
gccgguacggccgacgcccagc

SEQ ID NO: 794898 - RNA, 20 nt, Mycobacterium avium subsp. paratuberculosis
gccgguaaaacuggccagca

SEQ ID NO: 794899 - RNA, 21 nt, Mycobacterium avium subsp. paratuberculosis
gccggguuuucgggccgguca

SEQ ID NO: 794900 - RNA, 23 nt, Mycobacterium avium subsp. paratuberculosis
gccggguuuucgggccggucagc

SEQ ID NO: 794901 - RNA, 14 nt, Mycobacterium avium subsp. paratuberculosis
gccggguuucggcc

SEQ ID NO: 794902 - RNA, 18 nt, Mycobacterium avium subsp. paratuberculosis
gccggguuucggcccggc

SEQ ID NO: 794903 - RNA, 19 nt, Mycobacterium avium subsp. paratuberculosis
gccggguuucggcccggcu

SEQ ID NO: 794904 - RNA, 18 nt, Mycobacterium avium subsp. paratuberculosis
gccggguuguccuggccc

SEQ ID NO: 794905 - RNA, 19 nt, Mycobacterium avium subsp. paratuberculosis
gccggguugggcggcggcc

SEQ ID NO: 794906 - RNA, 21 nt, Mycobacterium avium subsp. paratuberculosis
gccggguugggcggcggccac

SEQ ID NO: 794907 - RNA, 22 nt, Mycobacterium avium subsp. paratuberculosis
gccggguuccgguuggccaggu

SEQ ID NO: 794908 - RNA, 18 nt, Mycobacterium avium subsp. paratuberculosis
gccggguuggcauccagg

SEQ ID NO: 794909 - RNA, 18 nt, Mycobacterium avium subsp. paratuberculosis
gccggguguagcugggcc

SEQ ID NO: 794910 - RNA, 22 nt, Mycobacterium avium subsp. paratuberculosis
gccgggugggcagccccagcga

SEQ ID NO: 794911 - RNA, 22 nt, Mycobacterium avium subsp. paratuberculosis
gccgggugggcggcacaccgcg

SEQ ID NO: 794912 - RNA, 14 nt, Mycobacterium avium subsp. paratuberculosis
gccggguggccgcc

SEQ ID NO: 794913 - RNA, 15 nt, Mycobacterium avium subsp. paratuberculosis
gccggguggccgcca

SEQ ID NO: 794914 - RNA, 14 nt, Mycobacterium avium subsp. paratuberculosis
gccggguggccggg

SEQ ID NO: 794915 - RNA, 20 nt, Mycobacterium avium subsp. paratuberculosis
gccggguggccggggccauc

SEQ ID NO: 794916 - RNA, 18 nt, Mycobacterium avium subsp. paratuberculosis
gccggguaguucaccccg

SEQ ID NO: 794917 - RNA, 14 nt, Mycobacterium avium subsp. paratuberculosis
gccgggucaccgga

SEQ ID NO: 794918 - RNA, 20 nt, Mycobacterium avium subsp. paratuberculosis
gccgggucacgugcacccac

SEQ ID NO: 794919 - RNA, 19 nt, Mycobacterium avium subsp. paratuberculosis
gccgggguagaggccgcgg

SEQ ID NO: 794920 - RNA, 21 nt, Mycobacterium avium subsp. paratuberculosis
gccgggguagaggccgcggau

SEQ ID NO: 794921 - RNA, 13 nt, Mycobacterium avium subsp. paratuberculosis
gccggguagcgcc

SEQ ID NO: 794922 - RNA, 17 nt, Mycobacterium avium subsp. paratuberculosis
gccggguagcgccgccg

SEQ ID NO: 794923 - RNA, 18 nt, Mycobacterium avium subsp. paratuberculosis
gccggguagcgccgccgg

SEQ ID NO: 794924 - RNA, 20 nt, Mycobacterium avium subsp. paratuberculosis
gccggguccuugcgccccgg

SEQ ID NO: 794925 - RNA, 23 nt, Mycobacterium avium subsp. paratuberculosis
gccggguccuugcgccccggcgg

SEQ ID NO: 794926 - RNA, 13 nt, Mycobacterium avium subsp. paratuberculosis
gccgggucgaacg

SEQ ID NO: 794927 - RNA, 18 nt, Mycobacterium avium subsp. paratuberculosis
gccgggucgaacggcaac

SEQ ID NO: 794928 - RNA, 16 nt, Mycobacterium avium subsp. paratuberculosis
gccggguccgcacccg

SEQ ID NO: 794929 - RNA, 22 nt, Mycobacterium avium subsp. paratuberculosis
gccgggucaggaacaccgagcc

SEQ ID NO: 794930 - RNA, 13 nt, Mycobacterium avium subsp. paratuberculosis
gccggggugcagc

SEQ ID NO: 794931 - RNA, 20 nt, Mycobacterium avium subsp. paratuberculosis
gccggggugcccgggccgca

SEQ ID NO: 794932 - RNA, 21 nt, Mycobacterium avium subsp. paratuberculosis
gccgggguccucucggcgccg

SEQ ID NO: 794933 - RNA, 15 nt, Mycobacterium avium subsp. paratuberculosis
gccggggucgacagc

SEQ ID NO: 794934 - RNA, 19 nt, Mycobacterium avium subsp. paratuberculosis
gccggggucgacagccuga

SEQ ID NO: 794935 - RNA, 16 nt, Mycobacterium avium subsp. paratuberculosis
gccggggucgcgcgcg

SEQ ID NO: 794936 - RNA, 18 nt, Mycobacterium avium subsp. paratuberculosis
gccggggugggccaucgg

SEQ ID NO: 794937 - RNA, 21 nt, Mycobacterium avium subsp. paratuberculosis
gccgggguguagcggauggcg

SEQ ID NO: 794938 - RNA, 14 nt, Mycobacterium avium subsp. paratuberculosis
gccgggguccgcaa

SEQ ID NO: 794939 - RNA, 20 nt, Mycobacterium avium subsp. paratuberculosis
gccgggguccgcaacgccgg

SEQ ID NO: 794940 - RNA, 21 nt, Mycobacterium avium subsp. paratuberculosis
gccgggguccgcaacgccggc

SEQ ID NO: 794941 - RNA, 22 nt, Mycobacterium avium subsp. paratuberculosis
gccgggguccgcaacgccggcg

SEQ ID NO: 794942 - RNA, 18 nt, Mycobacterium avium subsp. paratuberculosis
gccgggggcggcggcgcg

SEQ ID NO: 794943 - RNA, 14 nt, Mycobacterium avium subsp. paratuberculosis
gccgggggcggugc

SEQ ID NO: 794944 - RNA, 22 nt, Mycobacterium avium subsp. paratuberculosis
gccgggggcggugcagccgggu

SEQ ID NO: 794945 - RNA, 16 nt, Mycobacterium avium subsp. paratuberculosis
gccggggggaggucgc

SEQ ID NO: 794946 - RNA, 21 nt, Mycobacterium avium subsp. paratuberculosis
gccgggucuuccacgccggug

SEQ ID NO: 794947 - RNA, 15 nt, Mycobacterium avium subsp. paratuberculosis
gccgggugaacccga

SEQ ID NO: 794948 - RNA, 17 nt, Mycobacterium avium subsp. paratuberculosis
gccgggugaacccgacg

SEQ ID NO: 794949 - RNA, 15 nt, Mycobacterium avium subsp. paratuberculosis
gccgggugaugcagu

SEQ ID NO: 794950 - RNA, 22 nt, Mycobacterium avium subsp. paratuberculosis
gccgggugcccaucugcacagc

SEQ ID NO: 794951 - RNA, 15 nt, Mycobacterium avium subsp. paratuberculosis
gccgggugcccgcgu

SEQ ID NO: 794952 - RNA, 21 nt, Mycobacterium avium subsp. paratuberculosis
gccgggugcgggccagcagcc

SEQ ID NO: 794953 - RNA, 22 nt, Mycobacterium avium subsp. paratuberculosis
gccgggugcgggccagcagccg

SEQ ID NO: 794954 - RNA, 14 nt, Mycobacterium avium subsp. paratuberculosis
gccgggugcggugc

SEQ ID NO: 794955 - RNA, 22 nt, Mycobacterium avium subsp. paratuberculosis
gccgggugcugaacgccugccg

SEQ ID NO: 794956 - RNA, 14 nt, Mycobacterium avium subsp. paratuberculosis
gccggguggcccgc

SEQ ID NO: 794957 - RNA, 15 nt, Mycobacterium avium subsp. paratuberculosis
gccggguggcccgcc

SEQ ID NO: 794958 - RNA, 17 nt, Mycobacterium avium subsp. paratuberculosis
gccggguggcccgcccg

SEQ ID NO: 794959 - RNA, 19 nt, Mycobacterium avium subsp. paratuberculosis
gccggguggcccgcccggg

SEQ ID NO: 794960 - RNA, 23 nt, Mycobacterium avium subsp. paratuberculosis
gccgggucguaggccggaucccg

SEQ ID NO: 794961 - RNA, 22 nt, Mycobacterium avium subsp. paratuberculosis
gccgggucgggaccgaugccgc

SEQ ID NO: 794962 - RNA, 14 nt, Mycobacterium avium subsp. paratuberculosis
gccgggucgcggug

SEQ ID NO: 794963 - RNA, 16 nt, Mycobacterium avium subsp. paratuberculosis
gccgggucgcgguggg

SEQ ID NO: 794964 - RNA, 14 nt, Mycobacterium avium subsp. paratuberculosis
gccgggucgcacgc

SEQ ID NO: 794965 - RNA, 17 nt, Mycobacterium avium subsp. paratuberculosis
gccgggucgcacgccgg

SEQ ID NO: 794966 - RNA, 13 nt, Mycobacterium avium subsp. paratuberculosis
gccgggucgccgu

SEQ ID NO: 794967 - RNA, 18 nt, Mycobacterium avium subsp. paratuberculosis
gccgggucgccgucgagg

SEQ ID NO: 794968 - RNA, 18 nt, Mycobacterium avium subsp. paratuberculosis
gccggguccacgccgagg

SEQ ID NO: 794969 - RNA, 15 nt, Mycobacterium avium subsp. paratuberculosis
gccggguccagccgc

SEQ ID NO: 794970 - RNA, 17 nt, Mycobacterium avium subsp. paratuberculosis
gccggguccagccgcgg

SEQ ID NO: 794971 - RNA, 19 nt, Mycobacterium avium subsp. paratuberculosis
gccgggucauccagccgug

SEQ ID NO: 794972 - RNA, 18 nt, Mycobacterium avium subsp. paratuberculosis
gccgggucgaccgcgaug

SEQ ID NO: 794973 - RNA, 19 nt, Mycobacterium avium subsp. paratuberculosis
gccgggucgaccgcgaugg

SEQ ID NO: 794974 - RNA, 16 nt, Mycobacterium avium subsp. paratuberculosis
gccgggucgacgccga

SEQ ID NO: 794975 - RNA, 19 nt, Mycobacterium avium subsp. paratuberculosis
gccgggcguugcccgccgc

SEQ ID NO: 794976 - RNA, 12 nt, Mycobacterium avium subsp. paratuberculosis
gccgggcgucga

SEQ ID NO: 794977 - RNA, 19 nt, Mycobacterium avium subsp. paratuberculosis
gccgggcgugcccggcgca

SEQ ID NO: 794978 - RNA, 22 nt, Mycobacterium avium subsp. paratuberculosis
gccgggcgugcccggcgcacag

SEQ ID NO: 794979 - RNA, 13 nt, Mycobacterium avium subsp. paratuberculosis
gccgggcucgagc

SEQ ID NO: 794980 - RNA, 14 nt, Mycobacterium avium subsp. paratuberculosis
gccgggcucgaggg

SEQ ID NO: 794981 - RNA, 15 nt, Mycobacterium avium subsp. paratuberculosis
gccgggcucgagggc

SEQ ID NO: 794982 - RNA, 15 nt, Mycobacterium avium subsp. paratuberculosis
gccgggcgccacccg

SEQ ID NO: 794983 - RNA, 17 nt, Mycobacterium avium subsp. paratuberculosis
gccgggcugaccgucga

SEQ ID NO: 794984 - RNA, 19 nt, Mycobacterium avium subsp. paratuberculosis
gccgggcugagcugugccg

SEQ ID NO: 794985 - RNA, 16 nt, Mycobacterium avium subsp. paratuberculosis
gccggggacggugcag

SEQ ID NO: 794986 - RNA, 17 nt, Mycobacterium avium subsp. paratuberculosis
gccggggacggugcagc

SEQ ID NO: 794987 - RNA, 18 nt, Mycobacterium avium subsp. paratuberculosis
gccggggacggugcagcc

SEQ ID NO: 794988 - RNA, 18 nt, Mycobacterium avium subsp. paratuberculosis
gccggggaacaccggcga

SEQ ID NO: 794989 - RNA, 23 nt, Mycobacterium avium subsp. paratuberculosis
gccgggcuuggucaugaacgccg

SEQ ID NO: 794990 - RNA, 23 nt, Mycobacterium avium subsp. paratuberculosis
gccgggcuuccccaaccuggacg

SEQ ID NO: 794991 - RNA, 18 nt, Mycobacterium avium subsp. paratuberculosis
gccgggcugcccaccacc

SEQ ID NO: 794992 - RNA, 19 nt, Mycobacterium avium subsp. paratuberculosis
gccgggcugcccaccacca

SEQ ID NO: 794993 - RNA, 13 nt, Mycobacterium avium subsp. paratuberculosis
gccgggcuggccg

SEQ ID NO: 794994 - RNA, 13 nt, Mycobacterium avium subsp. paratuberculosis
gccgggcugcgca

SEQ ID NO: 794995 - RNA, 13 nt, Mycobacterium avium subsp. paratuberculosis
gccgggcuggcgc

SEQ ID NO: 794996 - RNA, 14 nt, Mycobacterium avium subsp. paratuberculosis
gccggggccggcga

SEQ ID NO: 794997 - RNA, 22 nt, Mycobacterium avium subsp. paratuberculosis
gccggggccuucuuggcggcgg

SEQ ID NO: 794998 - RNA, 14 nt, Mycobacterium avium subsp. paratuberculosis
gccggggcgaccag

SEQ ID NO: 794999 - RNA, 15 nt, Mycobacterium avium subsp. paratuberculosis
gccggggcgaccagu

SEQ ID NO: 795000 - RNA, 13 nt, Mycobacterium avium subsp. paratuberculosis
gccggggccgcgg

SEQ ID NO: 795001 - RNA, 15 nt, Mycobacterium avium subsp. paratuberculosis
gccggggccgcggcu

SEQ ID NO: 795002 - RNA, 20 nt, Mycobacterium avium subsp. paratuberculosis
gccggggcccucgcucaacc

SEQ ID NO: 795003 - RNA, 13 nt, Mycobacterium avium subsp. paratuberculosis
gccggggccagca

SEQ ID NO: 795004 - RNA, 16 nt, Mycobacterium avium subsp. paratuberculosis
gccggggccagcaccc

SEQ ID NO: 795005 - RNA, 15 nt, Mycobacterium avium subsp. paratuberculosis
gccggggacccgcac

SEQ ID NO: 795006 - RNA, 14 nt, Mycobacterium avium subsp. paratuberculosis
gccggggaucgcgc

SEQ ID NO: 795007 - RNA, 17 nt, Mycobacterium avium subsp. paratuberculosis
gccggggaucgcgcagc

SEQ ID NO: 795008 - RNA, 21 nt, Mycobacterium avium subsp. paratuberculosis
gccggggaucgcgcagccgcg

SEQ ID NO: 795009 - RNA, 20 nt, Mycobacterium avium subsp. paratuberculosis
gccggggcagacccgcgucg

SEQ ID NO: 795010 - RNA, 17 nt, Mycobacterium avium subsp. paratuberculosis
gccggggcagcacccgc

SEQ ID NO: 795011 - RNA, 18 nt, Mycobacterium avium subsp. paratuberculosis
gccggggcagcacccgca

SEQ ID NO: 795012 - RNA, 23 nt, Mycobacterium avium subsp. paratuberculosis
gccggggcagcacccgcaccgug

SEQ ID NO: 795013 - RNA, 19 nt, Mycobacterium avium subsp. paratuberculosis
gccggggcgcagcugcagc

SEQ ID NO: 795014 - RNA, 21 nt, Mycobacterium avium subsp. paratuberculosis
gccggggcgcagcugcagcuc

SEQ ID NO: 795015 - RNA, 13 nt, Mycobacterium avium subsp. paratuberculosis
gccggggcggcgg

SEQ ID NO: 795016 - RNA, 15 nt, Mycobacterium avium subsp. paratuberculosis
gccggggcggcggua

SEQ ID NO: 795017 - RNA, 14 nt, Mycobacterium avium subsp. paratuberculosis
gccggggcgggcac

SEQ ID NO: 795018 - RNA, 16 nt, Mycobacterium avium subsp. paratuberculosis
gccggggcgggcagca

SEQ ID NO: 795019 - RNA, 19 nt, Mycobacterium avium subsp. paratuberculosis
gccggggcggauccccgcg

SEQ ID NO: 795020 - RNA, 20 nt, Mycobacterium avium subsp. paratuberculosis
gccggggcgucggacgccag

SEQ ID NO: 795021 - RNA, 21 nt, Mycobacterium avium subsp. paratuberculosis
gccggggcuucgaacgcccgc

SEQ ID NO: 795022 - RNA, 18 nt, Mycobacterium avium subsp. paratuberculosis
gccgggggagucggggug

SEQ ID NO: 795023 - RNA, 16 nt, Mycobacterium avium subsp. paratuberculosis
gccgggggaucaccuc

SEQ ID NO: 795024 - RNA, 17 nt, Mycobacterium avium subsp. paratuberculosis
gccgggggaucaccuca

SEQ ID NO: 795025 - RNA, 23 nt, Mycobacterium avium subsp. paratuberculosis
gccgggggaucaccucaucgccc

SEQ ID NO: 795026 - RNA, 14 nt, Mycobacterium avium subsp. paratuberculosis
gccgggggccgagc

SEQ ID NO: 795027 - RNA, 14 nt, Mycobacterium avium subsp. paratuberculosis
gccgggggcgcggg

SEQ ID NO: 795028 - RNA, 17 nt, Mycobacterium avium subsp. paratuberculosis
gccgggggcgcgggcgg

SEQ ID NO: 795029 - RNA, 20 nt, Mycobacterium avium subsp. paratuberculosis
gccgggggcgcgggcggcag

SEQ ID NO: 795030 - RNA, 15 nt, Mycobacterium avium subsp. paratuberculosis
gccgggcgcccgagc

SEQ ID NO: 795031 - RNA, 19 nt, Mycobacterium avium subsp. paratuberculosis
gccgggccugcagcaacuc

SEQ ID NO: 795032 - RNA, 18 nt, Mycobacterium avium subsp. paratuberculosis
gccgggcgaucauccagg

SEQ ID NO: 795033 - RNA, 19 nt, Mycobacterium avium subsp. paratuberculosis
gccgggcggaugucggugu

SEQ ID NO: 795034 - RNA, 17 nt, Mycobacterium avium subsp. paratuberculosis
gccgggcggcagcagcu

SEQ ID NO: 795035 - RNA, 16 nt, Mycobacterium avium subsp. paratuberculosis
gccgggcgcgggcgcc

SEQ ID NO: 795036 - RNA, 19 nt, Mycobacterium avium subsp. paratuberculosis
gccgggcgcgggcgccguc

SEQ ID NO: 795037 - RNA, 13 nt, Mycobacterium avium subsp. paratuberculosis
gccgggcgggcac

SEQ ID NO: 795038 - RNA, 17 nt, Mycobacterium avium subsp. paratuberculosis
gccgggcgggcacccca

SEQ ID NO: 795039 - RNA, 16 nt, Mycobacterium avium subsp. paratuberculosis
gccgggcgggcgcagg

SEQ ID NO: 795040 - RNA, 13 nt, Mycobacterium avium subsp. paratuberculosis
gccgggcggggug

SEQ ID NO: 795041 - RNA, 12 nt, Mycobacterium avium subsp. paratuberculosis
gccgggcggcgu

SEQ ID NO: 795042 - RNA, 14 nt, Mycobacterium avium subsp. paratuberculosis
gccgggcggcgucc

SEQ ID NO: 795043 - RNA, 17 nt, Mycobacterium avium subsp. paratuberculosis
gccgggcgguacgcgcc

SEQ ID NO: 795044 - RNA, 18 nt, Mycobacterium avium subsp. paratuberculosis
gccgggcgguacgcgccg

SEQ ID NO: 795045 - RNA, 13 nt, Mycobacterium avium subsp. paratuberculosis
gccgggcgguuuc

SEQ ID NO: 795046 - RNA, 21 nt, Mycobacterium avium subsp. paratuberculosis
gccgggcguagucgauggccu

SEQ ID NO: 795047 - RNA, 20 nt, Mycobacterium avium subsp. paratuberculosis
gccgggcgucacucuggcgu

SEQ ID NO: 795048 - RNA, 17 nt, Mycobacterium avium subsp. paratuberculosis
gccgggcggcgccgaac

SEQ ID NO: 795049 - RNA, 20 nt, Mycobacterium avium subsp. paratuberculosis
gccgggcggcgccgaaccgg

SEQ ID NO: 795050 - RNA, 14 nt, Mycobacterium avium subsp. paratuberculosis
gccgggcggccagg

SEQ ID NO: 795051 - RNA, 12 nt, Mycobacterium avium subsp. paratuberculosis
gccgggcggcca

SEQ ID NO: 795052 - RNA, 13 nt, Mycobacterium avium subsp. paratuberculosis
gccgggcggcccg

SEQ ID NO: 795053 - RNA, 18 nt, Mycobacterium avium subsp. paratuberculosis
gccgggcggcccgccucg

SEQ ID NO: 795054 - RNA, 12 nt, Mycobacterium avium subsp. paratuberculosis
gccgggcggccg

SEQ ID NO: 795055 - RNA, 13 nt, Mycobacterium avium subsp. paratuberculosis
gccgggcggccgg

SEQ ID NO: 795056 - RNA, 14 nt, Mycobacterium avium subsp. paratuberculosis
gccgggcggccgga

SEQ ID NO: 795057 - RNA, 15 nt, Mycobacterium avium subsp. paratuberculosis
gccgggcggccgggc

SEQ ID NO: 795058 - RNA, 16 nt, Mycobacterium avium subsp. paratuberculosis
gccgggcggccgggcc

SEQ ID NO: 795059 - RNA, 17 nt, Mycobacterium avium subsp. paratuberculosis
gccgggcggccgggccg

SEQ ID NO: 795060 - RNA, 19 nt, Mycobacterium avium subsp. paratuberculosis
gccgggcggccgggccgga

SEQ ID NO: 795061 - RNA, 17 nt, Mycobacterium avium subsp. paratuberculosis
gccgggcggcgacgucg

SEQ ID NO: 795062 - RNA, 14 nt, Mycobacterium avium subsp. paratuberculosis
gccgggcgaagucg

SEQ ID NO: 795063 - RNA, 18 nt, Mycobacterium avium subsp. paratuberculosis
gccgggcgaccgucuucu

SEQ ID NO: 795064 - RNA, 18 nt, Mycobacterium avium subsp. paratuberculosis
gccgggccugcggcgcgg

SEQ ID NO: 795065 - RNA, 22 nt, Mycobacterium avium subsp. paratuberculosis
gccgggccugcggcgcggccac

SEQ ID NO: 795066 - RNA, 15 nt, Mycobacterium avium subsp. paratuberculosis
gccgggccggcggug

SEQ ID NO: 795067 - RNA, 15 nt, Mycobacterium avium subsp. paratuberculosis
gccgggccgggucca

SEQ ID NO: 795068 - RNA, 18 nt, Mycobacterium avium subsp. paratuberculosis
gccgggccggaacgcccg

SEQ ID NO: 795069 - RNA, 14 nt, Mycobacterium avium subsp. paratuberculosis
gccgggccggaucg

SEQ ID NO: 795070 - RNA, 17 nt, Mycobacterium avium subsp. paratuberculosis
gccgggccggaucgcgc

SEQ ID NO: 795071 - RNA, 18 nt, Mycobacterium avium subsp. paratuberculosis
gccgggcccgcucaccug

SEQ ID NO: 795072 - RNA, 15 nt, Mycobacterium avium subsp. paratuberculosis
gccgggccgccgaug

SEQ ID NO: 795073 - RNA, 14 nt, Mycobacterium avium subsp. paratuberculosis
gccgggccgccgcg

SEQ ID NO: 795074 - RNA, 15 nt, Mycobacterium avium subsp. paratuberculosis
gccgggccgccgcgg

SEQ ID NO: 795075 - RNA, 21 nt, Mycobacterium avium subsp. paratuberculosis
gccgggcccggguggcgucca

SEQ ID NO: 795076 - RNA, 15 nt, Mycobacterium avium subsp. paratuberculosis
gccgggcccgguccc

SEQ ID NO: 795077 - RNA, 16 nt, Mycobacterium avium subsp. paratuberculosis
gccgggcccggucccg

SEQ ID NO: 795078 - RNA, 17 nt, Mycobacterium avium subsp. paratuberculosis
gccgggcccucggacgg

SEQ ID NO: 795079 - RNA, 14 nt, Mycobacterium avium subsp. paratuberculosis
gccgggccgagcgc

SEQ ID NO: 795080 - RNA, 17 nt, Mycobacterium avium subsp. paratuberculosis
gccgggccgagcgcgcc

SEQ ID NO: 795081 - RNA, 14 nt, Mycobacterium avium subsp. paratuberculosis
gccgggccgcccgc

SEQ ID NO: 795082 - RNA, 16 nt, Mycobacterium avium subsp. paratuberculosis
gccgggccgcccgcgc

SEQ ID NO: 795083 - RNA, 17 nt, Mycobacterium avium subsp. paratuberculosis
gccgggccgcccgcgcg

SEQ ID NO: 795084 - RNA, 12 nt, Mycobacterium avium subsp. paratuberculosis
gccgggccagca

SEQ ID NO: 795085 - RNA, 21 nt, Mycobacterium avium subsp. paratuberculosis
gccgggccagcaacagcagcg

SEQ ID NO: 795086 - RNA, 14 nt, Mycobacterium avium subsp. paratuberculosis
gccgggccagcccg

SEQ ID NO: 795087 - RNA, 16 nt, Mycobacterium avium subsp. paratuberculosis
gccgggccagcccggg

SEQ ID NO: 795088 - RNA, 17 nt, Mycobacterium avium subsp. paratuberculosis
gccgggccagccggccc

SEQ ID NO: 795089 - RNA, 23 nt, Mycobacterium avium subsp. paratuberculosis
gccgggccagccggcccuccagg

SEQ ID NO: 795090 - RNA, 13 nt, Mycobacterium avium subsp. paratuberculosis
gccgggccagguc

SEQ ID NO: 795091 - RNA, 16 nt, Mycobacterium avium subsp. paratuberculosis
gccgggccagguccca

SEQ ID NO: 795092 - RNA, 13 nt, Mycobacterium avium subsp. paratuberculosis
gccgggcagcccg

SEQ ID NO: 795093 - RNA, 17 nt, Mycobacterium avium subsp. paratuberculosis
gccgggcagcccgccgc

SEQ ID NO: 795094 - RNA, 24 nt, Mycobacterium avium subsp. paratuberculosis
gccgggcagcccgccgcggaucgg

SEQ ID NO: 795095 - RNA, 15 nt, Mycobacterium avium subsp. paratuberculosis
gccgggcagcgcgcg

SEQ ID NO: 795096 - RNA, 16 nt, Mycobacterium avium subsp. paratuberculosis
gccgggcagcgcgcga

SEQ ID NO: 795097 - RNA, 13 nt, Mycobacterium avium subsp. paratuberculosis
gccgggcaccagc

SEQ ID NO: 795098 - RNA, 14 nt, Mycobacterium avium subsp. paratuberculosis
gccgggcaccagcg

SEQ ID NO: 795099 - RNA, 17 nt, Mycobacterium avium subsp. paratuberculosis
gccgggcacgucgacgc

SEQ ID NO: 795100 - RNA, 19 nt, Mycobacterium avium subsp. paratuberculosis
gccgggcacgucgacgccc

SEQ ID NO: 795101 - RNA, 23 nt, Mycobacterium avium subsp. paratuberculosis
gccgggcacccggguggacaccg

SEQ ID NO: 795102 - RNA, 14 nt, Mycobacterium avium subsp. paratuberculosis
gccgggcaccgcgc

SEQ ID NO: 795103 - RNA, 23 nt, Mycobacterium avium subsp. paratuberculosis
gccgggcaccgcgcccgccccgu

SEQ ID NO: 795104 - RNA, 14 nt, Mycobacterium avium subsp. paratuberculosis
gccgggcaccucgg

SEQ ID NO: 795105 - RNA, 21 nt, Mycobacterium avium subsp. paratuberculosis
gccgggcaccucggcgucggc

SEQ ID NO: 795106 - RNA, 22 nt, Mycobacterium avium subsp. paratuberculosis
gccgggcaccucggcgucggcg

SEQ ID NO: 795107 - RNA, 19 nt, Mycobacterium avium subsp. paratuberculosis
gccgggcaugccguucagc

SEQ ID NO: 795108 - RNA, 22 nt, Mycobacterium avium subsp. paratuberculosis
gccgggcaugccguucagcgcg

SEQ ID NO: 795109 - RNA, 18 nt, Mycobacterium avium subsp. paratuberculosis
gccgggcauccgggccgc

SEQ ID NO: 795110 - RNA, 20 nt, Mycobacterium avium subsp. paratuberculosis
gccgggcauccgggccgccg

SEQ ID NO: 795111 - RNA, 21 nt, Mycobacterium avium subsp. paratuberculosis
gccgggcauccgggccgccgc

SEQ ID NO: 795112 - RNA, 23 nt, Mycobacterium avium subsp. paratuberculosis
gccgggcauccgggccgccgcgg

SEQ ID NO: 795113 - RNA, 17 nt, Mycobacterium avium subsp. paratuberculosis
gccgggcagugcgcggc

SEQ ID NO: 795114 - RNA, 19 nt, Mycobacterium avium subsp. paratuberculosis
gccgggcaucucguugucg

SEQ ID NO: 795115 - RNA, 19 nt, Mycobacterium avium subsp. paratuberculosis
gccgggcagguggucggcg

SEQ ID NO: 795116 - RNA, 20 nt, Mycobacterium avium subsp. paratuberculosis
gccgggcagguggucggcga

SEQ ID NO: 795117 - RNA, 22 nt, Mycobacterium avium subsp. paratuberculosis
gccgggcagguggucggcgaac

SEQ ID NO: 795118 - RNA, 17 nt, Mycobacterium avium subsp. paratuberculosis
gccgggaugccgccggu

SEQ ID NO: 795119 - RNA, 17 nt, Mycobacterium avium subsp. paratuberculosis
gccgggaugcgccaccg

SEQ ID NO: 795120 - RNA, 20 nt, Mycobacterium avium subsp. paratuberculosis
gccgggaugcgccaccgaca

SEQ ID NO: 795121 - RNA, 19 nt, Mycobacterium avium subsp. paratuberculosis
gccgggauugugcuccagg

SEQ ID NO: 795122 - RNA, 16 nt, Mycobacterium avium subsp. paratuberculosis
gccgggcaacagcgcg

SEQ ID NO: 795123 - RNA, 20 nt, Mycobacterium avium subsp. paratuberculosis
gccgggcaacagcgcgccgg

SEQ ID NO: 795124 - RNA, 21 nt, Mycobacterium avium subsp. paratuberculosis
gccgggcaacagcgcgccggc

SEQ ID NO: 795125 - RNA, 22 nt, Mycobacterium avium subsp. paratuberculosis
gccgggcaacagcgcgccggcc

SEQ ID NO: 795126 - RNA, 14 nt, Mycobacterium avium subsp. paratuberculosis
gccgggcaaccaca

SEQ ID NO: 795127 - RNA, 19 nt, Mycobacterium avium subsp. paratuberculosis
gccgggcaaccacagcggc

SEQ ID NO: 795128 - RNA, 20 nt, Mycobacterium avium subsp. paratuberculosis
gccgggcaaccacagcggcg

SEQ ID NO: 795129 - RNA, 21 nt, Mycobacterium avium subsp. paratuberculosis
gccgggcaaccacagcggcgc

SEQ ID NO: 795130 - RNA, 21 nt, Mycobacterium avium subsp. paratuberculosis
gccgggauuucccgggcgauc

SEQ ID NO: 795131 - RNA, 23 nt, Mycobacterium avium subsp. paratuberculosis
gccggcccaguggaucggcccga

SEQ ID NO: 795132 - RNA, 14 nt, Mycobacterium avium subsp. paratuberculosis
gccggcccaggcag

SEQ ID NO: 795133 - RNA, 17 nt, Mycobacterium avium subsp. paratuberculosis
gccggccccgcccggcg

SEQ ID NO: 795134 - RNA, 20 nt, Mycobacterium avium subsp. paratuberculosis
gccggccccgcccggcgcgc

SEQ ID NO: 795135 - RNA, 23 nt, Mycobacterium avium subsp. paratuberculosis
gccggccccgcccggcgcgcagc

SEQ ID NO: 795136 - RNA, 16 nt, Mycobacterium avium subsp. paratuberculosis
gccggccccgcccggg

SEQ ID NO: 795137 - RNA, 19 nt, Mycobacterium avium subsp. paratuberculosis
gccggccccgcccggggcg

SEQ ID NO: 795138 - RNA, 14 nt, Mycobacterium avium subsp. paratuberculosis
gccggccccgcccg

SEQ ID NO: 795139 - RNA, 23 nt, Mycobacterium avium subsp. paratuberculosis
gcgcuguugcccaauucgacugc

SEQ ID NO: 795140 - RNA, 13 nt, Mycobacterium avium subsp. paratuberculosis
gcgcuguucggga

SEQ ID NO: 795141 - RNA, 16 nt, Mycobacterium avium subsp. paratuberculosis
gcgcuguggccguuga

SEQ ID NO: 795142 - RNA, 20 nt, Mycobacterium avium subsp. paratuberculosis
gcgcuguggugacggcccca

SEQ ID NO: 795143 - RNA, 14 nt, Mycobacterium avium subsp. paratuberculosis
gcgcugugcgggug

SEQ ID NO: 795144 - RNA, 13 nt, Mycobacterium avium subsp. paratuberculosis
gcgcugucggcgg

SEQ ID NO: 795145 - RNA, 18 nt, Mycobacterium avium subsp. paratuberculosis
gcgcuguccucgucgggg

SEQ ID NO: 795146 - RNA, 13 nt, Mycobacterium avium subsp. paratuberculosis
gcgcuguccuggu

SEQ ID NO: 795147 - RNA, 13 nt, Mycobacterium avium subsp. paratuberculosis
gcgcugucgacgc

SEQ ID NO: 795148 - RNA, 19 nt, Mycobacterium avium subsp. paratuberculosis
gcgcugucgcccucgaucg

SEQ ID NO: 795149 - RNA, 12 nt, Mycobacterium avium subsp. paratuberculosis
gcgcugucggcg

SEQ ID NO: 795150 - RNA, 16 nt, Mycobacterium avium subsp. paratuberculosis
gcgcuguaggcggcgu

SEQ ID NO: 795151 - RNA, 16 nt, Mycobacterium avium subsp. paratuberculosis
gcgcuguaggucgcgu

SEQ ID NO: 795152 - RNA, 15 nt, Mycobacterium avium subsp. paratuberculosis
gcgcuggugcgggcc

SEQ ID NO: 795153 - RNA, 16 nt, Mycobacterium avium subsp. paratuberculosis
gcgcuggugcgggcca

SEQ ID NO: 795154 - RNA, 17 nt, Mycobacterium avium subsp. paratuberculosis
gcgcuggugcgggccag

SEQ ID NO: 795155 - RNA, 16 nt, Mycobacterium avium subsp. paratuberculosis
gcgcuggugcacccga

SEQ ID NO: 795156 - RNA, 14 nt, Mycobacterium avium subsp. paratuberculosis
gcgcuguaccgcga

SEQ ID NO: 795157 - RNA, 22 nt, Mycobacterium avium subsp. paratuberculosis
gcgcuguaccgcgagaucagcg

SEQ ID NO: 795158 - RNA, 18 nt, Mycobacterium avium subsp. paratuberculosis
gcgcugguccucggggau

SEQ ID NO: 795159 - RNA, 13 nt, Mycobacterium avium subsp. paratuberculosis
gcgcuggucggcg

SEQ ID NO: 795160 - RNA, 14 nt, Mycobacterium avium subsp. paratuberculosis
gcgcuggucggcga

SEQ ID NO: 795161 - RNA, 15 nt, Mycobacterium avium subsp. paratuberculosis
gcgcuggucggcgaa

SEQ ID NO: 795162 - RNA, 15 nt, Mycobacterium avium subsp. paratuberculosis
gcgcuggucggcggg

SEQ ID NO: 795163 - RNA, 20 nt, Mycobacterium avium subsp. paratuberculosis
gcgcugguaguacaccgggc

SEQ ID NO: 795164 - RNA, 16 nt, Mycobacterium avium subsp. paratuberculosis
gcgcugguaguggcgu

SEQ ID NO: 795165 - RNA, 21 nt, Mycobacterium avium subsp. paratuberculosis
gcgcugguaguggcgugcggc

SEQ ID NO: 795166 - RNA, 23 nt, Mycobacterium avium subsp. paratuberculosis
gcgcugguaguggcgugcggccu

SEQ ID NO: 795167 - RNA, 19 nt, Mycobacterium avium subsp. paratuberculosis
gcgcuggucaacucgaccc

SEQ ID NO: 795168 - RNA, 21 nt, Mycobacterium avium subsp. paratuberculosis
gcgcuggucaacucgacccgc

SEQ ID NO: 795169 - RNA, 15 nt, Mycobacterium avium subsp. paratuberculosis
gcgcuugaccucgcc

SEQ ID NO: 795170 - RNA, 16 nt, Mycobacterium avium subsp. paratuberculosis
gcgcuugaccucgccg

SEQ ID NO: 795171 - RNA, 15 nt, Mycobacterium avium subsp. paratuberculosis
gcgcuugacgaacgc

SEQ ID NO: 795172 - RNA, 23 nt, Mycobacterium avium subsp. paratuberculosis
gcgcuugacgaacgccaccacgg

SEQ ID NO: 795173 - RNA, 18 nt, Mycobacterium avium subsp. paratuberculosis
gcgcuucgggugcgggug

SEQ ID NO: 795174 - RNA, 14 nt, Mycobacterium avium subsp. paratuberculosis
gcgcuucgcgcugu

SEQ ID NO: 795175 - RNA, 16 nt, Mycobacterium avium subsp. paratuberculosis
gcgcuuccagcgcggc

SEQ ID NO: 795176 - RNA, 23 nt, Mycobacterium avium subsp. paratuberculosis
gcgcuugcguucccagcccggcc

SEQ ID NO: 795177 - RNA, 20 nt, Mycobacterium avium subsp. paratuberculosis
gcgcuugggucgccgggucu

SEQ ID NO: 795178 - RNA, 15 nt, Mycobacterium avium subsp. paratuberculosis
gcgcuugucagcggc

SEQ ID NO: 795179 - RNA, 18 nt, Mycobacterium avium subsp. paratuberculosis
gcgcuugucagcggccuc

SEQ ID NO: 795180 - RNA, 17 nt, Mycobacterium avium subsp. paratuberculosis
gcgcuugguggcgacga

SEQ ID NO: 795181 - RNA, 15 nt, Mycobacterium avium subsp. paratuberculosis
gcgcuugucggcgug

SEQ ID NO: 795182 - RNA, 16 nt, Mycobacterium avium subsp. paratuberculosis
gcgcuugucggcgugg

SEQ ID NO: 795183 - RNA, 15 nt, Mycobacterium avium subsp. paratuberculosis
gcgcuuucgcgcacg

SEQ ID NO: 795184 - RNA, 19 nt, Mycobacterium avium subsp. paratuberculosis
gcgcuuucgcgcacgccau

SEQ ID NO: 795185 - RNA, 20 nt, Mycobacterium avium subsp. paratuberculosis
gcgcuuucgcgcacgccauc

SEQ ID NO: 795186 - RNA, 22 nt, Mycobacterium avium subsp. paratuberculosis
gcgcuuucgcgcacgccaucgc

SEQ ID NO: 795187 - RNA, 18 nt, Mycobacterium avium subsp. paratuberculosis
gcgcuuucgcuggucgcg

SEQ ID NO: 795188 - RNA, 17 nt, Mycobacterium avium subsp. paratuberculosis
gcgcuugcgcucggucg

SEQ ID NO: 795189 - RNA, 18 nt, Mycobacterium avium subsp. paratuberculosis
gcgcuugcgaccgccgcu

SEQ ID NO: 795190 - RNA, 18 nt, Mycobacterium avium subsp. paratuberculosis
gcgcuugcggcgcagcca

SEQ ID NO: 795191 - RNA, 21 nt, Mycobacterium avium subsp. paratuberculosis
gcgcuugcggcgcagccagcu

SEQ ID NO: 795192 - RNA, 20 nt, Mycobacterium avium subsp. paratuberculosis
gcgcuggccagcgcgacggc

SEQ ID NO: 795193 - RNA, 22 nt, Mycobacterium avium subsp. paratuberculosis
gcgcuggccagcgcgacggccu

SEQ ID NO: 795194 - RNA, 16 nt, Mycobacterium avium subsp. paratuberculosis
gcgcuggccagcguca

SEQ ID NO: 795195 - RNA, 14 nt, Mycobacterium avium subsp. paratuberculosis
gcgcuggaucugcc

SEQ ID NO: 795196 - RNA, 12 nt, Mycobacterium avium subsp. paratuberculosis
gcgcuggccggg

SEQ ID NO: 795197 - RNA, 18 nt, Mycobacterium avium subsp. paratuberculosis
gcgcuggccgcgaacggc

SEQ ID NO: 795198 - RNA, 14 nt, Mycobacterium avium subsp. paratuberculosis
gcgcuggccggcca

SEQ ID NO: 795199 - RNA, 17 nt, Mycobacterium avium subsp. paratuberculosis
gcgcuggccggccacca

SEQ ID NO: 795200 - RNA, 19 nt, Mycobacterium avium subsp. paratuberculosis
gcgcuggccggccaccagc

SEQ ID NO: 795201 - RNA, 22 nt, Mycobacterium avium subsp. paratuberculosis
gcgcuggccggccaccagcggc

SEQ ID NO: 795202 - RNA, 16 nt, Mycobacterium avium subsp. paratuberculosis
gcgcuggccgaccccg

SEQ ID NO: 795203 - RNA, 17 nt, Mycobacterium avium subsp. paratuberculosis
gcgcuggccgaccccga

SEQ ID NO: 795204 - RNA, 19 nt, Mycobacterium avium subsp. paratuberculosis
gcgcuggcgauggugccga

SEQ ID NO: 795205 - RNA, 14 nt, Mycobacterium avium subsp. paratuberculosis
gcgcugggugcggg

SEQ ID NO: 795206 - RNA, 15 nt, Mycobacterium avium subsp. paratuberculosis
gcgcugggcuggccg

SEQ ID NO: 795207 - RNA, 13 nt, Mycobacterium avium subsp. paratuberculosis
gcgcugcaccgca

SEQ ID NO: 795208 - RNA, 16 nt, Mycobacterium avium subsp. paratuberculosis
gcgcugccgcgccccg

SEQ ID NO: 795209 - RNA, 16 nt, Mycobacterium avium subsp. paratuberculosis
gcgcugccgcgcgccg

SEQ ID NO: 795210 - RNA, 19 nt, Mycobacterium avium subsp. paratuberculosis
gcgcugccgcgcgccgaca

SEQ ID NO: 795211 - RNA, 19 nt, Mycobacterium avium subsp. paratuberculosis
gcgcugccggcgcacccgc

SEQ ID NO: 795212 - RNA, 13 nt, Mycobacterium avium subsp. paratuberculosis
gcgcugccguccu

SEQ ID NO: 795213 - RNA, 19 nt, Mycobacterium avium subsp. paratuberculosis
gcgcugccguccuucucga

SEQ ID NO: 795214 - RNA, 16 nt, Mycobacterium avium subsp. paratuberculosis
gcgcugaugccguccu

SEQ ID NO: 795215 - RNA, 13 nt, Mycobacterium avium subsp. paratuberculosis
gcgcugccggccc

SEQ ID NO: 795216 - RNA, 14 nt, Mycobacterium avium subsp. paratuberculosis
gcgcugccggcccg

SEQ ID NO: 795217 - RNA, 15 nt, Mycobacterium avium subsp. paratuberculosis
gcgcugccggcccga

SEQ ID NO: 795218 - RNA, 12 nt, Mycobacterium avium subsp. paratuberculosis
gcgcugcgcggu

SEQ ID NO: 795219 - RNA, 13 nt, Mycobacterium avium subsp. paratuberculosis
gcgcugcgccggg

SEQ ID NO: 795220 - RNA, 15 nt, Mycobacterium avium subsp. paratuberculosis
gcgcugcgccguuga

SEQ ID NO: 795221 - RNA, 13 nt, Mycobacterium avium subsp. paratuberculosis
gcgcugcgcggug

SEQ ID NO: 795222 - RNA, 16 nt, Mycobacterium avium subsp. paratuberculosis
gcgcugcgcgacaccu

SEQ ID NO: 795223 - RNA, 19 nt, Mycobacterium avium subsp. paratuberculosis
gcgcugcgcgacaccugcu

SEQ ID NO: 795224 - RNA, 17 nt, Mycobacterium avium subsp. paratuberculosis
gcgcugcgcccggucag

SEQ ID NO: 795225 - RNA, 17 nt, Mycobacterium avium subsp. paratuberculosis
gcgcucgucgaugcgcg

SEQ ID NO: 795226 - RNA, 20 nt, Mycobacterium avium subsp. paratuberculosis
gcgcugaucgaguccucgcg

SEQ ID NO: 795227 - RNA, 22 nt, Mycobacterium avium subsp. paratuberculosis
gcgcugaucgaguccucgcggu

SEQ ID NO: 795228 - RNA, 15 nt, Mycobacterium avium subsp. paratuberculosis
gcgcucgucgaugcg

SEQ ID NO: 795229 - RNA, 18 nt, Mycobacterium avium subsp. paratuberculosis
gcgcucggugugcgguuc

SEQ ID NO: 795230 - RNA, 18 nt, Mycobacterium avium subsp. paratuberculosis
gcgcucgucguagucgag

SEQ ID NO: 795231 - RNA, 17 nt, Mycobacterium avium subsp. paratuberculosis
gcgcucgucgucgccga

SEQ ID NO: 795232 - RNA, 18 nt, Mycobacterium avium subsp. paratuberculosis
gcgcucgucgucgccgau

SEQ ID NO: 795233 - RNA, 14 nt, Mycobacterium avium subsp. paratuberculosis
gcgcucgucgucgg

SEQ ID NO: 795234 - RNA, 16 nt, Mycobacterium avium subsp. paratuberculosis
gcgcucgucgucggag

SEQ ID NO: 795235 - RNA, 17 nt, Mycobacterium avium subsp. paratuberculosis
gcgcucgugaccggcgg

SEQ ID NO: 795236 - RNA, 18 nt, Mycobacterium avium subsp. paratuberculosis
gcgcucgugaccggcggu

SEQ ID NO: 795237 - RNA, 13 nt, Mycobacterium avium subsp. paratuberculosis
gcgcuccguuggg

SEQ ID NO: 795238 - RNA, 19 nt, Mycobacterium avium subsp. paratuberculosis
gcgcucgggggugcccggc

SEQ ID NO: 795239 - RNA, 13 nt, Mycobacterium avium subsp. paratuberculosis
gcgcucggucgcg

SEQ ID NO: 795240 - RNA, 14 nt, Mycobacterium avium subsp. paratuberculosis
gcgcucggucgcgg

SEQ ID NO: 795241 - RNA, 15 nt, Mycobacterium avium subsp. paratuberculosis
gcgcucggucgcggc

SEQ ID NO: 795242 - RNA, 18 nt, Mycobacterium avium subsp. paratuberculosis
gcgcucggucgcggcgau

SEQ ID NO: 795243 - RNA, 20 nt, Mycobacterium avium subsp. paratuberculosis
gcgcucccgauggcucgcgg

SEQ ID NO: 795244 - RNA, 14 nt, Mycobacterium avium subsp. paratuberculosis
gcgcucggugcugg

SEQ ID NO: 795245 - RNA, 13 nt, Mycobacterium avium subsp. paratuberculosis
gcgcucccggcgc

SEQ ID NO: 795246 - RNA, 17 nt, Mycobacterium avium subsp. paratuberculosis
gcgcucccggcgccgcc

SEQ ID NO: 795247 - RNA, 14 nt, Mycobacterium avium subsp. paratuberculosis
gcgcuccagcgggc

SEQ ID NO: 795248 - RNA, 16 nt, Mycobacterium avium subsp. paratuberculosis
gcgcuccagcgggcgg

SEQ ID NO: 795249 - RNA, 18 nt, Mycobacterium avium subsp. paratuberculosis
gcgcuccagcgggcggcg

SEQ ID NO: 795250 - RNA, 21 nt, Mycobacterium avium subsp. paratuberculosis
gcgcuccagcaggcuggcguu

SEQ ID NO: 795251 - RNA, 18 nt, Mycobacterium avium subsp. paratuberculosis
gcgcgucucccccgauca

SEQ ID NO: 795252 - RNA, 21 nt, Mycobacterium avium subsp. paratuberculosis
gcgcgucucccccgaucagcg

SEQ ID NO: 795253 - RNA, 19 nt, Mycobacterium avium subsp. paratuberculosis
gcgcgugaccccggcgacc

SEQ ID NO: 795254 - RNA, 21 nt, Mycobacterium avium subsp. paratuberculosis
gcgcgugaccccggcgaccag

SEQ ID NO: 795255 - RNA, 23 nt, Mycobacterium avium subsp. paratuberculosis
gcgcgugaugggugggcagcucg

SEQ ID NO: 795256 - RNA, 16 nt, Mycobacterium avium subsp. paratuberculosis
gcgcgugcacgaacgc

SEQ ID NO: 795257 - RNA, 16 nt, Mycobacterium avium subsp. paratuberculosis
gcgcgugcagccgggc

SEQ ID NO: 795258 - RNA, 15 nt, Mycobacterium avium subsp. paratuberculosis
gcgcgugacggcggg

SEQ ID NO: 795259 - RNA, 22 nt, Mycobacterium avium subsp. paratuberculosis
gcgcgucgucggucaggccggc

SEQ ID NO: 795260 - RNA, 17 nt, Mycobacterium avium subsp. paratuberculosis
gcgcguuguccagcagc

SEQ ID NO: 795261 - RNA, 19 nt, Mycobacterium avium subsp. paratuberculosis
gcgcguuguccagcagcgc

SEQ ID NO: 795262 - RNA, 22 nt, Mycobacterium avium subsp. paratuberculosis
gcgcguugcggccguccagcgu

SEQ ID NO: 795263 - RNA, 16 nt, Mycobacterium avium subsp. paratuberculosis
gcgcguugcgcggacc

SEQ ID NO: 795264 - RNA, 17 nt, Mycobacterium avium subsp. paratuberculosis
gcgcguugcgcggaccg

SEQ ID NO: 795265 - RNA, 19 nt, Mycobacterium avium subsp. paratuberculosis
gcgcguugcgcggaccggc

SEQ ID NO: 795266 - RNA, 14 nt, Mycobacterium avium subsp. paratuberculosis
gcgcgugcccgcgg

SEQ ID NO: 795267 - RNA, 18 nt, Mycobacterium avium subsp. paratuberculosis
gcgcguuggccgaggggu

SEQ ID NO: 795268 - RNA, 14 nt, Mycobacterium avium subsp. paratuberculosis
gcgcguuggccggc

SEQ ID NO: 795269 - RNA, 20 nt, Mycobacterium avium subsp. paratuberculosis
gcgcguuggccggcuggaac

SEQ ID NO: 795270 - RNA, 19 nt, Mycobacterium avium subsp. paratuberculosis
gcgcuaaagccaccagcgu

SEQ ID NO: 795271 - RNA, 17 nt, Mycobacterium avium subsp. paratuberculosis
gcgcuaaggccgcugcc

SEQ ID NO: 795272 - RNA, 13 nt, Mycobacterium avium subsp. paratuberculosis
gcgcuaaccgcgg

SEQ ID NO: 795273 - RNA, 15 nt, Mycobacterium avium subsp. paratuberculosis
gcgcucaacccgggc

SEQ ID NO: 795274 - RNA, 16 nt, Mycobacterium avium subsp. paratuberculosis
gcgcucaacccgggcc

SEQ ID NO: 795275 - RNA, 17 nt, Mycobacterium avium subsp. paratuberculosis
gcgcucaacccgggccg

SEQ ID NO: 795276 - RNA, 19 nt, Mycobacterium avium subsp. paratuberculosis
gcgcucaacccgggccgga

SEQ ID NO: 795277 - RNA, 13 nt, Mycobacterium avium subsp. paratuberculosis
gcgcucaaccgcc

SEQ ID NO: 795278 - RNA, 17 nt, Mycobacterium avium subsp. paratuberculosis
gcgcucaaccgcccagc

SEQ ID NO: 795279 - RNA, 14 nt, Mycobacterium avium subsp. paratuberculosis
gcgcucagcgcggc

SEQ ID NO: 795280 - RNA, 15 nt, Mycobacterium avium subsp. paratuberculosis
gcgcucagcgcggcc

SEQ ID NO: 795281 - RNA, 18 nt, Mycobacterium avium subsp. paratuberculosis
gcgcucagcgcggccaca

SEQ ID NO: 795282 - RNA, 21 nt, Mycobacterium avium subsp. paratuberculosis
gcgcucagcgcggccacaccg

SEQ ID NO: 795283 - RNA, 13 nt, Mycobacterium avium subsp. paratuberculosis
gcgcucagcacgc

SEQ ID NO: 795284 - RNA, 16 nt, Mycobacterium avium subsp. paratuberculosis
gcgcucaccgcaucga

SEQ ID NO: 795285 - RNA, 20 nt, Mycobacterium avium subsp. paratuberculosis
gcgcucaccgcaucgaaccg

SEQ ID NO: 795286 - RNA, 13 nt, Mycobacterium avium subsp. paratuberculosis
gcgcucaccgcga

SEQ ID NO: 795287 - RNA, 16 nt, Mycobacterium avium subsp. paratuberculosis
gcgcucaccgcgauga

SEQ ID NO: 795288 - RNA, 15 nt, Mycobacterium avium subsp. paratuberculosis
gcgcucaccgucgcg

SEQ ID NO: 795289 - RNA, 16 nt, Mycobacterium avium subsp. paratuberculosis
gcgcucaccgucgcgg

SEQ ID NO: 795290 - RNA, 12 nt, Mycobacterium avium subsp. paratuberculosis
gcgcguccgcgg

SEQ ID NO: 795291 - RNA, 16 nt, Mycobacterium avium subsp. paratuberculosis
gcgcguccgcgggcgg

SEQ ID NO: 795292 - RNA, 15 nt, Mycobacterium avium subsp. paratuberculosis
gcgcguccggaggug

SEQ ID NO: 795293 - RNA, 14 nt, Mycobacterium avium subsp. paratuberculosis
gcgcguagucggcg

SEQ ID NO: 795294 - RNA, 15 nt, Mycobacterium avium subsp. paratuberculosis
gcgcguagucggcgu

SEQ ID NO: 795295 - RNA, 16 nt, Mycobacterium avium subsp. paratuberculosis
gcgcguagucggcguc

SEQ ID NO: 795296 - RNA, 16 nt, Mycobacterium avium subsp. paratuberculosis
gcgcgucgagcagcac

SEQ ID NO: 795297 - RNA, 21 nt, Mycobacterium avium subsp. paratuberculosis
gcgcgucgagcagcaccaccc

SEQ ID NO: 795298 - RNA, 18 nt, Mycobacterium avium subsp. paratuberculosis
gcgcgucgaggucgcgca

SEQ ID NO: 795299 - RNA, 20 nt, Mycobacterium avium subsp. paratuberculosis
gcgcgucgaggucgcgcagc

SEQ ID NO: 795300 - RNA, 11 nt, Mycobacterium avium subsp. paratuberculosis
gcgcgucgauc

SEQ ID NO: 795301 - RNA, 12 nt, Mycobacterium avium subsp. paratuberculosis
gcgcgucgagca

SEQ ID NO: 795302 - RNA, 14 nt, Mycobacterium avium subsp. paratuberculosis
gcgcgucgacgcgg

SEQ ID NO: 795303 - RNA, 22 nt, Mycobacterium avium subsp. paratuberculosis
gcgcgucgacguucgccgccag

SEQ ID NO: 795304 - RNA, 17 nt, Mycobacterium avium subsp. paratuberculosis
gcgcgucgaccagccgc

SEQ ID NO: 795305 - RNA, 14 nt, Mycobacterium avium subsp. paratuberculosis
gcgcgucguugccc

SEQ ID NO: 795306 - RNA, 19 nt, Mycobacterium avium subsp. paratuberculosis
gcgcgucguacaccucggu

SEQ ID NO: 795307 - RNA, 21 nt, Mycobacterium avium subsp. paratuberculosis
gcgcgucguagucgcucggcg

SEQ ID NO: 795308 - RNA, 12 nt, Mycobacterium avium subsp. paratuberculosis
gcgcgucggcgu

SEQ ID NO: 795309 - RNA, 13 nt, Mycobacterium avium subsp. paratuberculosis
gcgcgucggugau

SEQ ID NO: 795310 - RNA, 20 nt, Mycobacterium avium subsp. paratuberculosis
gcgcgucguccgacaccacc

SEQ ID NO: 795311 - RNA, 14 nt, Mycobacterium avium subsp. paratuberculosis
gcgcgucgucgaug

SEQ ID NO: 795312 - RNA, 15 nt, Mycobacterium avium subsp. paratuberculosis
gcgcgucgucgaugg

SEQ ID NO: 795313 - RNA, 22 nt, Mycobacterium avium subsp. paratuberculosis
gcgcgucgucgauggccaccag

SEQ ID NO: 795314 - RNA, 12 nt, Mycobacterium avium subsp. paratuberculosis
gcgcgucgucgc

SEQ ID NO: 795315 - RNA, 15 nt, Mycobacterium avium subsp. paratuberculosis
gcgcgucgucgccga

SEQ ID NO: 795316 - RNA, 13 nt, Mycobacterium avium subsp. paratuberculosis
gcgcgucggcgac

SEQ ID NO: 795317 - RNA, 14 nt, Mycobacterium avium subsp. paratuberculosis
gcgcgucggcgacc

SEQ ID NO: 795318 - RNA, 15 nt, Mycobacterium avium subsp. paratuberculosis
gcgcgucggcgaccg

SEQ ID NO: 795319 - RNA, 14 nt, Mycobacterium avium subsp. paratuberculosis
gcgcgucgggggug

SEQ ID NO: 795320 - RNA, 18 nt, Mycobacterium avium subsp. paratuberculosis
gcgcgucgggggugccgc

SEQ ID NO: 795321 - RNA, 20 nt, Mycobacterium avium subsp. paratuberculosis
gcgcgucgguaaucggcggu

SEQ ID NO: 795322 - RNA, 22 nt, Mycobacterium avium subsp. paratuberculosis
gcgcgucgguaaucggcggugg

SEQ ID NO: 795323 - RNA, 16 nt, Mycobacterium avium subsp. paratuberculosis
gcgcgucggccagcgc

SEQ ID NO: 795324 - RNA, 14 nt, Mycobacterium avium subsp. paratuberculosis
gcgcgucggccgca

SEQ ID NO: 795325 - RNA, 14 nt, Mycobacterium avium subsp. paratuberculosis
gcgcgucggccagc

SEQ ID NO: 795326 - RNA, 20 nt, Mycobacterium avium subsp. paratuberculosis
gcgcgucggccagcaccacc

SEQ ID NO: 795327 - RNA, 21 nt, Mycobacterium avium subsp. paratuberculosis
gcgcgucggccagcaccacca

SEQ ID NO: 795328 - RNA, 11 nt, Mycobacterium avium subsp. paratuberculosis
gcgcgucgacg

SEQ ID NO: 795329 - RNA, 13 nt, Mycobacterium avium subsp. paratuberculosis
gcgcgucggccag

SEQ ID NO: 795330 - RNA, 18 nt, Mycobacterium avium subsp. paratuberculosis
gcgcgucgcugggcagcc

SEQ ID NO: 795331 - RNA, 21 nt, Mycobacterium avium subsp. paratuberculosis
gcgcgucgcugggcagccguc

SEQ ID NO: 795332 - RNA, 20 nt, Mycobacterium avium subsp. paratuberculosis
gcgcgucggagaucaccggc

SEQ ID NO: 795333 - RNA, 14 nt, Mycobacterium avium subsp. paratuberculosis
gcgcgucgcggugg

SEQ ID NO: 795334 - RNA, 19 nt, Mycobacterium avium subsp. paratuberculosis
gcgcgucgcggcgcggacc

SEQ ID NO: 795335 - RNA, 14 nt, Mycobacterium avium subsp. paratuberculosis
gcgcgucgcgcagc

SEQ ID NO: 795336 - RNA, 13 nt, Mycobacterium avium subsp. paratuberculosis
gcgcgucgcgccc

SEQ ID NO: 795337 - RNA, 16 nt, Mycobacterium avium subsp. paratuberculosis
gcgcgucgcgcccggc

SEQ ID NO: 795338 - RNA, 17 nt, Mycobacterium avium subsp. paratuberculosis
gcgcggugccggugauc

SEQ ID NO: 795339 - RNA, 17 nt, Mycobacterium avium subsp. paratuberculosis
gcgcguacacgaugccc

SEQ ID NO: 795340 - RNA, 13 nt, Mycobacterium avium subsp. paratuberculosis
gcgcggugggcgg

SEQ ID NO: 795341 - RNA, 14 nt, Mycobacterium avium subsp. paratuberculosis
gcgcguagcgcagc

SEQ ID NO: 795342 - RNA, 15 nt, Mycobacterium avium subsp. paratuberculosis
gcgcguacuccgaca

SEQ ID NO: 795343 - RNA, 12 nt, Mycobacterium avium subsp. paratuberculosis
gcgcgguggcgu

SEQ ID NO: 795344 - RNA, 19 nt, Mycobacterium avium subsp. paratuberculosis
gcgcgguggcgugcagcgc

SEQ ID NO: 795345 - RNA, 21 nt, Mycobacterium avium subsp. paratuberculosis
gcgcgguggcgugcagcgcgg

SEQ ID NO: 795346 - RNA, 15 nt, Mycobacterium avium subsp. paratuberculosis
gcgcggugcucggcg

SEQ ID NO: 795347 - RNA, 14 nt, Mycobacterium avium subsp. paratuberculosis
gcgcggugcgccag

SEQ ID NO: 795348 - RNA, 20 nt, Mycobacterium avium subsp. paratuberculosis
gcgcggugcgccagcgccgg

SEQ ID NO: 795349 - RNA, 15 nt, Mycobacterium avium subsp. paratuberculosis
gcgcggugaugaccu

SEQ ID NO: 795350 - RNA, 23 nt, Mycobacterium avium subsp. paratuberculosis
gcgcggugauucgaagaacacgc

SEQ ID NO: 795351 - RNA, 13 nt, Mycobacterium avium subsp. paratuberculosis
gcgcggugcacca

SEQ ID NO: 795352 - RNA, 14 nt, Mycobacterium avium subsp. paratuberculosis
gcgcggugcacggu

SEQ ID NO: 795353 - RNA, 19 nt, Mycobacterium avium subsp. paratuberculosis
gcgcggugcccagccaggc

SEQ ID NO: 795354 - RNA, 14 nt, Mycobacterium avium subsp. paratuberculosis
gcgcggugcccgga

SEQ ID NO: 795355 - RNA, 15 nt, Mycobacterium avium subsp. paratuberculosis
gcgcggugccgaccu

SEQ ID NO: 795356 - RNA, 15 nt, Mycobacterium avium subsp. paratuberculosis
gcgcggucgguggcg

SEQ ID NO: 795357 - RNA, 16 nt, Mycobacterium avium subsp. paratuberculosis
gcgcggucgguggcgg

SEQ ID NO: 795358 - RNA, 18 nt, Mycobacterium avium subsp. paratuberculosis
gcgcggucgguggcggug

SEQ ID NO: 795359 - RNA, 13 nt, Mycobacterium avium subsp. paratuberculosis
gcgcggucgucgc

SEQ ID NO: 795360 - RNA, 21 nt, Mycobacterium avium subsp. paratuberculosis
gcgcggucgucuucuuggccg

SEQ ID NO: 795361 - RNA, 17 nt, Mycobacterium avium subsp. paratuberculosis
gcgcggugaagucggug

SEQ ID NO: 795362 - RNA, 18 nt, Mycobacterium avium subsp. paratuberculosis
gcgcggugaagucggugc

SEQ ID NO: 795363 - RNA, 19 nt, Mycobacterium avium subsp. paratuberculosis
gcgcggugaagucggugcc

SEQ ID NO: 795364 - RNA, 16 nt, Mycobacterium avium subsp. paratuberculosis
gcgcgggucggcgccg

SEQ ID NO: 795365 - RNA, 19 nt, Mycobacterium avium subsp. paratuberculosis
gcgcgggucggcgccggcc

SEQ ID NO: 795366 - RNA, 14 nt, Mycobacterium avium subsp. paratuberculosis
gcgcgggucgucgg

SEQ ID NO: 795367 - RNA, 17 nt, Mycobacterium avium subsp. paratuberculosis
gcgcgggucgucggccu

SEQ ID NO: 795368 - RNA, 13 nt, Mycobacterium avium subsp. paratuberculosis
gcgcgggugcggg

SEQ ID NO: 795369 - RNA, 14 nt, Mycobacterium avium subsp. paratuberculosis
gcgcgggucgagca

SEQ ID NO: 795370 - RNA, 17 nt, Mycobacterium avium subsp. paratuberculosis
gcgcgggucgagcagca

SEQ ID NO: 795371 - RNA, 21 nt, Mycobacterium avium subsp. paratuberculosis
gcgcgggguggcgccggccag

SEQ ID NO: 795372 - RNA, 23 nt, Mycobacterium avium subsp. paratuberculosis
gcgcgggguggcgccggccagca

SEQ ID NO: 795373 - RNA, 13 nt, Mycobacterium avium subsp. paratuberculosis
gcgcggguacggc

SEQ ID NO: 795374 - RNA, 18 nt, Mycobacterium avium subsp. paratuberculosis
gcgcggguacggcggccg

SEQ ID NO: 795375 - RNA, 14 nt, Mycobacterium avium subsp. paratuberculosis
gcgcggggucggcc

SEQ ID NO: 795376 - RNA, 16 nt, Mycobacterium avium subsp. paratuberculosis
gcgcggggucggccag

SEQ ID NO: 795377 - RNA, 14 nt, Mycobacterium avium subsp. paratuberculosis
gcgcggggucgggc

SEQ ID NO: 795378 - RNA, 17 nt, Mycobacterium avium subsp. paratuberculosis
gcgcgggcaaucgcugc

SEQ ID NO: 795379 - RNA, 14 nt, Mycobacterium avium subsp. paratuberculosis
gcgcgggcaccguc

SEQ ID NO: 795380 - RNA, 19 nt, Mycobacterium avium subsp. paratuberculosis
gcgcgggggccgccgcgau

SEQ ID NO: 795381 - RNA, 22 nt, Mycobacterium avium subsp. paratuberculosis
gcgcgggcaugaaccaggccgc

SEQ ID NO: 795382 - RNA, 17 nt, Mycobacterium avium subsp. paratuberculosis
gcgcgggccgcagcgcg

SEQ ID NO: 795383 - RNA, 21 nt, Mycobacterium avium subsp. paratuberculosis
gcgcgggccgccgacgucgug

SEQ ID NO: 795384 - RNA, 15 nt, Mycobacterium avium subsp. paratuberculosis
gcgcggcacgggccg

SEQ ID NO: 795385 - RNA, 13 nt, Mycobacterium avium subsp. paratuberculosis
gcgcggcucgcgg

SEQ ID NO: 795386 - RNA, 20 nt, Mycobacterium avium subsp. paratuberculosis
gcgcggcucgcgggcgaugc

SEQ ID NO: 795387 - RNA, 21 nt, Mycobacterium avium subsp. paratuberculosis
gcgcggcaggaauuccagcga

SEQ ID NO: 795388 - RNA, 14 nt, Mycobacterium avium subsp. paratuberculosis
gcgcggcagggcca

SEQ ID NO: 795389 - RNA, 15 nt, Mycobacterium avium subsp. paratuberculosis
gcgcggcagggccag

SEQ ID NO: 795390 - RNA, 13 nt, Mycobacterium avium subsp. paratuberculosis
gcgcggcuggccg

SEQ ID NO: 795391 - RNA, 19 nt, Mycobacterium avium subsp. paratuberculosis
gcgcggcuggccgucgucg

SEQ ID NO: 795392 - RNA, 17 nt, Mycobacterium avium subsp. paratuberculosis
gcgcggcuuggccacca

SEQ ID NO: 795393 - RNA, 23 nt, Mycobacterium avium subsp. paratuberculosis
gcgcggcuuggccaccaccacgg

SEQ ID NO: 795394 - RNA, 12 nt, Mycobacterium avium subsp. paratuberculosis
gcgcgggccagc

SEQ ID NO: 795395 - RNA, 13 nt, Mycobacterium avium subsp. paratuberculosis
gcgcgggccagca

SEQ ID NO: 795396 - RNA, 14 nt, Mycobacterium avium subsp. paratuberculosis
gcgcgggccagcgc

SEQ ID NO: 795397 - RNA, 14 nt, Mycobacterium avium subsp. paratuberculosis
gcgcgggccagcgu

SEQ ID NO: 795398 - RNA, 17 nt, Mycobacterium avium subsp. paratuberculosis
gcgcgggccagcguuuc

SEQ ID NO: 795399 - RNA, 22 nt, Mycobacterium avium subsp. paratuberculosis
gcgcggcuuuuggcgucguuga

SEQ ID NO: 795400 - RNA, 19 nt, Mycobacterium avium subsp. paratuberculosis
gcgcgggagcgcuggucgg

SEQ ID NO: 795401 - RNA, 16 nt, Mycobacterium avium subsp. paratuberculosis
gcgcgggaucggugcc

SEQ ID NO: 795402 - RNA, 21 nt, Mycobacterium avium subsp. paratuberculosis
gcgcggauuucucagcggcgc

SEQ ID NO: 795403 - RNA, 19 nt, Mycobacterium avium subsp. paratuberculosis
gcgcggauuccagcgcgac

SEQ ID NO: 795404 - RNA, 21 nt, Mycobacterium avium subsp. paratuberculosis
gcgcggauuccagcgcgaccg

SEQ ID NO: 795405 - RNA, 16 nt, Mycobacterium avium subsp. paratuberculosis
gcgcggauggguggcg

SEQ ID NO: 795406 - RNA, 20 nt, Mycobacterium avium subsp. paratuberculosis
gcgcggauggguggcgauca

SEQ ID NO: 795407 - RNA, 20 nt, Mycobacterium avium subsp. paratuberculosis
gcgcggaugcccaggccggc

SEQ ID NO: 795408 - RNA, 21 nt, Mycobacterium avium subsp. paratuberculosis
gcgcggaugacgugcaccacc

SEQ ID NO: 795409 - RNA, 17 nt, Mycobacterium avium subsp. paratuberculosis
gcgcggagauggugguc

SEQ ID NO: 795410 - RNA, 16 nt, Mycobacterium avium subsp. paratuberculosis
gcgcggacgcggcgga

SEQ ID NO: 795411 - RNA, 19 nt, Mycobacterium avium subsp. paratuberculosis
gcgcggagaaggugucgca

SEQ ID NO: 795412 - RNA, 17 nt, Mycobacterium avium subsp. paratuberculosis
gcgcggaaugcucgaca

SEQ ID NO: 795413 - RNA, 19 nt, Mycobacterium avium subsp. paratuberculosis
gcgcggaaugcucgacacg

SEQ ID NO: 795414 - RNA, 16 nt, Mycobacterium avium subsp. paratuberculosis
gcgcggacaccagguu

SEQ ID NO: 795415 - RNA, 16 nt, Mycobacterium avium subsp. paratuberculosis
gcgcggacagcgcggu

SEQ ID NO: 795416 - RNA, 19 nt, Mycobacterium avium subsp. paratuberculosis
gcgcggacagcugcgcggg

SEQ ID NO: 795417 - RNA, 16 nt, Mycobacterium avium subsp. paratuberculosis
gcgcggaaguggaccg

SEQ ID NO: 795418 - RNA, 15 nt, Mycobacterium avium subsp. paratuberculosis
gcgcggaccggcgau

SEQ ID NO: 795419 - RNA, 13 nt, Mycobacterium avium subsp. paratuberculosis
gcgcgcggccacc

SEQ ID NO: 795420 - RNA, 15 nt, Mycobacterium avium subsp. paratuberculosis
gcgcgcggccaccgc

SEQ ID NO: 795421 - RNA, 13 nt, Mycobacterium avium subsp. paratuberculosis
gcgcgcggccagc

SEQ ID NO: 795422 - RNA, 14 nt, Mycobacterium avium subsp. paratuberculosis
gcgcgcggccagcc

SEQ ID NO: 795423 - RNA, 14 nt, Mycobacterium avium subsp. paratuberculosis
gcgcgcgcuggugc

SEQ ID NO: 795424 - RNA, 13 nt, Mycobacterium avium subsp. paratuberculosis
gcgcgcggcgcag

SEQ ID NO: 795425 - RNA, 16 nt, Mycobacterium avium subsp. paratuberculosis
gcgcgcggcgacggug

SEQ ID NO: 795426 - RNA, 18 nt, Mycobacterium avium subsp. paratuberculosis
gcgcgcggcccagcguca

SEQ ID NO: 795427 - RNA, 17 nt, Mycobacterium avium subsp. paratuberculosis
gcgcgcggccuccagcc

SEQ ID NO: 795428 - RNA, 18 nt, Mycobacterium avium subsp. paratuberculosis
gcgcgcggccuccagccg

SEQ ID NO: 795429 - RNA, 17 nt, Mycobacterium avium subsp. paratuberculosis
gcgcgcggugcgccagc

SEQ ID NO: 795430 - RNA, 12 nt, Mycobacterium avium subsp. paratuberculosis
gcgcgcgguggu

SEQ ID NO: 795431 - RNA, 14 nt, Mycobacterium avium subsp. paratuberculosis
gcgcgcggugauga

SEQ ID NO: 795432 - RNA, 17 nt, Mycobacterium avium subsp. paratuberculosis
gcgcgcggugcacgguc

SEQ ID NO: 795433 - RNA, 14 nt, Mycobacterium avium subsp. paratuberculosis
gcgcgcgggguguc

SEQ ID NO: 795434 - RNA, 14 nt, Mycobacterium avium subsp. paratuberculosis
gcgcgcggggccgg

SEQ ID NO: 795435 - RNA, 17 nt, Mycobacterium avium subsp. paratuberculosis
gcgcgcggggccggcgc

SEQ ID NO: 795436 - RNA, 20 nt, Mycobacterium avium subsp. paratuberculosis
gcgcgcggggccggcgcggu

SEQ ID NO: 795437 - RNA, 22 nt, Mycobacterium avium subsp. paratuberculosis
gcgcgcggggccggcgcggugc

SEQ ID NO: 795438 - RNA, 16 nt, Mycobacterium avium subsp. paratuberculosis
gcgcgcgggcgcgcgc

SEQ ID NO: 795439 - RNA, 20 nt, Mycobacterium avium subsp. paratuberculosis
gcgcgcgggcgcgcgccgcc

SEQ ID NO: 795440 - RNA, 12 nt, Mycobacterium avium subsp. paratuberculosis
gcgcgcgggcca

SEQ ID NO: 795441 - RNA, 13 nt, Mycobacterium avium subsp. paratuberculosis
gcgcgcgggccag

SEQ ID NO: 795442 - RNA, 15 nt, Mycobacterium avium subsp. paratuberculosis
gcgcgcggcggccac

SEQ ID NO: 795443 - RNA, 12 nt, Mycobacterium avium subsp. paratuberculosis
gcgcgcggcgug

SEQ ID NO: 795444 - RNA, 13 nt, Mycobacterium avium subsp. paratuberculosis
gcgcgcggcgugg

SEQ ID NO: 795445 - RNA, 14 nt, Mycobacterium avium subsp. paratuberculosis
gcgcgcgcgcucgg

SEQ ID NO: 795446 - RNA, 12 nt, Mycobacterium avium subsp. paratuberculosis
gcgcgcgcgcca

SEQ ID NO: 795447 - RNA, 23 nt, Mycobacterium avium subsp. paratuberculosis
gcgcgcgcaccugaaccgcgcac

SEQ ID NO: 795448 - RNA, 14 nt, Mycobacterium avium subsp. paratuberculosis
gcgcgcgccacgac

SEQ ID NO: 795449 - RNA, 13 nt, Mycobacterium avium subsp. paratuberculosis
gcgcgcgccgauc

SEQ ID NO: 795450 - RNA, 14 nt, Mycobacterium avium subsp. paratuberculosis
gcgcgcgccgggau

SEQ ID NO: 795451 - RNA, 20 nt, Mycobacterium avium subsp. paratuberculosis
gcgcgcgagacaccucgucg

SEQ ID NO: 795452 - RNA, 16 nt, Mycobacterium avium subsp. paratuberculosis
gcgcgcgaucgccggu

SEQ ID NO: 795453 - RNA, 17 nt, Mycobacterium avium subsp. paratuberculosis
gcgcgcgaucagcgccg

SEQ ID NO: 795454 - RNA, 13 nt, Mycobacterium avium subsp. paratuberculosis
gcgcgcgacggcg

SEQ ID NO: 795455 - RNA, 20 nt, Mycobacterium avium subsp. paratuberculosis
gcgcgcgaaggcucgccacg

SEQ ID NO: 795456 - RNA, 14 nt, Mycobacterium avium subsp. paratuberculosis
gcgcgcucaaccgc

SEQ ID NO: 795457 - RNA, 21 nt, Mycobacterium avium subsp. paratuberculosis
gcgcgcucaaccgcccagcgg

SEQ ID NO: 795458 - RNA, 18 nt, Mycobacterium avium subsp. paratuberculosis
gcgcgcguuguccagcag

SEQ ID NO: 795459 - RNA, 19 nt, Mycobacterium avium subsp. paratuberculosis
gcgcgcguuguccagcagc

SEQ ID NO: 795460 - RNA, 23 nt, Mycobacterium avium subsp. paratuberculosis
gcgcgcguuguccagcagcgccg

SEQ ID NO: 795461 - RNA, 13 nt, Mycobacterium avium subsp. paratuberculosis
gcgcgcgucgacg

SEQ ID NO: 795462 - RNA, 14 nt, Mycobacterium avium subsp. paratuberculosis
gcgcgcgucgacgu

SEQ ID NO: 795463 - RNA, 19 nt, Mycobacterium avium subsp. paratuberculosis
gcgcgcguauuccagcgcc

SEQ ID NO: 795464 - RNA, 20 nt, Mycobacterium avium subsp. paratuberculosis
gcgcgcguauuccagcgcca

SEQ ID NO: 795465 - RNA, 23 nt, Mycobacterium avium subsp. paratuberculosis
gcgcgcguauuccagcgccagcg

SEQ ID NO: 795466 - RNA, 16 nt, Mycobacterium avium subsp. paratuberculosis
gcgcgcucggcguugg

SEQ ID NO: 795467 - RNA, 12 nt, Mycobacterium avium subsp. paratuberculosis
gcgcgcucgggg

SEQ ID NO: 795468 - RNA, 15 nt, Mycobacterium avium subsp. paratuberculosis
gcgcgcucgggggug

SEQ ID NO: 795469 - RNA, 16 nt, Mycobacterium avium subsp. paratuberculosis
gcgcgcucggucagca

SEQ ID NO: 795470 - RNA, 18 nt, Mycobacterium avium subsp. paratuberculosis
gcgcgcucggucagcacc

SEQ ID NO: 795471 - RNA, 19 nt, Mycobacterium avium subsp. paratuberculosis
gcgcgcucggucagcaccg

SEQ ID NO: 795472 - RNA, 21 nt, Mycobacterium avium subsp. paratuberculosis
gcgcgcucggucagcaccggg

SEQ ID NO: 795473 - RNA, 23 nt, Mycobacterium avium subsp. paratuberculosis
gcgcgcucgguggacagguagcg

SEQ ID NO: 795474 - RNA, 19 nt, Mycobacterium avium subsp. paratuberculosis
gcgcgcucuaacuccgcuc

SEQ ID NO: 795475 - RNA, 15 nt, Mycobacterium avium subsp. paratuberculosis
gcgcgcugaucgccg

SEQ ID NO: 795476 - RNA, 15 nt, Mycobacterium avium subsp. paratuberculosis
gcgcgcugcagcauc

SEQ ID NO: 795477 - RNA, 15 nt, Mycobacterium avium subsp. paratuberculosis
gcgcgcugcaggccc

SEQ ID NO: 795478 - RNA, 16 nt, Mycobacterium avium subsp. paratuberculosis
gcgcgcuugcgcucgg

SEQ ID NO: 795479 - RNA, 23 nt, Mycobacterium avium subsp. paratuberculosis
gcgcggaacagcgucgccgacgg

SEQ ID NO: 795480 - RNA, 13 nt, Mycobacterium avium subsp. paratuberculosis
gcgcggaacgcgc

SEQ ID NO: 795481 - RNA, 18 nt, Mycobacterium avium subsp. paratuberculosis
gcgcggaacgcgccgggc

SEQ ID NO: 795482 - RNA, 23 nt, Mycobacterium avium subsp. paratuberculosis
gcgcgcuuaauacagcgcguugg

SEQ ID NO: 795483 - RNA, 21 nt, Mycobacterium avium subsp. paratuberculosis
gcgcgcugggcuaacgcuggu

SEQ ID NO: 795484 - RNA, 13 nt, Mycobacterium avium subsp. paratuberculosis
gcgcgcugugcgc

SEQ ID NO: 795485 - RNA, 19 nt, Mycobacterium avium subsp. paratuberculosis
gcgcgcuggugcugccgaa

SEQ ID NO: 795486 - RNA, 21 nt, Mycobacterium avium subsp. paratuberculosis
gcgcgcuggugcugccgaaca

SEQ ID NO: 795487 - RNA, 12 nt, Mycobacterium avium subsp. paratuberculosis
gcgcgcuggccg

SEQ ID NO: 795488 - RNA, 15 nt, Mycobacterium avium subsp. paratuberculosis
gcgcgcuggccgcgu

SEQ ID NO: 795489 - RNA, 13 nt, Mycobacterium avium subsp. paratuberculosis
gcgcgcugccgcg

SEQ ID NO: 795490 - RNA, 14 nt, Mycobacterium avium subsp. paratuberculosis
gcgcgcugccgcgc

SEQ ID NO: 795491 - RNA, 15 nt, Mycobacterium avium subsp. paratuberculosis
gcgcgcugccgcgcc

SEQ ID NO: 795492 - RNA, 17 nt, Mycobacterium avium subsp. paratuberculosis
gcgcgcugcggcgucgu

SEQ ID NO: 795493 - RNA, 13 nt, Mycobacterium avium subsp. paratuberculosis
gcgcgccgcgcug

SEQ ID NO: 795494 - RNA, 13 nt, Mycobacterium avium subsp. paratuberculosis
gcgcgccggcgca

SEQ ID NO: 795495 - RNA, 14 nt, Mycobacterium avium subsp. paratuberculosis
gcgcgccggcgcag

SEQ ID NO: 795496 - RNA, 18 nt, Mycobacterium avium subsp. paratuberculosis
gcgcgccggcgcagcggc

SEQ ID NO: 795497 - RNA, 11 nt, Mycobacterium avium subsp. paratuberculosis
gcgcgccggcg

SEQ ID NO: 795498 - RNA, 13 nt, Mycobacterium avium subsp. paratuberculosis
gcgcgccggcggc

SEQ ID NO: 795499 - RNA, 14 nt, Mycobacterium avium subsp. paratuberculosis
gcgcgccggcggcc

SEQ ID NO: 795500 - RNA, 15 nt, Mycobacterium avium subsp. paratuberculosis
gcgcgccggcggccg

SEQ ID NO: 795501 - RNA, 17 nt, Mycobacterium avium subsp. paratuberculosis
gcgcgccggcgcgcagc

SEQ ID NO: 795502 - RNA, 19 nt, Mycobacterium avium subsp. paratuberculosis
gcgcgccggcgcgcagcca

SEQ ID NO: 795503 - RNA, 12 nt, Mycobacterium avium subsp. paratuberculosis
gcgcgccggcgg

SEQ ID NO: 795504 - RNA, 12 nt, Mycobacterium avium subsp. paratuberculosis
gcgcgccggcgu

SEQ ID NO: 795505 - RNA, 18 nt, Mycobacterium avium subsp. paratuberculosis
gcgcgccggccggagcgg

SEQ ID NO: 795506 - RNA, 14 nt, Mycobacterium avium subsp. paratuberculosis
gcgcgccggccggc

SEQ ID NO: 795507 - RNA, 16 nt, Mycobacterium avium subsp. paratuberculosis
gcgcgccggccggcac

SEQ ID NO: 795508 - RNA, 14 nt, Mycobacterium avium subsp. paratuberculosis
gcgcgccggcccga

SEQ ID NO: 795509 - RNA, 15 nt, Mycobacterium avium subsp. paratuberculosis
gcgcgccggccagca

SEQ ID NO: 795510 - RNA, 17 nt, Mycobacterium avium subsp. paratuberculosis
gcgcgccggccagcacg

SEQ ID NO: 795511 - RNA, 19 nt, Mycobacterium avium subsp. paratuberculosis
gcgcgccggccagcacggc

SEQ ID NO: 795512 - RNA, 20 nt, Mycobacterium avium subsp. paratuberculosis
gcgcgccggccagcacggcg

SEQ ID NO: 795513 - RNA, 16 nt, Mycobacterium avium subsp. paratuberculosis
gcgcgccgcguucggc

SEQ ID NO: 795514 - RNA, 17 nt, Mycobacterium avium subsp. paratuberculosis
gcgcgccgcguucggcg

SEQ ID NO: 795515 - RNA, 20 nt, Mycobacterium avium subsp. paratuberculosis
gcgcgccgcguucggcggcg

SEQ ID NO: 795516 - RNA, 14 nt, Mycobacterium avium subsp. paratuberculosis
gcgcgccugcgcgg

SEQ ID NO: 795517 - RNA, 15 nt, Mycobacterium avium subsp. paratuberculosis
gcgcgccugcgcggc

SEQ ID NO: 795518 - RNA, 20 nt, Mycobacterium avium subsp. paratuberculosis
gcgcgccugcgcggcggcgu

SEQ ID NO: 795519 - RNA, 18 nt, Mycobacterium avium subsp. paratuberculosis
gcgcgccuccgacgacga

SEQ ID NO: 795520 - RNA, 11 nt, Mycobacterium avium subsp. paratuberculosis
gcgcgccgucg

SEQ ID NO: 795521 - RNA, 11 nt, Mycobacterium avium subsp. paratuberculosis
gcgcgccgucu

SEQ ID NO: 795522 - RNA, 15 nt, Mycobacterium avium subsp. paratuberculosis
gcgcgccgugacgcc

SEQ ID NO: 795523 - RNA, 11 nt, Mycobacterium avium subsp. paratuberculosis
gcgcgccaacu

SEQ ID NO: 795524 - RNA, 16 nt, Mycobacterium avium subsp. paratuberculosis
gcgcgcaucugcucgg

SEQ ID NO: 795525 - RNA, 17 nt, Mycobacterium avium subsp. paratuberculosis
gcgcgcaucugcucggc

SEQ ID NO: 795526 - RNA, 20 nt, Mycobacterium avium subsp. paratuberculosis
gcgcgcaucugcucggcguc

SEQ ID NO: 795527 - RNA, 23 nt, Mycobacterium avium subsp. paratuberculosis
gcgcgcaucugcucggcguccag

SEQ ID NO: 795528 - RNA, 16 nt, Mycobacterium avium subsp. paratuberculosis
gcgcgcaucgcgggcc

SEQ ID NO: 795529 - RNA, 19 nt, Mycobacterium avium subsp. paratuberculosis
gcgcgcauagaggcguuga

SEQ ID NO: 795530 - RNA, 19 nt, Mycobacterium avium subsp. paratuberculosis
gcgcgcaucaccgagguca

SEQ ID NO: 795531 - RNA, 15 nt, Mycobacterium avium subsp. paratuberculosis
gcgcgcagguagccg

SEQ ID NO: 795532 - RNA, 21 nt, Mycobacterium avium subsp. paratuberculosis
gcgcgcagguagccgccguag

SEQ ID NO: 795533 - RNA, 12 nt, Mycobacterium avium subsp. paratuberculosis
gcgcgcccgucg

SEQ ID NO: 795534 - RNA, 14 nt, Mycobacterium avium subsp. paratuberculosis
gcgcgcccuagucg

SEQ ID NO: 795535 - RNA, 18 nt, Mycobacterium avium subsp. paratuberculosis
gcgcgcccuagucgacgc

SEQ ID NO: 795536 - RNA, 19 nt, Mycobacterium avium subsp. paratuberculosis
gcgcgcccuagucgacgcc

SEQ ID NO: 795537 - RNA, 22 nt, Mycobacterium avium subsp. paratuberculosis
gcgcgcccucgauaauggcggc

SEQ ID NO: 795538 - RNA, 20 nt, Mycobacterium avium subsp. paratuberculosis
gcgcgcccgagucacccggc

SEQ ID NO: 795539 - RNA, 16 nt, Mycobacterium avium subsp. paratuberculosis
gcgcgcccgcggccau

SEQ ID NO: 795540 - RNA, 18 nt, Mycobacterium avium subsp. paratuberculosis
gcgcgcccgcggccaucg

SEQ ID NO: 795541 - RNA, 19 nt, Mycobacterium avium subsp. paratuberculosis
gcgcgcccgcggccaucgc

SEQ ID NO: 795542 - RNA, 13 nt, Mycobacterium avium subsp. paratuberculosis
gcgcgcccgagca

SEQ ID NO: 795543 - RNA, 14 nt, Mycobacterium avium subsp. paratuberculosis
gcgcgcccgagcau

SEQ ID NO: 795544 - RNA, 23 nt, Mycobacterium avium subsp. paratuberculosis
gcgcgcccugaggcccggugagc

SEQ ID NO: 795545 - RNA, 21 nt, Mycobacterium avium subsp. paratuberculosis
gcgcgccgaacaccugcggcg

SEQ ID NO: 795546 - RNA, 13 nt, Mycobacterium avium subsp. paratuberculosis
gcgcgccgaccac

SEQ ID NO: 795547 - RNA, 22 nt, Mycobacterium avium subsp. paratuberculosis
gcgcgccgagagcgcgucgacg

SEQ ID NO: 795548 - RNA, 17 nt, Mycobacterium avium subsp. paratuberculosis
gcgcgccgagcgcuggu

SEQ ID NO: 795549 - RNA, 19 nt, Mycobacterium avium subsp. paratuberculosis
gcgcgccgagguggcccgc

SEQ ID NO: 795550 - RNA, 14 nt, Mycobacterium avium subsp. paratuberculosis
gcgcgccgaccacg

SEQ ID NO: 795551 - RNA, 14 nt, Mycobacterium avium subsp. paratuberculosis
gcgcgcccugcugg

SEQ ID NO: 795552 - RNA, 20 nt, Mycobacterium avium subsp. paratuberculosis
gcgcgccgaccgcgagcacg

SEQ ID NO: 795553 - RNA, 14 nt, Mycobacterium avium subsp. paratuberculosis
gcgcgccgagcagc

SEQ ID NO: 795554 - RNA, 13 nt, Mycobacterium avium subsp. paratuberculosis
gcgcgccgcgacg

SEQ ID NO: 795555 - RNA, 16 nt, Mycobacterium avium subsp. paratuberculosis
gcgcgccgccgccgcc

SEQ ID NO: 795556 - RNA, 17 nt, Mycobacterium avium subsp. paratuberculosis
gcgcgccgccgccgccc

SEQ ID NO: 795557 - RNA, 16 nt, Mycobacterium avium subsp. paratuberculosis
gcgcgccgcccagcgg

SEQ ID NO: 795558 - RNA, 17 nt, Mycobacterium avium subsp. paratuberculosis
gcgcgccgcccagcggu

SEQ ID NO: 795559 - RNA, 15 nt, Mycobacterium avium subsp. paratuberculosis
gcgcgccgcccccgc

SEQ ID NO: 795560 - RNA, 19 nt, Mycobacterium avium subsp. paratuberculosis
gcgcgccgcccucgccgaa

SEQ ID NO: 795561 - RNA, 13 nt, Mycobacterium avium subsp. paratuberculosis
gcgcgccgcccag

SEQ ID NO: 795562 - RNA, 23 nt, Mycobacterium avium subsp. paratuberculosis
gcgcgccgcagcgcgcgcucggu

SEQ ID NO: 795563 - RNA, 16 nt, Mycobacterium avium subsp. paratuberculosis
gcgcgccgcaaccguc

SEQ ID NO: 795564 - RNA, 22 nt, Mycobacterium avium subsp. paratuberculosis
gcgcgccgcacagccggcggcg

SEQ ID NO: 795565 - RNA, 12 nt, Mycobacterium avium subsp. paratuberculosis
gcgcgccgcacc

SEQ ID NO: 795566 - RNA, 15 nt, Mycobacterium avium subsp. paratuberculosis
gcgcgccgauccggc

SEQ ID NO: 795567 - RNA, 18 nt, Mycobacterium avium subsp. paratuberculosis
gcgcgccgaugccgcgcu

SEQ ID NO: 795568 - RNA, 20 nt, Mycobacterium avium subsp. paratuberculosis
gcgcgccgaugccgcgcugc

SEQ ID NO: 795569 - RNA, 14 nt, Mycobacterium avium subsp. paratuberculosis
gcgcgccgaugugg

SEQ ID NO: 795570 - RNA, 21 nt, Mycobacterium avium subsp. paratuberculosis
gcgcgcacaauucggucagcg

SEQ ID NO: 795571 - RNA, 22 nt, Mycobacterium avium subsp. paratuberculosis
gcgcgcacaauucggucagcgc

SEQ ID NO: 795572 - RNA, 15 nt, Mycobacterium avium subsp. paratuberculosis
gcgcgcacgcggaca

SEQ ID NO: 795573 - RNA, 17 nt, Mycobacterium avium subsp. paratuberculosis
gcgcgcacggcagcccg

SEQ ID NO: 795574 - RNA, 18 nt, Mycobacterium avium subsp. paratuberculosis
gcgcgcacggcagcccga

SEQ ID NO: 795575 - RNA, 14 nt, Mycobacterium avium subsp. paratuberculosis
gcgcgcaccccggc

SEQ ID NO: 795576 - RNA, 15 nt, Mycobacterium avium subsp. paratuberculosis
gcgcgcaccccggca

SEQ ID NO: 795577 - RNA, 13 nt, Mycobacterium avium subsp. paratuberculosis
gcgcgcaccgcga

SEQ ID NO: 795578 - RNA, 14 nt, Mycobacterium avium subsp. paratuberculosis
gcgcgcaccgcgaa

SEQ ID NO: 795579 - RNA, 19 nt, Mycobacterium avium subsp. paratuberculosis
gcgcgcaccgcgggcagca

SEQ ID NO: 795580 - RNA, 17 nt, Mycobacterium avium subsp. paratuberculosis
gcgcgcaggcgcaccac

SEQ ID NO: 795581 - RNA, 21 nt, Mycobacterium avium subsp. paratuberculosis
gcgcgcaggcgcaccaccagc

SEQ ID NO: 795582 - RNA, 13 nt, Mycobacterium avium subsp. paratuberculosis
gcgcgcaggcgcg

SEQ ID NO: 795583 - RNA, 18 nt, Mycobacterium avium subsp. paratuberculosis
gcgcgcaggcgcgcggcc

SEQ ID NO: 795584 - RNA, 19 nt, Mycobacterium avium subsp. paratuberculosis
gcgcgcaggcgcgcggcca

SEQ ID NO: 795585 - RNA, 20 nt, Mycobacterium avium subsp. paratuberculosis
gcgcgcacguuggcggccag

SEQ ID NO: 795586 - RNA, 17 nt, Mycobacterium avium subsp. paratuberculosis
gcgcgcacgucaccgcg

SEQ ID NO: 795587 - RNA, 21 nt, Mycobacterium avium subsp. paratuberculosis
gcgcgcaccgguuugucggcg

SEQ ID NO: 795588 - RNA, 16 nt, Mycobacterium avium subsp. paratuberculosis
gcgcgcacagcgccac

SEQ ID NO: 795589 - RNA, 23 nt, Mycobacterium avium subsp. paratuberculosis
gcgcgcacagcgccacaccgaag

SEQ ID NO: 795590 - RNA, 16 nt, Mycobacterium avium subsp. paratuberculosis
gcgcgcaccacgugcg

SEQ ID NO: 795591 - RNA, 20 nt, Mycobacterium avium subsp. paratuberculosis
gcgcgcaccacgugcgcgaa

SEQ ID NO: 795592 - RNA, 12 nt, Mycobacterium avium subsp. paratuberculosis
gcgcgcaccagc

SEQ ID NO: 795593 - RNA, 17 nt, Mycobacterium avium subsp. paratuberculosis
gcgcgcaccagcucggc

SEQ ID NO: 795594 - RNA, 18 nt, Mycobacterium avium subsp. paratuberculosis
gcgcgcaccagcucggcg

SEQ ID NO: 795595 - RNA, 13 nt, Mycobacterium avium subsp. paratuberculosis
gcgcgcaccaggc

SEQ ID NO: 795596 - RNA, 14 nt, Mycobacterium avium subsp. paratuberculosis
gcgcgagcgucacg

SEQ ID NO: 795597 - RNA, 16 nt, Mycobacterium avium subsp. paratuberculosis
gcgcgagcgucacgcu

SEQ ID NO: 795598 - RNA, 22 nt, Mycobacterium avium subsp. paratuberculosis
gcgcgcaacgcuuucgggucga

SEQ ID NO: 795599 - RNA, 12 nt, Mycobacterium avium subsp. paratuberculosis
gcgcgagcgcgc

SEQ ID NO: 795600 - RNA, 13 nt, Mycobacterium avium subsp. paratuberculosis
gcgcgagcgcgcu

SEQ ID NO: 795601 - RNA, 18 nt, Mycobacterium avium subsp. paratuberculosis
gcgcgagcgcagcgccag

SEQ ID NO: 795602 - RNA, 17 nt, Mycobacterium avium subsp. paratuberculosis
gcgcgagcagaucgcgg

SEQ ID NO: 795603 - RNA, 17 nt, Mycobacterium avium subsp. paratuberculosis
gcgcgagcaucaccguc

SEQ ID NO: 795604 - RNA, 18 nt, Mycobacterium avium subsp. paratuberculosis
gcgcgagaguaucgccac

SEQ ID NO: 795605 - RNA, 22 nt, Mycobacterium avium subsp. paratuberculosis
gcgcgagaguaucgccacgccg

SEQ ID NO: 795606 - RNA, 15 nt, Mycobacterium avium subsp. paratuberculosis
gcgcgagauggcgau

SEQ ID NO: 795607 - RNA, 17 nt, Mycobacterium avium subsp. paratuberculosis
gcgcgagauggcgauca

SEQ ID NO: 795608 - RNA, 13 nt, Mycobacterium avium subsp. paratuberculosis
gcgcgacugggcg

SEQ ID NO: 795609 - RNA, 17 nt, Mycobacterium avium subsp. paratuberculosis
gcgcgacugggcgccca

SEQ ID NO: 795610 - RNA, 16 nt, Mycobacterium avium subsp. paratuberculosis
gcgcgacgucgaccgc

SEQ ID NO: 795611 - RNA, 14 nt, Mycobacterium avium subsp. paratuberculosis
gcgcgacggcggcg

SEQ ID NO: 795612 - RNA, 15 nt, Mycobacterium avium subsp. paratuberculosis
gcgcgacggcggcga

SEQ ID NO: 795613 - RNA, 16 nt, Mycobacterium avium subsp. paratuberculosis
gcgcgacgggcacccg

SEQ ID NO: 795614 - RNA, 20 nt, Mycobacterium avium subsp. paratuberculosis
gcgcgacgggcugcugcacg

SEQ ID NO: 795615 - RNA, 22 nt, Mycobacterium avium subsp. paratuberculosis
gcgcgacgggcugcugcacguc

SEQ ID NO: 795616 - RNA, 16 nt, Mycobacterium avium subsp. paratuberculosis
gcgcgacggucacgcu

SEQ ID NO: 795617 - RNA, 22 nt, Mycobacterium avium subsp. paratuberculosis
gcgcgacgguguaggacgccgu

SEQ ID NO: 795618 - RNA, 14 nt, Mycobacterium avium subsp. paratuberculosis
gcgcgacggcgcgu

SEQ ID NO: 795619 - RNA, 18 nt, Mycobacterium avium subsp. paratuberculosis
gcgcgacggcgcgugauc

SEQ ID NO: 795620 - RNA, 18 nt, Mycobacterium avium subsp. paratuberculosis
gcgcgacggccucgccgu

SEQ ID NO: 795621 - RNA, 12 nt, Mycobacterium avium subsp. paratuberculosis
gcgcgacgccgu

SEQ ID NO: 795622 - RNA, 13 nt, Mycobacterium avium subsp. paratuberculosis
gcgcgacgccguc

SEQ ID NO: 795623 - RNA, 15 nt, Mycobacterium avium subsp. paratuberculosis
gcgcgacgccgacgc

SEQ ID NO: 795624 - RNA, 16 nt, Mycobacterium avium subsp. paratuberculosis
gcgcgacgccgacgcc

SEQ ID NO: 795625 - RNA, 19 nt, Mycobacterium avium subsp. paratuberculosis
gcgcgacgccgacgcccag

SEQ ID NO: 795626 - RNA, 21 nt, Mycobacterium avium subsp. paratuberculosis
gcgcgacgccgacgcccagcg

SEQ ID NO: 795627 - RNA, 16 nt, Mycobacterium avium subsp. paratuberculosis
gcgcgacgcacgccgg

SEQ ID NO: 795628 - RNA, 17 nt, Mycobacterium avium subsp. paratuberculosis
gcgcgacgcacgccggc

SEQ ID NO: 795629 - RNA, 15 nt, Mycobacterium avium subsp. paratuberculosis
gcgcgacgaacagca

SEQ ID NO: 795630 - RNA, 13 nt, Mycobacterium avium subsp. paratuberculosis
gcgcgacgaaucc

SEQ ID NO: 795631 - RNA, 17 nt, Mycobacterium avium subsp. paratuberculosis
gcgcgacgaauccggug

SEQ ID NO: 795632 - RNA, 15 nt, Mycobacterium avium subsp. paratuberculosis
gcgcgaccucggugg

SEQ ID NO: 795633 - RNA, 17 nt, Mycobacterium avium subsp. paratuberculosis
gcgcgaccucgguggug

SEQ ID NO: 795634 - RNA, 19 nt, Mycobacterium avium subsp. paratuberculosis
gcgcgaccucuucgcugga

SEQ ID NO: 795635 - RNA, 19 nt, Mycobacterium avium subsp. paratuberculosis
gcgcgaccaucagcccggu

SEQ ID NO: 795636 - RNA, 20 nt, Mycobacterium avium subsp. paratuberculosis
gcgcgaccccuacgggcgca

SEQ ID NO: 795637 - RNA, 14 nt, Mycobacterium avium subsp. paratuberculosis
gcgcgacccgcucg

SEQ ID NO: 795638 - RNA, 15 nt, Mycobacterium avium subsp. paratuberculosis
gcgcgacccgcucga

SEQ ID NO: 795639 - RNA, 16 nt, Mycobacterium avium subsp. paratuberculosis
gcgcgacccgcucgac

SEQ ID NO: 795640 - RNA, 19 nt, Mycobacterium avium subsp. paratuberculosis
gcgcgacccgcucgacgcg

SEQ ID NO: 795641 - RNA, 12 nt, Mycobacterium avium subsp. paratuberculosis
gcgcgaccacau

SEQ ID NO: 795642 - RNA, 16 nt, Mycobacterium avium subsp. paratuberculosis
gcgcgaccagcccggc

SEQ ID NO: 795643 - RNA, 17 nt, Mycobacterium avium subsp. paratuberculosis
gcgcgaccagcccggcc

SEQ ID NO: 795644 - RNA, 23 nt, Mycobacterium avium subsp. paratuberculosis
gcgcgaccagcccggccgccgag

SEQ ID NO: 795645 - RNA, 12 nt, Mycobacterium avium subsp. paratuberculosis
gcgcgaccagcg

SEQ ID NO: 795646 - RNA, 17 nt, Mycobacterium avium subsp. paratuberculosis
gcgcgaccagcggcagc

SEQ ID NO: 795647 - RNA, 21 nt, Mycobacterium avium subsp. paratuberculosis
gcgcgaccagcggcagcagca

SEQ ID NO: 795648 - RNA, 19 nt, Mycobacterium avium subsp. paratuberculosis
gcgcgaccaguaccgggcc

SEQ ID NO: 795649 - RNA, 18 nt, Mycobacterium avium subsp. paratuberculosis
gcgcgaccagugcaccuc

SEQ ID NO: 795650 - RNA, 23 nt, Mycobacterium avium subsp. paratuberculosis
gcgcgaccagugcaccucgacga

SEQ ID NO: 795651 - RNA, 16 nt, Mycobacterium avium subsp. paratuberculosis
gcgccuugggccaucc

SEQ ID NO: 795652 - RNA, 16 nt, Mycobacterium avium subsp. paratuberculosis
gcgccuuggccucggu

SEQ ID NO: 795653 - RNA, 20 nt, Mycobacterium avium subsp. paratuberculosis
gcgccuuggccucgguggcg

SEQ ID NO: 795654 - RNA, 21 nt, Mycobacterium avium subsp. paratuberculosis
gcgccuugguccgcaacgcgg

SEQ ID NO: 795655 - RNA, 15 nt, Mycobacterium avium subsp. paratuberculosis
gcgccuugccgucga

SEQ ID NO: 795656 - RNA, 14 nt, Mycobacterium avium subsp. paratuberculosis
gcgccuugaccgcg

SEQ ID NO: 795657 - RNA, 15 nt, Mycobacterium avium subsp. paratuberculosis
gcgccuugaccgcgu

SEQ ID NO: 795658 - RNA, 13 nt, Mycobacterium avium subsp. paratuberculosis
gcgccuucggcgc

SEQ ID NO: 795659 - RNA, 14 nt, Mycobacterium avium subsp. paratuberculosis
gcgccuucggcgcc

SEQ ID NO: 795660 - RNA, 15 nt, Mycobacterium avium subsp. paratuberculosis
gcgccuucuuggcgg

SEQ ID NO: 795661 - RNA, 19 nt, Mycobacterium avium subsp. paratuberculosis
gcgccuucuuggcggcggu

SEQ ID NO: 795662 - RNA, 21 nt, Mycobacterium avium subsp. paratuberculosis
gcgccuucuccagcuccucgg

SEQ ID NO: 795663 - RNA, 14 nt, Mycobacterium avium subsp. paratuberculosis
gcgccuucgacccg

SEQ ID NO: 795664 - RNA, 16 nt, Mycobacterium avium subsp. paratuberculosis
gcgccuucgacccggu

SEQ ID NO: 795665 - RNA, 19 nt, Mycobacterium avium subsp. paratuberculosis
gcgccuucgacccgguggc

SEQ ID NO: 795666 - RNA, 15 nt, Mycobacterium avium subsp. paratuberculosis
gcgccggacucgaag

SEQ ID NO: 795667 - RNA, 14 nt, Mycobacterium avium subsp. paratuberculosis
gcgccggacggccc

SEQ ID NO: 795668 - RNA, 17 nt, Mycobacterium avium subsp. paratuberculosis
gcgccggacggcccgca

SEQ ID NO: 795669 - RNA, 19 nt, Mycobacterium avium subsp. paratuberculosis
gcgccggaccgauccggcg

SEQ ID NO: 795670 - RNA, 21 nt, Mycobacterium avium subsp. paratuberculosis
gcgccggaccgauccggcgcc

SEQ ID NO: 795671 - RNA, 17 nt, Mycobacterium avium subsp. paratuberculosis
gcgccgcuucgucgccg

SEQ ID NO: 795672 - RNA, 19 nt, Mycobacterium avium subsp. paratuberculosis
gcgccgcuucgucgccggc

SEQ ID NO: 795673 - RNA, 22 nt, Mycobacterium avium subsp. paratuberculosis
gcgccgcuucgucgccggccgc

SEQ ID NO: 795674 - RNA, 15 nt, Mycobacterium avium subsp. paratuberculosis
gcgccggaggccagc

SEQ ID NO: 795675 - RNA, 16 nt, Mycobacterium avium subsp. paratuberculosis
gcgccggaggccagcu

SEQ ID NO: 795676 - RNA, 17 nt, Mycobacterium avium subsp. paratuberculosis
gcgccggaggccagcuc

SEQ ID NO: 795677 - RNA, 18 nt, Mycobacterium avium subsp. paratuberculosis
gcgccggaggccagcucg

SEQ ID NO: 795678 - RNA, 22 nt, Mycobacterium avium subsp. paratuberculosis
gcgccggaggccagcucgaccg

SEQ ID NO: 795679 - RNA, 23 nt, Mycobacterium avium subsp. paratuberculosis
gcgccggaggccagcucgaccgc

SEQ ID NO: 795680 - RNA, 15 nt, Mycobacterium avium subsp. paratuberculosis
gcgccguggcccggu

SEQ ID NO: 795681 - RNA, 20 nt, Mycobacterium avium subsp. paratuberculosis
gcgccguggcccggucggag

SEQ ID NO: 795682 - RNA, 21 nt, Mycobacterium avium subsp. paratuberculosis
gcgccguggcccggucggagu

SEQ ID NO: 795683 - RNA, 15 nt, Mycobacterium avium subsp. paratuberculosis
gcgccguuggugguc

SEQ ID NO: 795684 - RNA, 23 nt, Mycobacterium avium subsp. paratuberculosis
gcgccguugguggucugccagaa

SEQ ID NO: 795685 - RNA, 18 nt, Mycobacterium avium subsp. paratuberculosis
gcgccguuguaggccgcg

SEQ ID NO: 795686 - RNA, 22 nt, Mycobacterium avium subsp. paratuberculosis
gcgccguuguaggccgcgcggu

SEQ ID NO: 795687 - RNA, 23 nt, Mycobacterium avium subsp. paratuberculosis
gcgccguuucggacgagccgucg

SEQ ID NO: 795688 - RNA, 21 nt, Mycobacterium avium subsp. paratuberculosis
gcgccuaauucguuguuggcg

SEQ ID NO: 795689 - RNA, 23 nt, Mycobacterium avium subsp. paratuberculosis
gcgccuaauucguuguuggcggu

SEQ ID NO: 795690 - RNA, 19 nt, Mycobacterium avium subsp. paratuberculosis
gcgccguugaccgcggcga

SEQ ID NO: 795691 - RNA, 20 nt, Mycobacterium avium subsp. paratuberculosis
gcgccguugaccgcggcgau

SEQ ID NO: 795692 - RNA, 22 nt, Mycobacterium avium subsp. paratuberculosis
gcgccguugaccgcggcgaugg

SEQ ID NO: 795693 - RNA, 17 nt, Mycobacterium avium subsp. paratuberculosis
gcgccguugaccggccg

SEQ ID NO: 795694 - RNA, 20 nt, Mycobacterium avium subsp. paratuberculosis
gcgccucagcagcugcuggc

SEQ ID NO: 795695 - RNA, 14 nt, Mycobacterium avium subsp. paratuberculosis
gcgccuaccgggug

SEQ ID NO: 795696 - RNA, 16 nt, Mycobacterium avium subsp. paratuberculosis
gcgccuaccggguggc

SEQ ID NO: 795697 - RNA, 23 nt, Mycobacterium avium subsp. paratuberculosis
gcgccuaccggguggccagcacc

SEQ ID NO: 795698 - RNA, 22 nt, Mycobacterium avium subsp. paratuberculosis
gcgccgugggcgucacgcauca

SEQ ID NO: 795699 - RNA, 20 nt, Mycobacterium avium subsp. paratuberculosis
gcgccugggcguacagcggc

SEQ ID NO: 795700 - RNA, 24 nt, Mycobacterium avium subsp. paratuberculosis
gcgccugggcguacagcggcgcca

SEQ ID NO: 795701 - RNA, 23 nt, Mycobacterium avium subsp. paratuberculosis
gcgccucgugcaugugcucggcg

SEQ ID NO: 795702 - RNA, 16 nt, Mycobacterium avium subsp. paratuberculosis
gcgccucgucgagccg

SEQ ID NO: 795703 - RNA, 20 nt, Mycobacterium avium subsp. paratuberculosis
gcgccucgucgagccgggcc

SEQ ID NO: 795704 - RNA, 13 nt, Mycobacterium avium subsp. paratuberculosis
gcgccucggcggc

SEQ ID NO: 795705 - RNA, 12 nt, Mycobacterium avium subsp. paratuberculosis
gcgccucggcgu

SEQ ID NO: 795706 - RNA, 13 nt, Mycobacterium avium subsp. paratuberculosis
gcgccucggcguc

SEQ ID NO: 795707 - RNA, 14 nt, Mycobacterium avium subsp. paratuberculosis
gcgccucggcguca

SEQ ID NO: 795708 - RNA, 20 nt, Mycobacterium avium subsp. paratuberculosis
gcgccucggcgucccggcgu

SEQ ID NO: 795709 - RNA, 20 nt, Mycobacterium avium subsp. paratuberculosis
gcgccucggcguggcaggcg

SEQ ID NO: 795710 - RNA, 19 nt, Mycobacterium avium subsp. paratuberculosis
gcgccucggccucgucgac

SEQ ID NO: 795711 - RNA, 21 nt, Mycobacterium avium subsp. paratuberculosis
gcgccucggccucgucgacgu

SEQ ID NO: 795712 - RNA, 13 nt, Mycobacterium avium subsp. paratuberculosis
gcgccucggcgau

SEQ ID NO: 795713 - RNA, 15 nt, Mycobacterium avium subsp. paratuberculosis
gcgccucggcgaucg

SEQ ID NO: 795714 - RNA, 18 nt, Mycobacterium avium subsp. paratuberculosis
gcgccucggcgaucggcc

SEQ ID NO: 795715 - RNA, 12 nt, Mycobacterium avium subsp. paratuberculosis
gcgccucggcgc

SEQ ID NO: 795716 - RNA, 13 nt, Mycobacterium avium subsp. paratuberculosis
gcgccucggcgcc

SEQ ID NO: 795717 - RNA, 18 nt, Mycobacterium avium subsp. paratuberculosis
gcgccugguccucccggg

SEQ ID NO: 795718 - RNA, 13 nt, Mycobacterium avium subsp. paratuberculosis
gcgccucgcgguc

SEQ ID NO: 795719 - RNA, 19 nt, Mycobacterium avium subsp. paratuberculosis
gcgccucgcggucgacgga

SEQ ID NO: 795720 - RNA, 13 nt, Mycobacterium avium subsp. paratuberculosis
gcgccucgccgac

SEQ ID NO: 795721 - RNA, 15 nt, Mycobacterium avium subsp. paratuberculosis
gcgccucgagcacca

SEQ ID NO: 795722 - RNA, 16 nt, Mycobacterium avium subsp. paratuberculosis
gcgccucgagcaccac

SEQ ID NO: 795723 - RNA, 17 nt, Mycobacterium avium subsp. paratuberculosis
gcgccucgagcaccacg

SEQ ID NO: 795724 - RNA, 23 nt, Mycobacterium avium subsp. paratuberculosis
gcgccucgagcaccacggcccgc

SEQ ID NO: 795725 - RNA, 16 nt, Mycobacterium avium subsp. paratuberculosis
gcgccucgaacaucgg

SEQ ID NO: 795726 - RNA, 18 nt, Mycobacterium avium subsp. paratuberculosis
gcgccucgaucaacgccg

SEQ ID NO: 795727 - RNA, 14 nt, Mycobacterium avium subsp. paratuberculosis
gcgccucccggacc

SEQ ID NO: 795728 - RNA, 18 nt, Mycobacterium avium subsp. paratuberculosis
gcgccucccggaccacca

SEQ ID NO: 795729 - RNA, 22 nt, Mycobacterium avium subsp. paratuberculosis
gcgccucccggaccaccaggaa

SEQ ID NO: 795730 - RNA, 14 nt, Mycobacterium avium subsp. paratuberculosis
gcgccuccgacgac

SEQ ID NO: 795731 - RNA, 15 nt, Mycobacterium avium subsp. paratuberculosis
gcgccuccgacgacg

SEQ ID NO: 795732 - RNA, 18 nt, Mycobacterium avium subsp. paratuberculosis
gcgccuccgacgacgauu

SEQ ID NO: 795733 - RNA, 19 nt, Mycobacterium avium subsp. paratuberculosis
gcgccuccgacgacgauug

SEQ ID NO: 795734 - RNA, 12 nt, Mycobacterium avium subsp. paratuberculosis
gcgccuccgccc

SEQ ID NO: 795735 - RNA, 22 nt, Mycobacterium avium subsp. paratuberculosis
gcgccuccauucgggccagcgc

SEQ ID NO: 795736 - RNA, 17 nt, Mycobacterium avium subsp. paratuberculosis
gcgcagaagcuaacgcc

SEQ ID NO: 795737 - RNA, 19 nt, Mycobacterium avium subsp. paratuberculosis
gcgcagaagcuaacgccag

SEQ ID NO: 795738 - RNA, 20 nt, Mycobacterium avium subsp. paratuberculosis
gcgcagaagcuaacgccagc

SEQ ID NO: 795739 - RNA, 21 nt, Mycobacterium avium subsp. paratuberculosis
gcgcagaacaccaccgccagg

SEQ ID NO: 795740 - RNA, 16 nt, Mycobacterium avium subsp. paratuberculosis
gcgcacuucgcgggcg

SEQ ID NO: 795741 - RNA, 21 nt, Mycobacterium avium subsp. paratuberculosis
gcgcacuucgcgggcggcgca

SEQ ID NO: 795742 - RNA, 15 nt, Mycobacterium avium subsp. paratuberculosis
gcgcagaaaaaggcc

SEQ ID NO: 795743 - RNA, 21 nt, Mycobacterium avium subsp. paratuberculosis
gcgcagauagccguacacggc

SEQ ID NO: 795744 - RNA, 20 nt, Mycobacterium avium subsp. paratuberculosis
gcgcagaucgcgcaucaccc

SEQ ID NO: 795745 - RNA, 14 nt, Mycobacterium avium subsp. paratuberculosis
gcgcagaucgucga

SEQ ID NO: 795746 - RNA, 15 nt, Mycobacterium avium subsp. paratuberculosis
gcgcagaugaccggc

SEQ ID NO: 795747 - RNA, 17 nt, Mycobacterium avium subsp. paratuberculosis
gcgcagaugaccggccu

SEQ ID NO: 795748 - RNA, 18 nt, Mycobacterium avium subsp. paratuberculosis
gcgcagaugaccggccug

SEQ ID NO: 795749 - RNA, 19 nt, Mycobacterium avium subsp. paratuberculosis
gcgcagaucgagaucaggg

SEQ ID NO: 795750 - RNA, 22 nt, Mycobacterium avium subsp. paratuberculosis
gcgcagaucgagaucagggcgc

SEQ ID NO: 795751 - RNA, 16 nt, Mycobacterium avium subsp. paratuberculosis
gcgcagaucgccagca

SEQ ID NO: 795752 - RNA, 21 nt, Mycobacterium avium subsp. paratuberculosis
gcgcagaucgccagcaccggc

SEQ ID NO: 795753 - RNA, 22 nt, Mycobacterium avium subsp. paratuberculosis
gcgcagaucgccagcaccggcg

SEQ ID NO: 795754 - RNA, 23 nt, Mycobacterium avium subsp. paratuberculosis
gcgcagaucgccagcaccggcgc

SEQ ID NO: 795755 - RNA, 18 nt, Mycobacterium avium subsp. paratuberculosis
gcgcacucgaacggcccg

SEQ ID NO: 795756 - RNA, 16 nt, Mycobacterium avium subsp. paratuberculosis
gcgcacgucgaggucg

SEQ ID NO: 795757 - RNA, 21 nt, Mycobacterium avium subsp. paratuberculosis
gcgcacgucgaggucggacgc

SEQ ID NO: 795758 - RNA, 15 nt, Mycobacterium avium subsp. paratuberculosis
gcgcacgucgccgcc

SEQ ID NO: 795759 - RNA, 16 nt, Mycobacterium avium subsp. paratuberculosis
gcgcacgucgccgccg

SEQ ID NO: 795760 - RNA, 16 nt, Mycobacterium avium subsp. paratuberculosis
gcgcacgucggccgcc

SEQ ID NO: 795761 - RNA, 23 nt, Mycobacterium avium subsp. paratuberculosis
gcgcacgucggccgccagggcca

SEQ ID NO: 795762 - RNA, 21 nt, Mycobacterium avium subsp. paratuberculosis
gcgcacguggcugaccgacgg

SEQ ID NO: 795763 - RNA, 12 nt, Mycobacterium avium subsp. paratuberculosis
gcgcacguuggc

SEQ ID NO: 795764 - RNA, 19 nt, Mycobacterium avium subsp. paratuberculosis
gcgcacguuggcggccagc

SEQ ID NO: 795765 - RNA, 23 nt, Mycobacterium avium subsp. paratuberculosis
gcgcacuccaucacgaccucgaa

SEQ ID NO: 795766 - RNA, 17 nt, Mycobacterium avium subsp. paratuberculosis
gcgcacggugcccgucg

SEQ ID NO: 795767 - RNA, 19 nt, Mycobacterium avium subsp. paratuberculosis
gcgcacggugcccgucggc

SEQ ID NO: 795768 - RNA, 22 nt, Mycobacterium avium subsp. paratuberculosis
gcgcacggugcccgucggcaac

SEQ ID NO: 795769 - RNA, 16 nt, Mycobacterium avium subsp. paratuberculosis
gcgcacgcugcugguc

SEQ ID NO: 795770 - RNA, 21 nt, Mycobacterium avium subsp. paratuberculosis
gcgcacguaccgguacagcga

SEQ ID NO: 795771 - RNA, 16 nt, Mycobacterium avium subsp. paratuberculosis
gcgcacguagcccagc

SEQ ID NO: 795772 - RNA, 18 nt, Mycobacterium avium subsp. paratuberculosis
gcgcacguagcccagcgc

SEQ ID NO: 795773 - RNA, 13 nt, Mycobacterium avium subsp. paratuberculosis
gcgcacgucaccg

SEQ ID NO: 795774 - RNA, 15 nt, Mycobacterium avium subsp. paratuberculosis
gcgcacgucaccgcg

SEQ ID NO: 795775 - RNA, 17 nt, Mycobacterium avium subsp. paratuberculosis
gcgcacgucaccgcgcu

SEQ ID NO: 795776 - RNA, 16 nt, Mycobacterium avium subsp. paratuberculosis
gcgcacggcgcgcacc

SEQ ID NO: 795777 - RNA, 13 nt, Mycobacterium avium subsp. paratuberculosis
gcgcagcaccagg

SEQ ID NO: 795778 - RNA, 13 nt, Mycobacterium avium subsp. paratuberculosis
gcgcagcaccauc

SEQ ID NO: 795779 - RNA, 19 nt, Mycobacterium avium subsp. paratuberculosis
gcgcagcaccauccgcgcg

SEQ ID NO: 795780 - RNA, 20 nt, Mycobacterium avium subsp. paratuberculosis
gcgcagcaccauccgcgcga

SEQ ID NO: 795781 - RNA, 14 nt, Mycobacterium avium subsp. paratuberculosis
gcgcagcaccgacu

SEQ ID NO: 795782 - RNA, 21 nt, Mycobacterium avium subsp. paratuberculosis
gcgcagcaauugacgccgaca

SEQ ID NO: 795783 - RNA, 12 nt, Mycobacterium avium subsp. paratuberculosis
gcgcagcacggc

SEQ ID NO: 795784 - RNA, 16 nt, Mycobacterium avium subsp. paratuberculosis
gcgcagcacggccacu

SEQ ID NO: 795785 - RNA, 18 nt, Mycobacterium avium subsp. paratuberculosis
gcgcagcacggccacugc

SEQ ID NO: 795786 - RNA, 20 nt, Mycobacterium avium subsp. paratuberculosis
gcgcagcacggccacugccc

SEQ ID NO: 795787 - RNA, 20 nt, Mycobacterium avium subsp. paratuberculosis
gcgcagcacguguucgggau

SEQ ID NO: 795788 - RNA, 12 nt, Mycobacterium avium subsp. paratuberculosis
gcgcagcaccuc

SEQ ID NO: 795789 - RNA, 15 nt, Mycobacterium avium subsp. paratuberculosis
gcgcagcaccuccga

SEQ ID NO: 795790 - RNA, 17 nt, Mycobacterium avium subsp. paratuberculosis
gcgcagcaccuccgaca

SEQ ID NO: 795791 - RNA, 18 nt, Mycobacterium avium subsp. paratuberculosis
gcgcagcaccuccgacag

SEQ ID NO: 795792 - RNA, 17 nt, Mycobacterium avium subsp. paratuberculosis
gcgcagcaccuugccgg

SEQ ID NO: 795793 - RNA, 14 nt, Mycobacterium avium subsp. paratuberculosis
gcgcagcacgauga

SEQ ID NO: 795794 - RNA, 13 nt, Mycobacterium avium subsp. paratuberculosis
gcgcagcaccguc

SEQ ID NO: 795795 - RNA, 21 nt, Mycobacterium avium subsp. paratuberculosis
gcgcagcaacgguacgugcgc

SEQ ID NO: 795796 - RNA, 18 nt, Mycobacterium avium subsp. paratuberculosis
gcgcagcaccgcgucggc

SEQ ID NO: 795797 - RNA, 19 nt, Mycobacterium avium subsp. paratuberculosis
gcgcagcaccgcgucggcg

SEQ ID NO: 795798 - RNA, 20 nt, Mycobacterium avium subsp. paratuberculosis
gcgcagcaccgcgucggcgc

SEQ ID NO: 795799 - RNA, 22 nt, Mycobacterium avium subsp. paratuberculosis
gcgcagcaccgcgucggcgcug

SEQ ID NO: 795800 - RNA, 12 nt, Mycobacterium avium subsp. paratuberculosis
gcgcagcagcag

SEQ ID NO: 795801 - RNA, 21 nt, Mycobacterium avium subsp. paratuberculosis
gcgcagcagcaggucggccag

SEQ ID NO: 795802 - RNA, 22 nt, Mycobacterium avium subsp. paratuberculosis
gcgcagcagcaggucggccagc

SEQ ID NO: 795803 - RNA, 23 nt, Mycobacterium avium subsp. paratuberculosis
gcgcagcagcggcuugagcgcca

SEQ ID NO: 795804 - RNA, 23 nt, Mycobacterium avium subsp. paratuberculosis
gcgcagcagcguuccgucggcga

SEQ ID NO: 795805 - RNA, 12 nt, Mycobacterium avium subsp. paratuberculosis
gcgcagcagcgg

SEQ ID NO: 795806 - RNA, 12 nt, Mycobacterium avium subsp. paratuberculosis
gcgcagccaccg

SEQ ID NO: 795807 - RNA, 13 nt, Mycobacterium avium subsp. paratuberculosis
gcgcagccaccgc

SEQ ID NO: 795808 - RNA, 14 nt, Mycobacterium avium subsp. paratuberculosis
gcgcagccaccgcc

SEQ ID NO: 795809 - RNA, 16 nt, Mycobacterium avium subsp. paratuberculosis
gcgcagccaccgcccg

SEQ ID NO: 795810 - RNA, 16 nt, Mycobacterium avium subsp. paratuberculosis
gcgcagccacgagccc

SEQ ID NO: 795811 - RNA, 22 nt, Mycobacterium avium subsp. paratuberculosis
gcgcagcaucuccgagucggcg

SEQ ID NO: 795812 - RNA, 21 nt, Mycobacterium avium subsp. paratuberculosis
gcgcagcagcgccagcagcgg

SEQ ID NO: 795813 - RNA, 15 nt, Mycobacterium avium subsp. paratuberculosis
gcgcagcaucacguc

SEQ ID NO: 795814 - RNA, 19 nt, Mycobacterium avium subsp. paratuberculosis
gcgcagcaucacgucggcg

SEQ ID NO: 795815 - RNA, 20 nt, Mycobacterium avium subsp. paratuberculosis
gcgcagcaucacgucggcga

SEQ ID NO: 795816 - RNA, 15 nt, Mycobacterium avium subsp. paratuberculosis
gcgcagcauccgcac

SEQ ID NO: 795817 - RNA, 20 nt, Mycobacterium avium subsp. paratuberculosis
gcgcagcauccgcaccaggu

SEQ ID NO: 795818 - RNA, 20 nt, Mycobacterium avium subsp. paratuberculosis
gcgcagcaucggcagaucgu

SEQ ID NO: 795819 - RNA, 23 nt, Mycobacterium avium subsp. paratuberculosis
gcgcacgcccaugaucacaccgc

SEQ ID NO: 795820 - RNA, 17 nt, Mycobacterium avium subsp. paratuberculosis
gcgcacgccaucgccuc

SEQ ID NO: 795821 - RNA, 19 nt, Mycobacterium avium subsp. paratuberculosis
gcgcacgccaucgccucgg

SEQ ID NO: 795822 - RNA, 15 nt, Mycobacterium avium subsp. paratuberculosis
gcgcacgcggacacg

SEQ ID NO: 795823 - RNA, 15 nt, Mycobacterium avium subsp. paratuberculosis
gcgcacgcucgcggu

SEQ ID NO: 795824 - RNA, 16 nt, Mycobacterium avium subsp. paratuberculosis
gcgcacgcucgcggug

SEQ ID NO: 795825 - RNA, 20 nt, Mycobacterium avium subsp. paratuberculosis
gcgcacgcucgcggugcgcg

SEQ ID NO: 795826 - RNA, 19 nt, Mycobacterium avium subsp. paratuberculosis
gcgcacgcuuuuucgcgaa

SEQ ID NO: 795827 - RNA, 16 nt, Mycobacterium avium subsp. paratuberculosis
gcgcacgcuggccggc

SEQ ID NO: 795828 - RNA, 22 nt, Mycobacterium avium subsp. paratuberculosis
gcgcacgcuggccggcagcguc

SEQ ID NO: 795829 - RNA, 18 nt, Mycobacterium avium subsp. paratuberculosis
gcgcacgcagugccgcac

SEQ ID NO: 795830 - RNA, 21 nt, Mycobacterium avium subsp. paratuberculosis
gcgcacgcagugccgcaccag

SEQ ID NO: 795831 - RNA, 22 nt, Mycobacterium avium subsp. paratuberculosis
gcgcacgcagugccgcaccagc

SEQ ID NO: 795832 - RNA, 23 nt, Mycobacterium avium subsp. paratuberculosis
gcgcacgcagugccgcaccagca

SEQ ID NO: 795833 - RNA, 23 nt, Mycobacterium avium subsp. paratuberculosis
gcgcacgaacggcgcgaaccggg

SEQ ID NO: 795834 - RNA, 15 nt, Mycobacterium avium subsp. paratuberculosis
gcgcacgacguggag

SEQ ID NO: 795835 - RNA, 24 nt, Mycobacterium avium subsp. paratuberculosis
gcgcaccuggucggucagcucgaa

SEQ ID NO: 795836 - RNA, 16 nt, Mycobacterium avium subsp. paratuberculosis
gcgcaccuucccggcc

SEQ ID NO: 795837 - RNA, 17 nt, Mycobacterium avium subsp. paratuberculosis
gcgcaccuucccggccg

SEQ ID NO: 795838 - RNA, 18 nt, Mycobacterium avium subsp. paratuberculosis
gcgcaccuggcgcagcac

SEQ ID NO: 795839 - RNA, 22 nt, Mycobacterium avium subsp. paratuberculosis
gcgcaccgugccgcccgucgcc

SEQ ID NO: 795840 - RNA, 17 nt, Mycobacterium avium subsp. paratuberculosis
gcgcaccgugucgucgc

SEQ ID NO: 795841 - RNA, 23 nt, Mycobacterium avium subsp. paratuberculosis
gcgcaccgugucgucgcugacgc

SEQ ID NO: 795842 - RNA, 19 nt, Mycobacterium avium subsp. paratuberculosis
gcgcaccgucaucgcggcg

SEQ ID NO: 795843 - RNA, 17 nt, Mycobacterium avium subsp. paratuberculosis
gcgcaccggucagcgcu

SEQ ID NO: 795844 - RNA, 18 nt, Mycobacterium avium subsp. paratuberculosis
gcgcaccggucagcgcua

SEQ ID NO: 795845 - RNA, 20 nt, Mycobacterium avium subsp. paratuberculosis
gcgcaccgguuugucggcgc

SEQ ID NO: 795846 - RNA, 21 nt, Mycobacterium avium subsp. paratuberculosis
gcgcaccgguuugucggcgcc

SEQ ID NO: 795847 - RNA, 23 nt, Mycobacterium avium subsp. paratuberculosis
gcgcaccgguuugucggcgcccu

SEQ ID NO: 795848 - RNA, 13 nt, Mycobacterium avium subsp. paratuberculosis
gcgcaccgcggcc

SEQ ID NO: 795849 - RNA, 12 nt, Mycobacterium avium subsp. paratuberculosis
gcgcaccggcug

SEQ ID NO: 795850 - RNA, 20 nt, Mycobacterium avium subsp. paratuberculosis
gcgcaccgggaccagcgcgg

SEQ ID NO: 795851 - RNA, 21 nt, Mycobacterium avium subsp. paratuberculosis
gcgcaccgggaccagcgcggu

SEQ ID NO: 795852 - RNA, 13 nt, Mycobacterium avium subsp. paratuberculosis
gcgcaccggcgau

SEQ ID NO: 795853 - RNA, 15 nt, Mycobacterium avium subsp. paratuberculosis
gcgcaccggcgaugc

SEQ ID NO: 795854 - RNA, 13 nt, Mycobacterium avium subsp. paratuberculosis
gcgcaccggcgcu

SEQ ID NO: 795855 - RNA, 14 nt, Mycobacterium avium subsp. paratuberculosis
gcgcaccggcgcug

SEQ ID NO: 795856 - RNA, 21 nt, Mycobacterium avium subsp. paratuberculosis
gcgcaccgcgaaacgcaacag

SEQ ID NO: 795857 - RNA, 13 nt, Mycobacterium avium subsp. paratuberculosis
gcgcaccgcgcgu

SEQ ID NO: 795858 - RNA, 22 nt, Mycobacterium avium subsp. paratuberculosis
gcgcaccgcggauuccagcgcg

SEQ ID NO: 795859 - RNA, 16 nt, Mycobacterium avium subsp. paratuberculosis
gcgcaccgcggccucg

SEQ ID NO: 795860 - RNA, 17 nt, Mycobacterium avium subsp. paratuberculosis
gcgcaccgcggccucgg

SEQ ID NO: 795861 - RNA, 21 nt, Mycobacterium avium subsp. paratuberculosis
gcgcaccgcggccucggcguc

SEQ ID NO: 795862 - RNA, 14 nt, Mycobacterium avium subsp. paratuberculosis
gcgcaccgcggcgg

SEQ ID NO: 795863 - RNA, 15 nt, Mycobacterium avium subsp. paratuberculosis
gcgcaccgcggcgug

SEQ ID NO: 795864 - RNA, 17 nt, Mycobacterium avium subsp. paratuberculosis
gcgcaccgcggcgugcg

SEQ ID NO: 795865 - RNA, 19 nt, Mycobacterium avium subsp. paratuberculosis
gcgcaccgcggcgugcgcc

SEQ ID NO: 795866 - RNA, 22 nt, Mycobacterium avium subsp. paratuberculosis
gcgcaccgcggcgugcgccagu

SEQ ID NO: 795867 - RNA, 13 nt, Mycobacterium avium subsp. paratuberculosis
gcgcaccgcgggc

SEQ ID NO: 795868 - RNA, 18 nt, Mycobacterium avium subsp. paratuberculosis
gcgcaccgcgggcagcag

SEQ ID NO: 795869 - RNA, 19 nt, Mycobacterium avium subsp. paratuberculosis
gcgcaccgcgggcucgaac

SEQ ID NO: 795870 - RNA, 17 nt, Mycobacterium avium subsp. paratuberculosis
gcgcaccgcgucgacca

SEQ ID NO: 795871 - RNA, 20 nt, Mycobacterium avium subsp. paratuberculosis
gcgcaccgcgucgaccaccg

SEQ ID NO: 795872 - RNA, 23 nt, Mycobacterium avium subsp. paratuberculosis
gcgcaccgcgucgaccaccgccg

SEQ ID NO: 795873 - RNA, 22 nt, Mycobacterium avium subsp. paratuberculosis
gcgaucaacaccgguccggccg

SEQ ID NO: 795874 - RNA, 24 nt, Mycobacterium avium subsp. paratuberculosis
gcgaucaacaccgguccggccgug

SEQ ID NO: 795875 - RNA, 17 nt, Mycobacterium avium subsp. paratuberculosis
gcgaucacaccaccacg

SEQ ID NO: 795876 - RNA, 12 nt, Mycobacterium avium subsp. paratuberculosis
gcgaucaccgag

SEQ ID NO: 795877 - RNA, 22 nt, Mycobacterium avium subsp. paratuberculosis
gcgaucaccgagauggccacca

SEQ ID NO: 795878 - RNA, 14 nt, Mycobacterium avium subsp. paratuberculosis
gcgaucaccacccc

SEQ ID NO: 795879 - RNA, 14 nt, Mycobacterium avium subsp. paratuberculosis
gcgaucaccccggc

SEQ ID NO: 795880 - RNA, 15 nt, Mycobacterium avium subsp. paratuberculosis
gcgaucaccccggcg

SEQ ID NO: 795881 - RNA, 18 nt, Mycobacterium avium subsp. paratuberculosis
gcgaucaccccggcgacg

SEQ ID NO: 795882 - RNA, 18 nt, Mycobacterium avium subsp. paratuberculosis
gcgauagggccggccgga

SEQ ID NO: 795883 - RNA, 20 nt, Mycobacterium avium subsp. paratuberculosis
gcgcaccgccgcgggaugcu

SEQ ID NO: 795884 - RNA, 12 nt, Mycobacterium avium subsp. paratuberculosis
gcgcaccgccgg

SEQ ID NO: 795885 - RNA, 14 nt, Mycobacterium avium subsp. paratuberculosis
gcgcaccgccgggc

SEQ ID NO: 795886 - RNA, 15 nt, Mycobacterium avium subsp. paratuberculosis
gcgcaccgccgucgg

SEQ ID NO: 795887 - RNA, 23 nt, Mycobacterium avium subsp. paratuberculosis
gcgcaccgccgucggggcgucgg

SEQ ID NO: 795888 - RNA, 14 nt, Mycobacterium avium subsp. paratuberculosis
gcgcaccgccaccg

SEQ ID NO: 795889 - RNA, 16 nt, Mycobacterium avium subsp. paratuberculosis
gcgcaccgccaccgcc

SEQ ID NO: 795890 - RNA, 18 nt, Mycobacterium avium subsp. paratuberculosis
gcgcaccgccaccgcccg

SEQ ID NO: 795891 - RNA, 18 nt, Mycobacterium avium subsp. paratuberculosis
gcgcaccgccaccgcgca

SEQ ID NO: 795892 - RNA, 12 nt, Mycobacterium avium subsp. paratuberculosis
gcgcaccgccag

SEQ ID NO: 795893 - RNA, 14 nt, Mycobacterium avium subsp. paratuberculosis
gcgcaccgccagca

SEQ ID NO: 795894 - RNA, 15 nt, Mycobacterium avium subsp. paratuberculosis
gcgcaccgccagcac

SEQ ID NO: 795895 - RNA, 19 nt, Mycobacterium avium subsp. paratuberculosis
gcgcaccgccagcaccgac

SEQ ID NO: 795896 - RNA, 20 nt, Mycobacterium avium subsp. paratuberculosis
gcgcaccgccagcaccgacg

SEQ ID NO: 795897 - RNA, 13 nt, Mycobacterium avium subsp. paratuberculosis
gcgcaccgcccaa

SEQ ID NO: 795898 - RNA, 18 nt, Mycobacterium avium subsp. paratuberculosis
gcgcaccgagucggugac

SEQ ID NO: 795899 - RNA, 22 nt, Mycobacterium avium subsp. paratuberculosis
gcgcacccguaacacgaucacc

SEQ ID NO: 795900 - RNA, 20 nt, Mycobacterium avium subsp. paratuberculosis
gcgcaccgacaucaccaacc

SEQ ID NO: 795901 - RNA, 22 nt, Mycobacterium avium subsp. paratuberculosis
gcgcaccgacaucaccaaccgc

SEQ ID NO: 795902 - RNA, 18 nt, Mycobacterium avium subsp. paratuberculosis
gcgcaccccguugccgcc

SEQ ID NO: 795903 - RNA, 23 nt, Mycobacterium avium subsp. paratuberculosis
gcgcaccccguugccgccggcgc

SEQ ID NO: 795904 - RNA, 14 nt, Mycobacterium avium subsp. paratuberculosis
gcgcacccgcacga

SEQ ID NO: 795905 - RNA, 14 nt, Mycobacterium avium subsp. paratuberculosis
gcgcacccccgggg

SEQ ID NO: 795906 - RNA, 16 nt, Mycobacterium avium subsp. paratuberculosis
gcgcacccccggggcc

SEQ ID NO: 795907 - RNA, 12 nt, Mycobacterium avium subsp. paratuberculosis
gcgcacccggcc

SEQ ID NO: 795908 - RNA, 13 nt, Mycobacterium avium subsp. paratuberculosis
gcgcacccggcca

SEQ ID NO: 795909 - RNA, 12 nt, Mycobacterium avium subsp. paratuberculosis
gcgcacccggga

SEQ ID NO: 795910 - RNA, 12 nt, Mycobacterium avium subsp. paratuberculosis
gcgcacccgguc

SEQ ID NO: 795911 - RNA, 18 nt, Mycobacterium avium subsp. paratuberculosis
gcgcacccgguccggcug

SEQ ID NO: 795912 - RNA, 20 nt, Mycobacterium avium subsp. paratuberculosis
gcgcacccgguccggcuggu

SEQ ID NO: 795913 - RNA, 16 nt, Mycobacterium avium subsp. paratuberculosis
gcgcaccaucaccugu

SEQ ID NO: 795914 - RNA, 20 nt, Mycobacterium avium subsp. paratuberculosis
gcgcaccauccgcgacgcca

SEQ ID NO: 795915 - RNA, 23 nt, Mycobacterium avium subsp. paratuberculosis
gcgcaccauccgcgacgccagca

SEQ ID NO: 795916 - RNA, 14 nt, Mycobacterium avium subsp. paratuberculosis
gcgcacccagacgu

SEQ ID NO: 795917 - RNA, 13 nt, Mycobacterium avium subsp. paratuberculosis
gcgcacccagccg

SEQ ID NO: 795918 - RNA, 14 nt, Mycobacterium avium subsp. paratuberculosis
gcgcacccagccgc

SEQ ID NO: 795919 - RNA, 20 nt, Mycobacterium avium subsp. paratuberculosis
gcgcagcucuaugcccuuga

SEQ ID NO: 795920 - RNA, 23 nt, Mycobacterium avium subsp. paratuberculosis
gcgcagcugcgccgcgucgacgc

SEQ ID NO: 795921 - RNA, 17 nt, Mycobacterium avium subsp. paratuberculosis
gcgcagcuggccgugca

SEQ ID NO: 795922 - RNA, 20 nt, Mycobacterium avium subsp. paratuberculosis
gcgcagcuggccgugcaccg

SEQ ID NO: 795923 - RNA, 20 nt, Mycobacterium avium subsp. paratuberculosis
gcgcaggaacuccagcagcu

SEQ ID NO: 795924 - RNA, 21 nt, Mycobacterium avium subsp. paratuberculosis
gcgcaggaacuccagcagcug

SEQ ID NO: 795925 - RNA, 23 nt, Mycobacterium avium subsp. paratuberculosis
gcgcagcucgacgaccucgccga

SEQ ID NO: 795926 - RNA, 16 nt, Mycobacterium avium subsp. paratuberculosis
gcgcagcucgcgcagc

SEQ ID NO: 795927 - RNA, 19 nt, Mycobacterium avium subsp. paratuberculosis
gcgcagcucgcgcagccgg

SEQ ID NO: 795928 - RNA, 21 nt, Mycobacterium avium subsp. paratuberculosis
gcgcagcucgcgcagccggcc

SEQ ID NO: 795929 - RNA, 22 nt, Mycobacterium avium subsp. paratuberculosis
gcgcagcucgcgcagcuggccg

SEQ ID NO: 795930 - RNA, 21 nt, Mycobacterium avium subsp. paratuberculosis
gcgcagcucggggucggcguc

SEQ ID NO: 795931 - RNA, 14 nt, Mycobacterium avium subsp. paratuberculosis
gcgcagcgugucgg

SEQ ID NO: 795932 - RNA, 16 nt, Mycobacterium avium subsp. paratuberculosis
gcgcagcgugucgggg

SEQ ID NO: 795933 - RNA, 17 nt, Mycobacterium avium subsp. paratuberculosis
gcgcagcgugucggggu

SEQ ID NO: 795934 - RNA, 19 nt, Mycobacterium avium subsp. paratuberculosis
gcgcagcgugucggggucg

SEQ ID NO: 795935 - RNA, 17 nt, Mycobacterium avium subsp. paratuberculosis
gcgcagcgugugcaccu

SEQ ID NO: 795936 - RNA, 13 nt, Mycobacterium avium subsp. paratuberculosis
gcgcagcgucggc

SEQ ID NO: 795937 - RNA, 16 nt, Mycobacterium avium subsp. paratuberculosis
gcgcagcgucggcgug

SEQ ID NO: 795938 - RNA, 23 nt, Mycobacterium avium subsp. paratuberculosis
gcgcagcgucucccgggugcgcg

SEQ ID NO: 795939 - RNA, 20 nt, Mycobacterium avium subsp. paratuberculosis
gcgcagcgucuccucgaccg

SEQ ID NO: 795940 - RNA, 14 nt, Mycobacterium avium subsp. paratuberculosis
gcgcagcgucucga

SEQ ID NO: 795941 - RNA, 22 nt, Mycobacterium avium subsp. paratuberculosis
gcgcagcgucucgaucgacgac

SEQ ID NO: 795942 - RNA, 14 nt, Mycobacterium avium subsp. paratuberculosis
gcgcagcgucaacg

SEQ ID NO: 795943 - RNA, 24 nt, Mycobacterium avium subsp. paratuberculosis
gcgcagcggggaggcccagcccgc

SEQ ID NO: 795944 - RNA, 17 nt, Mycobacterium avium subsp. paratuberculosis
gcgcagcggggcgcgca

SEQ ID NO: 795945 - RNA, 18 nt, Mycobacterium avium subsp. paratuberculosis
gcgcagcggggcgcgcag

SEQ ID NO: 795946 - RNA, 13 nt, Mycobacterium avium subsp. paratuberculosis
gcgcagcggcccg

SEQ ID NO: 795947 - RNA, 16 nt, Mycobacterium avium subsp. paratuberculosis
gcgcaggaggcggcca

SEQ ID NO: 795948 - RNA, 20 nt, Mycobacterium avium subsp. paratuberculosis
gcgcaggaugcccagcacca

SEQ ID NO: 795949 - RNA, 16 nt, Mycobacterium avium subsp. paratuberculosis
gcgcaggccgccgacg

SEQ ID NO: 795950 - RNA, 14 nt, Mycobacterium avium subsp. paratuberculosis
gcgcaggccccggc

SEQ ID NO: 795951 - RNA, 15 nt, Mycobacterium avium subsp. paratuberculosis
gcgcaggccccggcg

SEQ ID NO: 795952 - RNA, 17 nt, Mycobacterium avium subsp. paratuberculosis
gcgcaggccccggcgcg

SEQ ID NO: 795953 - RNA, 14 nt, Mycobacterium avium subsp. paratuberculosis
gcgcaggcgcuggg

SEQ ID NO: 795954 - RNA, 13 nt, Mycobacterium avium subsp. paratuberculosis
gcgcaggcggcga

SEQ ID NO: 795955 - RNA, 16 nt, Mycobacterium avium subsp. paratuberculosis
gcgcaggcggcgcgca

SEQ ID NO: 795956 - RNA, 17 nt, Mycobacterium avium subsp. paratuberculosis
gcgcaggcggcgcgcag

SEQ ID NO: 795957 - RNA, 16 nt, Mycobacterium avium subsp. paratuberculosis
gcgcaggcgcgcggcc

SEQ ID NO: 795958 - RNA, 18 nt, Mycobacterium avium subsp. paratuberculosis
gcgcaggcgcgcggccag

SEQ ID NO: 795959 - RNA, 19 nt, Mycobacterium avium subsp. paratuberculosis
gcgcaggcgcgcggccagc

SEQ ID NO: 795960 - RNA, 17 nt, Mycobacterium avium subsp. paratuberculosis
gcgcaggccguccagca

SEQ ID NO: 795961 - RNA, 19 nt, Mycobacterium avium subsp. paratuberculosis
gcgcaggccguccagcagc

SEQ ID NO: 795962 - RNA, 21 nt, Mycobacterium avium subsp. paratuberculosis
gcgcaggccguccagcagcag

SEQ ID NO: 795963 - RNA, 15 nt, Mycobacterium avium subsp. paratuberculosis
gcgcaggccggucac

SEQ ID NO: 795964 - RNA, 19 nt, Mycobacterium avium subsp. paratuberculosis
gcgcagccagaccucgccg

SEQ ID NO: 795965 - RNA, 20 nt, Mycobacterium avium subsp. paratuberculosis
gcgcagccagaccucgccga

SEQ ID NO: 795966 - RNA, 23 nt, Mycobacterium avium subsp. paratuberculosis
gcgcagccagaccucgccgacgg

SEQ ID NO: 795967 - RNA, 16 nt, Mycobacterium avium subsp. paratuberculosis
gcgcagccagcgccgc

SEQ ID NO: 795968 - RNA, 20 nt, Mycobacterium avium subsp. paratuberculosis
gcgcagccagcgccgcacug

SEQ ID NO: 795969 - RNA, 13 nt, Mycobacterium avium subsp. paratuberculosis
gcgcagccagcgg

SEQ ID NO: 795970 - RNA, 15 nt, Mycobacterium avium subsp. paratuberculosis
gcgcagccagcgguc

SEQ ID NO: 795971 - RNA, 18 nt, Mycobacterium avium subsp. paratuberculosis
gcgcagccagcucggcgu

SEQ ID NO: 795972 - RNA, 13 nt, Mycobacterium avium subsp. paratuberculosis
gcgcagcccggcg

SEQ ID NO: 795973 - RNA, 14 nt, Mycobacterium avium subsp. paratuberculosis
gcgcagcccggcgg

SEQ ID NO: 795974 - RNA, 16 nt, Mycobacterium avium subsp. paratuberculosis
gcgcagcccggcgguu

SEQ ID NO: 795975 - RNA, 15 nt, Mycobacterium avium subsp. paratuberculosis
gcgcagcccagccag

SEQ ID NO: 795976 - RNA, 18 nt, Mycobacterium avium subsp. paratuberculosis
gcgcagcccagccagcga

SEQ ID NO: 795977 - RNA, 20 nt, Mycobacterium avium subsp. paratuberculosis
gcgcagcccagccagcgaca

SEQ ID NO: 795978 - RNA, 20 nt, Mycobacterium avium subsp. paratuberculosis
gcgcagccgucgcaucagcu

SEQ ID NO: 795979 - RNA, 14 nt, Mycobacterium avium subsp. paratuberculosis
gcgcagccggccgu

SEQ ID NO: 795980 - RNA, 19 nt, Mycobacterium avium subsp. paratuberculosis
gcgcagccggccguccacg

SEQ ID NO: 795981 - RNA, 13 nt, Mycobacterium avium subsp. paratuberculosis
gcgcagccgggcg

SEQ ID NO: 795982 - RNA, 14 nt, Mycobacterium avium subsp. paratuberculosis
gcgcagccgggcgg

SEQ ID NO: 795983 - RNA, 17 nt, Mycobacterium avium subsp. paratuberculosis
gcgcagccgggcggcgc

SEQ ID NO: 795984 - RNA, 18 nt, Mycobacterium avium subsp. paratuberculosis
gcgcagccgggcggcgcu

SEQ ID NO: 795985 - RNA, 16 nt, Mycobacterium avium subsp. paratuberculosis
gcgcagccgggcggug

SEQ ID NO: 795986 - RNA, 13 nt, Mycobacterium avium subsp. paratuberculosis
gcgcagccgcggu

SEQ ID NO: 795987 - RNA, 15 nt, Mycobacterium avium subsp. paratuberculosis
gcgcagccgcggugg

SEQ ID NO: 795988 - RNA, 17 nt, Mycobacterium avium subsp. paratuberculosis
gcgcagccgcgguggcg

SEQ ID NO: 795989 - RNA, 19 nt, Mycobacterium avium subsp. paratuberculosis
gcgcagccgcugcagcgcc

SEQ ID NO: 795990 - RNA, 21 nt, Mycobacterium avium subsp. paratuberculosis
gcgcagccgcugcagcgccgc

SEQ ID NO: 795991 - RNA, 22 nt, Mycobacterium avium subsp. paratuberculosis
gcgcagccgcugcagcgccgcc

SEQ ID NO: 795992 - RNA, 14 nt, Mycobacterium avium subsp. paratuberculosis
gcgcagcccgagcg

SEQ ID NO: 795993 - RNA, 16 nt, Mycobacterium avium subsp. paratuberculosis
gcgcagcccgagcggc

SEQ ID NO: 795994 - RNA, 22 nt, Mycobacterium avium subsp. paratuberculosis
gcgcagcccgccgggaugcgcc

SEQ ID NO: 795995 - RNA, 13 nt, Mycobacterium avium subsp. paratuberculosis
gcgcagccggcca

SEQ ID NO: 795996 - RNA, 17 nt, Mycobacterium avium subsp. paratuberculosis
gcgcagccggccaccgc

SEQ ID NO: 795997 - RNA, 18 nt, Mycobacterium avium subsp. paratuberculosis
gcgcagccggccaccgcc

SEQ ID NO: 795998 - RNA, 18 nt, Mycobacterium avium subsp. paratuberculosis
gcgcagcgcacgucgccg

SEQ ID NO: 795999 - RNA, 16 nt, Mycobacterium avium subsp. paratuberculosis
gcgcagcgagucggcg

SEQ ID NO: 796000 - RNA, 18 nt, Mycobacterium avium subsp. paratuberculosis
gcgcagcgagucggcgaa

SEQ ID NO: 796001 - RNA, 16 nt, Mycobacterium avium subsp. paratuberculosis
gcgcagcgaacgucag

SEQ ID NO: 796002 - RNA, 15 nt, Mycobacterium avium subsp. paratuberculosis
gcgcagcgaccuggu

SEQ ID NO: 796003 - RNA, 15 nt, Mycobacterium avium subsp. paratuberculosis
gcgcagccgccgggc

SEQ ID NO: 796004 - RNA, 12 nt, Mycobacterium avium subsp. paratuberculosis
gcgcagcgcacg

SEQ ID NO: 796005 - RNA, 15 nt, Mycobacterium avium subsp. paratuberculosis
gcgcagcgcagcacc

SEQ ID NO: 796006 - RNA, 16 nt, Mycobacterium avium subsp. paratuberculosis
gcgcagcgcagcacca

SEQ ID NO: 796007 - RNA, 20 nt, Mycobacterium avium subsp. paratuberculosis
gcgcagcgcagcaccauccg

SEQ ID NO: 796008 - RNA, 16 nt, Mycobacterium avium subsp. paratuberculosis
gcgcagcgcgaugucc

SEQ ID NO: 796009 - RNA, 13 nt, Mycobacterium avium subsp. paratuberculosis
gcgcagcgcgucg

SEQ ID NO: 796010 - RNA, 15 nt, Mycobacterium avium subsp. paratuberculosis
gcgcagcgcgucgcg

SEQ ID NO: 796011 - RNA, 19 nt, Mycobacterium avium subsp. paratuberculosis
gcgcagcgcgucgcgcccg

SEQ ID NO: 796012 - RNA, 21 nt, Mycobacterium avium subsp. paratuberculosis
gcgcagcgcgucgcgcccggc

SEQ ID NO: 796013 - RNA, 17 nt, Mycobacterium avium subsp. paratuberculosis
gcgcagcgcgucgggcu

SEQ ID NO: 796014 - RNA, 17 nt, Mycobacterium avium subsp. paratuberculosis
gcgcagcgcgucgucgg

SEQ ID NO: 796015 - RNA, 14 nt, Mycobacterium avium subsp. paratuberculosis
gcgcagcgccgcgc

SEQ ID NO: 796016 - RNA, 15 nt, Mycobacterium avium subsp. paratuberculosis
gcgcagcgccgcgcc

SEQ ID NO: 796017 - RNA, 18 nt, Mycobacterium avium subsp. paratuberculosis
gcgcagcgccgcgccgac

SEQ ID NO: 796018 - RNA, 13 nt, Mycobacterium avium subsp. paratuberculosis
gcgcagcgccguc

SEQ ID NO: 796019 - RNA, 17 nt, Mycobacterium avium subsp. paratuberculosis
gcgcagcgccgucucga

SEQ ID NO: 796020 - RNA, 15 nt, Mycobacterium avium subsp. paratuberculosis
gcgcagcgccucggc

SEQ ID NO: 796021 - RNA, 16 nt, Mycobacterium avium subsp. paratuberculosis
gcgcagcgccucggcg

SEQ ID NO: 796022 - RNA, 17 nt, Mycobacterium avium subsp. paratuberculosis
gcgcaguagccgacgug

SEQ ID NO: 796023 - RNA, 18 nt, Mycobacterium avium subsp. paratuberculosis
gcgcaguagccgacgugc

SEQ ID NO: 796024 - RNA, 18 nt, Mycobacterium avium subsp. paratuberculosis
gcgcagguuguccagccg

SEQ ID NO: 796025 - RNA, 22 nt, Mycobacterium avium subsp. paratuberculosis
gcgcagguuguccagccggugc

SEQ ID NO: 796026 - RNA, 19 nt, Mycobacterium avium subsp. paratuberculosis
gcgcagguugucggccaac

SEQ ID NO: 796027 - RNA, 20 nt, Mycobacterium avium subsp. paratuberculosis
gcgcaggugggcggugcgca

SEQ ID NO: 796028 - RNA, 17 nt, Mycobacterium avium subsp. paratuberculosis
gcgcaggugugcggcaa

SEQ ID NO: 796029 - RNA, 21 nt, Mycobacterium avium subsp. paratuberculosis
gcgcaggugaucaaagccggu

SEQ ID NO: 796030 - RNA, 23 nt, Mycobacterium avium subsp. paratuberculosis
gcgcaggugaucaaagccggugg

SEQ ID NO: 796031 - RNA, 22 nt, Mycobacterium avium subsp. paratuberculosis
gcgcaggugaugcggcccgacc

SEQ ID NO: 796032 - RNA, 18 nt, Mycobacterium avium subsp. paratuberculosis
gcgcagguccacccgccc

SEQ ID NO: 796033 - RNA, 14 nt, Mycobacterium avium subsp. paratuberculosis
gcgcaguugcgcgg

SEQ ID NO: 796034 - RNA, 15 nt, Mycobacterium avium subsp. paratuberculosis
gcgcaguugcgcggc

SEQ ID NO: 796035 - RNA, 17 nt, Mycobacterium avium subsp. paratuberculosis
gcgcaguugcgcggcgg

SEQ ID NO: 796036 - RNA, 18 nt, Mycobacterium avium subsp. paratuberculosis
gcgcaguugcgcggcggg

SEQ ID NO: 796037 - RNA, 19 nt, Mycobacterium avium subsp. paratuberculosis
gcgcaguugcgcggcgggc

SEQ ID NO: 796038 - RNA, 19 nt, Mycobacterium avium subsp. paratuberculosis
gcgcaguucgggaucgucg

SEQ ID NO: 796039 - RNA, 23 nt, Mycobacterium avium subsp. paratuberculosis
gcgcaguucgggaucgucgccgg

SEQ ID NO: 796040 - RNA, 17 nt, Mycobacterium avium subsp. paratuberculosis
gcgcagucgcuggucga

SEQ ID NO: 796041 - RNA, 17 nt, Mycobacterium avium subsp. paratuberculosis
gcgcagucggcgucgcg

SEQ ID NO: 796042 - RNA, 17 nt, Mycobacterium avium subsp. paratuberculosis
gcgcagguagccgccgu

SEQ ID NO: 796043 - RNA, 14 nt, Mycobacterium avium subsp. paratuberculosis
gcgcagguaggugg

SEQ ID NO: 796044 - RNA, 16 nt, Mycobacterium avium subsp. paratuberculosis
gcgcagguccggcagc

SEQ ID NO: 796045 - RNA, 16 nt, Mycobacterium avium subsp. paratuberculosis
gcgcagguccucggac

SEQ ID NO: 796046 - RNA, 20 nt, Mycobacterium avium subsp. paratuberculosis
gcgcagguccucggacucgu

SEQ ID NO: 796047 - RNA, 22 nt, Mycobacterium avium subsp. paratuberculosis
gcgcagguccucggacucgucg

SEQ ID NO: 796048 - RNA, 19 nt, Mycobacterium avium subsp. paratuberculosis
gcgcagggcggccggccag

SEQ ID NO: 796049 - RNA, 19 nt, Mycobacterium avium subsp. paratuberculosis
gcgcaggcuggcaucgucg

SEQ ID NO: 796050 - RNA, 17 nt, Mycobacterium avium subsp. paratuberculosis
gcgcagggacgggcgug

SEQ ID NO: 796051 - RNA, 20 nt, Mycobacterium avium subsp. paratuberculosis
gcgcagggacgggcgugacg

SEQ ID NO: 796052 - RNA, 21 nt, Mycobacterium avium subsp. paratuberculosis
gcgcagggacgggcgugacgg

SEQ ID NO: 796053 - RNA, 22 nt, Mycobacterium avium subsp. paratuberculosis
gcgcagggacgggcgugacgga

SEQ ID NO: 796054 - RNA, 21 nt, Mycobacterium avium subsp. paratuberculosis
gcgcagggccagcgccucggc

SEQ ID NO: 796055 - RNA, 23 nt, Mycobacterium avium subsp. paratuberculosis
gcgcagggccagcgccucggcgu

SEQ ID NO: 796056 - RNA, 16 nt, Mycobacterium avium subsp. paratuberculosis
gcgcauccgacaccgc

SEQ ID NO: 796057 - RNA, 12 nt, Mycobacterium avium subsp. paratuberculosis
gcgcauccgcac

SEQ ID NO: 796058 - RNA, 23 nt, Mycobacterium avium subsp. paratuberculosis
gcgcauccgcaccgagaccaugc

SEQ ID NO: 796059 - RNA, 14 nt, Mycobacterium avium subsp. paratuberculosis
gcgcaucccgaucg

SEQ ID NO: 796060 - RNA, 14 nt, Mycobacterium avium subsp. paratuberculosis
gcgcaucccgucga

SEQ ID NO: 796061 - RNA, 13 nt, Mycobacterium avium subsp. paratuberculosis
gcgcauccaccag

SEQ ID NO: 796062 - RNA, 13 nt, Mycobacterium avium subsp. paratuberculosis
gcgcaucgagcug

SEQ ID NO: 796063 - RNA, 21 nt, Mycobacterium avium subsp. paratuberculosis
gcgcauccucauagccggccg

SEQ ID NO: 796064 - RNA, 22 nt, Mycobacterium avium subsp. paratuberculosis
gcgcauccucauagccggccgc

SEQ ID NO: 796065 - RNA, 12 nt, Mycobacterium avium subsp. paratuberculosis
gcgcaucgagcu

SEQ ID NO: 796066 - RNA, 18 nt, Mycobacterium avium subsp. paratuberculosis
gcgcaucgcgggccaccg

SEQ ID NO: 796067 - RNA, 20 nt, Mycobacterium avium subsp. paratuberculosis
gcgcaucgcgggccaccggc

SEQ ID NO: 796068 - RNA, 13 nt, Mycobacterium avium subsp. paratuberculosis
gcgcaucgccggc

SEQ ID NO: 796069 - RNA, 14 nt, Mycobacterium avium subsp. paratuberculosis
gcgcaucgccggcg

SEQ ID NO: 796070 - RNA, 15 nt, Mycobacterium avium subsp. paratuberculosis
gcgcaucgccggcga

SEQ ID NO: 796071 - RNA, 16 nt, Mycobacterium avium subsp. paratuberculosis
gcgcaucgccggcgau

SEQ ID NO: 796072 - RNA, 18 nt, Mycobacterium avium subsp. paratuberculosis
gcgcaucgccggcgcgcu

SEQ ID NO: 796073 - RNA, 19 nt, Mycobacterium avium subsp. paratuberculosis
gcgcaucgccggcgcgcug

SEQ ID NO: 796074 - RNA, 15 nt, Mycobacterium avium subsp. paratuberculosis
gcgcaucgccucggc

SEQ ID NO: 796075 - RNA, 16 nt, Mycobacterium avium subsp. paratuberculosis
gcgcaucgccucggcg

SEQ ID NO: 796076 - RNA, 18 nt, Mycobacterium avium subsp. paratuberculosis
gcgcaucgccucggcggc

SEQ ID NO: 796077 - RNA, 19 nt, Mycobacterium avium subsp. paratuberculosis
gcgcaucgccucggcggcc

SEQ ID NO: 796078 - RNA, 20 nt, Mycobacterium avium subsp. paratuberculosis
gcgcauaaaccugguuggcg

SEQ ID NO: 796079 - RNA, 21 nt, Mycobacterium avium subsp. paratuberculosis
gcgcauaaaccugguuggcga

SEQ ID NO: 796080 - RNA, 14 nt, Mycobacterium avium subsp. paratuberculosis
gcgcaucacccggc

SEQ ID NO: 796081 - RNA, 16 nt, Mycobacterium avium subsp. paratuberculosis
gcgcaucaccgagguc

SEQ ID NO: 796082 - RNA, 22 nt, Mycobacterium avium subsp. paratuberculosis
gcgcaucaccgaggucaccgcg

SEQ ID NO: 796083 - RNA, 22 nt, Mycobacterium avium subsp. paratuberculosis
gcgcaucaccuucugcgucggc

SEQ ID NO: 796084 - RNA, 23 nt, Mycobacterium avium subsp. paratuberculosis
gcgcaguucgaccggcaccagca

SEQ ID NO: 796085 - RNA, 14 nt, Mycobacterium avium subsp. paratuberculosis
gcgcaucaucgccc

SEQ ID NO: 796086 - RNA, 19 nt, Mycobacterium avium subsp. paratuberculosis
gcgcaucaucgcccagcgc

SEQ ID NO: 796087 - RNA, 20 nt, Mycobacterium avium subsp. paratuberculosis
gcgcaucaucgcccagcgca

SEQ ID NO: 796088 - RNA, 18 nt, Mycobacterium avium subsp. paratuberculosis
gcgcaucaucucggcgaa

SEQ ID NO: 796089 - RNA, 23 nt, Mycobacterium avium subsp. paratuberculosis
gcgcaucaugcguuugccgucga

SEQ ID NO: 796090 - RNA, 15 nt, Mycobacterium avium subsp. paratuberculosis
gcgcaucagcggggc

SEQ ID NO: 796091 - RNA, 21 nt, Mycobacterium avium subsp. paratuberculosis
gcgcaucagcucuucgacgau

SEQ ID NO: 796092 - RNA, 14 nt, Mycobacterium avium subsp. paratuberculosis
gcgcaucagcgcca

SEQ ID NO: 796093 - RNA, 19 nt, Mycobacterium avium subsp. paratuberculosis
gcgcaucagcgccaccagc

SEQ ID NO: 796094 - RNA, 19 nt, Mycobacterium avium subsp. paratuberculosis
gcgcccgcgcgaucggcga

SEQ ID NO: 796095 - RNA, 13 nt, Mycobacterium avium subsp. paratuberculosis
gcgcccgcgcggg

SEQ ID NO: 796096 - RNA, 15 nt, Mycobacterium avium subsp. paratuberculosis
gcgcccgcgcgggcu

SEQ ID NO: 796097 - RNA, 12 nt, Mycobacterium avium subsp. paratuberculosis
gcgcccgcgcgu

SEQ ID NO: 796098 - RNA, 18 nt, Mycobacterium avium subsp. paratuberculosis
gcgcccgcgcgugggcca

SEQ ID NO: 796099 - RNA, 13 nt, Mycobacterium avium subsp. paratuberculosis
gcgcccgcggcca

SEQ ID NO: 796100 - RNA, 16 nt, Mycobacterium avium subsp. paratuberculosis
gcgcccgcggccaucg

SEQ ID NO: 796101 - RNA, 18 nt, Mycobacterium avium subsp. paratuberculosis
gcgcccgcggccaucgcc

SEQ ID NO: 796102 - RNA, 20 nt, Mycobacterium avium subsp. paratuberculosis
gcgcccgcggccaucgccug

SEQ ID NO: 796103 - RNA, 12 nt, Mycobacterium avium subsp. paratuberculosis
gcgcccgcggcg

SEQ ID NO: 796104 - RNA, 16 nt, Mycobacterium avium subsp. paratuberculosis
gcgcccgcggcgcgca

SEQ ID NO: 796105 - RNA, 15 nt, Mycobacterium avium subsp. paratuberculosis
gcgcccgcgggugca

SEQ ID NO: 796106 - RNA, 20 nt, Mycobacterium avium subsp. paratuberculosis
gcgcccgcgggugcagccgg

SEQ ID NO: 796107 - RNA, 21 nt, Mycobacterium avium subsp. paratuberculosis
gcgcccgcgggugcagccgga

SEQ ID NO: 796108 - RNA, 23 nt, Mycobacterium avium subsp. paratuberculosis
gcgcccgcgggugcagccggauc

SEQ ID NO: 796109 - RNA, 16 nt, Mycobacterium avium subsp. paratuberculosis
gcgcccgcauguucuc

SEQ ID NO: 796110 - RNA, 21 nt, Mycobacterium avium subsp. paratuberculosis
gcgcccgcauguucucgagcc

SEQ ID NO: 796111 - RNA, 16 nt, Mycobacterium avium subsp. paratuberculosis
gcgcccgauggaggug

SEQ ID NO: 796112 - RNA, 18 nt, Mycobacterium avium subsp. paratuberculosis
gcgcccgauucgcggcca

SEQ ID NO: 796113 - RNA, 20 nt, Mycobacterium avium subsp. paratuberculosis
gcgcccggccagccggccgc

SEQ ID NO: 796114 - RNA, 16 nt, Mycobacterium avium subsp. paratuberculosis
gcgccgaaccggguga

SEQ ID NO: 796115 - RNA, 21 nt, Mycobacterium avium subsp. paratuberculosis
gcgccgaaccgggugacgacc

SEQ ID NO: 796116 - RNA, 17 nt, Mycobacterium avium subsp. paratuberculosis
gcgcccggaaagcgcgg

SEQ ID NO: 796117 - RNA, 20 nt, Mycobacterium avium subsp. paratuberculosis
gcgcccggaaagcgcgggca

SEQ ID NO: 796118 - RNA, 20 nt, Mycobacterium avium subsp. paratuberculosis
gcgcccggagcugucgguga

SEQ ID NO: 796119 - RNA, 15 nt, Mycobacterium avium subsp. paratuberculosis
gcgcccggcaccgcg

SEQ ID NO: 796120 - RNA, 16 nt, Mycobacterium avium subsp. paratuberculosis
gcgcccggcaccgcgg

SEQ ID NO: 796121 - RNA, 22 nt, Mycobacterium avium subsp. paratuberculosis
gcgcccgcuugauggcggcgcg

SEQ ID NO: 796122 - RNA, 15 nt, Mycobacterium avium subsp. paratuberculosis
gcgcccgcugcgcgg

SEQ ID NO: 796123 - RNA, 15 nt, Mycobacterium avium subsp. paratuberculosis
gcgcccgcugcggcg

SEQ ID NO: 796124 - RNA, 17 nt, Mycobacterium avium subsp. paratuberculosis
gcgcccgcugcggcgca

SEQ ID NO: 796125 - RNA, 13 nt, Mycobacterium avium subsp. paratuberculosis
gcgcccgcggccu

SEQ ID NO: 796126 - RNA, 14 nt, Mycobacterium avium subsp. paratuberculosis
gcgcccgcggccuc

SEQ ID NO: 796127 - RNA, 19 nt, Mycobacterium avium subsp. paratuberculosis
gcgcccgcggccuccagcc

SEQ ID NO: 796128 - RNA, 15 nt, Mycobacterium avium subsp. paratuberculosis
gcgcccgcuccggcg

SEQ ID NO: 796129 - RNA, 21 nt, Mycobacterium avium subsp. paratuberculosis
gcgccgaacgcaccaccgcgg

SEQ ID NO: 796130 - RNA, 16 nt, Mycobacterium avium subsp. paratuberculosis
gcgccgaagccgucga

SEQ ID NO: 796131 - RNA, 15 nt, Mycobacterium avium subsp. paratuberculosis
gcgccgaacgucgag

SEQ ID NO: 796132 - RNA, 18 nt, Mycobacterium avium subsp. paratuberculosis
gcgccgaacgucgagcgc

SEQ ID NO: 796133 - RNA, 20 nt, Mycobacterium avium subsp. paratuberculosis
gcgccgaacgucgagcgcgg

SEQ ID NO: 796134 - RNA, 21 nt, Mycobacterium avium subsp. paratuberculosis
gcgccgaacgucgagcgcggc

SEQ ID NO: 796135 - RNA, 22 nt, Mycobacterium avium subsp. paratuberculosis
gcgccgaacgucgagcgcggcc

SEQ ID NO: 796136 - RNA, 16 nt, Mycobacterium avium subsp. paratuberculosis
gcgccgaacgugcacu

SEQ ID NO: 796137 - RNA, 18 nt, Mycobacterium avium subsp. paratuberculosis
gcgccgaacgugcacuca

SEQ ID NO: 796138 - RNA, 14 nt, Mycobacterium avium subsp. paratuberculosis
gcgccgaacgccgg

SEQ ID NO: 796139 - RNA, 15 nt, Mycobacterium avium subsp. paratuberculosis
gcgccgaacgccgga

SEQ ID NO: 796140 - RNA, 16 nt, Mycobacterium avium subsp. paratuberculosis
gcgccgaacgccggau

SEQ ID NO: 796141 - RNA, 21 nt, Mycobacterium avium subsp. paratuberculosis
gcgccgaacgccggauuggcg

SEQ ID NO: 796142 - RNA, 17 nt, Mycobacterium avium subsp. paratuberculosis
gcgccgaacucggcgcc

SEQ ID NO: 796143 - RNA, 20 nt, Mycobacterium avium subsp. paratuberculosis
gcgccgaacucggcgccgcc

SEQ ID NO: 796144 - RNA, 15 nt, Mycobacterium avium subsp. paratuberculosis
gcgccgaagauggcc

SEQ ID NO: 796145 - RNA, 22 nt, Mycobacterium avium subsp. paratuberculosis
gcgccgaagauggccagcgcgg

SEQ ID NO: 796146 - RNA, 19 nt, Mycobacterium avium subsp. paratuberculosis
gcgccgaagauggccagga

SEQ ID NO: 796147 - RNA, 13 nt, Mycobacterium avium subsp. paratuberculosis
gcgccgaccacgg

SEQ ID NO: 796148 - RNA, 19 nt, Mycobacterium avium subsp. paratuberculosis
gcgccgaccacggccccag

SEQ ID NO: 796149 - RNA, 22 nt, Mycobacterium avium subsp. paratuberculosis
gcgccgaccacggccccagccg

SEQ ID NO: 796150 - RNA, 16 nt, Mycobacterium avium subsp. paratuberculosis
gcgccgacagucgcgg

SEQ ID NO: 796151 - RNA, 21 nt, Mycobacterium avium subsp. paratuberculosis
gcgccgacagcugagcagccc

SEQ ID NO: 796152 - RNA, 22 nt, Mycobacterium avium subsp. paratuberculosis
gcgccgacagcugagcagcccg

SEQ ID NO: 796153 - RNA, 21 nt, Mycobacterium avium subsp. paratuberculosis
gcgccgaaucggcuguggcgc

SEQ ID NO: 796154 - RNA, 23 nt, Mycobacterium avium subsp. paratuberculosis
gcgccgaauucgguugucgcggu

SEQ ID NO: 796155 - RNA, 17 nt, Mycobacterium avium subsp. paratuberculosis
gcgccgauuccgucggu

SEQ ID NO: 796156 - RNA, 18 nt, Mycobacterium avium subsp. paratuberculosis
gcgccgauuccgucggug

SEQ ID NO: 796157 - RNA, 19 nt, Mycobacterium avium subsp. paratuberculosis
gcgccgauuccgucggugg

SEQ ID NO: 796158 - RNA, 21 nt, Mycobacterium avium subsp. paratuberculosis
gcgccgauuccgucgguggcg

SEQ ID NO: 796159 - RNA, 20 nt, Mycobacterium avium subsp. paratuberculosis
gcgccgcaggagaucggcgc

SEQ ID NO: 796160 - RNA, 22 nt, Mycobacterium avium subsp. paratuberculosis
gcgccgcaggagaucggcgcgg

SEQ ID NO: 796161 - RNA, 19 nt, Mycobacterium avium subsp. paratuberculosis
gcgccgcaugaugcggcca

SEQ ID NO: 796162 - RNA, 21 nt, Mycobacterium avium subsp. paratuberculosis
gcgccgcaugaugcggccaug

SEQ ID NO: 796163 - RNA, 16 nt, Mycobacterium avium subsp. paratuberculosis
gcgccgagcgcugguu

SEQ ID NO: 796164 - RNA, 13 nt, Mycobacterium avium subsp. paratuberculosis
gcgccgauguggc

SEQ ID NO: 796165 - RNA, 20 nt, Mycobacterium avium subsp. paratuberculosis
gcgccgauguggccggcgau

SEQ ID NO: 796166 - RNA, 22 nt, Mycobacterium avium subsp. paratuberculosis
gcgccgauggugacgauccggu

SEQ ID NO: 796167 - RNA, 16 nt, Mycobacterium avium subsp. paratuberculosis
gcgccgauggcgaagc

SEQ ID NO: 796168 - RNA, 22 nt, Mycobacterium avium subsp. paratuberculosis
gcgccgauggcgaagcccaugc

SEQ ID NO: 796169 - RNA, 16 nt, Mycobacterium avium subsp. paratuberculosis
gcgccgaggucaccgc

SEQ ID NO: 796170 - RNA, 20 nt, Mycobacterium avium subsp. paratuberculosis
gcgccgaggucaccgcggga

SEQ ID NO: 796171 - RNA, 21 nt, Mycobacterium avium subsp. paratuberculosis
gcgccgaucugcucggcugca

SEQ ID NO: 796172 - RNA, 14 nt, Mycobacterium avium subsp. paratuberculosis
gcgccgaugcagca

SEQ ID NO: 796173 - RNA, 21 nt, Mycobacterium avium subsp. paratuberculosis
gcgccgaugcagcacauccag

SEQ ID NO: 796174 - RNA, 18 nt, Mycobacterium avium subsp. paratuberculosis
gcgccgaugcauuggugc

SEQ ID NO: 796175 - RNA, 12 nt, Mycobacterium avium subsp. paratuberculosis
gcgccgaugccc

SEQ ID NO: 796176 - RNA, 21 nt, Mycobacterium avium subsp. paratuberculosis
gcgccgaugcccgccccggac

SEQ ID NO: 796177 - RNA, 16 nt, Mycobacterium avium subsp. paratuberculosis
gcgccgaugccgaacg

SEQ ID NO: 796178 - RNA, 18 nt, Mycobacterium avium subsp. paratuberculosis
gcgccgaugccgaacguc

SEQ ID NO: 796179 - RNA, 22 nt, Mycobacterium avium subsp. paratuberculosis
gcgccgaugccgaacgucacca

SEQ ID NO: 796180 - RNA, 14 nt, Mycobacterium avium subsp. paratuberculosis
gcgccgaugccgcg

SEQ ID NO: 796181 - RNA, 17 nt, Mycobacterium avium subsp. paratuberculosis
gcgccgaggcgcucggc

SEQ ID NO: 796182 - RNA, 19 nt, Mycobacterium avium subsp. paratuberculosis
gcgccgaggcgcucggccc

SEQ ID NO: 796183 - RNA, 12 nt, Mycobacterium avium subsp. paratuberculosis
gcgccgaggcca

SEQ ID NO: 796184 - RNA, 14 nt, Mycobacterium avium subsp. paratuberculosis
gcgccgaggccagc

SEQ ID NO: 796185 - RNA, 22 nt, Mycobacterium avium subsp. paratuberculosis
gcgccgaggccagcacgccggu

SEQ ID NO: 796186 - RNA, 15 nt, Mycobacterium avium subsp. paratuberculosis
gcgccgagccgaggc

SEQ ID NO: 796187 - RNA, 17 nt, Mycobacterium avium subsp. paratuberculosis
gcgccgagaucgcggug

SEQ ID NO: 796188 - RNA, 20 nt, Mycobacterium avium subsp. paratuberculosis
gcgccgagaucgcgguggcg

SEQ ID NO: 796189 - RNA, 21 nt, Mycobacterium avium subsp. paratuberculosis
gcgccgagaucgcgguggcgc

SEQ ID NO: 796190 - RNA, 17 nt, Mycobacterium avium subsp. paratuberculosis
gcgccgagcaaccggga

SEQ ID NO: 796191 - RNA, 22 nt, Mycobacterium avium subsp. paratuberculosis
gcgccgagcaaccgggauaccg

SEQ ID NO: 796192 - RNA, 17 nt, Mycobacterium avium subsp. paratuberculosis
gcgccgagcacgaacgc

SEQ ID NO: 796193 - RNA, 18 nt, Mycobacterium avium subsp. paratuberculosis
gcgccgagcacgaacgcg

SEQ ID NO: 796194 - RNA, 14 nt, Mycobacterium avium subsp. paratuberculosis
gcgccgagcacggc

SEQ ID NO: 796195 - RNA, 20 nt, Mycobacterium avium subsp. paratuberculosis
gcgccgagcacggcucgucc

SEQ ID NO: 796196 - RNA, 23 nt, Mycobacterium avium subsp. paratuberculosis
gcgccgagacgugguggugcgga

SEQ ID NO: 796197 - RNA, 15 nt, Mycobacterium avium subsp. paratuberculosis
gcgccgagagcgcgu

SEQ ID NO: 796198 - RNA, 17 nt, Mycobacterium avium subsp. paratuberculosis
gcgccgagagcgcgucg

SEQ ID NO: 796199 - RNA, 21 nt, Mycobacterium avium subsp. paratuberculosis
gcgccgagagcgcgucgacgc

SEQ ID NO: 796200 - RNA, 12 nt, Mycobacterium avium subsp. paratuberculosis
gcgccgaccgcg

SEQ ID NO: 796201 - RNA, 18 nt, Mycobacterium avium subsp. paratuberculosis
gcgccgaccgcgagcacg

SEQ ID NO: 796202 - RNA, 13 nt, Mycobacterium avium subsp. paratuberculosis
gcgccgacccgcc

SEQ ID NO: 796203 - RNA, 15 nt, Mycobacterium avium subsp. paratuberculosis
gcgccgacccgcccg

SEQ ID NO: 796204 - RNA, 19 nt, Mycobacterium avium subsp. paratuberculosis
gcgccgacccgcccgccgg

SEQ ID NO: 796205 - RNA, 14 nt, Mycobacterium avium subsp. paratuberculosis
gcgccgaccagcgc

SEQ ID NO: 796206 - RNA, 15 nt, Mycobacterium avium subsp. paratuberculosis
gcgccgaccagcgcg

SEQ ID NO: 796207 - RNA, 19 nt, Mycobacterium avium subsp. paratuberculosis
gcgccgaccagcgcguuga

SEQ ID NO: 796208 - RNA, 14 nt, Mycobacterium avium subsp. paratuberculosis
gcgccgcgacgucg

SEQ ID NO: 796209 - RNA, 12 nt, Mycobacterium avium subsp. paratuberculosis
gcgccgcgaccc

SEQ ID NO: 796210 - RNA, 23 nt, Mycobacterium avium subsp. paratuberculosis
gcgccgcgacgaacugccguuga

SEQ ID NO: 796211 - RNA, 15 nt, Mycobacterium avium subsp. paratuberculosis
gcgccgcgccgaccu

SEQ ID NO: 796212 - RNA, 13 nt, Mycobacterium avium subsp. paratuberculosis
gcgccgcgccgcc

SEQ ID NO: 796213 - RNA, 18 nt, Mycobacterium avium subsp. paratuberculosis
gcgccgcgcagccagacc

SEQ ID NO: 796214 - RNA, 18 nt, Mycobacterium avium subsp. paratuberculosis
gcgccgcgaucucggcgg

SEQ ID NO: 796215 - RNA, 19 nt, Mycobacterium avium subsp. paratuberculosis
gcgccgcgaucucggcgga

SEQ ID NO: 796216 - RNA, 23 nt, Mycobacterium avium subsp. paratuberculosis
gcgccgccuccgggcugccguag

SEQ ID NO: 796217 - RNA, 22 nt, Mycobacterium avium subsp. paratuberculosis
gcgccgccguucgccggcgacg

SEQ ID NO: 796218 - RNA, 14 nt, Mycobacterium avium subsp. paratuberculosis
gcgccgccggugac

SEQ ID NO: 796219 - RNA, 17 nt, Mycobacterium avium subsp. paratuberculosis
gcgccgccggggcgucg

SEQ ID NO: 796220 - RNA, 15 nt, Mycobacterium avium subsp. paratuberculosis
gcgccgccggucgcc

SEQ ID NO: 796221 - RNA, 14 nt, Mycobacterium avium subsp. paratuberculosis
gcgccgccggcguc

SEQ ID NO: 796222 - RNA, 15 nt, Mycobacterium avium subsp. paratuberculosis
gcgccgccggcgucg

SEQ ID NO: 796223 - RNA, 19 nt, Mycobacterium avium subsp. paratuberculosis
gcgccgccggcgucgacgu

SEQ ID NO: 796224 - RNA, 21 nt, Mycobacterium avium subsp. paratuberculosis
gcgccgccggcgucgacgucg

SEQ ID NO: 796225 - RNA, 20 nt, Mycobacterium avium subsp. paratuberculosis
gcgccgccacaccucggcga

SEQ ID NO: 796226 - RNA, 12 nt, Mycobacterium avium subsp. paratuberculosis
gcgccgccggcg

SEQ ID NO: 796227 - RNA, 20 nt, Mycobacterium avium subsp. paratuberculosis
gcgccgcauuggcaccgucg

SEQ ID NO: 796228 - RNA, 16 nt, Mycobacterium avium subsp. paratuberculosis
gcgccgcauuggugcc

SEQ ID NO: 796229 - RNA, 19 nt, Mycobacterium avium subsp. paratuberculosis
gcgccgcauuggugccggc

SEQ ID NO: 796230 - RNA, 23 nt, Mycobacterium avium subsp. paratuberculosis
gcgccgcauuggugccggccucg

SEQ ID NO: 796231 - RNA, 14 nt, Mycobacterium avium subsp. paratuberculosis
gcgccgccaaccag

SEQ ID NO: 796232 - RNA, 22 nt, Mycobacterium avium subsp. paratuberculosis
gcgccgccaaccaggucgcggc

SEQ ID NO: 796233 - RNA, 14 nt, Mycobacterium avium subsp. paratuberculosis
gcgccgcgcgccag

SEQ ID NO: 796234 - RNA, 23 nt, Mycobacterium avium subsp. paratuberculosis
gcgccgcgcgcccuagucgacgc

SEQ ID NO: 796235 - RNA, 15 nt, Mycobacterium avium subsp. paratuberculosis
gcgccgcgcgcgcgg

SEQ ID NO: 796236 - RNA, 16 nt, Mycobacterium avium subsp. paratuberculosis
gcgccgcgcgcgcggc

SEQ ID NO: 796237 - RNA, 19 nt, Mycobacterium avium subsp. paratuberculosis
gcgccgcgcgcgcggccuc

SEQ ID NO: 796238 - RNA, 13 nt, Mycobacterium avium subsp. paratuberculosis
gcgccgcgccggc

SEQ ID NO: 796239 - RNA, 21 nt, Mycobacterium avium subsp. paratuberculosis
gcgccgcgcuugcgaucgccg

SEQ ID NO: 796240 - RNA, 13 nt, Mycobacterium avium subsp. paratuberculosis
gcgccgcggccac

SEQ ID NO: 796241 - RNA, 16 nt, Mycobacterium avium subsp. paratuberculosis
gcgccgcggccagccg

SEQ ID NO: 796242 - RNA, 18 nt, Mycobacterium avium subsp. paratuberculosis
gcgccgcggccagccggu

SEQ ID NO: 796243 - RNA, 15 nt, Mycobacterium avium subsp. paratuberculosis
gcgccgcggccagcg

SEQ ID NO: 796244 - RNA, 17 nt, Mycobacterium avium subsp. paratuberculosis
gcgccgcggccagcgcc

SEQ ID NO: 796245 - RNA, 17 nt, Mycobacterium avium subsp. paratuberculosis
gcgccgcggcggcucgg

SEQ ID NO: 796246 - RNA, 13 nt, Mycobacterium avium subsp. paratuberculosis
gcgccgcggguga

SEQ ID NO: 796247 - RNA, 17 nt, Mycobacterium avium subsp. paratuberculosis
gcgccgcgggugcggca

SEQ ID NO: 796248 - RNA, 18 nt, Mycobacterium avium subsp. paratuberculosis
gcgccgcgguagcggacc

SEQ ID NO: 796249 - RNA, 18 nt, Mycobacterium avium subsp. paratuberculosis
gcgccgcggugcgccacg

SEQ ID NO: 796250 - RNA, 15 nt, Mycobacterium avium subsp. paratuberculosis
gcgccgcggcgaaaa

SEQ ID NO: 796251 - RNA, 14 nt, Mycobacterium avium subsp. paratuberculosis
gcgccgcggcgccc

SEQ ID NO: 796252 - RNA, 20 nt, Mycobacterium avium subsp. paratuberculosis
gcgccgcggcgcccucgccg

SEQ ID NO: 796253 - RNA, 16 nt, Mycobacterium avium subsp. paratuberculosis
gcgccgcggcgccgcc

SEQ ID NO: 796254 - RNA, 17 nt, Mycobacterium avium subsp. paratuberculosis
gcgccgcggccggugcc

SEQ ID NO: 796255 - RNA, 13 nt, Mycobacterium avium subsp. paratuberculosis
gcgccgcggccgu

SEQ ID NO: 796256 - RNA, 16 nt, Mycobacterium avium subsp. paratuberculosis
gcgccgcggccguugc

SEQ ID NO: 796257 - RNA, 12 nt, Mycobacterium avium subsp. paratuberculosis
gcgccgcggaug

SEQ ID NO: 796258 - RNA, 12 nt, Mycobacterium avium subsp. paratuberculosis
gcgccgcggcca

SEQ ID NO: 796259 - RNA, 14 nt, Mycobacterium avium subsp. paratuberculosis
gcgccgcggcccug

SEQ ID NO: 796260 - RNA, 22 nt, Mycobacterium avium subsp. paratuberculosis
gcgccgcggcccugcagcgccu

SEQ ID NO: 796261 - RNA, 14 nt, Mycobacterium avium subsp. paratuberculosis
gcgccgcugcgggc

SEQ ID NO: 796262 - RNA, 19 nt, Mycobacterium avium subsp. paratuberculosis
gcgccgcugcgggccaucg

SEQ ID NO: 796263 - RNA, 18 nt, Mycobacterium avium subsp. paratuberculosis
gcgccgcguugucggcgu

SEQ ID NO: 796264 - RNA, 18 nt, Mycobacterium avium subsp. paratuberculosis
gcgccgcucgucggccag

SEQ ID NO: 796265 - RNA, 16 nt, Mycobacterium avium subsp. paratuberculosis
gcgccgcugacugcga

SEQ ID NO: 796266 - RNA, 22 nt, Mycobacterium avium subsp. paratuberculosis
gcgccgcugacugcgaucgccg

SEQ ID NO: 796267 - RNA, 24 nt, Mycobacterium avium subsp. paratuberculosis
gcgccgcugacugcgaucgccgac

SEQ ID NO: 796268 - RNA, 22 nt, Mycobacterium avium subsp. paratuberculosis
gcgccgcucggaguucgcccgc

SEQ ID NO: 796269 - RNA, 12 nt, Mycobacterium avium subsp. paratuberculosis
gcgccgcucggc

SEQ ID NO: 796270 - RNA, 14 nt, Mycobacterium avium subsp. paratuberculosis
gcgccgcucggcca

SEQ ID NO: 796271 - RNA, 23 nt, Mycobacterium avium subsp. paratuberculosis
gcgccgcucggccagcagcacca

SEQ ID NO: 796272 - RNA, 14 nt, Mycobacterium avium subsp. paratuberculosis
gcgccgcguucggc

SEQ ID NO: 796273 - RNA, 17 nt, Mycobacterium avium subsp. paratuberculosis
gcgccgcguucggcggc

SEQ ID NO: 796274 - RNA, 18 nt, Mycobacterium avium subsp. paratuberculosis
gcgccgcguucacccgcg

SEQ ID NO: 796275 - RNA, 21 nt, Mycobacterium avium subsp. paratuberculosis
gcgccgcguaccagcgccacg

SEQ ID NO: 796276 - RNA, 22 nt, Mycobacterium avium subsp. paratuberculosis
gcgccgcguaggucuucgguga

SEQ ID NO: 796277 - RNA, 15 nt, Mycobacterium avium subsp. paratuberculosis
gcgccgcgucgacgc

SEQ ID NO: 796278 - RNA, 20 nt, Mycobacterium avium subsp. paratuberculosis
gcgccgcgucggaccccgau

SEQ ID NO: 796279 - RNA, 22 nt, Mycobacterium avium subsp. paratuberculosis
gcgccgcgucggaccccgaugc

SEQ ID NO: 796280 - RNA, 14 nt, Mycobacterium avium subsp. paratuberculosis
gcgccgcgucgucg

SEQ ID NO: 796281 - RNA, 15 nt, Mycobacterium avium subsp. paratuberculosis
gcgccgcgucgucgu

SEQ ID NO: 796282 - RNA, 19 nt, Mycobacterium avium subsp. paratuberculosis
gcgccgcgucgucgucgac

SEQ ID NO: 796283 - RNA, 20 nt, Mycobacterium avium subsp. paratuberculosis
gcgccaggcagaagcuccac

SEQ ID NO: 796284 - RNA, 16 nt, Mycobacterium avium subsp. paratuberculosis
gcgccaggcaggcggc

SEQ ID NO: 796285 - RNA, 17 nt, Mycobacterium avium subsp. paratuberculosis
gcgccaggcaggcggcc

SEQ ID NO: 796286 - RNA, 19 nt, Mycobacterium avium subsp. paratuberculosis
gcgccaggcaggcggccag

SEQ ID NO: 796287 - RNA, 15 nt, Mycobacterium avium subsp. paratuberculosis
gcgccaggauccgcc

SEQ ID NO: 796288 - RNA, 16 nt, Mycobacterium avium subsp. paratuberculosis
gcgccaggauccgccc

SEQ ID NO: 796289 - RNA, 16 nt, Mycobacterium avium subsp. paratuberculosis
gcgccaggaccagcgg

SEQ ID NO: 796290 - RNA, 19 nt, Mycobacterium avium subsp. paratuberculosis
gcgccagucgcggcgaacc

SEQ ID NO: 796291 - RNA, 22 nt, Mycobacterium avium subsp. paratuberculosis
gcgccaguaguggaucagccag

SEQ ID NO: 796292 - RNA, 17 nt, Mycobacterium avium subsp. paratuberculosis
gcgccaggccauggcgc

SEQ ID NO: 796293 - RNA, 22 nt, Mycobacterium avium subsp. paratuberculosis
gcgccaggccauggcgcaccgc

SEQ ID NO: 796294 - RNA, 23 nt, Mycobacterium avium subsp. paratuberculosis
gcgccaggccauggcgcaccgcg

SEQ ID NO: 796295 - RNA, 14 nt, Mycobacterium avium subsp. paratuberculosis
gcgccaggccggcg

SEQ ID NO: 796296 - RNA, 17 nt, Mycobacterium avium subsp. paratuberculosis
gcgccaggccggcgacg

SEQ ID NO: 796297 - RNA, 13 nt, Mycobacterium avium subsp. paratuberculosis
gcgccagcgcggu

SEQ ID NO: 796298 - RNA, 16 nt, Mycobacterium avium subsp. paratuberculosis
gcgccagcgcggugcc

SEQ ID NO: 796299 - RNA, 18 nt, Mycobacterium avium subsp. paratuberculosis
gcgccagcgcggugccca

SEQ ID NO: 796300 - RNA, 21 nt, Mycobacterium avium subsp. paratuberculosis
gcgccagcgcggugcccagcc

SEQ ID NO: 796301 - RNA, 12 nt, Mycobacterium avium subsp. paratuberculosis
gcgccagcgcgu

SEQ ID NO: 796302 - RNA, 16 nt, Mycobacterium avium subsp. paratuberculosis
gcgccagcgcgcccgc

SEQ ID NO: 796303 - RNA, 17 nt, Mycobacterium avium subsp. paratuberculosis
gcgccagcgcgcccgcc

SEQ ID NO: 796304 - RNA, 13 nt, Mycobacterium avium subsp. paratuberculosis
gcgccagcgccag

SEQ ID NO: 796305 - RNA, 16 nt, Mycobacterium avium subsp. paratuberculosis
gcgccagcgaccgcag

SEQ ID NO: 796306 - RNA, 16 nt, Mycobacterium avium subsp. paratuberculosis
gcgccagcgacggccg

SEQ ID NO: 796307 - RNA, 21 nt, Mycobacterium avium subsp. paratuberculosis
gcgccagccgccgccgaccac

SEQ ID NO: 796308 - RNA, 17 nt, Mycobacterium avium subsp. paratuberculosis
gcgccagccgucgccgc

SEQ ID NO: 796309 - RNA, 15 nt, Mycobacterium avium subsp. paratuberculosis
gcgccagcagcagcg

SEQ ID NO: 796310 - RNA, 16 nt, Mycobacterium avium subsp. paratuberculosis
gcgccagcagcagcgc

SEQ ID NO: 796311 - RNA, 12 nt, Mycobacterium avium subsp. paratuberculosis
gcgccagcagca

SEQ ID NO: 796312 - RNA, 17 nt, Mycobacterium avium subsp. paratuberculosis
gcgccagcacggccacc

SEQ ID NO: 796313 - RNA, 22 nt, Mycobacterium avium subsp. paratuberculosis
gcgccagcacggccaccagcag

SEQ ID NO: 796314 - RNA, 19 nt, Mycobacterium avium subsp. paratuberculosis
gcgccagacguccagcgcc

SEQ ID NO: 796315 - RNA, 21 nt, Mycobacterium avium subsp. paratuberculosis
gcgccagacguccagcgccgc

SEQ ID NO: 796316 - RNA, 15 nt, Mycobacterium avium subsp. paratuberculosis
gcgccacguggucga

SEQ ID NO: 796317 - RNA, 15 nt, Mycobacterium avium subsp. paratuberculosis
gcgccacuggcuggu

SEQ ID NO: 796318 - RNA, 17 nt, Mycobacterium avium subsp. paratuberculosis
gcgccacuggcugguca

SEQ ID NO: 796319 - RNA, 19 nt, Mycobacterium avium subsp. paratuberculosis
gcgccacuggcuggucacc

SEQ ID NO: 796320 - RNA, 20 nt, Mycobacterium avium subsp. paratuberculosis
gcgccacuggcuggucaccc

SEQ ID NO: 796321 - RNA, 18 nt, Mycobacterium avium subsp. paratuberculosis
gcgccacuucuccacgcc

SEQ ID NO: 796322 - RNA, 23 nt, Mycobacterium avium subsp. paratuberculosis
gcgccacuucuccacgccgacga

SEQ ID NO: 796323 - RNA, 21 nt, Mycobacterium avium subsp. paratuberculosis
gcgccagcaacacccagccgc

SEQ ID NO: 796324 - RNA, 18 nt, Mycobacterium avium subsp. paratuberculosis
gcgccagaucagcguggu

SEQ ID NO: 796325 - RNA, 19 nt, Mycobacterium avium subsp. paratuberculosis
gcgccagaucagcgugguc

SEQ ID NO: 796326 - RNA, 14 nt, Mycobacterium avium subsp. paratuberculosis
gcgccagagcgcga

SEQ ID NO: 796327 - RNA, 12 nt, Mycobacterium avium subsp. paratuberculosis
gcgccagcaccg

SEQ ID NO: 796328 - RNA, 13 nt, Mycobacterium avium subsp. paratuberculosis
gcgccagcaccgc

SEQ ID NO: 796329 - RNA, 14 nt, Mycobacterium avium subsp. paratuberculosis
gcgccagcaccgcc

SEQ ID NO: 796330 - RNA, 15 nt, Mycobacterium avium subsp. paratuberculosis
gcgccagcaccgccu

SEQ ID NO: 796331 - RNA, 14 nt, Mycobacterium avium subsp. paratuberculosis
gcgccagcaccggg

SEQ ID NO: 796332 - RNA, 15 nt, Mycobacterium avium subsp. paratuberculosis
gcgccagcaccgggc

SEQ ID NO: 796333 - RNA, 19 nt, Mycobacterium avium subsp. paratuberculosis
gcgccagcaccgggcccag

SEQ ID NO: 796334 - RNA, 13 nt, Mycobacterium avium subsp. paratuberculosis
gcgccagcaccuc

SEQ ID NO: 796335 - RNA, 14 nt, Mycobacterium avium subsp. paratuberculosis
gcgccagcaccucg

SEQ ID NO: 796336 - RNA, 21 nt, Mycobacterium avium subsp. paratuberculosis
gcgccagcaccucgaacgccg

SEQ ID NO: 796337 - RNA, 16 nt, Mycobacterium avium subsp. paratuberculosis
gcgccagcaccucggc

SEQ ID NO: 796338 - RNA, 17 nt, Mycobacterium avium subsp. paratuberculosis
gcgcaucuugaucucgc

SEQ ID NO: 796339 - RNA, 19 nt, Mycobacterium avium subsp. paratuberculosis
gcgccacgcucaugcccgc

SEQ ID NO: 796340 - RNA, 17 nt, Mycobacterium avium subsp. paratuberculosis
gcgccacgcuggcguga

SEQ ID NO: 796341 - RNA, 17 nt, Mycobacterium avium subsp. paratuberculosis
gcgcaucggcgacgccg

SEQ ID NO: 796342 - RNA, 18 nt, Mycobacterium avium subsp. paratuberculosis
gcgcaucggcgacgccgc

SEQ ID NO: 796343 - RNA, 19 nt, Mycobacterium avium subsp. paratuberculosis
gcgcaucggcgacgccgcc

SEQ ID NO: 796344 - RNA, 20 nt, Mycobacterium avium subsp. paratuberculosis
gcgcaucggcgacgccgccg

SEQ ID NO: 796345 - RNA, 13 nt, Mycobacterium avium subsp. paratuberculosis
gcgcaucggucac

SEQ ID NO: 796346 - RNA, 18 nt, Mycobacterium avium subsp. paratuberculosis
gcgcaucggucaccagcu

SEQ ID NO: 796347 - RNA, 17 nt, Mycobacterium avium subsp. paratuberculosis
gcgcaucguugccggcg

SEQ ID NO: 796348 - RNA, 18 nt, Mycobacterium avium subsp. paratuberculosis
gcgcaucguugccggcgg

SEQ ID NO: 796349 - RNA, 14 nt, Mycobacterium avium subsp. paratuberculosis
gcgcaucugcucgg

SEQ ID NO: 796350 - RNA, 16 nt, Mycobacterium avium subsp. paratuberculosis
gcgcaucugcucggcg

SEQ ID NO: 796351 - RNA, 19 nt, Mycobacterium avium subsp. paratuberculosis
gcgcaucugcucggcgucc

SEQ ID NO: 796352 - RNA, 21 nt, Mycobacterium avium subsp. paratuberculosis
gcgcaucugcucggcguccag

SEQ ID NO: 796353 - RNA, 19 nt, Mycobacterium avium subsp. paratuberculosis
gcgcccagcgagcugccgg

SEQ ID NO: 796354 - RNA, 17 nt, Mycobacterium avium subsp. paratuberculosis
gcgcccagcgucucggc

SEQ ID NO: 796355 - RNA, 19 nt, Mycobacterium avium subsp. paratuberculosis
gcgcccagcgucucggcgg

SEQ ID NO: 796356 - RNA, 21 nt, Mycobacterium avium subsp. paratuberculosis
gcgcccagcgucucggcggcc

SEQ ID NO: 796357 - RNA, 22 nt, Mycobacterium avium subsp. paratuberculosis
gcgcccagcgucucggcggccg

SEQ ID NO: 796358 - RNA, 22 nt, Mycobacterium avium subsp. paratuberculosis
gcgcccagcguggucacccgca

SEQ ID NO: 796359 - RNA, 13 nt, Mycobacterium avium subsp. paratuberculosis
gcgcccagcgcgc

SEQ ID NO: 796360 - RNA, 24 nt, Mycobacterium avium subsp. paratuberculosis
gcgcccagcgcgcgaucgccggug

SEQ ID NO: 796361 - RNA, 14 nt, Mycobacterium avium subsp. paratuberculosis
gcgcccagcggcga

SEQ ID NO: 796362 - RNA, 18 nt, Mycobacterium avium subsp. paratuberculosis
gcgcccagcggcgaugcc

SEQ ID NO: 796363 - RNA, 18 nt, Mycobacterium avium subsp. paratuberculosis
gcgcccaggaacgcgccg

SEQ ID NO: 796364 - RNA, 18 nt, Mycobacterium avium subsp. paratuberculosis
gcgcccaggaugacgccg

SEQ ID NO: 796365 - RNA, 22 nt, Mycobacterium avium subsp. paratuberculosis
gcgcccaggauucucagcagcg

SEQ ID NO: 796366 - RNA, 13 nt, Mycobacterium avium subsp. paratuberculosis
gcgcccauccggc

SEQ ID NO: 796367 - RNA, 14 nt, Mycobacterium avium subsp. paratuberculosis
gcgcccauccggcg

SEQ ID NO: 796368 - RNA, 19 nt, Mycobacterium avium subsp. paratuberculosis
gcgcccaugaacgcgucgc

SEQ ID NO: 796369 - RNA, 22 nt, Mycobacterium avium subsp. paratuberculosis
gcgcccagguacuccucggugu

SEQ ID NO: 796370 - RNA, 20 nt, Mycobacterium avium subsp. paratuberculosis
gcgcccaggcugaacaccac

SEQ ID NO: 796371 - RNA, 21 nt, Mycobacterium avium subsp. paratuberculosis
gcgcccgacauccaggaccgc

SEQ ID NO: 796372 - RNA, 19 nt, Mycobacterium avium subsp. paratuberculosis
gcgcccgacgaugcggggc

SEQ ID NO: 796373 - RNA, 13 nt, Mycobacterium avium subsp. paratuberculosis
gcgcccgacgccg

SEQ ID NO: 796374 - RNA, 15 nt, Mycobacterium avium subsp. paratuberculosis
gcgcccgacgccgga

SEQ ID NO: 796375 - RNA, 13 nt, Mycobacterium avium subsp. paratuberculosis
gcgcccccagcgg

SEQ ID NO: 796376 - RNA, 15 nt, Mycobacterium avium subsp. paratuberculosis
gcgcccccagcgggg

SEQ ID NO: 796377 - RNA, 13 nt, Mycobacterium avium subsp. paratuberculosis
gcgcccccgagga

SEQ ID NO: 796378 - RNA, 15 nt, Mycobacterium avium subsp. paratuberculosis
gcgcccgaucggcac

SEQ ID NO: 796379 - RNA, 18 nt, Mycobacterium avium subsp. paratuberculosis
gcgcccgaucggcacccg

SEQ ID NO: 796380 - RNA, 19 nt, Mycobacterium avium subsp. paratuberculosis
gcgcccgaucggcacccgc

SEQ ID NO: 796381 - RNA, 20 nt, Mycobacterium avium subsp. paratuberculosis
gcgcccgaucggcacccgca

SEQ ID NO: 796382 - RNA, 16 nt, Mycobacterium avium subsp. paratuberculosis
gcgcccgaucggcgug

SEQ ID NO: 796383 - RNA, 12 nt, Mycobacterium avium subsp. paratuberculosis
gcgcccgagccg

SEQ ID NO: 796384 - RNA, 19 nt, Mycobacterium avium subsp. paratuberculosis
gcgcccgagccgcacaaca

SEQ ID NO: 796385 - RNA, 18 nt, Mycobacterium avium subsp. paratuberculosis
gcgcccgacggucgccac

SEQ ID NO: 796386 - RNA, 20 nt, Mycobacterium avium subsp. paratuberculosis
gcgcccgacggucgccacca

SEQ ID NO: 796387 - RNA, 19 nt, Mycobacterium avium subsp. paratuberculosis
gcgccccagugcaggcagg

SEQ ID NO: 796388 - RNA, 22 nt, Mycobacterium avium subsp. paratuberculosis
gcgccccagugcaggcaggccc

SEQ ID NO: 796389 - RNA, 13 nt, Mycobacterium avium subsp. paratuberculosis
gcgccccagacgu

SEQ ID NO: 796390 - RNA, 17 nt, Mycobacterium avium subsp. paratuberculosis
gcgccccagcuccucgg

SEQ ID NO: 796391 - RNA, 20 nt, Mycobacterium avium subsp. paratuberculosis
gcgccccagggccucggcga

SEQ ID NO: 796392 - RNA, 13 nt, Mycobacterium avium subsp. paratuberculosis
gcgccccaacggu

SEQ ID NO: 796393 - RNA, 13 nt, Mycobacterium avium subsp. paratuberculosis
gcgccccacgccu

SEQ ID NO: 796394 - RNA, 13 nt, Mycobacterium avium subsp. paratuberculosis
gcgccccacggcg

SEQ ID NO: 796395 - RNA, 14 nt, Mycobacterium avium subsp. paratuberculosis
gcgccccacggcgc

SEQ ID NO: 796396 - RNA, 22 nt, Mycobacterium avium subsp. paratuberculosis
gcgccccacggucuuugccggc

SEQ ID NO: 796397 - RNA, 19 nt, Mycobacterium avium subsp. paratuberculosis
gcgccaguugcucggguga

SEQ ID NO: 796398 - RNA, 22 nt, Mycobacterium avium subsp. paratuberculosis
gcgccagugggggaauggcggu

SEQ ID NO: 796399 - RNA, 16 nt, Mycobacterium avium subsp. paratuberculosis
gcgccauugucggauc

SEQ ID NO: 796400 - RNA, 14 nt, Mycobacterium avium subsp. paratuberculosis
gcgcccacggccac

SEQ ID NO: 796401 - RNA, 18 nt, Mycobacterium avium subsp. paratuberculosis
gcgcccagcacgucaccg

SEQ ID NO: 796402 - RNA, 18 nt, Mycobacterium avium subsp. paratuberculosis
gcgcccagaucggccagc

SEQ ID NO: 796403 - RNA, 19 nt, Mycobacterium avium subsp. paratuberculosis
gcgcccagaugccgccgcc

SEQ ID NO: 796404 - RNA, 20 nt, Mycobacterium avium subsp. paratuberculosis
gcgcccagaugccgccgcca

SEQ ID NO: 796405 - RNA, 22 nt, Mycobacterium avium subsp. paratuberculosis
gcgcccagaugccgccgccagc

SEQ ID NO: 796406 - RNA, 13 nt, Mycobacterium avium subsp. paratuberculosis
gcgcccagcccga

SEQ ID NO: 796407 - RNA, 20 nt, Mycobacterium avium subsp. paratuberculosis
gcgcccagcccgagcaccag

SEQ ID NO: 796408 - RNA, 21 nt, Mycobacterium avium subsp. paratuberculosis
gcgcccagcccgagcaccagc

SEQ ID NO: 796409 - RNA, 14 nt, Mycobacterium avium subsp. paratuberculosis
gcgcccagccgagc

SEQ ID NO: 796410 - RNA, 13 nt, Mycobacterium avium subsp. paratuberculosis
gcgcccagcccca

SEQ ID NO: 796411 - RNA, 17 nt, Mycobacterium avium subsp. paratuberculosis
gcgcccagccccagcac

SEQ ID NO: 796412 - RNA, 17 nt, Mycobacterium avium subsp. paratuberculosis
gcgcccacaguccgccc

SEQ ID NO: 796413 - RNA, 18 nt, Mycobacterium avium subsp. paratuberculosis
gcgcccacaguccgccca

SEQ ID NO: 796414 - RNA, 16 nt, Mycobacterium avium subsp. paratuberculosis
gcgcccacccgcgcac

SEQ ID NO: 796415 - RNA, 22 nt, Mycobacterium avium subsp. paratuberculosis
gcgcccacccgcgcacgcucgc

SEQ ID NO: 796416 - RNA, 18 nt, Mycobacterium avium subsp. paratuberculosis
gcgcccacccguuggcag

SEQ ID NO: 796417 - RNA, 11 nt, Mycobacterium avium subsp. paratuberculosis
gcgcccaccgc

SEQ ID NO: 796418 - RNA, 13 nt, Mycobacterium avium subsp. paratuberculosis
gcgcccaccgcgg

SEQ ID NO: 796419 - RNA, 16 nt, Mycobacterium avium subsp. paratuberculosis
gcgcccaccgcggcgc

SEQ ID NO: 796420 - RNA, 22 nt, Mycobacterium avium subsp. paratuberculosis
gcgcccaccgcggcgcgcggcc

SEQ ID NO: 796421 - RNA, 15 nt, Mycobacterium avium subsp. paratuberculosis
gcgcccaccgcucgu

SEQ ID NO: 796422 - RNA, 16 nt, Mycobacterium avium subsp. paratuberculosis
gcgcccaccgcucguc

SEQ ID NO: 796423 - RNA, 20 nt, Mycobacterium avium subsp. paratuberculosis
gcgcccaccgcucgucgggc

SEQ ID NO: 796424 - RNA, 13 nt, Mycobacterium avium subsp. paratuberculosis
gcuaaucgccgcg

SEQ ID NO: 796425 - RNA, 15 nt, Mycobacterium avium subsp. paratuberculosis
gcuaaucgccgcgcg

SEQ ID NO: 796426 - RNA, 21 nt, Mycobacterium avium subsp. paratuberculosis
gcuaauucgggccgccgcgcg

SEQ ID NO: 796427 - RNA, 21 nt, Mycobacterium avium subsp. paratuberculosis
gcuacaaaaccaagaccgcgg

SEQ ID NO: 796428 - RNA, 17 nt, Mycobacterium avium subsp. paratuberculosis
gcuaccagccccaggag

SEQ ID NO: 796429 - RNA, 15 nt, Mycobacterium avium subsp. paratuberculosis
gcuccauggcggcga

SEQ ID NO: 796430 - RNA, 15 nt, Mycobacterium avium subsp. paratuberculosis
gcucccccgacaccg

SEQ ID NO: 796431 - RNA, 18 nt, Mycobacterium avium subsp. paratuberculosis
gcucccccgacaccgcca

SEQ ID NO: 796432 - RNA, 19 nt, Mycobacterium avium subsp. paratuberculosis
gcucccccgacaccgccag

SEQ ID NO: 796433 - RNA, 17 nt, Mycobacterium avium subsp. paratuberculosis
gcucccccggcgugagc

SEQ ID NO: 796434 - RNA, 18 nt, Mycobacterium avium subsp. paratuberculosis
gcucccccggcgugagcg

SEQ ID NO: 796435 - RNA, 15 nt, Mycobacterium avium subsp. paratuberculosis
gcucccccgucgggc

SEQ ID NO: 796436 - RNA, 18 nt, Mycobacterium avium subsp. paratuberculosis
gcucccccgucgggccgu

SEQ ID NO: 796437 - RNA, 18 nt, Mycobacterium avium subsp. paratuberculosis
gcucccaggacgcgguga

SEQ ID NO: 796438 - RNA, 19 nt, Mycobacterium avium subsp. paratuberculosis
gcucccaggacggcgcggu

SEQ ID NO: 796439 - RNA, 12 nt, Mycobacterium avium subsp. paratuberculosis
gcucccaggccc

SEQ ID NO: 796440 - RNA, 24 nt, Mycobacterium avium subsp. paratuberculosis
gcucccaggcccaucgcggucagc

SEQ ID NO: 796441 - RNA, 15 nt, Mycobacterium avium subsp. paratuberculosis
gcucccaggcgucgu

SEQ ID NO: 796442 - RNA, 15 nt, Mycobacterium avium subsp. paratuberculosis
gcucccagucccagc

SEQ ID NO: 796443 - RNA, 17 nt, Mycobacterium avium subsp. paratuberculosis
gcuccgcgggcagcgag

SEQ ID NO: 796444 - RNA, 16 nt, Mycobacterium avium subsp. paratuberculosis
gcuccgcggugcugca

SEQ ID NO: 796445 - RNA, 22 nt, Mycobacterium avium subsp. paratuberculosis
gcuccgcggugcugcagcgcga

SEQ ID NO: 796446 - RNA, 20 nt, Mycobacterium avium subsp. paratuberculosis
gcuccgcguucgaccuccac

SEQ ID NO: 796447 - RNA, 15 nt, Mycobacterium avium subsp. paratuberculosis
gcuccgccgacacca

SEQ ID NO: 796448 - RNA, 20 nt, Mycobacterium avium subsp. paratuberculosis
gcuccgcgcugaccagcgug

SEQ ID NO: 796449 - RNA, 17 nt, Mycobacterium avium subsp. paratuberculosis
gcuccgcggccagcucg

SEQ ID NO: 796450 - RNA, 18 nt, Mycobacterium avium subsp. paratuberculosis
gcuccgcggccagcucgg

SEQ ID NO: 796451 - RNA, 20 nt, Mycobacterium avium subsp. paratuberculosis
gcuccggcccgagcaccacc

SEQ ID NO: 796452 - RNA, 18 nt, Mycobacterium avium subsp. paratuberculosis
gcuccggccgcgccggcc

SEQ ID NO: 796453 - RNA, 12 nt, Mycobacterium avium subsp. paratuberculosis
gcuccggcgucg

SEQ ID NO: 796454 - RNA, 13 nt, Mycobacterium avium subsp. paratuberculosis
gcuccggcgucga

SEQ ID NO: 796455 - RNA, 13 nt, Mycobacterium avium subsp. paratuberculosis
gcuccggcggacc

SEQ ID NO: 796456 - RNA, 15 nt, Mycobacterium avium subsp. paratuberculosis
gcuccggcggaccca

SEQ ID NO: 796457 - RNA, 19 nt, Mycobacterium avium subsp. paratuberculosis
gcuccggcggacccagcuc

SEQ ID NO: 796458 - RNA, 19 nt, Mycobacterium avium subsp. paratuberculosis
gcuccgacgcgguggcgug

SEQ ID NO: 796459 - RNA, 12 nt, Mycobacterium avium subsp. paratuberculosis
gcuccgagcgga

SEQ ID NO: 796460 - RNA, 19 nt, Mycobacterium avium subsp. paratuberculosis
gcuccgcaugcccgggcga

SEQ ID NO: 796461 - RNA, 14 nt, Mycobacterium avium subsp. paratuberculosis
gcuccgccacccug

SEQ ID NO: 796462 - RNA, 20 nt, Mycobacterium avium subsp. paratuberculosis
gcucccggcagaucgcggcc

SEQ ID NO: 796463 - RNA, 23 nt, Mycobacterium avium subsp. paratuberculosis
gcucccggcagaucgcggcccgc

SEQ ID NO: 796464 - RNA, 14 nt, Mycobacterium avium subsp. paratuberculosis
gcucccgccgagau

SEQ ID NO: 796465 - RNA, 21 nt, Mycobacterium avium subsp. paratuberculosis
gcuccccgagcacgucgagca

SEQ ID NO: 796466 - RNA, 21 nt, Mycobacterium avium subsp. paratuberculosis
gcuccccguugaucuugaccg

SEQ ID NO: 796467 - RNA, 14 nt, Mycobacterium avium subsp. paratuberculosis
gcucccgagcaucg

SEQ ID NO: 796468 - RNA, 20 nt, Mycobacterium avium subsp. paratuberculosis
gcucccgcucgccaugcgac

SEQ ID NO: 796469 - RNA, 14 nt, Mycobacterium avium subsp. paratuberculosis
gcucccggcgcagc

SEQ ID NO: 796470 - RNA, 15 nt, Mycobacterium avium subsp. paratuberculosis
gcucccggcgcagca

SEQ ID NO: 796471 - RNA, 16 nt, Mycobacterium avium subsp. paratuberculosis
gcucccggcgccgccg

SEQ ID NO: 796472 - RNA, 22 nt, Mycobacterium avium subsp. paratuberculosis
gcucccgguagagcggcaccag

SEQ ID NO: 796473 - RNA, 22 nt, Mycobacterium avium subsp. paratuberculosis
gcucccggucguagucggcccg

SEQ ID NO: 796474 - RNA, 23 nt, Mycobacterium avium subsp. paratuberculosis
gcucccggucguagucggcccgc

SEQ ID NO: 796475 - RNA, 17 nt, Mycobacterium avium subsp. paratuberculosis
gcucgaaggugaccauc

SEQ ID NO: 796476 - RNA, 16 nt, Mycobacterium avium subsp. paratuberculosis
gcucgaaggugcccgc

SEQ ID NO: 796477 - RNA, 20 nt, Mycobacterium avium subsp. paratuberculosis
gcucgaagcuuucggugcgc

SEQ ID NO: 796478 - RNA, 15 nt, Mycobacterium avium subsp. paratuberculosis
gcucgaacucaccgg

SEQ ID NO: 796479 - RNA, 20 nt, Mycobacterium avium subsp. paratuberculosis
gcucgaacucaccgguggcc

SEQ ID NO: 796480 - RNA, 23 nt, Mycobacterium avium subsp. paratuberculosis
gcucgaacucaccgguggccgcg

SEQ ID NO: 796481 - RNA, 13 nt, Mycobacterium avium subsp. paratuberculosis
gcucgaaccgcga

SEQ ID NO: 796482 - RNA, 14 nt, Mycobacterium avium subsp. paratuberculosis
gcucgaaccgcgag

SEQ ID NO: 796483 - RNA, 22 nt, Mycobacterium avium subsp. paratuberculosis
gcucgacaacugcccaaugauc

SEQ ID NO: 796484 - RNA, 15 nt, Mycobacterium avium subsp. paratuberculosis
gcucgacaggcagcc

SEQ ID NO: 796485 - RNA, 19 nt, Mycobacterium avium subsp. paratuberculosis
gcucgacaggcagcccggc

SEQ ID NO: 796486 - RNA, 13 nt, Mycobacterium avium subsp. paratuberculosis
gcucgaccgcggc

SEQ ID NO: 796487 - RNA, 15 nt, Mycobacterium avium subsp. paratuberculosis
gcucgaccgcggcga

SEQ ID NO: 796488 - RNA, 16 nt, Mycobacterium avium subsp. paratuberculosis
gcucgaccagauugcg

SEQ ID NO: 796489 - RNA, 17 nt, Mycobacterium avium subsp. paratuberculosis
gcucgaccagcccccgc

SEQ ID NO: 796490 - RNA, 13 nt, Mycobacterium avium subsp. paratuberculosis
gcucgaccagccg

SEQ ID NO: 796491 - RNA, 13 nt, Mycobacterium avium subsp. paratuberculosis
gcucgaccagcgc

SEQ ID NO: 796492 - RNA, 17 nt, Mycobacterium avium subsp. paratuberculosis
gcucgagcaacaccacc

SEQ ID NO: 796493 - RNA, 17 nt, Mycobacterium avium subsp. paratuberculosis
gcucgagcacaucggcg

SEQ ID NO: 796494 - RNA, 14 nt, Mycobacterium avium subsp. paratuberculosis
gcucgacgcgucga

SEQ ID NO: 796495 - RNA, 14 nt, Mycobacterium avium subsp. paratuberculosis
gcucgagcaucacg

SEQ ID NO: 796496 - RNA, 16 nt, Mycobacterium avium subsp. paratuberculosis
gcucgagcaucacgaa

SEQ ID NO: 796497 - RNA, 19 nt, Mycobacterium avium subsp. paratuberculosis
gcucgagcaucuccagccg

SEQ ID NO: 796498 - RNA, 18 nt, Mycobacterium avium subsp. paratuberculosis
gcucgagcaucucggugc

SEQ ID NO: 796499 - RNA, 22 nt, Mycobacterium avium subsp. paratuberculosis
gcucgagcaucucggugccguc

SEQ ID NO: 796500 - RNA, 14 nt, Mycobacterium avium subsp. paratuberculosis
gcucgacggcaccc

SEQ ID NO: 796501 - RNA, 17 nt, Mycobacterium avium subsp. paratuberculosis
gcucgacggcacccggc

SEQ ID NO: 796502 - RNA, 17 nt, Mycobacterium avium subsp. paratuberculosis
gcucgacggccggcguc

SEQ ID NO: 796503 - RNA, 14 nt, Mycobacterium avium subsp. paratuberculosis
gcucgacguagucg

SEQ ID NO: 796504 - RNA, 20 nt, Mycobacterium avium subsp. paratuberculosis
gcucgacgaugucgacgccc

SEQ ID NO: 796505 - RNA, 17 nt, Mycobacterium avium subsp. paratuberculosis
gcucgacgaccucgccg

SEQ ID NO: 796506 - RNA, 14 nt, Mycobacterium avium subsp. paratuberculosis
gcucgaccucggcg

SEQ ID NO: 796507 - RNA, 15 nt, Mycobacterium avium subsp. paratuberculosis
gcucgaccucggcga

SEQ ID NO: 796508 - RNA, 19 nt, Mycobacterium avium subsp. paratuberculosis
gcucgaccucggcgaccag

SEQ ID NO: 796509 - RNA, 19 nt, Mycobacterium avium subsp. paratuberculosis
gcucgaccucggcggccag

SEQ ID NO: 796510 - RNA, 23 nt, Mycobacterium avium subsp. paratuberculosis
gcucgaccucggcggccagcgcg

SEQ ID NO: 796511 - RNA, 14 nt, Mycobacterium avium subsp. paratuberculosis
gcucgacgacuucg

SEQ ID NO: 796512 - RNA, 15 nt, Mycobacterium avium subsp. paratuberculosis
gcucgacgacuucgg

SEQ ID NO: 796513 - RNA, 16 nt, Mycobacterium avium subsp. paratuberculosis
gcucgacgacuucggc

SEQ ID NO: 796514 - RNA, 14 nt, Mycobacterium avium subsp. paratuberculosis
gcuccguccaccgg

SEQ ID NO: 796515 - RNA, 16 nt, Mycobacterium avium subsp. paratuberculosis
gcuccguccaccggca

SEQ ID NO: 796516 - RNA, 18 nt, Mycobacterium avium subsp. paratuberculosis
gcuccgggggcaccgcca

SEQ ID NO: 796517 - RNA, 15 nt, Mycobacterium avium subsp. paratuberculosis
gcuccgggguggccu

SEQ ID NO: 796518 - RNA, 16 nt, Mycobacterium avium subsp. paratuberculosis
gcuccgggucgaccgc

SEQ ID NO: 796519 - RNA, 17 nt, Mycobacterium avium subsp. paratuberculosis
gcuccggucgcgucgug

SEQ ID NO: 796520 - RNA, 13 nt, Mycobacterium avium subsp. paratuberculosis
gcuccggucggcg

SEQ ID NO: 796521 - RNA, 17 nt, Mycobacterium avium subsp. paratuberculosis
gcuccggugaaccgcug

SEQ ID NO: 796522 - RNA, 20 nt, Mycobacterium avium subsp. paratuberculosis
gcuccgucuuguuggucagc

SEQ ID NO: 796523 - RNA, 22 nt, Mycobacterium avium subsp. paratuberculosis
gcuccguugggucucaucccgc

SEQ ID NO: 796524 - RNA, 22 nt, Mycobacterium avium subsp. paratuberculosis
gcuccuccggguccccgccgcc

SEQ ID NO: 796525 - RNA, 13 nt, Mycobacterium avium subsp. paratuberculosis
gcuccuccucgcg

SEQ ID NO: 796526 - RNA, 20 nt, Mycobacterium avium subsp. paratuberculosis
gcuccuccucgcgccgccac

SEQ ID NO: 796527 - RNA, 13 nt, Mycobacterium avium subsp. paratuberculosis
gcuccuccugcgg

SEQ ID NO: 796528 - RNA, 17 nt, Mycobacterium avium subsp. paratuberculosis
gcuccucgaaccucgcg

SEQ ID NO: 796529 - RNA, 22 nt, Mycobacterium avium subsp. paratuberculosis
gcuccucgaaccucgcggcggc

SEQ ID NO: 796530 - RNA, 21 nt, Mycobacterium avium subsp. paratuberculosis
gcuccuugagccgccgcggca

SEQ ID NO: 796531 - RNA, 22 nt, Mycobacterium avium subsp. paratuberculosis
gcucgaaaugccuuggcggcgu

SEQ ID NO: 796532 - RNA, 23 nt, Mycobacterium avium subsp. paratuberculosis
gcucgaaaugccuuggcggcgug

SEQ ID NO: 796533 - RNA, 18 nt, Mycobacterium avium subsp. paratuberculosis
gcucgaacaacccggccg

SEQ ID NO: 796534 - RNA, 22 nt, Mycobacterium avium subsp. paratuberculosis
gcucgaacaacccggccgcgau

SEQ ID NO: 796535 - RNA, 19 nt, Mycobacterium avium subsp. paratuberculosis
gcucgaacacccggcuucg

SEQ ID NO: 796536 - RNA, 15 nt, Mycobacterium avium subsp. paratuberculosis
gcucgaacaccgucg

SEQ ID NO: 796537 - RNA, 16 nt, Mycobacterium avium subsp. paratuberculosis
gcucgaacaccgucga

SEQ ID NO: 796538 - RNA, 19 nt, Mycobacterium avium subsp. paratuberculosis
gcucgaacaccgucgagga

SEQ ID NO: 796539 - RNA, 16 nt, Mycobacterium avium subsp. paratuberculosis
gcuccugccguucggc

SEQ ID NO: 796540 - RNA, 20 nt, Mycobacterium avium subsp. paratuberculosis
gcuccugcaggccgagccgc

SEQ ID NO: 796541 - RNA, 21 nt, Mycobacterium avium subsp. paratuberculosis
gcuccugcaggccgagccgcc

SEQ ID NO: 796542 - RNA, 15 nt, Mycobacterium avium subsp. paratuberculosis
gcuccugccagcggc

SEQ ID NO: 796543 - RNA, 16 nt, Mycobacterium avium subsp. paratuberculosis
gcuccucggccagcgg

SEQ ID NO: 796544 - RNA, 17 nt, Mycobacterium avium subsp. paratuberculosis
gcuccucggccagcggu

SEQ ID NO: 796545 - RNA, 12 nt, Mycobacterium avium subsp. paratuberculosis
gcuccucggccc

SEQ ID NO: 796546 - RNA, 16 nt, Mycobacterium avium subsp. paratuberculosis
gcuccucggcggccuc

SEQ ID NO: 796547 - RNA, 18 nt, Mycobacterium avium subsp. paratuberculosis
gcuccucggucagcggcg

SEQ ID NO: 796548 - RNA, 23 nt, Mycobacterium avium subsp. paratuberculosis
gcuccucggucagcucgggguag

SEQ ID NO: 796549 - RNA, 11 nt, Mycobacterium avium subsp. paratuberculosis
gcuccucggug

SEQ ID NO: 796550 - RNA, 13 nt, Mycobacterium avium subsp. paratuberculosis
gcuccucggccag

SEQ ID NO: 796551 - RNA, 12 nt, Mycobacterium avium subsp. paratuberculosis
gcuccugcaggc

SEQ ID NO: 796552 - RNA, 16 nt, Mycobacterium avium subsp. paratuberculosis
gcucgcaggcgagccg

SEQ ID NO: 796553 - RNA, 17 nt, Mycobacterium avium subsp. paratuberculosis
gcucgauguaccaggcc

SEQ ID NO: 796554 - RNA, 19 nt, Mycobacterium avium subsp. paratuberculosis
gcucgauguugaucgccau

SEQ ID NO: 796555 - RNA, 20 nt, Mycobacterium avium subsp. paratuberculosis
gcucgcacaacccgcccggg

SEQ ID NO: 796556 - RNA, 21 nt, Mycobacterium avium subsp. paratuberculosis
gcucgcacaacccgcccgggu

SEQ ID NO: 796557 - RNA, 14 nt, Mycobacterium avium subsp. paratuberculosis
gcucgcaccagcgc

SEQ ID NO: 796558 - RNA, 17 nt, Mycobacterium avium subsp. paratuberculosis
gcucgaugcgcaccugc

SEQ ID NO: 796559 - RNA, 16 nt, Mycobacterium avium subsp. paratuberculosis
gcucgauggugccguc

SEQ ID NO: 796560 - RNA, 19 nt, Mycobacterium avium subsp. paratuberculosis
gcucgauggugccgucggc

SEQ ID NO: 796561 - RNA, 20 nt, Mycobacterium avium subsp. paratuberculosis
gcucgauggugccgucggcg

SEQ ID NO: 796562 - RNA, 20 nt, Mycobacterium avium subsp. paratuberculosis
gcucgaugcgacgcaccucg

SEQ ID NO: 796563 - RNA, 22 nt, Mycobacterium avium subsp. paratuberculosis
gcucgaugcgacgcaccucggc

SEQ ID NO: 796564 - RNA, 20 nt, Mycobacterium avium subsp. paratuberculosis
gcucgauggcgccgaucgcg

SEQ ID NO: 796565 - RNA, 16 nt, Mycobacterium avium subsp. paratuberculosis
gcucgaugcgcgccag

SEQ ID NO: 796566 - RNA, 17 nt, Mycobacterium avium subsp. paratuberculosis
gcucgaugcgcgccagc

SEQ ID NO: 796567 - RNA, 18 nt, Mycobacterium avium subsp. paratuberculosis
gcucgaugcgcgccagca

SEQ ID NO: 796568 - RNA, 22 nt, Mycobacterium avium subsp. paratuberculosis
gcucgauggaauucgucggcgg

SEQ ID NO: 796569 - RNA, 23 nt, Mycobacterium avium subsp. paratuberculosis
gcucgauggaauucgucggcggu

SEQ ID NO: 796570 - RNA, 21 nt, Mycobacterium avium subsp. paratuberculosis
gcucgauggaccggguggugg

SEQ ID NO: 796571 - RNA, 16 nt, Mycobacterium avium subsp. paratuberculosis
gcucgauggccagcgc

SEQ ID NO: 796572 - RNA, 17 nt, Mycobacterium avium subsp. paratuberculosis
gcucgauggccagcgcg

SEQ ID NO: 796573 - RNA, 16 nt, Mycobacterium avium subsp. paratuberculosis
gcucgaugccguucgc

SEQ ID NO: 796574 - RNA, 15 nt, Mycobacterium avium subsp. paratuberculosis
gcucgaucucggcca

SEQ ID NO: 796575 - RNA, 17 nt, Mycobacterium avium subsp. paratuberculosis
gcucgaucucggccacc

SEQ ID NO: 796576 - RNA, 15 nt, Mycobacterium avium subsp. paratuberculosis
gcucgaucugcuccg

SEQ ID NO: 796577 - RNA, 19 nt, Mycobacterium avium subsp. paratuberculosis
gcucgaucugcuccggggu

SEQ ID NO: 796578 - RNA, 14 nt, Mycobacterium avium subsp. paratuberculosis
gcucgaucuggcgg

SEQ ID NO: 796579 - RNA, 16 nt, Mycobacterium avium subsp. paratuberculosis
gcucgaucggcgcgcc

SEQ ID NO: 796580 - RNA, 18 nt, Mycobacterium avium subsp. paratuberculosis
gcucgaucggcgcgccga

SEQ ID NO: 796581 - RNA, 14 nt, Mycobacterium avium subsp. paratuberculosis
gcucgaucgccgcg

SEQ ID NO: 796582 - RNA, 17 nt, Mycobacterium avium subsp. paratuberculosis
gcucgaucgcguucugc

SEQ ID NO: 796583 - RNA, 15 nt, Mycobacterium avium subsp. paratuberculosis
gcucgaggccgcggg

SEQ ID NO: 796584 - RNA, 14 nt, Mycobacterium avium subsp. paratuberculosis
gcucgaggccccgc

SEQ ID NO: 796585 - RNA, 19 nt, Mycobacterium avium subsp. paratuberculosis
gcucgagggcggcgaccug

SEQ ID NO: 796586 - RNA, 21 nt, Mycobacterium avium subsp. paratuberculosis
gcucgagggccuccaccacca

SEQ ID NO: 796587 - RNA, 13 nt, Mycobacterium avium subsp. paratuberculosis
gcucgagcucggc

SEQ ID NO: 796588 - RNA, 16 nt, Mycobacterium avium subsp. paratuberculosis
gcucgagcucggcgag

SEQ ID NO: 796589 - RNA, 15 nt, Mycobacterium avium subsp. paratuberculosis
gcucgccgauccgcg

SEQ ID NO: 796590 - RNA, 19 nt, Mycobacterium avium subsp. paratuberculosis
gcucgccgaucuggcgcag

SEQ ID NO: 796591 - RNA, 15 nt, Mycobacterium avium subsp. paratuberculosis
gcucgccgaugucgg

SEQ ID NO: 796592 - RNA, 20 nt, Mycobacterium avium subsp. paratuberculosis
gcucgccgauguggcgggcg

SEQ ID NO: 796593 - RNA, 14 nt, Mycobacterium avium subsp. paratuberculosis
gcucgccgcgcggc

SEQ ID NO: 796594 - RNA, 15 nt, Mycobacterium avium subsp. paratuberculosis
gcucgccgcgcggcc

SEQ ID NO: 796595 - RNA, 18 nt, Mycobacterium avium subsp. paratuberculosis
gcucgccgcgcggcccgc

SEQ ID NO: 796596 - RNA, 17 nt, Mycobacterium avium subsp. paratuberculosis
gcucgccggccgcgggc

SEQ ID NO: 796597 - RNA, 13 nt, Mycobacterium avium subsp. paratuberculosis
gcucgccggcccg

SEQ ID NO: 796598 - RNA, 12 nt, Mycobacterium avium subsp. paratuberculosis
gcucgccggccg

SEQ ID NO: 796599 - RNA, 21 nt, Mycobacterium avium subsp. paratuberculosis
gcucgccgcugucgucgaaga

SEQ ID NO: 796600 - RNA, 14 nt, Mycobacterium avium subsp. paratuberculosis
gcucgccggcgcgg

SEQ ID NO: 796601 - RNA, 15 nt, Mycobacterium avium subsp. paratuberculosis
gcucgccggcgcgga

SEQ ID NO: 796602 - RNA, 14 nt, Mycobacterium avium subsp. paratuberculosis
gcucgccggcggcc

SEQ ID NO: 796603 - RNA, 16 nt, Mycobacterium avium subsp. paratuberculosis
gcucgccggcgcgcac

SEQ ID NO: 796604 - RNA, 17 nt, Mycobacterium avium subsp. paratuberculosis
gcucgccggcgcgcagc

SEQ ID NO: 796605 - RNA, 12 nt, Mycobacterium avium subsp. paratuberculosis
gcucgccggcgc

SEQ ID NO: 796606 - RNA, 14 nt, Mycobacterium avium subsp. paratuberculosis
gcucgccgggcugc

SEQ ID NO: 796607 - RNA, 13 nt, Mycobacterium avium subsp. paratuberculosis
gcucgccggggac

SEQ ID NO: 796608 - RNA, 19 nt, Mycobacterium avium subsp. paratuberculosis
gcucgccggggacgacggc

SEQ ID NO: 796609 - RNA, 20 nt, Mycobacterium avium subsp. paratuberculosis
gcucgccggggacgacggcg

SEQ ID NO: 796610 - RNA, 22 nt, Mycobacterium avium subsp. paratuberculosis
gcucgccggggacgacggcggg

SEQ ID NO: 796611 - RNA, 16 nt, Mycobacterium avium subsp. paratuberculosis
gcucgccggcggccgc

SEQ ID NO: 796612 - RNA, 17 nt, Mycobacterium avium subsp. paratuberculosis
gcucgccggcggccgcc

SEQ ID NO: 796613 - RNA, 18 nt, Mycobacterium avium subsp. paratuberculosis
gcucgccaugcgaccacg

SEQ ID NO: 796614 - RNA, 15 nt, Mycobacterium avium subsp. paratuberculosis
gcucgcccagcaccg

SEQ ID NO: 796615 - RNA, 12 nt, Mycobacterium avium subsp. paratuberculosis
gcucgcccagcg

SEQ ID NO: 796616 - RNA, 14 nt, Mycobacterium avium subsp. paratuberculosis
gcucgcccagcgcg

SEQ ID NO: 796617 - RNA, 17 nt, Mycobacterium avium subsp. paratuberculosis
gcucgcccagcgcggcg

SEQ ID NO: 796618 - RNA, 19 nt, Mycobacterium avium subsp. paratuberculosis
gcucgcccagcgcggcggc

SEQ ID NO: 796619 - RNA, 20 nt, Mycobacterium avium subsp. paratuberculosis
gcucgcccagcgcggcggcc

SEQ ID NO: 796620 - RNA, 21 nt, Mycobacterium avium subsp. paratuberculosis
gcucgcccagcgcggcggcca

SEQ ID NO: 796621 - RNA, 16 nt, Mycobacterium avium subsp. paratuberculosis
gcucgcagauggucgg

SEQ ID NO: 796622 - RNA, 17 nt, Mycobacterium avium subsp. paratuberculosis
gcucgccaccccgcgcc

SEQ ID NO: 796623 - RNA, 20 nt, Mycobacterium avium subsp. paratuberculosis
gcucgccaccccgcgccacg

SEQ ID NO: 796624 - RNA, 24 nt, Mycobacterium avium subsp. paratuberculosis
gcucgccaccccgcgccacgccgc

SEQ ID NO: 796625 - RNA, 22 nt, Mycobacterium avium subsp. paratuberculosis
gcucgccaccucggagaugaug

SEQ ID NO: 796626 - RNA, 22 nt, Mycobacterium avium subsp. paratuberculosis
gcucgccagacucacggcggca

SEQ ID NO: 796627 - RNA, 15 nt, Mycobacterium avium subsp. paratuberculosis
gcucgccgagcgugu

SEQ ID NO: 796628 - RNA, 13 nt, Mycobacterium avium subsp. paratuberculosis
gcucgcccgcgac

SEQ ID NO: 796629 - RNA, 15 nt, Mycobacterium avium subsp. paratuberculosis
gcucgcccgcgacug

SEQ ID NO: 796630 - RNA, 21 nt, Mycobacterium avium subsp. paratuberculosis
gcucggaaccguuggacugca

SEQ ID NO: 796631 - RNA, 20 nt, Mycobacterium avium subsp. paratuberculosis
gcucggaaugaacugccgcg

SEQ ID NO: 796632 - RNA, 17 nt, Mycobacterium avium subsp. paratuberculosis
gcucgcuugccagccgg

SEQ ID NO: 796633 - RNA, 21 nt, Mycobacterium avium subsp. paratuberculosis
gcucgcuugccagccgggccg

SEQ ID NO: 796634 - RNA, 16 nt, Mycobacterium avium subsp. paratuberculosis
gcucggccagcgcagc

SEQ ID NO: 796635 - RNA, 20 nt, Mycobacterium avium subsp. paratuberculosis
gcucggccagcgcagcgacc

SEQ ID NO: 796636 - RNA, 16 nt, Mycobacterium avium subsp. paratuberculosis
gcucggccagcgcgcc

SEQ ID NO: 796637 - RNA, 18 nt, Mycobacterium avium subsp. paratuberculosis
gcucggccagcgcgccgc

SEQ ID NO: 796638 - RNA, 19 nt, Mycobacterium avium subsp. paratuberculosis
gcucggccagcgcgccgca

SEQ ID NO: 796639 - RNA, 17 nt, Mycobacterium avium subsp. paratuberculosis
gcucggccagcagcacc

SEQ ID NO: 796640 - RNA, 19 nt, Mycobacterium avium subsp. paratuberculosis
gcucggccaccgcgcggug

SEQ ID NO: 796641 - RNA, 22 nt, Mycobacterium avium subsp. paratuberculosis
gcucggccauccgggcggcauc

SEQ ID NO: 796642 - RNA, 13 nt, Mycobacterium avium subsp. paratuberculosis
gcucggcccgccg

SEQ ID NO: 796643 - RNA, 18 nt, Mycobacterium avium subsp. paratuberculosis
gcucggcccgccgggcgc

SEQ ID NO: 796644 - RNA, 12 nt, Mycobacterium avium subsp. paratuberculosis
gcucggcccgcu

SEQ ID NO: 796645 - RNA, 23 nt, Mycobacterium avium subsp. paratuberculosis
gcucggcgagguagaccgccgag

SEQ ID NO: 796646 - RNA, 16 nt, Mycobacterium avium subsp. paratuberculosis
gcucggccagggugac

SEQ ID NO: 796647 - RNA, 20 nt, Mycobacterium avium subsp. paratuberculosis
gcucggccagggugacgguc

SEQ ID NO: 796648 - RNA, 20 nt, Mycobacterium avium subsp. paratuberculosis
gcucgcuauaucgcaccggc

SEQ ID NO: 796649 - RNA, 21 nt, Mycobacterium avium subsp. paratuberculosis
gcucgcuauaucgcaccggcg

SEQ ID NO: 796650 - RNA, 20 nt, Mycobacterium avium subsp. paratuberculosis
gcucgcguucgggcccggcc

SEQ ID NO: 796651 - RNA, 22 nt, Mycobacterium avium subsp. paratuberculosis
gcucgcguucgggcccggccgc

SEQ ID NO: 796652 - RNA, 18 nt, Mycobacterium avium subsp. paratuberculosis
gcucgcgugcgaacguga

SEQ ID NO: 796653 - RNA, 16 nt, Mycobacterium avium subsp. paratuberculosis
gcucgcgucgacgucg

SEQ ID NO: 796654 - RNA, 17 nt, Mycobacterium avium subsp. paratuberculosis
gcucgcgucgacgucgg

SEQ ID NO: 796655 - RNA, 12 nt, Mycobacterium avium subsp. paratuberculosis
gcucgcgggugc

SEQ ID NO: 796656 - RNA, 17 nt, Mycobacterium avium subsp. paratuberculosis
gcucgcggugugggcgg

SEQ ID NO: 796657 - RNA, 18 nt, Mycobacterium avium subsp. paratuberculosis
gcucgcgguugggccgcc

SEQ ID NO: 796658 - RNA, 21 nt, Mycobacterium avium subsp. paratuberculosis
gcucgcgguugggccgccggc

SEQ ID NO: 796659 - RNA, 22 nt, Mycobacterium avium subsp. paratuberculosis
gcucgcgguugggccgccggcc

SEQ ID NO: 796660 - RNA, 23 nt, Mycobacterium avium subsp. paratuberculosis
gcucgcgguugggccggcgcccg

SEQ ID NO: 796661 - RNA, 21 nt, Mycobacterium avium subsp. paratuberculosis
gcucgcugagcgggacgcgca

SEQ ID NO: 796662 - RNA, 23 nt, Mycobacterium avium subsp. paratuberculosis
gcucgcugagcgggacgcgcaga

SEQ ID NO: 796663 - RNA, 15 nt, Mycobacterium avium subsp. paratuberculosis
gcucgcucccgcgcg

SEQ ID NO: 796664 - RNA, 15 nt, Mycobacterium avium subsp. paratuberculosis
gcucgcgccgggcgg

SEQ ID NO: 796665 - RNA, 16 nt, Mycobacterium avium subsp. paratuberculosis
gcucgcgccgggcggc

SEQ ID NO: 796666 - RNA, 22 nt, Mycobacterium avium subsp. paratuberculosis
gcucgcgccgggcggccucggc

SEQ ID NO: 796667 - RNA, 13 nt, Mycobacterium avium subsp. paratuberculosis
gcucgcgcccggc

SEQ ID NO: 796668 - RNA, 14 nt, Mycobacterium avium subsp. paratuberculosis
gcucgcgcccggcc

SEQ ID NO: 796669 - RNA, 15 nt, Mycobacterium avium subsp. paratuberculosis
gcucgcgccgacccg

SEQ ID NO: 796670 - RNA, 19 nt, Mycobacterium avium subsp. paratuberculosis
gcucgcgccgacccgcccg

SEQ ID NO: 796671 - RNA, 15 nt, Mycobacterium avium subsp. paratuberculosis
gcucgcgcucgucca

SEQ ID NO: 796672 - RNA, 23 nt, Mycobacterium avium subsp. paratuberculosis
gcucgcgggugcgcugcagcgag

SEQ ID NO: 796673 - RNA, 15 nt, Mycobacterium avium subsp. paratuberculosis
gcucgcgggugucga

SEQ ID NO: 796674 - RNA, 21 nt, Mycobacterium avium subsp. paratuberculosis
gcucgcgggcgaugcggcccg

SEQ ID NO: 796675 - RNA, 23 nt, Mycobacterium avium subsp. paratuberculosis
gcucgcgggcgaugcggcccggc

SEQ ID NO: 796676 - RNA, 19 nt, Mycobacterium avium subsp. paratuberculosis
gcucgcggggugucgugca

SEQ ID NO: 796677 - RNA, 16 nt, Mycobacterium avium subsp. paratuberculosis
gcucgcggcguaggcg

SEQ ID NO: 796678 - RNA, 17 nt, Mycobacterium avium subsp. paratuberculosis
gcucgcgggcccgcgcc

SEQ ID NO: 796679 - RNA, 13 nt, Mycobacterium avium subsp. paratuberculosis
gcucgcggccgua

SEQ ID NO: 796680 - RNA, 16 nt, Mycobacterium avium subsp. paratuberculosis
gcucgcggcgcagcuc

SEQ ID NO: 796681 - RNA, 19 nt, Mycobacterium avium subsp. paratuberculosis
gcucgcggcgcagcucgcg

SEQ ID NO: 796682 - RNA, 20 nt, Mycobacterium avium subsp. paratuberculosis
gcucgcggcgcagcucgcgc

SEQ ID NO: 796683 - RNA, 15 nt, Mycobacterium avium subsp. paratuberculosis
gcucgcgcugaagcc

SEQ ID NO: 796684 - RNA, 15 nt, Mycobacterium avium subsp. paratuberculosis
gcucgcgcugcaugc

SEQ ID NO: 796685 - RNA, 20 nt, Mycobacterium avium subsp. paratuberculosis
gcucgcggauccgcagcuga

SEQ ID NO: 796686 - RNA, 23 nt, Mycobacterium avium subsp. paratuberculosis
gcucgcggauccgggccggcguc

SEQ ID NO: 796687 - RNA, 15 nt, Mycobacterium avium subsp. paratuberculosis
gcucgcggauguccg

SEQ ID NO: 796688 - RNA, 13 nt, Mycobacterium avium subsp. paratuberculosis
gcucgcgacgcgg

SEQ ID NO: 796689 - RNA, 17 nt, Mycobacterium avium subsp. paratuberculosis
gcucgcgacgcggcucg

SEQ ID NO: 796690 - RNA, 13 nt, Mycobacterium avium subsp. paratuberculosis
gcucgcgcacccg

SEQ ID NO: 796691 - RNA, 15 nt, Mycobacterium avium subsp. paratuberculosis
gcucgcgcacccgua

SEQ ID NO: 796692 - RNA, 20 nt, Mycobacterium avium subsp. paratuberculosis
gcucgcgcaccgggaccagc

SEQ ID NO: 796693 - RNA, 22 nt, Mycobacterium avium subsp. paratuberculosis
gcucgcgcaccgggaccagcgc

SEQ ID NO: 796694 - RNA, 23 nt, Mycobacterium avium subsp. paratuberculosis
gcucgcgcaccgggaccagcgcg

SEQ ID NO: 796695 - RNA, 18 nt, Mycobacterium avium subsp. paratuberculosis
gcucgcgcagcuggccgu

SEQ ID NO: 796696 - RNA, 22 nt, Mycobacterium avium subsp. paratuberculosis
gcucgcgcaggaacuccagcag

SEQ ID NO: 796697 - RNA, 14 nt, Mycobacterium avium subsp. paratuberculosis
gcucgcgcaucagc

SEQ ID NO: 796698 - RNA, 15 nt, Mycobacterium avium subsp. paratuberculosis
gcucgcgcagcagcu

SEQ ID NO: 796699 - RNA, 18 nt, Mycobacterium avium subsp. paratuberculosis
gcucgcgcagccggccga

SEQ ID NO: 796700 - RNA, 22 nt, Mycobacterium avium subsp. paratuberculosis
gcucgccuuugaugacgacgug

SEQ ID NO: 796701 - RNA, 23 nt, Mycobacterium avium subsp. paratuberculosis
gcucgccuuugaugacgacguga

SEQ ID NO: 796702 - RNA, 21 nt, Mycobacterium avium subsp. paratuberculosis
gcucgccgucacaccgcggcc

SEQ ID NO: 796703 - RNA, 13 nt, Mycobacterium avium subsp. paratuberculosis
gcucgccucaacg

SEQ ID NO: 796704 - RNA, 15 nt, Mycobacterium avium subsp. paratuberculosis
gcucgccucaacggu

SEQ ID NO: 796705 - RNA, 17 nt, Mycobacterium avium subsp. paratuberculosis
gcucgccgguggcggcg

SEQ ID NO: 796706 - RNA, 13 nt, Mycobacterium avium subsp. paratuberculosis
gcucgccguccgg

SEQ ID NO: 796707 - RNA, 14 nt, Mycobacterium avium subsp. paratuberculosis
gcucgccgucggcc

SEQ ID NO: 796708 - RNA, 14 nt, Mycobacterium avium subsp. paratuberculosis
gcucgccguugcgg

SEQ ID NO: 796709 - RNA, 20 nt, Mycobacterium avium subsp. paratuberculosis
gcucgccguugcgggucggc

SEQ ID NO: 796710 - RNA, 18 nt, Mycobacterium avium subsp. paratuberculosis
gcucguucucggcgaaca

SEQ ID NO: 796711 - RNA, 22 nt, Mycobacterium avium subsp. paratuberculosis
gcucguugugaauccagccgug

SEQ ID NO: 796712 - RNA, 22 nt, Mycobacterium avium subsp. paratuberculosis
gcucuccugcuugaccguggag

SEQ ID NO: 796713 - RNA, 22 nt, Mycobacterium avium subsp. paratuberculosis
gcucguugagcacacacagguc

SEQ ID NO: 796714 - RNA, 23 nt, Mycobacterium avium subsp. paratuberculosis
gcucguguccgaugacgagcagc

SEQ ID NO: 796715 - RNA, 21 nt, Mycobacterium avium subsp. paratuberculosis
gcucguugccggcggccagca

SEQ ID NO: 796716 - RNA, 18 nt, Mycobacterium avium subsp. paratuberculosis
gcucgugguucuccgcga

SEQ ID NO: 796717 - RNA, 20 nt, Mycobacterium avium subsp. paratuberculosis
gcucguggaacgacgccaga

SEQ ID NO: 796718 - RNA, 15 nt, Mycobacterium avium subsp. paratuberculosis
gcucguggcgggccc

SEQ ID NO: 796719 - RNA, 15 nt, Mycobacterium avium subsp. paratuberculosis
gcucgucgucgguga

SEQ ID NO: 796720 - RNA, 22 nt, Mycobacterium avium subsp. paratuberculosis
gcucgucgucggugaacgccgg

SEQ ID NO: 796721 - RNA, 17 nt, Mycobacterium avium subsp. paratuberculosis
gcucgugaugguccagc

SEQ ID NO: 796722 - RNA, 20 nt, Mycobacterium avium subsp. paratuberculosis
gcucgugcaaaccggaccgc

SEQ ID NO: 796723 - RNA, 15 nt, Mycobacterium avium subsp. paratuberculosis
gcucgugcagccggc

SEQ ID NO: 796724 - RNA, 16 nt, Mycobacterium avium subsp. paratuberculosis
gcucgugcagccggcg

SEQ ID NO: 796725 - RNA, 19 nt, Mycobacterium avium subsp. paratuberculosis
gcucgugcagccggcggcg

SEQ ID NO: 796726 - RNA, 13 nt, Mycobacterium avium subsp. paratuberculosis
gcucggcgaucug

SEQ ID NO: 796727 - RNA, 16 nt, Mycobacterium avium subsp. paratuberculosis
gcucggcgaucuggcg

SEQ ID NO: 796728 - RNA, 11 nt, Mycobacterium avium subsp. paratuberculosis
gcucggcgauc

SEQ ID NO: 796729 - RNA, 13 nt, Mycobacterium avium subsp. paratuberculosis
gcucggcgaucac

SEQ ID NO: 796730 - RNA, 17 nt, Mycobacterium avium subsp. paratuberculosis
gcucggcgaucaccgcg

SEQ ID NO: 796731 - RNA, 22 nt, Mycobacterium avium subsp. paratuberculosis
gcucggcgccccacgccuggcg

SEQ ID NO: 796732 - RNA, 14 nt, Mycobacterium avium subsp. paratuberculosis
gcucggcgccgacc

SEQ ID NO: 796733 - RNA, 15 nt, Mycobacterium avium subsp. paratuberculosis
gcucggcgccgaccu

SEQ ID NO: 796734 - RNA, 23 nt, Mycobacterium avium subsp. paratuberculosis
gcucggcgccgaccucggccagc

SEQ ID NO: 796735 - RNA, 13 nt, Mycobacterium avium subsp. paratuberculosis
gcucggcgccgag

SEQ ID NO: 796736 - RNA, 14 nt, Mycobacterium avium subsp. paratuberculosis
gcucggcgccgagc

SEQ ID NO: 796737 - RNA, 15 nt, Mycobacterium avium subsp. paratuberculosis
gcucggcgccgagcg

SEQ ID NO: 796738 - RNA, 12 nt, Mycobacterium avium subsp. paratuberculosis
gcucggcgccgc

SEQ ID NO: 796739 - RNA, 13 nt, Mycobacterium avium subsp. paratuberculosis
gcucggcgccgcg

SEQ ID NO: 796740 - RNA, 15 nt, Mycobacterium avium subsp. paratuberculosis
gcucggcgccgcggg

SEQ ID NO: 796741 - RNA, 13 nt, Mycobacterium avium subsp. paratuberculosis
gcucggcgccggc

SEQ ID NO: 796742 - RNA, 23 nt, Mycobacterium avium subsp. paratuberculosis
gcucggcgccggccgucacgcug

SEQ ID NO: 796743 - RNA, 21 nt, Mycobacterium avium subsp. paratuberculosis
gcucgucggguguggcgccgu

SEQ ID NO: 796744 - RNA, 16 nt, Mycobacterium avium subsp. paratuberculosis
gcucggcgcgcggggc

SEQ ID NO: 796745 - RNA, 18 nt, Mycobacterium avium subsp. paratuberculosis
gcucggcgcgcggggccg

SEQ ID NO: 796746 - RNA, 20 nt, Mycobacterium avium subsp. paratuberculosis
gcucggcgcgcggggccggc

SEQ ID NO: 796747 - RNA, 20 nt, Mycobacterium avium subsp. paratuberculosis
gcucgucggcgggcaccucg

SEQ ID NO: 796748 - RNA, 23 nt, Mycobacterium avium subsp. paratuberculosis
gcucgucggcgggcaccucggcc

SEQ ID NO: 796749 - RNA, 20 nt, Mycobacterium avium subsp. paratuberculosis
gcucgucgggcacaucccgc

SEQ ID NO: 796750 - RNA, 22 nt, Mycobacterium avium subsp. paratuberculosis
gcucgucggggcagccgucgau

SEQ ID NO: 796751 - RNA, 20 nt, Mycobacterium avium subsp. paratuberculosis
gcucgucgugggugacccgg

SEQ ID NO: 796752 - RNA, 18 nt, Mycobacterium avium subsp. paratuberculosis
gcucgucguugaccugcu

SEQ ID NO: 796753 - RNA, 17 nt, Mycobacterium avium subsp. paratuberculosis
gcucgucguugcgcagc

SEQ ID NO: 796754 - RNA, 14 nt, Mycobacterium avium subsp. paratuberculosis
gcucgugaccggcg

SEQ ID NO: 796755 - RNA, 15 nt, Mycobacterium avium subsp. paratuberculosis
gcucgugaccggcgg

SEQ ID NO: 796756 - RNA, 14 nt, Mycobacterium avium subsp. paratuberculosis
gcugaccgacggcg

SEQ ID NO: 796757 - RNA, 15 nt, Mycobacterium avium subsp. paratuberculosis
gcugaccgacggcga

SEQ ID NO: 796758 - RNA, 19 nt, Mycobacterium avium subsp. paratuberculosis
gcugaccgacggcgaccag

SEQ ID NO: 796759 - RNA, 13 nt, Mycobacterium avium subsp. paratuberculosis
gcugacccgggcg

SEQ ID NO: 796760 - RNA, 14 nt, Mycobacterium avium subsp. paratuberculosis
gcugacccgggcgg

SEQ ID NO: 796761 - RNA, 17 nt, Mycobacterium avium subsp. paratuberculosis
gcugacccgggcggccu

SEQ ID NO: 796762 - RNA, 16 nt, Mycobacterium avium subsp. paratuberculosis
gcugacccggucgcgg

SEQ ID NO: 796763 - RNA, 15 nt, Mycobacterium avium subsp. paratuberculosis
gcugacccgcccggg

SEQ ID NO: 796764 - RNA, 14 nt, Mycobacterium avium subsp. paratuberculosis
gcugacccgccgca

SEQ ID NO: 796765 - RNA, 19 nt, Mycobacterium avium subsp. paratuberculosis
gcugaccaggaagaugccg

SEQ ID NO: 796766 - RNA, 18 nt, Mycobacterium avium subsp. paratuberculosis
gcugaccaugacccacgg

SEQ ID NO: 796767 - RNA, 14 nt, Mycobacterium avium subsp. paratuberculosis
gcugaccagcgccu

SEQ ID NO: 796768 - RNA, 22 nt, Mycobacterium avium subsp. paratuberculosis
gcugaccagcgccucgcgggug

SEQ ID NO: 796769 - RNA, 20 nt, Mycobacterium avium subsp. paratuberculosis
gcugaccacgcuccagaugc

SEQ ID NO: 796770 - RNA, 23 nt, Mycobacterium avium subsp. paratuberculosis
gcugaauucuguugucggcucgc

SEQ ID NO: 796771 - RNA, 14 nt, Mycobacterium avium subsp. paratuberculosis
gcugaacgggcagc

SEQ ID NO: 796772 - RNA, 18 nt, Mycobacterium avium subsp. paratuberculosis
gcugaacgggcagccacg

SEQ ID NO: 796773 - RNA, 18 nt, Mycobacterium avium subsp. paratuberculosis
gcugaacgccagcagccg

SEQ ID NO: 796774 - RNA, 19 nt, Mycobacterium avium subsp. paratuberculosis
gcugaacgccagcagccgc

SEQ ID NO: 796775 - RNA, 18 nt, Mycobacterium avium subsp. paratuberculosis
gcugaaccugcugggcgg

SEQ ID NO: 796776 - RNA, 17 nt, Mycobacterium avium subsp. paratuberculosis
gcugaacgccugccggc

SEQ ID NO: 796777 - RNA, 19 nt, Mycobacterium avium subsp. paratuberculosis
gcugaacgccugccggcgc

SEQ ID NO: 796778 - RNA, 23 nt, Mycobacterium avium subsp. paratuberculosis
gcugaacgccugccggcgccgga

SEQ ID NO: 796779 - RNA, 22 nt, Mycobacterium avium subsp. paratuberculosis
gcugaacgcggugggcaccagc

SEQ ID NO: 796780 - RNA, 23 nt, Mycobacterium avium subsp. paratuberculosis
gcugaacgcggugggcaccagca

SEQ ID NO: 796781 - RNA, 14 nt, Mycobacterium avium subsp. paratuberculosis
gcugaacgcgucgu

SEQ ID NO: 796782 - RNA, 13 nt, Mycobacterium avium subsp. paratuberculosis
gcugaaccgguag

SEQ ID NO: 796783 - RNA, 22 nt, Mycobacterium avium subsp. paratuberculosis
gcugaaccgguagucgucgagg

SEQ ID NO: 796784 - RNA, 19 nt, Mycobacterium avium subsp. paratuberculosis
gcugaacaccaccaggccg

SEQ ID NO: 796785 - RNA, 19 nt, Mycobacterium avium subsp. paratuberculosis
gcugaacacgaacccggcg

SEQ ID NO: 796786 - RNA, 21 nt, Mycobacterium avium subsp. paratuberculosis
gcugaacacgaacccggcggc

SEQ ID NO: 796787 - RNA, 14 nt, Mycobacterium avium subsp. paratuberculosis
gcugaacagcccga

SEQ ID NO: 796788 - RNA, 14 nt, Mycobacterium avium subsp. paratuberculosis
gcugaacagcgcgc

SEQ ID NO: 796789 - RNA, 14 nt, Mycobacterium avium subsp. paratuberculosis
gcugaaccaccgcg

SEQ ID NO: 796790 - RNA, 15 nt, Mycobacterium avium subsp. paratuberculosis
gcugaaccaccgcgc

SEQ ID NO: 796791 - RNA, 17 nt, Mycobacterium avium subsp. paratuberculosis
gcugaaccaccgcgccc

SEQ ID NO: 796792 - RNA, 22 nt, Mycobacterium avium subsp. paratuberculosis
gcugaaccaccgcgcccacccg

SEQ ID NO: 796793 - RNA, 21 nt, Mycobacterium avium subsp. paratuberculosis
gcugcaacgcgucggcgccgg

SEQ ID NO: 796794 - RNA, 13 nt, Mycobacterium avium subsp. paratuberculosis
gcugcaacggcug

SEQ ID NO: 796795 - RNA, 16 nt, Mycobacterium avium subsp. paratuberculosis
gcugcaccagcccguc

SEQ ID NO: 796796 - RNA, 19 nt, Mycobacterium avium subsp. paratuberculosis
gcugcaccagcccgucggc

SEQ ID NO: 796797 - RNA, 14 nt, Mycobacterium avium subsp. paratuberculosis
gcugcaccagggcg

SEQ ID NO: 796798 - RNA, 13 nt, Mycobacterium avium subsp. paratuberculosis
gcugcagcagcga

SEQ ID NO: 796799 - RNA, 16 nt, Mycobacterium avium subsp. paratuberculosis
gcugcacccaccggcc

SEQ ID NO: 796800 - RNA, 23 nt, Mycobacterium avium subsp. paratuberculosis
gcugcacccaccggcgcagcgcg

SEQ ID NO: 796801 - RNA, 19 nt, Mycobacterium avium subsp. paratuberculosis
gcugcacccucugccacgg

SEQ ID NO: 796802 - RNA, 20 nt, Mycobacterium avium subsp. paratuberculosis
gcugcacccucugccacggc

SEQ ID NO: 796803 - RNA, 23 nt, Mycobacterium avium subsp. paratuberculosis
gcugcacccucugccacggcgga

SEQ ID NO: 796804 - RNA, 23 nt, Mycobacterium avium subsp. paratuberculosis
gcugaucaccaaauagccgucgg

SEQ ID NO: 796805 - RNA, 19 nt, Mycobacterium avium subsp. paratuberculosis
gcugaucuacgucggcugg

SEQ ID NO: 796806 - RNA, 15 nt, Mycobacterium avium subsp. paratuberculosis
gcugaucucggcggu

SEQ ID NO: 796807 - RNA, 17 nt, Mycobacterium avium subsp. paratuberculosis
gcugaucucggcggucu

SEQ ID NO: 796808 - RNA, 22 nt, Mycobacterium avium subsp. paratuberculosis
gcugaucucggcggucugucgc

SEQ ID NO: 796809 - RNA, 21 nt, Mycobacterium avium subsp. paratuberculosis
gcugauagcccgccgcggcga

SEQ ID NO: 796810 - RNA, 16 nt, Mycobacterium avium subsp. paratuberculosis
gcugaugcgcaacagc

SEQ ID NO: 796811 - RNA, 15 nt, Mycobacterium avium subsp. paratuberculosis
gcugaugccgccgaa

SEQ ID NO: 796812 - RNA, 17 nt, Mycobacterium avium subsp. paratuberculosis
gcugaucuggaugcggc

SEQ ID NO: 796813 - RNA, 20 nt, Mycobacterium avium subsp. paratuberculosis
gcugaucuggaugcggcccu

SEQ ID NO: 796814 - RNA, 22 nt, Mycobacterium avium subsp. paratuberculosis
gcugaguaugcagaugaugccg

SEQ ID NO: 796815 - RNA, 17 nt, Mycobacterium avium subsp. paratuberculosis
gcugagcaaccgccgaa

SEQ ID NO: 796816 - RNA, 17 nt, Mycobacterium avium subsp. paratuberculosis
gcugagcacggugggcg

SEQ ID NO: 796817 - RNA, 19 nt, Mycobacterium avium subsp. paratuberculosis
gcugagcagcaggucggcg

SEQ ID NO: 796818 - RNA, 14 nt, Mycobacterium avium subsp. paratuberculosis
gcugagcagcccga

SEQ ID NO: 796819 - RNA, 23 nt, Mycobacterium avium subsp. paratuberculosis
gcugagcagcccgaccaccuccc

SEQ ID NO: 796820 - RNA, 15 nt, Mycobacterium avium subsp. paratuberculosis
gcugagcacccgccc

SEQ ID NO: 796821 - RNA, 16 nt, Mycobacterium avium subsp. paratuberculosis
gcugagcacccgcccg

SEQ ID NO: 796822 - RNA, 17 nt, Mycobacterium avium subsp. paratuberculosis
gcugagcacccgcccgg

SEQ ID NO: 796823 - RNA, 18 nt, Mycobacterium avium subsp. paratuberculosis
gcugagcacccgcccgga

SEQ ID NO: 796824 - RNA, 21 nt, Mycobacterium avium subsp. paratuberculosis
gcugagcacccgcccggacgc

SEQ ID NO: 796825 - RNA, 14 nt, Mycobacterium avium subsp. paratuberculosis
gcugagcaccgggg

SEQ ID NO: 796826 - RNA, 17 nt, Mycobacterium avium subsp. paratuberculosis
gcugacugcgaucgccg

SEQ ID NO: 796827 - RNA, 23 nt, Mycobacterium avium subsp. paratuberculosis
gcugacugcgaucgccgacgcca

SEQ ID NO: 796828 - RNA, 15 nt, Mycobacterium avium subsp. paratuberculosis
gcugaggcugcgggu

SEQ ID NO: 796829 - RNA, 19 nt, Mycobacterium avium subsp. paratuberculosis
gcugagcagcucgcggauc

SEQ ID NO: 796830 - RNA, 13 nt, Mycobacterium avium subsp. paratuberculosis
gcugagccgccga

SEQ ID NO: 796831 - RNA, 17 nt, Mycobacterium avium subsp. paratuberculosis
gcugagccgccgagccg

SEQ ID NO: 796832 - RNA, 16 nt, Mycobacterium avium subsp. paratuberculosis
gcugaggccgccccgg

SEQ ID NO: 796833 - RNA, 14 nt, Mycobacterium avium subsp. paratuberculosis
gcugaccgccgcgc

SEQ ID NO: 796834 - RNA, 20 nt, Mycobacterium avium subsp. paratuberculosis
gcugaccgccgcgcucggcc

SEQ ID NO: 796835 - RNA, 14 nt, Mycobacterium avium subsp. paratuberculosis
gcugaccggcggug

SEQ ID NO: 796836 - RNA, 16 nt, Mycobacterium avium subsp. paratuberculosis
gcugaccggcggugcc

SEQ ID NO: 796837 - RNA, 19 nt, Mycobacterium avium subsp. paratuberculosis
gcugaccuucuuggucagc

SEQ ID NO: 796838 - RNA, 20 nt, Mycobacterium avium subsp. paratuberculosis
gcugaccuucuuggucagcg

SEQ ID NO: 796839 - RNA, 18 nt, Mycobacterium avium subsp. paratuberculosis
gcugacgaacgcgccgcc

SEQ ID NO: 796840 - RNA, 17 nt, Mycobacterium avium subsp. paratuberculosis
gcugaccguggugucgg

SEQ ID NO: 796841 - RNA, 12 nt, Mycobacterium avium subsp. paratuberculosis
gcugaccgucga

SEQ ID NO: 796842 - RNA, 16 nt, Mycobacterium avium subsp. paratuberculosis
gcugaccgucgaccaa

SEQ ID NO: 796843 - RNA, 15 nt, Mycobacterium avium subsp. paratuberculosis
gcugaccucgccgcc

SEQ ID NO: 796844 - RNA, 16 nt, Mycobacterium avium subsp. paratuberculosis
gcugaccucgccgccc

SEQ ID NO: 796845 - RNA, 19 nt, Mycobacterium avium subsp. paratuberculosis
gcugaccucgcgcaccggc

SEQ ID NO: 796846 - RNA, 20 nt, Mycobacterium avium subsp. paratuberculosis
gcugaccucgcgcaccggcu

SEQ ID NO: 796847 - RNA, 14 nt, Mycobacterium avium subsp. paratuberculosis
gcugaccugugcgc

SEQ ID NO: 796848 - RNA, 21 nt, Mycobacterium avium subsp. paratuberculosis
gcugaccucgacacgggccgc

SEQ ID NO: 796849 - RNA, 16 nt, Mycobacterium avium subsp. paratuberculosis
gcugccguugcgccag

SEQ ID NO: 796850 - RNA, 19 nt, Mycobacterium avium subsp. paratuberculosis
gcugccguugcgccagcgg

SEQ ID NO: 796851 - RNA, 16 nt, Mycobacterium avium subsp. paratuberculosis
gcugccguccggcggc

SEQ ID NO: 796852 - RNA, 20 nt, Mycobacterium avium subsp. paratuberculosis
gcugccguugggcacggugu

SEQ ID NO: 796853 - RNA, 14 nt, Mycobacterium avium subsp. paratuberculosis
gcugccguucgccg

SEQ ID NO: 796854 - RNA, 15 nt, Mycobacterium avium subsp. paratuberculosis
gcugccguucgccgg

SEQ ID NO: 796855 - RNA, 16 nt, Mycobacterium avium subsp. paratuberculosis
gcugccguucgccggu

SEQ ID NO: 796856 - RNA, 19 nt, Mycobacterium avium subsp. paratuberculosis
gcugccguucgccgguacc

SEQ ID NO: 796857 - RNA, 22 nt, Mycobacterium avium subsp. paratuberculosis
gcugccggugcugcucgagggc

SEQ ID NO: 796858 - RNA, 18 nt, Mycobacterium avium subsp. paratuberculosis
gcugccgguggucccggu

SEQ ID NO: 796859 - RNA, 18 nt, Mycobacterium avium subsp. paratuberculosis
gcugccguagcgcugggu

SEQ ID NO: 796860 - RNA, 14 nt, Mycobacterium avium subsp. paratuberculosis
gcugccggggcgca

SEQ ID NO: 796861 - RNA, 19 nt, Mycobacterium avium subsp. paratuberculosis
gcugccggggugcagcacc

SEQ ID NO: 796862 - RNA, 13 nt, Mycobacterium avium subsp. paratuberculosis
gcugccggcggcc

SEQ ID NO: 796863 - RNA, 21 nt, Mycobacterium avium subsp. paratuberculosis
gcugccggcggccgccggcac

SEQ ID NO: 796864 - RNA, 22 nt, Mycobacterium avium subsp. paratuberculosis
gcugccggcggccgccggcacc

SEQ ID NO: 796865 - RNA, 15 nt, Mycobacterium avium subsp. paratuberculosis
gcugcgaaucgucgg

SEQ ID NO: 796866 - RNA, 19 nt, Mycobacterium avium subsp. paratuberculosis
gcugcgaaucgucggcgau

SEQ ID NO: 796867 - RNA, 14 nt, Mycobacterium avium subsp. paratuberculosis
gcugcgacagcacg

SEQ ID NO: 796868 - RNA, 22 nt, Mycobacterium avium subsp. paratuberculosis
gcugcgacagcacgggcgggca

SEQ ID NO: 796869 - RNA, 16 nt, Mycobacterium avium subsp. paratuberculosis
gcugcgauugguggcc

SEQ ID NO: 796870 - RNA, 17 nt, Mycobacterium avium subsp. paratuberculosis
gcugcgauugguggccc

SEQ ID NO: 796871 - RNA, 20 nt, Mycobacterium avium subsp. paratuberculosis
gcugcgauugguggcccggu

SEQ ID NO: 796872 - RNA, 14 nt, Mycobacterium avium subsp. paratuberculosis
gcugcgagcccggc

SEQ ID NO: 796873 - RNA, 15 nt, Mycobacterium avium subsp. paratuberculosis
gcugcgagcccggcc

SEQ ID NO: 796874 - RNA, 18 nt, Mycobacterium avium subsp. paratuberculosis
gcugcgagcccggccagu

SEQ ID NO: 796875 - RNA, 15 nt, Mycobacterium avium subsp. paratuberculosis
gcugcgaggcgggca

SEQ ID NO: 796876 - RNA, 19 nt, Mycobacterium avium subsp. paratuberculosis
gcugcagcauuuccgagcg

SEQ ID NO: 796877 - RNA, 14 nt, Mycobacterium avium subsp. paratuberculosis
gcugcagcgucggg

SEQ ID NO: 796878 - RNA, 14 nt, Mycobacterium avium subsp. paratuberculosis
gcugcagcugcucg

SEQ ID NO: 796879 - RNA, 12 nt, Mycobacterium avium subsp. paratuberculosis
gcugccagggcc

SEQ ID NO: 796880 - RNA, 16 nt, Mycobacterium avium subsp. paratuberculosis
gcugccagggccgggc

SEQ ID NO: 796881 - RNA, 22 nt, Mycobacterium avium subsp. paratuberculosis
gcugccagggccgggcgugccc

SEQ ID NO: 796882 - RNA, 17 nt, Mycobacterium avium subsp. paratuberculosis
gcugcccaacgucgacu

SEQ ID NO: 796883 - RNA, 18 nt, Mycobacterium avium subsp. paratuberculosis
gcugcccaccaccagggg

SEQ ID NO: 796884 - RNA, 13 nt, Mycobacterium avium subsp. paratuberculosis
gcugcccaccagc

SEQ ID NO: 796885 - RNA, 17 nt, Mycobacterium avium subsp. paratuberculosis
gcugcccaccagcaggu

SEQ ID NO: 796886 - RNA, 19 nt, Mycobacterium avium subsp. paratuberculosis
gcugcccaccagcaggucg

SEQ ID NO: 796887 - RNA, 17 nt, Mycobacterium avium subsp. paratuberculosis
gcugcagcuccucggcg

SEQ ID NO: 796888 - RNA, 19 nt, Mycobacterium avium subsp. paratuberculosis
gcugcagcuccucggcggc

SEQ ID NO: 796889 - RNA, 21 nt, Mycobacterium avium subsp. paratuberculosis
gcugcagcuccucggcggccu

SEQ ID NO: 796890 - RNA, 13 nt, Mycobacterium avium subsp. paratuberculosis
gcugcagcgcccg

SEQ ID NO: 796891 - RNA, 17 nt, Mycobacterium avium subsp. paratuberculosis
gcugcagcgcccgggcc

SEQ ID NO: 796892 - RNA, 23 nt, Mycobacterium avium subsp. paratuberculosis
gcugcagcgccgaggccagcacg

SEQ ID NO: 796893 - RNA, 16 nt, Mycobacterium avium subsp. paratuberculosis
gcugcagcgccgcccg

SEQ ID NO: 796894 - RNA, 17 nt, Mycobacterium avium subsp. paratuberculosis
gcugcagcgccgcccgc

SEQ ID NO: 796895 - RNA, 18 nt, Mycobacterium avium subsp. paratuberculosis
gcugcagcgccgcccgca

SEQ ID NO: 796896 - RNA, 23 nt, Mycobacterium avium subsp. paratuberculosis
gcugcagcgccgcccgcaccugc

SEQ ID NO: 796897 - RNA, 20 nt, Mycobacterium avium subsp. paratuberculosis
gcugcagcggaaacgacguc

SEQ ID NO: 796898 - RNA, 21 nt, Mycobacterium avium subsp. paratuberculosis
gcugcagcggaaacgacgucg

SEQ ID NO: 796899 - RNA, 12 nt, Mycobacterium avium subsp. paratuberculosis
gcugcagcggcg

SEQ ID NO: 796900 - RNA, 13 nt, Mycobacterium avium subsp. paratuberculosis
gcugcagcggcgg

SEQ ID NO: 796901 - RNA, 15 nt, Mycobacterium avium subsp. paratuberculosis
gcugcagcggcggcc

SEQ ID NO: 796902 - RNA, 17 nt, Mycobacterium avium subsp. paratuberculosis
gcugcagcggcggccag

SEQ ID NO: 796903 - RNA, 21 nt, Mycobacterium avium subsp. paratuberculosis
gcugcagcggcggccaguuga

SEQ ID NO: 796904 - RNA, 20 nt, Mycobacterium avium subsp. paratuberculosis
gcugcagcauccagguggcg

SEQ ID NO: 796905 - RNA, 19 nt, Mycobacterium avium subsp. paratuberculosis
gcugcagcauggacccgaa

SEQ ID NO: 796906 - RNA, 17 nt, Mycobacterium avium subsp. paratuberculosis
gcugcagccggccggcg

SEQ ID NO: 796907 - RNA, 14 nt, Mycobacterium avium subsp. paratuberculosis
gcugcagccgggcg

SEQ ID NO: 796908 - RNA, 15 nt, Mycobacterium avium subsp. paratuberculosis
gcugcagccgggcgg

SEQ ID NO: 796909 - RNA, 20 nt, Mycobacterium avium subsp. paratuberculosis
gcugcagccgggcggcggcc

SEQ ID NO: 796910 - RNA, 15 nt, Mycobacterium avium subsp. paratuberculosis
gcugcagccgguccg

SEQ ID NO: 796911 - RNA, 18 nt, Mycobacterium avium subsp. paratuberculosis
gcugcagccgguccggcg

SEQ ID NO: 796912 - RNA, 19 nt, Mycobacterium avium subsp. paratuberculosis
gcugcagccgguccggcgg

SEQ ID NO: 796913 - RNA, 20 nt, Mycobacterium avium subsp. paratuberculosis
gcugcagccgguccggcggc

SEQ ID NO: 796914 - RNA, 15 nt, Mycobacterium avium subsp. paratuberculosis
gcugcagcgacugga

SEQ ID NO: 796915 - RNA, 22 nt, Mycobacterium avium subsp. paratuberculosis
gcugcagcgagaccucccggcg

SEQ ID NO: 796916 - RNA, 23 nt, Mycobacterium avium subsp. paratuberculosis
gcugcagcgagaccucccggcgc

SEQ ID NO: 796917 - RNA, 13 nt, Mycobacterium avium subsp. paratuberculosis
gcugccgccggcc

SEQ ID NO: 796918 - RNA, 16 nt, Mycobacterium avium subsp. paratuberculosis
gcugccgcgacucggu

SEQ ID NO: 796919 - RNA, 18 nt, Mycobacterium avium subsp. paratuberculosis
gcugccgcgacucggugu

SEQ ID NO: 796920 - RNA, 22 nt, Mycobacterium avium subsp. paratuberculosis
gcugccgcgacucggugucgcu

SEQ ID NO: 796921 - RNA, 14 nt, Mycobacterium avium subsp. paratuberculosis
gcugccgcgccccg

SEQ ID NO: 796922 - RNA, 15 nt, Mycobacterium avium subsp. paratuberculosis
gcugccgcgccccga

SEQ ID NO: 796923 - RNA, 12 nt, Mycobacterium avium subsp. paratuberculosis
gcugccgcgccg

SEQ ID NO: 796924 - RNA, 19 nt, Mycobacterium avium subsp. paratuberculosis
gcugccggcgaccagcccc

SEQ ID NO: 796925 - RNA, 17 nt, Mycobacterium avium subsp. paratuberculosis
gcugccggcgcacccgc

SEQ ID NO: 796926 - RNA, 16 nt, Mycobacterium avium subsp. paratuberculosis
gcugccgccgcagcag

SEQ ID NO: 796927 - RNA, 19 nt, Mycobacterium avium subsp. paratuberculosis
gcugccgccgcagcagccg

SEQ ID NO: 796928 - RNA, 13 nt, Mycobacterium avium subsp. paratuberculosis
gcugccgccgccg

SEQ ID NO: 796929 - RNA, 17 nt, Mycobacterium avium subsp. paratuberculosis
gcugccgccgccgcugu

SEQ ID NO: 796930 - RNA, 16 nt, Mycobacterium avium subsp. paratuberculosis
gcugccgccgccggcg

SEQ ID NO: 796931 - RNA, 17 nt, Mycobacterium avium subsp. paratuberculosis
gcugccgccgccggcgg

SEQ ID NO: 796932 - RNA, 13 nt, Mycobacterium avium subsp. paratuberculosis
gcugcccagcgcg

SEQ ID NO: 796933 - RNA, 14 nt, Mycobacterium avium subsp. paratuberculosis
gcugcccagcgcgg

SEQ ID NO: 796934 - RNA, 19 nt, Mycobacterium avium subsp. paratuberculosis
gcugcccagcgcggucgcc

SEQ ID NO: 796935 - RNA, 17 nt, Mycobacterium avium subsp. paratuberculosis
gcugccgcccccgcugg

SEQ ID NO: 796936 - RNA, 16 nt, Mycobacterium avium subsp. paratuberculosis
gcugcgcagccgugcc

SEQ ID NO: 796937 - RNA, 17 nt, Mycobacterium avium subsp. paratuberculosis
gcugcgcagccgugccc

SEQ ID NO: 796938 - RNA, 16 nt, Mycobacterium avium subsp. paratuberculosis
gcugcgcagcagcgcc

SEQ ID NO: 796939 - RNA, 14 nt, Mycobacterium avium subsp. paratuberculosis
gcugcgcagcagcg

SEQ ID NO: 796940 - RNA, 14 nt, Mycobacterium avium subsp. paratuberculosis
gcugcgcagacccg

SEQ ID NO: 796941 - RNA, 23 nt, Mycobacterium avium subsp. paratuberculosis
gcugcgcagacccgguggccgag

SEQ ID NO: 796942 - RNA, 13 nt, Mycobacterium avium subsp. paratuberculosis
gcugcgcagcacc

SEQ ID NO: 796943 - RNA, 12 nt, Mycobacterium avium subsp. paratuberculosis
gcugcgcagcag

SEQ ID NO: 796944 - RNA, 16 nt, Mycobacterium avium subsp. paratuberculosis
gcugcgcaacaccucg

SEQ ID NO: 796945 - RNA, 21 nt, Mycobacterium avium subsp. paratuberculosis
gcugcgcaacaccucggcgac

SEQ ID NO: 796946 - RNA, 13 nt, Mycobacterium avium subsp. paratuberculosis
gcugcgcacccgg

SEQ ID NO: 796947 - RNA, 22 nt, Mycobacterium avium subsp. paratuberculosis
gcugcgcacccgguccggcugg

SEQ ID NO: 796948 - RNA, 15 nt, Mycobacterium avium subsp. paratuberculosis
gcugcgcccagcgcg

SEQ ID NO: 796949 - RNA, 16 nt, Mycobacterium avium subsp. paratuberculosis
gcugcgcccagcgcgc

SEQ ID NO: 796950 - RNA, 20 nt, Mycobacterium avium subsp. paratuberculosis
gcugcgccacaacuggccgg

SEQ ID NO: 796951 - RNA, 13 nt, Mycobacterium avium subsp. paratuberculosis
gcugcgccagccg

SEQ ID NO: 796952 - RNA, 18 nt, Mycobacterium avium subsp. paratuberculosis
gcugcgccagccgucgcc

SEQ ID NO: 796953 - RNA, 19 nt, Mycobacterium avium subsp. paratuberculosis
gcugcgccagccgucgccg

SEQ ID NO: 796954 - RNA, 13 nt, Mycobacterium avium subsp. paratuberculosis
gcugcgcccgccg

SEQ ID NO: 796955 - RNA, 15 nt, Mycobacterium avium subsp. paratuberculosis
gcugcgcccgccgcc

SEQ ID NO: 796956 - RNA, 20 nt, Mycobacterium avium subsp. paratuberculosis
gcugcgcccgccgccaccac

SEQ ID NO: 796957 - RNA, 23 nt, Mycobacterium avium subsp. paratuberculosis
gcugcgcccgccgccaccacggc

SEQ ID NO: 796958 - RNA, 24 nt, Mycobacterium avium subsp. paratuberculosis
gcugcgccgcgcuugcgaucgccg

SEQ ID NO: 796959 - RNA, 13 nt, Mycobacterium avium subsp. paratuberculosis
gcugcgcggcggc

SEQ ID NO: 796960 - RNA, 13 nt, Mycobacterium avium subsp. paratuberculosis
gcugcgcggcacg

SEQ ID NO: 796961 - RNA, 21 nt, Mycobacterium avium subsp. paratuberculosis
gcugcgcgcguuguccagcag

SEQ ID NO: 796962 - RNA, 17 nt, Mycobacterium avium subsp. paratuberculosis
gcugcgcgcgcgaucgg

SEQ ID NO: 796963 - RNA, 19 nt, Mycobacterium avium subsp. paratuberculosis
gcugcgcgcgcgaucggug

SEQ ID NO: 796964 - RNA, 15 nt, Mycobacterium avium subsp. paratuberculosis
gcugcgcgccggcgg

SEQ ID NO: 796965 - RNA, 14 nt, Mycobacterium avium subsp. paratuberculosis
gcugcgcgccggcg

SEQ ID NO: 796966 - RNA, 13 nt, Mycobacterium avium subsp. paratuberculosis
gcugcgcgccggc

SEQ ID NO: 796967 - RNA, 18 nt, Mycobacterium avium subsp. paratuberculosis
gcugcgcgccccggcccg

SEQ ID NO: 796968 - RNA, 23 nt, Mycobacterium avium subsp. paratuberculosis
gcugcgcgccccggcccggcgaa

SEQ ID NO: 796969 - RNA, 17 nt, Mycobacterium avium subsp. paratuberculosis
gcugcgcgacaccugcu

SEQ ID NO: 796970 - RNA, 14 nt, Mycobacterium avium subsp. paratuberculosis
gcugcgcgaccugc

SEQ ID NO: 796971 - RNA, 15 nt, Mycobacterium avium subsp. paratuberculosis
gcugcgccggcgcgg

SEQ ID NO: 796972 - RNA, 19 nt, Mycobacterium avium subsp. paratuberculosis
gcugcgccggcgcggccag

SEQ ID NO: 796973 - RNA, 15 nt, Mycobacterium avium subsp. paratuberculosis
gcugcgccgcgucga

SEQ ID NO: 796974 - RNA, 21 nt, Mycobacterium avium subsp. paratuberculosis
gcugcgccgcgucgacgccgc

SEQ ID NO: 796975 - RNA, 18 nt, Mycobacterium avium subsp. paratuberculosis
gcugcggauaaccgucca

SEQ ID NO: 796976 - RNA, 22 nt, Mycobacterium avium subsp. paratuberculosis
gcugcggauaaccguccacacc

SEQ ID NO: 796977 - RNA, 19 nt, Mycobacterium avium subsp. paratuberculosis
gcugcgcuucgagcagauc

SEQ ID NO: 796978 - RNA, 19 nt, Mycobacterium avium subsp. paratuberculosis
gcugcggcaaugccguugg

SEQ ID NO: 796979 - RNA, 15 nt, Mycobacterium avium subsp. paratuberculosis
gcugcggccccggug

SEQ ID NO: 796980 - RNA, 14 nt, Mycobacterium avium subsp. paratuberculosis
gcugcgcgccgccc

SEQ ID NO: 796981 - RNA, 18 nt, Mycobacterium avium subsp. paratuberculosis
gcugcgcucgccgucggc

SEQ ID NO: 796982 - RNA, 21 nt, Mycobacterium avium subsp. paratuberculosis
gcugcgcucgccgucggccag

SEQ ID NO: 796983 - RNA, 17 nt, Mycobacterium avium subsp. paratuberculosis
gcugcggaaaugcccgc

SEQ ID NO: 796984 - RNA, 18 nt, Mycobacterium avium subsp. paratuberculosis
gcugcggaaaugcccgcg

SEQ ID NO: 796985 - RNA, 19 nt, Mycobacterium avium subsp. paratuberculosis
gcugcggaaaugcccgcgc

SEQ ID NO: 796986 - RNA, 14 nt, Mycobacterium avium subsp. paratuberculosis
gcugcggaacccac

SEQ ID NO: 796987 - RNA, 19 nt, Mycobacterium avium subsp. paratuberculosis
gcugcggaacccacgugcg

SEQ ID NO: 796988 - RNA, 20 nt, Mycobacterium avium subsp. paratuberculosis
gcugcggaacccacgugcgg

SEQ ID NO: 796989 - RNA, 21 nt, Mycobacterium avium subsp. paratuberculosis
gcugcggaacccacgugcggc

SEQ ID NO: 796990 - RNA, 16 nt, Mycobacterium avium subsp. paratuberculosis
gcugcggaaucacuuc

SEQ ID NO: 796991 - RNA, 21 nt, Mycobacterium avium subsp. paratuberculosis
gcugcggaaucacuuccgcgg

SEQ ID NO: 796992 - RNA, 22 nt, Mycobacterium avium subsp. paratuberculosis
gcugcggaaucacuuccgcggc

SEQ ID NO: 796993 - RNA, 14 nt, Mycobacterium avium subsp. paratuberculosis
gcugcgcguucggc

SEQ ID NO: 796994 - RNA, 23 nt, Mycobacterium avium subsp. paratuberculosis
gcugcgcguucggcgccaccccg

SEQ ID NO: 796995 - RNA, 15 nt, Mycobacterium avium subsp. paratuberculosis
gcugcgcgucggccg

SEQ ID NO: 796996 - RNA, 21 nt, Mycobacterium avium subsp. paratuberculosis
gcugcgcgucgagcagcacca

SEQ ID NO: 796997 - RNA, 14 nt, Mycobacterium avium subsp. paratuberculosis
gcugcgcgggucgg

SEQ ID NO: 796998 - RNA, 16 nt, Mycobacterium avium subsp. paratuberculosis
gcugcgcgggucggcg

SEQ ID NO: 796999 - RNA, 13 nt, Mycobacterium avium subsp. paratuberculosis
gcugcgcgggcgc

SEQ ID NO: 797000 - RNA, 17 nt, Mycobacterium avium subsp. paratuberculosis
gcugcgcgggcgcggcc

SEQ ID NO: 797001 - RNA, 13 nt, Mycobacterium avium subsp. paratuberculosis
gcugcgcgguggc

SEQ ID NO: 797002 - RNA, 14 nt, Mycobacterium avium subsp. paratuberculosis
gcugcgcgguggcg

SEQ ID NO: 797003 - RNA, 17 nt, Mycobacterium avium subsp. paratuberculosis
gcugcgucggcaccagc

SEQ ID NO: 797004 - RNA, 18 nt, Mycobacterium avium subsp. paratuberculosis
gcugcgguuggccggccg

SEQ ID NO: 797005 - RNA, 21 nt, Mycobacterium avium subsp. paratuberculosis
gcugcgguuggccggccgggc

SEQ ID NO: 797006 - RNA, 22 nt, Mycobacterium avium subsp. paratuberculosis
gcugcgguuggccggccgggcg

SEQ ID NO: 797007 - RNA, 12 nt, Mycobacterium avium subsp. paratuberculosis
gcugcggcucca

SEQ ID NO: 797008 - RNA, 15 nt, Mycobacterium avium subsp. paratuberculosis
gcugcguucggcgau

SEQ ID NO: 797009 - RNA, 14 nt, Mycobacterium avium subsp. paratuberculosis
gcuuuccgacggcu

SEQ ID NO: 797010 - RNA, 19 nt, Mycobacterium avium subsp. paratuberculosis
gcuuuccggccgccucguc

SEQ ID NO: 797011 - RNA, 17 nt, Mycobacterium avium subsp. paratuberculosis
gcuuucgggucgacgag

SEQ ID NO: 797012 - RNA, 22 nt, Mycobacterium avium subsp. paratuberculosis
gcuuucgaagugacgccgcucg

SEQ ID NO: 797013 - RNA, 20 nt, Mycobacterium avium subsp. paratuberculosis
gcuuucgcgucugcucgcgg

SEQ ID NO: 797014 - RNA, 13 nt, Mycobacterium avium subsp. paratuberculosis
gcuuucggcgcca

SEQ ID NO: 797015 - RNA, 21 nt, Mycobacterium avium subsp. paratuberculosis
gcuugucguagcggcgccacc

SEQ ID NO: 797016 - RNA, 17 nt, Mycobacterium avium subsp. paratuberculosis
gcuugucggcguggccg

SEQ ID NO: 797017 - RNA, 19 nt, Mycobacterium avium subsp. paratuberculosis
gcuucuugcugccgucggu

SEQ ID NO: 797018 - RNA, 18 nt, Mycobacterium avium subsp. paratuberculosis
gcuugaaaguccgccgac

SEQ ID NO: 797019 - RNA, 15 nt, Mycobacterium avium subsp. paratuberculosis
gcuugaacgccgccc

SEQ ID NO: 797020 - RNA, 17 nt, Mycobacterium avium subsp. paratuberculosis
ggaaaagugggucagcc

SEQ ID NO: 797021 - RNA, 15 nt, Mycobacterium avium subsp. paratuberculosis
gcuuuggaccagggc

SEQ ID NO: 797022 - RNA, 16 nt, Mycobacterium avium subsp. paratuberculosis
gcuuuggaccagggcg

SEQ ID NO: 797023 - RNA, 16 nt, Mycobacterium avium subsp. paratuberculosis
ggaaaccaccugccgc

SEQ ID NO: 797024 - RNA, 14 nt, Mycobacterium avium subsp. paratuberculosis
ggaaacgacgucgc

SEQ ID NO: 797025 - RNA, 20 nt, Mycobacterium avium subsp. paratuberculosis
ggaaacccucgacgccgggc

SEQ ID NO: 797026 - RNA, 17 nt, Mycobacterium avium subsp. paratuberculosis
ggaaaccucuugcggcg

SEQ ID NO: 797027 - RNA, 18 nt, Mycobacterium avium subsp. paratuberculosis
ggaaaccucuugcggcgc

SEQ ID NO: 797028 - RNA, 23 nt, Mycobacterium avium subsp. paratuberculosis
ggaaacuccuggccccgaucauc

SEQ ID NO: 797029 - RNA, 16 nt, Mycobacterium avium subsp. paratuberculosis
ggaaauagguguagcc

SEQ ID NO: 797030 - RNA, 14 nt, Mycobacterium avium subsp. paratuberculosis
ggaaaugcgucggc

SEQ ID NO: 797031 - RNA, 12 nt, Mycobacterium avium subsp. paratuberculosis
ggaacaacgcgc

SEQ ID NO: 797032 - RNA, 17 nt, Mycobacterium avium subsp. paratuberculosis
ggaacaccgagccggcg

SEQ ID NO: 797033 - RNA, 16 nt, Mycobacterium avium subsp. paratuberculosis
ggaacaccacggccgg

SEQ ID NO: 797034 - RNA, 17 nt, Mycobacterium avium subsp. paratuberculosis
ggaacaccacggccggc

SEQ ID NO: 797035 - RNA, 19 nt, Mycobacterium avium subsp. paratuberculosis
ggaacaccacggccggcaa

SEQ ID NO: 797036 - RNA, 20 nt, Mycobacterium avium subsp. paratuberculosis
ggaacaccacgucguccagc

SEQ ID NO: 797037 - RNA, 19 nt, Mycobacterium avium subsp. paratuberculosis
ggaacaucccggagccguc

SEQ ID NO: 797038 - RNA, 15 nt, Mycobacterium avium subsp. paratuberculosis
ggaacagcgggccgg

SEQ ID NO: 797039 - RNA, 21 nt, Mycobacterium avium subsp. paratuberculosis
ggaacagcgggccggcgucgu

SEQ ID NO: 797040 - RNA, 24 nt, Mycobacterium avium subsp. paratuberculosis
ggaacagacucagcccggcccagc

SEQ ID NO: 797041 - RNA, 14 nt, Mycobacterium avium subsp. paratuberculosis
ggaacagcccgccc

SEQ ID NO: 797042 - RNA, 14 nt, Mycobacterium avium subsp. paratuberculosis
ggaacacgucggcg

SEQ ID NO: 797043 - RNA, 15 nt, Mycobacterium avium subsp. paratuberculosis
ggaacagacacagca

SEQ ID NO: 797044 - RNA, 18 nt, Mycobacterium avium subsp. paratuberculosis
ggaacagacacagcacgc

SEQ ID NO: 797045 - RNA, 20 nt, Mycobacterium avium subsp. paratuberculosis
ggaacccgcguggcaggucg

SEQ ID NO: 797046 - RNA, 20 nt, Mycobacterium avium subsp. paratuberculosis
ggaacccggguggcccgcac

SEQ ID NO: 797047 - RNA, 18 nt, Mycobacterium avium subsp. paratuberculosis
ggaacccacgugcggcgc

SEQ ID NO: 797048 - RNA, 12 nt, Mycobacterium avium subsp. paratuberculosis
ggaacauggccu

SEQ ID NO: 797049 - RNA, 16 nt, Mycobacterium avium subsp. paratuberculosis
ggaacaucuccagcgc

SEQ ID NO: 797050 - RNA, 18 nt, Mycobacterium avium subsp. paratuberculosis
ggaacaucuccagcgcgg

SEQ ID NO: 797051 - RNA, 19 nt, Mycobacterium avium subsp. paratuberculosis
ggaacaucuccagcgcggu

SEQ ID NO: 797052 - RNA, 16 nt, Mycobacterium avium subsp. paratuberculosis
ggaaguucucgccgug

SEQ ID NO: 797053 - RNA, 15 nt, Mycobacterium avium subsp. paratuberculosis
ggaagugcacgccga

SEQ ID NO: 797054 - RNA, 12 nt, Mycobacterium avium subsp. paratuberculosis
ggaagucgucgu

SEQ ID NO: 797055 - RNA, 22 nt, Mycobacterium avium subsp. paratuberculosis
ggaagcugccguugcgccagcg

SEQ ID NO: 797056 - RNA, 17 nt, Mycobacterium avium subsp. paratuberculosis
ggaagucgaccggggcg

SEQ ID NO: 797057 - RNA, 21 nt, Mycobacterium avium subsp. paratuberculosis
ggaagucgaccggggcgcccc

SEQ ID NO: 797058 - RNA, 20 nt, Mycobacterium avium subsp. paratuberculosis
ggaagucgccguccggggcc

SEQ ID NO: 797059 - RNA, 19 nt, Mycobacterium avium subsp. paratuberculosis
ggaagcgcaucgccggcgc

SEQ ID NO: 797060 - RNA, 20 nt, Mycobacterium avium subsp. paratuberculosis
ggaagcgcaucgccggcgcg

SEQ ID NO: 797061 - RNA, 22 nt, Mycobacterium avium subsp. paratuberculosis
ggaagcgaagcgggacugcagc

SEQ ID NO: 797062 - RNA, 17 nt, Mycobacterium avium subsp. paratuberculosis
ggaagcgaauccgggug

SEQ ID NO: 797063 - RNA, 21 nt, Mycobacterium avium subsp. paratuberculosis
ggaagcgaauccgggugucga

SEQ ID NO: 797064 - RNA, 18 nt, Mycobacterium avium subsp. paratuberculosis
ggaagcccuugcagcaca

SEQ ID NO: 797065 - RNA, 15 nt, Mycobacterium avium subsp. paratuberculosis
ggaagccggcgacga

SEQ ID NO: 797066 - RNA, 20 nt, Mycobacterium avium subsp. paratuberculosis
ggaagccgaguuuggcgucg

SEQ ID NO: 797067 - RNA, 17 nt, Mycobacterium avium subsp. paratuberculosis
ggaagccgcagcaggug

SEQ ID NO: 797068 - RNA, 22 nt, Mycobacterium avium subsp. paratuberculosis
ggaagccgcauggugcgggugu

SEQ ID NO: 797069 - RNA, 13 nt, Mycobacterium avium subsp. paratuberculosis
ggaagccgccgcc

SEQ ID NO: 797070 - RNA, 20 nt, Mycobacterium avium subsp. paratuberculosis
ggaagacguaggcggccagc

SEQ ID NO: 797071 - RNA, 21 nt, Mycobacterium avium subsp. paratuberculosis
ggaagaucgcagcggugacac

SEQ ID NO: 797072 - RNA, 14 nt, Mycobacterium avium subsp. paratuberculosis
ggaagauguccucg

SEQ ID NO: 797073 - RNA, 13 nt, Mycobacterium avium subsp. paratuberculosis
ggaaugcaucgcg

SEQ ID NO: 797074 - RNA, 16 nt, Mycobacterium avium subsp. paratuberculosis
ggaauuugcggcccgg

SEQ ID NO: 797075 - RNA, 20 nt, Mycobacterium avium subsp. paratuberculosis
ggaauugaagcccugcucgg

SEQ ID NO: 797076 - RNA, 16 nt, Mycobacterium avium subsp. paratuberculosis
ggaauucgccgacgcg

SEQ ID NO: 797077 - RNA, 18 nt, Mycobacterium avium subsp. paratuberculosis
ggaauucgggugcggcgu

SEQ ID NO: 797078 - RNA, 19 nt, Mycobacterium avium subsp. paratuberculosis
ggaauucuggccgaccgcc

SEQ ID NO: 797079 - RNA, 23 nt, Mycobacterium avium subsp. paratuberculosis
ggaaugucauuugagcggccgac

SEQ ID NO: 797080 - RNA, 15 nt, Mycobacterium avium subsp. paratuberculosis
ggaaugucgcgcagc

SEQ ID NO: 797081 - RNA, 14 nt, Mycobacterium avium subsp. paratuberculosis
ggaaugucggcguu

SEQ ID NO: 797082 - RNA, 17 nt, Mycobacterium avium subsp. paratuberculosis
ggaauuccagcgacaac

SEQ ID NO: 797083 - RNA, 15 nt, Mycobacterium avium subsp. paratuberculosis
ggacaggucgcggua

SEQ ID NO: 797084 - RNA, 17 nt, Mycobacterium avium subsp. paratuberculosis
ggacagguagcgcagcc

SEQ ID NO: 797085 - RNA, 14 nt, Mycobacterium avium subsp. paratuberculosis
ggacaggucgauga

SEQ ID NO: 797086 - RNA, 15 nt, Mycobacterium avium subsp. paratuberculosis
ggacaggucgaugau

SEQ ID NO: 797087 - RNA, 20 nt, Mycobacterium avium subsp. paratuberculosis
ggacagggcggcgaccuucg

SEQ ID NO: 797088 - RNA, 11 nt, Mycobacterium avium subsp. paratuberculosis
ggacaggccgg

SEQ ID NO: 797089 - RNA, 16 nt, Mycobacterium avium subsp. paratuberculosis
ggacaggccggcgacg

SEQ ID NO: 797090 - RNA, 17 nt, Mycobacterium avium subsp. paratuberculosis
ggacaggccggcgacgg

SEQ ID NO: 797091 - RNA, 19 nt, Mycobacterium avium subsp. paratuberculosis
ggacaggccggcgacggcg

SEQ ID NO: 797092 - RNA, 17 nt, Mycobacterium avium subsp. paratuberculosis
ggacagggaggacagca

SEQ ID NO: 797093 - RNA, 20 nt, Mycobacterium avium subsp. paratuberculosis
ggacagggaggacagcaccg

SEQ ID NO: 797094 - RNA, 15 nt, Mycobacterium avium subsp. paratuberculosis
ggaccagcgcggugc

SEQ ID NO: 797095 - RNA, 18 nt, Mycobacterium avium subsp. paratuberculosis
ggaccaggguggccccag

SEQ ID NO: 797096 - RNA, 22 nt, Mycobacterium avium subsp. paratuberculosis
ggaccagguauucaucgcggcc

SEQ ID NO: 797097 - RNA, 23 nt, Mycobacterium avium subsp. paratuberculosis
ggacaucaagugcaagggcgaca

SEQ ID NO: 797098 - RNA, 22 nt, Mycobacterium avium subsp. paratuberculosis
ggacauccauugggccgcggcg

SEQ ID NO: 797099 - RNA, 17 nt, Mycobacterium avium subsp. paratuberculosis
ggacaucgccucggcgu

SEQ ID NO: 797100 - RNA, 19 nt, Mycobacterium avium subsp. paratuberculosis
ggacaucgccucggcgucc

SEQ ID NO: 797101 - RNA, 13 nt, Mycobacterium avium subsp. paratuberculosis
ggacaucggcagc

SEQ ID NO: 797102 - RNA, 18 nt, Mycobacterium avium subsp. paratuberculosis
ggacgaguggucggccgc

SEQ ID NO: 797103 - RNA, 22 nt, Mycobacterium avium subsp. paratuberculosis
ggacgaugcggggccggcggcg

SEQ ID NO: 797104 - RNA, 16 nt, Mycobacterium avium subsp. paratuberculosis
ggacgaugccgcggcg

SEQ ID NO: 797105 - RNA, 20 nt, Mycobacterium avium subsp. paratuberculosis
ggacgaugccgcggcguccc

SEQ ID NO: 797106 - RNA, 21 nt, Mycobacterium avium subsp. paratuberculosis
ggacgaugcgcacccccgggg

SEQ ID NO: 797107 - RNA, 15 nt, Mycobacterium avium subsp. paratuberculosis
ggaccgggugaccgg

SEQ ID NO: 797108 - RNA, 18 nt, Mycobacterium avium subsp. paratuberculosis
ggaccgggugaccggcgc

SEQ ID NO: 797109 - RNA, 23 nt, Mycobacterium avium subsp. paratuberculosis
ggaccgggugaccggcgcgcagc

SEQ ID NO: 797110 - RNA, 19 nt, Mycobacterium avium subsp. paratuberculosis
ggaccgguaggcgcaccgc

SEQ ID NO: 797111 - RNA, 21 nt, Mycobacterium avium subsp. paratuberculosis
ggaccgguaggcgcaccgccg

SEQ ID NO: 797112 - RNA, 23 nt, Mycobacterium avium subsp. paratuberculosis
ggaccgguccuccccgcuggcgc

SEQ ID NO: 797113 - RNA, 20 nt, Mycobacterium avium subsp. paratuberculosis
ggaccggccagcagccgcuc

SEQ ID NO: 797114 - RNA, 16 nt, Mycobacterium avium subsp. paratuberculosis
ggaccgggcgggcugc

SEQ ID NO: 797115 - RNA, 21 nt, Mycobacterium avium subsp. paratuberculosis
ggacgcccaacuacccgccga

SEQ ID NO: 797116 - RNA, 19 nt, Mycobacterium avium subsp. paratuberculosis
ggacgcagcgaucggcggc

SEQ ID NO: 797117 - RNA, 23 nt, Mycobacterium avium subsp. paratuberculosis
ggacgcagcgaucggcggcucgc

SEQ ID NO: 797118 - RNA, 18 nt, Mycobacterium avium subsp. paratuberculosis
ggacgccagcaugaucac

SEQ ID NO: 797119 - RNA, 20 nt, Mycobacterium avium subsp. paratuberculosis
ggacgccagcaugaucaccg

SEQ ID NO: 797120 - RNA, 16 nt, Mycobacterium avium subsp. paratuberculosis
ggacgauucgcgauca

SEQ ID NO: 797121 - RNA, 17 nt, Mycobacterium avium subsp. paratuberculosis
ggacgauucgcgaucaa

SEQ ID NO: 797122 - RNA, 17 nt, Mycobacterium avium subsp. paratuberculosis
ggaccgggacgacggcg

SEQ ID NO: 797123 - RNA, 19 nt, Mycobacterium avium subsp. paratuberculosis
ggaccgggacgacggcgcc

SEQ ID NO: 797124 - RNA, 18 nt, Mycobacterium avium subsp. paratuberculosis
ggaccgcuugacgccgcc

SEQ ID NO: 797125 - RNA, 14 nt, Mycobacterium avium subsp. paratuberculosis
ggaccgggcccggc

SEQ ID NO: 797126 - RNA, 16 nt, Mycobacterium avium subsp. paratuberculosis
ggaccgggcccggcgc

SEQ ID NO: 797127 - RNA, 19 nt, Mycobacterium avium subsp. paratuberculosis
ggaccggcgauuucggccg

SEQ ID NO: 797128 - RNA, 20 nt, Mycobacterium avium subsp. paratuberculosis
ggaccggcgauuucggccgu

SEQ ID NO: 797129 - RNA, 16 nt, Mycobacterium avium subsp. paratuberculosis
ggaccggcgccggccg

SEQ ID NO: 797130 - RNA, 13 nt, Mycobacterium avium subsp. paratuberculosis
ggaccggcggccg

SEQ ID NO: 797131 - RNA, 19 nt, Mycobacterium avium subsp. paratuberculosis
ggaccggcggccgccauca

SEQ ID NO: 797132 - RNA, 20 nt, Mycobacterium avium subsp. paratuberculosis
ggaccgcggucgggucccgg

SEQ ID NO: 797133 - RNA, 14 nt, Mycobacterium avium subsp. paratuberculosis
ggacccauucgucg

SEQ ID NO: 797134 - RNA, 17 nt, Mycobacterium avium subsp. paratuberculosis
ggacccauucgucggcg

SEQ ID NO: 797135 - RNA, 16 nt, Mycobacterium avium subsp. paratuberculosis
ggaccccacagcgcgc

SEQ ID NO: 797136 - RNA, 19 nt, Mycobacterium avium subsp. paratuberculosis
ggaccccgaugcgcucacc

SEQ ID NO: 797137 - RNA, 20 nt, Mycobacterium avium subsp. paratuberculosis
ggacccgacggucgggccca

SEQ ID NO: 797138 - RNA, 23 nt, Mycobacterium avium subsp. paratuberculosis
ggacccgacggucgggcccaggu

SEQ ID NO: 797139 - RNA, 15 nt, Mycobacterium avium subsp. paratuberculosis
ggaccgcgcgccggc

SEQ ID NO: 797140 - RNA, 16 nt, Mycobacterium avium subsp. paratuberculosis
ggaccgcgcgccggcc

SEQ ID NO: 797141 - RNA, 19 nt, Mycobacterium avium subsp. paratuberculosis
ggaccgcgcgccggccagc

SEQ ID NO: 797142 - RNA, 14 nt, Mycobacterium avium subsp. paratuberculosis
ggaccgcgcgggcc

SEQ ID NO: 797143 - RNA, 17 nt, Mycobacterium avium subsp. paratuberculosis
ggaccgcgcgggccagc

SEQ ID NO: 797144 - RNA, 23 nt, Mycobacterium avium subsp. paratuberculosis
ggaccaucuacgaccucgaagaa

SEQ ID NO: 797145 - RNA, 14 nt, Mycobacterium avium subsp. paratuberculosis
ggacccagcccggc

SEQ ID NO: 797146 - RNA, 15 nt, Mycobacterium avium subsp. paratuberculosis
ggacuugucgccguu

SEQ ID NO: 797147 - RNA, 17 nt, Mycobacterium avium subsp. paratuberculosis
ggacuugucgccguugu

SEQ ID NO: 797148 - RNA, 20 nt, Mycobacterium avium subsp. paratuberculosis
ggacuuucgcgucugcucgc

SEQ ID NO: 797149 - RNA, 14 nt, Mycobacterium avium subsp. paratuberculosis
ggacugggcgauug

SEQ ID NO: 797150 - RNA, 17 nt, Mycobacterium avium subsp. paratuberculosis
ggacuggccaccgcgau

SEQ ID NO: 797151 - RNA, 15 nt, Mycobacterium avium subsp. paratuberculosis
ggagacagccgagau

SEQ ID NO: 797152 - RNA, 18 nt, Mycobacterium avium subsp. paratuberculosis
ggagaaguccuuguggcc

SEQ ID NO: 797153 - RNA, 17 nt, Mycobacterium avium subsp. paratuberculosis
ggagaaguggcugguca

SEQ ID NO: 797154 - RNA, 16 nt, Mycobacterium avium subsp. paratuberculosis
ggagaaggccgcgcgc

SEQ ID NO: 797155 - RNA, 19 nt, Mycobacterium avium subsp. paratuberculosis
ggagaacgucaggcccagc

SEQ ID NO: 797156 - RNA, 13 nt, Mycobacterium avium subsp. paratuberculosis
ggagaacucgacg

SEQ ID NO: 797157 - RNA, 14 nt, Mycobacterium avium subsp. paratuberculosis
ggagaacucgaucu

SEQ ID NO: 797158 - RNA, 23 nt, Mycobacterium avium subsp. paratuberculosis
ggagaacucgaucugcagccggc

SEQ ID NO: 797159 - RNA, 24 nt, Mycobacterium avium subsp. paratuberculosis
ggagaacucgaucugcagccggcg

SEQ ID NO: 797160 - RNA, 19 nt, Mycobacterium avium subsp. paratuberculosis
ggagaacauuucgucgaag

SEQ ID NO: 797161 - RNA, 22 nt, Mycobacterium avium subsp. paratuberculosis
ggagaaccgcucgauggcgccg

SEQ ID NO: 797162 - RNA, 21 nt, Mycobacterium avium subsp. paratuberculosis
ggacugaaguaguacgaccgc

SEQ ID NO: 797163 - RNA, 22 nt, Mycobacterium avium subsp. paratuberculosis
ggacuccuucaucgaucgggug

SEQ ID NO: 797164 - RNA, 21 nt, Mycobacterium avium subsp. paratuberculosis
ggacucguuggggccaccaga

SEQ ID NO: 797165 - RNA, 16 nt, Mycobacterium avium subsp. paratuberculosis
ggacucgaucgccacc

SEQ ID NO: 797166 - RNA, 17 nt, Mycobacterium avium subsp. paratuberculosis
ggacucgaucgccaccg

SEQ ID NO: 797167 - RNA, 18 nt, Mycobacterium avium subsp. paratuberculosis
ggacucgaucgccaccga

SEQ ID NO: 797168 - RNA, 19 nt, Mycobacterium avium subsp. paratuberculosis
ggacguugaggcggcggcg

SEQ ID NO: 797169 - RNA, 17 nt, Mycobacterium avium subsp. paratuberculosis
ggacguugaugucgucc

SEQ ID NO: 797170 - RNA, 14 nt, Mycobacterium avium subsp. paratuberculosis
ggacgugguccggu

SEQ ID NO: 797171 - RNA, 14 nt, Mycobacterium avium subsp. paratuberculosis
ggacgucggcgcgc

SEQ ID NO: 797172 - RNA, 18 nt, Mycobacterium avium subsp. paratuberculosis
ggacuauacacgccugga

SEQ ID NO: 797173 - RNA, 17 nt, Mycobacterium avium subsp. paratuberculosis
ggacuccaccgccaccg

SEQ ID NO: 797174 - RNA, 19 nt, Mycobacterium avium subsp. paratuberculosis
ggacuccaccgccaccgcg

SEQ ID NO: 797175 - RNA, 15 nt, Mycobacterium avium subsp. paratuberculosis
ggacuccagcaccag

SEQ ID NO: 797176 - RNA, 17 nt, Mycobacterium avium subsp. paratuberculosis
ggacuccagcaccagca

SEQ ID NO: 797177 - RNA, 22 nt, Mycobacterium avium subsp. paratuberculosis
ggacuccagcaccagcacggcg

SEQ ID NO: 797178 - RNA, 20 nt, Mycobacterium avium subsp. paratuberculosis
ggacuccaguugacggcgca

SEQ ID NO: 797179 - RNA, 14 nt, Mycobacterium avium subsp. paratuberculosis
ggacucccccacca

SEQ ID NO: 797180 - RNA, 17 nt, Mycobacterium avium subsp. paratuberculosis
ggacucccccaccacgu

SEQ ID NO: 797181 - RNA, 22 nt, Mycobacterium avium subsp. paratuberculosis
ggacucccccaccacguaggcg

SEQ ID NO: 797182 - RNA, 18 nt, Mycobacterium avium subsp. paratuberculosis
ggacgcgcagaucgucga

SEQ ID NO: 797183 - RNA, 14 nt, Mycobacterium avium subsp. paratuberculosis
ggacgcgcccggcg

SEQ ID NO: 797184 - RNA, 21 nt, Mycobacterium avium subsp. paratuberculosis
ggacgcggcaggcgccccagc

SEQ ID NO: 797185 - RNA, 13 nt, Mycobacterium avium subsp. paratuberculosis
ggacgcggccagc

SEQ ID NO: 797186 - RNA, 20 nt, Mycobacterium avium subsp. paratuberculosis
ggacgcggccagcgcccgcg

SEQ ID NO: 797187 - RNA, 21 nt, Mycobacterium avium subsp. paratuberculosis
ggacgcggccagcgcccgcgc

SEQ ID NO: 797188 - RNA, 15 nt, Mycobacterium avium subsp. paratuberculosis
ggacgcggucgccgc

SEQ ID NO: 797189 - RNA, 19 nt, Mycobacterium avium subsp. paratuberculosis
ggacgcggucgccgcccac

SEQ ID NO: 797190 - RNA, 21 nt, Mycobacterium avium subsp. paratuberculosis
ggacgcggucgccgcccacgc

SEQ ID NO: 797191 - RNA, 14 nt, Mycobacterium avium subsp. paratuberculosis
ggacgcugaacagc

SEQ ID NO: 797192 - RNA, 22 nt, Mycobacterium avium subsp. paratuberculosis
ggacgcugaucuacgucggcug

SEQ ID NO: 797193 - RNA, 19 nt, Mycobacterium avium subsp. paratuberculosis
ggacggcuuggguguggcg

SEQ ID NO: 797194 - RNA, 23 nt, Mycobacterium avium subsp. paratuberculosis
ggacgggaccacccgcagcgcgg

SEQ ID NO: 797195 - RNA, 18 nt, Mycobacterium avium subsp. paratuberculosis
ggacggcgaacuuggccg

SEQ ID NO: 797196 - RNA, 14 nt, Mycobacterium avium subsp. paratuberculosis
ggacggcgacggca

SEQ ID NO: 797197 - RNA, 16 nt, Mycobacterium avium subsp. paratuberculosis
ggacggcgacggcagc

SEQ ID NO: 797198 - RNA, 23 nt, Mycobacterium avium subsp. paratuberculosis
ggacggcgaggaucgcgaugucg

SEQ ID NO: 797199 - RNA, 20 nt, Mycobacterium avium subsp. paratuberculosis
ggacggcgcgguggcgugca

SEQ ID NO: 797200 - RNA, 16 nt, Mycobacterium avium subsp. paratuberculosis
ggacggaaaucgccug

SEQ ID NO: 797201 - RNA, 23 nt, Mycobacterium avium subsp. paratuberculosis
ggacggaucgagucccgcgcggc

SEQ ID NO: 797202 - RNA, 12 nt, Mycobacterium avium subsp. paratuberculosis
ggacgucgucga

SEQ ID NO: 797203 - RNA, 14 nt, Mycobacterium avium subsp. paratuberculosis
ggacgucgucgacg

SEQ ID NO: 797204 - RNA, 15 nt, Mycobacterium avium subsp. paratuberculosis
ggacgucgucgacgu

SEQ ID NO: 797205 - RNA, 12 nt, Mycobacterium avium subsp. paratuberculosis
ggacgucgucgc

SEQ ID NO: 797206 - RNA, 15 nt, Mycobacterium avium subsp. paratuberculosis
ggacgucgucgcugu

SEQ ID NO: 797207 - RNA, 12 nt, Mycobacterium avium subsp. paratuberculosis
ggacgucgucgu

SEQ ID NO: 797208 - RNA, 16 nt, Mycobacterium avium subsp. paratuberculosis
ggacgucgucguccca

SEQ ID NO: 797209 - RNA, 14 nt, Mycobacterium avium subsp. paratuberculosis
ggacguccgcgcga

SEQ ID NO: 797210 - RNA, 21 nt, Mycobacterium avium subsp. paratuberculosis
ggacgucgacgugggcggcca

SEQ ID NO: 797211 - RNA, 14 nt, Mycobacterium avium subsp. paratuberculosis
ggacgucggccggc

SEQ ID NO: 797212 - RNA, 21 nt, Mycobacterium avium subsp. paratuberculosis
ggacgucggccggcugcagcc

SEQ ID NO: 797213 - RNA, 18 nt, Mycobacterium avium subsp. paratuberculosis
ggacgguuucugccggcc

SEQ ID NO: 797214 - RNA, 17 nt, Mycobacterium avium subsp. paratuberculosis
ggacgucaggccgguca

SEQ ID NO: 797215 - RNA, 18 nt, Mycobacterium avium subsp. paratuberculosis
ggacguccagcggcccuc

SEQ ID NO: 797216 - RNA, 19 nt, Mycobacterium avium subsp. paratuberculosis
ggacggguugggcgccagc

SEQ ID NO: 797217 - RNA, 20 nt, Mycobacterium avium subsp. paratuberculosis
ggacggguugggcgccagca

SEQ ID NO: 797218 - RNA, 16 nt, Mycobacterium avium subsp. paratuberculosis
ggacggggcgaugccg

SEQ ID NO: 797219 - RNA, 17 nt, Mycobacterium avium subsp. paratuberculosis
ggacgggcgugacaggg

SEQ ID NO: 797220 - RNA, 17 nt, Mycobacterium avium subsp. paratuberculosis
ggacgggggugccgacc

SEQ ID NO: 797221 - RNA, 15 nt, Mycobacterium avium subsp. paratuberculosis
ggacgggucgaccgc

SEQ ID NO: 797222 - RNA, 18 nt, Mycobacterium avium subsp. paratuberculosis
ggacggccagcccgucgg

SEQ ID NO: 797223 - RNA, 15 nt, Mycobacterium avium subsp. paratuberculosis
ggacgggcauccggc

SEQ ID NO: 797224 - RNA, 19 nt, Mycobacterium avium subsp. paratuberculosis
gcuucaucccgucguugaa

SEQ ID NO: 797225 - RNA, 18 nt, Mycobacterium avium subsp. paratuberculosis
gcuucauaugacgccggc

SEQ ID NO: 797226 - RNA, 16 nt, Mycobacterium avium subsp. paratuberculosis
gcuucaggcagcgcac

SEQ ID NO: 797227 - RNA, 17 nt, Mycobacterium avium subsp. paratuberculosis
gcuucaggcagcgcacg

SEQ ID NO: 797228 - RNA, 19 nt, Mycobacterium avium subsp. paratuberculosis
gcuucaugcccuuggcccg

SEQ ID NO: 797229 - RNA, 15 nt, Mycobacterium avium subsp. paratuberculosis
gcuuccagcgcggcg

SEQ ID NO: 797230 - RNA, 12 nt, Mycobacterium avium subsp. paratuberculosis
gcuucacgcucg

SEQ ID NO: 797231 - RNA, 14 nt, Mycobacterium avium subsp. paratuberculosis
gcuucacgcucggc

SEQ ID NO: 797232 - RNA, 15 nt, Mycobacterium avium subsp. paratuberculosis
gcuucacgcucggca

SEQ ID NO: 797233 - RNA, 15 nt, Mycobacterium avium subsp. paratuberculosis
gcuucacgcucggcg

SEQ ID NO: 797234 - RNA, 19 nt, Mycobacterium avium subsp. paratuberculosis
gcuucacgcucggcgccga

SEQ ID NO: 797235 - RNA, 24 nt, Mycobacterium avium subsp. paratuberculosis
gcuucacgcucggcgccgagcgug

SEQ ID NO: 797236 - RNA, 22 nt, Mycobacterium avium subsp. paratuberculosis
gcuucacggucggagcccagcg

SEQ ID NO: 797237 - RNA, 15 nt, Mycobacterium avium subsp. paratuberculosis
gcuucacguucggcg

SEQ ID NO: 797238 - RNA, 16 nt, Mycobacterium avium subsp. paratuberculosis
gcuuaccgaccucgag

SEQ ID NO: 797239 - RNA, 14 nt, Mycobacterium avium subsp. paratuberculosis
gcuguugaccacgg

SEQ ID NO: 797240 - RNA, 21 nt, Mycobacterium avium subsp. paratuberculosis
gcuguugaccacggccuggua

SEQ ID NO: 797241 - RNA, 15 nt, Mycobacterium avium subsp. paratuberculosis
gcuguugacgggccg

SEQ ID NO: 797242 - RNA, 17 nt, Mycobacterium avium subsp. paratuberculosis
gcuuagccccucccacc

SEQ ID NO: 797243 - RNA, 20 nt, Mycobacterium avium subsp. paratuberculosis
gcuuagccccucccaccacg

SEQ ID NO: 797244 - RNA, 20 nt, Mycobacterium avium subsp. paratuberculosis
gcuucugcccggccagcagg

SEQ ID NO: 797245 - RNA, 19 nt, Mycobacterium avium subsp. paratuberculosis
gcuucucggugaucacccg

SEQ ID NO: 797246 - RNA, 14 nt, Mycobacterium avium subsp. paratuberculosis
gcuucugcgccggu

SEQ ID NO: 797247 - RNA, 15 nt, Mycobacterium avium subsp. paratuberculosis
gcuucugcagcucgc

SEQ ID NO: 797248 - RNA, 17 nt, Mycobacterium avium subsp. paratuberculosis
gcuucugcagcucgcug

SEQ ID NO: 797249 - RNA, 14 nt, Mycobacterium avium subsp. paratuberculosis
gcuucucgccgucg

SEQ ID NO: 797250 - RNA, 14 nt, Mycobacterium avium subsp. paratuberculosis
gcuucuccucggua

SEQ ID NO: 797251 - RNA, 11 nt, Mycobacterium avium subsp. paratuberculosis
gcuucgccgcg

SEQ ID NO: 797252 - RNA, 12 nt, Mycobacterium avium subsp. paratuberculosis
gcuucggcgccg

SEQ ID NO: 797253 - RNA, 15 nt, Mycobacterium avium subsp. paratuberculosis
gcuucguacggcccg

SEQ ID NO: 797254 - RNA, 16 nt, Mycobacterium avium subsp. paratuberculosis
gcuucguacggcccgg

SEQ ID NO: 797255 - RNA, 21 nt, Mycobacterium avium subsp. paratuberculosis
gcuucgggcgcgcgcgccacg

SEQ ID NO: 797256 - RNA, 15 nt, Mycobacterium avium subsp. paratuberculosis
gcuucgggaucagcg

SEQ ID NO: 797257 - RNA, 15 nt, Mycobacterium avium subsp. paratuberculosis
gcuucgggugcgggu

SEQ ID NO: 797258 - RNA, 23 nt, Mycobacterium avium subsp. paratuberculosis
gcuucggguuguuguccgaccag

SEQ ID NO: 797259 - RNA, 17 nt, Mycobacterium avium subsp. paratuberculosis
gcuucgcccggcugcgc

SEQ ID NO: 797260 - RNA, 19 nt, Mycobacterium avium subsp. paratuberculosis
gcuucgccgccgcaccggc

SEQ ID NO: 797261 - RNA, 20 nt, Mycobacterium avium subsp. paratuberculosis
gcuucgccgccgcaccggcc

SEQ ID NO: 797262 - RNA, 21 nt, Mycobacterium avium subsp. paratuberculosis
gcuucgccgccgcaccggccg

SEQ ID NO: 797263 - RNA, 15 nt, Mycobacterium avium subsp. paratuberculosis
gcuucgccgcgcuug

SEQ ID NO: 797264 - RNA, 21 nt, Mycobacterium avium subsp. paratuberculosis
gcuucgccgcgcuugcgaccg

SEQ ID NO: 797265 - RNA, 22 nt, Mycobacterium avium subsp. paratuberculosis
gcuucgccgcgcuugcgaccgc

SEQ ID NO: 797266 - RNA, 15 nt, Mycobacterium avium subsp. paratuberculosis
gcuucgaacgcccgc

SEQ ID NO: 797267 - RNA, 21 nt, Mycobacterium avium subsp. paratuberculosis
gcuucgaacgcccgcaccacg

SEQ ID NO: 797268 - RNA, 18 nt, Mycobacterium avium subsp. paratuberculosis
gcuuccuccucggcgcgg

SEQ ID NO: 797269 - RNA, 13 nt, Mycobacterium avium subsp. paratuberculosis
gcuucccacccgg

SEQ ID NO: 797270 - RNA, 12 nt, Mycobacterium avium subsp. paratuberculosis
gcuucccggcgg

SEQ ID NO: 797271 - RNA, 15 nt, Mycobacterium avium subsp. paratuberculosis
gcuucccggcggucg

SEQ ID NO: 797272 - RNA, 15 nt, Mycobacterium avium subsp. paratuberculosis
gcuuccgccgagacg

SEQ ID NO: 797273 - RNA, 19 nt, Mycobacterium avium subsp. paratuberculosis
gcuuccgccgagacggcgu

SEQ ID NO: 797274 - RNA, 13 nt, Mycobacterium avium subsp. paratuberculosis
gcuuccgccgagu

SEQ ID NO: 797275 - RNA, 20 nt, Mycobacterium avium subsp. paratuberculosis
gcuuccgccgagucgcgccg

SEQ ID NO: 797276 - RNA, 13 nt, Mycobacterium avium subsp. paratuberculosis
gcuguagcacccg

SEQ ID NO: 797277 - RNA, 14 nt, Mycobacterium avium subsp. paratuberculosis
gcuguagcacccgg

SEQ ID NO: 797278 - RNA, 22 nt, Mycobacterium avium subsp. paratuberculosis
gcuguaccgcgagaucagcgcc

SEQ ID NO: 797279 - RNA, 15 nt, Mycobacterium avium subsp. paratuberculosis
gcugguccggccggc

SEQ ID NO: 797280 - RNA, 16 nt, Mycobacterium avium subsp. paratuberculosis
gcugguccggccggcc

SEQ ID NO: 797281 - RNA, 19 nt, Mycobacterium avium subsp. paratuberculosis
gcuggucccacagcggggu

SEQ ID NO: 797282 - RNA, 21 nt, Mycobacterium avium subsp. paratuberculosis
gcuggucccacagcggggucg

SEQ ID NO: 797283 - RNA, 22 nt, Mycobacterium avium subsp. paratuberculosis
gcuggucaugccgucgacgacg

SEQ ID NO: 797284 - RNA, 24 nt, Mycobacterium avium subsp. paratuberculosis
gcuggucaugccgucgacgacggu

SEQ ID NO: 797285 - RNA, 16 nt, Mycobacterium avium subsp. paratuberculosis
gcugguggugaucggc

SEQ ID NO: 797286 - RNA, 20 nt, Mycobacterium avium subsp. paratuberculosis
gcuggugucccgcguggccg

SEQ ID NO: 797287 - RNA, 14 nt, Mycobacterium avium subsp. paratuberculosis
gcuguggccguuga

SEQ ID NO: 797288 - RNA, 21 nt, Mycobacterium avium subsp. paratuberculosis
gcugugggagguacucgagcg

SEQ ID NO: 797289 - RNA, 22 nt, Mycobacterium avium subsp. paratuberculosis
gcugugggccagcagcgucguc

SEQ ID NO: 797290 - RNA, 18 nt, Mycobacterium avium subsp. paratuberculosis
gcugugggcgcagggccg

SEQ ID NO: 797291 - RNA, 20 nt, Mycobacterium avium subsp. paratuberculosis
gcuguucgggcagauggucg

SEQ ID NO: 797292 - RNA, 20 nt, Mycobacterium avium subsp. paratuberculosis
gcuguucgucgaguucgcgg

SEQ ID NO: 797293 - RNA, 21 nt, Mycobacterium avium subsp. paratuberculosis
gcuguucgucgaguucgcggc

SEQ ID NO: 797294 - RNA, 23 nt, Mycobacterium avium subsp. paratuberculosis
gcuguuccugguagucgucgugg

SEQ ID NO: 797295 - RNA, 19 nt, Mycobacterium avium subsp. paratuberculosis
gcugucgaacaccgugccg

SEQ ID NO: 797296 - RNA, 16 nt, Mycobacterium avium subsp. paratuberculosis
gcuguccucccagcgc

SEQ ID NO: 797297 - RNA, 17 nt, Mycobacterium avium subsp. paratuberculosis
gcuguccucccagcgcc

SEQ ID NO: 797298 - RNA, 14 nt, Mycobacterium avium subsp. paratuberculosis
gcuguccucgucgg

SEQ ID NO: 797299 - RNA, 11 nt, Mycobacterium avium subsp. paratuberculosis
gcuguccugcc

SEQ ID NO: 797300 - RNA, 16 nt, Mycobacterium avium subsp. paratuberculosis
gcuguccugccgggcg

SEQ ID NO: 797301 - RNA, 17 nt, Mycobacterium avium subsp. paratuberculosis
gcugucccggccgcgac

SEQ ID NO: 797302 - RNA, 15 nt, Mycobacterium avium subsp. paratuberculosis
gcuguggaugacgca

SEQ ID NO: 797303 - RNA, 17 nt, Mycobacterium avium subsp. paratuberculosis
gcuguggaacacgucgg

SEQ ID NO: 797304 - RNA, 18 nt, Mycobacterium avium subsp. paratuberculosis
gcuguggaacacgucggc

SEQ ID NO: 797305 - RNA, 19 nt, Mycobacterium avium subsp. paratuberculosis
gcuguggaacacgucggcg

SEQ ID NO: 797306 - RNA, 19 nt, Mycobacterium avium subsp. paratuberculosis
gcugucgcccucgaucgcg

SEQ ID NO: 797307 - RNA, 22 nt, Mycobacterium avium subsp. paratuberculosis
gcugucgcccucgaucgcgacc

SEQ ID NO: 797308 - RNA, 12 nt, Mycobacterium avium subsp. paratuberculosis
gcugucgccgag

SEQ ID NO: 797309 - RNA, 14 nt, Mycobacterium avium subsp. paratuberculosis
gcugucgccgaggu

SEQ ID NO: 797310 - RNA, 19 nt, Mycobacterium avium subsp. paratuberculosis
gcuggcguugagcacgcgg

SEQ ID NO: 797311 - RNA, 17 nt, Mycobacterium avium subsp. paratuberculosis
gcuggcguucgccgagg

SEQ ID NO: 797312 - RNA, 22 nt, Mycobacterium avium subsp. paratuberculosis
gcuggcguugggcgggaucgcg

SEQ ID NO: 797313 - RNA, 13 nt, Mycobacterium avium subsp. paratuberculosis
gcuggcggcgcgg

SEQ ID NO: 797314 - RNA, 17 nt, Mycobacterium avium subsp. paratuberculosis
gcuggcgugcggcgcgg

SEQ ID NO: 797315 - RNA, 17 nt, Mycobacterium avium subsp. paratuberculosis
gcuggcguggcacccgg

SEQ ID NO: 797316 - RNA, 19 nt, Mycobacterium avium subsp. paratuberculosis
gcuggcguggcacccgggc

SEQ ID NO: 797317 - RNA, 14 nt, Mycobacterium avium subsp. paratuberculosis
gcuggcguggcgcc

SEQ ID NO: 797318 - RNA, 18 nt, Mycobacterium avium subsp. paratuberculosis
gcuggcguggcgccggcg

SEQ ID NO: 797319 - RNA, 23 nt, Mycobacterium avium subsp. paratuberculosis
gcuggcguggcucggcccgccgg

SEQ ID NO: 797320 - RNA, 20 nt, Mycobacterium avium subsp. paratuberculosis
gcuggcggccaucgccgcgg

SEQ ID NO: 797321 - RNA, 22 nt, Mycobacterium avium subsp. paratuberculosis
gcuggcggccaucgccgcggug

SEQ ID NO: 797322 - RNA, 22 nt, Mycobacterium avium subsp. paratuberculosis
gcuggcggccuucuuggccgga

SEQ ID NO: 797323 - RNA, 19 nt, Mycobacterium avium subsp. paratuberculosis
gcuggcggcgaucaccgcc

SEQ ID NO: 797324 - RNA, 23 nt, Mycobacterium avium subsp. paratuberculosis
gcuggcggcgaucaccgccgcgg

SEQ ID NO: 797325 - RNA, 12 nt, Mycobacterium avium subsp. paratuberculosis
gcuggcgcuggg

SEQ ID NO: 797326 - RNA, 17 nt, Mycobacterium avium subsp. paratuberculosis
gcuggcgcuguaggcgg

SEQ ID NO: 797327 - RNA, 18 nt, Mycobacterium avium subsp. paratuberculosis
gcuggcgcuguaggcggc

SEQ ID NO: 797328 - RNA, 12 nt, Mycobacterium avium subsp. paratuberculosis
gcugcugcucgg

SEQ ID NO: 797329 - RNA, 15 nt, Mycobacterium avium subsp. paratuberculosis
gcugcugcucggccg

SEQ ID NO: 797330 - RNA, 21 nt, Mycobacterium avium subsp. paratuberculosis
gcugcugcucggccgcaucgu

SEQ ID NO: 797331 - RNA, 15 nt, Mycobacterium avium subsp. paratuberculosis
gcugcugcugcccgc

SEQ ID NO: 797332 - RNA, 20 nt, Mycobacterium avium subsp. paratuberculosis
gcugcugcacgucgccggcg

SEQ ID NO: 797333 - RNA, 16 nt, Mycobacterium avium subsp. paratuberculosis
gcugcugaugcggaca

SEQ ID NO: 797334 - RNA, 18 nt, Mycobacterium avium subsp. paratuberculosis
gcugcugcccgcccgaga

SEQ ID NO: 797335 - RNA, 19 nt, Mycobacterium avium subsp. paratuberculosis
gcugcugcccgcccgagag

SEQ ID NO: 797336 - RNA, 17 nt, Mycobacterium avium subsp. paratuberculosis
gcugcugccccucgacg

SEQ ID NO: 797337 - RNA, 18 nt, Mycobacterium avium subsp. paratuberculosis
gcugcugccccucgacga

SEQ ID NO: 797338 - RNA, 21 nt, Mycobacterium avium subsp. paratuberculosis
gcugcugccgccgcagcagcc

SEQ ID NO: 797339 - RNA, 14 nt, Mycobacterium avium subsp. paratuberculosis
gcugcugcgcggcg

SEQ ID NO: 797340 - RNA, 15 nt, Mycobacterium avium subsp. paratuberculosis
gcugcugcgcggcgg

SEQ ID NO: 797341 - RNA, 14 nt, Mycobacterium avium subsp. paratuberculosis
gcugcugcagcgcc

SEQ ID NO: 797342 - RNA, 12 nt, Mycobacterium avium subsp. paratuberculosis
gcugcugcggcc

SEQ ID NO: 797343 - RNA, 14 nt, Mycobacterium avium subsp. paratuberculosis
gcugguagacccgg

SEQ ID NO: 797344 - RNA, 17 nt, Mycobacterium avium subsp. paratuberculosis
gcugguaguacaccggg

SEQ ID NO: 797345 - RNA, 18 nt, Mycobacterium avium subsp. paratuberculosis
gcugguaguggcgugcgg

SEQ ID NO: 797346 - RNA, 19 nt, Mycobacterium avium subsp. paratuberculosis
gcuggucacccacuggcgg

SEQ ID NO: 797347 - RNA, 19 nt, Mycobacterium avium subsp. paratuberculosis
gcuggucaacucgacccgc

SEQ ID NO: 797348 - RNA, 23 nt, Mycobacterium avium subsp. paratuberculosis
gcuggucaaugcccucguagcgg

SEQ ID NO: 797349 - RNA, 15 nt, Mycobacterium avium subsp. paratuberculosis
gcuggguugcucgcc

SEQ ID NO: 797350 - RNA, 15 nt, Mycobacterium avium subsp. paratuberculosis
gcuggguguuccccg

SEQ ID NO: 797351 - RNA, 21 nt, Mycobacterium avium subsp. paratuberculosis
gcugggugccgcguuccccgg

SEQ ID NO: 797352 - RNA, 17 nt, Mycobacterium avium subsp. paratuberculosis
gcuggguggucaccagc

SEQ ID NO: 797353 - RNA, 18 nt, Mycobacterium avium subsp. paratuberculosis
gcuggguguaaccggcuu

SEQ ID NO: 797354 - RNA, 17 nt, Mycobacterium avium subsp. paratuberculosis
gcugggccacgauccgc

SEQ ID NO: 797355 - RNA, 18 nt, Mycobacterium avium subsp. paratuberculosis
gcugggccacgauccgcg

SEQ ID NO: 797356 - RNA, 20 nt, Mycobacterium avium subsp. paratuberculosis
gcugggccacgauccgcgcg

SEQ ID NO: 797357 - RNA, 22 nt, Mycobacterium avium subsp. paratuberculosis
gcugggccacgauccgcgcggc

SEQ ID NO: 797358 - RNA, 19 nt, Mycobacterium avium subsp. paratuberculosis
gcugggcaucaucggcacg

SEQ ID NO: 797359 - RNA, 22 nt, Mycobacterium avium subsp. paratuberculosis
gcugggcaucaucggcacgccg

SEQ ID NO: 797360 - RNA, 21 nt, Mycobacterium avium subsp. paratuberculosis
gcuggguccgauugcccgacu

SEQ ID NO: 797361 - RNA, 17 nt, Mycobacterium avium subsp. paratuberculosis
gcugggugaacaccccg

SEQ ID NO: 797362 - RNA, 13 nt, Mycobacterium avium subsp. paratuberculosis
gcugggcaccguc

SEQ ID NO: 797363 - RNA, 13 nt, Mycobacterium avium subsp. paratuberculosis
gcugggagcggcc

SEQ ID NO: 797364 - RNA, 14 nt, Mycobacterium avium subsp. paratuberculosis
gcugggcagccaga

SEQ ID NO: 797365 - RNA, 14 nt, Mycobacterium avium subsp. paratuberculosis
gcugggcagccgcg

SEQ ID NO: 797366 - RNA, 17 nt, Mycobacterium avium subsp. paratuberculosis
gcugggcagccgcgcgu

SEQ ID NO: 797367 - RNA, 19 nt, Mycobacterium avium subsp. paratuberculosis
gcugggacgggucggcggc

SEQ ID NO: 797368 - RNA, 12 nt, Mycobacterium avium subsp. paratuberculosis
gcuggcugcggc

SEQ ID NO: 797369 - RNA, 16 nt, Mycobacterium avium subsp. paratuberculosis
gcgguugccccacccc

SEQ ID NO: 797370 - RNA, 13 nt, Mycobacterium avium subsp. paratuberculosis
gcgguugcgggug

SEQ ID NO: 797371 - RNA, 15 nt, Mycobacterium avium subsp. paratuberculosis
gcgguugcucgucgg

SEQ ID NO: 797372 - RNA, 16 nt, Mycobacterium avium subsp. paratuberculosis
gcgguugcucgucggc

SEQ ID NO: 797373 - RNA, 19 nt, Mycobacterium avium subsp. paratuberculosis
gcgguugcucgucggccga

SEQ ID NO: 797374 - RNA, 16 nt, Mycobacterium avium subsp. paratuberculosis
gcgguuggacaggccg

SEQ ID NO: 797375 - RNA, 22 nt, Mycobacterium avium subsp. paratuberculosis
gcgguuggacaggccggcgacg

SEQ ID NO: 797376 - RNA, 13 nt, Mycobacterium avium subsp. paratuberculosis
gcgguuggcccgc

SEQ ID NO: 797377 - RNA, 14 nt, Mycobacterium avium subsp. paratuberculosis
gcgguuggcccgcg

SEQ ID NO: 797378 - RNA, 15 nt, Mycobacterium avium subsp. paratuberculosis
gcgguuggcccgcgg

SEQ ID NO: 797379 - RNA, 15 nt, Mycobacterium avium subsp. paratuberculosis
gcgguugggccgccg

SEQ ID NO: 797380 - RNA, 16 nt, Mycobacterium avium subsp. paratuberculosis
gcgguugggccgccgg

SEQ ID NO: 797381 - RNA, 17 nt, Mycobacterium avium subsp. paratuberculosis
gcgguugggccgccggc

SEQ ID NO: 797382 - RNA, 18 nt, Mycobacterium avium subsp. paratuberculosis
gcgguugggccggcgccc

SEQ ID NO: 797383 - RNA, 17 nt, Mycobacterium avium subsp. paratuberculosis
gcgguuggucaccaggu

SEQ ID NO: 797384 - RNA, 13 nt, Mycobacterium avium subsp. paratuberculosis
gcggugucggcgc

SEQ ID NO: 797385 - RNA, 16 nt, Mycobacterium avium subsp. paratuberculosis
gcggugucggcggcaa

SEQ ID NO: 797386 - RNA, 15 nt, Mycobacterium avium subsp. paratuberculosis
gcgguugaccgccga

SEQ ID NO: 797387 - RNA, 15 nt, Mycobacterium avium subsp. paratuberculosis
gcgguugacguccgc

SEQ ID NO: 797388 - RNA, 17 nt, Mycobacterium avium subsp. paratuberculosis
gcgguugacguccgcgg

SEQ ID NO: 797389 - RNA, 22 nt, Mycobacterium avium subsp. paratuberculosis
gcgguugaucacaccgucggcg

SEQ ID NO: 797390 - RNA, 19 nt, Mycobacterium avium subsp. paratuberculosis
gcgguguaaccguggcagg

SEQ ID NO: 797391 - RNA, 21 nt, Mycobacterium avium subsp. paratuberculosis
gcgguguacagcgcgccgcgg

SEQ ID NO: 797392 - RNA, 15 nt, Mycobacterium avium subsp. paratuberculosis
gcggugucaccgacg

SEQ ID NO: 797393 - RNA, 21 nt, Mycobacterium avium subsp. paratuberculosis
gcggugucaccgacgccagcg

SEQ ID NO: 797394 - RNA, 20 nt, Mycobacterium avium subsp. paratuberculosis
gcggugucgaagaccggugc

SEQ ID NO: 797395 - RNA, 21 nt, Mycobacterium avium subsp. paratuberculosis
gcggugucgaagaccggugcg

SEQ ID NO: 797396 - RNA, 14 nt, Mycobacterium avium subsp. paratuberculosis
gcggugucgaaggc

SEQ ID NO: 797397 - RNA, 18 nt, Mycobacterium avium subsp. paratuberculosis
gcggugucgaaggccggg

SEQ ID NO: 797398 - RNA, 19 nt, Mycobacterium avium subsp. paratuberculosis
gcgguggccguaaccgccg

SEQ ID NO: 797399 - RNA, 13 nt, Mycobacterium avium subsp. paratuberculosis
gcgguggucggcg

SEQ ID NO: 797400 - RNA, 13 nt, Mycobacterium avium subsp. paratuberculosis
gcgguggccaugc

SEQ ID NO: 797401 - RNA, 17 nt, Mycobacterium avium subsp. paratuberculosis
gcgguggccaugcgcga

SEQ ID NO: 797402 - RNA, 12 nt, Mycobacterium avium subsp. paratuberculosis
gcgguggcccgg

SEQ ID NO: 797403 - RNA, 21 nt, Mycobacterium avium subsp. paratuberculosis
gcgguggcccgguacagcgcc

SEQ ID NO: 797404 - RNA, 18 nt, Mycobacterium avium subsp. paratuberculosis
gcgguggccgaaccgcuc

SEQ ID NO: 797405 - RNA, 19 nt, Mycobacterium avium subsp. paratuberculosis
gcgguggccgaaccgcucg

SEQ ID NO: 797406 - RNA, 14 nt, Mycobacterium avium subsp. paratuberculosis
gcgguggccgauca

SEQ ID NO: 797407 - RNA, 16 nt, Mycobacterium avium subsp. paratuberculosis
gcgguggccgaucagg

SEQ ID NO: 797408 - RNA, 16 nt, Mycobacterium avium subsp. paratuberculosis
gcgguggucggggucg

SEQ ID NO: 797409 - RNA, 17 nt, Mycobacterium avium subsp. paratuberculosis
gcgguggucggggucga

SEQ ID NO: 797410 - RNA, 19 nt, Mycobacterium avium subsp. paratuberculosis
gcgguggugaacgcgucgg

SEQ ID NO: 797411 - RNA, 16 nt, Mycobacterium avium subsp. paratuberculosis
gcgguggugccgccgu

SEQ ID NO: 797412 - RNA, 17 nt, Mycobacterium avium subsp. paratuberculosis
gcgguggugauggacgg

SEQ ID NO: 797413 - RNA, 21 nt, Mycobacterium avium subsp. paratuberculosis
gcgguggugauggacggggcg

SEQ ID NO: 797414 - RNA, 15 nt, Mycobacterium avium subsp. paratuberculosis
gcgguggugcucgcc

SEQ ID NO: 797415 - RNA, 19 nt, Mycobacterium avium subsp. paratuberculosis
gcgguggugcucgccccgc

SEQ ID NO: 797416 - RNA, 16 nt, Mycobacterium avium subsp. paratuberculosis
gcggugguuaccagcu

SEQ ID NO: 797417 - RNA, 21 nt, Mycobacterium avium subsp. paratuberculosis
gcggugguuaccagcucaccg

SEQ ID NO: 797418 - RNA, 13 nt, Mycobacterium avium subsp. paratuberculosis
gcggugguugggg

SEQ ID NO: 797419 - RNA, 20 nt, Mycobacterium avium subsp. paratuberculosis
gcggugcaacgccgccgaca

SEQ ID NO: 797420 - RNA, 15 nt, Mycobacterium avium subsp. paratuberculosis
gcggugcaccaccgu

SEQ ID NO: 797421 - RNA, 23 nt, Mycobacterium avium subsp. paratuberculosis
gcggugcaccaccgugccgucgc

SEQ ID NO: 797422 - RNA, 16 nt, Mycobacterium avium subsp. paratuberculosis
gcggugcaccaggacg

SEQ ID NO: 797423 - RNA, 13 nt, Mycobacterium avium subsp. paratuberculosis
gcggugcaccgcg

SEQ ID NO: 797424 - RNA, 14 nt, Mycobacterium avium subsp. paratuberculosis
gcggugcaccgcgg

SEQ ID NO: 797425 - RNA, 20 nt, Mycobacterium avium subsp. paratuberculosis
gcggugcaccgcggcgcgca

SEQ ID NO: 797426 - RNA, 16 nt, Mycobacterium avium subsp. paratuberculosis
gcggugcgcagccgcu

SEQ ID NO: 797427 - RNA, 15 nt, Mycobacterium avium subsp. paratuberculosis
gcggugcagccccgc

SEQ ID NO: 797428 - RNA, 17 nt, Mycobacterium avium subsp. paratuberculosis
gcggugcagccgggggc

SEQ ID NO: 797429 - RNA, 18 nt, Mycobacterium avium subsp. paratuberculosis
gcggugcagccgggggcg

SEQ ID NO: 797430 - RNA, 21 nt, Mycobacterium avium subsp. paratuberculosis
gcggugcagccgggugcggug

SEQ ID NO: 797431 - RNA, 16 nt, Mycobacterium avium subsp. paratuberculosis
gcggugccguccucgg

SEQ ID NO: 797432 - RNA, 21 nt, Mycobacterium avium subsp. paratuberculosis
gcggugccguccucggccgcc

SEQ ID NO: 797433 - RNA, 20 nt, Mycobacterium avium subsp. paratuberculosis
gcggugaguucaucgacguc

SEQ ID NO: 797434 - RNA, 15 nt, Mycobacterium avium subsp. paratuberculosis
gcggugaugaccucc

SEQ ID NO: 797435 - RNA, 14 nt, Mycobacterium avium subsp. paratuberculosis
gcggugaugcgcgc

SEQ ID NO: 797436 - RNA, 15 nt, Mycobacterium avium subsp. paratuberculosis
gcggugaugcgcgcc

SEQ ID NO: 797437 - RNA, 21 nt, Mycobacterium avium subsp. paratuberculosis
gcggugaugcgcggcgacggc

SEQ ID NO: 797438 - RNA, 16 nt, Mycobacterium avium subsp. paratuberculosis
gcggugauggcgaugc

SEQ ID NO: 797439 - RNA, 23 nt, Mycobacterium avium subsp. paratuberculosis
gcggugauccagagcaucagggc

SEQ ID NO: 797440 - RNA, 13 nt, Mycobacterium avium subsp. paratuberculosis
gcggugauccgcc

SEQ ID NO: 797441 - RNA, 21 nt, Mycobacterium avium subsp. paratuberculosis
gcggugauccgcccggcccgc

SEQ ID NO: 797442 - RNA, 14 nt, Mycobacterium avium subsp. paratuberculosis
gcggugaucgcguc

SEQ ID NO: 797443 - RNA, 16 nt, Mycobacterium avium subsp. paratuberculosis
gcggugaucgcgucaa

SEQ ID NO: 797444 - RNA, 23 nt, Mycobacterium avium subsp. paratuberculosis
gcggugaucgcgucaaccaccgg

SEQ ID NO: 797445 - RNA, 17 nt, Mycobacterium avium subsp. paratuberculosis
gcggugaucucgucggc

SEQ ID NO: 797446 - RNA, 21 nt, Mycobacterium avium subsp. paratuberculosis
gcggugaucucgucggcggcg

SEQ ID NO: 797447 - RNA, 18 nt, Mycobacterium avium subsp. paratuberculosis
gcgguggccugcccggcg

SEQ ID NO: 797448 - RNA, 12 nt, Mycobacterium avium subsp. paratuberculosis
gcgguggccugg

SEQ ID NO: 797449 - RNA, 22 nt, Mycobacterium avium subsp. paratuberculosis
gcgguggccuggucggcgaccu

SEQ ID NO: 797450 - RNA, 13 nt, Mycobacterium avium subsp. paratuberculosis
gcgguggcgauga

SEQ ID NO: 797451 - RNA, 21 nt, Mycobacterium avium subsp. paratuberculosis
gcgguggcgcacaacccggac

SEQ ID NO: 797452 - RNA, 15 nt, Mycobacterium avium subsp. paratuberculosis
gcgguggcgcccgcg

SEQ ID NO: 797453 - RNA, 16 nt, Mycobacterium avium subsp. paratuberculosis
gcgguggcgcccgcgg

SEQ ID NO: 797454 - RNA, 15 nt, Mycobacterium avium subsp. paratuberculosis
gcgguggcgccgcgg

SEQ ID NO: 797455 - RNA, 18 nt, Mycobacterium avium subsp. paratuberculosis
gcgguggcgccgcgggcg

SEQ ID NO: 797456 - RNA, 19 nt, Mycobacterium avium subsp. paratuberculosis
gcgguggcgccgcgggcgg

SEQ ID NO: 797457 - RNA, 21 nt, Mycobacterium avium subsp. paratuberculosis
gcgguggcgccgcgggcgguc

SEQ ID NO: 797458 - RNA, 13 nt, Mycobacterium avium subsp. paratuberculosis
gcgguggcggcga

SEQ ID NO: 797459 - RNA, 19 nt, Mycobacterium avium subsp. paratuberculosis
gcgguggcggcgaacgcgc

SEQ ID NO: 797460 - RNA, 19 nt, Mycobacterium avium subsp. paratuberculosis
gcgguggucgaacacggcg

SEQ ID NO: 797461 - RNA, 19 nt, Mycobacterium avium subsp. paratuberculosis
gcggugcuuaccggccggc

SEQ ID NO: 797462 - RNA, 20 nt, Mycobacterium avium subsp. paratuberculosis
gcggugcuuaccggccggcc

SEQ ID NO: 797463 - RNA, 23 nt, Mycobacterium avium subsp. paratuberculosis
gcggugcuucaucccgucguuga

SEQ ID NO: 797464 - RNA, 20 nt, Mycobacterium avium subsp. paratuberculosis
gcgguggagcacagcacggc

SEQ ID NO: 797465 - RNA, 13 nt, Mycobacterium avium subsp. paratuberculosis
gcgguggccacgc

SEQ ID NO: 797466 - RNA, 17 nt, Mycobacterium avium subsp. paratuberculosis
gcgguggccacgcccca

SEQ ID NO: 797467 - RNA, 19 nt, Mycobacterium avium subsp. paratuberculosis
gcgguggccacggcguuga

SEQ ID NO: 797468 - RNA, 16 nt, Mycobacterium avium subsp. paratuberculosis
gcggugcggucgcgca

SEQ ID NO: 797469 - RNA, 21 nt, Mycobacterium avium subsp. paratuberculosis
gcggugcgcgcgcgcucggcg

SEQ ID NO: 797470 - RNA, 13 nt, Mycobacterium avium subsp. paratuberculosis
gcggugcgucggg

SEQ ID NO: 797471 - RNA, 15 nt, Mycobacterium avium subsp. paratuberculosis
gcggugcgucgggcg

SEQ ID NO: 797472 - RNA, 17 nt, Mycobacterium avium subsp. paratuberculosis
gcggugcgucgggcgcc

SEQ ID NO: 797473 - RNA, 18 nt, Mycobacterium avium subsp. paratuberculosis
gcggugcgucgggcgccg

SEQ ID NO: 797474 - RNA, 23 nt, Mycobacterium avium subsp. paratuberculosis
gcggugcucgcgccgggcggccu

SEQ ID NO: 797475 - RNA, 16 nt, Mycobacterium avium subsp. paratuberculosis
gcggugcucggcgcgc

SEQ ID NO: 797476 - RNA, 23 nt, Mycobacterium avium subsp. paratuberculosis
gcggugcucggcgcgcggggccg

SEQ ID NO: 797477 - RNA, 22 nt, Mycobacterium avium subsp. paratuberculosis
gcggugcucucgucgucggcgg

SEQ ID NO: 797478 - RNA, 18 nt, Mycobacterium avium subsp. paratuberculosis
gcggugcgccacgcccgc

SEQ ID NO: 797479 - RNA, 14 nt, Mycobacterium avium subsp. paratuberculosis
gcggugcgcccagg

SEQ ID NO: 797480 - RNA, 14 nt, Mycobacterium avium subsp. paratuberculosis
gcggugcgccgaca

SEQ ID NO: 797481 - RNA, 16 nt, Mycobacterium avium subsp. paratuberculosis
gcggugcgccgacagc

SEQ ID NO: 797482 - RNA, 14 nt, Mycobacterium avium subsp. paratuberculosis
gcggugcggcccgc

SEQ ID NO: 797483 - RNA, 15 nt, Mycobacterium avium subsp. paratuberculosis
gcggugcggcccgcg

SEQ ID NO: 797484 - RNA, 14 nt, Mycobacterium avium subsp. paratuberculosis
gcggugcggccgcg

SEQ ID NO: 797485 - RNA, 14 nt, Mycobacterium avium subsp. paratuberculosis
gcggugcggcucgg

SEQ ID NO: 797486 - RNA, 18 nt, Mycobacterium avium subsp. paratuberculosis
gcggugcggcucgggcgg

SEQ ID NO: 797487 - RNA, 13 nt, Mycobacterium avium subsp. paratuberculosis
gcggugcggggcc

SEQ ID NO: 797488 - RNA, 14 nt, Mycobacterium avium subsp. paratuberculosis
gcggugcggggccg

SEQ ID NO: 797489 - RNA, 21 nt, Mycobacterium avium subsp. paratuberculosis
gcggugcggggccgcggccgg

SEQ ID NO: 797490 - RNA, 22 nt, Mycobacterium avium subsp. paratuberculosis
gcggugcggggccgcggccggc

SEQ ID NO: 797491 - RNA, 23 nt, Mycobacterium avium subsp. paratuberculosis
gcggugcggggccgcggccggca

SEQ ID NO: 797492 - RNA, 17 nt, Mycobacterium avium subsp. paratuberculosis
gcggucagcgcguccag

SEQ ID NO: 797493 - RNA, 22 nt, Mycobacterium avium subsp. paratuberculosis
gcggucagcgcguccaggugcg

SEQ ID NO: 797494 - RNA, 15 nt, Mycobacterium avium subsp. paratuberculosis
gcggucagcucccgc

SEQ ID NO: 797495 - RNA, 17 nt, Mycobacterium avium subsp. paratuberculosis
gcggucagcucccgcag

SEQ ID NO: 797496 - RNA, 18 nt, Mycobacterium avium subsp. paratuberculosis
gcggucagcucccgcagc

SEQ ID NO: 797497 - RNA, 18 nt, Mycobacterium avium subsp. paratuberculosis
gcggucagcucgaucgcc

SEQ ID NO: 797498 - RNA, 20 nt, Mycobacterium avium subsp. paratuberculosis
gcggucagcucgaucgccgc

SEQ ID NO: 797499 - RNA, 22 nt, Mycobacterium avium subsp. paratuberculosis
gcggucagcucgaucgccgcgc

SEQ ID NO: 797500 - RNA, 23 nt, Mycobacterium avium subsp. paratuberculosis
gcggucagcucgaucgccgcgcc

SEQ ID NO: 797501 - RNA, 12 nt, Mycobacterium avium subsp. paratuberculosis
gcggucaggccg

SEQ ID NO: 797502 - RNA, 18 nt, Mycobacterium avium subsp. paratuberculosis
gcggucaggccgucucga

SEQ ID NO: 797503 - RNA, 23 nt, Mycobacterium avium subsp. paratuberculosis
gcggucaggccgucucgagccgg

SEQ ID NO: 797504 - RNA, 15 nt, Mycobacterium avium subsp. paratuberculosis
gcggucagggucagc

SEQ ID NO: 797505 - RNA, 14 nt, Mycobacterium avium subsp. paratuberculosis
gcggucaucgagcc

SEQ ID NO: 797506 - RNA, 15 nt, Mycobacterium avium subsp. paratuberculosis
gcggucaucgagccg

SEQ ID NO: 797507 - RNA, 19 nt, Mycobacterium avium subsp. paratuberculosis
gcggucaucgagccgguac

SEQ ID NO: 797508 - RNA, 13 nt, Mycobacterium avium subsp. paratuberculosis
gcggucaugcgcg

SEQ ID NO: 797509 - RNA, 14 nt, Mycobacterium avium subsp. paratuberculosis
gcggucaugcgcgg

SEQ ID NO: 797510 - RNA, 20 nt, Mycobacterium avium subsp. paratuberculosis
gcggucaugcgcgggcaauc

SEQ ID NO: 797511 - RNA, 21 nt, Mycobacterium avium subsp. paratuberculosis
gcgguccaacgggcucagcac

SEQ ID NO: 797512 - RNA, 22 nt, Mycobacterium avium subsp. paratuberculosis
gcgguccaacgggcucagcacc

SEQ ID NO: 797513 - RNA, 21 nt, Mycobacterium avium subsp. paratuberculosis
gcggucauugaucuccgcggc

SEQ ID NO: 797514 - RNA, 19 nt, Mycobacterium avium subsp. paratuberculosis
gcgguccaccaauggcggc

SEQ ID NO: 797515 - RNA, 21 nt, Mycobacterium avium subsp. paratuberculosis
gcgguccaccaauggcggcca

SEQ ID NO: 797516 - RNA, 22 nt, Mycobacterium avium subsp. paratuberculosis
gcgguccaccaauggcggccac

SEQ ID NO: 797517 - RNA, 23 nt, Mycobacterium avium subsp. paratuberculosis
gcgguccaccaauggcggccacg

SEQ ID NO: 797518 - RNA, 24 nt, Mycobacterium avium subsp. paratuberculosis
gcgguccaccaauggcggccacga

SEQ ID NO: 797519 - RNA, 21 nt, Mycobacterium avium subsp. paratuberculosis
gcgguccaccaccacacccgc

SEQ ID NO: 797520 - RNA, 13 nt, Mycobacterium avium subsp. paratuberculosis
gcgguccaccgac

SEQ ID NO: 797521 - RNA, 15 nt, Mycobacterium avium subsp. paratuberculosis
gcgguccaccgacgc

SEQ ID NO: 797522 - RNA, 18 nt, Mycobacterium avium subsp. paratuberculosis
gcgguccaccgacgccac

SEQ ID NO: 797523 - RNA, 20 nt, Mycobacterium avium subsp. paratuberculosis
gcggggaaguaguaccccgg

SEQ ID NO: 797524 - RNA, 12 nt, Mycobacterium avium subsp. paratuberculosis
gcggucaccggc

SEQ ID NO: 797525 - RNA, 13 nt, Mycobacterium avium subsp. paratuberculosis
gcggucaccggcu

SEQ ID NO: 797526 - RNA, 16 nt, Mycobacterium avium subsp. paratuberculosis
gcggucaccggcucgg

SEQ ID NO: 797527 - RNA, 12 nt, Mycobacterium avium subsp. paratuberculosis
gcggucaccggu

SEQ ID NO: 797528 - RNA, 14 nt, Mycobacterium avium subsp. paratuberculosis
gcggucaccggucg

SEQ ID NO: 797529 - RNA, 13 nt, Mycobacterium avium subsp. paratuberculosis
gcggucacgcccg

SEQ ID NO: 797530 - RNA, 14 nt, Mycobacterium avium subsp. paratuberculosis
gcggucacgcccgg

SEQ ID NO: 797531 - RNA, 15 nt, Mycobacterium avium subsp. paratuberculosis
gcggucagcaccguc

SEQ ID NO: 797532 - RNA, 19 nt, Mycobacterium avium subsp. paratuberculosis
gcggucagcauggcgauga

SEQ ID NO: 797533 - RNA, 12 nt, Mycobacterium avium subsp. paratuberculosis
gcgggcuggcgu

SEQ ID NO: 797534 - RNA, 16 nt, Mycobacterium avium subsp. paratuberculosis
gcgggcuggugcgcag

SEQ ID NO: 797535 - RNA, 24 nt, Mycobacterium avium subsp. paratuberculosis
gcgggcuggugcgcagccgucgca

SEQ ID NO: 797536 - RNA, 13 nt, Mycobacterium avium subsp. paratuberculosis
gcgggcgggccgc

SEQ ID NO: 797537 - RNA, 13 nt, Mycobacterium avium subsp. paratuberculosis
gcgggcugcggcg

SEQ ID NO: 797538 - RNA, 14 nt, Mycobacterium avium subsp. paratuberculosis
gcgggcugcggcga

SEQ ID NO: 797539 - RNA, 12 nt, Mycobacterium avium subsp. paratuberculosis
gcgggcugcggg

SEQ ID NO: 797540 - RNA, 16 nt, Mycobacterium avium subsp. paratuberculosis
gcgggcugcgggcauc

SEQ ID NO: 797541 - RNA, 17 nt, Mycobacterium avium subsp. paratuberculosis
gcgggcuguccgcgugg

SEQ ID NO: 797542 - RNA, 17 nt, Mycobacterium avium subsp. paratuberculosis
gcgggcugucggcgccc

SEQ ID NO: 797543 - RNA, 18 nt, Mycobacterium avium subsp. paratuberculosis
gcgggcugucggcgccca

SEQ ID NO: 797544 - RNA, 16 nt, Mycobacterium avium subsp. paratuberculosis
gcgggcugugccggcg

SEQ ID NO: 797545 - RNA, 17 nt, Mycobacterium avium subsp. paratuberculosis
gcgggcugugccggcgg

SEQ ID NO: 797546 - RNA, 20 nt, Mycobacterium avium subsp. paratuberculosis
gcgggcugugccggcggguc

SEQ ID NO: 797547 - RNA, 23 nt, Mycobacterium avium subsp. paratuberculosis
gcggucgaacaacgcggugaccg

SEQ ID NO: 797548 - RNA, 19 nt, Mycobacterium avium subsp. paratuberculosis
gcggucgaacgcggcgccg

SEQ ID NO: 797549 - RNA, 23 nt, Mycobacterium avium subsp. paratuberculosis
gcggucgacacgaucggcaugac

SEQ ID NO: 797550 - RNA, 22 nt, Mycobacterium avium subsp. paratuberculosis
gcggucgacggaagccgagcgg

SEQ ID NO: 797551 - RNA, 23 nt, Mycobacterium avium subsp. paratuberculosis
gcggucgacggaagccgagcggu

SEQ ID NO: 797552 - RNA, 22 nt, Mycobacterium avium subsp. paratuberculosis
gcggucgacgggaagaucgcag

SEQ ID NO: 797553 - RNA, 14 nt, Mycobacterium avium subsp. paratuberculosis
gcgguccguucggc

SEQ ID NO: 797554 - RNA, 15 nt, Mycobacterium avium subsp. paratuberculosis
gcgguccguucggcg

SEQ ID NO: 797555 - RNA, 14 nt, Mycobacterium avium subsp. paratuberculosis
gcgguccucgaacc

SEQ ID NO: 797556 - RNA, 17 nt, Mycobacterium avium subsp. paratuberculosis
gcgguccucgagcuggc

SEQ ID NO: 797557 - RNA, 16 nt, Mycobacterium avium subsp. paratuberculosis
gcgguccgcuccacca

SEQ ID NO: 797558 - RNA, 21 nt, Mycobacterium avium subsp. paratuberculosis
gcgguccgcuccaccagcgcg

SEQ ID NO: 797559 - RNA, 16 nt, Mycobacterium avium subsp. paratuberculosis
gcggucgaccaagacg

SEQ ID NO: 797560 - RNA, 12 nt, Mycobacterium avium subsp. paratuberculosis
gcggucgacugg

SEQ ID NO: 797561 - RNA, 19 nt, Mycobacterium avium subsp. paratuberculosis
gcggucgacuggucgucga

SEQ ID NO: 797562 - RNA, 14 nt, Mycobacterium avium subsp. paratuberculosis
gcggucggcgcggg

SEQ ID NO: 797563 - RNA, 18 nt, Mycobacterium avium subsp. paratuberculosis
gcggucggcgcggggcca

SEQ ID NO: 797564 - RNA, 16 nt, Mycobacterium avium subsp. paratuberculosis
gcggucggcgcccggc

SEQ ID NO: 797565 - RNA, 15 nt, Mycobacterium avium subsp. paratuberculosis
gcggucggcgccgau

SEQ ID NO: 797566 - RNA, 16 nt, Mycobacterium avium subsp. paratuberculosis
gcggucggcgccgauc

SEQ ID NO: 797567 - RNA, 22 nt, Mycobacterium avium subsp. paratuberculosis
gcggucggcgccgaucacgccg

SEQ ID NO: 797568 - RNA, 12 nt, Mycobacterium avium subsp. paratuberculosis
gcggucggcgcg

SEQ ID NO: 797569 - RNA, 13 nt, Mycobacterium avium subsp. paratuberculosis
gcggucucgaccg

SEQ ID NO: 797570 - RNA, 14 nt, Mycobacterium avium subsp. paratuberculosis
gcggucucgaccga

SEQ ID NO: 797571 - RNA, 14 nt, Mycobacterium avium subsp. paratuberculosis
gcggucucgaucug

SEQ ID NO: 797572 - RNA, 12 nt, Mycobacterium avium subsp. paratuberculosis
gcggucgugcgg

SEQ ID NO: 797573 - RNA, 16 nt, Mycobacterium avium subsp. paratuberculosis
gcggucgugcgggaug

SEQ ID NO: 797574 - RNA, 15 nt, Mycobacterium avium subsp. paratuberculosis
gcggucgugucaggg

SEQ ID NO: 797575 - RNA, 13 nt, Mycobacterium avium subsp. paratuberculosis
gcggucugcgcca

SEQ ID NO: 797576 - RNA, 16 nt, Mycobacterium avium subsp. paratuberculosis
gcggucugcgccagcu

SEQ ID NO: 797577 - RNA, 14 nt, Mycobacterium avium subsp. paratuberculosis
gcggucugcgcccg

SEQ ID NO: 797578 - RNA, 15 nt, Mycobacterium avium subsp. paratuberculosis
gcggucugcgcccga

SEQ ID NO: 797579 - RNA, 20 nt, Mycobacterium avium subsp. paratuberculosis
gcggucgguggcggugccgc

SEQ ID NO: 797580 - RNA, 22 nt, Mycobacterium avium subsp. paratuberculosis
gcggucgguggcggugccgcgg

SEQ ID NO: 797581 - RNA, 21 nt, Mycobacterium avium subsp. paratuberculosis
gcggucgguucauccacucgg

SEQ ID NO: 797582 - RNA, 11 nt, Mycobacterium avium subsp. paratuberculosis
gcggucgucgc

SEQ ID NO: 797583 - RNA, 14 nt, Mycobacterium avium subsp. paratuberculosis
gcggucgucgccca

SEQ ID NO: 797584 - RNA, 20 nt, Mycobacterium avium subsp. paratuberculosis
gcggucgucgcccaccgacg

SEQ ID NO: 797585 - RNA, 21 nt, Mycobacterium avium subsp. paratuberculosis
gcggucgucgcccgucucggc

SEQ ID NO: 797586 - RNA, 22 nt, Mycobacterium avium subsp. paratuberculosis
gcggucgucgcccgucucggcg

SEQ ID NO: 797587 - RNA, 23 nt, Mycobacterium avium subsp. paratuberculosis
gcggucgucgcccgucucggcgu

SEQ ID NO: 797588 - RNA, 17 nt, Mycobacterium avium subsp. paratuberculosis
gcggucgucgucgucgg

SEQ ID NO: 797589 - RNA, 14 nt, Mycobacterium avium subsp. paratuberculosis
gcggucggcggcgu

SEQ ID NO: 797590 - RNA, 14 nt, Mycobacterium avium subsp. paratuberculosis
gcggucggcgguuc

SEQ ID NO: 797591 - RNA, 15 nt, Mycobacterium avium subsp. paratuberculosis
gcggucggcgucgcu

SEQ ID NO: 797592 - RNA, 16 nt, Mycobacterium avium subsp. paratuberculosis
gcggucggcgucgcuc

SEQ ID NO: 797593 - RNA, 19 nt, Mycobacterium avium subsp. paratuberculosis
gcggucggggaauuccggc

SEQ ID NO: 797594 - RNA, 23 nt, Mycobacterium avium subsp. paratuberculosis
gcggucggggaauuccggcgcga

SEQ ID NO: 797595 - RNA, 12 nt, Mycobacterium avium subsp. paratuberculosis
gcggucgggucc

SEQ ID NO: 797596 - RNA, 16 nt, Mycobacterium avium subsp. paratuberculosis
gcggucgggucccggc

SEQ ID NO: 797597 - RNA, 20 nt, Mycobacterium avium subsp. paratuberculosis
gcguaucaacugagcgcccg

SEQ ID NO: 797598 - RNA, 22 nt, Mycobacterium avium subsp. paratuberculosis
gcguaucaacugagcgcccggu

SEQ ID NO: 797599 - RNA, 15 nt, Mycobacterium avium subsp. paratuberculosis
gcguaguccagcacg

SEQ ID NO: 797600 - RNA, 17 nt, Mycobacterium avium subsp. paratuberculosis
gcguaguccagcacggc

SEQ ID NO: 797601 - RNA, 20 nt, Mycobacterium avium subsp. paratuberculosis
gcguaguccagcacggcgaa

SEQ ID NO: 797602 - RNA, 16 nt, Mycobacterium avium subsp. paratuberculosis
gcguagucggcgcagc

SEQ ID NO: 797603 - RNA, 20 nt, Mycobacterium avium subsp. paratuberculosis
gcguagucggcgcagcgcac

SEQ ID NO: 797604 - RNA, 13 nt, Mycobacterium avium subsp. paratuberculosis
gcguagucggcgu

SEQ ID NO: 797605 - RNA, 17 nt, Mycobacterium avium subsp. paratuberculosis
gcguagucggcgucggc

SEQ ID NO: 797606 - RNA, 21 nt, Mycobacterium avium subsp. paratuberculosis
gcguagucggcgucggccacc

SEQ ID NO: 797607 - RNA, 22 nt, Mycobacterium avium subsp. paratuberculosis
gcguagucggcgucggccaccg

SEQ ID NO: 797608 - RNA, 14 nt, Mycobacterium avium subsp. paratuberculosis
gcguagucgucgau

SEQ ID NO: 797609 - RNA, 18 nt, Mycobacterium avium subsp. paratuberculosis
gcguagugcagcugcagc

SEQ ID NO: 797610 - RNA, 15 nt, Mycobacterium avium subsp. paratuberculosis
gcguagugggucggc

SEQ ID NO: 797611 - RNA, 17 nt, Mycobacterium avium subsp. paratuberculosis
gcguagugggucggcgg

SEQ ID NO: 797612 - RNA, 15 nt, Mycobacterium avium subsp. paratuberculosis
gcguagggcagcccg

SEQ ID NO: 797613 - RNA, 16 nt, Mycobacterium avium subsp. paratuberculosis
gcguagggcagcccga

SEQ ID NO: 797614 - RNA, 18 nt, Mycobacterium avium subsp. paratuberculosis
gcguaggugggcagcgcg

SEQ ID NO: 797615 - RNA, 23 nt, Mycobacterium avium subsp. paratuberculosis
gcguaggugggcagcgcggccag

SEQ ID NO: 797616 - RNA, 18 nt, Mycobacterium avium subsp. paratuberculosis
gcguauccggccagccgg

SEQ ID NO: 797617 - RNA, 20 nt, Mycobacterium avium subsp. paratuberculosis
gcguauccggccagccgggg

SEQ ID NO: 797618 - RNA, 14 nt, Mycobacterium avium subsp. paratuberculosis
gcguaugccggugg

SEQ ID NO: 797619 - RNA, 16 nt, Mycobacterium avium subsp. paratuberculosis
gcguaugccgguggcg

SEQ ID NO: 797620 - RNA, 18 nt, Mycobacterium avium subsp. paratuberculosis
gcguaugccuccucggug

SEQ ID NO: 797621 - RNA, 18 nt, Mycobacterium avium subsp. paratuberculosis
gcguauugcacggcggcg

SEQ ID NO: 797622 - RNA, 16 nt, Mycobacterium avium subsp. paratuberculosis
gcgucaaccaccggca

SEQ ID NO: 797623 - RNA, 18 nt, Mycobacterium avium subsp. paratuberculosis
gcgucaaccaccggcauc

SEQ ID NO: 797624 - RNA, 20 nt, Mycobacterium avium subsp. paratuberculosis
gcgucaaccaccggcaucgg

SEQ ID NO: 797625 - RNA, 21 nt, Mycobacterium avium subsp. paratuberculosis
gcgucaaccaccggcaucggu

SEQ ID NO: 797626 - RNA, 12 nt, Mycobacterium avium subsp. paratuberculosis
gcgucaacccgu

SEQ ID NO: 797627 - RNA, 19 nt, Mycobacterium avium subsp. paratuberculosis
gcgucaacucgucggcgaa

SEQ ID NO: 797628 - RNA, 23 nt, Mycobacterium avium subsp. paratuberculosis
gcguagcccuaccggcucggccc

SEQ ID NO: 797629 - RNA, 16 nt, Mycobacterium avium subsp. paratuberculosis
gcguagcagucggccu

SEQ ID NO: 797630 - RNA, 19 nt, Mycobacterium avium subsp. paratuberculosis
gcguagcagucggccugca

SEQ ID NO: 797631 - RNA, 21 nt, Mycobacterium avium subsp. paratuberculosis
gcguagcagucggccugcagc

SEQ ID NO: 797632 - RNA, 13 nt, Mycobacterium avium subsp. paratuberculosis
gcguaggacagca

SEQ ID NO: 797633 - RNA, 16 nt, Mycobacterium avium subsp. paratuberculosis
gcguaggacagcagcc

SEQ ID NO: 797634 - RNA, 17 nt, Mycobacterium avium subsp. paratuberculosis
gcguaggacagcagccg

SEQ ID NO: 797635 - RNA, 23 nt, Mycobacterium avium subsp. paratuberculosis
gcguagcgccagucgcggcgaac

SEQ ID NO: 797636 - RNA, 17 nt, Mycobacterium avium subsp. paratuberculosis
gcguagcgccgcccguc

SEQ ID NO: 797637 - RNA, 13 nt, Mycobacterium avium subsp. paratuberculosis
gcguagcggcccg

SEQ ID NO: 797638 - RNA, 19 nt, Mycobacterium avium subsp. paratuberculosis
gcguagcgggucagcucca

SEQ ID NO: 797639 - RNA, 20 nt, Mycobacterium avium subsp. paratuberculosis
gcguagcgggucagcuccac

SEQ ID NO: 797640 - RNA, 22 nt, Mycobacterium avium subsp. paratuberculosis
gcguagaagaaauacaucugcc

SEQ ID NO: 797641 - RNA, 15 nt, Mycobacterium avium subsp. paratuberculosis
gcguacuucgcgccc

SEQ ID NO: 797642 - RNA, 18 nt, Mycobacterium avium subsp. paratuberculosis
gcguacuucgcguuccgc

SEQ ID NO: 797643 - RNA, 21 nt, Mycobacterium avium subsp. paratuberculosis
gcguacggguugggcggggcg

SEQ ID NO: 797644 - RNA, 22 nt, Mycobacterium avium subsp. paratuberculosis
gcguacucgcacagccggcgcg

SEQ ID NO: 797645 - RNA, 14 nt, Mycobacterium avium subsp. paratuberculosis
gcguacugcucggc

SEQ ID NO: 797646 - RNA, 12 nt, Mycobacterium avium subsp. paratuberculosis
gcguacaccagg

SEQ ID NO: 797647 - RNA, 21 nt, Mycobacterium avium subsp. paratuberculosis
gcguacaccagggugccgccg

SEQ ID NO: 797648 - RNA, 22 nt, Mycobacterium avium subsp. paratuberculosis
gcguacaccagggugccgccgg

SEQ ID NO: 797649 - RNA, 13 nt, Mycobacterium avium subsp. paratuberculosis
gcguacaccggcu

SEQ ID NO: 797650 - RNA, 20 nt, Mycobacterium avium subsp. paratuberculosis
gcguacaccggcugaccggc

SEQ ID NO: 797651 - RNA, 12 nt, Mycobacterium avium subsp. paratuberculosis
gcguacagccag

SEQ ID NO: 797652 - RNA, 13 nt, Mycobacterium avium subsp. paratuberculosis
gcguacagcccgc

SEQ ID NO: 797653 - RNA, 18 nt, Mycobacterium avium subsp. paratuberculosis
gcguacaggccgucgggg

SEQ ID NO: 797654 - RNA, 13 nt, Mycobacterium avium subsp. paratuberculosis
gcguacagcgccc

SEQ ID NO: 797655 - RNA, 14 nt, Mycobacterium avium subsp. paratuberculosis
gcguacagcgcccg

SEQ ID NO: 797656 - RNA, 18 nt, Mycobacterium avium subsp. paratuberculosis
gcguacagcggcgccagg

SEQ ID NO: 797657 - RNA, 14 nt, Mycobacterium avium subsp. paratuberculosis
gcguaccagcgcca

SEQ ID NO: 797658 - RNA, 18 nt, Mycobacterium avium subsp. paratuberculosis
gcguacgacaucucgacg

SEQ ID NO: 797659 - RNA, 19 nt, Mycobacterium avium subsp. paratuberculosis
gcguacgacaucucgacgg

SEQ ID NO: 797660 - RNA, 23 nt, Mycobacterium avium subsp. paratuberculosis
gcguacgaccguagccggucggc

SEQ ID NO: 797661 - RNA, 21 nt, Mycobacterium avium subsp. paratuberculosis
gcguacgggaugaucagcagg

SEQ ID NO: 797662 - RNA, 17 nt, Mycobacterium avium subsp. paratuberculosis
gcguacgcgauggcggc

SEQ ID NO: 797663 - RNA, 20 nt, Mycobacterium avium subsp. paratuberculosis
gcguacccaggucggcguga

SEQ ID NO: 797664 - RNA, 13 nt, Mycobacterium avium subsp. paratuberculosis
gcguacccgcgcg

SEQ ID NO: 797665 - RNA, 15 nt, Mycobacterium avium subsp. paratuberculosis
gcguacccgcgcggc

SEQ ID NO: 797666 - RNA, 18 nt, Mycobacterium avium subsp. paratuberculosis
gcgucaucgggcccgacg

SEQ ID NO: 797667 - RNA, 16 nt, Mycobacterium avium subsp. paratuberculosis
gcguccacgaaaccca

SEQ ID NO: 797668 - RNA, 15 nt, Mycobacterium avium subsp. paratuberculosis
gcguccacgaccccg

SEQ ID NO: 797669 - RNA, 17 nt, Mycobacterium avium subsp. paratuberculosis
gcguccacgaccccggc

SEQ ID NO: 797670 - RNA, 21 nt, Mycobacterium avium subsp. paratuberculosis
gcguccacgaccccggcggca

SEQ ID NO: 797671 - RNA, 17 nt, Mycobacterium avium subsp. paratuberculosis
gcguccaccggucgacg

SEQ ID NO: 797672 - RNA, 23 nt, Mycobacterium avium subsp. paratuberculosis
gcguccacuccaauacggcccgg

SEQ ID NO: 797673 - RNA, 16 nt, Mycobacterium avium subsp. paratuberculosis
gcguccagaccggccg

SEQ ID NO: 797674 - RNA, 21 nt, Mycobacterium avium subsp. paratuberculosis
gcguccagaccggccggggcg

SEQ ID NO: 797675 - RNA, 13 nt, Mycobacterium avium subsp. paratuberculosis
gcguccagcagca

SEQ ID NO: 797676 - RNA, 14 nt, Mycobacterium avium subsp. paratuberculosis
gcguccagcaugcc

SEQ ID NO: 797677 - RNA, 12 nt, Mycobacterium avium subsp. paratuberculosis
gcguccagccag

SEQ ID NO: 797678 - RNA, 17 nt, Mycobacterium avium subsp. paratuberculosis
gcguccagcgcggugag

SEQ ID NO: 797679 - RNA, 18 nt, Mycobacterium avium subsp. paratuberculosis
gcguccagcgcgucgcug

SEQ ID NO: 797680 - RNA, 20 nt, Mycobacterium avium subsp. paratuberculosis
gcguccagcgcgucgcugcc

SEQ ID NO: 797681 - RNA, 16 nt, Mycobacterium avium subsp. paratuberculosis
gcguccagcugcgcgc

SEQ ID NO: 797682 - RNA, 21 nt, Mycobacterium avium subsp. paratuberculosis
gcguccagcugcgcgccggcg

SEQ ID NO: 797683 - RNA, 22 nt, Mycobacterium avium subsp. paratuberculosis
gcguccagcugcgcgccggcgg

SEQ ID NO: 797684 - RNA, 20 nt, Mycobacterium avium subsp. paratuberculosis
gcguccaguagccgccgggc

SEQ ID NO: 797685 - RNA, 15 nt, Mycobacterium avium subsp. paratuberculosis
gcguccaggcgcacc

SEQ ID NO: 797686 - RNA, 20 nt, Mycobacterium avium subsp. paratuberculosis
gcguccaggcgcaccgccac

SEQ ID NO: 797687 - RNA, 21 nt, Mycobacterium avium subsp. paratuberculosis
gcguccaggcgcaccgccacc

SEQ ID NO: 797688 - RNA, 16 nt, Mycobacterium avium subsp. paratuberculosis
gcguccaguccggcgu

SEQ ID NO: 797689 - RNA, 14 nt, Mycobacterium avium subsp. paratuberculosis
gcguccagucgaug

SEQ ID NO: 797690 - RNA, 16 nt, Mycobacterium avium subsp. paratuberculosis
gcguccagucgauguc

SEQ ID NO: 797691 - RNA, 16 nt, Mycobacterium avium subsp. paratuberculosis
gcguccagugcaugcc

SEQ ID NO: 797692 - RNA, 16 nt, Mycobacterium avium subsp. paratuberculosis
gcguccaguucggcca

SEQ ID NO: 797693 - RNA, 17 nt, Mycobacterium avium subsp. paratuberculosis
gcguccaguucggccag

SEQ ID NO: 797694 - RNA, 20 nt, Mycobacterium avium subsp. paratuberculosis
gcguccaguucggccagcgc

SEQ ID NO: 797695 - RNA, 22 nt, Mycobacterium avium subsp. paratuberculosis
gcguccaguucggccagcgcgg

SEQ ID NO: 797696 - RNA, 18 nt, Mycobacterium avium subsp. paratuberculosis
gcguccaguugcggcacg

SEQ ID NO: 797697 - RNA, 21 nt, Mycobacterium avium subsp. paratuberculosis
gcguccaguugcggcacgccg

SEQ ID NO: 797698 - RNA, 23 nt, Mycobacterium avium subsp. paratuberculosis
gcguccaguugcggcacgccgac

SEQ ID NO: 797699 - RNA, 13 nt, Mycobacterium avium subsp. paratuberculosis
gcguccagcgcgg

SEQ ID NO: 797700 - RNA, 15 nt, Mycobacterium avium subsp. paratuberculosis
gcguccaggucgccc

SEQ ID NO: 797701 - RNA, 16 nt, Mycobacterium avium subsp. paratuberculosis
gcguccaggucgcccu

SEQ ID NO: 797702 - RNA, 17 nt, Mycobacterium avium subsp. paratuberculosis
gcguccaggugcgccgc

SEQ ID NO: 797703 - RNA, 19 nt, Mycobacterium avium subsp. paratuberculosis
gcguccaggugcgccgccg

SEQ ID NO: 797704 - RNA, 18 nt, Mycobacterium avium subsp. paratuberculosis
gcguccagggccaccgcg

SEQ ID NO: 797705 - RNA, 20 nt, Mycobacterium avium subsp. paratuberculosis
gcguccagggccaccgcguc

SEQ ID NO: 797706 - RNA, 21 nt, Mycobacterium avium subsp. paratuberculosis
gcguccagggccaccgcgucg

SEQ ID NO: 797707 - RNA, 22 nt, Mycobacterium avium subsp. paratuberculosis
gcguccagggccaccgcgucgc

SEQ ID NO: 797708 - RNA, 16 nt, Mycobacterium avium subsp. paratuberculosis
gcgucauggccgucgg

SEQ ID NO: 797709 - RNA, 17 nt, Mycobacterium avium subsp. paratuberculosis
gcgucauggccgucggg

SEQ ID NO: 797710 - RNA, 16 nt, Mycobacterium avium subsp. paratuberculosis
gcguccaccagcacgc

SEQ ID NO: 797711 - RNA, 18 nt, Mycobacterium avium subsp. paratuberculosis
gcguccaccagcacgccg

SEQ ID NO: 797712 - RNA, 15 nt, Mycobacterium avium subsp. paratuberculosis
gcgucauggugcgcg

SEQ ID NO: 797713 - RNA, 14 nt, Mycobacterium avium subsp. paratuberculosis
gcgucauuccgccg

SEQ ID NO: 797714 - RNA, 17 nt, Mycobacterium avium subsp. paratuberculosis
gcgucauuccgccgcgc

SEQ ID NO: 797715 - RNA, 18 nt, Mycobacterium avium subsp. paratuberculosis
gcgucauuccgccgcgcc

SEQ ID NO: 797716 - RNA, 19 nt, Mycobacterium avium subsp. paratuberculosis
gcgucauuccgccgcgccc

SEQ ID NO: 797717 - RNA, 20 nt, Mycobacterium avium subsp. paratuberculosis
gcgucauuccgccgcgcccg

SEQ ID NO: 797718 - RNA, 23 nt, Mycobacterium avium subsp. paratuberculosis
gcgucauuccgccgcgcccgucg

SEQ ID NO: 797719 - RNA, 17 nt, Mycobacterium avium subsp. paratuberculosis
gcgucaucccccgcagc

SEQ ID NO: 797720 - RNA, 16 nt, Mycobacterium avium subsp. paratuberculosis
gcgucaucacgugcug

SEQ ID NO: 797721 - RNA, 20 nt, Mycobacterium avium subsp. paratuberculosis
gcgucaucacgugcuggcgc

SEQ ID NO: 797722 - RNA, 19 nt, Mycobacterium avium subsp. paratuberculosis
gcgucaucgacuugccgcc

SEQ ID NO: 797723 - RNA, 21 nt, Mycobacterium avium subsp. paratuberculosis
gcgucaucgacuugccgccgc

SEQ ID NO: 797724 - RNA, 22 nt, Mycobacterium avium subsp. paratuberculosis
gcgucaucgacuugccgccgca

SEQ ID NO: 797725 - RNA, 22 nt, Mycobacterium avium subsp. paratuberculosis
gcgucagggguuggcgcgcaga

SEQ ID NO: 797726 - RNA, 14 nt, Mycobacterium avium subsp. paratuberculosis
gcgucagguccgcg

SEQ ID NO: 797727 - RNA, 15 nt, Mycobacterium avium subsp. paratuberculosis
gcgucagguccgcga

SEQ ID NO: 797728 - RNA, 17 nt, Mycobacterium avium subsp. paratuberculosis
gcgucaauacgucacgg

SEQ ID NO: 797729 - RNA, 22 nt, Mycobacterium avium subsp. paratuberculosis
gcgucaauugccaacugcagca

SEQ ID NO: 797730 - RNA, 14 nt, Mycobacterium avium subsp. paratuberculosis
gcgucaccaggcug

SEQ ID NO: 797731 - RNA, 20 nt, Mycobacterium avium subsp. paratuberculosis
gcgucaccaggcugcucggc

SEQ ID NO: 797732 - RNA, 23 nt, Mycobacterium avium subsp. paratuberculosis
gcgucaccccaccgagcagcugc

SEQ ID NO: 797733 - RNA, 19 nt, Mycobacterium avium subsp. paratuberculosis
gcgucacauccgucacgcc

SEQ ID NO: 797734 - RNA, 20 nt, Mycobacterium avium subsp. paratuberculosis
gcgucacauccgucacgccc

SEQ ID NO: 797735 - RNA, 18 nt, Mycobacterium avium subsp. paratuberculosis
gcgucaccaaugcgccgg

SEQ ID NO: 797736 - RNA, 19 nt, Mycobacterium avium subsp. paratuberculosis
gcgucaccaaugcgccggc

SEQ ID NO: 797737 - RNA, 21 nt, Mycobacterium avium subsp. paratuberculosis
gcgucaccaaugcgccggcgg

SEQ ID NO: 797738 - RNA, 22 nt, Mycobacterium avium subsp. paratuberculosis
gcgucaccaaugcgccggcggc

SEQ ID NO: 797739 - RNA, 22 nt, Mycobacterium avium subsp. paratuberculosis
gcgucacgcaucagggccagcc

SEQ ID NO: 797740 - RNA, 13 nt, Mycobacterium avium subsp. paratuberculosis
gcgucacgccagc

SEQ ID NO: 797741 - RNA, 16 nt, Mycobacterium avium subsp. paratuberculosis
gcgucacgccagcgug

SEQ ID NO: 797742 - RNA, 19 nt, Mycobacterium avium subsp. paratuberculosis
gcgucacgccagcgugacg

SEQ ID NO: 797743 - RNA, 20 nt, Mycobacterium avium subsp. paratuberculosis
gcgucacgccagcgugacgc

SEQ ID NO: 797744 - RNA, 13 nt, Mycobacterium avium subsp. paratuberculosis
gcgucacgccgcg

SEQ ID NO: 797745 - RNA, 14 nt, Mycobacterium avium subsp. paratuberculosis
gcgucacgccgcgc

SEQ ID NO: 797746 - RNA, 15 nt, Mycobacterium avium subsp. paratuberculosis
gcgucacgccgcgcc

SEQ ID NO: 797747 - RNA, 16 nt, Mycobacterium avium subsp. paratuberculosis
gcgucacgccgcgccc

SEQ ID NO: 797748 - RNA, 17 nt, Mycobacterium avium subsp. paratuberculosis
gcgucacgccgcgcccg

SEQ ID NO: 797749 - RNA, 18 nt, Mycobacterium avium subsp. paratuberculosis
gcgucacgccgcgcccgu

SEQ ID NO: 797750 - RNA, 15 nt, Mycobacterium avium subsp. paratuberculosis
gcgucaccuucacca

SEQ ID NO: 797751 - RNA, 20 nt, Mycobacterium avium subsp. paratuberculosis
gcgucaccuucaccacggcc

SEQ ID NO: 797752 - RNA, 20 nt, Mycobacterium avium subsp. paratuberculosis
gcgucagagguuggcgaagc

SEQ ID NO: 797753 - RNA, 17 nt, Mycobacterium avium subsp. paratuberculosis
gcgucacucuggcguga

SEQ ID NO: 797754 - RNA, 19 nt, Mycobacterium avium subsp. paratuberculosis
gcgucacucuggcgugacg

SEQ ID NO: 797755 - RNA, 20 nt, Mycobacterium avium subsp. paratuberculosis
gcgucacucuggcgugacgc

SEQ ID NO: 797756 - RNA, 20 nt, Mycobacterium avium subsp. paratuberculosis
gcgucacucuggcgugacgu

SEQ ID NO: 797757 - RNA, 19 nt, Mycobacterium avium subsp. paratuberculosis
gcgucacugcccagccauc

SEQ ID NO: 797758 - RNA, 16 nt, Mycobacterium avium subsp. paratuberculosis
gcgucagcaccgcgac

SEQ ID NO: 797759 - RNA, 20 nt, Mycobacterium avium subsp. paratuberculosis
gcgucagcaccgcgacggug

SEQ ID NO: 797760 - RNA, 22 nt, Mycobacterium avium subsp. paratuberculosis
gcgucagcaccgcgacggugag

SEQ ID NO: 797761 - RNA, 15 nt, Mycobacterium avium subsp. paratuberculosis
gcgucagaaccgggg

SEQ ID NO: 797762 - RNA, 20 nt, Mycobacterium avium subsp. paratuberculosis
gcgucagaaccggggccagc

SEQ ID NO: 797763 - RNA, 22 nt, Mycobacterium avium subsp. paratuberculosis
gcgucagaaccggggccagcac

SEQ ID NO: 797764 - RNA, 16 nt, Mycobacterium avium subsp. paratuberculosis
gcgucacgucgacggc

SEQ ID NO: 797765 - RNA, 14 nt, Mycobacterium avium subsp. paratuberculosis
gcgucacgucggcc

SEQ ID NO: 797766 - RNA, 16 nt, Mycobacterium avium subsp. paratuberculosis
gcgucacuccucgauc

SEQ ID NO: 797767 - RNA, 17 nt, Mycobacterium avium subsp. paratuberculosis
gcgucacuccucgaucu

SEQ ID NO: 797768 - RNA, 20 nt, Mycobacterium avium subsp. paratuberculosis
gcgucacgcuagcgugacag

SEQ ID NO: 797769 - RNA, 17 nt, Mycobacterium avium subsp. paratuberculosis
gcgucacgcugcgcgcc

SEQ ID NO: 797770 - RNA, 14 nt, Mycobacterium avium subsp. paratuberculosis
gcgucacgcuggcg

SEQ ID NO: 797771 - RNA, 16 nt, Mycobacterium avium subsp. paratuberculosis
gcgucacgcuggcgug

SEQ ID NO: 797772 - RNA, 17 nt, Mycobacterium avium subsp. paratuberculosis
gcgucacgcuggcguga

SEQ ID NO: 797773 - RNA, 19 nt, Mycobacterium avium subsp. paratuberculosis
gcgucacgcuggcgugacg

SEQ ID NO: 797774 - RNA, 20 nt, Mycobacterium avium subsp. paratuberculosis
gcgucacgcuggcgugacgg

SEQ ID NO: 797775 - RNA, 22 nt, Mycobacterium avium subsp. paratuberculosis
gcgucacgcuggcgugacgguc

SEQ ID NO: 797776 - RNA, 18 nt, Mycobacterium avium subsp. paratuberculosis
gcgucacgcuggcguggc

SEQ ID NO: 797777 - RNA, 20 nt, Mycobacterium avium subsp. paratuberculosis
gcgucacgcuggcguggcgc

SEQ ID NO: 797778 - RNA, 14 nt, Mycobacterium avium subsp. paratuberculosis
gcgucacgcuggug

SEQ ID NO: 797779 - RNA, 17 nt, Mycobacterium avium subsp. paratuberculosis
gcgucacgcuggugacg

SEQ ID NO: 797780 - RNA, 17 nt, Mycobacterium avium subsp. paratuberculosis
gcgucaggcgcugggug

SEQ ID NO: 797781 - RNA, 18 nt, Mycobacterium avium subsp. paratuberculosis
gcgucaggcgcugggugc

SEQ ID NO: 797782 - RNA, 15 nt, Mycobacterium avium subsp. paratuberculosis
gcgucagggcgacuc

SEQ ID NO: 797783 - RNA, 19 nt, Mycobacterium avium subsp. paratuberculosis
gcgucagggcgacuccggc

SEQ ID NO: 797784 - RNA, 24 nt, Mycobacterium avium subsp. paratuberculosis
gcgucagggcgacuccggcgccgg

SEQ ID NO: 797785 - RNA, 13 nt, Mycobacterium avium subsp. paratuberculosis
gcgucagcggcgg

SEQ ID NO: 797786 - RNA, 15 nt, Mycobacterium avium subsp. paratuberculosis
gcgucagcggcgggc

SEQ ID NO: 797787 - RNA, 15 nt, Mycobacterium avium subsp. paratuberculosis
gcgucagcagcgcga

SEQ ID NO: 797788 - RNA, 17 nt, Mycobacterium avium subsp. paratuberculosis
gcgucagcagcgcgacg

SEQ ID NO: 797789 - RNA, 15 nt, Mycobacterium avium subsp. paratuberculosis
gcgucagcaucgccg

SEQ ID NO: 797790 - RNA, 17 nt, Mycobacterium avium subsp. paratuberculosis
gcgucagccgucgucgu

SEQ ID NO: 797791 - RNA, 19 nt, Mycobacterium avium subsp. paratuberculosis
gcgucagccgucgucgucc

SEQ ID NO: 797792 - RNA, 16 nt, Mycobacterium avium subsp. paratuberculosis
gcgucagccccgaguc

SEQ ID NO: 797793 - RNA, 18 nt, Mycobacterium avium subsp. paratuberculosis
gcguuuugaaauccgggc

SEQ ID NO: 797794 - RNA, 20 nt, Mycobacterium avium subsp. paratuberculosis
gcuaaacaauggccccggcg

SEQ ID NO: 797795 - RNA, 16 nt, Mycobacterium avium subsp. paratuberculosis
gcuaaagccaccagcg

SEQ ID NO: 797796 - RNA, 16 nt, Mycobacterium avium subsp. paratuberculosis
gcuaaagccgaccgcc

SEQ ID NO: 797797 - RNA, 16 nt, Mycobacterium avium subsp. paratuberculosis
gcuaaaccccacggcc

SEQ ID NO: 797798 - RNA, 18 nt, Mycobacterium avium subsp. paratuberculosis
gcuaacgccagcugggca

SEQ ID NO: 797799 - RNA, 15 nt, Mycobacterium avium subsp. paratuberculosis
gcuaacgcuggucga

SEQ ID NO: 797800 - RNA, 15 nt, Mycobacterium avium subsp. paratuberculosis
gcuaagccggcgucg

SEQ ID NO: 797801 - RNA, 23 nt, Mycobacterium avium subsp. paratuberculosis
gcguugccggccgaagugcucga

SEQ ID NO: 797802 - RNA, 14 nt, Mycobacterium avium subsp. paratuberculosis
gcguugcgccagca

SEQ ID NO: 797803 - RNA, 18 nt, Mycobacterium avium subsp. paratuberculosis
gcguugcgcggaccggcg

SEQ ID NO: 797804 - RNA, 18 nt, Mycobacterium avium subsp. paratuberculosis
gcguugcgcggcggccaa

SEQ ID NO: 797805 - RNA, 24 nt, Mycobacterium avium subsp. paratuberculosis
gcguugcgcucuguuggccgucgc

SEQ ID NO: 797806 - RNA, 17 nt, Mycobacterium avium subsp. paratuberculosis
gcguugcggccguccag

SEQ ID NO: 797807 - RNA, 17 nt, Mycobacterium avium subsp. paratuberculosis
gcguugcggaucgaacg

SEQ ID NO: 797808 - RNA, 14 nt, Mycobacterium avium subsp. paratuberculosis
gcguugccgcgcgc

SEQ ID NO: 797809 - RNA, 17 nt, Mycobacterium avium subsp. paratuberculosis
gcguugcggcacaggcg

SEQ ID NO: 797810 - RNA, 19 nt, Mycobacterium avium subsp. paratuberculosis
gcguuggccgagcagccgg

SEQ ID NO: 797811 - RNA, 21 nt, Mycobacterium avium subsp. paratuberculosis
gcguuggccgagcagccgggc

SEQ ID NO: 797812 - RNA, 12 nt, Mycobacterium avium subsp. paratuberculosis
gcguuggccgcc

SEQ ID NO: 797813 - RNA, 13 nt, Mycobacterium avium subsp. paratuberculosis
gcguuggccggcu

SEQ ID NO: 797814 - RNA, 18 nt, Mycobacterium avium subsp. paratuberculosis
gcguuggacagcucgacg

SEQ ID NO: 797815 - RNA, 19 nt, Mycobacterium avium subsp. paratuberculosis
gcguuggacagcucgacga

SEQ ID NO: 797816 - RNA, 19 nt, Mycobacterium avium subsp. paratuberculosis
gcguuggacuccaccgcca

SEQ ID NO: 797817 - RNA, 21 nt, Mycobacterium avium subsp. paratuberculosis
gcguuggacuccaccgccacc

SEQ ID NO: 797818 - RNA, 22 nt, Mycobacterium avium subsp. paratuberculosis
gcguuguugcucggcggcccgc

SEQ ID NO: 797819 - RNA, 19 nt, Mycobacterium avium subsp. paratuberculosis
gcguugucgaccaccaggu

SEQ ID NO: 797820 - RNA, 13 nt, Mycobacterium avium subsp. paratuberculosis
gcguugucggcga

SEQ ID NO: 797821 - RNA, 21 nt, Mycobacterium avium subsp. paratuberculosis
gcguugguguagccgaacgug

SEQ ID NO: 797822 - RNA, 22 nt, Mycobacterium avium subsp. paratuberculosis
gcguugguugcggccccgccag

SEQ ID NO: 797823 - RNA, 21 nt, Mycobacterium avium subsp. paratuberculosis
gcguuguccagcagcgccggc

SEQ ID NO: 797824 - RNA, 19 nt, Mycobacterium avium subsp. paratuberculosis
gcguuguccagguagccca

SEQ ID NO: 797825 - RNA, 19 nt, Mycobacterium avium subsp. paratuberculosis
gcguuguugaggaacgcga

SEQ ID NO: 797826 - RNA, 16 nt, Mycobacterium avium subsp. paratuberculosis
gcguuucagcaacccg

SEQ ID NO: 797827 - RNA, 19 nt, Mycobacterium avium subsp. paratuberculosis
gcguuuccuggugcaccag

SEQ ID NO: 797828 - RNA, 20 nt, Mycobacterium avium subsp. paratuberculosis
gcguuuccuggugcaccagg

SEQ ID NO: 797829 - RNA, 16 nt, Mycobacterium avium subsp. paratuberculosis
gcguggaacgcgucgc

SEQ ID NO: 797830 - RNA, 18 nt, Mycobacterium avium subsp. paratuberculosis
gcguggaacgcgucgcgc

SEQ ID NO: 797831 - RNA, 19 nt, Mycobacterium avium subsp. paratuberculosis
gcguggaacgcgucgcgcc

SEQ ID NO: 797832 - RNA, 20 nt, Mycobacterium avium subsp. paratuberculosis
gcguggaacgcgucgcgcca

SEQ ID NO: 797833 - RNA, 21 nt, Mycobacterium avium subsp. paratuberculosis
gcguggaacgcgucgcgccag

SEQ ID NO: 797834 - RNA, 16 nt, Mycobacterium avium subsp. paratuberculosis
gcgugcgguggucggc

SEQ ID NO: 797835 - RNA, 17 nt, Mycobacterium avium subsp. paratuberculosis
gcgugcgguuggcccgc

SEQ ID NO: 797836 - RNA, 16 nt, Mycobacterium avium subsp. paratuberculosis
gcgugcgucacgcugg

SEQ ID NO: 797837 - RNA, 20 nt, Mycobacterium avium subsp. paratuberculosis
gcgugcgucacgcuggugac

SEQ ID NO: 797838 - RNA, 18 nt, Mycobacterium avium subsp. paratuberculosis
gcguggaacacgcccagc

SEQ ID NO: 797839 - RNA, 22 nt, Mycobacterium avium subsp. paratuberculosis
gcgugcggccgcagcgcccggc

SEQ ID NO: 797840 - RNA, 15 nt, Mycobacterium avium subsp. paratuberculosis
gcgugcgggucgcgc

SEQ ID NO: 797841 - RNA, 15 nt, Mycobacterium avium subsp. paratuberculosis
gcgugcggguggccg

SEQ ID NO: 797842 - RNA, 17 nt, Mycobacterium avium subsp. paratuberculosis
gcguggauggccggccg

SEQ ID NO: 797843 - RNA, 16 nt, Mycobacterium avium subsp. paratuberculosis
gcguggcaggccauca

SEQ ID NO: 797844 - RNA, 19 nt, Mycobacterium avium subsp. paratuberculosis
gcguggcaggccaucagcc

SEQ ID NO: 797845 - RNA, 22 nt, Mycobacterium avium subsp. paratuberculosis
gcguggcaggccaucagcccgg

SEQ ID NO: 797846 - RNA, 17 nt, Mycobacterium avium subsp. paratuberculosis
gcguggcaauucgaccg

SEQ ID NO: 797847 - RNA, 19 nt, Mycobacterium avium subsp. paratuberculosis
gcguggcaauucgaccguc

SEQ ID NO: 797848 - RNA, 16 nt, Mycobacterium avium subsp. paratuberculosis
gcguggcacccgggcg

SEQ ID NO: 797849 - RNA, 12 nt, Mycobacterium avium subsp. paratuberculosis
gcguggccagca

SEQ ID NO: 797850 - RNA, 20 nt, Mycobacterium avium subsp. paratuberculosis
gcgugugcgugguggggccg

SEQ ID NO: 797851 - RNA, 15 nt, Mycobacterium avium subsp. paratuberculosis
gcgugugggcucgcc

SEQ ID NO: 797852 - RNA, 17 nt, Mycobacterium avium subsp. paratuberculosis
gcgugugggcucgcccg

SEQ ID NO: 797853 - RNA, 18 nt, Mycobacterium avium subsp. paratuberculosis
gcgugugggcucgcccgg

SEQ ID NO: 797854 - RNA, 19 nt, Mycobacterium avium subsp. paratuberculosis
gcgugugggcucgcccggg

SEQ ID NO: 797855 - RNA, 20 nt, Mycobacterium avium subsp. paratuberculosis
gcguguuccuugcggccgcc

SEQ ID NO: 797856 - RNA, 17 nt, Mycobacterium avium subsp. paratuberculosis
gcgugugcccagcacga

SEQ ID NO: 797857 - RNA, 15 nt, Mycobacterium avium subsp. paratuberculosis
gcguguugagcucgc

SEQ ID NO: 797858 - RNA, 18 nt, Mycobacterium avium subsp. paratuberculosis
gcguguugagcucgcggc

SEQ ID NO: 797859 - RNA, 13 nt, Mycobacterium avium subsp. paratuberculosis
gcgugucggcgau

SEQ ID NO: 797860 - RNA, 18 nt, Mycobacterium avium subsp. paratuberculosis
gcgugucggcgccaccgg

SEQ ID NO: 797861 - RNA, 19 nt, Mycobacterium avium subsp. paratuberculosis
gcgugucggggucggcgcc

SEQ ID NO: 797862 - RNA, 18 nt, Mycobacterium avium subsp. paratuberculosis
gcgugucgugugcgugac

SEQ ID NO: 797863 - RNA, 19 nt, Mycobacterium avium subsp. paratuberculosis
gcguugaaagccgcgaacg

SEQ ID NO: 797864 - RNA, 21 nt, Mycobacterium avium subsp. paratuberculosis
gcguugaaaguccuugcugcc

SEQ ID NO: 797865 - RNA, 13 nt, Mycobacterium avium subsp. paratuberculosis
gcguugaccgggc

SEQ ID NO: 797866 - RNA, 21 nt, Mycobacterium avium subsp. paratuberculosis
gcguugaccgggccgcuggug

SEQ ID NO: 797867 - RNA, 16 nt, Mycobacterium avium subsp. paratuberculosis
gcguugaccagaccga

SEQ ID NO: 797868 - RNA, 15 nt, Mycobacterium avium subsp. paratuberculosis
gcguugagcgucgcc

SEQ ID NO: 797869 - RNA, 20 nt, Mycobacterium avium subsp. paratuberculosis
gcguugagccggcgcaccgc

SEQ ID NO: 797870 - RNA, 19 nt, Mycobacterium avium subsp. paratuberculosis
gcguugacgaugacgcggu

SEQ ID NO: 797871 - RNA, 16 nt, Mycobacterium avium subsp. paratuberculosis
gcguucgccgaggaag

SEQ ID NO: 797872 - RNA, 18 nt, Mycobacterium avium subsp. paratuberculosis
gcguucgauugccggacg

SEQ ID NO: 797873 - RNA, 14 nt, Mycobacterium avium subsp. paratuberculosis
gcguucgccggcgu

SEQ ID NO: 797874 - RNA, 22 nt, Mycobacterium avium subsp. paratuberculosis
gcguucgccggcguagaccagc

SEQ ID NO: 797875 - RNA, 13 nt, Mycobacterium avium subsp. paratuberculosis
gcguucugcacca

SEQ ID NO: 797876 - RNA, 19 nt, Mycobacterium avium subsp. paratuberculosis
gcguucugcaccagcucgg

SEQ ID NO: 797877 - RNA, 16 nt, Mycobacterium avium subsp. paratuberculosis
gcguucugcaccgacu

SEQ ID NO: 797878 - RNA, 16 nt, Mycobacterium avium subsp. paratuberculosis
gcguucuccaccgcgc

SEQ ID NO: 797879 - RNA, 17 nt, Mycobacterium avium subsp. paratuberculosis
gcguucuccagcacccg

SEQ ID NO: 797880 - RNA, 22 nt, Mycobacterium avium subsp. paratuberculosis
gcguucuccucgaacaccgcac

SEQ ID NO: 797881 - RNA, 13 nt, Mycobacterium avium subsp. paratuberculosis
gcguucccgggcc

SEQ ID NO: 797882 - RNA, 15 nt, Mycobacterium avium subsp. paratuberculosis
gcguuccgccacggc

SEQ ID NO: 797883 - RNA, 17 nt, Mycobacterium avium subsp. paratuberculosis
gcguuccgccacggcgg

SEQ ID NO: 797884 - RNA, 13 nt, Mycobacterium avium subsp. paratuberculosis
gcguuccgcgaca

SEQ ID NO: 797885 - RNA, 13 nt, Mycobacterium avium subsp. paratuberculosis
gcguuccggcggc

SEQ ID NO: 797886 - RNA, 18 nt, Mycobacterium avium subsp. paratuberculosis
gcguucgaccuccacgag

SEQ ID NO: 797887 - RNA, 22 nt, Mycobacterium avium subsp. paratuberculosis
gcguucgaccuccacgagccgg

SEQ ID NO: 797888 - RNA, 20 nt, Mycobacterium avium subsp. paratuberculosis
gcguucgacccacaccucgc

SEQ ID NO: 797889 - RNA, 18 nt, Mycobacterium avium subsp. paratuberculosis
gcguuccuuacgccgacg

SEQ ID NO: 797890 - RNA, 16 nt, Mycobacterium avium subsp. paratuberculosis
gcguucagcagcgcgg

SEQ ID NO: 797891 - RNA, 12 nt, Mycobacterium avium subsp. paratuberculosis
gcguucacccgc

SEQ ID NO: 797892 - RNA, 13 nt, Mycobacterium avium subsp. paratuberculosis
gcguucacccgcg

SEQ ID NO: 797893 - RNA, 16 nt, Mycobacterium avium subsp. paratuberculosis
gcguucacccgcgccc

SEQ ID NO: 797894 - RNA, 19 nt, Mycobacterium avium subsp. paratuberculosis
gcguucacccgcgcccgca

SEQ ID NO: 797895 - RNA, 22 nt, Mycobacterium avium subsp. paratuberculosis
gcguucacccgcgcccgcaugu

SEQ ID NO: 797896 - RNA, 17 nt, Mycobacterium avium subsp. paratuberculosis
gcguucacaguaggcgg

SEQ ID NO: 797897 - RNA, 21 nt, Mycobacterium avium subsp. paratuberculosis
gcgucccagugcucgaccaga

SEQ ID NO: 797898 - RNA, 18 nt, Mycobacterium avium subsp. paratuberculosis
gcguccaggacucggggu

SEQ ID NO: 797899 - RNA, 18 nt, Mycobacterium avium subsp. paratuberculosis
gcguccauggucgagccg

SEQ ID NO: 797900 - RNA, 17 nt, Mycobacterium avium subsp. paratuberculosis
gcgucccguccugggcc

SEQ ID NO: 797901 - RNA, 13 nt, Mycobacterium avium subsp. paratuberculosis
gcgucccgucggc

SEQ ID NO: 797902 - RNA, 15 nt, Mycobacterium avium subsp. paratuberculosis
gcgucccgucggcca

SEQ ID NO: 797903 - RNA, 16 nt, Mycobacterium avium subsp. paratuberculosis
gcgucccgucggccag

SEQ ID NO: 797904 - RNA, 15 nt, Mycobacterium avium subsp. paratuberculosis
gcgucccggcgucuc

SEQ ID NO: 797905 - RNA, 17 nt, Mycobacterium avium subsp. paratuberculosis
gcgucccggcgucucgg

SEQ ID NO: 797906 - RNA, 23 nt, Mycobacterium avium subsp. paratuberculosis
gcgucccgggccuuggccaacgc

SEQ ID NO: 797907 - RNA, 15 nt, Mycobacterium avium subsp. paratuberculosis
gcgucccggguaccu

SEQ ID NO: 797908 - RNA, 14 nt, Mycobacterium avium subsp. paratuberculosis
gcguccccgcgccg

SEQ ID NO: 797909 - RNA, 17 nt, Mycobacterium avium subsp. paratuberculosis
gcguccccgcgccgggc

SEQ ID NO: 797910 - RNA, 13 nt, Mycobacterium avium subsp. paratuberculosis
gcguccccggcgg

SEQ ID NO: 797911 - RNA, 14 nt, Mycobacterium avium subsp. paratuberculosis
gcguccccggcggu

SEQ ID NO: 797912 - RNA, 20 nt, Mycobacterium avium subsp. paratuberculosis
gcgucccgcgccacguaucg

SEQ ID NO: 797913 - RNA, 15 nt, Mycobacterium avium subsp. paratuberculosis
gcgucgccgacgggc

SEQ ID NO: 797914 - RNA, 17 nt, Mycobacterium avium subsp. paratuberculosis
gcgucgccgagccgcgc

SEQ ID NO: 797915 - RNA, 21 nt, Mycobacterium avium subsp. paratuberculosis
gcgucgccgagccgcgccacg

SEQ ID NO: 797916 - RNA, 20 nt, Mycobacterium avium subsp. paratuberculosis
gcgucgccgaucgcccggua

SEQ ID NO: 797917 - RNA, 12 nt, Mycobacterium avium subsp. paratuberculosis
gcgucgccgacc

SEQ ID NO: 797918 - RNA, 14 nt, Mycobacterium avium subsp. paratuberculosis
gcgucgccgaccag

SEQ ID NO: 797919 - RNA, 16 nt, Mycobacterium avium subsp. paratuberculosis
gcgucgccgaccagca

SEQ ID NO: 797920 - RNA, 19 nt, Mycobacterium avium subsp. paratuberculosis
gcgucccguuggcgccggu

SEQ ID NO: 797921 - RNA, 20 nt, Mycobacterium avium subsp. paratuberculosis
gcgucccguuggcgccgguc

SEQ ID NO: 797922 - RNA, 13 nt, Mycobacterium avium subsp. paratuberculosis
gcgucccuggcga

SEQ ID NO: 797923 - RNA, 14 nt, Mycobacterium avium subsp. paratuberculosis
gcgucccuggcgau

SEQ ID NO: 797924 - RNA, 14 nt, Mycobacterium avium subsp. paratuberculosis
gcguccgacggcug

SEQ ID NO: 797925 - RNA, 21 nt, Mycobacterium avium subsp. paratuberculosis
gcguccgacggcuggguggcg

SEQ ID NO: 797926 - RNA, 14 nt, Mycobacterium avium subsp. paratuberculosis
gcgucgcccgccga

SEQ ID NO: 797927 - RNA, 16 nt, Mycobacterium avium subsp. paratuberculosis
gcgucgcccgccgacg

SEQ ID NO: 797928 - RNA, 14 nt, Mycobacterium avium subsp. paratuberculosis
gcgucggccagcgc

SEQ ID NO: 797929 - RNA, 16 nt, Mycobacterium avium subsp. paratuberculosis
gcgucggccagcgcgc

SEQ ID NO: 797930 - RNA, 12 nt, Mycobacterium avium subsp. paratuberculosis
gcgucggccagc

SEQ ID NO: 797931 - RNA, 15 nt, Mycobacterium avium subsp. paratuberculosis
gcgucggccagcacc

SEQ ID NO: 797932 - RNA, 16 nt, Mycobacterium avium subsp. paratuberculosis
gcgucggccagcacca

SEQ ID NO: 797933 - RNA, 17 nt, Mycobacterium avium subsp. paratuberculosis
gcgucggccaccgcgcc

SEQ ID NO: 797934 - RNA, 13 nt, Mycobacterium avium subsp. paratuberculosis
gcgucggccaacg

SEQ ID NO: 797935 - RNA, 15 nt, Mycobacterium avium subsp. paratuberculosis
gcgucggcaccagcg

SEQ ID NO: 797936 - RNA, 17 nt, Mycobacterium avium subsp. paratuberculosis
gcgucggagaucaccgg

SEQ ID NO: 797937 - RNA, 17 nt, Mycobacterium avium subsp. paratuberculosis
gcgucggaggcggcgua

SEQ ID NO: 797938 - RNA, 18 nt, Mycobacterium avium subsp. paratuberculosis
gcgucggagucgcuguug

SEQ ID NO: 797939 - RNA, 21 nt, Mycobacterium avium subsp. paratuberculosis
gcgucggagucgcuguuggcg

SEQ ID NO: 797940 - RNA, 14 nt, Mycobacterium avium subsp. paratuberculosis
gcgucgccgcgugg

SEQ ID NO: 797941 - RNA, 14 nt, Mycobacterium avium subsp. paratuberculosis
gcgucgccgugccg

SEQ ID NO: 797942 - RNA, 23 nt, Mycobacterium avium subsp. paratuberculosis
gcgucgccgugccggaccgcgcg

SEQ ID NO: 797943 - RNA, 23 nt, Mycobacterium avium subsp. paratuberculosis
gcgucgcgaugagauucgagcgu

SEQ ID NO: 797944 - RNA, 12 nt, Mycobacterium avium subsp. paratuberculosis
gcgucgcgcagc

SEQ ID NO: 797945 - RNA, 13 nt, Mycobacterium avium subsp. paratuberculosis
gcgucgcgcagca

SEQ ID NO: 797946 - RNA, 21 nt, Mycobacterium avium subsp. paratuberculosis
gcgucgcgcagcaacgguacg

SEQ ID NO: 797947 - RNA, 17 nt, Mycobacterium avium subsp. paratuberculosis
gcgucgcgcagcagcgg

SEQ ID NO: 797948 - RNA, 12 nt, Mycobacterium avium subsp. paratuberculosis
gcgucgccgccc

SEQ ID NO: 797949 - RNA, 20 nt, Mycobacterium avium subsp. paratuberculosis
gcgucgccgccccgaguucc

SEQ ID NO: 797950 - RNA, 16 nt, Mycobacterium avium subsp. paratuberculosis
gcgucgccgccgggcg

SEQ ID NO: 797951 - RNA, 18 nt, Mycobacterium avium subsp. paratuberculosis
gcgucgccgccggugccg

SEQ ID NO: 797952 - RNA, 22 nt, Mycobacterium avium subsp. paratuberculosis
gcgucgguaaucggcgguggug

SEQ ID NO: 797953 - RNA, 18 nt, Mycobacterium avium subsp. paratuberculosis
gcgucgguaggugucgau

SEQ ID NO: 797954 - RNA, 19 nt, Mycobacterium avium subsp. paratuberculosis
gcgucgguaggugucgaug

SEQ ID NO: 797955 - RNA, 20 nt, Mycobacterium avium subsp. paratuberculosis
gcgucgguaggugucgauga

SEQ ID NO: 797956 - RNA, 12 nt, Mycobacterium avium subsp. paratuberculosis
gcgucggucagc

SEQ ID NO: 797957 - RNA, 13 nt, Mycobacterium avium subsp. paratuberculosis
gcgucggucagca

SEQ ID NO: 797958 - RNA, 18 nt, Mycobacterium avium subsp. paratuberculosis
gcgucggucagcaggcgc

SEQ ID NO: 797959 - RNA, 22 nt, Mycobacterium avium subsp. paratuberculosis
gcgucggucagcaggcgccgca

SEQ ID NO: 797960 - RNA, 24 nt, Mycobacterium avium subsp. paratuberculosis
gcgucggucagcaggcgccgcagc

SEQ ID NO: 797961 - RNA, 14 nt, Mycobacterium avium subsp. paratuberculosis
gcgucggucagcgc

SEQ ID NO: 797962 - RNA, 17 nt, Mycobacterium avium subsp. paratuberculosis
gcgucggucagcgccac

SEQ ID NO: 797963 - RNA, 17 nt, Mycobacterium avium subsp. paratuberculosis
gcgucggucagcggcgu

SEQ ID NO: 797964 - RNA, 20 nt, Mycobacterium avium subsp. paratuberculosis
gcgucggucagcggcgucag

SEQ ID NO: 797965 - RNA, 12 nt, Mycobacterium avium subsp. paratuberculosis
gcgucgggggug

SEQ ID NO: 797966 - RNA, 20 nt, Mycobacterium avium subsp. paratuberculosis
gcgucgggggugccgcuccg

SEQ ID NO: 797967 - RNA, 12 nt, Mycobacterium avium subsp. paratuberculosis
gcgucgggcacc

SEQ ID NO: 797968 - RNA, 22 nt, Mycobacterium avium subsp. paratuberculosis
gcgucggguacaccgagccggg

SEQ ID NO: 797969 - RNA, 23 nt, Mycobacterium avium subsp. paratuberculosis
gcgucggguacaccgagccgggg

SEQ ID NO: 797970 - RNA, 18 nt, Mycobacterium avium subsp. paratuberculosis
gcgucggucucgacguug

SEQ ID NO: 797971 - RNA, 22 nt, Mycobacterium avium subsp. paratuberculosis
gcgucggugaacucguccaugc

SEQ ID NO: 797972 - RNA, 18 nt, Mycobacterium avium subsp. paratuberculosis
gcgucggugaugccggac

SEQ ID NO: 797973 - RNA, 13 nt, Mycobacterium avium subsp. paratuberculosis
gcgucggccagcg

SEQ ID NO: 797974 - RNA, 12 nt, Mycobacterium avium subsp. paratuberculosis
gcgucggccggg

SEQ ID NO: 797975 - RNA, 13 nt, Mycobacterium avium subsp. paratuberculosis
gcgucggccgggg

SEQ ID NO: 797976 - RNA, 12 nt, Mycobacterium avium subsp. paratuberculosis
gcgucggccugc

SEQ ID NO: 797977 - RNA, 16 nt, Mycobacterium avium subsp. paratuberculosis
gcgucggcgaccgcgc

SEQ ID NO: 797978 - RNA, 17 nt, Mycobacterium avium subsp. paratuberculosis
gcgucggcgaccgcgcg

SEQ ID NO: 797979 - RNA, 21 nt, Mycobacterium avium subsp. paratuberculosis
gcgucggcgaccgcgcgcggc

SEQ ID NO: 797980 - RNA, 15 nt, Mycobacterium avium subsp. paratuberculosis
gcgucggcgacggcg

SEQ ID NO: 797981 - RNA, 20 nt, Mycobacterium avium subsp. paratuberculosis
gcgucggcgacggcguccag

SEQ ID NO: 797982 - RNA, 18 nt, Mycobacterium avium subsp. paratuberculosis
gcgucgggaccgucgcgc

SEQ ID NO: 797983 - RNA, 16 nt, Mycobacterium avium subsp. paratuberculosis
gcgucgggauggucga

SEQ ID NO: 797984 - RNA, 13 nt, Mycobacterium avium subsp. paratuberculosis
gcgucgggcaggu

SEQ ID NO: 797985 - RNA, 17 nt, Mycobacterium avium subsp. paratuberculosis
gcgucgggccgggggcg

SEQ ID NO: 797986 - RNA, 20 nt, Mycobacterium avium subsp. paratuberculosis
gcgucgggccgggggcggcg

SEQ ID NO: 797987 - RNA, 13 nt, Mycobacterium avium subsp. paratuberculosis
gcgucgggcgccg

SEQ ID NO: 797988 - RNA, 17 nt, Mycobacterium avium subsp. paratuberculosis
gcgucgggcgccggcgc

SEQ ID NO: 797989 - RNA, 18 nt, Mycobacterium avium subsp. paratuberculosis
gcgucgggcgccggcgcg

SEQ ID NO: 797990 - RNA, 15 nt, Mycobacterium avium subsp. paratuberculosis
gcgucgggcggggug

SEQ ID NO: 797991 - RNA, 14 nt, Mycobacterium avium subsp. paratuberculosis
gcgucgggcucgcg

SEQ ID NO: 797992 - RNA, 15 nt, Mycobacterium avium subsp. paratuberculosis
gcgucgggcucgcgg

SEQ ID NO: 797993 - RNA, 16 nt, Mycobacterium avium subsp. paratuberculosis
gcgucggugucccgcg

SEQ ID NO: 797994 - RNA, 23 nt, Mycobacterium avium subsp. paratuberculosis
gcgucggugucccgcgcccgcga

SEQ ID NO: 797995 - RNA, 23 nt, Mycobacterium avium subsp. paratuberculosis
gcgucgguccaaaacaucccgga

SEQ ID NO: 797996 - RNA, 12 nt, Mycobacterium avium subsp. paratuberculosis
gcgucggccgca

SEQ ID NO: 797997 - RNA, 16 nt, Mycobacterium avium subsp. paratuberculosis
gcgucguagagcugac

SEQ ID NO: 797998 - RNA, 13 nt, Mycobacterium avium subsp. paratuberculosis
gcgucguagucgc

SEQ ID NO: 797999 - RNA, 17 nt, Mycobacterium avium subsp. paratuberculosis
gcgucguagucgcucgg

SEQ ID NO: 798000 - RNA, 18 nt, Mycobacterium avium subsp. paratuberculosis
gcgucguagucgcucggc

SEQ ID NO: 798001 - RNA, 22 nt, Mycobacterium avium subsp. paratuberculosis
gcgucguagucgcucggcggcg

SEQ ID NO: 798002 - RNA, 17 nt, Mycobacterium avium subsp. paratuberculosis
gcgucguacaccucggu

SEQ ID NO: 798003 - RNA, 18 nt, Mycobacterium avium subsp. paratuberculosis
gcgucguacaccucgguc

SEQ ID NO: 798004 - RNA, 17 nt, Mycobacterium avium subsp. paratuberculosis
gcgucguacagcagccc

SEQ ID NO: 798005 - RNA, 19 nt, Mycobacterium avium subsp. paratuberculosis
gcgucguagacgcugccgc

SEQ ID NO: 798006 - RNA, 20 nt, Mycobacterium avium subsp. paratuberculosis
gcgucguugaacgcgcgggu

SEQ ID NO: 798007 - RNA, 21 nt, Mycobacterium avium subsp. paratuberculosis
gcgucguugaacgcgcgggug

SEQ ID NO: 798008 - RNA, 22 nt, Mycobacterium avium subsp. paratuberculosis
gcgucguugaacgcgcgggugc

SEQ ID NO: 798009 - RNA, 17 nt, Mycobacterium avium subsp. paratuberculosis
gcgucguugagcaggcu

SEQ ID NO: 798010 - RNA, 16 nt, Mycobacterium avium subsp. paratuberculosis
gcgucguguccgggcc

SEQ ID NO: 798011 - RNA, 18 nt, Mycobacterium avium subsp. paratuberculosis
gcgucguguccgggcccg

SEQ ID NO: 798012 - RNA, 14 nt, Mycobacterium avium subsp. paratuberculosis
gcgucguggucgac

SEQ ID NO: 798013 - RNA, 16 nt, Mycobacterium avium subsp. paratuberculosis
gcgucguggucgacgc

SEQ ID NO: 798014 - RNA, 17 nt, Mycobacterium avium subsp. paratuberculosis
gcgucguggucgacgcc

SEQ ID NO: 798015 - RNA, 22 nt, Mycobacterium avium subsp. paratuberculosis
gcgucguggucgacgccguggu

SEQ ID NO: 798016 - RNA, 17 nt, Mycobacterium avium subsp. paratuberculosis
gcgucgugcgggcuccg

SEQ ID NO: 798017 - RNA, 22 nt, Mycobacterium avium subsp. paratuberculosis
gcgucgugcgggcuccgcacga

SEQ ID NO: 798018 - RNA, 24 nt, Mycobacterium avium subsp. paratuberculosis
gcgucgugcgggcuccgcacgacc

SEQ ID NO: 798019 - RNA, 15 nt, Mycobacterium avium subsp. paratuberculosis
gcgucguggcccugc

SEQ ID NO: 798020 - RNA, 22 nt, Mycobacterium avium subsp. paratuberculosis
gcgucguggcccugcucgucgu

SEQ ID NO: 798021 - RNA, 19 nt, Mycobacterium avium subsp. paratuberculosis
gcgucguaguugcggccgg

SEQ ID NO: 798022 - RNA, 20 nt, Mycobacterium avium subsp. paratuberculosis
gcgucguaguugcggccggc

SEQ ID NO: 798023 - RNA, 22 nt, Mycobacterium avium subsp. paratuberculosis
gcgucguaguugcggccggcgg

SEQ ID NO: 798024 - RNA, 17 nt, Mycobacterium avium subsp. paratuberculosis
gcgugaucccgauccuc

SEQ ID NO: 798025 - RNA, 20 nt, Mycobacterium avium subsp. paratuberculosis
gcgugacuugucgggccgca

SEQ ID NO: 798026 - RNA, 16 nt, Mycobacterium avium subsp. paratuberculosis
gcgugauaggccucgu

SEQ ID NO: 798027 - RNA, 21 nt, Mycobacterium avium subsp. paratuberculosis
gcgugaucuguucggcggcga

SEQ ID NO: 798028 - RNA, 15 nt, Mycobacterium avium subsp. paratuberculosis
gcgugaugaccaggg

SEQ ID NO: 798029 - RNA, 17 nt, Mycobacterium avium subsp. paratuberculosis
gcgugaugacggcggcg

SEQ ID NO: 798030 - RNA, 15 nt, Mycobacterium avium subsp. paratuberculosis
gcgugaugcagcagg

SEQ ID NO: 798031 - RNA, 22 nt, Mycobacterium avium subsp. paratuberculosis
gcgugaugggugggcagcucgg

SEQ ID NO: 798032 - RNA, 16 nt, Mycobacterium avium subsp. paratuberculosis
gcgugcaacugcgugg

SEQ ID NO: 798033 - RNA, 19 nt, Mycobacterium avium subsp. paratuberculosis
gcgugcaacugcguggccg

SEQ ID NO: 798034 - RNA, 16 nt, Mycobacterium avium subsp. paratuberculosis
gcgugccgaacggcgc

SEQ ID NO: 798035 - RNA, 15 nt, Mycobacterium avium subsp. paratuberculosis
gcgugccgaccagcc

SEQ ID NO: 798036 - RNA, 13 nt, Mycobacterium avium subsp. paratuberculosis
gcgugacguucgg

SEQ ID NO: 798037 - RNA, 14 nt, Mycobacterium avium subsp. paratuberculosis
gcgugacguucggc

SEQ ID NO: 798038 - RNA, 16 nt, Mycobacterium avium subsp. paratuberculosis
gcgugacguucggcca

SEQ ID NO: 798039 - RNA, 14 nt, Mycobacterium avium subsp. paratuberculosis
gcgugaccccggcg

SEQ ID NO: 798040 - RNA, 15 nt, Mycobacterium avium subsp. paratuberculosis
gcgugacccugccgu

SEQ ID NO: 798041 - RNA, 22 nt, Mycobacterium avium subsp. paratuberculosis
gcgugacccugccgucaccggc

SEQ ID NO: 798042 - RNA, 23 nt, Mycobacterium avium subsp. paratuberculosis
gcgugacccugccgucaccggcc

SEQ ID NO: 798043 - RNA, 13 nt, Mycobacterium avium subsp. paratuberculosis
gcgugaccggcgg

SEQ ID NO: 798044 - RNA, 14 nt, Mycobacterium avium subsp. paratuberculosis
gcgugaccggcggu

SEQ ID NO: 798045 - RNA, 20 nt, Mycobacterium avium subsp. paratuberculosis
gcgugaccggcggugcggac

SEQ ID NO: 798046 - RNA, 20 nt, Mycobacterium avium subsp. paratuberculosis
gcgugaccggcugcucgcgc

SEQ ID NO: 798047 - RNA, 15 nt, Mycobacterium avium subsp. paratuberculosis
gcgugcgcggccgcc

SEQ ID NO: 798048 - RNA, 17 nt, Mycobacterium avium subsp. paratuberculosis
gcgugcgcggccgccca

SEQ ID NO: 798049 - RNA, 19 nt, Mycobacterium avium subsp. paratuberculosis
gcgugcgcggccgcccagu

SEQ ID NO: 798050 - RNA, 18 nt, Mycobacterium avium subsp. paratuberculosis
gcgugccggacaccggca

SEQ ID NO: 798051 - RNA, 12 nt, Mycobacterium avium subsp. paratuberculosis
gcgugcgcccga

SEQ ID NO: 798052 - RNA, 13 nt, Mycobacterium avium subsp. paratuberculosis
gcgugcgccgcgg

SEQ ID NO: 798053 - RNA, 14 nt, Mycobacterium avium subsp. paratuberculosis
gcgugcgccgcggc

SEQ ID NO: 798054 - RNA, 17 nt, Mycobacterium avium subsp. paratuberculosis
gcgugcgccgcggcggc

SEQ ID NO: 798055 - RNA, 12 nt, Mycobacterium avium subsp. paratuberculosis
gcgugccgucca

SEQ ID NO: 798056 - RNA, 15 nt, Mycobacterium avium subsp. paratuberculosis
gcgugccguccagcu

SEQ ID NO: 798057 - RNA, 13 nt, Mycobacterium avium subsp. paratuberculosis
gcgugccggcccg

SEQ ID NO: 798058 - RNA, 14 nt, Mycobacterium avium subsp. paratuberculosis
gcgugccggcccgg

SEQ ID NO: 798059 - RNA, 20 nt, Mycobacterium avium subsp. paratuberculosis
gcgugccgggauagccggau

SEQ ID NO: 798060 - RNA, 20 nt, Mycobacterium avium subsp. paratuberculosis
gcgugccgggcgguacgcgc

SEQ ID NO: 798061 - RNA, 14 nt, Mycobacterium avium subsp. paratuberculosis
gcgugccgcccgga

SEQ ID NO: 798062 - RNA, 21 nt, Mycobacterium avium subsp. paratuberculosis
gcgugccgaucgagaccaugu

SEQ ID NO: 798063 - RNA, 21 nt, Mycobacterium avium subsp. paratuberculosis
gcgugauccggaaugcggugc

SEQ ID NO: 798064 - RNA, 20 nt, Mycobacterium avium subsp. paratuberculosis
gcgugcccggcgccgaccag

SEQ ID NO: 798065 - RNA, 17 nt, Mycobacterium avium subsp. paratuberculosis
gcgucuucuucucgccg

SEQ ID NO: 798066 - RNA, 15 nt, Mycobacterium avium subsp. paratuberculosis
gcgucuugacgaacu

SEQ ID NO: 798067 - RNA, 24 nt, Mycobacterium avium subsp. paratuberculosis
gcgugaaacuagcuucacgcucgg

SEQ ID NO: 798068 - RNA, 19 nt, Mycobacterium avium subsp. paratuberculosis
gcgucuuguuggcgaaguc

SEQ ID NO: 798069 - RNA, 22 nt, Mycobacterium avium subsp. paratuberculosis
gcgugaaaucguggcuuucggc

SEQ ID NO: 798070 - RNA, 18 nt, Mycobacterium avium subsp. paratuberculosis
gcgugaacaccgcguugg

SEQ ID NO: 798071 - RNA, 19 nt, Mycobacterium avium subsp. paratuberculosis
gcgugaacaccgcguuggc

SEQ ID NO: 798072 - RNA, 18 nt, Mycobacterium avium subsp. paratuberculosis
gcgugaacagcgcccggc

SEQ ID NO: 798073 - RNA, 19 nt, Mycobacterium avium subsp. paratuberculosis
gcgugaacagcgcccggcc

SEQ ID NO: 798074 - RNA, 21 nt, Mycobacterium avium subsp. paratuberculosis
gcgucuuggacgcccgcgacc

SEQ ID NO: 798075 - RNA, 17 nt, Mycobacterium avium subsp. paratuberculosis
gcgucuuggacgcccgg

SEQ ID NO: 798076 - RNA, 22 nt, Mycobacterium avium subsp. paratuberculosis
gcgucuuggggaugguccccgg

SEQ ID NO: 798077 - RNA, 20 nt, Mycobacterium avium subsp. paratuberculosis
gcgugaacuuaacuucacgc

SEQ ID NO: 798078 - RNA, 23 nt, Mycobacterium avium subsp. paratuberculosis
gcgugaacuuaacuucacgcucg

SEQ ID NO: 798079 - RNA, 16 nt, Mycobacterium avium subsp. paratuberculosis
gcgugacacucgguca

SEQ ID NO: 798080 - RNA, 21 nt, Mycobacterium avium subsp. paratuberculosis
gcgugacacucggucaccggu

SEQ ID NO: 798081 - RNA, 17 nt, Mycobacterium avium subsp. paratuberculosis
gcgugacaggggcagca

SEQ ID NO: 798082 - RNA, 18 nt, Mycobacterium avium subsp. paratuberculosis
gcgugacagucgaccucg

SEQ ID NO: 798083 - RNA, 20 nt, Mycobacterium avium subsp. paratuberculosis
gcgugacagucgaccucgcg

SEQ ID NO: 798084 - RNA, 21 nt, Mycobacterium avium subsp. paratuberculosis
gcgugacagucgaccucgcgc

SEQ ID NO: 798085 - RNA, 20 nt, Mycobacterium avium subsp. paratuberculosis
gcgugaaguuaacuucacgc

SEQ ID NO: 798086 - RNA, 19 nt, Mycobacterium avium subsp. paratuberculosis
gcgugaauccucagcacgg

SEQ ID NO: 798087 - RNA, 20 nt, Mycobacterium avium subsp. paratuberculosis
gcgugaauccucagcacggc

SEQ ID NO: 798088 - RNA, 21 nt, Mycobacterium avium subsp. paratuberculosis
gcgugaaucuuggccagcagc

SEQ ID NO: 798089 - RNA, 17 nt, Mycobacterium avium subsp. paratuberculosis
gcgugaaugcccagcgg

SEQ ID NO: 798090 - RNA, 15 nt, Mycobacterium avium subsp. paratuberculosis
gcgugacaagccggc

SEQ ID NO: 798091 - RNA, 17 nt, Mycobacterium avium subsp. paratuberculosis
gcgugacaagccggcgu

SEQ ID NO: 798092 - RNA, 20 nt, Mycobacterium avium subsp. paratuberculosis
gcgugacaagccggcgucga

SEQ ID NO: 798093 - RNA, 15 nt, Mycobacterium avium subsp. paratuberculosis
gcgucuggcagccgg

SEQ ID NO: 798094 - RNA, 16 nt, Mycobacterium avium subsp. paratuberculosis
gcgucuggcagccggc

SEQ ID NO: 798095 - RNA, 17 nt, Mycobacterium avium subsp. paratuberculosis
gcgucuggcagccggcc

SEQ ID NO: 798096 - RNA, 19 nt, Mycobacterium avium subsp. paratuberculosis
gcgucuggcagccggccgg

SEQ ID NO: 798097 - RNA, 21 nt, Mycobacterium avium subsp. paratuberculosis
gcgucuggcagccggccggca

SEQ ID NO: 798098 - RNA, 23 nt, Mycobacterium avium subsp. paratuberculosis
gcgucuggccggagcggugcggc

SEQ ID NO: 798099 - RNA, 13 nt, Mycobacterium avium subsp. paratuberculosis
gcgucugcucgcc

SEQ ID NO: 798100 - RNA, 14 nt, Mycobacterium avium subsp. paratuberculosis
gcgucugcucgccg

SEQ ID NO: 798101 - RNA, 21 nt, Mycobacterium avium subsp. paratuberculosis
gcgucugcucgccggcuaccg

SEQ ID NO: 798102 - RNA, 15 nt, Mycobacterium avium subsp. paratuberculosis
gcgucugcucgcgcc

SEQ ID NO: 798103 - RNA, 16 nt, Mycobacterium avium subsp. paratuberculosis
gcgucugcucgcgccc

SEQ ID NO: 798104 - RNA, 17 nt, Mycobacterium avium subsp. paratuberculosis
gcgucugcucggcggcu

SEQ ID NO: 798105 - RNA, 18 nt, Mycobacterium avium subsp. paratuberculosis
gcgucugcucggcggcuc

SEQ ID NO: 798106 - RNA, 15 nt, Mycobacterium avium subsp. paratuberculosis
gcgucugcucgccgu

SEQ ID NO: 798107 - RNA, 14 nt, Mycobacterium avium subsp. paratuberculosis
gcgucugcugcgcc

SEQ ID NO: 798108 - RNA, 18 nt, Mycobacterium avium subsp. paratuberculosis
gcgucguugucgucgccg

SEQ ID NO: 798109 - RNA, 21 nt, Mycobacterium avium subsp. paratuberculosis
gcgucguugucgucgccggcc

SEQ ID NO: 798110 - RNA, 22 nt, Mycobacterium avium subsp. paratuberculosis
gcgucguugucgucgccggccg

SEQ ID NO: 798111 - RNA, 23 nt, Mycobacterium avium subsp. paratuberculosis
gcgucguugucgucgccggccgc

SEQ ID NO: 798112 - RNA, 15 nt, Mycobacterium avium subsp. paratuberculosis
gcgucguuggcgccg

SEQ ID NO: 798113 - RNA, 22 nt, Mycobacterium avium subsp. paratuberculosis
gcgucugccuugcugacgccgc

SEQ ID NO: 798114 - RNA, 16 nt, Mycobacterium avium subsp. paratuberculosis
gcgucguugucgucgc

SEQ ID NO: 798115 - RNA, 20 nt, Mycobacterium avium subsp. paratuberculosis
gcgucucagucggccaccgc

SEQ ID NO: 798116 - RNA, 18 nt, Mycobacterium avium subsp. paratuberculosis
gcgucugcgccccggcgu

SEQ ID NO: 798117 - RNA, 12 nt, Mycobacterium avium subsp. paratuberculosis
gcgucugcucgc

SEQ ID NO: 798118 - RNA, 20 nt, Mycobacterium avium subsp. paratuberculosis
gcgggcgaucgccucggccu

SEQ ID NO: 798119 - RNA, 20 nt, Mycobacterium avium subsp. paratuberculosis
gcgggcgagccgaagcgggu

SEQ ID NO: 798120 - RNA, 16 nt, Mycobacterium avium subsp. paratuberculosis
gcgggcgacccgcugg

SEQ ID NO: 798121 - RNA, 18 nt, Mycobacterium avium subsp. paratuberculosis
gcgggcgacgucgggguc

SEQ ID NO: 798122 - RNA, 13 nt, Mycobacterium avium subsp. paratuberculosis
gcgggcgacuucu

SEQ ID NO: 798123 - RNA, 19 nt, Mycobacterium avium subsp. paratuberculosis
gcgggcgacuucuucgccg

SEQ ID NO: 798124 - RNA, 18 nt, Mycobacterium avium subsp. paratuberculosis
gcgggcgaaaucucgaag

SEQ ID NO: 798125 - RNA, 14 nt, Mycobacterium avium subsp. paratuberculosis
gcgggcgaacgcgg

SEQ ID NO: 798126 - RNA, 22 nt, Mycobacterium avium subsp. paratuberculosis
gcgggcgaagcgaaagacguug

SEQ ID NO: 798127 - RNA, 23 nt, Mycobacterium avium subsp. paratuberculosis
gcgggccuucacgcuggccucca

SEQ ID NO: 798128 - RNA, 13 nt, Mycobacterium avium subsp. paratuberculosis
gcgggccugggca

SEQ ID NO: 798129 - RNA, 15 nt, Mycobacterium avium subsp. paratuberculosis
gcgggccugcucguc

SEQ ID NO: 798130 - RNA, 18 nt, Mycobacterium avium subsp. paratuberculosis
gcgggccuaggaccccgg

SEQ ID NO: 798131 - RNA, 18 nt, Mycobacterium avium subsp. paratuberculosis
gcgggccgguccccggcg

SEQ ID NO: 798132 - RNA, 15 nt, Mycobacterium avium subsp. paratuberculosis
gcgggccggcgucgu

SEQ ID NO: 798133 - RNA, 12 nt, Mycobacterium avium subsp. paratuberculosis
gcgggccguugc

SEQ ID NO: 798134 - RNA, 23 nt, Mycobacterium avium subsp. paratuberculosis
gcgggccgcuucgaggugcacgc

SEQ ID NO: 798135 - RNA, 16 nt, Mycobacterium avium subsp. paratuberculosis
gcgggccggcgccggu

SEQ ID NO: 798136 - RNA, 14 nt, Mycobacterium avium subsp. paratuberculosis
gcgggccgcgucgg

SEQ ID NO: 798137 - RNA, 16 nt, Mycobacterium avium subsp. paratuberculosis
gcgggccgcgucggcc

SEQ ID NO: 798138 - RNA, 19 nt, Mycobacterium avium subsp. paratuberculosis
gcgggccgcgucggccaac

SEQ ID NO: 798139 - RNA, 17 nt, Mycobacterium avium subsp. paratuberculosis
gcgggccgcagcgcgcg

SEQ ID NO: 798140 - RNA, 12 nt, Mycobacterium avium subsp. paratuberculosis
gcgggccgccag

SEQ ID NO: 798141 - RNA, 14 nt, Mycobacterium avium subsp. paratuberculosis
gcgggccgccaggu

SEQ ID NO: 798142 - RNA, 15 nt, Mycobacterium avium subsp. paratuberculosis
gcgggccgcccggcg

SEQ ID NO: 798143 - RNA, 17 nt, Mycobacterium avium subsp. paratuberculosis
gcgggccgccgacgucg

SEQ ID NO: 798144 - RNA, 20 nt, Mycobacterium avium subsp. paratuberculosis
gcgggccgccgacgucgugg

SEQ ID NO: 798145 - RNA, 14 nt, Mycobacterium avium subsp. paratuberculosis
gcgggccgacccgg

SEQ ID NO: 798146 - RNA, 15 nt, Mycobacterium avium subsp. paratuberculosis
gcgggccgacccggc

SEQ ID NO: 798147 - RNA, 23 nt, Mycobacterium avium subsp. paratuberculosis
gcgggccgacccggccgauggug

SEQ ID NO: 798148 - RNA, 14 nt, Mycobacterium avium subsp. paratuberculosis
gcgggccgaccguc

SEQ ID NO: 798149 - RNA, 16 nt, Mycobacterium avium subsp. paratuberculosis
gcgggccgaccuggcg

SEQ ID NO: 798150 - RNA, 22 nt, Mycobacterium avium subsp. paratuberculosis
gcgggccgaccuggcggccgga

SEQ ID NO: 798151 - RNA, 15 nt, Mycobacterium avium subsp. paratuberculosis
gcgggcccgcaacug

SEQ ID NO: 798152 - RNA, 22 nt, Mycobacterium avium subsp. paratuberculosis
gcgggccgagcguucggcgcgg

SEQ ID NO: 798153 - RNA, 16 nt, Mycobacterium avium subsp. paratuberculosis
gcgggccgacagcacg

SEQ ID NO: 798154 - RNA, 19 nt, Mycobacterium avium subsp. paratuberculosis
gcgggccgacagcacgccg

SEQ ID NO: 798155 - RNA, 22 nt, Mycobacterium avium subsp. paratuberculosis
gcgggccgacagcacgccgggc

SEQ ID NO: 798156 - RNA, 14 nt, Mycobacterium avium subsp. paratuberculosis
gcgggccgaaccgg

SEQ ID NO: 798157 - RNA, 13 nt, Mycobacterium avium subsp. paratuberculosis
gcgggccgaacug

SEQ ID NO: 798158 - RNA, 18 nt, Mycobacterium avium subsp. paratuberculosis
gcgggccgaacugccgau

SEQ ID NO: 798159 - RNA, 20 nt, Mycobacterium avium subsp. paratuberculosis
gcgggccgaagaccgggccg

SEQ ID NO: 798160 - RNA, 16 nt, Mycobacterium avium subsp. paratuberculosis
gcgggcccggcgaugc

SEQ ID NO: 798161 - RNA, 14 nt, Mycobacterium avium subsp. paratuberculosis
gcgggcccgggcca

SEQ ID NO: 798162 - RNA, 17 nt, Mycobacterium avium subsp. paratuberculosis
gcgggcccgggccaccc

SEQ ID NO: 798163 - RNA, 13 nt, Mycobacterium avium subsp. paratuberculosis
gcgggcccgggcg

SEQ ID NO: 798164 - RNA, 14 nt, Mycobacterium avium subsp. paratuberculosis
gcgggcccgggcgc

SEQ ID NO: 798165 - RNA, 17 nt, Mycobacterium avium subsp. paratuberculosis
gcgggcccgggcgcuga

SEQ ID NO: 798166 - RNA, 15 nt, Mycobacterium avium subsp. paratuberculosis
gcgggcccgggcugc

SEQ ID NO: 798167 - RNA, 15 nt, Mycobacterium avium subsp. paratuberculosis
gcgggcccgucgccg

SEQ ID NO: 798168 - RNA, 16 nt, Mycobacterium avium subsp. paratuberculosis
gcgggcccgucgccgg

SEQ ID NO: 798169 - RNA, 18 nt, Mycobacterium avium subsp. paratuberculosis
gcgggcccgucgccggcg

SEQ ID NO: 798170 - RNA, 20 nt, Mycobacterium avium subsp. paratuberculosis
gcgggcccgucgccggcgcg

SEQ ID NO: 798171 - RNA, 22 nt, Mycobacterium avium subsp. paratuberculosis
gcgggcccgucgccggcgcgca

SEQ ID NO: 798172 - RNA, 13 nt, Mycobacterium avium subsp. paratuberculosis
gcgggcccgccgu

SEQ ID NO: 798173 - RNA, 14 nt, Mycobacterium avium subsp. paratuberculosis
gcgggcccgcgccg

SEQ ID NO: 798174 - RNA, 21 nt, Mycobacterium avium subsp. paratuberculosis
gcgggcccgcgccgcgucguc

SEQ ID NO: 798175 - RNA, 13 nt, Mycobacterium avium subsp. paratuberculosis
gcgggcccgcgcg

SEQ ID NO: 798176 - RNA, 14 nt, Mycobacterium avium subsp. paratuberculosis
gcgggcccgcgcgg

SEQ ID NO: 798177 - RNA, 15 nt, Mycobacterium avium subsp. paratuberculosis
gcgggcccgcgcggc

SEQ ID NO: 798178 - RNA, 18 nt, Mycobacterium avium subsp. paratuberculosis
gcgggcgauggcgggccg

SEQ ID NO: 798179 - RNA, 13 nt, Mycobacterium avium subsp. paratuberculosis
gcgggcgcagcuc

SEQ ID NO: 798180 - RNA, 17 nt, Mycobacterium avium subsp. paratuberculosis
gcgggcgcaggugggcg

SEQ ID NO: 798181 - RNA, 23 nt, Mycobacterium avium subsp. paratuberculosis
gcgggcgcauaccagcgcuggua

SEQ ID NO: 798182 - RNA, 14 nt, Mycobacterium avium subsp. paratuberculosis
gcgggcgccgaacg

SEQ ID NO: 798183 - RNA, 18 nt, Mycobacterium avium subsp. paratuberculosis
gcgggcgccgaacgucga

SEQ ID NO: 798184 - RNA, 19 nt, Mycobacterium avium subsp. paratuberculosis
gcgggcgccgaacgucgag

SEQ ID NO: 798185 - RNA, 20 nt, Mycobacterium avium subsp. paratuberculosis
gcgggcgccgaacgucgagc

SEQ ID NO: 798186 - RNA, 20 nt, Mycobacterium avium subsp. paratuberculosis
gcgggcgccgaagauggcca

SEQ ID NO: 798187 - RNA, 18 nt, Mycobacterium avium subsp. paratuberculosis
gcgggcgauuucgucggc

SEQ ID NO: 798188 - RNA, 19 nt, Mycobacterium avium subsp. paratuberculosis
gcgggcgauuucgucggcg

SEQ ID NO: 798189 - RNA, 20 nt, Mycobacterium avium subsp. paratuberculosis
gcgggcgauuucgucggcgg

SEQ ID NO: 798190 - RNA, 20 nt, Mycobacterium avium subsp. paratuberculosis
gcgggccuugagcaccgcgu

SEQ ID NO: 798191 - RNA, 18 nt, Mycobacterium avium subsp. paratuberculosis
gcgggcgaugcggcccgg

SEQ ID NO: 798192 - RNA, 22 nt, Mycobacterium avium subsp. paratuberculosis
gcgggcgaugcggcccggccac

SEQ ID NO: 798193 - RNA, 21 nt, Mycobacterium avium subsp. paratuberculosis
gcgggcgaucuccagcggccg

SEQ ID NO: 798194 - RNA, 18 nt, Mycobacterium avium subsp. paratuberculosis
gcgggcgaucucgauggc

SEQ ID NO: 798195 - RNA, 15 nt, Mycobacterium avium subsp. paratuberculosis
gcgggcgcgucgagg

SEQ ID NO: 798196 - RNA, 14 nt, Mycobacterium avium subsp. paratuberculosis
gcgggcgcggccag

SEQ ID NO: 798197 - RNA, 17 nt, Mycobacterium avium subsp. paratuberculosis
gcgggcgcggccagcgc

SEQ ID NO: 798198 - RNA, 13 nt, Mycobacterium avium subsp. paratuberculosis
gcgggcgcgcgcc

SEQ ID NO: 798199 - RNA, 14 nt, Mycobacterium avium subsp. paratuberculosis
gcgggcgcgcgccg

SEQ ID NO: 798200 - RNA, 15 nt, Mycobacterium avium subsp. paratuberculosis
gcgggcgcgcgccgc

SEQ ID NO: 798201 - RNA, 14 nt, Mycobacterium avium subsp. paratuberculosis
gcgggcgcgccggc

SEQ ID NO: 798202 - RNA, 15 nt, Mycobacterium avium subsp. paratuberculosis
gcgggcgcgccggcg

SEQ ID NO: 798203 - RNA, 16 nt, Mycobacterium avium subsp. paratuberculosis
gcgggcgcgccggcgc

SEQ ID NO: 798204 - RNA, 17 nt, Mycobacterium avium subsp. paratuberculosis
gcgggcgcgccggcgcg

SEQ ID NO: 798205 - RNA, 19 nt, Mycobacterium avium subsp. paratuberculosis
gcgggcgcgccggcgcgca

SEQ ID NO: 798206 - RNA, 13 nt, Mycobacterium avium subsp. paratuberculosis
gcgggcgcccagc

SEQ ID NO: 798207 - RNA, 19 nt, Mycobacterium avium subsp. paratuberculosis
gcgggcgccuucuuggccg

SEQ ID NO: 798208 - RNA, 23 nt, Mycobacterium avium subsp. paratuberculosis
gcgggcgccuucuuggccgcgcc

SEQ ID NO: 798209 - RNA, 15 nt, Mycobacterium avium subsp. paratuberculosis
gcgggcgccggcugc

SEQ ID NO: 798210 - RNA, 19 nt, Mycobacterium avium subsp. paratuberculosis
gcgggcgccggcugcccgc

SEQ ID NO: 798211 - RNA, 20 nt, Mycobacterium avium subsp. paratuberculosis
gcgggcgccguaggccgcgc

SEQ ID NO: 798212 - RNA, 14 nt, Mycobacterium avium subsp. paratuberculosis
gcgggcugcaccag

SEQ ID NO: 798213 - RNA, 18 nt, Mycobacterium avium subsp. paratuberculosis
gcgggcugcaccagggcg

SEQ ID NO: 798214 - RNA, 22 nt, Mycobacterium avium subsp. paratuberculosis
gcgggcugcaccagggcgucga

SEQ ID NO: 798215 - RNA, 14 nt, Mycobacterium avium subsp. paratuberculosis
gcgggcugcagcga

SEQ ID NO: 798216 - RNA, 16 nt, Mycobacterium avium subsp. paratuberculosis
gcgggcugcagggccg

SEQ ID NO: 798217 - RNA, 19 nt, Mycobacterium avium subsp. paratuberculosis
gcgggcugcagggccgggu

SEQ ID NO: 798218 - RNA, 13 nt, Mycobacterium avium subsp. paratuberculosis
gcgggcguccacg

SEQ ID NO: 798219 - RNA, 12 nt, Mycobacterium avium subsp. paratuberculosis
gcgggcgggcgg

SEQ ID NO: 798220 - RNA, 13 nt, Mycobacterium avium subsp. paratuberculosis
gcgggcggggccu

SEQ ID NO: 798221 - RNA, 15 nt, Mycobacterium avium subsp. paratuberculosis
gcgggcggggccugc

SEQ ID NO: 798222 - RNA, 12 nt, Mycobacterium avium subsp. paratuberculosis
gcgggcggggcg

SEQ ID NO: 798223 - RNA, 16 nt, Mycobacterium avium subsp. paratuberculosis
gcgggcggggcgccga

SEQ ID NO: 798224 - RNA, 18 nt, Mycobacterium avium subsp. paratuberculosis
gcgggcgggggaucggcg

SEQ ID NO: 798225 - RNA, 22 nt, Mycobacterium avium subsp. paratuberculosis
gcgggcggcgucguagacgcug

SEQ ID NO: 798226 - RNA, 18 nt, Mycobacterium avium subsp. paratuberculosis
gcgggcggucgcgcagcc

SEQ ID NO: 798227 - RNA, 23 nt, Mycobacterium avium subsp. paratuberculosis
gcgggcggucgcgcagccgccgg

SEQ ID NO: 798228 - RNA, 15 nt, Mycobacterium avium subsp. paratuberculosis
gcgggcggcgcggcg

SEQ ID NO: 798229 - RNA, 15 nt, Mycobacterium avium subsp. paratuberculosis
gcgggcggcgcgguu

SEQ ID NO: 798230 - RNA, 20 nt, Mycobacterium avium subsp. paratuberculosis
gcgggcggcggcguuggccg

SEQ ID NO: 798231 - RNA, 15 nt, Mycobacterium avium subsp. paratuberculosis
gcgggcggcggcugg

SEQ ID NO: 798232 - RNA, 15 nt, Mycobacterium avium subsp. paratuberculosis
gcgggcggcgguggc

SEQ ID NO: 798233 - RNA, 16 nt, Mycobacterium avium subsp. paratuberculosis
gcgggcggcgguggcc

SEQ ID NO: 798234 - RNA, 17 nt, Mycobacterium avium subsp. paratuberculosis
gcgggcggcgguggccu

SEQ ID NO: 798235 - RNA, 13 nt, Mycobacterium avium subsp. paratuberculosis
gcgggcggcccgc

SEQ ID NO: 798236 - RNA, 14 nt, Mycobacterium avium subsp. paratuberculosis
gcgggcggcccgca

SEQ ID NO: 798237 - RNA, 15 nt, Mycobacterium avium subsp. paratuberculosis
gcgggcggcccgcac

SEQ ID NO: 798238 - RNA, 17 nt, Mycobacterium avium subsp. paratuberculosis
gcgggcggcccgcacgg

SEQ ID NO: 798239 - RNA, 18 nt, Mycobacterium avium subsp. paratuberculosis
gcgggcggcccgcacggc

SEQ ID NO: 798240 - RNA, 22 nt, Mycobacterium avium subsp. paratuberculosis
gcgggcggcaucgcgccgcaug

SEQ ID NO: 798241 - RNA, 13 nt, Mycobacterium avium subsp. paratuberculosis
gcgggcggcgcag

SEQ ID NO: 798242 - RNA, 22 nt, Mycobacterium avium subsp. paratuberculosis
gcgggcggcgcagucggccgga

SEQ ID NO: 798243 - RNA, 12 nt, Mycobacterium avium subsp. paratuberculosis
gcgggcggccag

SEQ ID NO: 798244 - RNA, 13 nt, Mycobacterium avium subsp. paratuberculosis
gcgggcggccagc

SEQ ID NO: 798245 - RNA, 15 nt, Mycobacterium avium subsp. paratuberculosis
gcgggcggccagccg

SEQ ID NO: 798246 - RNA, 16 nt, Mycobacterium avium subsp. paratuberculosis
gcgggcggccagccgc

SEQ ID NO: 798247 - RNA, 23 nt, Mycobacterium avium subsp. paratuberculosis
gcgggcggccagccgcucccggc

SEQ ID NO: 798248 - RNA, 21 nt, Mycobacterium avium subsp. paratuberculosis
gcgggcggccccgggcgcugg

SEQ ID NO: 798249 - RNA, 14 nt, Mycobacterium avium subsp. paratuberculosis
gcgggcggcaucgc

SEQ ID NO: 798250 - RNA, 17 nt, Mycobacterium avium subsp. paratuberculosis
gcgggacaacacgaucg

SEQ ID NO: 798251 - RNA, 17 nt, Mycobacterium avium subsp. paratuberculosis
gcgggaauggccgcgcc

SEQ ID NO: 798252 - RNA, 13 nt, Mycobacterium avium subsp. paratuberculosis
gcgggacacggcg

SEQ ID NO: 798253 - RNA, 14 nt, Mycobacterium avium subsp. paratuberculosis
gcgggacacggcgg

SEQ ID NO: 798254 - RNA, 19 nt, Mycobacterium avium subsp. paratuberculosis
gcgggacacggcggcgcgg

SEQ ID NO: 798255 - RNA, 20 nt, Mycobacterium avium subsp. paratuberculosis
gcgggacacggcggcgcggg

SEQ ID NO: 798256 - RNA, 15 nt, Mycobacterium avium subsp. paratuberculosis
gcgggacggcggcga

SEQ ID NO: 798257 - RNA, 22 nt, Mycobacterium avium subsp. paratuberculosis
gcgggacgccguugacaccggg

SEQ ID NO: 798258 - RNA, 18 nt, Mycobacterium avium subsp. paratuberculosis
gcgggaccagcgccucgg

SEQ ID NO: 798259 - RNA, 20 nt, Mycobacterium avium subsp. paratuberculosis
gcgggaccagcgccucggcc

SEQ ID NO: 798260 - RNA, 21 nt, Mycobacterium avium subsp. paratuberculosis
gcgggaccagcgccucggccu

SEQ ID NO: 798261 - RNA, 16 nt, Mycobacterium avium subsp. paratuberculosis
gcgggaccgaggugcc

SEQ ID NO: 798262 - RNA, 15 nt, Mycobacterium avium subsp. paratuberculosis
gcgggaccgggcccg

SEQ ID NO: 798263 - RNA, 17 nt, Mycobacterium avium subsp. paratuberculosis
gcgggaccgggcccggc

SEQ ID NO: 798264 - RNA, 18 nt, Mycobacterium avium subsp. paratuberculosis
gcgggacgaucugcguca

SEQ ID NO: 798265 - RNA, 19 nt, Mycobacterium avium subsp. paratuberculosis
gcgggagcgcuggucggcg

SEQ ID NO: 798266 - RNA, 22 nt, Mycobacterium avium subsp. paratuberculosis
gcgggagcgcuggucggcgaac

SEQ ID NO: 798267 - RNA, 14 nt, Mycobacterium avium subsp. paratuberculosis
gcgggagccggcca

SEQ ID NO: 798268 - RNA, 16 nt, Mycobacterium avium subsp. paratuberculosis
gcgggagccggccagg

SEQ ID NO: 798269 - RNA, 17 nt, Mycobacterium avium subsp. paratuberculosis
gcgggagccggccaggu

SEQ ID NO: 798270 - RNA, 15 nt, Mycobacterium avium subsp. paratuberculosis
gcgggacugggcgau

SEQ ID NO: 798271 - RNA, 16 nt, Mycobacterium avium subsp. paratuberculosis
gcgggacugggcgauu

SEQ ID NO: 798272 - RNA, 18 nt, Mycobacterium avium subsp. paratuberculosis
gcgggagaaaugggccag

SEQ ID NO: 798273 - RNA, 14 nt, Mycobacterium avium subsp. paratuberculosis
gcgggagagcgcgg

SEQ ID NO: 798274 - RNA, 20 nt, Mycobacterium avium subsp. paratuberculosis
gcgggacgcgcagaucgucg

SEQ ID NO: 798275 - RNA, 15 nt, Mycobacterium avium subsp. paratuberculosis
gcgggacugcagcgc

SEQ ID NO: 798276 - RNA, 22 nt, Mycobacterium avium subsp. paratuberculosis
gcgggacugcagcgcggugguc

SEQ ID NO: 798277 - RNA, 12 nt, Mycobacterium avium subsp. paratuberculosis
gcgggcccgccg

SEQ ID NO: 798278 - RNA, 14 nt, Mycobacterium avium subsp. paratuberculosis
gcgggccaccgcgg

SEQ ID NO: 798279 - RNA, 17 nt, Mycobacterium avium subsp. paratuberculosis
gcgggccaccgcggcgu

SEQ ID NO: 798280 - RNA, 21 nt, Mycobacterium avium subsp. paratuberculosis
gcgggcccaccgccaccaggc

SEQ ID NO: 798281 - RNA, 17 nt, Mycobacterium avium subsp. paratuberculosis
gcgggcccaccgcgcgc

SEQ ID NO: 798282 - RNA, 16 nt, Mycobacterium avium subsp. paratuberculosis
gcgggccacagcggcg

SEQ ID NO: 798283 - RNA, 17 nt, Mycobacterium avium subsp. paratuberculosis
gcgggcccagcucggug

SEQ ID NO: 798284 - RNA, 19 nt, Mycobacterium avium subsp. paratuberculosis
gcgggcccagcucggugcg

SEQ ID NO: 798285 - RNA, 23 nt, Mycobacterium avium subsp. paratuberculosis
gcgggcauacugcuugccgucga

SEQ ID NO: 798286 - RNA, 16 nt, Mycobacterium avium subsp. paratuberculosis
gcgggcaucgccguca

SEQ ID NO: 798287 - RNA, 19 nt, Mycobacterium avium subsp. paratuberculosis
gcgggcaucgccgucaugg

SEQ ID NO: 798288 - RNA, 16 nt, Mycobacterium avium subsp. paratuberculosis
gcgggcaucgcuggug

SEQ ID NO: 798289 - RNA, 20 nt, Mycobacterium avium subsp. paratuberculosis
gcgggcaucgcugguggccg

SEQ ID NO: 798290 - RNA, 24 nt, Mycobacterium avium subsp. paratuberculosis
gcgggcaucgcugguggccgacgu

SEQ ID NO: 798291 - RNA, 15 nt, Mycobacterium avium subsp. paratuberculosis
gcgggcaucggcugg

SEQ ID NO: 798292 - RNA, 21 nt, Mycobacterium avium subsp. paratuberculosis
gcgggcaucggcuggucggcg

SEQ ID NO: 798293 - RNA, 22 nt, Mycobacterium avium subsp. paratuberculosis
gcgggcagguacugcuugccgc

SEQ ID NO: 798294 - RNA, 16 nt, Mycobacterium avium subsp. paratuberculosis
gcgggcagcaccagcg

SEQ ID NO: 798295 - RNA, 13 nt, Mycobacterium avium subsp. paratuberculosis
gcgggcagcagcu

SEQ ID NO: 798296 - RNA, 14 nt, Mycobacterium avium subsp. paratuberculosis
gcgggcaggcccga

SEQ ID NO: 798297 - RNA, 21 nt, Mycobacterium avium subsp. paratuberculosis
gcgggcaggcccgagcccgac

SEQ ID NO: 798298 - RNA, 12 nt, Mycobacterium avium subsp. paratuberculosis
gcgggcagccca

SEQ ID NO: 798299 - RNA, 16 nt, Mycobacterium avium subsp. paratuberculosis
gcgggaguggccggcg

SEQ ID NO: 798300 - RNA, 16 nt, Mycobacterium avium subsp. paratuberculosis
gcgggaggacagcgcg

SEQ ID NO: 798301 - RNA, 13 nt, Mycobacterium avium subsp. paratuberculosis
gcgggaggcccag

SEQ ID NO: 798302 - RNA, 23 nt, Mycobacterium avium subsp. paratuberculosis
gcggcuucauaugacgccggccu

SEQ ID NO: 798303 - RNA, 18 nt, Mycobacterium avium subsp. paratuberculosis
gcggcuucagucccgcga

SEQ ID NO: 798304 - RNA, 19 nt, Mycobacterium avium subsp. paratuberculosis
gcggcuucagucccgcgaa

SEQ ID NO: 798305 - RNA, 19 nt, Mycobacterium avium subsp. paratuberculosis
gcggcucgauggacgccag

SEQ ID NO: 798306 - RNA, 18 nt, Mycobacterium avium subsp. paratuberculosis
gcggcuugaccggcucgc

SEQ ID NO: 798307 - RNA, 20 nt, Mycobacterium avium subsp. paratuberculosis
gcggcuugaccggcucgccg

SEQ ID NO: 798308 - RNA, 15 nt, Mycobacterium avium subsp. paratuberculosis
gcggcuugagccgga

SEQ ID NO: 798309 - RNA, 18 nt, Mycobacterium avium subsp. paratuberculosis
gcggcuugagccggaucg

SEQ ID NO: 798310 - RNA, 19 nt, Mycobacterium avium subsp. paratuberculosis
gcggcuugagcgccagcgc

SEQ ID NO: 798311 - RNA, 13 nt, Mycobacterium avium subsp. paratuberculosis
gcggcuugcccgu

SEQ ID NO: 798312 - RNA, 17 nt, Mycobacterium avium subsp. paratuberculosis
gcggcuuggucaccagc

SEQ ID NO: 798313 - RNA, 19 nt, Mycobacterium avium subsp. paratuberculosis
gcggcuuggucaccagcuc

SEQ ID NO: 798314 - RNA, 17 nt, Mycobacterium avium subsp. paratuberculosis
gcgggaagccgaggucg

SEQ ID NO: 798315 - RNA, 15 nt, Mycobacterium avium subsp. paratuberculosis
gcgggaagccgaguu

SEQ ID NO: 798316 - RNA, 23 nt, Mycobacterium avium subsp. paratuberculosis
gcgggaagccgaguuuggcgucg

SEQ ID NO: 798317 - RNA, 20 nt, Mycobacterium avium subsp. paratuberculosis
gcgggaagccgccgcccugc

SEQ ID NO: 798318 - RNA, 21 nt, Mycobacterium avium subsp. paratuberculosis
gcgggaagccgccgcccugcg

SEQ ID NO: 798319 - RNA, 14 nt, Mycobacterium avium subsp. paratuberculosis
gcggcuugccgccg

SEQ ID NO: 798320 - RNA, 14 nt, Mycobacterium avium subsp. paratuberculosis
gcggcuuggccgug

SEQ ID NO: 798321 - RNA, 15 nt, Mycobacterium avium subsp. paratuberculosis
gcggcuuggccacca

SEQ ID NO: 798322 - RNA, 20 nt, Mycobacterium avium subsp. paratuberculosis
gcggcuuggccaccaccacg

SEQ ID NO: 798323 - RNA, 12 nt, Mycobacterium avium subsp. paratuberculosis
gcggcucggccu

SEQ ID NO: 798324 - RNA, 15 nt, Mycobacterium avium subsp. paratuberculosis
gcggcucggcgcuga

SEQ ID NO: 798325 - RNA, 13 nt, Mycobacterium avium subsp. paratuberculosis
gcggcucggcggc

SEQ ID NO: 798326 - RNA, 18 nt, Mycobacterium avium subsp. paratuberculosis
gcggcucgggcgguggcg

SEQ ID NO: 798327 - RNA, 16 nt, Mycobacterium avium subsp. paratuberculosis
gcggcucggggguguc

SEQ ID NO: 798328 - RNA, 23 nt, Mycobacterium avium subsp. paratuberculosis
gcggcucgggggugucguagcgg

SEQ ID NO: 798329 - RNA, 14 nt, Mycobacterium avium subsp. paratuberculosis
gcggcucggucgcg

SEQ ID NO: 798330 - RNA, 13 nt, Mycobacterium avium subsp. paratuberculosis
gcggcucgguguc

SEQ ID NO: 798331 - RNA, 19 nt, Mycobacterium avium subsp. paratuberculosis
gcggcucguccagcccggu

SEQ ID NO: 798332 - RNA, 13 nt, Mycobacterium avium subsp. paratuberculosis
gcggcucgucggc

SEQ ID NO: 798333 - RNA, 14 nt, Mycobacterium avium subsp. paratuberculosis
gcggcucgucggcg

SEQ ID NO: 798334 - RNA, 14 nt, Mycobacterium avium subsp. paratuberculosis
gcggcucgccggcg

SEQ ID NO: 798335 - RNA, 16 nt, Mycobacterium avium subsp. paratuberculosis
gcggcucgccggcguc

SEQ ID NO: 798336 - RNA, 11 nt, Mycobacterium avium subsp. paratuberculosis
gcggcucgcga

SEQ ID NO: 798337 - RNA, 13 nt, Mycobacterium avium subsp. paratuberculosis
gcggcucgcgcgg

SEQ ID NO: 798338 - RNA, 14 nt, Mycobacterium avium subsp. paratuberculosis
gcggcucgcgcggu

SEQ ID NO: 798339 - RNA, 15 nt, Mycobacterium avium subsp. paratuberculosis
gcggcucgcgcggug

SEQ ID NO: 798340 - RNA, 19 nt, Mycobacterium avium subsp. paratuberculosis
gcggcucgcgggcgaugcg

SEQ ID NO: 798341 - RNA, 15 nt, Mycobacterium avium subsp. paratuberculosis
gcggcucgcgggugc

SEQ ID NO: 798342 - RNA, 19 nt, Mycobacterium avium subsp. paratuberculosis
gcggcucgcgggugcggcg

SEQ ID NO: 798343 - RNA, 12 nt, Mycobacterium avium subsp. paratuberculosis
gcggcuccggcc

SEQ ID NO: 798344 - RNA, 14 nt, Mycobacterium avium subsp. paratuberculosis
gcggcuccggccgc

SEQ ID NO: 798345 - RNA, 16 nt, Mycobacterium avium subsp. paratuberculosis
gcggcuccggccgcgc

SEQ ID NO: 798346 - RNA, 17 nt, Mycobacterium avium subsp. paratuberculosis
gcggcuccggccgcgcc

SEQ ID NO: 798347 - RNA, 18 nt, Mycobacterium avium subsp. paratuberculosis
gcggcuccggccgcgccg

SEQ ID NO: 798348 - RNA, 19 nt, Mycobacterium avium subsp. paratuberculosis
gcggcuccggccgcgccgg

SEQ ID NO: 798349 - RNA, 14 nt, Mycobacterium avium subsp. paratuberculosis
gcggcguugcgggu

SEQ ID NO: 798350 - RNA, 15 nt, Mycobacterium avium subsp. paratuberculosis
gcggcguugcgggug

SEQ ID NO: 798351 - RNA, 17 nt, Mycobacterium avium subsp. paratuberculosis
gcggcguuggccgccgc

SEQ ID NO: 798352 - RNA, 15 nt, Mycobacterium avium subsp. paratuberculosis
gcggcguugcccggg

SEQ ID NO: 798353 - RNA, 17 nt, Mycobacterium avium subsp. paratuberculosis
gcggcguugccgccggc

SEQ ID NO: 798354 - RNA, 18 nt, Mycobacterium avium subsp. paratuberculosis
gcggcguugccgccggcg

SEQ ID NO: 798355 - RNA, 21 nt, Mycobacterium avium subsp. paratuberculosis
gcggcguugccgccggcgcgg

SEQ ID NO: 798356 - RNA, 22 nt, Mycobacterium avium subsp. paratuberculosis
gcggcguugccgccggcgcggu

SEQ ID NO: 798357 - RNA, 24 nt, Mycobacterium avium subsp. paratuberculosis
gcggcguugccgccggcgcgguuc

SEQ ID NO: 798358 - RNA, 14 nt, Mycobacterium avium subsp. paratuberculosis
gcggcuaagccggc

SEQ ID NO: 798359 - RNA, 15 nt, Mycobacterium avium subsp. paratuberculosis
gcggcuaagccggcg

SEQ ID NO: 798360 - RNA, 16 nt, Mycobacterium avium subsp. paratuberculosis
gcggcuaagccggcgu

SEQ ID NO: 798361 - RNA, 18 nt, Mycobacterium avium subsp. paratuberculosis
gcggcuaagccggcgucg

SEQ ID NO: 798362 - RNA, 19 nt, Mycobacterium avium subsp. paratuberculosis
gcggcguuguggccaccga

SEQ ID NO: 798363 - RNA, 19 nt, Mycobacterium avium subsp. paratuberculosis
gcggcuccgaucuccuggu

SEQ ID NO: 798364 - RNA, 15 nt, Mycobacterium avium subsp. paratuberculosis
gcggcggcgcugguc

SEQ ID NO: 798365 - RNA, 14 nt, Mycobacterium avium subsp. paratuberculosis
gcggcggcgccgac

SEQ ID NO: 798366 - RNA, 14 nt, Mycobacterium avium subsp. paratuberculosis
gcggcggcgccgcg

SEQ ID NO: 798367 - RNA, 15 nt, Mycobacterium avium subsp. paratuberculosis
gcggcggcgccgcgg

SEQ ID NO: 798368 - RNA, 16 nt, Mycobacterium avium subsp. paratuberculosis
gcggcggcgccgcggu

SEQ ID NO: 798369 - RNA, 14 nt, Mycobacterium avium subsp. paratuberculosis
gcggcggcgccggg

SEQ ID NO: 798370 - RNA, 13 nt, Mycobacterium avium subsp. paratuberculosis
gcggcggcgcgcc

SEQ ID NO: 798371 - RNA, 14 nt, Mycobacterium avium subsp. paratuberculosis
gcggcggcgcgccg

SEQ ID NO: 798372 - RNA, 16 nt, Mycobacterium avium subsp. paratuberculosis
gcggcggcgcgccggc

SEQ ID NO: 798373 - RNA, 19 nt, Mycobacterium avium subsp. paratuberculosis
gcggcggccuucuuggccg

SEQ ID NO: 798374 - RNA, 12 nt, Mycobacterium avium subsp. paratuberculosis
gcggcggccugc

SEQ ID NO: 798375 - RNA, 15 nt, Mycobacterium avium subsp. paratuberculosis
gcggcggccugcgcg

SEQ ID NO: 798376 - RNA, 22 nt, Mycobacterium avium subsp. paratuberculosis
gcggcggccugcgcgucgucgc

SEQ ID NO: 798377 - RNA, 15 nt, Mycobacterium avium subsp. paratuberculosis
gcggcggccuggccg

SEQ ID NO: 798378 - RNA, 13 nt, Mycobacterium avium subsp. paratuberculosis
gcggcggccggcc

SEQ ID NO: 798379 - RNA, 15 nt, Mycobacterium avium subsp. paratuberculosis
gcggcggccggccag

SEQ ID NO: 798380 - RNA, 16 nt, Mycobacterium avium subsp. paratuberculosis
gcggcggccggccagc

SEQ ID NO: 798381 - RNA, 19 nt, Mycobacterium avium subsp. paratuberculosis
gcggcggccggccagcagc

SEQ ID NO: 798382 - RNA, 17 nt, Mycobacterium avium subsp. paratuberculosis
gcggcggccggccagcg

SEQ ID NO: 798383 - RNA, 13 nt, Mycobacterium avium subsp. paratuberculosis
gcggcggccggcg

SEQ ID NO: 798384 - RNA, 14 nt, Mycobacterium avium subsp. paratuberculosis
gcggcggccggcga

SEQ ID NO: 798385 - RNA, 15 nt, Mycobacterium avium subsp. paratuberculosis
gcggcggccggcgau

SEQ ID NO: 798386 - RNA, 16 nt, Mycobacterium avium subsp. paratuberculosis
gcggcggccggcgccg

SEQ ID NO: 798387 - RNA, 17 nt, Mycobacterium avium subsp. paratuberculosis
gcggcggccggcgccga

SEQ ID NO: 798388 - RNA, 13 nt, Mycobacterium avium subsp. paratuberculosis
gcggcggccgacg

SEQ ID NO: 798389 - RNA, 14 nt, Mycobacterium avium subsp. paratuberculosis
gcggcggccgacgc

SEQ ID NO: 798390 - RNA, 12 nt, Mycobacterium avium subsp. paratuberculosis
gcggcggccgca

SEQ ID NO: 798391 - RNA, 13 nt, Mycobacterium avium subsp. paratuberculosis
gcggcggccgcag

SEQ ID NO: 798392 - RNA, 14 nt, Mycobacterium avium subsp. paratuberculosis
gcggcggccaacgc

SEQ ID NO: 798393 - RNA, 14 nt, Mycobacterium avium subsp. paratuberculosis
gcggcggccaccgc

SEQ ID NO: 798394 - RNA, 15 nt, Mycobacterium avium subsp. paratuberculosis
gcggcggccaccgcg

SEQ ID NO: 798395 - RNA, 12 nt, Mycobacterium avium subsp. paratuberculosis
gcggcggccagc

SEQ ID NO: 798396 - RNA, 19 nt, Mycobacterium avium subsp. paratuberculosis
gcggcggccagcucggccc

SEQ ID NO: 798397 - RNA, 20 nt, Mycobacterium avium subsp. paratuberculosis
gcggcggccagcucggcccg

SEQ ID NO: 798398 - RNA, 13 nt, Mycobacterium avium subsp. paratuberculosis
gcggcggccaucu

SEQ ID NO: 798399 - RNA, 21 nt, Mycobacterium avium subsp. paratuberculosis
gcggcggccauucaucgcgca

SEQ ID NO: 798400 - RNA, 22 nt, Mycobacterium avium subsp. paratuberculosis
gcggcggccauucaucgcgcac

SEQ ID NO: 798401 - RNA, 24 nt, Mycobacterium avium subsp. paratuberculosis
gcggcggccauucaucgcgcacca

SEQ ID NO: 798402 - RNA, 10 nt, Mycobacterium avium subsp. paratuberculosis
gcggcggccc

SEQ ID NO: 798403 - RNA, 13 nt, Mycobacterium avium subsp. paratuberculosis
gcggcggcccgcc

SEQ ID NO: 798404 - RNA, 17 nt, Mycobacterium avium subsp. paratuberculosis
gcggcggcccgccgcgc

SEQ ID NO: 798405 - RNA, 15 nt, Mycobacterium avium subsp. paratuberculosis
gcggcggcccgcgcg

SEQ ID NO: 798406 - RNA, 20 nt, Mycobacterium avium subsp. paratuberculosis
gcggcggcccgcgcgggguc

SEQ ID NO: 798407 - RNA, 17 nt, Mycobacterium avium subsp. paratuberculosis
gcggcggcccggcguca

SEQ ID NO: 798408 - RNA, 13 nt, Mycobacterium avium subsp. paratuberculosis
gcggcggcccguc

SEQ ID NO: 798409 - RNA, 18 nt, Mycobacterium avium subsp. paratuberculosis
gcggcggcccguccgccc

SEQ ID NO: 798410 - RNA, 21 nt, Mycobacterium avium subsp. paratuberculosis
gcggcggcccguccgccccgc

SEQ ID NO: 798411 - RNA, 17 nt, Mycobacterium avium subsp. paratuberculosis
gcggcggcccuucucgg

SEQ ID NO: 798412 - RNA, 23 nt, Mycobacterium avium subsp. paratuberculosis
gcggcgggccuugagcaccgcgu

SEQ ID NO: 798413 - RNA, 24 nt, Mycobacterium avium subsp. paratuberculosis
gcggcgggcgaaguagccggcgau

SEQ ID NO: 798414 - RNA, 16 nt, Mycobacterium avium subsp. paratuberculosis
gcggcgggcgcgucga

SEQ ID NO: 798415 - RNA, 16 nt, Mycobacterium avium subsp. paratuberculosis
gcggcggcgugccgcc

SEQ ID NO: 798416 - RNA, 15 nt, Mycobacterium avium subsp. paratuberculosis
gcggcgggcucggag

SEQ ID NO: 798417 - RNA, 17 nt, Mycobacterium avium subsp. paratuberculosis
gcggcgggccagcucgu

SEQ ID NO: 798418 - RNA, 22 nt, Mycobacterium avium subsp. paratuberculosis
gcggcgggccagggcgaggacg

SEQ ID NO: 798419 - RNA, 21 nt, Mycobacterium avium subsp. paratuberculosis
gcggcgggccagucgccgcgc

SEQ ID NO: 798420 - RNA, 13 nt, Mycobacterium avium subsp. paratuberculosis
gcggcgggcccgc

SEQ ID NO: 798421 - RNA, 14 nt, Mycobacterium avium subsp. paratuberculosis
gcggcgggcccgca

SEQ ID NO: 798422 - RNA, 18 nt, Mycobacterium avium subsp. paratuberculosis
gcggcgggcccgcagcuc

SEQ ID NO: 798423 - RNA, 14 nt, Mycobacterium avium subsp. paratuberculosis
gcggcgggcccggc

SEQ ID NO: 798424 - RNA, 15 nt, Mycobacterium avium subsp. paratuberculosis
gcggcgggcccggcg

SEQ ID NO: 798425 - RNA, 17 nt, Mycobacterium avium subsp. paratuberculosis
gcggcgggcccggcgau

SEQ ID NO: 798426 - RNA, 18 nt, Mycobacterium avium subsp. paratuberculosis
gcggcgggcccggcgaug

SEQ ID NO: 798427 - RNA, 19 nt, Mycobacterium avium subsp. paratuberculosis
gcggcgggcccggcgaugc

SEQ ID NO: 798428 - RNA, 13 nt, Mycobacterium avium subsp. paratuberculosis
gcggcgggccgca

SEQ ID NO: 798429 - RNA, 17 nt, Mycobacterium avium subsp. paratuberculosis
gcggcgggagcuaggcg

SEQ ID NO: 798430 - RNA, 19 nt, Mycobacterium avium subsp. paratuberculosis
gcggcgggagcuaggcggc

SEQ ID NO: 798431 - RNA, 21 nt, Mycobacterium avium subsp. paratuberculosis
gcggcgggacggaaucacgca

SEQ ID NO: 798432 - RNA, 19 nt, Mycobacterium avium subsp. paratuberculosis
gcggcgggaaaccaccugc

SEQ ID NO: 798433 - RNA, 20 nt, Mycobacterium avium subsp. paratuberculosis
gcggcgggaaaccaccugcc

SEQ ID NO: 798434 - RNA, 14 nt, Mycobacterium avium subsp. paratuberculosis
gcggcggcucggcg

SEQ ID NO: 798435 - RNA, 21 nt, Mycobacterium avium subsp. paratuberculosis
gcggcggcucggcggcgucgu

SEQ ID NO: 798436 - RNA, 14 nt, Mycobacterium avium subsp. paratuberculosis
gcggcggcucgucc

SEQ ID NO: 798437 - RNA, 15 nt, Mycobacterium avium subsp. paratuberculosis
gcggcggcucguuga

SEQ ID NO: 798438 - RNA, 20 nt, Mycobacterium avium subsp. paratuberculosis
gcggcggcugaagcgcuggg

SEQ ID NO: 798439 - RNA, 17 nt, Mycobacterium avium subsp. paratuberculosis
gcggcggcugccucgac

SEQ ID NO: 798440 - RNA, 14 nt, Mycobacterium avium subsp. paratuberculosis
gcggcggcgucggc

SEQ ID NO: 798441 - RNA, 13 nt, Mycobacterium avium subsp. paratuberculosis
gcggcggcggccc

SEQ ID NO: 798442 - RNA, 14 nt, Mycobacterium avium subsp. paratuberculosis
gcggcggcggcccg

SEQ ID NO: 798443 - RNA, 15 nt, Mycobacterium avium subsp. paratuberculosis
gcggcggcggcccgu

SEQ ID NO: 798444 - RNA, 15 nt, Mycobacterium avium subsp. paratuberculosis
gcggcggcggccgcg

SEQ ID NO: 798445 - RNA, 13 nt, Mycobacterium avium subsp. paratuberculosis
gcggcggcggucg

SEQ ID NO: 798446 - RNA, 14 nt, Mycobacterium avium subsp. paratuberculosis
gcggcggcggugcu

SEQ ID NO: 798447 - RNA, 16 nt, Mycobacterium avium subsp. paratuberculosis
gcggcggcguccgcgg

SEQ ID NO: 798448 - RNA, 14 nt, Mycobacterium avium subsp. paratuberculosis
gcggcggcgucgac

SEQ ID NO: 798449 - RNA, 15 nt, Mycobacterium avium subsp. paratuberculosis
gcggcggcgucgacc

SEQ ID NO: 798450 - RNA, 18 nt, Mycobacterium avium subsp. paratuberculosis
gcggcguccgcggccgcg

SEQ ID NO: 798451 - RNA, 14 nt, Mycobacterium avium subsp. paratuberculosis
gcggcgucacccug

SEQ ID NO: 798452 - RNA, 17 nt, Mycobacterium avium subsp. paratuberculosis
gcggcguccaccagcac

SEQ ID NO: 798453 - RNA, 23 nt, Mycobacterium avium subsp. paratuberculosis
gcggcgucccagugcucgaccag

SEQ ID NO: 798454 - RNA, 16 nt, Mycobacterium avium subsp. paratuberculosis
gcggcguauucccggg

SEQ ID NO: 798455 - RNA, 17 nt, Mycobacterium avium subsp. paratuberculosis
gcggcguauucccgggg

SEQ ID NO: 798456 - RNA, 19 nt, Mycobacterium avium subsp. paratuberculosis
gcggcguagucgccggugu

SEQ ID NO: 798457 - RNA, 16 nt, Mycobacterium avium subsp. paratuberculosis
gcggcguagucggcgc

SEQ ID NO: 798458 - RNA, 22 nt, Mycobacterium avium subsp. paratuberculosis
gcggcguacgcgauggcggcgc

SEQ ID NO: 798459 - RNA, 16 nt, Mycobacterium avium subsp. paratuberculosis
gcggcguagccgccgg

SEQ ID NO: 798460 - RNA, 17 nt, Mycobacterium avium subsp. paratuberculosis
gcggcguagccgccggu

SEQ ID NO: 798461 - RNA, 13 nt, Mycobacterium avium subsp. paratuberculosis
gcggcguagcgcc

SEQ ID NO: 798462 - RNA, 14 nt, Mycobacterium avium subsp. paratuberculosis
gcggcguagcgcca

SEQ ID NO: 798463 - RNA, 15 nt, Mycobacterium avium subsp. paratuberculosis
gcggcguagcgccag

SEQ ID NO: 798464 - RNA, 14 nt, Mycobacterium avium subsp. paratuberculosis
gcggcguaccgcgg

SEQ ID NO: 798465 - RNA, 16 nt, Mycobacterium avium subsp. paratuberculosis
gcggcguaccgcggcg

SEQ ID NO: 798466 - RNA, 17 nt, Mycobacterium avium subsp. paratuberculosis
gcggcguaccgcggcgg

SEQ ID NO: 798467 - RNA, 20 nt, Mycobacterium avium subsp. paratuberculosis
gcggcguaccgcggcggcgu

SEQ ID NO: 798468 - RNA, 23 nt, Mycobacterium avium subsp. paratuberculosis
gcggcguaccgcggcggcgucga

SEQ ID NO: 798469 - RNA, 21 nt, Mycobacterium avium subsp. paratuberculosis
gcggcgguaccgaacgacgag

SEQ ID NO: 798470 - RNA, 16 nt, Mycobacterium avium subsp. paratuberculosis
gcggcgggucagcacc

SEQ ID NO: 798471 - RNA, 20 nt, Mycobacterium avium subsp. paratuberculosis
gcggcgggggcgggccccac

SEQ ID NO: 798472 - RNA, 16 nt, Mycobacterium avium subsp. paratuberculosis
gcggcgggggucggag

SEQ ID NO: 798473 - RNA, 15 nt, Mycobacterium avium subsp. paratuberculosis
gcggcgggguccacg

SEQ ID NO: 798474 - RNA, 17 nt, Mycobacterium avium subsp. paratuberculosis
gcggcgggguccacgca

SEQ ID NO: 798475 - RNA, 14 nt, Mycobacterium avium subsp. paratuberculosis
gcggcgugaccggg

SEQ ID NO: 798476 - RNA, 15 nt, Mycobacterium avium subsp. paratuberculosis
gcggcgugcugcgca

SEQ ID NO: 798477 - RNA, 18 nt, Mycobacterium avium subsp. paratuberculosis
gcggcgugguagccgccg

SEQ ID NO: 798478 - RNA, 22 nt, Mycobacterium avium subsp. paratuberculosis
gcggcgugcaacugcguggccg

SEQ ID NO: 798479 - RNA, 15 nt, Mycobacterium avium subsp. paratuberculosis
gcggcgugcaccgcc

SEQ ID NO: 798480 - RNA, 21 nt, Mycobacterium avium subsp. paratuberculosis
gcggcgugcaccgcccgcgcg

SEQ ID NO: 798481 - RNA, 12 nt, Mycobacterium avium subsp. paratuberculosis
gcggcgugcagu

SEQ ID NO: 798482 - RNA, 20 nt, Mycobacterium avium subsp. paratuberculosis
gcggcgugcagucccagauc

SEQ ID NO: 798483 - RNA, 17 nt, Mycobacterium avium subsp. paratuberculosis
gcggcgugccgcccgga

SEQ ID NO: 798484 - RNA, 14 nt, Mycobacterium avium subsp. paratuberculosis
gcggcgugcgccag

SEQ ID NO: 798485 - RNA, 18 nt, Mycobacterium avium subsp. paratuberculosis
gcggcguucagcagcgcg

SEQ ID NO: 798486 - RNA, 17 nt, Mycobacterium avium subsp. paratuberculosis
gcggcguucggugcccg

SEQ ID NO: 798487 - RNA, 19 nt, Mycobacterium avium subsp. paratuberculosis
gcggcguucggugcccggg

SEQ ID NO: 798488 - RNA, 19 nt, Mycobacterium avium subsp. paratuberculosis
gcggcguucuccagcaccc

SEQ ID NO: 798489 - RNA, 20 nt, Mycobacterium avium subsp. paratuberculosis
gcggcguucuccagcacccg

SEQ ID NO: 798490 - RNA, 15 nt, Mycobacterium avium subsp. paratuberculosis
gcggcgcaccccgaa

SEQ ID NO: 798491 - RNA, 15 nt, Mycobacterium avium subsp. paratuberculosis
gcggcgcacccgggc

SEQ ID NO: 798492 - RNA, 13 nt, Mycobacterium avium subsp. paratuberculosis
gcggcgaaaucgg

SEQ ID NO: 798493 - RNA, 18 nt, Mycobacterium avium subsp. paratuberculosis
gcggcgaugucgucgacg

SEQ ID NO: 798494 - RNA, 16 nt, Mycobacterium avium subsp. paratuberculosis
gcggcgaacaccagca

SEQ ID NO: 798495 - RNA, 19 nt, Mycobacterium avium subsp. paratuberculosis
gcggcgaacaccagcaccc

SEQ ID NO: 798496 - RNA, 15 nt, Mycobacterium avium subsp. paratuberculosis
gcggcgaacaccucg

SEQ ID NO: 798497 - RNA, 20 nt, Mycobacterium avium subsp. paratuberculosis
gcggcgaacaccucggcgau

SEQ ID NO: 798498 - RNA, 21 nt, Mycobacterium avium subsp. paratuberculosis
gcggcgaacaccucggcgaug

SEQ ID NO: 798499 - RNA, 23 nt, Mycobacterium avium subsp. paratuberculosis
gcggcgaacaccucggcgaugcc

SEQ ID NO: 798500 - RNA, 19 nt, Mycobacterium avium subsp. paratuberculosis
gcggccuuuuucugcgccc

SEQ ID NO: 798501 - RNA, 20 nt, Mycobacterium avium subsp. paratuberculosis
gcggcgaaaacgccugcgcc

SEQ ID NO: 798502 - RNA, 23 nt, Mycobacterium avium subsp. paratuberculosis
gcggcgaaaacgccugcgccgcc

SEQ ID NO: 798503 - RNA, 15 nt, Mycobacterium avium subsp. paratuberculosis
gcggccuuuuccggc

SEQ ID NO: 798504 - RNA, 17 nt, Mycobacterium avium subsp. paratuberculosis
gcggccuuuuccggcga

SEQ ID NO: 798505 - RNA, 19 nt, Mycobacterium avium subsp. paratuberculosis
gcggccuugcgcaccggag

SEQ ID NO: 798506 - RNA, 15 nt, Mycobacterium avium subsp. paratuberculosis
gcggccuugcgggcc

SEQ ID NO: 798507 - RNA, 16 nt, Mycobacterium avium subsp. paratuberculosis
gcggccuugcgggccg

SEQ ID NO: 798508 - RNA, 18 nt, Mycobacterium avium subsp. paratuberculosis
gcggccuugcgggccgga

SEQ ID NO: 798509 - RNA, 19 nt, Mycobacterium avium subsp. paratuberculosis
gcggccuugcgggccggag

SEQ ID NO: 798510 - RNA, 20 nt, Mycobacterium avium subsp. paratuberculosis
gcggccuugcgggccggagc

SEQ ID NO: 798511 - RNA, 20 nt, Mycobacterium avium subsp. paratuberculosis
gcggccuucuuggccggagc

SEQ ID NO: 798512 - RNA, 19 nt, Mycobacterium avium subsp. paratuberculosis
gcggcgcaccgagucggug

SEQ ID NO: 798513 - RNA, 13 nt, Mycobacterium avium subsp. paratuberculosis
gcggcgcaccgcc

SEQ ID NO: 798514 - RNA, 15 nt, Mycobacterium avium subsp. paratuberculosis
gcggcgcaccgcccg

SEQ ID NO: 798515 - RNA, 16 nt, Mycobacterium avium subsp. paratuberculosis
gcggcgcaccgcccgc

SEQ ID NO: 798516 - RNA, 18 nt, Mycobacterium avium subsp. paratuberculosis
gcggcgcaccgcccgcgg

SEQ ID NO: 798517 - RNA, 15 nt, Mycobacterium avium subsp. paratuberculosis
gcggcgcaccuggcg

SEQ ID NO: 798518 - RNA, 18 nt, Mycobacterium avium subsp. paratuberculosis
gcggcgcaccuggcgcag

SEQ ID NO: 798519 - RNA, 13 nt, Mycobacterium avium subsp. paratuberculosis
gcggcgcacgcag

SEQ ID NO: 798520 - RNA, 13 nt, Mycobacterium avium subsp. paratuberculosis
gcggcgcacggug

SEQ ID NO: 798521 - RNA, 15 nt, Mycobacterium avium subsp. paratuberculosis
gcggcgcacggugcc

SEQ ID NO: 798522 - RNA, 17 nt, Mycobacterium avium subsp. paratuberculosis
gcggcgcacggugcccg

SEQ ID NO: 798523 - RNA, 22 nt, Mycobacterium avium subsp. paratuberculosis
gcggcgcacggugcccgucggc

SEQ ID NO: 798524 - RNA, 20 nt, Mycobacterium avium subsp. paratuberculosis
gcggcgccagcggccgauca

SEQ ID NO: 798525 - RNA, 18 nt, Mycobacterium avium subsp. paratuberculosis
gcggcgcagccagcucgg

SEQ ID NO: 798526 - RNA, 20 nt, Mycobacterium avium subsp. paratuberculosis
gcggcgcagccagcucggcg

SEQ ID NO: 798527 - RNA, 19 nt, Mycobacterium avium subsp. paratuberculosis
gcggcgcagaugaccggcc

SEQ ID NO: 798528 - RNA, 22 nt, Mycobacterium avium subsp. paratuberculosis
gcggcgcagaugaccggccugc

SEQ ID NO: 798529 - RNA, 19 nt, Mycobacterium avium subsp. paratuberculosis
gcggcgcagcacggccacu

SEQ ID NO: 798530 - RNA, 14 nt, Mycobacterium avium subsp. paratuberculosis
gcggcgcccccgcg

SEQ ID NO: 798531 - RNA, 20 nt, Mycobacterium avium subsp. paratuberculosis
gcggcgcccccgcgacgucc

SEQ ID NO: 798532 - RNA, 13 nt, Mycobacterium avium subsp. paratuberculosis
gcggcgcccagga

SEQ ID NO: 798533 - RNA, 12 nt, Mycobacterium avium subsp. paratuberculosis
gcggcgcgccag

SEQ ID NO: 798534 - RNA, 14 nt, Mycobacterium avium subsp. paratuberculosis
gcggcgcgccggcc

SEQ ID NO: 798535 - RNA, 18 nt, Mycobacterium avium subsp. paratuberculosis
gcggcgcgccggccggag

SEQ ID NO: 798536 - RNA, 20 nt, Mycobacterium avium subsp. paratuberculosis
gcggcgcgccggccggagcg

SEQ ID NO: 798537 - RNA, 14 nt, Mycobacterium avium subsp. paratuberculosis
gcggcgcgccgggc

SEQ ID NO: 798538 - RNA, 22 nt, Mycobacterium avium subsp. paratuberculosis
gcggcgcgcucgucgucgguga

SEQ ID NO: 798539 - RNA, 14 nt, Mycobacterium avium subsp. paratuberculosis
gcggcgcggagccg

SEQ ID NO: 798540 - RNA, 15 nt, Mycobacterium avium subsp. paratuberculosis
gcggcgcggagccgg

SEQ ID NO: 798541 - RNA, 16 nt, Mycobacterium avium subsp. paratuberculosis
gcggcgcggaucucgc

SEQ ID NO: 798542 - RNA, 15 nt, Mycobacterium avium subsp. paratuberculosis
gcggcgcgcugcagg

SEQ ID NO: 798543 - RNA, 20 nt, Mycobacterium avium subsp. paratuberculosis
gcggcgcgcugcggcgucgu

SEQ ID NO: 798544 - RNA, 18 nt, Mycobacterium avium subsp. paratuberculosis
gcggcgccaugaacggcg

SEQ ID NO: 798545 - RNA, 12 nt, Mycobacterium avium subsp. paratuberculosis
gcggcgcgcgcc

SEQ ID NO: 798546 - RNA, 18 nt, Mycobacterium avium subsp. paratuberculosis
gcggcgcgcgccagcguc

SEQ ID NO: 798547 - RNA, 22 nt, Mycobacterium avium subsp. paratuberculosis
gcggcgcgcgccagcgucugcu

SEQ ID NO: 798548 - RNA, 14 nt, Mycobacterium avium subsp. paratuberculosis
gcggcgcgcgccgc

SEQ ID NO: 798549 - RNA, 23 nt, Mycobacterium avium subsp. paratuberculosis
gcggcgcgcgaaaaaacggcggc

SEQ ID NO: 798550 - RNA, 14 nt, Mycobacterium avium subsp. paratuberculosis
gcggcgcgcgaugg

SEQ ID NO: 798551 - RNA, 20 nt, Mycobacterium avium subsp. paratuberculosis
gcggcgcgcacgucaccgcg

SEQ ID NO: 798552 - RNA, 17 nt, Mycobacterium avium subsp. paratuberculosis
gcggcgcgcagccggcc

SEQ ID NO: 798553 - RNA, 17 nt, Mycobacterium avium subsp. paratuberculosis
gcggcgcgcaggcgcgc

SEQ ID NO: 798554 - RNA, 19 nt, Mycobacterium avium subsp. paratuberculosis
gcggcgcgcaggcgcgcgg

SEQ ID NO: 798555 - RNA, 12 nt, Mycobacterium avium subsp. paratuberculosis
gcggcgcgcauc

SEQ ID NO: 798556 - RNA, 14 nt, Mycobacterium avium subsp. paratuberculosis
gcggcgcgcauccc

SEQ ID NO: 798557 - RNA, 20 nt, Mycobacterium avium subsp. paratuberculosis
gcggcgcgcaucgccgucca

SEQ ID NO: 798558 - RNA, 14 nt, Mycobacterium avium subsp. paratuberculosis
gcggcgcgcaucgu

SEQ ID NO: 798559 - RNA, 21 nt, Mycobacterium avium subsp. paratuberculosis
gcggcgcgcaucgucgcggcg

SEQ ID NO: 798560 - RNA, 23 nt, Mycobacterium avium subsp. paratuberculosis
gcggcgcgcaucgucgcggcgcu

SEQ ID NO: 798561 - RNA, 16 nt, Mycobacterium avium subsp. paratuberculosis
gcggcgcccgcggccu

SEQ ID NO: 798562 - RNA, 17 nt, Mycobacterium avium subsp. paratuberculosis
gcggcgcccugcgaaua

SEQ ID NO: 798563 - RNA, 17 nt, Mycobacterium avium subsp. paratuberculosis
gcggcgcccuucccggu

SEQ ID NO: 798564 - RNA, 21 nt, Mycobacterium avium subsp. paratuberculosis
gcggcgccgaaaaacgcgacg

SEQ ID NO: 798565 - RNA, 22 nt, Mycobacterium avium subsp. paratuberculosis
gcggcgcgaugaucgccggcgc

SEQ ID NO: 798566 - RNA, 13 nt, Mycobacterium avium subsp. paratuberculosis
gcggcgcccggcg

SEQ ID NO: 798567 - RNA, 14 nt, Mycobacterium avium subsp. paratuberculosis
gcggcgcccggcgc

SEQ ID NO: 798568 - RNA, 19 nt, Mycobacterium avium subsp. paratuberculosis
gcggcgcccucgccggcgg

SEQ ID NO: 798569 - RNA, 22 nt, Mycobacterium avium subsp. paratuberculosis
gcggcgcccucgccggcggcgc

SEQ ID NO: 798570 - RNA, 12 nt, Mycobacterium avium subsp. paratuberculosis
gcggcggcaggu

SEQ ID NO: 798571 - RNA, 14 nt, Mycobacterium avium subsp. paratuberculosis
gcggcggcagucgc

SEQ ID NO: 798572 - RNA, 18 nt, Mycobacterium avium subsp. paratuberculosis
gcggcggcagcacccgca

SEQ ID NO: 798573 - RNA, 22 nt, Mycobacterium avium subsp. paratuberculosis
gcggcggcagcacccgcaucaa

SEQ ID NO: 798574 - RNA, 15 nt, Mycobacterium avium subsp. paratuberculosis
gcggcggcagcagcc

SEQ ID NO: 798575 - RNA, 21 nt, Mycobacterium avium subsp. paratuberculosis
gcggcgcuaaagccaccagcg

SEQ ID NO: 798576 - RNA, 14 nt, Mycobacterium avium subsp. paratuberculosis
gcggcgcgucgcug

SEQ ID NO: 798577 - RNA, 14 nt, Mycobacterium avium subsp. paratuberculosis
gcggcgcgugcgcc

SEQ ID NO: 798578 - RNA, 18 nt, Mycobacterium avium subsp. paratuberculosis
gcggcgcgugcgccgcgg

SEQ ID NO: 798579 - RNA, 16 nt, Mycobacterium avium subsp. paratuberculosis
gcggcgcgggcgcccu

SEQ ID NO: 798580 - RNA, 22 nt, Mycobacterium avium subsp. paratuberculosis
gcggcgcggccaccccggugac

SEQ ID NO: 798581 - RNA, 13 nt, Mycobacterium avium subsp. paratuberculosis
gcggcgcgggcgg

SEQ ID NO: 798582 - RNA, 15 nt, Mycobacterium avium subsp. paratuberculosis
gcggcgcgggcggcg

SEQ ID NO: 798583 - RNA, 21 nt, Mycobacterium avium subsp. paratuberculosis
gcggcgcgggcggcgucggcg

SEQ ID NO: 798584 - RNA, 23 nt, Mycobacterium avium subsp. paratuberculosis
gcggcgcgggcggcgucggcgac

SEQ ID NO: 798585 - RNA, 21 nt, Mycobacterium avium subsp. paratuberculosis
gcggcgcgggucgcuggccgc

SEQ ID NO: 798586 - RNA, 13 nt, Mycobacterium avium subsp. paratuberculosis
gcggcgcggucgc

SEQ ID NO: 798587 - RNA, 14 nt, Mycobacterium avium subsp. paratuberculosis
gcggcgcggucgca

SEQ ID NO: 798588 - RNA, 14 nt, Mycobacterium avium subsp. paratuberculosis
gcggcgcggugcgc

SEQ ID NO: 798589 - RNA, 19 nt, Mycobacterium avium subsp. paratuberculosis
gcggcgcgguugaccgccg

SEQ ID NO: 798590 - RNA, 21 nt, Mycobacterium avium subsp. paratuberculosis
gcggcgcgguugaccgccgac

SEQ ID NO: 798591 - RNA, 17 nt, Mycobacterium avium subsp. paratuberculosis
gcggcgcgguuucggcg

SEQ ID NO: 798592 - RNA, 23 nt, Mycobacterium avium subsp. paratuberculosis
gcggcgcguccauggucgagccg

SEQ ID NO: 798593 - RNA, 14 nt, Mycobacterium avium subsp. paratuberculosis
gcggcgcggcgguc

SEQ ID NO: 798594 - RNA, 19 nt, Mycobacterium avium subsp. paratuberculosis
gcggcgcggcccggcccgc

SEQ ID NO: 798595 - RNA, 22 nt, Mycobacterium avium subsp. paratuberculosis
gcggcgcggcccggcccgcugg

SEQ ID NO: 798596 - RNA, 13 nt, Mycobacterium avium subsp. paratuberculosis
gcggcgcggccca

SEQ ID NO: 798597 - RNA, 14 nt, Mycobacterium avium subsp. paratuberculosis
gcggcgcggcccag

SEQ ID NO: 798598 - RNA, 21 nt, Mycobacterium avium subsp. paratuberculosis
gcggccauauaggggugggcg

SEQ ID NO: 798599 - RNA, 16 nt, Mycobacterium avium subsp. paratuberculosis
gcggccaucgccgcca

SEQ ID NO: 798600 - RNA, 14 nt, Mycobacterium avium subsp. paratuberculosis
gcggccaucgccgc

SEQ ID NO: 798601 - RNA, 20 nt, Mycobacterium avium subsp. paratuberculosis
gcggccaguucgagcgccgc

SEQ ID NO: 798602 - RNA, 21 nt, Mycobacterium avium subsp. paratuberculosis
gcggccaguucgagcgccgcg

SEQ ID NO: 798603 - RNA, 15 nt, Mycobacterium avium subsp. paratuberculosis
gcggccagggcggcg

SEQ ID NO: 798604 - RNA, 17 nt, Mycobacterium avium subsp. paratuberculosis
gcggccagggcggcgcc

SEQ ID NO: 798605 - RNA, 20 nt, Mycobacterium avium subsp. paratuberculosis
gcggccagggcggcgccggc

SEQ ID NO: 798606 - RNA, 16 nt, Mycobacterium avium subsp. paratuberculosis
gcggccagugccgggc

SEQ ID NO: 798607 - RNA, 18 nt, Mycobacterium avium subsp. paratuberculosis
gcggccagugccgggcca

SEQ ID NO: 798608 - RNA, 21 nt, Mycobacterium avium subsp. paratuberculosis
gcggccagggugucccagcgc

SEQ ID NO: 798609 - RNA, 23 nt, Mycobacterium avium subsp. paratuberculosis
gcggccagggugucccagcgcca

SEQ ID NO: 798610 - RNA, 12 nt, Mycobacterium avium subsp. paratuberculosis
gcggcccaccgc

SEQ ID NO: 798611 - RNA, 13 nt, Mycobacterium avium subsp. paratuberculosis
gcggcccaccgcg

SEQ ID NO: 798612 - RNA, 14 nt, Mycobacterium avium subsp. paratuberculosis
gcggcccaccgcga

SEQ ID NO: 798613 - RNA, 22 nt, Mycobacterium avium subsp. paratuberculosis
gcggcccaccgcgacccggccg

SEQ ID NO: 798614 - RNA, 14 nt, Mycobacterium avium subsp. paratuberculosis
gcggcccaccgcgu

SEQ ID NO: 798615 - RNA, 16 nt, Mycobacterium avium subsp. paratuberculosis
gcggcccaccgcgucg

SEQ ID NO: 798616 - RNA, 20 nt, Mycobacterium avium subsp. paratuberculosis
gcggccauguccccgccggu

SEQ ID NO: 798617 - RNA, 22 nt, Mycobacterium avium subsp. paratuberculosis
gcggccauguccccgccggugg

SEQ ID NO: 798618 - RNA, 23 nt, Mycobacterium avium subsp. paratuberculosis
gcggccauguccccgccgguggc

SEQ ID NO: 798619 - RNA, 23 nt, Mycobacterium avium subsp. paratuberculosis
gcggccaugucggagcugcgcgc

SEQ ID NO: 798620 - RNA, 16 nt, Mycobacterium avium subsp. paratuberculosis
gcggccaucgccgcgg

SEQ ID NO: 798621 - RNA, 17 nt, Mycobacterium avium subsp. paratuberculosis
gcggccaucgccgcggu

SEQ ID NO: 798622 - RNA, 21 nt, Mycobacterium avium subsp. paratuberculosis
gcggcccccacgcagcggugc

SEQ ID NO: 798623 - RNA, 23 nt, Mycobacterium avium subsp. paratuberculosis
gcggcccagcgucaacucgucgg

SEQ ID NO: 798624 - RNA, 20 nt, Mycobacterium avium subsp. paratuberculosis
gcggccccacguugaucaug

SEQ ID NO: 798625 - RNA, 18 nt, Mycobacterium avium subsp. paratuberculosis
gcggccccccgcacaccg

SEQ ID NO: 798626 - RNA, 19 nt, Mycobacterium avium subsp. paratuberculosis
gcggcccccugaucggccg

SEQ ID NO: 798627 - RNA, 20 nt, Mycobacterium avium subsp. paratuberculosis
gcggcccccugaucggccgc

SEQ ID NO: 798628 - RNA, 19 nt, Mycobacterium avium subsp. paratuberculosis
gcggccccggcucgggcca

SEQ ID NO: 798629 - RNA, 16 nt, Mycobacterium avium subsp. paratuberculosis
gcggccccgguggaug

SEQ ID NO: 798630 - RNA, 17 nt, Mycobacterium avium subsp. paratuberculosis
gcggccccgguggaugg

SEQ ID NO: 798631 - RNA, 17 nt, Mycobacterium avium subsp. paratuberculosis
gcggccccugcggggug

SEQ ID NO: 798632 - RNA, 19 nt, Mycobacterium avium subsp. paratuberculosis
gcggccccugcgggguguc

SEQ ID NO: 798633 - RNA, 23 nt, Mycobacterium avium subsp. paratuberculosis
gcggccccugcggggugucgacc

SEQ ID NO: 798634 - RNA, 20 nt, Mycobacterium avium subsp. paratuberculosis
gcggcccgaaaacgcccggg

SEQ ID NO: 798635 - RNA, 22 nt, Mycobacterium avium subsp. paratuberculosis
gcggcccgaacacccagaugcc

SEQ ID NO: 798636 - RNA, 18 nt, Mycobacterium avium subsp. paratuberculosis
gcggcccgaccagcgggc

SEQ ID NO: 798637 - RNA, 23 nt, Mycobacterium avium subsp. paratuberculosis
gcggccccuucgaugucgccggc

SEQ ID NO: 798638 - RNA, 14 nt, Mycobacterium avium subsp. paratuberculosis
gcggcccagcucgg

SEQ ID NO: 798639 - RNA, 15 nt, Mycobacterium avium subsp. paratuberculosis
gcggcccagcccggc

SEQ ID NO: 798640 - RNA, 20 nt, Mycobacterium avium subsp. paratuberculosis
gcggcccagcccggccagca

SEQ ID NO: 798641 - RNA, 21 nt, Mycobacterium avium subsp. paratuberculosis
gcggcccagcccggccagcac

SEQ ID NO: 798642 - RNA, 19 nt, Mycobacterium avium subsp. paratuberculosis
gcggcccagggcgcucugg

SEQ ID NO: 798643 - RNA, 21 nt, Mycobacterium avium subsp. paratuberculosis
gcggcccagguauucguugcc

SEQ ID NO: 798644 - RNA, 22 nt, Mycobacterium avium subsp. paratuberculosis
gcggcccagguauucguugccc

SEQ ID NO: 798645 - RNA, 22 nt, Mycobacterium avium subsp. paratuberculosis
gcggcccagguucuccggcccg

SEQ ID NO: 798646 - RNA, 15 nt, Mycobacterium avium subsp. paratuberculosis
gcggcccagaucgcg

SEQ ID NO: 798647 - RNA, 12 nt, Mycobacterium avium subsp. paratuberculosis
gcggcccagcac

SEQ ID NO: 798648 - RNA, 16 nt, Mycobacterium avium subsp. paratuberculosis
gcggcccagcaccacc

SEQ ID NO: 798649 - RNA, 12 nt, Mycobacterium avium subsp. paratuberculosis
gcggcccacccg

SEQ ID NO: 798650 - RNA, 13 nt, Mycobacterium avium subsp. paratuberculosis
gcggcccacccgg

SEQ ID NO: 798651 - RNA, 13 nt, Mycobacterium avium subsp. paratuberculosis
gcggccagcgaga

SEQ ID NO: 798652 - RNA, 19 nt, Mycobacterium avium subsp. paratuberculosis
gcggccagcgagucgauga

SEQ ID NO: 798653 - RNA, 12 nt, Mycobacterium avium subsp. paratuberculosis
gcggccagcgca

SEQ ID NO: 798654 - RNA, 13 nt, Mycobacterium avium subsp. paratuberculosis
gcggccagcgcgc

SEQ ID NO: 798655 - RNA, 13 nt, Mycobacterium avium subsp. paratuberculosis
gcggccagcgcga

SEQ ID NO: 798656 - RNA, 17 nt, Mycobacterium avium subsp. paratuberculosis
gcggccagcgcgacgcg

SEQ ID NO: 798657 - RNA, 16 nt, Mycobacterium avium subsp. paratuberculosis
gcggccagcgccccgc

SEQ ID NO: 798658 - RNA, 19 nt, Mycobacterium avium subsp. paratuberculosis
gcggccagcgccccgccgg

SEQ ID NO: 798659 - RNA, 14 nt, Mycobacterium avium subsp. paratuberculosis
gcggccagcgcccg

SEQ ID NO: 798660 - RNA, 15 nt, Mycobacterium avium subsp. paratuberculosis
gcggccagcgcccgc

SEQ ID NO: 798661 - RNA, 18 nt, Mycobacterium avium subsp. paratuberculosis
gcggccagcggcagcguc

SEQ ID NO: 798662 - RNA, 13 nt, Mycobacterium avium subsp. paratuberculosis
gcggccagcggcg

SEQ ID NO: 798663 - RNA, 17 nt, Mycobacterium avium subsp. paratuberculosis
gcggccagcggcgccga

SEQ ID NO: 798664 - RNA, 15 nt, Mycobacterium avium subsp. paratuberculosis
gcggccagcgggccg

SEQ ID NO: 798665 - RNA, 13 nt, Mycobacterium avium subsp. paratuberculosis
gcggccagcguga

SEQ ID NO: 798666 - RNA, 20 nt, Mycobacterium avium subsp. paratuberculosis
gcggccagcguggcgcgccc

SEQ ID NO: 798667 - RNA, 22 nt, Mycobacterium avium subsp. paratuberculosis
gcggccagcguggcgcgccccg

SEQ ID NO: 798668 - RNA, 22 nt, Mycobacterium avium subsp. paratuberculosis
gcggccagcgcgcgggcguccu

SEQ ID NO: 798669 - RNA, 14 nt, Mycobacterium avium subsp. paratuberculosis
gcggccagcgcgcc

SEQ ID NO: 798670 - RNA, 15 nt, Mycobacterium avium subsp. paratuberculosis
gcggccagcgcgccg

SEQ ID NO: 798671 - RNA, 16 nt, Mycobacterium avium subsp. paratuberculosis
gcggccagcgcgccgc

SEQ ID NO: 798672 - RNA, 16 nt, Mycobacterium avium subsp. paratuberculosis
gcggccagcugcccgc

SEQ ID NO: 798673 - RNA, 19 nt, Mycobacterium avium subsp. paratuberculosis
gcggccagcugcccgccga

SEQ ID NO: 798674 - RNA, 22 nt, Mycobacterium avium subsp. paratuberculosis
gcggccagcugcccgccgacgc

SEQ ID NO: 798675 - RNA, 15 nt, Mycobacterium avium subsp. paratuberculosis
gcggccaggccggcg

SEQ ID NO: 798676 - RNA, 17 nt, Mycobacterium avium subsp. paratuberculosis
gcggccaggccggcgac

SEQ ID NO: 798677 - RNA, 18 nt, Mycobacterium avium subsp. paratuberculosis
gcggccagcucggcccgc

SEQ ID NO: 798678 - RNA, 19 nt, Mycobacterium avium subsp. paratuberculosis
gcggccagcucggucgcgg

SEQ ID NO: 798679 - RNA, 17 nt, Mycobacterium avium subsp. paratuberculosis
gcggccagcagcaccag

SEQ ID NO: 798680 - RNA, 13 nt, Mycobacterium avium subsp. paratuberculosis
gcggccagcacgg

SEQ ID NO: 798681 - RNA, 22 nt, Mycobacterium avium subsp. paratuberculosis
gcggccagcacggucagcggcc

SEQ ID NO: 798682 - RNA, 16 nt, Mycobacterium avium subsp. paratuberculosis
gcggccagccggucgu

SEQ ID NO: 798683 - RNA, 21 nt, Mycobacterium avium subsp. paratuberculosis
gcggccagcccgcggcagcca

SEQ ID NO: 798684 - RNA, 12 nt, Mycobacterium avium subsp. paratuberculosis
gcggccagccgc

SEQ ID NO: 798685 - RNA, 13 nt, Mycobacterium avium subsp. paratuberculosis
gcggccagccgcg

SEQ ID NO: 798686 - RNA, 15 nt, Mycobacterium avium subsp. paratuberculosis
gcggccagccgcgcg

SEQ ID NO: 798687 - RNA, 17 nt, Mycobacterium avium subsp. paratuberculosis
gcggccagccgcgcggc

SEQ ID NO: 798688 - RNA, 18 nt, Mycobacterium avium subsp. paratuberculosis
gcggccagccgcgcggcg

SEQ ID NO: 798689 - RNA, 14 nt, Mycobacterium avium subsp. paratuberculosis
gcggccacgcuagc

SEQ ID NO: 798690 - RNA, 21 nt, Mycobacterium avium subsp. paratuberculosis
gcggccacgcuagcgugacgc

SEQ ID NO: 798691 - RNA, 19 nt, Mycobacterium avium subsp. paratuberculosis
gcggccacgcucgggccgg

SEQ ID NO: 798692 - RNA, 20 nt, Mycobacterium avium subsp. paratuberculosis
gcggccacgcucgggccggc

SEQ ID NO: 798693 - RNA, 16 nt, Mycobacterium avium subsp. paratuberculosis
gcggccacgcccuggc

SEQ ID NO: 798694 - RNA, 21 nt, Mycobacterium avium subsp. paratuberculosis
gcggccacgcccuggccgccg

SEQ ID NO: 798695 - RNA, 22 nt, Mycobacterium avium subsp. paratuberculosis
gcggccacgcccuggccgccgg

SEQ ID NO: 798696 - RNA, 16 nt, Mycobacterium avium subsp. paratuberculosis
gcggccaccagcgcgg

SEQ ID NO: 798697 - RNA, 21 nt, Mycobacterium avium subsp. paratuberculosis
gcggccaccagcgcggccacc

SEQ ID NO: 798698 - RNA, 22 nt, Mycobacterium avium subsp. paratuberculosis
gcggccaccagcgcggccacca

SEQ ID NO: 798699 - RNA, 17 nt, Mycobacterium avium subsp. paratuberculosis
gcggccaccuccagccc

SEQ ID NO: 798700 - RNA, 13 nt, Mycobacterium avium subsp. paratuberculosis
gcggccaccucgc

SEQ ID NO: 798701 - RNA, 21 nt, Mycobacterium avium subsp. paratuberculosis
gcggccaccucgccgcaggcg

SEQ ID NO: 798702 - RNA, 22 nt, Mycobacterium avium subsp. paratuberculosis
gcggccaccucgccgcaggcgu

SEQ ID NO: 798703 - RNA, 14 nt, Mycobacterium avium subsp. paratuberculosis
gcggccaccucggc

SEQ ID NO: 798704 - RNA, 15 nt, Mycobacterium avium subsp. paratuberculosis
gcggccaccucggcg

SEQ ID NO: 798705 - RNA, 17 nt, Mycobacterium avium subsp. paratuberculosis
gcggccaccucggcggc

SEQ ID NO: 798706 - RNA, 21 nt, Mycobacterium avium subsp. paratuberculosis
gcggccaccucggcggcaccg

SEQ ID NO: 798707 - RNA, 12 nt, Mycobacterium avium subsp. paratuberculosis
gcggccaccugg

SEQ ID NO: 798708 - RNA, 21 nt, Mycobacterium avium subsp. paratuberculosis
gcggccacgaucgcgaucgcc

SEQ ID NO: 798709 - RNA, 17 nt, Mycobacterium avium subsp. paratuberculosis
gcggccacgaucgcggc

SEQ ID NO: 798710 - RNA, 20 nt, Mycobacterium avium subsp. paratuberculosis
gcggccacgaucgcggccag

SEQ ID NO: 798711 - RNA, 21 nt, Mycobacterium avium subsp. paratuberculosis
gcggccacgaucgcggccagc

SEQ ID NO: 798712 - RNA, 16 nt, Mycobacterium avium subsp. paratuberculosis
gcggccacgcaggcgu

SEQ ID NO: 798713 - RNA, 16 nt, Mycobacterium avium subsp. paratuberculosis
gcggccaaucccacca

SEQ ID NO: 798714 - RNA, 16 nt, Mycobacterium avium subsp. paratuberculosis
gcggccaacccgggcg

SEQ ID NO: 798715 - RNA, 17 nt, Mycobacterium avium subsp. paratuberculosis
gcggccacaccgaucag

SEQ ID NO: 798716 - RNA, 14 nt, Mycobacterium avium subsp. paratuberculosis
gcggccacaccggg

SEQ ID NO: 798717 - RNA, 17 nt, Mycobacterium avium subsp. paratuberculosis
gcggccacaccggggcc

SEQ ID NO: 798718 - RNA, 14 nt, Mycobacterium avium subsp. paratuberculosis
gcggccacacuggc

SEQ ID NO: 798719 - RNA, 15 nt, Mycobacterium avium subsp. paratuberculosis
gcggccacacuggcg

SEQ ID NO: 798720 - RNA, 15 nt, Mycobacterium avium subsp. paratuberculosis
gcggccaccaccacg

SEQ ID NO: 798721 - RNA, 16 nt, Mycobacterium avium subsp. paratuberculosis
gcggccaccaccacgg

SEQ ID NO: 798722 - RNA, 16 nt, Mycobacterium avium subsp. paratuberculosis
gcggccaccaccgcca

SEQ ID NO: 798723 - RNA, 13 nt, Mycobacterium avium subsp. paratuberculosis
gcggccaccacca

SEQ ID NO: 798724 - RNA, 12 nt, Mycobacterium avium subsp. paratuberculosis
gcggccaccacc

SEQ ID NO: 798725 - RNA, 21 nt, Mycobacterium avium subsp. paratuberculosis
gcggccaccaacggcagcagc

SEQ ID NO: 798726 - RNA, 22 nt, Mycobacterium avium subsp. paratuberculosis
gcggccaccaacggcagcagca

SEQ ID NO: 798727 - RNA, 12 nt, Mycobacterium avium subsp. paratuberculosis
gcggccaccagc

SEQ ID NO: 798728 - RNA, 20 nt, Mycobacterium avium subsp. paratuberculosis
gcggccaccagccggccggc

SEQ ID NO: 798729 - RNA, 21 nt, Mycobacterium avium subsp. paratuberculosis
gcggccaccagccggccggcc

SEQ ID NO: 798730 - RNA, 13 nt, Mycobacterium avium subsp. paratuberculosis
gcggccaccagcg

SEQ ID NO: 798731 - RNA, 12 nt, Mycobacterium avium subsp. paratuberculosis
gcggccaccgcg

SEQ ID NO: 798732 - RNA, 13 nt, Mycobacterium avium subsp. paratuberculosis
gcggccaccgcgc

SEQ ID NO: 798733 - RNA, 14 nt, Mycobacterium avium subsp. paratuberculosis
gcggccaccgcgcc

SEQ ID NO: 798734 - RNA, 17 nt, Mycobacterium avium subsp. paratuberculosis
gcggccaccgcgccccg

SEQ ID NO: 798735 - RNA, 19 nt, Mycobacterium avium subsp. paratuberculosis
gcggccaccgcgccccggc

SEQ ID NO: 798736 - RNA, 21 nt, Mycobacterium avium subsp. paratuberculosis
gcggccaccgcgccccggcgc

SEQ ID NO: 798737 - RNA, 21 nt, Mycobacterium avium subsp. paratuberculosis
gcggccaccgcgccgugggcg

SEQ ID NO: 798738 - RNA, 16 nt, Mycobacterium avium subsp. paratuberculosis
gcggccaccgcgcgcu

SEQ ID NO: 798739 - RNA, 17 nt, Mycobacterium avium subsp. paratuberculosis
gcggccaccgcgcgcug

SEQ ID NO: 798740 - RNA, 18 nt, Mycobacterium avium subsp. paratuberculosis
gcggccaccgcggccagc

SEQ ID NO: 798741 - RNA, 12 nt, Mycobacterium avium subsp. paratuberculosis
gcggccaccggg

SEQ ID NO: 798742 - RNA, 13 nt, Mycobacterium avium subsp. paratuberculosis
gcggccaccggga

SEQ ID NO: 798743 - RNA, 20 nt, Mycobacterium avium subsp. paratuberculosis
gcggccaccaucuccgcggc

SEQ ID NO: 798744 - RNA, 21 nt, Mycobacterium avium subsp. paratuberculosis
gcggccaccaucuccgcggcg

SEQ ID NO: 798745 - RNA, 14 nt, Mycobacterium avium subsp. paratuberculosis
gcggccaccaugcc

SEQ ID NO: 798746 - RNA, 20 nt, Mycobacterium avium subsp. paratuberculosis
gcggccaccaugccggcguc

SEQ ID NO: 798747 - RNA, 13 nt, Mycobacterium avium subsp. paratuberculosis
gcggccaccccgg

SEQ ID NO: 798748 - RNA, 14 nt, Mycobacterium avium subsp. paratuberculosis
gcggccaccccggu

SEQ ID NO: 798749 - RNA, 14 nt, Mycobacterium avium subsp. paratuberculosis
gcggccaccaccgc

SEQ ID NO: 798750 - RNA, 15 nt, Mycobacterium avium subsp. paratuberculosis
gcggccaccaccgca

SEQ ID NO: 798751 - RNA, 16 nt, Mycobacterium avium subsp. paratuberculosis
gcggccaccaccggug

SEQ ID NO: 798752 - RNA, 15 nt, Mycobacterium avium subsp. paratuberculosis
gcggccaccacgacg

SEQ ID NO: 798753 - RNA, 18 nt, Mycobacterium avium subsp. paratuberculosis
gcggccaccacgacgccg

SEQ ID NO: 798754 - RNA, 22 nt, Mycobacterium avium subsp. paratuberculosis
gcggccaccacgacgccgggcg

SEQ ID NO: 798755 - RNA, 16 nt, Mycobacterium avium subsp. paratuberculosis
gcggccaacaacgcca

SEQ ID NO: 798756 - RNA, 14 nt, Mycobacterium avium subsp. paratuberculosis
gcggccaacgccca

SEQ ID NO: 798757 - RNA, 23 nt, Mycobacterium avium subsp. paratuberculosis
gcggccaacgcccaccacaucgg

SEQ ID NO: 798758 - RNA, 13 nt, Mycobacterium avium subsp. paratuberculosis
gcggccaacgccu

SEQ ID NO: 798759 - RNA, 14 nt, Mycobacterium avium subsp. paratuberculosis
gcggccaacgccuc

SEQ ID NO: 798760 - RNA, 21 nt, Mycobacterium avium subsp. paratuberculosis
gcggccaacgccucgucgacc

SEQ ID NO: 798761 - RNA, 15 nt, Mycobacterium avium subsp. paratuberculosis
gcggccaacgcgacg

SEQ ID NO: 798762 - RNA, 22 nt, Mycobacterium avium subsp. paratuberculosis
gcggccaacgcgacgaagccgg

SEQ ID NO: 798763 - RNA, 17 nt, Mycobacterium avium subsp. paratuberculosis
gcggcauggcuggcggc

SEQ ID NO: 798764 - RNA, 19 nt, Mycobacterium avium subsp. paratuberculosis
gcggcauggcuggcggcaa

SEQ ID NO: 798765 - RNA, 13 nt, Mycobacterium avium subsp. paratuberculosis
gcggcauggcgau

SEQ ID NO: 798766 - RNA, 23 nt, Mycobacterium avium subsp. paratuberculosis
gcggcauggcgaugaccagcgcg

SEQ ID NO: 798767 - RNA, 15 nt, Mycobacterium avium subsp. paratuberculosis
gcggcaugccgcccg

SEQ ID NO: 798768 - RNA, 15 nt, Mycobacterium avium subsp. paratuberculosis
gcggcaugaccggcc

SEQ ID NO: 798769 - RNA, 18 nt, Mycobacterium avium subsp. paratuberculosis
gcggcaugaccggccagc

SEQ ID NO: 798770 - RNA, 19 nt, Mycobacterium avium subsp. paratuberculosis
gcggcaugaccggccagca

SEQ ID NO: 798771 - RNA, 21 nt, Mycobacterium avium subsp. paratuberculosis
gcggcaugaccggccagcaug

SEQ ID NO: 798772 - RNA, 15 nt, Mycobacterium avium subsp. paratuberculosis
gcggcaucggcgacg

SEQ ID NO: 798773 - RNA, 20 nt, Mycobacterium avium subsp. paratuberculosis
gcggcaguagcgcaccgguc

SEQ ID NO: 798774 - RNA, 16 nt, Mycobacterium avium subsp. paratuberculosis
gcggcagucgcagcag

SEQ ID NO: 798775 - RNA, 15 nt, Mycobacterium avium subsp. paratuberculosis
gcggcaucgaggacc

SEQ ID NO: 798776 - RNA, 15 nt, Mycobacterium avium subsp. paratuberculosis
gcggcaucgccgcca

SEQ ID NO: 798777 - RNA, 16 nt, Mycobacterium avium subsp. paratuberculosis
gcggcaucgccgccaa

SEQ ID NO: 798778 - RNA, 12 nt, Mycobacterium avium subsp. paratuberculosis
gcggcaucgcgc

SEQ ID NO: 798779 - RNA, 14 nt, Mycobacterium avium subsp. paratuberculosis
gcggcaucgcgccg

SEQ ID NO: 798780 - RNA, 13 nt, Mycobacterium avium subsp. paratuberculosis
gcggcaucgcgcg

SEQ ID NO: 798781 - RNA, 16 nt, Mycobacterium avium subsp. paratuberculosis
gcggcaucgcgcgcgg

SEQ ID NO: 798782 - RNA, 19 nt, Mycobacterium avium subsp. paratuberculosis
gcggcaucgcgcgcggcgg

SEQ ID NO: 798783 - RNA, 21 nt, Mycobacterium avium subsp. paratuberculosis
gcggcaucgcgcgcggcggcc

SEQ ID NO: 798784 - RNA, 22 nt, Mycobacterium avium subsp. paratuberculosis
gcggcaucgcgcgcggcggcca

SEQ ID NO: 798785 - RNA, 20 nt, Mycobacterium avium subsp. paratuberculosis
gcggcauaguccagcucgcg

SEQ ID NO: 798786 - RNA, 14 nt, Mycobacterium avium subsp. paratuberculosis
gcggcauccccagc

SEQ ID NO: 798787 - RNA, 22 nt, Mycobacterium avium subsp. paratuberculosis
gcggcauccccagcugggccgc

SEQ ID NO: 798788 - RNA, 15 nt, Mycobacterium avium subsp. paratuberculosis
gcggcaucccuggug

SEQ ID NO: 798789 - RNA, 21 nt, Mycobacterium avium subsp. paratuberculosis
gcggcaucccuggugaccgac

SEQ ID NO: 798790 - RNA, 14 nt, Mycobacterium avium subsp. paratuberculosis
gcgcuuugaucagc

SEQ ID NO: 798791 - RNA, 17 nt, Mycobacterium avium subsp. paratuberculosis
gcgcuuuggaccagggc

SEQ ID NO: 798792 - RNA, 20 nt, Mycobacterium avium subsp. paratuberculosis
gcggcagugcgccgucccgg

SEQ ID NO: 798793 - RNA, 14 nt, Mycobacterium avium subsp. paratuberculosis
gcggaacaccgccu

SEQ ID NO: 798794 - RNA, 15 nt, Mycobacterium avium subsp. paratuberculosis
gcggaaaugcccgcg

SEQ ID NO: 798795 - RNA, 17 nt, Mycobacterium avium subsp. paratuberculosis
gcggaaacgacgucgcc

SEQ ID NO: 798796 - RNA, 21 nt, Mycobacterium avium subsp. paratuberculosis
gcggaaacgacgucgccacca

SEQ ID NO: 798797 - RNA, 18 nt, Mycobacterium avium subsp. paratuberculosis
gcggcccgaucaccaggc

SEQ ID NO: 798798 - RNA, 17 nt, Mycobacterium avium subsp. paratuberculosis
gcggcccgaucaccgcc

SEQ ID NO: 798799 - RNA, 13 nt, Mycobacterium avium subsp. paratuberculosis
gcggcccgcacgg

SEQ ID NO: 798800 - RNA, 15 nt, Mycobacterium avium subsp. paratuberculosis
gcggcccgcacggcc

SEQ ID NO: 798801 - RNA, 16 nt, Mycobacterium avium subsp. paratuberculosis
gcggcccgcacggccg

SEQ ID NO: 798802 - RNA, 20 nt, Mycobacterium avium subsp. paratuberculosis
gcggcccgcaggaucgagcc

SEQ ID NO: 798803 - RNA, 13 nt, Mycobacterium avium subsp. paratuberculosis
gcggcccgcaucg

SEQ ID NO: 798804 - RNA, 13 nt, Mycobacterium avium subsp. paratuberculosis
gcggcccgccgcg

SEQ ID NO: 798805 - RNA, 14 nt, Mycobacterium avium subsp. paratuberculosis
gcggcccgccgcgc

SEQ ID NO: 798806 - RNA, 15 nt, Mycobacterium avium subsp. paratuberculosis
gcggcccgccgcgcc

SEQ ID NO: 798807 - RNA, 17 nt, Mycobacterium avium subsp. paratuberculosis
gcggcccgccgcgcccg

SEQ ID NO: 798808 - RNA, 15 nt, Mycobacterium avium subsp. paratuberculosis
gcggcccgccgcuca

SEQ ID NO: 798809 - RNA, 19 nt, Mycobacterium avium subsp. paratuberculosis
gcggcccgccgcucaccgc

SEQ ID NO: 798810 - RNA, 21 nt, Mycobacterium avium subsp. paratuberculosis
gcggcccgccgcucaccgccg

SEQ ID NO: 798811 - RNA, 15 nt, Mycobacterium avium subsp. paratuberculosis
gcggcccgccggaac

SEQ ID NO: 798812 - RNA, 15 nt, Mycobacterium avium subsp. paratuberculosis
gcggcccgcggggcg

SEQ ID NO: 798813 - RNA, 14 nt, Mycobacterium avium subsp. paratuberculosis
gcggcccgcgccgg

SEQ ID NO: 798814 - RNA, 16 nt, Mycobacterium avium subsp. paratuberculosis
gcggcccgcgccggcg

SEQ ID NO: 798815 - RNA, 12 nt, Mycobacterium avium subsp. paratuberculosis
gcggcccgcgcg

SEQ ID NO: 798816 - RNA, 15 nt, Mycobacterium avium subsp. paratuberculosis
gcggcccgcggcauc

SEQ ID NO: 798817 - RNA, 18 nt, Mycobacterium avium subsp. paratuberculosis
gcggcccgcggcaucguc

SEQ ID NO: 798818 - RNA, 13 nt, Mycobacterium avium subsp. paratuberculosis
gcggcccgccgaa

SEQ ID NO: 798819 - RNA, 21 nt, Mycobacterium avium subsp. paratuberculosis
gcggcccgccgaacgccuccg

SEQ ID NO: 798820 - RNA, 13 nt, Mycobacterium avium subsp. paratuberculosis
gcggcccgcgacg

SEQ ID NO: 798821 - RNA, 15 nt, Mycobacterium avium subsp. paratuberculosis
gcggcccgcgacguc

SEQ ID NO: 798822 - RNA, 16 nt, Mycobacterium avium subsp. paratuberculosis
gcggcccgcgacgucg

SEQ ID NO: 798823 - RNA, 21 nt, Mycobacterium avium subsp. paratuberculosis
gcggcccggguggacgcccgc

SEQ ID NO: 798824 - RNA, 13 nt, Mycobacterium avium subsp. paratuberculosis
gcggcccguccgc

SEQ ID NO: 798825 - RNA, 15 nt, Mycobacterium avium subsp. paratuberculosis
gcggcccguccgccc

SEQ ID NO: 798826 - RNA, 19 nt, Mycobacterium avium subsp. paratuberculosis
gcggcccguccgccccgcu

SEQ ID NO: 798827 - RNA, 11 nt, Mycobacterium avium subsp. paratuberculosis
gcggcccggcu

SEQ ID NO: 798828 - RNA, 21 nt, Mycobacterium avium subsp. paratuberculosis
gcggcccgguacaucgacgcg

SEQ ID NO: 798829 - RNA, 23 nt, Mycobacterium avium subsp. paratuberculosis
gcggcccgguacaucgacgcgac

SEQ ID NO: 798830 - RNA, 14 nt, Mycobacterium avium subsp. paratuberculosis
gcggcccggccacc

SEQ ID NO: 798831 - RNA, 20 nt, Mycobacterium avium subsp. paratuberculosis
gcggcccggccacucgccgc

SEQ ID NO: 798832 - RNA, 17 nt, Mycobacterium avium subsp. paratuberculosis
gcggcccggcccgcugg

SEQ ID NO: 798833 - RNA, 20 nt, Mycobacterium avium subsp. paratuberculosis
gcggcccggcccgcuggccg

SEQ ID NO: 798834 - RNA, 23 nt, Mycobacterium avium subsp. paratuberculosis
gcggcccggcccgcuggccgccg

SEQ ID NO: 798835 - RNA, 16 nt, Mycobacterium avium subsp. paratuberculosis
gcggcccgcaucgacg

SEQ ID NO: 798836 - RNA, 23 nt, Mycobacterium avium subsp. paratuberculosis
gcggcccgcuuccuucaucgguu

SEQ ID NO: 798837 - RNA, 18 nt, Mycobacterium avium subsp. paratuberculosis
gcggcccgcuugccgacg

SEQ ID NO: 798838 - RNA, 17 nt, Mycobacterium avium subsp. paratuberculosis
gcggccgaauccggccg

SEQ ID NO: 798839 - RNA, 19 nt, Mycobacterium avium subsp. paratuberculosis
gcggccgaauccggccgga

SEQ ID NO: 798840 - RNA, 20 nt, Mycobacterium avium subsp. paratuberculosis
gcggccgaaaucaacgcgcc

SEQ ID NO: 798841 - RNA, 21 nt, Mycobacterium avium subsp. paratuberculosis
gcggccgaaaucaacgcgccg

SEQ ID NO: 798842 - RNA, 22 nt, Mycobacterium avium subsp. paratuberculosis
gcggccgaaaucaacgcgccga

SEQ ID NO: 798843 - RNA, 23 nt, Mycobacterium avium subsp. paratuberculosis
gcggccgaaaucaacgcgccgaa

SEQ ID NO: 798844 - RNA, 17 nt, Mycobacterium avium subsp. paratuberculosis
gcggcccuucucggacg

SEQ ID NO: 798845 - RNA, 17 nt, Mycobacterium avium subsp. paratuberculosis
gcggccgacagggugcc

SEQ ID NO: 798846 - RNA, 22 nt, Mycobacterium avium subsp. paratuberculosis
gcggccgacccugcguccggcc

SEQ ID NO: 798847 - RNA, 20 nt, Mycobacterium avium subsp. paratuberculosis
gcggccgacgcgccgucggc

SEQ ID NO: 798848 - RNA, 21 nt, Mycobacterium avium subsp. paratuberculosis
gcggccgacgcgccgucggcc

SEQ ID NO: 798849 - RNA, 22 nt, Mycobacterium avium subsp. paratuberculosis
gcggccgacuuggucagcccgc

SEQ ID NO: 798850 - RNA, 16 nt, Mycobacterium avium subsp. paratuberculosis
gcggccgagccgaggc

SEQ ID NO: 798851 - RNA, 18 nt, Mycobacterium avium subsp. paratuberculosis
gcggccgagccgaggccg

SEQ ID NO: 798852 - RNA, 17 nt, Mycobacterium avium subsp. paratuberculosis
gcggccgagcgcaccgc

SEQ ID NO: 798853 - RNA, 20 nt, Mycobacterium avium subsp. paratuberculosis
gcggccgagcgcaccgcgga

SEQ ID NO: 798854 - RNA, 20 nt, Mycobacterium avium subsp. paratuberculosis
gcggcccuugcggccgauca

SEQ ID NO: 798855 - RNA, 21 nt, Mycobacterium avium subsp. paratuberculosis
gcggcccugguugagcaccgc

SEQ ID NO: 798856 - RNA, 22 nt, Mycobacterium avium subsp. paratuberculosis
gcggcccugguugagcaccgcg

SEQ ID NO: 798857 - RNA, 21 nt, Mycobacterium avium subsp. paratuberculosis
gcggcccuguuugcaggcgau

SEQ ID NO: 798858 - RNA, 15 nt, Mycobacterium avium subsp. paratuberculosis
gcggcccuggauguc

SEQ ID NO: 798859 - RNA, 13 nt, Mycobacterium avium subsp. paratuberculosis
gcggcccuggcgg

SEQ ID NO: 798860 - RNA, 16 nt, Mycobacterium avium subsp. paratuberculosis
gcggcccuggcgggcg

SEQ ID NO: 798861 - RNA, 20 nt, Mycobacterium avium subsp. paratuberculosis
gcggcccuggcgggcggccc

SEQ ID NO: 798862 - RNA, 21 nt, Mycobacterium avium subsp. paratuberculosis
gcggcccuggcgggcggcccg

SEQ ID NO: 798863 - RNA, 22 nt, Mycobacterium avium subsp. paratuberculosis
gcggcccuggcgggcggcccgc

SEQ ID NO: 798864 - RNA, 13 nt, Mycobacterium avium subsp. paratuberculosis
gcggcccgucgcc

SEQ ID NO: 798865 - RNA, 14 nt, Mycobacterium avium subsp. paratuberculosis
gcggcccgucgcca

SEQ ID NO: 798866 - RNA, 15 nt, Mycobacterium avium subsp. paratuberculosis
gcggcccgucgccac

SEQ ID NO: 798867 - RNA, 20 nt, Mycobacterium avium subsp. paratuberculosis
gcggcccgucgccaccacgg

SEQ ID NO: 798868 - RNA, 14 nt, Mycobacterium avium subsp. paratuberculosis
gcggcccgucgccg

SEQ ID NO: 798869 - RNA, 15 nt, Mycobacterium avium subsp. paratuberculosis
gcggcccgucgccga

SEQ ID NO: 798870 - RNA, 23 nt, Mycobacterium avium subsp. paratuberculosis
gcggcccgucgccgugcguccag

SEQ ID NO: 798871 - RNA, 18 nt, Mycobacterium avium subsp. paratuberculosis
gcggcccguugagcaccg

SEQ ID NO: 798872 - RNA, 19 nt, Mycobacterium avium subsp. paratuberculosis
gcggcccguugagcaccgc

SEQ ID NO: 798873 - RNA, 21 nt, Mycobacterium avium subsp. paratuberculosis
gcggcccguugagcaccgcga

SEQ ID NO: 798874 - RNA, 22 nt, Mycobacterium avium subsp. paratuberculosis
gcggcccguugagcaccgcgaa

SEQ ID NO: 798875 - RNA, 15 nt, Mycobacterium avium subsp. paratuberculosis
gcggcccugcagcgc

SEQ ID NO: 798876 - RNA, 19 nt, Mycobacterium avium subsp. paratuberculosis
gcggcccugcaggucgcgg

SEQ ID NO: 798877 - RNA, 21 nt, Mycobacterium avium subsp. paratuberculosis
gcggcccugcaggucgcggug

SEQ ID NO: 798878 - RNA, 14 nt, Mycobacterium avium subsp. paratuberculosis
gcggcccugcgcgg

SEQ ID NO: 798879 - RNA, 16 nt, Mycobacterium avium subsp. paratuberculosis
gcggcccugcgcggcc

SEQ ID NO: 798880 - RNA, 20 nt, Mycobacterium avium subsp. paratuberculosis
gcggcccugcgcggccugca

SEQ ID NO: 798881 - RNA, 16 nt, Mycobacterium avium subsp. paratuberculosis
gcggccggaacagcug

SEQ ID NO: 798882 - RNA, 22 nt, Mycobacterium avium subsp. paratuberculosis
gcggccggaagaccguugacga

SEQ ID NO: 798883 - RNA, 15 nt, Mycobacterium avium subsp. paratuberculosis
gcggccggagccgac

SEQ ID NO: 798884 - RNA, 22 nt, Mycobacterium avium subsp. paratuberculosis
gcggccggagccgaccucggcg

SEQ ID NO: 798885 - RNA, 16 nt, Mycobacterium avium subsp. paratuberculosis
gcggccgcguccucgc

SEQ ID NO: 798886 - RNA, 17 nt, Mycobacterium avium subsp. paratuberculosis
gcggccgcguccucgcc

SEQ ID NO: 798887 - RNA, 13 nt, Mycobacterium avium subsp. paratuberculosis
gcggccgcgucgc

SEQ ID NO: 798888 - RNA, 14 nt, Mycobacterium avium subsp. paratuberculosis
gcggccgcgucgcc

SEQ ID NO: 798889 - RNA, 15 nt, Mycobacterium avium subsp. paratuberculosis
gcggccgcgucgccg

SEQ ID NO: 798890 - RNA, 16 nt, Mycobacterium avium subsp. paratuberculosis
gcggccgcgucgccga

SEQ ID NO: 798891 - RNA, 17 nt, Mycobacterium avium subsp. paratuberculosis
gcggccgcgucggcggc

SEQ ID NO: 798892 - RNA, 18 nt, Mycobacterium avium subsp. paratuberculosis
gcggccgcguugucgacc

SEQ ID NO: 798893 - RNA, 23 nt, Mycobacterium avium subsp. paratuberculosis
gcggccgcggaauucgcgggugc

SEQ ID NO: 798894 - RNA, 18 nt, Mycobacterium avium subsp. paratuberculosis
gcggccgcgaucgccaac

SEQ ID NO: 798895 - RNA, 22 nt, Mycobacterium avium subsp. paratuberculosis
gcggccgcgauguagcggacgg

SEQ ID NO: 798896 - RNA, 10 nt, Mycobacterium avium subsp. paratuberculosis
gcggccgcgc

SEQ ID NO: 798897 - RNA, 12 nt, Mycobacterium avium subsp. paratuberculosis
gcggccgcgcag

SEQ ID NO: 798898 - RNA, 22 nt, Mycobacterium avium subsp. paratuberculosis
gcggccgcgcagcucgacgacc

SEQ ID NO: 798899 - RNA, 13 nt, Mycobacterium avium subsp. paratuberculosis
gcggccgcgccgg

SEQ ID NO: 798900 - RNA, 15 nt, Mycobacterium avium subsp. paratuberculosis
gcggccgcgccggcc

SEQ ID NO: 798901 - RNA, 18 nt, Mycobacterium avium subsp. paratuberculosis
gcggccgcgccggccgga

SEQ ID NO: 798902 - RNA, 14 nt, Mycobacterium avium subsp. paratuberculosis
gcggccgcgcgccc

SEQ ID NO: 798903 - RNA, 12 nt, Mycobacterium avium subsp. paratuberculosis
gcggccgcgacg

SEQ ID NO: 798904 - RNA, 14 nt, Mycobacterium avium subsp. paratuberculosis
gcggccgcgacgcg

SEQ ID NO: 798905 - RNA, 15 nt, Mycobacterium avium subsp. paratuberculosis
gcggccgcgacggac

SEQ ID NO: 798906 - RNA, 20 nt, Mycobacterium avium subsp. paratuberculosis
gcggccgcgacggaccagug

SEQ ID NO: 798907 - RNA, 21 nt, Mycobacterium avium subsp. paratuberculosis
gcggccgcgacugcacccgaa

SEQ ID NO: 798908 - RNA, 17 nt, Mycobacterium avium subsp. paratuberculosis
gcggccgcgagcccggc

SEQ ID NO: 798909 - RNA, 18 nt, Mycobacterium avium subsp. paratuberculosis
gcggccgcgagcccggcg

SEQ ID NO: 798910 - RNA, 21 nt, Mycobacterium avium subsp. paratuberculosis
gcggccgcgagcccggcgacg

SEQ ID NO: 798911 - RNA, 21 nt, Mycobacterium avium subsp. paratuberculosis
gcggccgccuucacgaccggc

SEQ ID NO: 798912 - RNA, 15 nt, Mycobacterium avium subsp. paratuberculosis
gcggccgcgaaggcg

SEQ ID NO: 798913 - RNA, 15 nt, Mycobacterium avium subsp. paratuberculosis
gcggccgccucccgc

SEQ ID NO: 798914 - RNA, 21 nt, Mycobacterium avium subsp. paratuberculosis
gcggccgccucccgcagcgcc

SEQ ID NO: 798915 - RNA, 18 nt, Mycobacterium avium subsp. paratuberculosis
gcggccgccgggccggcg

SEQ ID NO: 798916 - RNA, 22 nt, Mycobacterium avium subsp. paratuberculosis
gcggccgccgggccggcggcca

SEQ ID NO: 798917 - RNA, 16 nt, Mycobacterium avium subsp. paratuberculosis
gcggccgccggggccc

SEQ ID NO: 798918 - RNA, 14 nt, Mycobacterium avium subsp. paratuberculosis
gcggccgccgcgac

SEQ ID NO: 798919 - RNA, 19 nt, Mycobacterium avium subsp. paratuberculosis
gcggccgccgcgacggccg

SEQ ID NO: 798920 - RNA, 20 nt, Mycobacterium avium subsp. paratuberculosis
gcggccgccgcgacggccgc

SEQ ID NO: 798921 - RNA, 14 nt, Mycobacterium avium subsp. paratuberculosis
gcggccgccgcgau

SEQ ID NO: 798922 - RNA, 18 nt, Mycobacterium avium subsp. paratuberculosis
gcggccgccgcgaucagg

SEQ ID NO: 798923 - RNA, 20 nt, Mycobacterium avium subsp. paratuberculosis
gcggccgcccgggcggcccg

SEQ ID NO: 798924 - RNA, 15 nt, Mycobacterium avium subsp. paratuberculosis
gcggccgcccggucc

SEQ ID NO: 798925 - RNA, 17 nt, Mycobacterium avium subsp. paratuberculosis
gcggccgcccgguccgg

SEQ ID NO: 798926 - RNA, 21 nt, Mycobacterium avium subsp. paratuberculosis
gcggccgcccgguccgggucg

SEQ ID NO: 798927 - RNA, 12 nt, Mycobacterium avium subsp. paratuberculosis
gcggccgcccgu

SEQ ID NO: 798928 - RNA, 14 nt, Mycobacterium avium subsp. paratuberculosis
gcggccgcccgucg

SEQ ID NO: 798929 - RNA, 16 nt, Mycobacterium avium subsp. paratuberculosis
gcggccgcccgucggg

SEQ ID NO: 798930 - RNA, 14 nt, Mycobacterium avium subsp. paratuberculosis
gcggccgcccagcc

SEQ ID NO: 798931 - RNA, 19 nt, Mycobacterium avium subsp. paratuberculosis
gcggccgcccagucgccgc

SEQ ID NO: 798932 - RNA, 21 nt, Mycobacterium avium subsp. paratuberculosis
gcggccgcccagucgccgccg

SEQ ID NO: 798933 - RNA, 22 nt, Mycobacterium avium subsp. paratuberculosis
gcggccgcccagucgccgccgc

SEQ ID NO: 798934 - RNA, 13 nt, Mycobacterium avium subsp. paratuberculosis
gcggccgccaggu

SEQ ID NO: 798935 - RNA, 15 nt, Mycobacterium avium subsp. paratuberculosis
gcggccgccaucauc

SEQ ID NO: 798936 - RNA, 20 nt, Mycobacterium avium subsp. paratuberculosis
gcggccgccaucgaucgggc

SEQ ID NO: 798937 - RNA, 12 nt, Mycobacterium avium subsp. paratuberculosis
gcggccgccgau

SEQ ID NO: 798938 - RNA, 14 nt, Mycobacterium avium subsp. paratuberculosis
gcggccgccgauca

SEQ ID NO: 798939 - RNA, 13 nt, Mycobacterium avium subsp. paratuberculosis
gcggccgccgccc

SEQ ID NO: 798940 - RNA, 19 nt, Mycobacterium avium subsp. paratuberculosis
gcggccgccgcccgcgcgg

SEQ ID NO: 798941 - RNA, 16 nt, Mycobacterium avium subsp. paratuberculosis
gcggccgccgccgcgg

SEQ ID NO: 798942 - RNA, 17 nt, Mycobacterium avium subsp. paratuberculosis
gcggccgccgccgcggc

SEQ ID NO: 798943 - RNA, 19 nt, Mycobacterium avium subsp. paratuberculosis
gcggccgccgccgcggccg

SEQ ID NO: 798944 - RNA, 16 nt, Mycobacterium avium subsp. paratuberculosis
gcggccgccggcaccg

SEQ ID NO: 798945 - RNA, 14 nt, Mycobacterium avium subsp. paratuberculosis
gcggccgccggcca

SEQ ID NO: 798946 - RNA, 18 nt, Mycobacterium avium subsp. paratuberculosis
gcggccgccggccagcuc

SEQ ID NO: 798947 - RNA, 14 nt, Mycobacterium avium subsp. paratuberculosis
gcggccgccagcgc

SEQ ID NO: 798948 - RNA, 16 nt, Mycobacterium avium subsp. paratuberculosis
gcggccgcaugucgac

SEQ ID NO: 798949 - RNA, 18 nt, Mycobacterium avium subsp. paratuberculosis
gcggccgcaugucgaccu

SEQ ID NO: 798950 - RNA, 16 nt, Mycobacterium avium subsp. paratuberculosis
gcggccgccacgcugg

SEQ ID NO: 798951 - RNA, 23 nt, Mycobacterium avium subsp. paratuberculosis
gcggccgcagcgcaucgccggcg

SEQ ID NO: 798952 - RNA, 21 nt, Mycobacterium avium subsp. paratuberculosis
gcggccgcagcgcccggcagc

SEQ ID NO: 798953 - RNA, 18 nt, Mycobacterium avium subsp. paratuberculosis
gcggccgcaaucggcgcc

SEQ ID NO: 798954 - RNA, 21 nt, Mycobacterium avium subsp. paratuberculosis
gcggccgcaaucggcgccggc

SEQ ID NO: 798955 - RNA, 17 nt, Mycobacterium avium subsp. paratuberculosis
gcggccgauucggcgcc

SEQ ID NO: 798956 - RNA, 22 nt, Mycobacterium avium subsp. paratuberculosis
gcggccgauucggcgccgcgac

SEQ ID NO: 798957 - RNA, 16 nt, Mycobacterium avium subsp. paratuberculosis
gcggccgaucaccucg

SEQ ID NO: 798958 - RNA, 14 nt, Mycobacterium avium subsp. paratuberculosis
gcggccgaucccga

SEQ ID NO: 798959 - RNA, 16 nt, Mycobacterium avium subsp. paratuberculosis
gcggccugcacagggg

SEQ ID NO: 798960 - RNA, 13 nt, Mycobacterium avium subsp. paratuberculosis
gcggccugcaccc

SEQ ID NO: 798961 - RNA, 15 nt, Mycobacterium avium subsp. paratuberculosis
gcggccugcacccag

SEQ ID NO: 798962 - RNA, 12 nt, Mycobacterium avium subsp. paratuberculosis
gcggccugccgg

SEQ ID NO: 798963 - RNA, 13 nt, Mycobacterium avium subsp. paratuberculosis
gcggccugccggc

SEQ ID NO: 798964 - RNA, 14 nt, Mycobacterium avium subsp. paratuberculosis
gcggccugccggcc

SEQ ID NO: 798965 - RNA, 16 nt, Mycobacterium avium subsp. paratuberculosis
gcggccugcgccagga

SEQ ID NO: 798966 - RNA, 23 nt, Mycobacterium avium subsp. paratuberculosis
gcggccucguugaccgggucgcc

SEQ ID NO: 798967 - RNA, 17 nt, Mycobacterium avium subsp. paratuberculosis
gcggccugagccgccgg

SEQ ID NO: 798968 - RNA, 19 nt, Mycobacterium avium subsp. paratuberculosis
gcggccugagccgccgggg

SEQ ID NO: 798969 - RNA, 13 nt, Mycobacterium avium subsp. paratuberculosis
gcggccugcucgc

SEQ ID NO: 798970 - RNA, 19 nt, Mycobacterium avium subsp. paratuberculosis
gcggccugcggcggcaacg

SEQ ID NO: 798971 - RNA, 21 nt, Mycobacterium avium subsp. paratuberculosis
gcggccugcgggcgccggcug

SEQ ID NO: 798972 - RNA, 14 nt, Mycobacterium avium subsp. paratuberculosis
gcggccugcgcguc

SEQ ID NO: 798973 - RNA, 21 nt, Mycobacterium avium subsp. paratuberculosis
gcggccugcagcaccgaaccg

SEQ ID NO: 798974 - RNA, 20 nt, Mycobacterium avium subsp. paratuberculosis
gcggccugggugaccgaguc

SEQ ID NO: 798975 - RNA, 18 nt, Mycobacterium avium subsp. paratuberculosis
gcggccugcuucucgccg

SEQ ID NO: 798976 - RNA, 23 nt, Mycobacterium avium subsp. paratuberculosis
gcggccugcuugaccgccagacu

SEQ ID NO: 798977 - RNA, 19 nt, Mycobacterium avium subsp. paratuberculosis
gcggccucggcguccgcgg

SEQ ID NO: 798978 - RNA, 17 nt, Mycobacterium avium subsp. paratuberculosis
gcggccucggcaccgug

SEQ ID NO: 798979 - RNA, 14 nt, Mycobacterium avium subsp. paratuberculosis
gcggccucggugcu

SEQ ID NO: 798980 - RNA, 16 nt, Mycobacterium avium subsp. paratuberculosis
gcggccucggugcuca

SEQ ID NO: 798981 - RNA, 15 nt, Mycobacterium avium subsp. paratuberculosis
gcggccucggugguc

SEQ ID NO: 798982 - RNA, 12 nt, Mycobacterium avium subsp. paratuberculosis
gcggccucgacg

SEQ ID NO: 798983 - RNA, 12 nt, Mycobacterium avium subsp. paratuberculosis
gcggccucgccg

SEQ ID NO: 798984 - RNA, 17 nt, Mycobacterium avium subsp. paratuberculosis
gcggccucgccgucgaa

SEQ ID NO: 798985 - RNA, 20 nt, Mycobacterium avium subsp. paratuberculosis
gcggccucgccgucgaaggc

SEQ ID NO: 798986 - RNA, 22 nt, Mycobacterium avium subsp. paratuberculosis
gcggccucgccgucgaaggccg

SEQ ID NO: 798987 - RNA, 16 nt, Mycobacterium avium subsp. paratuberculosis
gcggccucgacgauug

SEQ ID NO: 798988 - RNA, 16 nt, Mycobacterium avium subsp. paratuberculosis
gcggccuccgagcggc

SEQ ID NO: 798989 - RNA, 22 nt, Mycobacterium avium subsp. paratuberculosis
gcggccuccgagcggcgcaggc

SEQ ID NO: 798990 - RNA, 23 nt, Mycobacterium avium subsp. paratuberculosis
gcggccuccgagcggcgcaggcc

SEQ ID NO: 798991 - RNA, 22 nt, Mycobacterium avium subsp. paratuberculosis
gcggccuccggauggcggucgc

SEQ ID NO: 798992 - RNA, 15 nt, Mycobacterium avium subsp. paratuberculosis
gcggccuccagccgc

SEQ ID NO: 798993 - RNA, 16 nt, Mycobacterium avium subsp. paratuberculosis
gcggccuccagccgcg

SEQ ID NO: 798994 - RNA, 19 nt, Mycobacterium avium subsp. paratuberculosis
gcggccuccagccgcgcgg

SEQ ID NO: 798995 - RNA, 22 nt, Mycobacterium avium subsp. paratuberculosis
gcggccuccagccgcgcggccg

SEQ ID NO: 798996 - RNA, 13 nt, Mycobacterium avium subsp. paratuberculosis
gcggccucaccgc

SEQ ID NO: 798997 - RNA, 19 nt, Mycobacterium avium subsp. paratuberculosis
gcggccuaggacgccgccc

SEQ ID NO: 798998 - RNA, 17 nt, Mycobacterium avium subsp. paratuberculosis
gcggccuaggacgccgc

SEQ ID NO: 798999 - RNA, 18 nt, Mycobacterium avium subsp. paratuberculosis
gcggccgucuugcccggc

SEQ ID NO: 799000 - RNA, 22 nt, Mycobacterium avium subsp. paratuberculosis
gcggccguggcgaacucgacgg

SEQ ID NO: 799001 - RNA, 14 nt, Mycobacterium avium subsp. paratuberculosis
gcggccgucgucgu

SEQ ID NO: 799002 - RNA, 22 nt, Mycobacterium avium subsp. paratuberculosis
gcggccgucgucgugcaccacg

SEQ ID NO: 799003 - RNA, 23 nt, Mycobacterium avium subsp. paratuberculosis
gcggccgucgucgugcaccacga

SEQ ID NO: 799004 - RNA, 16 nt, Mycobacterium avium subsp. paratuberculosis
gcggccgucgccgggc

SEQ ID NO: 799005 - RNA, 13 nt, Mycobacterium avium subsp. paratuberculosis
gcggccgucgcgc

SEQ ID NO: 799006 - RNA, 14 nt, Mycobacterium avium subsp. paratuberculosis
gcggccgucggauc

SEQ ID NO: 799007 - RNA, 15 nt, Mycobacterium avium subsp. paratuberculosis
gcggccgucggaucg

SEQ ID NO: 799008 - RNA, 10 nt, Mycobacterium avium subsp. paratuberculosis
gcggccgggg

SEQ ID NO: 799009 - RNA, 14 nt, Mycobacterium avium subsp. paratuberculosis
gcggccguccagcg

SEQ ID NO: 799010 - RNA, 12 nt, Mycobacterium avium subsp. paratuberculosis
gcggccggugcc

SEQ ID NO: 799011 - RNA, 24 nt, Mycobacterium avium subsp. paratuberculosis
gcggccgguugccuuuccgcgcgg

SEQ ID NO: 799012 - RNA, 20 nt, Mycobacterium avium subsp. paratuberculosis
gcggccggguguagcugggc

SEQ ID NO: 799013 - RNA, 21 nt, Mycobacterium avium subsp. paratuberculosis
gcggccggguguagcugggcc

SEQ ID NO: 799014 - RNA, 13 nt, Mycobacterium avium subsp. paratuberculosis
gcggccgggucga

SEQ ID NO: 799015 - RNA, 22 nt, Mycobacterium avium subsp. paratuberculosis
gcggccgggucgagcgcgccga

SEQ ID NO: 799016 - RNA, 23 nt, Mycobacterium avium subsp. paratuberculosis
gcggccgggucgagcgcgccgag

SEQ ID NO: 799017 - RNA, 16 nt, Mycobacterium avium subsp. paratuberculosis
gcggccgggccgcggc

SEQ ID NO: 799018 - RNA, 13 nt, Mycobacterium avium subsp. paratuberculosis
gcggccgggccgg

SEQ ID NO: 799019 - RNA, 14 nt, Mycobacterium avium subsp. paratuberculosis
gcggccgggccgga

SEQ ID NO: 799020 - RNA, 13 nt, Mycobacterium avium subsp. paratuberculosis
gcggccgggcgcc

SEQ ID NO: 799021 - RNA, 19 nt, Mycobacterium avium subsp. paratuberculosis
gcggccggcuucggccaag

SEQ ID NO: 799022 - RNA, 15 nt, Mycobacterium avium subsp. paratuberculosis
gcggccgggcggccg

SEQ ID NO: 799023 - RNA, 18 nt, Mycobacterium avium subsp. paratuberculosis
gcggccgggaucuggccg

SEQ ID NO: 799024 - RNA, 19 nt, Mycobacterium avium subsp. paratuberculosis
gcggccgggaucuggccgg

SEQ ID NO: 799025 - RNA, 16 nt, Mycobacterium avium subsp. paratuberculosis
gcggccgggaugccgc

SEQ ID NO: 799026 - RNA, 19 nt, Mycobacterium avium subsp. paratuberculosis
gcggccgggaugccgccgg

SEQ ID NO: 799027 - RNA, 21 nt, Mycobacterium avium subsp. paratuberculosis
gcggccgggaugccgccgguc

SEQ ID NO: 799028 - RNA, 14 nt, Mycobacterium avium subsp. paratuberculosis
gcggccggcggcgu

SEQ ID NO: 799029 - RNA, 19 nt, Mycobacterium avium subsp. paratuberculosis
gcggccggcggcgucguga

SEQ ID NO: 799030 - RNA, 13 nt, Mycobacterium avium subsp. paratuberculosis
gcggccggcgggc

SEQ ID NO: 799031 - RNA, 13 nt, Mycobacterium avium subsp. paratuberculosis
gcggccggcggug

SEQ ID NO: 799032 - RNA, 15 nt, Mycobacterium avium subsp. paratuberculosis
gcggccggcgguguc

SEQ ID NO: 799033 - RNA, 15 nt, Mycobacterium avium subsp. paratuberculosis
gcggccggcgccggc

SEQ ID NO: 799034 - RNA, 18 nt, Mycobacterium avium subsp. paratuberculosis
gcggccggcgccggcggu

SEQ ID NO: 799035 - RNA, 13 nt, Mycobacterium avium subsp. paratuberculosis
gcggccggcggca

SEQ ID NO: 799036 - RNA, 20 nt, Mycobacterium avium subsp. paratuberculosis
gcggccggcggcaguccggc

SEQ ID NO: 799037 - RNA, 19 nt, Mycobacterium avium subsp. paratuberculosis
gcggccggcgagucgcgga

SEQ ID NO: 799038 - RNA, 19 nt, Mycobacterium avium subsp. paratuberculosis
gcggccggcgcagccggcc

SEQ ID NO: 799039 - RNA, 23 nt, Mycobacterium avium subsp. paratuberculosis
gcggccggcgcagccggccaccg

SEQ ID NO: 799040 - RNA, 23 nt, Mycobacterium avium subsp. paratuberculosis
gcggccggcgccgaccgagggcg

SEQ ID NO: 799041 - RNA, 14 nt, Mycobacterium avium subsp. paratuberculosis
gcggccggccggcc

SEQ ID NO: 799042 - RNA, 13 nt, Mycobacterium avium subsp. paratuberculosis
gcggccggccgac

SEQ ID NO: 799043 - RNA, 20 nt, Mycobacterium avium subsp. paratuberculosis
gcggccggccgacaccccga

SEQ ID NO: 799044 - RNA, 16 nt, Mycobacterium avium subsp. paratuberculosis
gcggccggccgcgccc

SEQ ID NO: 799045 - RNA, 15 nt, Mycobacterium avium subsp. paratuberculosis
gcggccggccgcgcg

SEQ ID NO: 799046 - RNA, 13 nt, Mycobacterium avium subsp. paratuberculosis
gcggccggccccg

SEQ ID NO: 799047 - RNA, 15 nt, Mycobacterium avium subsp. paratuberculosis
gcggccggccccggc

SEQ ID NO: 799048 - RNA, 20 nt, Mycobacterium avium subsp. paratuberculosis
gcggccggccccggccgggc

SEQ ID NO: 799049 - RNA, 21 nt, Mycobacterium avium subsp. paratuberculosis
gcggccggccaguccugggcc

SEQ ID NO: 799050 - RNA, 13 nt, Mycobacterium avium subsp. paratuberculosis
gcggccggccaug

SEQ ID NO: 799051 - RNA, 12 nt, Mycobacterium avium subsp. paratuberculosis
gcggccggccca

SEQ ID NO: 799052 - RNA, 13 nt, Mycobacterium avium subsp. paratuberculosis
gcggccggcccag

SEQ ID NO: 799053 - RNA, 12 nt, Mycobacterium avium subsp. paratuberculosis
gcggccggcccc

SEQ ID NO: 799054 - RNA, 21 nt, Mycobacterium avium subsp. paratuberculosis
gcggccggccagcgcgcggcc

SEQ ID NO: 799055 - RNA, 14 nt, Mycobacterium avium subsp. paratuberculosis
gcggccggccacgc

SEQ ID NO: 799056 - RNA, 22 nt, Mycobacterium avium subsp. paratuberculosis
gcggccggccagcagccgguac

SEQ ID NO: 799057 - RNA, 23 nt, Mycobacterium avium subsp. paratuberculosis
gcggccggcacuaccgccucgcc

SEQ ID NO: 799058 - RNA, 15 nt, Mycobacterium avium subsp. paratuberculosis
gcggccgcggcgcgc

SEQ ID NO: 799059 - RNA, 16 nt, Mycobacterium avium subsp. paratuberculosis
gcggccgcggcgcgca

SEQ ID NO: 799060 - RNA, 22 nt, Mycobacterium avium subsp. paratuberculosis
uuccaccugcgguucgucgcgg

SEQ ID NO: 799061 - RNA, 14 nt, Mycobacterium avium subsp. paratuberculosis
uuccacaucagguu

SEQ ID NO: 799062 - RNA, 22 nt, Mycobacterium avium subsp. paratuberculosis
uuccaccgggccgccaucaccg

SEQ ID NO: 799063 - RNA, 14 nt, Mycobacterium avium subsp. paratuberculosis
uuccagaccggcgg

SEQ ID NO: 799064 - RNA, 15 nt, Mycobacterium avium subsp. paratuberculosis
uuccagaccggcggc

SEQ ID NO: 799065 - RNA, 14 nt, Mycobacterium avium subsp. paratuberculosis
uuccagcacgccca

SEQ ID NO: 799066 - RNA, 19 nt, Mycobacterium avium subsp. paratuberculosis
uuccagcccguugucgagc

SEQ ID NO: 799067 - RNA, 19 nt, Mycobacterium avium subsp. paratuberculosis
uuccagccgaucgcggugc

SEQ ID NO: 799068 - RNA, 19 nt, Mycobacterium avium subsp. paratuberculosis
uuccagcgcgaccgcccgg

SEQ ID NO: 799069 - RNA, 17 nt, Mycobacterium avium subsp. paratuberculosis
uuccagcgcguagucgg

SEQ ID NO: 799070 - RNA, 14 nt, Mycobacterium avium subsp. paratuberculosis
uuccaccaccgcgg

SEQ ID NO: 799071 - RNA, 16 nt, Mycobacterium avium subsp. paratuberculosis
uuccaccccggcgguc

SEQ ID NO: 799072 - RNA, 18 nt, Mycobacterium avium subsp. paratuberculosis
uuccaccccggcggucgg

SEQ ID NO: 799073 - RNA, 23 nt, Mycobacterium avium subsp. paratuberculosis
uuccacagcugcaggcuggucug

SEQ ID NO: 799074 - RNA, 22 nt, Mycobacterium avium subsp. paratuberculosis
uuccacagcccguugcugcguu

SEQ ID NO: 799075 - RNA, 22 nt, Mycobacterium avium subsp. paratuberculosis
uuccaacggaagcgguugagcc

SEQ ID NO: 799076 - RNA, 18 nt, Mycobacterium avium subsp. paratuberculosis
uucauguggaagccgcga

SEQ ID NO: 799077 - RNA, 14 nt, Mycobacterium avium subsp. paratuberculosis
uucccgcuuggcgg

SEQ ID NO: 799078 - RNA, 18 nt, Mycobacterium avium subsp. paratuberculosis
uucccacacgcucggcga

SEQ ID NO: 799079 - RNA, 21 nt, Mycobacterium avium subsp. paratuberculosis
uucccggcagaacgacgccag

SEQ ID NO: 799080 - RNA, 16 nt, Mycobacterium avium subsp. paratuberculosis
uucccacagucgcugg

SEQ ID NO: 799081 - RNA, 22 nt, Mycobacterium avium subsp. paratuberculosis
uuccaucacgccccggcgucgg

SEQ ID NO: 799082 - RNA, 20 nt, Mycobacterium avium subsp. paratuberculosis
uuccaucagcgcccgcgcgg

SEQ ID NO: 799083 - RNA, 14 nt, Mycobacterium avium subsp. paratuberculosis
uuccaugucgucga

SEQ ID NO: 799084 - RNA, 17 nt, Mycobacterium avium subsp. paratuberculosis
uuccaugucgucgagcu

SEQ ID NO: 799085 - RNA, 20 nt, Mycobacterium avium subsp. paratuberculosis
uuccaugucgucgagcucga

SEQ ID NO: 799086 - RNA, 20 nt, Mycobacterium avium subsp. paratuberculosis
uucaugaucucguugcggcg

SEQ ID NO: 799087 - RNA, 19 nt, Mycobacterium avium subsp. paratuberculosis
uucaggcccgcgccgacgg

SEQ ID NO: 799088 - RNA, 21 nt, Mycobacterium avium subsp. paratuberculosis
uucaggcugaucuggaugcgg

SEQ ID NO: 799089 - RNA, 13 nt, Mycobacterium avium subsp. paratuberculosis
uucagggcggugc

SEQ ID NO: 799090 - RNA, 22 nt, Mycobacterium avium subsp. paratuberculosis
uucagggcggugcggugcgccg

SEQ ID NO: 799091 - RNA, 16 nt, Mycobacterium avium subsp. paratuberculosis
uucagaagucgcccgc

SEQ ID NO: 799092 - RNA, 15 nt, Mycobacterium avium subsp. paratuberculosis
uucacgaccggcagc

SEQ ID NO: 799093 - RNA, 15 nt, Mycobacterium avium subsp. paratuberculosis
uucacgucugcucgg

SEQ ID NO: 799094 - RNA, 18 nt, Mycobacterium avium subsp. paratuberculosis
uucacgucugcucggcgg

SEQ ID NO: 799095 - RNA, 14 nt, Mycobacterium avium subsp. paratuberculosis
uucacgcucggcag

SEQ ID NO: 799096 - RNA, 19 nt, Mycobacterium avium subsp. paratuberculosis
uucggagaccaggucggcc

SEQ ID NO: 799097 - RNA, 17 nt, Mycobacterium avium subsp. paratuberculosis
uucggcgcggcucacga

SEQ ID NO: 799098 - RNA, 12 nt, Mycobacterium avium subsp. paratuberculosis
uucgcuggucgc

SEQ ID NO: 799099 - RNA, 17 nt, Mycobacterium avium subsp. paratuberculosis
uucggaacccugcccca

SEQ ID NO: 799100 - RNA, 19 nt, Mycobacterium avium subsp. paratuberculosis
uucggacgagccgucgcgg

SEQ ID NO: 799101 - RNA, 15 nt, Mycobacterium avium subsp. paratuberculosis
uucgccgacagcagc

SEQ ID NO: 799102 - RNA, 17 nt, Mycobacterium avium subsp. paratuberculosis
uucgccgacagcagcuc

SEQ ID NO: 799103 - RNA, 19 nt, Mycobacterium avium subsp. paratuberculosis
uucgccgauguccccgcgg

SEQ ID NO: 799104 - RNA, 17 nt, Mycobacterium avium subsp. paratuberculosis
uucgccgcaaccuucuu

SEQ ID NO: 799105 - RNA, 16 nt, Mycobacterium avium subsp. paratuberculosis
uucgccgaggaaccgg

SEQ ID NO: 799106 - RNA, 13 nt, Mycobacterium avium subsp. paratuberculosis
uucgcgcacgcug

SEQ ID NO: 799107 - RNA, 22 nt, Mycobacterium avium subsp. paratuberculosis
uucgcgcacgcuggccggcagc

SEQ ID NO: 799108 - RNA, 23 nt, Mycobacterium avium subsp. paratuberculosis
uucgcgcacggcgcgcaccgcgg

SEQ ID NO: 799109 - RNA, 14 nt, Mycobacterium avium subsp. paratuberculosis
uucgcggcgcagca

SEQ ID NO: 799110 - RNA, 13 nt, Mycobacterium avium subsp. paratuberculosis
uucgcggcggcgc

SEQ ID NO: 799111 - RNA, 15 nt, Mycobacterium avium subsp. paratuberculosis
uucgcggcuggccgc

SEQ ID NO: 799112 - RNA, 17 nt, Mycobacterium avium subsp. paratuberculosis
uucgcggcuggccgcgg

SEQ ID NO: 799113 - RNA, 14 nt, Mycobacterium avium subsp. paratuberculosis
uucgcgggcggcgc

SEQ ID NO: 799114 - RNA, 17 nt, Mycobacterium avium subsp. paratuberculosis
uucgcgggugccuucuu

SEQ ID NO: 799115 - RNA, 20 nt, Mycobacterium avium subsp. paratuberculosis
uucgcgggugcgcucgacgg

SEQ ID NO: 799116 - RNA, 23 nt, Mycobacterium avium subsp. paratuberculosis
uucgacacggugaacgucgaucc

SEQ ID NO: 799117 - RNA, 13 nt, Mycobacterium avium subsp. paratuberculosis
uucgaagcgcagc

SEQ ID NO: 799118 - RNA, 19 nt, Mycobacterium avium subsp. paratuberculosis
uucgaagcugucgccgagg

SEQ ID NO: 799119 - RNA, 19 nt, Mycobacterium avium subsp. paratuberculosis
uucgaaguacucaccggug

SEQ ID NO: 799120 - RNA, 13 nt, Mycobacterium avium subsp. paratuberculosis
uucgcccaccccg

SEQ ID NO: 799121 - RNA, 17 nt, Mycobacterium avium subsp. paratuberculosis
uuccuugauccggccgc

SEQ ID NO: 799122 - RNA, 19 nt, Mycobacterium avium subsp. paratuberculosis
uuccgcgcgucgggggugc

SEQ ID NO: 799123 - RNA, 13 nt, Mycobacterium avium subsp. paratuberculosis
uuccgcgucggcc

SEQ ID NO: 799124 - RNA, 15 nt, Mycobacterium avium subsp. paratuberculosis
uuccgccgcgcccgu

SEQ ID NO: 799125 - RNA, 18 nt, Mycobacterium avium subsp. paratuberculosis
uuccgcccggcgagcaca

SEQ ID NO: 799126 - RNA, 13 nt, Mycobacterium avium subsp. paratuberculosis
uuccgccucggcg

SEQ ID NO: 799127 - RNA, 14 nt, Mycobacterium avium subsp. paratuberculosis
uuccgccucggcga

SEQ ID NO: 799128 - RNA, 23 nt, Mycobacterium avium subsp. paratuberculosis
uuccgccucggcgaggucgucga

SEQ ID NO: 799129 - RNA, 15 nt, Mycobacterium avium subsp. paratuberculosis
uuccgcgcggcgggc

SEQ ID NO: 799130 - RNA, 15 nt, Mycobacterium avium subsp. paratuberculosis
uucuccagcggccgc

SEQ ID NO: 799131 - RNA, 19 nt, Mycobacterium avium subsp. paratuberculosis
uucuccagcuccucgguca

SEQ ID NO: 799132 - RNA, 15 nt, Mycobacterium avium subsp. paratuberculosis
uucuccccgccucgg

SEQ ID NO: 799133 - RNA, 19 nt, Mycobacterium avium subsp. paratuberculosis
uucuacggcgggccggcgc

SEQ ID NO: 799134 - RNA, 18 nt, Mycobacterium avium subsp. paratuberculosis
uucucgaacgggucgagg

SEQ ID NO: 799135 - RNA, 22 nt, Mycobacterium avium subsp. paratuberculosis
uucucgaugacccaccagccga

SEQ ID NO: 799136 - RNA, 12 nt, Mycobacterium avium subsp. paratuberculosis
uucucgcacagc

SEQ ID NO: 799137 - RNA, 18 nt, Mycobacterium avium subsp. paratuberculosis
uucucgcccggcuccacg

SEQ ID NO: 799138 - RNA, 19 nt, Mycobacterium avium subsp. paratuberculosis
uucucgcccggcuccacga

SEQ ID NO: 799139 - RNA, 22 nt, Mycobacterium avium subsp. paratuberculosis
uucucgccgugcagcaccucga

SEQ ID NO: 799140 - RNA, 13 nt, Mycobacterium avium subsp. paratuberculosis
uucuccgcggccg

SEQ ID NO: 799141 - RNA, 14 nt, Mycobacterium avium subsp. paratuberculosis
uucuccgcggccgc

SEQ ID NO: 799142 - RNA, 15 nt, Mycobacterium avium subsp. paratuberculosis
uucuccucgucgcgg

SEQ ID NO: 799143 - RNA, 19 nt, Mycobacterium avium subsp. paratuberculosis
uucuccggcccgcucggcg

SEQ ID NO: 799144 - RNA, 16 nt, Mycobacterium avium subsp. paratuberculosis
uucugcucuucggugg

SEQ ID NO: 799145 - RNA, 21 nt, Mycobacterium avium subsp. paratuberculosis
uucugcgccuuuugcacccgc

SEQ ID NO: 799146 - RNA, 13 nt, Mycobacterium avium subsp. paratuberculosis
uucugccggccgc

SEQ ID NO: 799147 - RNA, 12 nt, Mycobacterium avium subsp. paratuberculosis
uucucgcgcagg

SEQ ID NO: 799148 - RNA, 10 nt, Mycobacterium avium subsp. paratuberculosis
uucucgcggc

SEQ ID NO: 799149 - RNA, 14 nt, Mycobacterium avium subsp. paratuberculosis
uucguugucgagcg

SEQ ID NO: 799150 - RNA, 17 nt, Mycobacterium avium subsp. paratuberculosis
uucguuguuggcggugg

SEQ ID NO: 799151 - RNA, 23 nt, Mycobacterium avium subsp. paratuberculosis
uucgucggccgucggcgccgccg

SEQ ID NO: 799152 - RNA, 13 nt, Mycobacterium avium subsp. paratuberculosis
uucgucggcggug

SEQ ID NO: 799153 - RNA, 18 nt, Mycobacterium avium subsp. paratuberculosis
uucgucgaccgucacgcu

SEQ ID NO: 799154 - RNA, 14 nt, Mycobacterium avium subsp. paratuberculosis
uucgucggcggugu

SEQ ID NO: 799155 - RNA, 22 nt, Mycobacterium avium subsp. paratuberculosis
uucgucggucacggacagccgg

SEQ ID NO: 799156 - RNA, 18 nt, Mycobacterium avium subsp. paratuberculosis
uucgucggugcgcgccgc

SEQ ID NO: 799157 - RNA, 16 nt, Mycobacterium avium subsp. paratuberculosis
uucgucgucgcgcagg

SEQ ID NO: 799158 - RNA, 22 nt, Mycobacterium avium subsp. paratuberculosis
uucgucgucguuggcccgccgc

SEQ ID NO: 799159 - RNA, 21 nt, Mycobacterium avium subsp. paratuberculosis
uucguggucucgcaccugccg

SEQ ID NO: 799160 - RNA, 19 nt, Mycobacterium avium subsp. paratuberculosis
uucgggccagcgccgagcc

SEQ ID NO: 799161 - RNA, 15 nt, Mycobacterium avium subsp. paratuberculosis
uucgggcccggccgc

SEQ ID NO: 799162 - RNA, 17 nt, Mycobacterium avium subsp. paratuberculosis
uucgucccaguccagcc

SEQ ID NO: 799163 - RNA, 20 nt, Mycobacterium avium subsp. paratuberculosis
uucgucgaaguagggccgca

SEQ ID NO: 799164 - RNA, 14 nt, Mycobacterium avium subsp. paratuberculosis
uucguccagcccga

SEQ ID NO: 799165 - RNA, 21 nt, Mycobacterium avium subsp. paratuberculosis
uucguccgugcugccggccgg

SEQ ID NO: 799166 - RNA, 15 nt, Mycobacterium avium subsp. paratuberculosis
uucgucgccggccgc

SEQ ID NO: 799167 - RNA, 12 nt, Mycobacterium avium subsp. paratuberculosis
uucgucgcggcg

SEQ ID NO: 799168 - RNA, 17 nt, Mycobacterium avium subsp. paratuberculosis
uucggcguccucgacgc

SEQ ID NO: 799169 - RNA, 19 nt, Mycobacterium avium subsp. paratuberculosis
uucggcguccucgacgccg

SEQ ID NO: 799170 - RNA, 19 nt, Mycobacterium avium subsp. paratuberculosis
uucgggauccucgccgcgg

SEQ ID NO: 799171 - RNA, 17 nt, Mycobacterium avium subsp. paratuberculosis
uucgggaucgucgccgg

SEQ ID NO: 799172 - RNA, 12 nt, Mycobacterium avium subsp. paratuberculosis
uucggcucggcg

SEQ ID NO: 799173 - RNA, 20 nt, Mycobacterium avium subsp. paratuberculosis
uuacguggacgcgcgcggcg

SEQ ID NO: 799174 - RNA, 15 nt, Mycobacterium avium subsp. paratuberculosis
uuagcccggccgcgg

SEQ ID NO: 799175 - RNA, 20 nt, Mycobacterium avium subsp. paratuberculosis
uguucgucgaguucgcggcg

SEQ ID NO: 799176 - RNA, 16 nt, Mycobacterium avium subsp. paratuberculosis
uguucuccagcggccg

SEQ ID NO: 799177 - RNA, 23 nt, Mycobacterium avium subsp. paratuberculosis
uguugcaggcggaccugggugcg

SEQ ID NO: 799178 - RNA, 19 nt, Mycobacterium avium subsp. paratuberculosis
uguugaggaugucgacgau

SEQ ID NO: 799179 - RNA, 19 nt, Mycobacterium avium subsp. paratuberculosis
uguggcgccgugcaggaug

SEQ ID NO: 799180 - RNA, 13 nt, Mycobacterium avium subsp. paratuberculosis
ugugggucgacag

SEQ ID NO: 799181 - RNA, 17 nt, Mycobacterium avium subsp. paratuberculosis
ugugggcgauggcggcg

SEQ ID NO: 799182 - RNA, 20 nt, Mycobacterium avium subsp. paratuberculosis
ugugggcgauggcggcgucg

SEQ ID NO: 799183 - RNA, 23 nt, Mycobacterium avium subsp. paratuberculosis
ugugggcgcccgcggcgcgcagg

SEQ ID NO: 799184 - RNA, 17 nt, Mycobacterium avium subsp. paratuberculosis
ugugggcucgcccgggc

SEQ ID NO: 799185 - RNA, 17 nt, Mycobacterium avium subsp. paratuberculosis
uguucaacgcgccgaug

SEQ ID NO: 799186 - RNA, 14 nt, Mycobacterium avium subsp. paratuberculosis
uguucgaugcgguc

SEQ ID NO: 799187 - RNA, 19 nt, Mycobacterium avium subsp. paratuberculosis
uguucgaugcggucccgcg

SEQ ID NO: 799188 - RNA, 14 nt, Mycobacterium avium subsp. paratuberculosis
uguucggccaccgc

SEQ ID NO: 799189 - RNA, 19 nt, Mycobacterium avium subsp. paratuberculosis
uguucggcgccagccgcac

SEQ ID NO: 799190 - RNA, 16 nt, Mycobacterium avium subsp. paratuberculosis
uguucggguagacgau

SEQ ID NO: 799191 - RNA, 16 nt, Mycobacterium avium subsp. paratuberculosis
ugugcccagcacgacg

SEQ ID NO: 799192 - RNA, 13 nt, Mycobacterium avium subsp. paratuberculosis
ugugccacaggua

SEQ ID NO: 799193 - RNA, 16 nt, Mycobacterium avium subsp. paratuberculosis
ugugccaccgccgaug

SEQ ID NO: 799194 - RNA, 23 nt, Mycobacterium avium subsp. paratuberculosis
ugugccaccgccgauggcgacgg

SEQ ID NO: 799195 - RNA, 22 nt, Mycobacterium avium subsp. paratuberculosis
ugugcccgacggcgcgcccgac

SEQ ID NO: 799196 - RNA, 17 nt, Mycobacterium avium subsp. paratuberculosis
ugugcccgcgggccaga

SEQ ID NO: 799197 - RNA, 17 nt, Mycobacterium avium subsp. paratuberculosis
ugugcgcaucggcgacg

SEQ ID NO: 799198 - RNA, 19 nt, Mycobacterium avium subsp. paratuberculosis
ugugcgcaucggcgacgcc

SEQ ID NO: 799199 - RNA, 14 nt, Mycobacterium avium subsp. paratuberculosis
ugugccggcgcucg

SEQ ID NO: 799200 - RNA, 12 nt, Mycobacterium avium subsp. paratuberculosis
ugugccggcggg

SEQ ID NO: 799201 - RNA, 18 nt, Mycobacterium avium subsp. paratuberculosis
ugugccggcgggucagca

SEQ ID NO: 799202 - RNA, 12 nt, Mycobacterium avium subsp. paratuberculosis
ugugccugcggg

SEQ ID NO: 799203 - RNA, 20 nt, Mycobacterium avium subsp. paratuberculosis
ugugcgcuugggucgccggg

SEQ ID NO: 799204 - RNA, 13 nt, Mycobacterium avium subsp. paratuberculosis
ugugcggcgcggc

SEQ ID NO: 799205 - RNA, 12 nt, Mycobacterium avium subsp. paratuberculosis
ugugcgcgcugg

SEQ ID NO: 799206 - RNA, 20 nt, Mycobacterium avium subsp. paratuberculosis
uguggcccaggccggcggug

SEQ ID NO: 799207 - RNA, 18 nt, Mycobacterium avium subsp. paratuberculosis
uguggaugacgcagccga

SEQ ID NO: 799208 - RNA, 22 nt, Mycobacterium avium subsp. paratuberculosis
uguggaacaucuccagcgcggu

SEQ ID NO: 799209 - RNA, 15 nt, Mycobacterium avium subsp. paratuberculosis
ugugcuugaucagcg

SEQ ID NO: 799210 - RNA, 14 nt, Mycobacterium avium subsp. paratuberculosis
ugugcuggccagca

SEQ ID NO: 799211 - RNA, 13 nt, Mycobacterium avium subsp. paratuberculosis
ugugcucgacgaa

SEQ ID NO: 799212 - RNA, 12 nt, Mycobacterium avium subsp. paratuberculosis
ugugcucggcgg

SEQ ID NO: 799213 - RNA, 13 nt, Mycobacterium avium subsp. paratuberculosis
ugugcucgucgau

SEQ ID NO: 799214 - RNA, 17 nt, Mycobacterium avium subsp. paratuberculosis
ugucguacgggcgcagc

SEQ ID NO: 799215 - RNA, 19 nt, Mycobacterium avium subsp. paratuberculosis
ugucguagaacucgccgug

SEQ ID NO: 799216 - RNA, 17 nt, Mycobacterium avium subsp. paratuberculosis
ugucguccagugacgcc

SEQ ID NO: 799217 - RNA, 14 nt, Mycobacterium avium subsp. paratuberculosis
ugucguagcggcug

SEQ ID NO: 799218 - RNA, 14 nt, Mycobacterium avium subsp. paratuberculosis
ugucguagcggucg

SEQ ID NO: 799219 - RNA, 13 nt, Mycobacterium avium subsp. paratuberculosis
ugucgguggugug

SEQ ID NO: 799220 - RNA, 21 nt, Mycobacterium avium subsp. paratuberculosis
ugucgucguugugggccagcg

SEQ ID NO: 799221 - RNA, 18 nt, Mycobacterium avium subsp. paratuberculosis
ugucgucgaccucgauca

SEQ ID NO: 799222 - RNA, 21 nt, Mycobacterium avium subsp. paratuberculosis
ugucguaguugcgcgccgaug

SEQ ID NO: 799223 - RNA, 19 nt, Mycobacterium avium subsp. paratuberculosis
ugucgucgccgguggccgc

SEQ ID NO: 799224 - RNA, 13 nt, Mycobacterium avium subsp. paratuberculosis
ugucgucgcgcac

SEQ ID NO: 799225 - RNA, 19 nt, Mycobacterium avium subsp. paratuberculosis
ugucggggucgcggcccgc

SEQ ID NO: 799226 - RNA, 23 nt, Mycobacterium avium subsp. paratuberculosis
ugucggggucgcggcccgccuuc

SEQ ID NO: 799227 - RNA, 15 nt, Mycobacterium avium subsp. paratuberculosis
ugucggggucgucga

SEQ ID NO: 799228 - RNA, 20 nt, Mycobacterium avium subsp. paratuberculosis
ugucggggaccguccccguc

SEQ ID NO: 799229 - RNA, 18 nt, Mycobacterium avium subsp. paratuberculosis
ugucggugccgagcacgc

SEQ ID NO: 799230 - RNA, 16 nt, Mycobacterium avium subsp. paratuberculosis
ugucggugcggccgca

SEQ ID NO: 799231 - RNA, 20 nt, Mycobacterium avium subsp. paratuberculosis
ugucacccucgaggccgacg

SEQ ID NO: 799232 - RNA, 18 nt, Mycobacterium avium subsp. paratuberculosis
ugucacguccacgccgcg

SEQ ID NO: 799233 - RNA, 16 nt, Mycobacterium avium subsp. paratuberculosis
ugucagcgcgaccucg

SEQ ID NO: 799234 - RNA, 20 nt, Mycobacterium avium subsp. paratuberculosis
ugucagcgcgaccucggugg

SEQ ID NO: 799235 - RNA, 15 nt, Mycobacterium avium subsp. paratuberculosis
ugucggcgucgccga

SEQ ID NO: 799236 - RNA, 18 nt, Mycobacterium avium subsp. paratuberculosis
ugucggcguggccguccg

SEQ ID NO: 799237 - RNA, 15 nt, Mycobacterium avium subsp. paratuberculosis
ugucggcucgccgau

SEQ ID NO: 799238 - RNA, 16 nt, Mycobacterium avium subsp. paratuberculosis
ugucggcucgccgauc

SEQ ID NO: 799239 - RNA, 14 nt, Mycobacterium avium subsp. paratuberculosis
ugucgggccgcggg

SEQ ID NO: 799240 - RNA, 19 nt, Mycobacterium avium subsp. paratuberculosis
ugucgucgggcaccacggc

SEQ ID NO: 799241 - RNA, 18 nt, Mycobacterium avium subsp. paratuberculosis
ugucguugacgcugggcg

SEQ ID NO: 799242 - RNA, 16 nt, Mycobacterium avium subsp. paratuberculosis
ugucgugggcgugccg

SEQ ID NO: 799243 - RNA, 16 nt, Mycobacterium avium subsp. paratuberculosis
ugucgugugcgugacg

SEQ ID NO: 799244 - RNA, 15 nt, Mycobacterium avium subsp. paratuberculosis
ugucguuggugucga

SEQ ID NO: 799245 - RNA, 14 nt, Mycobacterium avium subsp. paratuberculosis
ugugaucggcggcc

SEQ ID NO: 799246 - RNA, 22 nt, Mycobacterium avium subsp. paratuberculosis
ugugcaccagcgauccggcgcg

SEQ ID NO: 799247 - RNA, 12 nt, Mycobacterium avium subsp. paratuberculosis
ugugaccacggu

SEQ ID NO: 799248 - RNA, 23 nt, Mycobacterium avium subsp. paratuberculosis
ugugaccggggucggcgcccucg

SEQ ID NO: 799249 - RNA, 14 nt, Mycobacterium avium subsp. paratuberculosis
ugugagcggugacc

SEQ ID NO: 799250 - RNA, 18 nt, Mycobacterium avium subsp. paratuberculosis
ugugagcuuccugccaac

SEQ ID NO: 799251 - RNA, 21 nt, Mycobacterium avium subsp. paratuberculosis
ugugaggcaccgaacgccagc

SEQ ID NO: 799252 - RNA, 22 nt, Mycobacterium avium subsp. paratuberculosis
aaugcgggcgauggcgggccgc

SEQ ID NO: 799253 - RNA, 18 nt, Mycobacterium avium subsp. paratuberculosis
aauggcaauacgccucgc

SEQ ID NO: 799254 - RNA, 12 nt, Mycobacterium avium subsp. paratuberculosis
aaugcgccggcg

SEQ ID NO: 799255 - RNA, 17 nt, Mycobacterium avium subsp. paratuberculosis
aaugcgccggcggccgc

SEQ ID NO: 799256 - RNA, 17 nt, Mycobacterium avium subsp. paratuberculosis
aaugucauuugagcggc

SEQ ID NO: 799257 - RNA, 19 nt, Mycobacterium avium subsp. paratuberculosis
aauguccuccugcgccggc

SEQ ID NO: 799258 - RNA, 18 nt, Mycobacterium avium subsp. paratuberculosis
aaugggcugcgcgucgag

SEQ ID NO: 799259 - RNA, 20 nt, Mycobacterium avium subsp. paratuberculosis
aauggguguaacgcgucgac

SEQ ID NO: 799260 - RNA, 23 nt, Mycobacterium avium subsp. paratuberculosis
aauggcgaacauggucgcccaca

SEQ ID NO: 799261 - RNA, 14 nt, Mycobacterium avium subsp. paratuberculosis
aaugaacgcggcca

SEQ ID NO: 799262 - RNA, 14 nt, Mycobacterium avium subsp. paratuberculosis
aaucgucggccacg

SEQ ID NO: 799263 - RNA, 13 nt, Mycobacterium avium subsp. paratuberculosis
aaucgucgggccg

SEQ ID NO: 799264 - RNA, 16 nt, Mycobacterium avium subsp. paratuberculosis
aaucggugaagccgac

SEQ ID NO: 799265 - RNA, 17 nt, Mycobacterium avium subsp. paratuberculosis
aaucggugaagccgacg

SEQ ID NO: 799266 - RNA, 20 nt, Mycobacterium avium subsp. paratuberculosis
aaucgccuguccgaccagcg

SEQ ID NO: 799267 - RNA, 19 nt, Mycobacterium avium subsp. paratuberculosis
aaucgccuuggcucgggcc

SEQ ID NO: 799268 - RNA, 16 nt, Mycobacterium avium subsp. paratuberculosis
aaucgcugcgcccgcc

SEQ ID NO: 799269 - RNA, 17 nt, Mycobacterium avium subsp. paratuberculosis
aaucgcugcgcccgccg

SEQ ID NO: 799270 - RNA, 13 nt, Mycobacterium avium subsp. paratuberculosis
uuugaggcgagca

SEQ ID NO: 799271 - RNA, 15 nt, Mycobacterium avium subsp. paratuberculosis
uuugaugccgccggg

SEQ ID NO: 799272 - RNA, 19 nt, Mycobacterium avium subsp. paratuberculosis
uuugcccuccuucccggug

SEQ ID NO: 799273 - RNA, 19 nt, Mycobacterium avium subsp. paratuberculosis
uuugcccagcagggcggcg

SEQ ID NO: 799274 - RNA, 20 nt, Mycobacterium avium subsp. paratuberculosis
uuugcccagcagggcggcga

SEQ ID NO: 799275 - RNA, 15 nt, Mycobacterium avium subsp. paratuberculosis
uuuggcuggucucgg

SEQ ID NO: 799276 - RNA, 14 nt, Mycobacterium avium subsp. paratuberculosis
uuucggucgcggug

SEQ ID NO: 799277 - RNA, 19 nt, Mycobacterium avium subsp. paratuberculosis
uuucgggucgagagccgca

SEQ ID NO: 799278 - RNA, 20 nt, Mycobacterium avium subsp. paratuberculosis
uuucgcgcuaggacgcgggc

SEQ ID NO: 799279 - RNA, 23 nt, Mycobacterium avium subsp. paratuberculosis
uugucguugaacaguucggugca

SEQ ID NO: 799280 - RNA, 18 nt, Mycobacterium avium subsp. paratuberculosis
uugugcaccaacacgucg

SEQ ID NO: 799281 - RNA, 13 nt, Mycobacterium avium subsp. paratuberculosis
uugugaggcgcgc

SEQ ID NO: 799282 - RNA, 16 nt, Mycobacterium avium subsp. paratuberculosis
uuguccugcucggcga

SEQ ID NO: 799283 - RNA, 17 nt, Mycobacterium avium subsp. paratuberculosis
uugucgaggucggugag

SEQ ID NO: 799284 - RNA, 23 nt, Mycobacterium avium subsp. paratuberculosis
uugucgaguucgcucuucucguu

SEQ ID NO: 799285 - RNA, 16 nt, Mycobacterium avium subsp. paratuberculosis
uuguccacccccgcgg

SEQ ID NO: 799286 - RNA, 22 nt, Mycobacterium avium subsp. paratuberculosis
uugucagccacucgccgugaga

SEQ ID NO: 799287 - RNA, 19 nt, Mycobacterium avium subsp. paratuberculosis
uugucgcucaaaggcgggc

SEQ ID NO: 799288 - RNA, 19 nt, Mycobacterium avium subsp. paratuberculosis
uugucgucgucggcgacga

SEQ ID NO: 799289 - RNA, 20 nt, Mycobacterium avium subsp. paratuberculosis
uugucgccgugcggcguucg

SEQ ID NO: 799290 - RNA, 15 nt, Mycobacterium avium subsp. paratuberculosis
uugucggcucgccga

SEQ ID NO: 799291 - RNA, 15 nt, Mycobacterium avium subsp. paratuberculosis
uuggugccggccucg

SEQ ID NO: 799292 - RNA, 22 nt, Mycobacterium avium subsp. paratuberculosis
uuggugaaaccguuggccugcg

SEQ ID NO: 799293 - RNA, 15 nt, Mycobacterium avium subsp. paratuberculosis
uugucaccgaaccgc

SEQ ID NO: 799294 - RNA, 12 nt, Mycobacterium avium subsp. paratuberculosis
aaucgagccgcc

SEQ ID NO: 799295 - RNA, 21 nt, Mycobacterium avium subsp. paratuberculosis
aaucgagccgccugcgcgccg

SEQ ID NO: 799296 - RNA, 15 nt, Mycobacterium avium subsp. paratuberculosis
aaucgcagacguagc

SEQ ID NO: 799297 - RNA, 13 nt, Mycobacterium avium subsp. paratuberculosis
aauccccccgcgc

SEQ ID NO: 799298 - RNA, 16 nt, Mycobacterium avium subsp. paratuberculosis
uugcgccccggcgggc

SEQ ID NO: 799299 - RNA, 21 nt, Mycobacterium avium subsp. paratuberculosis
uugcgccccggcgggcggccg

SEQ ID NO: 799300 - RNA, 21 nt, Mycobacterium avium subsp. paratuberculosis
uugcgcccggccaucugcgcg

SEQ ID NO: 799301 - RNA, 21 nt, Mycobacterium avium subsp. paratuberculosis
uugcgccgccagggcgcggcg

SEQ ID NO: 799302 - RNA, 11 nt, Mycobacterium avium subsp. paratuberculosis
uugcgcccgua

SEQ ID NO: 799303 - RNA, 14 nt, Mycobacterium avium subsp. paratuberculosis
uugcgcgacgccgu

SEQ ID NO: 799304 - RNA, 15 nt, Mycobacterium avium subsp. paratuberculosis
uugcgcgacgccguc

SEQ ID NO: 799305 - RNA, 16 nt, Mycobacterium avium subsp. paratuberculosis
aauccagaacagccag

SEQ ID NO: 799306 - RNA, 18 nt, Mycobacterium avium subsp. paratuberculosis
uuggccagcgccuccagc

SEQ ID NO: 799307 - RNA, 23 nt, Mycobacterium avium subsp. paratuberculosis
uuggccagcagcgugggauccga

SEQ ID NO: 799308 - RNA, 13 nt, Mycobacterium avium subsp. paratuberculosis
uuggccagcucgg

SEQ ID NO: 799309 - RNA, 16 nt, Mycobacterium avium subsp. paratuberculosis
uuggccagcucggcgg

SEQ ID NO: 799310 - RNA, 18 nt, Mycobacterium avium subsp. paratuberculosis
uuggccagguggccgcuu

SEQ ID NO: 799311 - RNA, 21 nt, Mycobacterium avium subsp. paratuberculosis
uuggcaaggagguggucgagc

SEQ ID NO: 799312 - RNA, 17 nt, Mycobacterium avium subsp. paratuberculosis
uuggccacgucgaagcc

SEQ ID NO: 799313 - RNA, 14 nt, Mycobacterium avium subsp. paratuberculosis
uuggccagcaccgc

SEQ ID NO: 799314 - RNA, 16 nt, Mycobacterium avium subsp. paratuberculosis
uuggccagcaccgcgg

SEQ ID NO: 799315 - RNA, 17 nt, Mycobacterium avium subsp. paratuberculosis
uuggucgcggccuucuu

SEQ ID NO: 799316 - RNA, 17 nt, Mycobacterium avium subsp. paratuberculosis
uuggucacaaagcccgg

SEQ ID NO: 799317 - RNA, 16 nt, Mycobacterium avium subsp. paratuberculosis
uugguccaggcguucg

SEQ ID NO: 799318 - RNA, 19 nt, Mycobacterium avium subsp. paratuberculosis
uugguccgcaacgcggcgg

SEQ ID NO: 799319 - RNA, 19 nt, Mycobacterium avium subsp. paratuberculosis
uuggcgccguccgcggcgg

SEQ ID NO: 799320 - RNA, 13 nt, Mycobacterium avium subsp. paratuberculosis
uuggcgcucaacg

SEQ ID NO: 799321 - RNA, 13 nt, Mycobacterium avium subsp. paratuberculosis
uuggcgcgcucgg

SEQ ID NO: 799322 - RNA, 21 nt, Mycobacterium avium subsp. paratuberculosis
uuggcgaucucgauggccucg

SEQ ID NO: 799323 - RNA, 16 nt, Mycobacterium avium subsp. paratuberculosis
uugggcgucucgauga

SEQ ID NO: 799324 - RNA, 16 nt, Mycobacterium avium subsp. paratuberculosis
uugggcuccucgacca

SEQ ID NO: 799325 - RNA, 21 nt, Mycobacterium avium subsp. paratuberculosis
uuggcgacgcugaacagcagc

SEQ ID NO: 799326 - RNA, 15 nt, Mycobacterium avium subsp. paratuberculosis
uuggcgacggcgcug

SEQ ID NO: 799327 - RNA, 21 nt, Mycobacterium avium subsp. paratuberculosis
uuggcgaagcguuucagcaac

SEQ ID NO: 799328 - RNA, 17 nt, Mycobacterium avium subsp. paratuberculosis
aauccgccguugaccgg

SEQ ID NO: 799329 - RNA, 18 nt, Mycobacterium avium subsp. paratuberculosis
uugccagaaaucgccggg

SEQ ID NO: 799330 - RNA, 13 nt, Mycobacterium avium subsp. paratuberculosis
uugcccgccagca

SEQ ID NO: 799331 - RNA, 12 nt, Mycobacterium avium subsp. paratuberculosis
uugcccgccgcg

SEQ ID NO: 799332 - RNA, 19 nt, Mycobacterium avium subsp. paratuberculosis
uugcccggcgagcgacgcc

SEQ ID NO: 799333 - RNA, 23 nt, Mycobacterium avium subsp. paratuberculosis
uugcccggcgagcgacgccacgg

SEQ ID NO: 799334 - RNA, 16 nt, Mycobacterium avium subsp. paratuberculosis
uugcccggcucggugc

SEQ ID NO: 799335 - RNA, 17 nt, Mycobacterium avium subsp. paratuberculosis
uugcccggcucggugcg

SEQ ID NO: 799336 - RNA, 17 nt, Mycobacterium avium subsp. paratuberculosis
uugccgagcaccccguc

SEQ ID NO: 799337 - RNA, 12 nt, Mycobacterium avium subsp. paratuberculosis
uugccgacgacg

SEQ ID NO: 799338 - RNA, 18 nt, Mycobacterium avium subsp. paratuberculosis
uugccgaucccggccagc

SEQ ID NO: 799339 - RNA, 16 nt, Mycobacterium avium subsp. paratuberculosis
uugccgacggcgccgg

SEQ ID NO: 799340 - RNA, 20 nt, Mycobacterium avium subsp. paratuberculosis
uugcccugguacgcgccguc

SEQ ID NO: 799341 - RNA, 16 nt, Mycobacterium avium subsp. paratuberculosis
uugccgcccucggccg

SEQ ID NO: 799342 - RNA, 19 nt, Mycobacterium avium subsp. paratuberculosis
uugccgcgacccgggccgc

SEQ ID NO: 799343 - RNA, 13 nt, Mycobacterium avium subsp. paratuberculosis
uugccgccggcgc

SEQ ID NO: 799344 - RNA, 14 nt, Mycobacterium avium subsp. paratuberculosis
uugccgccgccggg

SEQ ID NO: 799345 - RNA, 12 nt, Mycobacterium avium subsp. paratuberculosis
uugccgccgcgc

SEQ ID NO: 799346 - RNA, 19 nt, Mycobacterium avium subsp. paratuberculosis
uugccggauugcgagccgg

SEQ ID NO: 799347 - RNA, 13 nt, Mycobacterium avium subsp. paratuberculosis
uugccgggccaga

SEQ ID NO: 799348 - RNA, 18 nt, Mycobacterium avium subsp. paratuberculosis
uugccggugccgacgauc

SEQ ID NO: 799349 - RNA, 12 nt, Mycobacterium avium subsp. paratuberculosis
uugccggcggcg

SEQ ID NO: 799350 - RNA, 15 nt, Mycobacterium avium subsp. paratuberculosis
uugccggcggcgggc

SEQ ID NO: 799351 - RNA, 18 nt, Mycobacterium avium subsp. paratuberculosis
uugccggcuuccucgcgg

SEQ ID NO: 799352 - RNA, 15 nt, Mycobacterium avium subsp. paratuberculosis
uugccgugcucggcg

SEQ ID NO: 799353 - RNA, 16 nt, Mycobacterium avium subsp. paratuberculosis
uugccgugcucggcgg

SEQ ID NO: 799354 - RNA, 17 nt, Mycobacterium avium subsp. paratuberculosis
uugccgucgggacgcgg

SEQ ID NO: 799355 - RNA, 19 nt, Mycobacterium avium subsp. paratuberculosis
uugcgcaucagcgccacca

SEQ ID NO: 799356 - RNA, 17 nt, Mycobacterium avium subsp. paratuberculosis
uugcagcuuggcggugg

SEQ ID NO: 799357 - RNA, 21 nt, Mycobacterium avium subsp. paratuberculosis
uugcaccaccgucuugccguu

SEQ ID NO: 799358 - RNA, 16 nt, Mycobacterium avium subsp. paratuberculosis
uugcacacccggugcg

SEQ ID NO: 799359 - RNA, 13 nt, Mycobacterium avium subsp. paratuberculosis
uugcacggcggcg

SEQ ID NO: 799360 - RNA, 19 nt, Mycobacterium avium subsp. paratuberculosis
uucuguugucggcucgccg

SEQ ID NO: 799361 - RNA, 15 nt, Mycobacterium avium subsp. paratuberculosis
uucuucagggcggug

SEQ ID NO: 799362 - RNA, 17 nt, Mycobacterium avium subsp. paratuberculosis
uugaugaugccggccgc

SEQ ID NO: 799363 - RNA, 19 nt, Mycobacterium avium subsp. paratuberculosis
uugaugaacacggucgccg

SEQ ID NO: 799364 - RNA, 20 nt, Mycobacterium avium subsp. paratuberculosis
uugaugaacacggucgccgg

SEQ ID NO: 799365 - RNA, 14 nt, Mycobacterium avium subsp. paratuberculosis
uugaugucggccag

SEQ ID NO: 799366 - RNA, 18 nt, Mycobacterium avium subsp. paratuberculosis
ugcucagcgggaagccga

SEQ ID NO: 799367 - RNA, 14 nt, Mycobacterium avium subsp. paratuberculosis
ugcgugacgggcug

SEQ ID NO: 799368 - RNA, 12 nt, Mycobacterium avium subsp. paratuberculosis
ugcguguggcgc

SEQ ID NO: 799369 - RNA, 19 nt, Mycobacterium avium subsp. paratuberculosis
ugcucaugagcccuccagc

SEQ ID NO: 799370 - RNA, 21 nt, Mycobacterium avium subsp. paratuberculosis
ugcucgaucucggccaccguc

SEQ ID NO: 799371 - RNA, 13 nt, Mycobacterium avium subsp. paratuberculosis
ugcucgaccagau

SEQ ID NO: 799372 - RNA, 17 nt, Mycobacterium avium subsp. paratuberculosis
ugcucgaccagcgccga

SEQ ID NO: 799373 - RNA, 19 nt, Mycobacterium avium subsp. paratuberculosis
ugcucgaccagcgccgagg

SEQ ID NO: 799374 - RNA, 20 nt, Mycobacterium avium subsp. paratuberculosis
ugcucgaccucggcgaccag

SEQ ID NO: 799375 - RNA, 13 nt, Mycobacterium avium subsp. paratuberculosis
ugcucgacacgau

SEQ ID NO: 799376 - RNA, 21 nt, Mycobacterium avium subsp. paratuberculosis
ugcucgaaccgcgagacccgg

SEQ ID NO: 799377 - RNA, 22 nt, Mycobacterium avium subsp. paratuberculosis
ugcucgaaccgcgagacccggu

SEQ ID NO: 799378 - RNA, 16 nt, Mycobacterium avium subsp. paratuberculosis
ugcucgaacgcgccga

SEQ ID NO: 799379 - RNA, 20 nt, Mycobacterium avium subsp. paratuberculosis
ugcucgaagcuuucggugcg

SEQ ID NO: 799380 - RNA, 16 nt, Mycobacterium avium subsp. paratuberculosis
ugcucgccggcgcgga

SEQ ID NO: 799381 - RNA, 17 nt, Mycobacterium avium subsp. paratuberculosis
ugcucgccggcuaccgg

SEQ ID NO: 799382 - RNA, 14 nt, Mycobacterium avium subsp. paratuberculosis
ugcugcacgacgac

SEQ ID NO: 799383 - RNA, 17 nt, Mycobacterium avium subsp. paratuberculosis
ugcugcacgacgaccgc

SEQ ID NO: 799384 - RNA, 18 nt, Mycobacterium avium subsp. paratuberculosis
ugcugauccacgcccgga

SEQ ID NO: 799385 - RNA, 18 nt, Mycobacterium avium subsp. paratuberculosis
ugcugauacccgcgcggc

SEQ ID NO: 799386 - RNA, 14 nt, Mycobacterium avium subsp. paratuberculosis
ugcucggccaccgc

SEQ ID NO: 799387 - RNA, 18 nt, Mycobacterium avium subsp. paratuberculosis
ugcucggccaccgcgcgg

SEQ ID NO: 799388 - RNA, 18 nt, Mycobacterium avium subsp. paratuberculosis
ugcucgcuugccagccgg

SEQ ID NO: 799389 - RNA, 17 nt, Mycobacterium avium subsp. paratuberculosis
ugcucggaggaaccgug

SEQ ID NO: 799390 - RNA, 15 nt, Mycobacterium avium subsp. paratuberculosis
ugcucgcgccgggcg

SEQ ID NO: 799391 - RNA, 19 nt, Mycobacterium avium subsp. paratuberculosis
ugcucgcgggccaccgcgg

SEQ ID NO: 799392 - RNA, 20 nt, Mycobacterium avium subsp. paratuberculosis
ugcucgcgggccaccgcggc

SEQ ID NO: 799393 - RNA, 22 nt, Mycobacterium avium subsp. paratuberculosis
uggaaaguccuucucgggcaau

SEQ ID NO: 799394 - RNA, 15 nt, Mycobacterium avium subsp. paratuberculosis
uggaaaucgagcgcg

SEQ ID NO: 799395 - RNA, 20 nt, Mycobacterium avium subsp. paratuberculosis
uggaaaccucuugcggcgca

SEQ ID NO: 799396 - RNA, 15 nt, Mycobacterium avium subsp. paratuberculosis
uggaacacgcccagc

SEQ ID NO: 799397 - RNA, 19 nt, Mycobacterium avium subsp. paratuberculosis
ugcuuucgcgucugcucgc

SEQ ID NO: 799398 - RNA, 14 nt, Mycobacterium avium subsp. paratuberculosis
ugcuucgucgccgg

SEQ ID NO: 799399 - RNA, 17 nt, Mycobacterium avium subsp. paratuberculosis
ugcuugccgucgacgcg

SEQ ID NO: 799400 - RNA, 16 nt, Mycobacterium avium subsp. paratuberculosis
ugcuucgggucgccgg

SEQ ID NO: 799401 - RNA, 17 nt, Mycobacterium avium subsp. paratuberculosis
ugcugcguucggcgauc

SEQ ID NO: 799402 - RNA, 23 nt, Mycobacterium avium subsp. paratuberculosis
ugcugcucgagggccuccaccac

SEQ ID NO: 799403 - RNA, 16 nt, Mycobacterium avium subsp. paratuberculosis
ugcugcggcuccacga

SEQ ID NO: 799404 - RNA, 16 nt, Mycobacterium avium subsp. paratuberculosis
ugcugcagcgcccggg

SEQ ID NO: 799405 - RNA, 17 nt, Mycobacterium avium subsp. paratuberculosis
ugcuggaaucgcggauc

SEQ ID NO: 799406 - RNA, 16 nt, Mycobacterium avium subsp. paratuberculosis
ugcggcaacagcacca

SEQ ID NO: 799407 - RNA, 14 nt, Mycobacterium avium subsp. paratuberculosis
ugcggcaacccgau

SEQ ID NO: 799408 - RNA, 13 nt, Mycobacterium avium subsp. paratuberculosis
ugcggcacaccag

SEQ ID NO: 799409 - RNA, 15 nt, Mycobacterium avium subsp. paratuberculosis
ugcggcaccggcgaa

SEQ ID NO: 799410 - RNA, 20 nt, Mycobacterium avium subsp. paratuberculosis
ugcggcaccagucgcgcagc

SEQ ID NO: 799411 - RNA, 17 nt, Mycobacterium avium subsp. paratuberculosis
ugcgcuugucagcggcc

SEQ ID NO: 799412 - RNA, 23 nt, Mycobacterium avium subsp. paratuberculosis
ugcggaucgggcguggcgucggu

SEQ ID NO: 799413 - RNA, 20 nt, Mycobacterium avium subsp. paratuberculosis
ugcggaucggugcaggccgc

SEQ ID NO: 799414 - RNA, 15 nt, Mycobacterium avium subsp. paratuberculosis
ugcggaucucgaccu

SEQ ID NO: 799415 - RNA, 18 nt, Mycobacterium avium subsp. paratuberculosis
ugcgccgucaucgacacc

SEQ ID NO: 799416 - RNA, 15 nt, Mycobacterium avium subsp. paratuberculosis
ugcgccgucccggac

SEQ ID NO: 799417 - RNA, 17 nt, Mycobacterium avium subsp. paratuberculosis
ugcgccgucccggacgc

SEQ ID NO: 799418 - RNA, 24 nt, Mycobacterium avium subsp. paratuberculosis
ugcgccgucccggacgcugcggua

SEQ ID NO: 799419 - RNA, 20 nt, Mycobacterium avium subsp. paratuberculosis
ugcgccguccggccacgacc

SEQ ID NO: 799420 - RNA, 13 nt, Mycobacterium avium subsp. paratuberculosis
ugcgccgguucgc

SEQ ID NO: 799421 - RNA, 19 nt, Mycobacterium avium subsp. paratuberculosis
ugcgccgguucgcuggcgg

SEQ ID NO: 799422 - RNA, 18 nt, Mycobacterium avium subsp. paratuberculosis
ugcgccgucaccggcugc

SEQ ID NO: 799423 - RNA, 13 nt, Mycobacterium avium subsp. paratuberculosis
ugcgcuugcggcg

SEQ ID NO: 799424 - RNA, 21 nt, Mycobacterium avium subsp. paratuberculosis
ugcgccucgaucaacgccggg

SEQ ID NO: 799425 - RNA, 15 nt, Mycobacterium avium subsp. paratuberculosis
ugcggcgcugccggc

SEQ ID NO: 799426 - RNA, 16 nt, Mycobacterium avium subsp. paratuberculosis
ugcggccgccggccag

SEQ ID NO: 799427 - RNA, 18 nt, Mycobacterium avium subsp. paratuberculosis
ugcggccgcgacgcgcgg

SEQ ID NO: 799428 - RNA, 18 nt, Mycobacterium avium subsp. paratuberculosis
ugcggcgggcucggacga

SEQ ID NO: 799429 - RNA, 19 nt, Mycobacterium avium subsp. paratuberculosis
ugcggcgggcucggacgac

SEQ ID NO: 799430 - RNA, 17 nt, Mycobacterium avium subsp. paratuberculosis
ugcggcggcagucgcag

SEQ ID NO: 799431 - RNA, 18 nt, Mycobacterium avium subsp. paratuberculosis
ugcggcggccgcagcgug

SEQ ID NO: 799432 - RNA, 23 nt, Mycobacterium avium subsp. paratuberculosis
ugcggcggccggccagcagccgg

SEQ ID NO: 799433 - RNA, 19 nt, Mycobacterium avium subsp. paratuberculosis
ugcggccgcuucccacccg

SEQ ID NO: 799434 - RNA, 16 nt, Mycobacterium avium subsp. paratuberculosis
ugcggccggaaucucg

SEQ ID NO: 799435 - RNA, 15 nt, Mycobacterium avium subsp. paratuberculosis
ugcggccggaccacc

SEQ ID NO: 799436 - RNA, 18 nt, Mycobacterium avium subsp. paratuberculosis
ugcggccggaccacccag

SEQ ID NO: 799437 - RNA, 18 nt, Mycobacterium avium subsp. paratuberculosis
ugcggccggcgccggcgg

SEQ ID NO: 799438 - RNA, 13 nt, Mycobacterium avium subsp. paratuberculosis
ugcggccggcggg

SEQ ID NO: 799439 - RNA, 17 nt, Mycobacterium avium subsp. paratuberculosis
ugcggccggggcagacc

SEQ ID NO: 799440 - RNA, 17 nt, Mycobacterium avium subsp. paratuberculosis
ugcggcgcucggugugc

SEQ ID NO: 799441 - RNA, 12 nt, Mycobacterium avium subsp. paratuberculosis
ugcggcccgacc

SEQ ID NO: 799442 - RNA, 14 nt, Mycobacterium avium subsp. paratuberculosis
ugcggcccgacccg

SEQ ID NO: 799443 - RNA, 15 nt, Mycobacterium avium subsp. paratuberculosis
ugcggcccgacccgg

SEQ ID NO: 799444 - RNA, 17 nt, Mycobacterium avium subsp. paratuberculosis
ugcggcccgacccgguc

SEQ ID NO: 799445 - RNA, 16 nt, Mycobacterium avium subsp. paratuberculosis
ugcggcacgccgacca

SEQ ID NO: 799446 - RNA, 19 nt, Mycobacterium avium subsp. paratuberculosis
ugcggcacgccgaccaccc

SEQ ID NO: 799447 - RNA, 14 nt, Mycobacterium avium subsp. paratuberculosis
ugcggcacggugcg

SEQ ID NO: 799448 - RNA, 16 nt, Mycobacterium avium subsp. paratuberculosis
ugcggcccgccgggcg

SEQ ID NO: 799449 - RNA, 20 nt, Mycobacterium avium subsp. paratuberculosis
ugcggcccgccgggcgucgc

SEQ ID NO: 799450 - RNA, 18 nt, Mycobacterium avium subsp. paratuberculosis
ugcggcccgcggcaucgu

SEQ ID NO: 799451 - RNA, 23 nt, Mycobacterium avium subsp. paratuberculosis
ugcggcccgcggcaucgucgggg

SEQ ID NO: 799452 - RNA, 13 nt, Mycobacterium avium subsp. paratuberculosis
ugcggcccggcac

SEQ ID NO: 799453 - RNA, 11 nt, Mycobacterium avium subsp. paratuberculosis
ugcggcccguc

SEQ ID NO: 799454 - RNA, 17 nt, Mycobacterium avium subsp. paratuberculosis
ugcggcccgucgccgug

SEQ ID NO: 799455 - RNA, 22 nt, Mycobacterium avium subsp. paratuberculosis
ugcggcccugguugagcaccgc

SEQ ID NO: 799456 - RNA, 16 nt, Mycobacterium avium subsp. paratuberculosis
ugcggcccuugcggcc

SEQ ID NO: 799457 - RNA, 18 nt, Mycobacterium avium subsp. paratuberculosis
ugcggcccuugcggccga

SEQ ID NO: 799458 - RNA, 20 nt, Mycobacterium avium subsp. paratuberculosis
ugcggcccuugcggccgauc

SEQ ID NO: 799459 - RNA, 13 nt, Mycobacterium avium subsp. paratuberculosis
ugcggcugcauca

SEQ ID NO: 799460 - RNA, 19 nt, Mycobacterium avium subsp. paratuberculosis
ugcggcugguagaugccga

SEQ ID NO: 799461 - RNA, 20 nt, Mycobacterium avium subsp. paratuberculosis
ugcggcugcccaggaucacc

SEQ ID NO: 799462 - RNA, 20 nt, Mycobacterium avium subsp. paratuberculosis
ugcggcugcgcguucggcgc

SEQ ID NO: 799463 - RNA, 13 nt, Mycobacterium avium subsp. paratuberculosis
ugcggcucggcgc

SEQ ID NO: 799464 - RNA, 16 nt, Mycobacterium avium subsp. paratuberculosis
ugcggcucggcgcuga

SEQ ID NO: 799465 - RNA, 16 nt, Mycobacterium avium subsp. paratuberculosis
ugcggcucgucggcga

SEQ ID NO: 799466 - RNA, 18 nt, Mycobacterium avium subsp. paratuberculosis
ugcggcuccacgaaguca

SEQ ID NO: 799467 - RNA, 16 nt, Mycobacterium avium subsp. paratuberculosis
ugcggcucccaccgug

SEQ ID NO: 799468 - RNA, 17 nt, Mycobacterium avium subsp. paratuberculosis
ugcgggugucgccggug

SEQ ID NO: 799469 - RNA, 18 nt, Mycobacterium avium subsp. paratuberculosis
ugcgggugguccacccag

SEQ ID NO: 799470 - RNA, 13 nt, Mycobacterium avium subsp. paratuberculosis
ugcgggugcggcc

SEQ ID NO: 799471 - RNA, 16 nt, Mycobacterium avium subsp. paratuberculosis
ugcgggugcggccggu

SEQ ID NO: 799472 - RNA, 19 nt, Mycobacterium avium subsp. paratuberculosis
ugcggguugcgggccaggc

SEQ ID NO: 799473 - RNA, 17 nt, Mycobacterium avium subsp. paratuberculosis
ugcggguuggcgccggu

SEQ ID NO: 799474 - RNA, 18 nt, Mycobacterium avium subsp. paratuberculosis
ugcgggugauccagcccu

SEQ ID NO: 799475 - RNA, 15 nt, Mycobacterium avium subsp. paratuberculosis
ugcgggucucgccca

SEQ ID NO: 799476 - RNA, 15 nt, Mycobacterium avium subsp. paratuberculosis
ugcgggucggcguca

SEQ ID NO: 799477 - RNA, 22 nt, Mycobacterium avium subsp. paratuberculosis
ugcggguccaucgccucgacca

SEQ ID NO: 799478 - RNA, 12 nt, Mycobacterium avium subsp. paratuberculosis
ugcgggcgaacg

SEQ ID NO: 799479 - RNA, 11 nt, Mycobacterium avium subsp. paratuberculosis
ugcgggcccac

SEQ ID NO: 799480 - RNA, 15 nt, Mycobacterium avium subsp. paratuberculosis
ugcgggcccaccgcg

SEQ ID NO: 799481 - RNA, 12 nt, Mycobacterium avium subsp. paratuberculosis
ugcgggcccgca

SEQ ID NO: 799482 - RNA, 15 nt, Mycobacterium avium subsp. paratuberculosis
ugcgggcaucggcug

SEQ ID NO: 799483 - RNA, 15 nt, Mycobacterium avium subsp. paratuberculosis
ugcgggacugggcga

SEQ ID NO: 799484 - RNA, 20 nt, Mycobacterium avium subsp. paratuberculosis
ugcgggagaaaugggccagg

SEQ ID NO: 799485 - RNA, 16 nt, Mycobacterium avium subsp. paratuberculosis
ugcgggaccagcgccu

SEQ ID NO: 799486 - RNA, 13 nt, Mycobacterium avium subsp. paratuberculosis
ugcgggacgccgu

SEQ ID NO: 799487 - RNA, 18 nt, Mycobacterium avium subsp. paratuberculosis
ugcgggccaggucgagcg

SEQ ID NO: 799488 - RNA, 19 nt, Mycobacterium avium subsp. paratuberculosis
ugcggggccucgucgccgc

SEQ ID NO: 799489 - RNA, 22 nt, Mycobacterium avium subsp. paratuberculosis
ugcggggaggucgucgcgucca

SEQ ID NO: 799490 - RNA, 17 nt, Mycobacterium avium subsp. paratuberculosis
ugcgggcgggccgccag

SEQ ID NO: 799491 - RNA, 20 nt, Mycobacterium avium subsp. paratuberculosis
ugcgggcggggcccgggccg

SEQ ID NO: 799492 - RNA, 18 nt, Mycobacterium avium subsp. paratuberculosis
ugcgggcguccuugacca

SEQ ID NO: 799493 - RNA, 16 nt, Mycobacterium avium subsp. paratuberculosis
ugcgggcggcgcggcg

SEQ ID NO: 799494 - RNA, 12 nt, Mycobacterium avium subsp. paratuberculosis
ugcgggcgaugg

SEQ ID NO: 799495 - RNA, 20 nt, Mycobacterium avium subsp. paratuberculosis
ugcgguugccccaccccgga

SEQ ID NO: 799496 - RNA, 17 nt, Mycobacterium avium subsp. paratuberculosis
ugcgguugagcaccagc

SEQ ID NO: 799497 - RNA, 19 nt, Mycobacterium avium subsp. paratuberculosis
ugcgguugagcaccagccc

SEQ ID NO: 799498 - RNA, 20 nt, Mycobacterium avium subsp. paratuberculosis
ugcgguuggcccgcggcgcc

SEQ ID NO: 799499 - RNA, 14 nt, Mycobacterium avium subsp. paratuberculosis
ugcgguuggccgga

SEQ ID NO: 799500 - RNA, 19 nt, Mycobacterium avium subsp. paratuberculosis
ugcgguuggccggaaucgc

SEQ ID NO: 799501 - RNA, 16 nt, Mycobacterium avium subsp. paratuberculosis
ugcgucggcaccagcg

SEQ ID NO: 799502 - RNA, 13 nt, Mycobacterium avium subsp. paratuberculosis
ugcgucgggcgcc

SEQ ID NO: 799503 - RNA, 15 nt, Mycobacterium avium subsp. paratuberculosis
ugcgucgggcgccgg

SEQ ID NO: 799504 - RNA, 23 nt, Mycobacterium avium subsp. paratuberculosis
ugcgucgggcgccggcgcguccg

SEQ ID NO: 799505 - RNA, 13 nt, Mycobacterium avium subsp. paratuberculosis
ugcgucugcucgc

SEQ ID NO: 799506 - RNA, 14 nt, Mycobacterium avium subsp. paratuberculosis
ugcguccggcccgg

SEQ ID NO: 799507 - RNA, 22 nt, Mycobacterium avium subsp. paratuberculosis
ugcgucuuuucccacacgcucg

SEQ ID NO: 799508 - RNA, 23 nt, Mycobacterium avium subsp. paratuberculosis
ugcgucugcuugugaaugggcug

SEQ ID NO: 799509 - RNA, 19 nt, Mycobacterium avium subsp. paratuberculosis
ugcggucgaugacgccgcg

SEQ ID NO: 799510 - RNA, 23 nt, Mycobacterium avium subsp. paratuberculosis
ugcggucgaugacgccgcgccgc

SEQ ID NO: 799511 - RNA, 12 nt, Mycobacterium avium subsp. paratuberculosis
ugcggucggcgc

SEQ ID NO: 799512 - RNA, 12 nt, Mycobacterium avium subsp. paratuberculosis
ugcggugacgau

SEQ ID NO: 799513 - RNA, 17 nt, Mycobacterium avium subsp. paratuberculosis
ugcgguccucgagcugg

SEQ ID NO: 799514 - RNA, 17 nt, Mycobacterium avium subsp. paratuberculosis
ugcggugaugcgcggcg

SEQ ID NO: 799515 - RNA, 17 nt, Mycobacterium avium subsp. paratuberculosis
ugcggugcaccgcggcg

SEQ ID NO: 799516 - RNA, 21 nt, Mycobacterium avium subsp. paratuberculosis
ugcggugcaccgcggcgcgca

SEQ ID NO: 799517 - RNA, 13 nt, Mycobacterium avium subsp. paratuberculosis
ugcgguggucgaa

SEQ ID NO: 799518 - RNA, 18 nt, Mycobacterium avium subsp. paratuberculosis
ugcgguggucgaaaucgc

SEQ ID NO: 799519 - RNA, 13 nt, Mycobacterium avium subsp. paratuberculosis
ugcgguggucggc

SEQ ID NO: 799520 - RNA, 20 nt, Mycobacterium avium subsp. paratuberculosis
ugcggugcaucgucgcggcg

SEQ ID NO: 799521 - RNA, 14 nt, Mycobacterium avium subsp. paratuberculosis
ugcggugccgggcc

SEQ ID NO: 799522 - RNA, 13 nt, Mycobacterium avium subsp. paratuberculosis
ugcggugcgccgc

SEQ ID NO: 799523 - RNA, 12 nt, Mycobacterium avium subsp. paratuberculosis
ugcggugcggcc

SEQ ID NO: 799524 - RNA, 15 nt, Mycobacterium avium subsp. paratuberculosis
ugcggugcucgucga

SEQ ID NO: 799525 - RNA, 16 nt, Mycobacterium avium subsp. paratuberculosis
ugcggugcucgucgag

SEQ ID NO: 799526 - RNA, 18 nt, Mycobacterium avium subsp. paratuberculosis
ugcggugcucgucgagca

SEQ ID NO: 799527 - RNA, 16 nt, Mycobacterium avium subsp. paratuberculosis
ugcgguggccgaucag

SEQ ID NO: 799528 - RNA, 23 nt, Mycobacterium avium subsp. paratuberculosis
ugcgcaacaccucggcgacgucc

SEQ ID NO: 799529 - RNA, 19 nt, Mycobacterium avium subsp. paratuberculosis
ugcgauugguggcccgguc

SEQ ID NO: 799530 - RNA, 19 nt, Mycobacterium avium subsp. paratuberculosis
ugcgcaagcaccggcuggc

SEQ ID NO: 799531 - RNA, 15 nt, Mycobacterium avium subsp. paratuberculosis
ugcgaugguggucgc

SEQ ID NO: 799532 - RNA, 16 nt, Mycobacterium avium subsp. paratuberculosis
ugcgaugguggucgcc

SEQ ID NO: 799533 - RNA, 19 nt, Mycobacterium avium subsp. paratuberculosis
ugcgaugguggucgccguc

SEQ ID NO: 799534 - RNA, 15 nt, Mycobacterium avium subsp. paratuberculosis
ugcgaugucggugcg

SEQ ID NO: 799535 - RNA, 18 nt, Mycobacterium avium subsp. paratuberculosis
ugcgaauacccgcccagc

SEQ ID NO: 799536 - RNA, 22 nt, Mycobacterium avium subsp. paratuberculosis
ugcgagauggggugaugcgucc

SEQ ID NO: 799537 - RNA, 19 nt, Mycobacterium avium subsp. paratuberculosis
ugcgagaucggcagaccgg

SEQ ID NO: 799538 - RNA, 17 nt, Mycobacterium avium subsp. paratuberculosis
ugcgacuucuacggcgg

SEQ ID NO: 799539 - RNA, 16 nt, Mycobacterium avium subsp. paratuberculosis
ugcgacuugcgcgccg

SEQ ID NO: 799540 - RNA, 19 nt, Mycobacterium avium subsp. paratuberculosis
ugcgacuugguggccagca

SEQ ID NO: 799541 - RNA, 20 nt, Mycobacterium avium subsp. paratuberculosis
ugcgacggcucuucgcggcg

SEQ ID NO: 799542 - RNA, 21 nt, Mycobacterium avium subsp. paratuberculosis
ugcgacggcucuucgcggcgg

SEQ ID NO: 799543 - RNA, 17 nt, Mycobacterium avium subsp. paratuberculosis
ugcgaugaccacccucg

SEQ ID NO: 799544 - RNA, 14 nt, Mycobacterium avium subsp. paratuberculosis
ugcgagcaggccga

SEQ ID NO: 799545 - RNA, 20 nt, Mycobacterium avium subsp. paratuberculosis
ugcgagccaccucgaucagc

SEQ ID NO: 799546 - RNA, 12 nt, Mycobacterium avium subsp. paratuberculosis
ugcgagccagcu

SEQ ID NO: 799547 - RNA, 15 nt, Mycobacterium avium subsp. paratuberculosis
ugcgagcccggccag

SEQ ID NO: 799548 - RNA, 17 nt, Mycobacterium avium subsp. paratuberculosis
ugcgagcccggccaguc

SEQ ID NO: 799549 - RNA, 23 nt, Mycobacterium avium subsp. paratuberculosis
ugcgagccggagccuugcuggcg

SEQ ID NO: 799550 - RNA, 13 nt, Mycobacterium avium subsp. paratuberculosis
ugcgaucgcgucg

SEQ ID NO: 799551 - RNA, 12 nt, Mycobacterium avium subsp. paratuberculosis
ugccuugcgccc

SEQ ID NO: 799552 - RNA, 20 nt, Mycobacterium avium subsp. paratuberculosis
ugccuuggcccgcgcggccg

SEQ ID NO: 799553 - RNA, 17 nt, Mycobacterium avium subsp. paratuberculosis
ugccuuuccgcgcggcg

SEQ ID NO: 799554 - RNA, 13 nt, Mycobacterium avium subsp. paratuberculosis
ugcgaaucgucgg

SEQ ID NO: 799555 - RNA, 13 nt, Mycobacterium avium subsp. paratuberculosis
ugcgacgcccacu

SEQ ID NO: 799556 - RNA, 13 nt, Mycobacterium avium subsp. paratuberculosis
ugcgacgccgcgc

SEQ ID NO: 799557 - RNA, 15 nt, Mycobacterium avium subsp. paratuberculosis
ugcgacgccgcgcag

SEQ ID NO: 799558 - RNA, 22 nt, Mycobacterium avium subsp. paratuberculosis
ugcgacgccgcgcagcggggcg

SEQ ID NO: 799559 - RNA, 16 nt, Mycobacterium avium subsp. paratuberculosis
ugcgaacagccacggu

SEQ ID NO: 799560 - RNA, 21 nt, Mycobacterium avium subsp. paratuberculosis
ugccguuccagccggcccgca

SEQ ID NO: 799561 - RNA, 22 nt, Mycobacterium avium subsp. paratuberculosis
ugcgcacguaccgguacagcga

SEQ ID NO: 799562 - RNA, 18 nt, Mycobacterium avium subsp. paratuberculosis
ugcgcacguagcccagcg

SEQ ID NO: 799563 - RNA, 16 nt, Mycobacterium avium subsp. paratuberculosis
ugcgcacgucggccgc

SEQ ID NO: 799564 - RNA, 18 nt, Mycobacterium avium subsp. paratuberculosis
ugcgcacccccggggccu

SEQ ID NO: 799565 - RNA, 17 nt, Mycobacterium avium subsp. paratuberculosis
ugcgcaccacgucgggu

SEQ ID NO: 799566 - RNA, 21 nt, Mycobacterium avium subsp. paratuberculosis
ugcgcaccccguugccgccgg

SEQ ID NO: 799567 - RNA, 22 nt, Mycobacterium avium subsp. paratuberculosis
ugcgcaccccguugccgccggc

SEQ ID NO: 799568 - RNA, 12 nt, Mycobacterium avium subsp. paratuberculosis
ugcgcacccggu

SEQ ID NO: 799569 - RNA, 15 nt, Mycobacterium avium subsp. paratuberculosis
ugcgcacccgguccg

SEQ ID NO: 799570 - RNA, 23 nt, Mycobacterium avium subsp. paratuberculosis
ugcgcaccgcggauuccagcgcg

SEQ ID NO: 799571 - RNA, 20 nt, Mycobacterium avium subsp. paratuberculosis
ugcgcaccugcuccucgaac

SEQ ID NO: 799572 - RNA, 18 nt, Mycobacterium avium subsp. paratuberculosis
ugcgccagcgugaacagc

SEQ ID NO: 799573 - RNA, 15 nt, Mycobacterium avium subsp. paratuberculosis
ugcgccagcgccggg

SEQ ID NO: 799574 - RNA, 13 nt, Mycobacterium avium subsp. paratuberculosis
ugcgccagcucca

SEQ ID NO: 799575 - RNA, 14 nt, Mycobacterium avium subsp. paratuberculosis
ugcgccaggauccg

SEQ ID NO: 799576 - RNA, 18 nt, Mycobacterium avium subsp. paratuberculosis
ugcgccaggauccgcccg

SEQ ID NO: 799577 - RNA, 21 nt, Mycobacterium avium subsp. paratuberculosis
ugcgccaggauccgcccgccg

SEQ ID NO: 799578 - RNA, 13 nt, Mycobacterium avium subsp. paratuberculosis
ugcgccagcgccg

SEQ ID NO: 799579 - RNA, 18 nt, Mycobacterium avium subsp. paratuberculosis
ugcgccagcgacggccgg

SEQ ID NO: 799580 - RNA, 15 nt, Mycobacterium avium subsp. paratuberculosis
ugcgccaccgacacc

SEQ ID NO: 799581 - RNA, 22 nt, Mycobacterium avium subsp. paratuberculosis
ugcgccaccgacaccaccggcc

SEQ ID NO: 799582 - RNA, 13 nt, Mycobacterium avium subsp. paratuberculosis
ugcgccacugcgg

SEQ ID NO: 799583 - RNA, 14 nt, Mycobacterium avium subsp. paratuberculosis
ugcgccagcaccga

SEQ ID NO: 799584 - RNA, 13 nt, Mycobacterium avium subsp. paratuberculosis
ugcgccagcagca

SEQ ID NO: 799585 - RNA, 21 nt, Mycobacterium avium subsp. paratuberculosis
ugcgccagcagcaacgcggug

SEQ ID NO: 799586 - RNA, 21 nt, Mycobacterium avium subsp. paratuberculosis
ugcgccagcagcagcgcggca

SEQ ID NO: 799587 - RNA, 19 nt, Mycobacterium avium subsp. paratuberculosis
ugcgccagcagggcaucuc

SEQ ID NO: 799588 - RNA, 15 nt, Mycobacterium avium subsp. paratuberculosis
ugcgccgauggugcc

SEQ ID NO: 799589 - RNA, 16 nt, Mycobacterium avium subsp. paratuberculosis
ugcgccgaggucaccg

SEQ ID NO: 799590 - RNA, 23 nt, Mycobacterium avium subsp. paratuberculosis
ugcgccgacagcugagcagcccg

SEQ ID NO: 799591 - RNA, 19 nt, Mycobacterium avium subsp. paratuberculosis
ugcgccgaccgcgaucgag

SEQ ID NO: 799592 - RNA, 12 nt, Mycobacterium avium subsp. paratuberculosis
ugcgccggcggu

SEQ ID NO: 799593 - RNA, 15 nt, Mycobacterium avium subsp. paratuberculosis
ugcgccggcggugcg

SEQ ID NO: 799594 - RNA, 10 nt, Mycobacterium avium subsp. paratuberculosis
ugcgcccggc

SEQ ID NO: 799595 - RNA, 19 nt, Mycobacterium avium subsp. paratuberculosis
ugcgcccggccagccggua

SEQ ID NO: 799596 - RNA, 16 nt, Mycobacterium avium subsp. paratuberculosis
ugcgcccggucacccg

SEQ ID NO: 799597 - RNA, 15 nt, Mycobacterium avium subsp. paratuberculosis
ugcgcccgucggugg

SEQ ID NO: 799598 - RNA, 18 nt, Mycobacterium avium subsp. paratuberculosis
ugcgcccgucgucgccga

SEQ ID NO: 799599 - RNA, 21 nt, Mycobacterium avium subsp. paratuberculosis
ugcgcccgccgaacaccggca

SEQ ID NO: 799600 - RNA, 17 nt, Mycobacterium avium subsp. paratuberculosis
ugcgcccgccgccacca

SEQ ID NO: 799601 - RNA, 14 nt, Mycobacterium avium subsp. paratuberculosis
ugcgcccgcgauca

SEQ ID NO: 799602 - RNA, 13 nt, Mycobacterium avium subsp. paratuberculosis
ugcgcccgacgcc

SEQ ID NO: 799603 - RNA, 15 nt, Mycobacterium avium subsp. paratuberculosis
ugcgcccgacgccgg

SEQ ID NO: 799604 - RNA, 16 nt, Mycobacterium avium subsp. paratuberculosis
ugcgcccgacgccgga

SEQ ID NO: 799605 - RNA, 16 nt, Mycobacterium avium subsp. paratuberculosis
ugcgcccagaugccgg

SEQ ID NO: 799606 - RNA, 18 nt, Mycobacterium avium subsp. paratuberculosis
ugcgcccagaugccggcg

SEQ ID NO: 799607 - RNA, 15 nt, Mycobacterium avium subsp. paratuberculosis
ugcgccaguggggga

SEQ ID NO: 799608 - RNA, 18 nt, Mycobacterium avium subsp. paratuberculosis
ugcgccaguuugccgucg

SEQ ID NO: 799609 - RNA, 20 nt, Mycobacterium avium subsp. paratuberculosis
ugcgccaguuugccgucggg

SEQ ID NO: 799610 - RNA, 16 nt, Mycobacterium avium subsp. paratuberculosis
ugccgucgggacgcgg

SEQ ID NO: 799611 - RNA, 17 nt, Mycobacterium avium subsp. paratuberculosis
ugccgucgggacgcggc

SEQ ID NO: 799612 - RNA, 18 nt, Mycobacterium avium subsp. paratuberculosis
ugccgucgggacgcggca

SEQ ID NO: 799613 - RNA, 12 nt, Mycobacterium avium subsp. paratuberculosis
ugccgucguuga

SEQ ID NO: 799614 - RNA, 20 nt, Mycobacterium avium subsp. paratuberculosis
ugccgucguugacgcccucc

SEQ ID NO: 799615 - RNA, 23 nt, Mycobacterium avium subsp. paratuberculosis
ugccgucucgauaaacgguugcg

SEQ ID NO: 799616 - RNA, 14 nt, Mycobacterium avium subsp. paratuberculosis
ugccgucggugguc

SEQ ID NO: 799617 - RNA, 21 nt, Mycobacterium avium subsp. paratuberculosis
ugccgucggugguccagucga

SEQ ID NO: 799618 - RNA, 23 nt, Mycobacterium avium subsp. paratuberculosis
ugccgucgguuucggucgcggug

SEQ ID NO: 799619 - RNA, 17 nt, Mycobacterium avium subsp. paratuberculosis
ugccgucggcgcccggc

SEQ ID NO: 799620 - RNA, 16 nt, Mycobacterium avium subsp. paratuberculosis
ugccgucggccgccga

SEQ ID NO: 799621 - RNA, 17 nt, Mycobacterium avium subsp. paratuberculosis
ugccgucggccgccgac

SEQ ID NO: 799622 - RNA, 17 nt, Mycobacterium avium subsp. paratuberculosis
ugccguccuugucgcgc

SEQ ID NO: 799623 - RNA, 14 nt, Mycobacterium avium subsp. paratuberculosis
ugccguccggccgg

SEQ ID NO: 799624 - RNA, 14 nt, Mycobacterium avium subsp. paratuberculosis
ugccguccggcggc

SEQ ID NO: 799625 - RNA, 14 nt, Mycobacterium avium subsp. paratuberculosis
ugccgucgcgcucg

SEQ ID NO: 799626 - RNA, 20 nt, Mycobacterium avium subsp. paratuberculosis
ugccgucgcgcucgacgaug

SEQ ID NO: 799627 - RNA, 24 nt, Mycobacterium avium subsp. paratuberculosis
ugccgucgcgggcgucgggcagca

SEQ ID NO: 799628 - RNA, 13 nt, Mycobacterium avium subsp. paratuberculosis
ugccgucgacgaa

SEQ ID NO: 799629 - RNA, 13 nt, Mycobacterium avium subsp. paratuberculosis
ugccgucgacgac

SEQ ID NO: 799630 - RNA, 21 nt, Mycobacterium avium subsp. paratuberculosis
ugccgucgacgaccaccacca

SEQ ID NO: 799631 - RNA, 14 nt, Mycobacterium avium subsp. paratuberculosis
ugccgucgacgacg

SEQ ID NO: 799632 - RNA, 17 nt, Mycobacterium avium subsp. paratuberculosis
ugccgucgacgacgguc

SEQ ID NO: 799633 - RNA, 20 nt, Mycobacterium avium subsp. paratuberculosis
ugccggucuuguagucgacc

SEQ ID NO: 799634 - RNA, 22 nt, Mycobacterium avium subsp. paratuberculosis
ugccggugaugaacgcgccguc

SEQ ID NO: 799635 - RNA, 23 nt, Mycobacterium avium subsp. paratuberculosis
ugccggugaugaacgcgccgucg

SEQ ID NO: 799636 - RNA, 18 nt, Mycobacterium avium subsp. paratuberculosis
ugccggucgaugucggcg

SEQ ID NO: 799637 - RNA, 19 nt, Mycobacterium avium subsp. paratuberculosis
ugccggugcagaucgucca

SEQ ID NO: 799638 - RNA, 17 nt, Mycobacterium avium subsp. paratuberculosis
ugccggugcagcaccuc

SEQ ID NO: 799639 - RNA, 12 nt, Mycobacterium avium subsp. paratuberculosis
ugccggugccga

SEQ ID NO: 799640 - RNA, 23 nt, Mycobacterium avium subsp. paratuberculosis
ugccgguggauauuucgcggccg

SEQ ID NO: 799641 - RNA, 16 nt, Mycobacterium avium subsp. paratuberculosis
ugccguaaguggcgcc

SEQ ID NO: 799642 - RNA, 19 nt, Mycobacterium avium subsp. paratuberculosis
ugccguaaguggcgccgcg

SEQ ID NO: 799643 - RNA, 23 nt, Mycobacterium avium subsp. paratuberculosis
ugccgguggaacaguucggugcg

SEQ ID NO: 799644 - RNA, 15 nt, Mycobacterium avium subsp. paratuberculosis
ugccgguggacgagg

SEQ ID NO: 799645 - RNA, 15 nt, Mycobacterium avium subsp. paratuberculosis
ugccggugucggugc

SEQ ID NO: 799646 - RNA, 16 nt, Mycobacterium avium subsp. paratuberculosis
ugccggugucggugcg

SEQ ID NO: 799647 - RNA, 23 nt, Mycobacterium avium subsp. paratuberculosis
ugccgguggcguccuugccgauc

SEQ ID NO: 799648 - RNA, 19 nt, Mycobacterium avium subsp. paratuberculosis
ugccgguggucccggucag

SEQ ID NO: 799649 - RNA, 15 nt, Mycobacterium avium subsp. paratuberculosis
ugccgguguugccga

SEQ ID NO: 799650 - RNA, 18 nt, Mycobacterium avium subsp. paratuberculosis
ugccgguguugccgacgg

SEQ ID NO: 799651 - RNA, 21 nt, Mycobacterium avium subsp. paratuberculosis
ugccgguguugccgacggcgc

SEQ ID NO: 799652 - RNA, 16 nt, Mycobacterium avium subsp. paratuberculosis
ugccgggggccgagca

SEQ ID NO: 799653 - RNA, 17 nt, Mycobacterium avium subsp. paratuberculosis
ugccgggggccgagcag

SEQ ID NO: 799654 - RNA, 19 nt, Mycobacterium avium subsp. paratuberculosis
ugccggguuucggcccggc

SEQ ID NO: 799655 - RNA, 20 nt, Mycobacterium avium subsp. paratuberculosis
ugccggguuucggcccggcu

SEQ ID NO: 799656 - RNA, 21 nt, Mycobacterium avium subsp. paratuberculosis
ugccgggucgcagcggcacgu

SEQ ID NO: 799657 - RNA, 19 nt, Mycobacterium avium subsp. paratuberculosis
ugccgguacggccgacgcc

SEQ ID NO: 799658 - RNA, 23 nt, Mycobacterium avium subsp. paratuberculosis
ugccggucaagcgcuuucgccga

SEQ ID NO: 799659 - RNA, 22 nt, Mycobacterium avium subsp. paratuberculosis
ugccggucaggcauuccaccgc

SEQ ID NO: 799660 - RNA, 16 nt, Mycobacterium avium subsp. paratuberculosis
ugccggggcagcaccc

SEQ ID NO: 799661 - RNA, 13 nt, Mycobacterium avium subsp. paratuberculosis
ugccggggcgcag

SEQ ID NO: 799662 - RNA, 15 nt, Mycobacterium avium subsp. paratuberculosis
ugccggggcgcagcu

SEQ ID NO: 799663 - RNA, 23 nt, Mycobacterium avium subsp. paratuberculosis
ugccgggccgcauccagcgccgc

SEQ ID NO: 799664 - RNA, 15 nt, Mycobacterium avium subsp. paratuberculosis
ugccgggcggcgacg

SEQ ID NO: 799665 - RNA, 22 nt, Mycobacterium avium subsp. paratuberculosis
ugccgggcgguacgcgccgcgc

SEQ ID NO: 799666 - RNA, 17 nt, Mycobacterium avium subsp. paratuberculosis
ugccgggcgucgacgau

SEQ ID NO: 799667 - RNA, 22 nt, Mycobacterium avium subsp. paratuberculosis
ugccgggcaaccacagcggcgc

SEQ ID NO: 799668 - RNA, 19 nt, Mycobacterium avium subsp. paratuberculosis
ugccggcgguguccacgau

SEQ ID NO: 799669 - RNA, 17 nt, Mycobacterium avium subsp. paratuberculosis
ugccggcguagcagucg

SEQ ID NO: 799670 - RNA, 19 nt, Mycobacterium avium subsp. paratuberculosis
ugccggcggcggaccgucg

SEQ ID NO: 799671 - RNA, 19 nt, Mycobacterium avium subsp. paratuberculosis
ugccggcgauccgcgcggc

SEQ ID NO: 799672 - RNA, 21 nt, Mycobacterium avium subsp. paratuberculosis
ugccggcgauccgcgcggcga

SEQ ID NO: 799673 - RNA, 20 nt, Mycobacterium avium subsp. paratuberculosis
ugccggcgacgguggcgccc

SEQ ID NO: 799674 - RNA, 17 nt, Mycobacterium avium subsp. paratuberculosis
ugccggcgaucaccggg

SEQ ID NO: 799675 - RNA, 15 nt, Mycobacterium avium subsp. paratuberculosis
ugccggcggccagca

SEQ ID NO: 799676 - RNA, 13 nt, Mycobacterium avium subsp. paratuberculosis
ugccggcggccgc

SEQ ID NO: 799677 - RNA, 18 nt, Mycobacterium avium subsp. paratuberculosis
ugccggcggccgccggca

SEQ ID NO: 799678 - RNA, 23 nt, Mycobacterium avium subsp. paratuberculosis
ugccggcggccgccggcaccguc

SEQ ID NO: 799679 - RNA, 14 nt, Mycobacterium avium subsp. paratuberculosis
ugccggcgcucguc

SEQ ID NO: 799680 - RNA, 19 nt, Mycobacterium avium subsp. paratuberculosis
ugccggcgcucgucgucgc

SEQ ID NO: 799681 - RNA, 21 nt, Mycobacterium avium subsp. paratuberculosis
ugccggcgcugcccgucgacc

SEQ ID NO: 799682 - RNA, 21 nt, Mycobacterium avium subsp. paratuberculosis
ugccggcgcuucugcgccggu

SEQ ID NO: 799683 - RNA, 22 nt, Mycobacterium avium subsp. paratuberculosis
ugccggcgcuucugcgccgguu

SEQ ID NO: 799684 - RNA, 14 nt, Mycobacterium avium subsp. paratuberculosis
ugccggcgcacccg

SEQ ID NO: 799685 - RNA, 16 nt, Mycobacterium avium subsp. paratuberculosis
ugccggcgcacccgca

SEQ ID NO: 799686 - RNA, 14 nt, Mycobacterium avium subsp. paratuberculosis
ugccggcgcaccgc

SEQ ID NO: 799687 - RNA, 18 nt, Mycobacterium avium subsp. paratuberculosis
ugccggcgcaccgcgucg

SEQ ID NO: 799688 - RNA, 22 nt, Mycobacterium avium subsp. paratuberculosis
ugccggcgcaccgcgucgacca

SEQ ID NO: 799689 - RNA, 17 nt, Mycobacterium avium subsp. paratuberculosis
ugccggcgcccagcggc

SEQ ID NO: 799690 - RNA, 14 nt, Mycobacterium avium subsp. paratuberculosis
ugccggcgccgauu

SEQ ID NO: 799691 - RNA, 13 nt, Mycobacterium avium subsp. paratuberculosis
ugccggcgaccag

SEQ ID NO: 799692 - RNA, 14 nt, Mycobacterium avium subsp. paratuberculosis
ugccggccggggcg

SEQ ID NO: 799693 - RNA, 17 nt, Mycobacterium avium subsp. paratuberculosis
ugccggccggucgaagg

SEQ ID NO: 799694 - RNA, 20 nt, Mycobacterium avium subsp. paratuberculosis
ugccggccucgucggcgagc

SEQ ID NO: 799695 - RNA, 21 nt, Mycobacterium avium subsp. paratuberculosis
ugccggccucgucggcgagca

SEQ ID NO: 799696 - RNA, 21 nt, Mycobacterium avium subsp. paratuberculosis
ugccggccuggcccagccgcg

SEQ ID NO: 799697 - RNA, 14 nt, Mycobacterium avium subsp. paratuberculosis
ugcccuuggacacc

SEQ ID NO: 799698 - RNA, 16 nt, Mycobacterium avium subsp. paratuberculosis
ugcccuuggcggccac

SEQ ID NO: 799699 - RNA, 19 nt, Mycobacterium avium subsp. paratuberculosis
ugcccuugguguaggcgau

SEQ ID NO: 799700 - RNA, 18 nt, Mycobacterium avium subsp. paratuberculosis
ugccgaacaucagccgau

SEQ ID NO: 799701 - RNA, 13 nt, Mycobacterium avium subsp. paratuberculosis
ugccgaacagcga

SEQ ID NO: 799702 - RNA, 18 nt, Mycobacterium avium subsp. paratuberculosis
ugccgaacaacagggccg

SEQ ID NO: 799703 - RNA, 23 nt, Mycobacterium avium subsp. paratuberculosis
ugccgaacaacagggccgcgcgg

SEQ ID NO: 799704 - RNA, 16 nt, Mycobacterium avium subsp. paratuberculosis
ugccgaacagcgacgu

SEQ ID NO: 799705 - RNA, 15 nt, Mycobacterium avium subsp. paratuberculosis
ugccgaacaggcgca

SEQ ID NO: 799706 - RNA, 19 nt, Mycobacterium avium subsp. paratuberculosis
ugccgaccucgauggcgac

SEQ ID NO: 799707 - RNA, 17 nt, Mycobacterium avium subsp. paratuberculosis
ugccgaccugcgcgacg

SEQ ID NO: 799708 - RNA, 16 nt, Mycobacterium avium subsp. paratuberculosis
ugccgacccggcguag

SEQ ID NO: 799709 - RNA, 13 nt, Mycobacterium avium subsp. paratuberculosis
ugccgaccgacag

SEQ ID NO: 799710 - RNA, 21 nt, Mycobacterium avium subsp. paratuberculosis
ugccgacgaccucgucgucga

SEQ ID NO: 799711 - RNA, 22 nt, Mycobacterium avium subsp. paratuberculosis
ugccgacgaccucgucgucgau

SEQ ID NO: 799712 - RNA, 20 nt, Mycobacterium avium subsp. paratuberculosis
ugccgacgagcucgccgcug

SEQ ID NO: 799713 - RNA, 17 nt, Mycobacterium avium subsp. paratuberculosis
ugccgacgauccgggcg

SEQ ID NO: 799714 - RNA, 14 nt, Mycobacterium avium subsp. paratuberculosis
ugccgacggcgccg

SEQ ID NO: 799715 - RNA, 13 nt, Mycobacterium avium subsp. paratuberculosis
ugccgcucggcgc

SEQ ID NO: 799716 - RNA, 22 nt, Mycobacterium avium subsp. paratuberculosis
ugccgcucggcgcuccagcggg

SEQ ID NO: 799717 - RNA, 16 nt, Mycobacterium avium subsp. paratuberculosis
ugccgacggcgccggu

SEQ ID NO: 799718 - RNA, 17 nt, Mycobacterium avium subsp. paratuberculosis
ugccgacggcgccggug

SEQ ID NO: 799719 - RNA, 13 nt, Mycobacterium avium subsp. paratuberculosis
ugccgacggugcg

SEQ ID NO: 799720 - RNA, 21 nt, Mycobacterium avium subsp. paratuberculosis
ugccgacggugcgugccagca

SEQ ID NO: 799721 - RNA, 14 nt, Mycobacterium avium subsp. paratuberculosis
ugccgacggugucg

SEQ ID NO: 799722 - RNA, 19 nt, Mycobacterium avium subsp. paratuberculosis
ugccgcugugauagcggcg

SEQ ID NO: 799723 - RNA, 20 nt, Mycobacterium avium subsp. paratuberculosis
ugccgcugugauagcggcgu

SEQ ID NO: 799724 - RNA, 14 nt, Mycobacterium avium subsp. paratuberculosis
ugccgcuggcgucg

SEQ ID NO: 799725 - RNA, 18 nt, Mycobacterium avium subsp. paratuberculosis
ugccgcugggagcacgug

SEQ ID NO: 799726 - RNA, 19 nt, Mycobacterium avium subsp. paratuberculosis
ugccgcugggagcacguga

SEQ ID NO: 799727 - RNA, 18 nt, Mycobacterium avium subsp. paratuberculosis
ugccgcugguaggcggcg

SEQ ID NO: 799728 - RNA, 20 nt, Mycobacterium avium subsp. paratuberculosis
ugccgcugguaggcggcgca

SEQ ID NO: 799729 - RNA, 21 nt, Mycobacterium avium subsp. paratuberculosis
ugccgcugguaggcggcgcag

SEQ ID NO: 799730 - RNA, 18 nt, Mycobacterium avium subsp. paratuberculosis
ugccgcuggucaggccga

SEQ ID NO: 799731 - RNA, 14 nt, Mycobacterium avium subsp. paratuberculosis
ugccgcugcgccgg

SEQ ID NO: 799732 - RNA, 15 nt, Mycobacterium avium subsp. paratuberculosis
ugccggaugccgcgc

SEQ ID NO: 799733 - RNA, 17 nt, Mycobacterium avium subsp. paratuberculosis
ugccggaugccgcgcgg

SEQ ID NO: 799734 - RNA, 18 nt, Mycobacterium avium subsp. paratuberculosis
ugccggaugccgcgcggc

SEQ ID NO: 799735 - RNA, 14 nt, Mycobacterium avium subsp. paratuberculosis
ugccggaggcggcg

SEQ ID NO: 799736 - RNA, 21 nt, Mycobacterium avium subsp. paratuberculosis
ugccggaggcggcguagucgg

SEQ ID NO: 799737 - RNA, 16 nt, Mycobacterium avium subsp. paratuberculosis
ugccggaagcggcggu

SEQ ID NO: 799738 - RNA, 20 nt, Mycobacterium avium subsp. paratuberculosis
ugccggaacgagccggacau

SEQ ID NO: 799739 - RNA, 17 nt, Mycobacterium avium subsp. paratuberculosis
ugccggaccucgaccag

SEQ ID NO: 799740 - RNA, 19 nt, Mycobacterium avium subsp. paratuberculosis
ugccggacaccccggccag

SEQ ID NO: 799741 - RNA, 21 nt, Mycobacterium avium subsp. paratuberculosis
ugccggaaaaguucggcgggg

SEQ ID NO: 799742 - RNA, 16 nt, Mycobacterium avium subsp. paratuberculosis
ugccggcaaccgcugc

SEQ ID NO: 799743 - RNA, 18 nt, Mycobacterium avium subsp. paratuberculosis
ugccggcauaggccagca

SEQ ID NO: 799744 - RNA, 23 nt, Mycobacterium avium subsp. paratuberculosis
ugccggcauaggccagcaccagc

SEQ ID NO: 799745 - RNA, 22 nt, Mycobacterium avium subsp. paratuberculosis
ugccggccaaggcaagucgucg

SEQ ID NO: 799746 - RNA, 23 nt, Mycobacterium avium subsp. paratuberculosis
ugccggccaaggcaagucgucgg

SEQ ID NO: 799747 - RNA, 13 nt, Mycobacterium avium subsp. paratuberculosis
ugccggccaccgg

SEQ ID NO: 799748 - RNA, 18 nt, Mycobacterium avium subsp. paratuberculosis
ugccggccgccgcgcauc

SEQ ID NO: 799749 - RNA, 20 nt, Mycobacterium avium subsp. paratuberculosis
ugccggccgccgcgcauccg

SEQ ID NO: 799750 - RNA, 11 nt, Mycobacterium avium subsp. paratuberculosis
ugccggccgcg

SEQ ID NO: 799751 - RNA, 16 nt, Mycobacterium avium subsp. paratuberculosis
ugccggccaucugcug

SEQ ID NO: 799752 - RNA, 14 nt, Mycobacterium avium subsp. paratuberculosis
ugccggccgcgauc

SEQ ID NO: 799753 - RNA, 22 nt, Mycobacterium avium subsp. paratuberculosis
ugccggccggcagcugcccguc

SEQ ID NO: 799754 - RNA, 13 nt, Mycobacterium avium subsp. paratuberculosis
ugccggccggggc

SEQ ID NO: 799755 - RNA, 14 nt, Mycobacterium avium subsp. paratuberculosis
ugccggccagcggc

SEQ ID NO: 799756 - RNA, 18 nt, Mycobacterium avium subsp. paratuberculosis
ugccggccagaucgacgc

SEQ ID NO: 799757 - RNA, 15 nt, Mycobacterium avium subsp. paratuberculosis
ugccggccagcggcc

SEQ ID NO: 799758 - RNA, 21 nt, Mycobacterium avium subsp. paratuberculosis
ugccggccagcucgccgccga

SEQ ID NO: 799759 - RNA, 22 nt, Mycobacterium avium subsp. paratuberculosis
ugccggccagcucgccgccgac

SEQ ID NO: 799760 - RNA, 21 nt, Mycobacterium avium subsp. paratuberculosis
ugccggccagcuuuccggccg

SEQ ID NO: 799761 - RNA, 22 nt, Mycobacterium avium subsp. paratuberculosis
ugccggccagcuuuccggccgc

SEQ ID NO: 799762 - RNA, 12 nt, Mycobacterium avium subsp. paratuberculosis
ugccggccaggc

SEQ ID NO: 799763 - RNA, 14 nt, Mycobacterium avium subsp. paratuberculosis
ugggcuaccagccc

SEQ ID NO: 799764 - RNA, 20 nt, Mycobacterium avium subsp. paratuberculosis
ugggcuaccagccccaggag

SEQ ID NO: 799765 - RNA, 13 nt, Mycobacterium avium subsp. paratuberculosis
ugggcuccucgac

SEQ ID NO: 799766 - RNA, 16 nt, Mycobacterium avium subsp. paratuberculosis
ugggcuccucgaccac

SEQ ID NO: 799767 - RNA, 13 nt, Mycobacterium avium subsp. paratuberculosis
ugggcucgaccac

SEQ ID NO: 799768 - RNA, 13 nt, Mycobacterium avium subsp. paratuberculosis
ugggcuccgaccg

SEQ ID NO: 799769 - RNA, 17 nt, Mycobacterium avium subsp. paratuberculosis
ugggcucggccaucccg

SEQ ID NO: 799770 - RNA, 21 nt, Mycobacterium avium subsp. paratuberculosis
ugggcugcaacaacuucgggg

SEQ ID NO: 799771 - RNA, 23 nt, Mycobacterium avium subsp. paratuberculosis
ugggcugcaacaacuucggggug

SEQ ID NO: 799772 - RNA, 13 nt, Mycobacterium avium subsp. paratuberculosis
ugggcgucgagug

SEQ ID NO: 799773 - RNA, 15 nt, Mycobacterium avium subsp. paratuberculosis
ugggcgucgagugug

SEQ ID NO: 799774 - RNA, 16 nt, Mycobacterium avium subsp. paratuberculosis
ugggcgucgucgauga

SEQ ID NO: 799775 - RNA, 14 nt, Mycobacterium avium subsp. paratuberculosis
ugggcguacgggcg

SEQ ID NO: 799776 - RNA, 16 nt, Mycobacterium avium subsp. paratuberculosis
ugggcggcgcccgaca

SEQ ID NO: 799777 - RNA, 22 nt, Mycobacterium avium subsp. paratuberculosis
ugggcgguccgcuccaccagcg

SEQ ID NO: 799778 - RNA, 15 nt, Mycobacterium avium subsp. paratuberculosis
ugggcuggccguccg

SEQ ID NO: 799779 - RNA, 17 nt, Mycobacterium avium subsp. paratuberculosis
ugggcugggucaccacg

SEQ ID NO: 799780 - RNA, 13 nt, Mycobacterium avium subsp. paratuberculosis
uggggacgacgcc

SEQ ID NO: 799781 - RNA, 18 nt, Mycobacterium avium subsp. paratuberculosis
uggggacgacgccgaacu

SEQ ID NO: 799782 - RNA, 17 nt, Mycobacterium avium subsp. paratuberculosis
uggggcaguagcgacgc

SEQ ID NO: 799783 - RNA, 20 nt, Mycobacterium avium subsp. paratuberculosis
uggggccgauguucaccccg

SEQ ID NO: 799784 - RNA, 19 nt, Mycobacterium avium subsp. paratuberculosis
uggggccgccgucuuccca

SEQ ID NO: 799785 - RNA, 19 nt, Mycobacterium avium subsp. paratuberculosis
uggggcagaucgucggcac

SEQ ID NO: 799786 - RNA, 19 nt, Mycobacterium avium subsp. paratuberculosis
uggggccgaagccgacacc

SEQ ID NO: 799787 - RNA, 20 nt, Mycobacterium avium subsp. paratuberculosis
uggggccgaagccgacaccg

SEQ ID NO: 799788 - RNA, 21 nt, Mycobacterium avium subsp. paratuberculosis
uggggccgaagccgacaccgg

SEQ ID NO: 799789 - RNA, 23 nt, Mycobacterium avium subsp. paratuberculosis
uggguguccuugcgcaccacguc

SEQ ID NO: 799790 - RNA, 17 nt, Mycobacterium avium subsp. paratuberculosis
ugguauccgaucgcggc

SEQ ID NO: 799791 - RNA, 15 nt, Mycobacterium avium subsp. paratuberculosis
ugguaguacaccggg

SEQ ID NO: 799792 - RNA, 15 nt, Mycobacterium avium subsp. paratuberculosis
ugguaggcggccggg

SEQ ID NO: 799793 - RNA, 14 nt, Mycobacterium avium subsp. paratuberculosis
ugguaggcggcgca

SEQ ID NO: 799794 - RNA, 13 nt, Mycobacterium avium subsp. paratuberculosis
ugggugcgcgggc

SEQ ID NO: 799795 - RNA, 16 nt, Mycobacterium avium subsp. paratuberculosis
ugggugcgcgggcgcc

SEQ ID NO: 799796 - RNA, 17 nt, Mycobacterium avium subsp. paratuberculosis
ugggugcucaccccggc

SEQ ID NO: 799797 - RNA, 18 nt, Mycobacterium avium subsp. paratuberculosis
ugggugcucccgccaaua

SEQ ID NO: 799798 - RNA, 13 nt, Mycobacterium avium subsp. paratuberculosis
uggguggccccuc

SEQ ID NO: 799799 - RNA, 21 nt, Mycobacterium avium subsp. paratuberculosis
uggguggccccucauugggac

SEQ ID NO: 799800 - RNA, 18 nt, Mycobacterium avium subsp. paratuberculosis
uggguggucugcugggcg

SEQ ID NO: 799801 - RNA, 15 nt, Mycobacterium avium subsp. paratuberculosis
ugggugaucgcggcc

SEQ ID NO: 799802 - RNA, 18 nt, Mycobacterium avium subsp. paratuberculosis
ugggugaucgcggcccgc

SEQ ID NO: 799803 - RNA, 13 nt, Mycobacterium avium subsp. paratuberculosis
ugggucucggcga

SEQ ID NO: 799804 - RNA, 16 nt, Mycobacterium avium subsp. paratuberculosis
ugggucugcggccggg

SEQ ID NO: 799805 - RNA, 21 nt, Mycobacterium avium subsp. paratuberculosis
ugggugccgacgagcucgccg

SEQ ID NO: 799806 - RNA, 14 nt, Mycobacterium avium subsp. paratuberculosis
uggggcgcaccgcc

SEQ ID NO: 799807 - RNA, 15 nt, Mycobacterium avium subsp. paratuberculosis
ugggggcgccgcggc

SEQ ID NO: 799808 - RNA, 23 nt, Mycobacterium avium subsp. paratuberculosis
ugggggccaggcgggugaucccg

SEQ ID NO: 799809 - RNA, 13 nt, Mycobacterium avium subsp. paratuberculosis
uggggucgcgggc

SEQ ID NO: 799810 - RNA, 14 nt, Mycobacterium avium subsp. paratuberculosis
uggggucgcgggcg

SEQ ID NO: 799811 - RNA, 16 nt, Mycobacterium avium subsp. paratuberculosis
uggggucgcgggcgcc

SEQ ID NO: 799812 - RNA, 17 nt, Mycobacterium avium subsp. paratuberculosis
uggggucgcgggcgccg

SEQ ID NO: 799813 - RNA, 15 nt, Mycobacterium avium subsp. paratuberculosis
uggcgucggccagcg

SEQ ID NO: 799814 - RNA, 18 nt, Mycobacterium avium subsp. paratuberculosis
uggcgucggccgggggcg

SEQ ID NO: 799815 - RNA, 13 nt, Mycobacterium avium subsp. paratuberculosis
ugggccagcgcgg

SEQ ID NO: 799816 - RNA, 15 nt, Mycobacterium avium subsp. paratuberculosis
ugggccagcgcggug

SEQ ID NO: 799817 - RNA, 21 nt, Mycobacterium avium subsp. paratuberculosis
ugggccaggaucucgucggga

SEQ ID NO: 799818 - RNA, 14 nt, Mycobacterium avium subsp. paratuberculosis
ugggccaucgccag

SEQ ID NO: 799819 - RNA, 23 nt, Mycobacterium avium subsp. paratuberculosis
ugggccaggccucccacagcgga

SEQ ID NO: 799820 - RNA, 16 nt, Mycobacterium avium subsp. paratuberculosis
ugggcccgccgucgac

SEQ ID NO: 799821 - RNA, 20 nt, Mycobacterium avium subsp. paratuberculosis
ugggcccgccgucgaccacg

SEQ ID NO: 799822 - RNA, 22 nt, Mycobacterium avium subsp. paratuberculosis
ugggcccgcgcaucccgucgac

SEQ ID NO: 799823 - RNA, 12 nt, Mycobacterium avium subsp. paratuberculosis
ugggcgacgucg

SEQ ID NO: 799824 - RNA, 24 nt, Mycobacterium avium subsp. paratuberculosis
ugggcgauccgcaggccgucgccg

SEQ ID NO: 799825 - RNA, 19 nt, Mycobacterium avium subsp. paratuberculosis
ugggccgcagcgcggcgac

SEQ ID NO: 799826 - RNA, 19 nt, Mycobacterium avium subsp. paratuberculosis
ugggcgaaucugucgaugg

SEQ ID NO: 799827 - RNA, 22 nt, Mycobacterium avium subsp. paratuberculosis
ugggcgaaucugucgauggcgg

SEQ ID NO: 799828 - RNA, 19 nt, Mycobacterium avium subsp. paratuberculosis
ugggcggcaccacccgguc

SEQ ID NO: 799829 - RNA, 21 nt, Mycobacterium avium subsp. paratuberculosis
ugggcggacgggaccacccgc

SEQ ID NO: 799830 - RNA, 15 nt, Mycobacterium avium subsp. paratuberculosis
ugggcggccaccaac

SEQ ID NO: 799831 - RNA, 17 nt, Mycobacterium avium subsp. paratuberculosis
ugggcgcguuggccggc

SEQ ID NO: 799832 - RNA, 16 nt, Mycobacterium avium subsp. paratuberculosis
ugggcgcgggccgcgu

SEQ ID NO: 799833 - RNA, 14 nt, Mycobacterium avium subsp. paratuberculosis
ugggcgccugcggu

SEQ ID NO: 799834 - RNA, 13 nt, Mycobacterium avium subsp. paratuberculosis
ugggcgccgucaa

SEQ ID NO: 799835 - RNA, 14 nt, Mycobacterium avium subsp. paratuberculosis
ugggcgccggcguc

SEQ ID NO: 799836 - RNA, 17 nt, Mycobacterium avium subsp. paratuberculosis
ugggcgccgccggcguc

SEQ ID NO: 799837 - RNA, 18 nt, Mycobacterium avium subsp. paratuberculosis
ugggcgcccgcggcgcgc

SEQ ID NO: 799838 - RNA, 23 nt, Mycobacterium avium subsp. paratuberculosis
ugggcgauugcguugaucgacgg

SEQ ID NO: 799839 - RNA, 16 nt, Mycobacterium avium subsp. paratuberculosis
uguacacagggcggcg

SEQ ID NO: 799840 - RNA, 15 nt, Mycobacterium avium subsp. paratuberculosis
ugguuuccacugcca

SEQ ID NO: 799841 - RNA, 19 nt, Mycobacterium avium subsp. paratuberculosis
ugguugcggccccgccagc

SEQ ID NO: 799842 - RNA, 16 nt, Mycobacterium avium subsp. paratuberculosis
ugguugcggcgggccg

SEQ ID NO: 799843 - RNA, 15 nt, Mycobacterium avium subsp. paratuberculosis
uggugggguagacgg

SEQ ID NO: 799844 - RNA, 13 nt, Mycobacterium avium subsp. paratuberculosis
uggugggcgcggu

SEQ ID NO: 799845 - RNA, 14 nt, Mycobacterium avium subsp. paratuberculosis
uggugggcgucgug

SEQ ID NO: 799846 - RNA, 16 nt, Mycobacterium avium subsp. paratuberculosis
uggugggcgugcaggc

SEQ ID NO: 799847 - RNA, 14 nt, Mycobacterium avium subsp. paratuberculosis
uggugggcgugccg

SEQ ID NO: 799848 - RNA, 19 nt, Mycobacterium avium subsp. paratuberculosis
uguaggacaggucgcggua

SEQ ID NO: 799849 - RNA, 14 nt, Mycobacterium avium subsp. paratuberculosis
uguaggacgccgca

SEQ ID NO: 799850 - RNA, 18 nt, Mycobacterium avium subsp. paratuberculosis
uguaggacgccgcaccgc

SEQ ID NO: 799851 - RNA, 15 nt, Mycobacterium avium subsp. paratuberculosis
uguagcggcggucgg

SEQ ID NO: 799852 - RNA, 14 nt, Mycobacterium avium subsp. paratuberculosis
uguagccgccggug

SEQ ID NO: 799853 - RNA, 18 nt, Mycobacterium avium subsp. paratuberculosis
uguagccugcggccugca

SEQ ID NO: 799854 - RNA, 20 nt, Mycobacterium avium subsp. paratuberculosis
uguagacguagugcagccgc

SEQ ID NO: 799855 - RNA, 18 nt, Mycobacterium avium subsp. paratuberculosis
uguagucgaccacccgca

SEQ ID NO: 799856 - RNA, 15 nt, Mycobacterium avium subsp. paratuberculosis
uguagucggcgaucg

SEQ ID NO: 799857 - RNA, 12 nt, Mycobacterium avium subsp. paratuberculosis
uggugcgccggg

SEQ ID NO: 799858 - RNA, 18 nt, Mycobacterium avium subsp. paratuberculosis
uggugcgccgggucgcgg

SEQ ID NO: 799859 - RNA, 20 nt, Mycobacterium avium subsp. paratuberculosis
uggugcgccgggucgcggug

SEQ ID NO: 799860 - RNA, 13 nt, Mycobacterium avium subsp. paratuberculosis
uggugcacccgau

SEQ ID NO: 799861 - RNA, 20 nt, Mycobacterium avium subsp. paratuberculosis
uggugcggacggucgccgac

SEQ ID NO: 799862 - RNA, 22 nt, Mycobacterium avium subsp. paratuberculosis
uggugccgccgaugacggcgcg

SEQ ID NO: 799863 - RNA, 16 nt, Mycobacterium avium subsp. paratuberculosis
uggugcggucgaugac

SEQ ID NO: 799864 - RNA, 20 nt, Mycobacterium avium subsp. paratuberculosis
uggugcggugcaccgcggcg

SEQ ID NO: 799865 - RNA, 14 nt, Mycobacterium avium subsp. paratuberculosis
uggugcucgcgcuc

SEQ ID NO: 799866 - RNA, 13 nt, Mycobacterium avium subsp. paratuberculosis
uggugcagcagcu

SEQ ID NO: 799867 - RNA, 14 nt, Mycobacterium avium subsp. paratuberculosis
uggugccgccggcg

SEQ ID NO: 799868 - RNA, 21 nt, Mycobacterium avium subsp. paratuberculosis
uggugccgccgucgacgacga

SEQ ID NO: 799869 - RNA, 18 nt, Mycobacterium avium subsp. paratuberculosis
uggugcccaucgacccgu

SEQ ID NO: 799870 - RNA, 14 nt, Mycobacterium avium subsp. paratuberculosis
ugguggcggcgccg

SEQ ID NO: 799871 - RNA, 21 nt, Mycobacterium avium subsp. paratuberculosis
uggugggccaucgccaggaac

SEQ ID NO: 799872 - RNA, 14 nt, Mycobacterium avium subsp. paratuberculosis
ugguggcgcugccg

SEQ ID NO: 799873 - RNA, 22 nt, Mycobacterium avium subsp. paratuberculosis
ugguggcgcugccgagcaccuc

SEQ ID NO: 799874 - RNA, 15 nt, Mycobacterium avium subsp. paratuberculosis
ugguggccgcggccg

SEQ ID NO: 799875 - RNA, 17 nt, Mycobacterium avium subsp. paratuberculosis
ugguggccgcggccgcc

SEQ ID NO: 799876 - RNA, 20 nt, Mycobacterium avium subsp. paratuberculosis
uggugcugcugccccucgac

SEQ ID NO: 799877 - RNA, 17 nt, Mycobacterium avium subsp. paratuberculosis
ugguggacggucagcgc

SEQ ID NO: 799878 - RNA, 23 nt, Mycobacterium avium subsp. paratuberculosis
ugguggaaggugacgucgccgau

SEQ ID NO: 799879 - RNA, 14 nt, Mycobacterium avium subsp. paratuberculosis
uggugcugcccggc

SEQ ID NO: 799880 - RNA, 20 nt, Mycobacterium avium subsp. paratuberculosis
uggugaacagguaggcggcg

SEQ ID NO: 799881 - RNA, 24 nt, Mycobacterium avium subsp. paratuberculosis
uggucugcagcgacggaucggccg

SEQ ID NO: 799882 - RNA, 15 nt, Mycobacterium avium subsp. paratuberculosis
uggugaagcccagcg

SEQ ID NO: 799883 - RNA, 23 nt, Mycobacterium avium subsp. paratuberculosis
uggugaaccacuucuggcgcugc

SEQ ID NO: 799884 - RNA, 20 nt, Mycobacterium avium subsp. paratuberculosis
uggugaagccgugcacgccg

SEQ ID NO: 799885 - RNA, 15 nt, Mycobacterium avium subsp. paratuberculosis
uggucuucggugucg

SEQ ID NO: 799886 - RNA, 21 nt, Mycobacterium avium subsp. paratuberculosis
uggugaaguugccggucaggc

SEQ ID NO: 799887 - RNA, 14 nt, Mycobacterium avium subsp. paratuberculosis
uggugcaacaccga

SEQ ID NO: 799888 - RNA, 15 nt, Mycobacterium avium subsp. paratuberculosis
uggugcaacaccgaa

SEQ ID NO: 799889 - RNA, 15 nt, Mycobacterium avium subsp. paratuberculosis
ugguccgcaugucga

SEQ ID NO: 799890 - RNA, 14 nt, Mycobacterium avium subsp. paratuberculosis
ugguccgcgcgacc

SEQ ID NO: 799891 - RNA, 12 nt, Mycobacterium avium subsp. paratuberculosis
uggucuccggcc

SEQ ID NO: 799892 - RNA, 14 nt, Mycobacterium avium subsp. paratuberculosis
ugguccccgggccc

SEQ ID NO: 799893 - RNA, 14 nt, Mycobacterium avium subsp. paratuberculosis
uggucccgaucacc

SEQ ID NO: 799894 - RNA, 13 nt, Mycobacterium avium subsp. paratuberculosis
uggucugcgccgg

SEQ ID NO: 799895 - RNA, 14 nt, Mycobacterium avium subsp. paratuberculosis
uggucugcgccggc

SEQ ID NO: 799896 - RNA, 17 nt, Mycobacterium avium subsp. paratuberculosis
uggucugcgccggcggu

SEQ ID NO: 799897 - RNA, 22 nt, Mycobacterium avium subsp. paratuberculosis
uggucugcgcgagcagaucgcg

SEQ ID NO: 799898 - RNA, 18 nt, Mycobacterium avium subsp. paratuberculosis
uggucucgcaccugccgu

SEQ ID NO: 799899 - RNA, 14 nt, Mycobacterium avium subsp. paratuberculosis
uggucucgccgauc

SEQ ID NO: 799900 - RNA, 21 nt, Mycobacterium avium subsp. paratuberculosis
uggucucgcugaucucgacgg

SEQ ID NO: 799901 - RNA, 18 nt, Mycobacterium avium subsp. paratuberculosis
ugguaugccuuggcccgc

SEQ ID NO: 799902 - RNA, 13 nt, Mycobacterium avium subsp. paratuberculosis
uggucaccagguc

SEQ ID NO: 799903 - RNA, 17 nt, Mycobacterium avium subsp. paratuberculosis
uggucaccaggucgcgg

SEQ ID NO: 799904 - RNA, 18 nt, Mycobacterium avium subsp. paratuberculosis
uggucaccaggucgcggu

SEQ ID NO: 799905 - RNA, 20 nt, Mycobacterium avium subsp. paratuberculosis
uggucaccaggucgcgguag

SEQ ID NO: 799906 - RNA, 14 nt, Mycobacterium avium subsp. paratuberculosis
uggucaauccgggc

SEQ ID NO: 799907 - RNA, 23 nt, Mycobacterium avium subsp. paratuberculosis
uggucaaugcccucguagcggcc

SEQ ID NO: 799908 - RNA, 23 nt, Mycobacterium avium subsp. paratuberculosis
uggucacacccuugucggugacc

SEQ ID NO: 799909 - RNA, 18 nt, Mycobacterium avium subsp. paratuberculosis
uggucaugaacgccgggu

SEQ ID NO: 799910 - RNA, 18 nt, Mycobacterium avium subsp. paratuberculosis
uggucaugaaggcgacgu

SEQ ID NO: 799911 - RNA, 21 nt, Mycobacterium avium subsp. paratuberculosis
uggucaugaaggcgacgucgg

SEQ ID NO: 799912 - RNA, 14 nt, Mycobacterium avium subsp. paratuberculosis
ugguccaccgccgc

SEQ ID NO: 799913 - RNA, 15 nt, Mycobacterium avium subsp. paratuberculosis
ugguccaccgccgcg

SEQ ID NO: 799914 - RNA, 14 nt, Mycobacterium avium subsp. paratuberculosis
ugguccagcaccgg

SEQ ID NO: 799915 - RNA, 16 nt, Mycobacterium avium subsp. paratuberculosis
ugguccagcaccggcg

SEQ ID NO: 799916 - RNA, 22 nt, Mycobacterium avium subsp. paratuberculosis
ugguccagcgugcgcggcuggc

SEQ ID NO: 799917 - RNA, 19 nt, Mycobacterium avium subsp. paratuberculosis
uggcgaggaaguccggcgc

SEQ ID NO: 799918 - RNA, 17 nt, Mycobacterium avium subsp. paratuberculosis
uggcgaugaucaccucg

SEQ ID NO: 799919 - RNA, 21 nt, Mycobacterium avium subsp. paratuberculosis
uggcgaugaucaccucgguga

SEQ ID NO: 799920 - RNA, 23 nt, Mycobacterium avium subsp. paratuberculosis
uggcgaugaucaccucggugaug

SEQ ID NO: 799921 - RNA, 22 nt, Mycobacterium avium subsp. paratuberculosis
uggcgaugacgaauuccgcacc

SEQ ID NO: 799922 - RNA, 22 nt, Mycobacterium avium subsp. paratuberculosis
uggcgaucucgauggccucguc

SEQ ID NO: 799923 - RNA, 14 nt, Mycobacterium avium subsp. paratuberculosis
uggcgcaccgccgc

SEQ ID NO: 799924 - RNA, 13 nt, Mycobacterium avium subsp. paratuberculosis
uggcgcaccggga

SEQ ID NO: 799925 - RNA, 14 nt, Mycobacterium avium subsp. paratuberculosis
uggcgcaccgggac

SEQ ID NO: 799926 - RNA, 15 nt, Mycobacterium avium subsp. paratuberculosis
uggcgcaccgggacg

SEQ ID NO: 799927 - RNA, 23 nt, Mycobacterium avium subsp. paratuberculosis
uggcgaugggcaauaccggcagc

SEQ ID NO: 799928 - RNA, 13 nt, Mycobacterium avium subsp. paratuberculosis
uggcgauggugcu

SEQ ID NO: 799929 - RNA, 14 nt, Mycobacterium avium subsp. paratuberculosis
uggcgcacaacccg

SEQ ID NO: 799930 - RNA, 19 nt, Mycobacterium avium subsp. paratuberculosis
uggcgcacaacccggacag

SEQ ID NO: 799931 - RNA, 22 nt, Mycobacterium avium subsp. paratuberculosis
uggcgcacagaucgucucggcc

SEQ ID NO: 799932 - RNA, 23 nt, Mycobacterium avium subsp. paratuberculosis
uggcgcacagaucgucucggcca

SEQ ID NO: 799933 - RNA, 19 nt, Mycobacterium avium subsp. paratuberculosis
uggcgcggcggccggccag

SEQ ID NO: 799934 - RNA, 13 nt, Mycobacterium avium subsp. paratuberculosis
uggcgcggccggc

SEQ ID NO: 799935 - RNA, 15 nt, Mycobacterium avium subsp. paratuberculosis
uggcgcgaaucccgg

SEQ ID NO: 799936 - RNA, 21 nt, Mycobacterium avium subsp. paratuberculosis
uggcgcgaaucccggccucgu

SEQ ID NO: 799937 - RNA, 17 nt, Mycobacterium avium subsp. paratuberculosis
uggcgccggucggugcg

SEQ ID NO: 799938 - RNA, 13 nt, Mycobacterium avium subsp. paratuberculosis
uggcgccgguuuc

SEQ ID NO: 799939 - RNA, 14 nt, Mycobacterium avium subsp. paratuberculosis
uggcgccggugaag

SEQ ID NO: 799940 - RNA, 17 nt, Mycobacterium avium subsp. paratuberculosis
uggcgccggugaagcgg

SEQ ID NO: 799941 - RNA, 21 nt, Mycobacterium avium subsp. paratuberculosis
uggcgccggugaagcgggaca

SEQ ID NO: 799942 - RNA, 19 nt, Mycobacterium avium subsp. paratuberculosis
uggcgccgguaggcgcggg

SEQ ID NO: 799943 - RNA, 16 nt, Mycobacterium avium subsp. paratuberculosis
uggcgccggucgacgc

SEQ ID NO: 799944 - RNA, 22 nt, Mycobacterium avium subsp. paratuberculosis
uggcgcagaacaccacggugua

SEQ ID NO: 799945 - RNA, 13 nt, Mycobacterium avium subsp. paratuberculosis
uggcgccggcguc

SEQ ID NO: 799946 - RNA, 15 nt, Mycobacterium avium subsp. paratuberculosis
uggccguaaccgccg

SEQ ID NO: 799947 - RNA, 16 nt, Mycobacterium avium subsp. paratuberculosis
uggccgucacgcuggc

SEQ ID NO: 799948 - RNA, 19 nt, Mycobacterium avium subsp. paratuberculosis
uggccguccgaaucguuga

SEQ ID NO: 799949 - RNA, 23 nt, Mycobacterium avium subsp. paratuberculosis
uggccguccggauagccgucggc

SEQ ID NO: 799950 - RNA, 15 nt, Mycobacterium avium subsp. paratuberculosis
uggcgaacucgacgg

SEQ ID NO: 799951 - RNA, 16 nt, Mycobacterium avium subsp. paratuberculosis
uggcgaacucgcgcag

SEQ ID NO: 799952 - RNA, 14 nt, Mycobacterium avium subsp. paratuberculosis
uggccgucgcggcg

SEQ ID NO: 799953 - RNA, 20 nt, Mycobacterium avium subsp. paratuberculosis
uggccgucgcguucgaccca

SEQ ID NO: 799954 - RNA, 13 nt, Mycobacterium avium subsp. paratuberculosis
uggccgucgcuga

SEQ ID NO: 799955 - RNA, 17 nt, Mycobacterium avium subsp. paratuberculosis
uggccggguuggcaucc

SEQ ID NO: 799956 - RNA, 15 nt, Mycobacterium avium subsp. paratuberculosis
uggccgggucgccgu

SEQ ID NO: 799957 - RNA, 16 nt, Mycobacterium avium subsp. paratuberculosis
uggccggugggcggcg

SEQ ID NO: 799958 - RNA, 18 nt, Mycobacterium avium subsp. paratuberculosis
uggccggugggcggcgcc

SEQ ID NO: 799959 - RNA, 21 nt, Mycobacterium avium subsp. paratuberculosis
uggccgggcucgagggcggcg

SEQ ID NO: 799960 - RNA, 18 nt, Mycobacterium avium subsp. paratuberculosis
uggccgggaugccagucc

SEQ ID NO: 799961 - RNA, 14 nt, Mycobacterium avium subsp. paratuberculosis
uggcgaucaccccg

SEQ ID NO: 799962 - RNA, 16 nt, Mycobacterium avium subsp. paratuberculosis
uggcgaucaccccggc

SEQ ID NO: 799963 - RNA, 22 nt, Mycobacterium avium subsp. paratuberculosis
uggcgaucaccccggcgacggc

SEQ ID NO: 799964 - RNA, 24 nt, Mycobacterium avium subsp. paratuberculosis
uggcgaucaccccggcgacggcgg

SEQ ID NO: 799965 - RNA, 20 nt, Mycobacterium avium subsp. paratuberculosis
uggcgaucaccuugcggccg

SEQ ID NO: 799966 - RNA, 22 nt, Mycobacterium avium subsp. paratuberculosis
uggcgaucagaugcucgucggu

SEQ ID NO: 799967 - RNA, 12 nt, Mycobacterium avium subsp. paratuberculosis
uggcgaccaccg

SEQ ID NO: 799968 - RNA, 17 nt, Mycobacterium avium subsp. paratuberculosis
uggcgaccaccgacccc

SEQ ID NO: 799969 - RNA, 18 nt, Mycobacterium avium subsp. paratuberculosis
uggcgacaucgccgcggc

SEQ ID NO: 799970 - RNA, 20 nt, Mycobacterium avium subsp. paratuberculosis
uggcgacaucgccgcggccg

SEQ ID NO: 799971 - RNA, 21 nt, Mycobacterium avium subsp. paratuberculosis
uggcgaauuccccguagucac

SEQ ID NO: 799972 - RNA, 19 nt, Mycobacterium avium subsp. paratuberculosis
uggcgacaggaaccugguc

SEQ ID NO: 799973 - RNA, 20 nt, Mycobacterium avium subsp. paratuberculosis
uggcgaaguagucggcgucc

SEQ ID NO: 799974 - RNA, 21 nt, Mycobacterium avium subsp. paratuberculosis
uggcgaagcaggggucguugu

SEQ ID NO: 799975 - RNA, 15 nt, Mycobacterium avium subsp. paratuberculosis
uggcgaacgcgaccu

SEQ ID NO: 799976 - RNA, 20 nt, Mycobacterium avium subsp. paratuberculosis
uggcgaagcccaugccgaug

SEQ ID NO: 799977 - RNA, 14 nt, Mycobacterium avium subsp. paratuberculosis
uggcgcugccgagc

SEQ ID NO: 799978 - RNA, 15 nt, Mycobacterium avium subsp. paratuberculosis
uggcgcugccgagca

SEQ ID NO: 799979 - RNA, 16 nt, Mycobacterium avium subsp. paratuberculosis
uggcgcugccgagcac

SEQ ID NO: 799980 - RNA, 15 nt, Mycobacterium avium subsp. paratuberculosis
uggcgcugcgcgaca

SEQ ID NO: 799981 - RNA, 14 nt, Mycobacterium avium subsp. paratuberculosis
uggcggcggugauc

SEQ ID NO: 799982 - RNA, 17 nt, Mycobacterium avium subsp. paratuberculosis
uggcggcggugaucgcc

SEQ ID NO: 799983 - RNA, 19 nt, Mycobacterium avium subsp. paratuberculosis
uggcggcggugaucgccgg

SEQ ID NO: 799984 - RNA, 22 nt, Mycobacterium avium subsp. paratuberculosis
uggcggcggugaucgccggauc

SEQ ID NO: 799985 - RNA, 13 nt, Mycobacterium avium subsp. paratuberculosis
uggcggcggcugc

SEQ ID NO: 799986 - RNA, 19 nt, Mycobacterium avium subsp. paratuberculosis
uggcggcgggccagcucgu

SEQ ID NO: 799987 - RNA, 13 nt, Mycobacterium avium subsp. paratuberculosis
uggcggcgcgcuc

SEQ ID NO: 799988 - RNA, 22 nt, Mycobacterium avium subsp. paratuberculosis
uggcggcggcccgccgcgcccg

SEQ ID NO: 799989 - RNA, 15 nt, Mycobacterium avium subsp. paratuberculosis
uggcggcggcccgcg

SEQ ID NO: 799990 - RNA, 15 nt, Mycobacterium avium subsp. paratuberculosis
uggcggcggcgacga

SEQ ID NO: 799991 - RNA, 12 nt, Mycobacterium avium subsp. paratuberculosis
uggcggcgaugu

SEQ ID NO: 799992 - RNA, 18 nt, Mycobacterium avium subsp. paratuberculosis
uggcggcgaugucgucga

SEQ ID NO: 799993 - RNA, 16 nt, Mycobacterium avium subsp. paratuberculosis
uggcggcgaucaccgc

SEQ ID NO: 799994 - RNA, 24 nt, Mycobacterium avium subsp. paratuberculosis
uggcgcuugcguucccagcccggc

SEQ ID NO: 799995 - RNA, 18 nt, Mycobacterium avium subsp. paratuberculosis
uggcggcggugucgccca

SEQ ID NO: 799996 - RNA, 19 nt, Mycobacterium avium subsp. paratuberculosis
uggcggcgucgucgccgug

SEQ ID NO: 799997 - RNA, 20 nt, Mycobacterium avium subsp. paratuberculosis
uggcggcgugggguucccgg

SEQ ID NO: 799998 - RNA, 23 nt, Mycobacterium avium subsp. paratuberculosis
uggcggcgugggguucccggccg

SEQ ID NO: 799999 - RNA, 15 nt, Mycobacterium avium subsp. paratuberculosis
uggcgggcgaucgcc

SEQ ID NO: 800000 - RNA, 23 nt, Mycobacterium avium subsp. paratuberculosis
uggcgggcgcgccggcgcgcagc

SEQ ID NO: 800001 - RNA, 16 nt, Mycobacterium avium subsp. paratuberculosis
uggcgggcggcccgca

SEQ ID NO: 800002 - RNA, 21 nt, Mycobacterium avium subsp. paratuberculosis
uggcgggcccgggcgcugagc

SEQ ID NO: 800003 - RNA, 17 nt, Mycobacterium avium subsp. paratuberculosis
uggcggucgcgccagac

SEQ ID NO: 800004 - RNA, 12 nt, Mycobacterium avium subsp. paratuberculosis
uggcgguggccc

SEQ ID NO: 800005 - RNA, 16 nt, Mycobacterium avium subsp. paratuberculosis
uggcgguggcccggua

SEQ ID NO: 800006 - RNA, 19 nt, Mycobacterium avium subsp. paratuberculosis
uggcgguggcccgguacag

SEQ ID NO: 800007 - RNA, 15 nt, Mycobacterium avium subsp. paratuberculosis
uggcggugccgcggc

SEQ ID NO: 800008 - RNA, 18 nt, Mycobacterium avium subsp. paratuberculosis
uggcggucugcgcccgau

SEQ ID NO: 800009 - RNA, 19 nt, Mycobacterium avium subsp. paratuberculosis
uggcggucugcgcccgauc

SEQ ID NO: 800010 - RNA, 17 nt, Mycobacterium avium subsp. paratuberculosis
uggcguccaaugcgccg

SEQ ID NO: 800011 - RNA, 15 nt, Mycobacterium avium subsp. paratuberculosis
uggcguccucgacgg

SEQ ID NO: 800012 - RNA, 20 nt, Mycobacterium avium subsp. paratuberculosis
uggcguccuugccgaucagc

SEQ ID NO: 800013 - RNA, 22 nt, Mycobacterium avium subsp. paratuberculosis
uggcguccagcggguugccgcu

SEQ ID NO: 800014 - RNA, 12 nt, Mycobacterium avium subsp. paratuberculosis
uggcgucgacgg

SEQ ID NO: 800015 - RNA, 21 nt, Mycobacterium avium subsp. paratuberculosis
uggcgucgaucagcgcgccgc

SEQ ID NO: 800016 - RNA, 23 nt, Mycobacterium avium subsp. paratuberculosis
uggcgucgaucagcgcgccgccc

SEQ ID NO: 800017 - RNA, 12 nt, Mycobacterium avium subsp. paratuberculosis
uggcgucgaugc

SEQ ID NO: 800018 - RNA, 20 nt, Mycobacterium avium subsp. paratuberculosis
uggcgucgccgccggugccg

SEQ ID NO: 800019 - RNA, 21 nt, Mycobacterium avium subsp. paratuberculosis
uggcgucgccgccggugccga

SEQ ID NO: 800020 - RNA, 15 nt, Mycobacterium avium subsp. paratuberculosis
uggcccgcgcccgcu

SEQ ID NO: 800021 - RNA, 16 nt, Mycobacterium avium subsp. paratuberculosis
uggcccgccacgugcg

SEQ ID NO: 800022 - RNA, 21 nt, Mycobacterium avium subsp. paratuberculosis
uggcccgccacgugcggcugc

SEQ ID NO: 800023 - RNA, 13 nt, Mycobacterium avium subsp. paratuberculosis
uggcccgcccggg

SEQ ID NO: 800024 - RNA, 16 nt, Mycobacterium avium subsp. paratuberculosis
uggcccgcgcggccgc

SEQ ID NO: 800025 - RNA, 17 nt, Mycobacterium avium subsp. paratuberculosis
uggcccggcgcggcggc

SEQ ID NO: 800026 - RNA, 22 nt, Mycobacterium avium subsp. paratuberculosis
uggcccgguacagcgccgcggc

SEQ ID NO: 800027 - RNA, 15 nt, Mycobacterium avium subsp. paratuberculosis
uggcccgggccacac

SEQ ID NO: 800028 - RNA, 21 nt, Mycobacterium avium subsp. paratuberculosis
uggcccgggccacacccgucg

SEQ ID NO: 800029 - RNA, 12 nt, Mycobacterium avium subsp. paratuberculosis
uggcccgggcgu

SEQ ID NO: 800030 - RNA, 15 nt, Mycobacterium avium subsp. paratuberculosis
uggcccggaccgccg

SEQ ID NO: 800031 - RNA, 19 nt, Mycobacterium avium subsp. paratuberculosis
uggcccggaccgccgcggc

SEQ ID NO: 800032 - RNA, 17 nt, Mycobacterium avium subsp. paratuberculosis
uggccgaaccgcucguc

SEQ ID NO: 800033 - RNA, 20 nt, Mycobacterium avium subsp. paratuberculosis
uggccgaacggcaugucggu

SEQ ID NO: 800034 - RNA, 12 nt, Mycobacterium avium subsp. paratuberculosis
uggcccuggcag

SEQ ID NO: 800035 - RNA, 17 nt, Mycobacterium avium subsp. paratuberculosis
uggcccugcucgucguu

SEQ ID NO: 800036 - RNA, 16 nt, Mycobacterium avium subsp. paratuberculosis
uggcccggugcgacgc

SEQ ID NO: 800037 - RNA, 17 nt, Mycobacterium avium subsp. paratuberculosis
uggcccgugucgcggcc

SEQ ID NO: 800038 - RNA, 23 nt, Mycobacterium avium subsp. paratuberculosis
uggcccuccacggugcgcaccga

SEQ ID NO: 800039 - RNA, 24 nt, Mycobacterium avium subsp. paratuberculosis
uggcccucggaggugccgcgcggc

SEQ ID NO: 800040 - RNA, 17 nt, Mycobacterium avium subsp. paratuberculosis
uggccaucgcggccccc

SEQ ID NO: 800041 - RNA, 17 nt, Mycobacterium avium subsp. paratuberculosis
uggcccagccggccgac

SEQ ID NO: 800042 - RNA, 16 nt, Mycobacterium avium subsp. paratuberculosis
uggcccagccggugcg

SEQ ID NO: 800043 - RNA, 16 nt, Mycobacterium avium subsp. paratuberculosis
uggcccaccgaaucac

SEQ ID NO: 800044 - RNA, 12 nt, Mycobacterium avium subsp. paratuberculosis
uggcccacgacg

SEQ ID NO: 800045 - RNA, 18 nt, Mycobacterium avium subsp. paratuberculosis
uggcccacgacgucuggg

SEQ ID NO: 800046 - RNA, 21 nt, Mycobacterium avium subsp. paratuberculosis
uggcccacgacgucugggccg

SEQ ID NO: 800047 - RNA, 18 nt, Mycobacterium avium subsp. paratuberculosis
uggcccacgcagccgucg

SEQ ID NO: 800048 - RNA, 22 nt, Mycobacterium avium subsp. paratuberculosis
uggcccagacaggccggccgcu

SEQ ID NO: 800049 - RNA, 16 nt, Mycobacterium avium subsp. paratuberculosis
uggccccacgggccau

SEQ ID NO: 800050 - RNA, 14 nt, Mycobacterium avium subsp. paratuberculosis
uggcccaggccggc

SEQ ID NO: 800051 - RNA, 13 nt, Mycobacterium avium subsp. paratuberculosis
uggccccgaucau

SEQ ID NO: 800052 - RNA, 13 nt, Mycobacterium avium subsp. paratuberculosis
uggccccgggccg

SEQ ID NO: 800053 - RNA, 12 nt, Mycobacterium avium subsp. paratuberculosis
uggccgcgccgu

SEQ ID NO: 800054 - RNA, 17 nt, Mycobacterium avium subsp. paratuberculosis
uggccgcgggcgggccg

SEQ ID NO: 800055 - RNA, 17 nt, Mycobacterium avium subsp. paratuberculosis
uggccgcguuccaggac

SEQ ID NO: 800056 - RNA, 13 nt, Mycobacterium avium subsp. paratuberculosis
uggccgcgccgcc

SEQ ID NO: 800057 - RNA, 12 nt, Mycobacterium avium subsp. paratuberculosis
uggccgcgcagc

SEQ ID NO: 800058 - RNA, 13 nt, Mycobacterium avium subsp. paratuberculosis
uggccgcgcagcu

SEQ ID NO: 800059 - RNA, 18 nt, Mycobacterium avium subsp. paratuberculosis
uggccgcgcagcucgggg

SEQ ID NO: 800060 - RNA, 20 nt, Mycobacterium avium subsp. paratuberculosis
uggccgccgcuagucgccca

SEQ ID NO: 800061 - RNA, 21 nt, Mycobacterium avium subsp. paratuberculosis
uggccgcccucgcugccgccc

SEQ ID NO: 800062 - RNA, 21 nt, Mycobacterium avium subsp. paratuberculosis
uggccgcccgcagguucaugu

SEQ ID NO: 800063 - RNA, 15 nt, Mycobacterium avium subsp. paratuberculosis
uggccgagagccggu

SEQ ID NO: 800064 - RNA, 17 nt, Mycobacterium avium subsp. paratuberculosis
uggccgccagcaccucc

SEQ ID NO: 800065 - RNA, 17 nt, Mycobacterium avium subsp. paratuberculosis
uggccgcaggcggccag

SEQ ID NO: 800066 - RNA, 18 nt, Mycobacterium avium subsp. paratuberculosis
uggccgcaggcggccagc

SEQ ID NO: 800067 - RNA, 23 nt, Mycobacterium avium subsp. paratuberculosis
uggccgauggucagcugccgcac

SEQ ID NO: 800068 - RNA, 16 nt, Mycobacterium avium subsp. paratuberculosis
uggccgaucagcggcg

SEQ ID NO: 800069 - RNA, 19 nt, Mycobacterium avium subsp. paratuberculosis
uggccgaucagcggcgggc

SEQ ID NO: 800070 - RNA, 22 nt, Mycobacterium avium subsp. paratuberculosis
uggccgaucagcugcucggcca

SEQ ID NO: 800071 - RNA, 20 nt, Mycobacterium avium subsp. paratuberculosis
uggccgagcagccgggccag

SEQ ID NO: 800072 - RNA, 22 nt, Mycobacterium avium subsp. paratuberculosis
uggccgagcagccgggccagca

SEQ ID NO: 800073 - RNA, 16 nt, Mycobacterium avium subsp. paratuberculosis
uggccgaacugcauca

SEQ ID NO: 800074 - RNA, 12 nt, Mycobacterium avium subsp. paratuberculosis
uggccgaccccg

SEQ ID NO: 800075 - RNA, 18 nt, Mycobacterium avium subsp. paratuberculosis
uggccgaccgccgccauc

SEQ ID NO: 800076 - RNA, 18 nt, Mycobacterium avium subsp. paratuberculosis
uggccgaggauggggucg

SEQ ID NO: 800077 - RNA, 15 nt, Mycobacterium avium subsp. paratuberculosis
uggccgagcggcugc

SEQ ID NO: 800078 - RNA, 20 nt, Mycobacterium avium subsp. paratuberculosis
uggccagaugcccgccccgc

SEQ ID NO: 800079 - RNA, 16 nt, Mycobacterium avium subsp. paratuberculosis
uggccagcaccaccgc

SEQ ID NO: 800080 - RNA, 17 nt, Mycobacterium avium subsp. paratuberculosis
uggccagcaccaccgcg

SEQ ID NO: 800081 - RNA, 13 nt, Mycobacterium avium subsp. paratuberculosis
uggccagcaccgc

SEQ ID NO: 800082 - RNA, 14 nt, Mycobacterium avium subsp. paratuberculosis
uggccagcaccgcg

SEQ ID NO: 800083 - RNA, 20 nt, Mycobacterium avium subsp. paratuberculosis
uggccagcaccgcggccguc

SEQ ID NO: 800084 - RNA, 19 nt, Mycobacterium avium subsp. paratuberculosis
uggccagcaccgcgucgau

SEQ ID NO: 800085 - RNA, 15 nt, Mycobacterium avium subsp. paratuberculosis
uggccagcacgcugc

SEQ ID NO: 800086 - RNA, 19 nt, Mycobacterium avium subsp. paratuberculosis
uggccagcagugccaccac

SEQ ID NO: 800087 - RNA, 22 nt, Mycobacterium avium subsp. paratuberculosis
uggccagcagugccaccaccac

SEQ ID NO: 800088 - RNA, 13 nt, Mycobacterium avium subsp. paratuberculosis
uggccaccggggu

SEQ ID NO: 800089 - RNA, 22 nt, Mycobacterium avium subsp. paratuberculosis
uggccacgccccauugccgcgc

SEQ ID NO: 800090 - RNA, 20 nt, Mycobacterium avium subsp. paratuberculosis
uggccacgcucucgccgguc

SEQ ID NO: 800091 - RNA, 13 nt, Mycobacterium avium subsp. paratuberculosis
uggccaccucgac

SEQ ID NO: 800092 - RNA, 15 nt, Mycobacterium avium subsp. paratuberculosis
uggccaccucgacgg

SEQ ID NO: 800093 - RNA, 14 nt, Mycobacterium avium subsp. paratuberculosis
uggccacgauccgg

SEQ ID NO: 800094 - RNA, 17 nt, Mycobacterium avium subsp. paratuberculosis
uggccacgauccggggc

SEQ ID NO: 800095 - RNA, 14 nt, Mycobacterium avium subsp. paratuberculosis
uggccacgaugauc

SEQ ID NO: 800096 - RNA, 19 nt, Mycobacterium avium subsp. paratuberculosis
uggccagcgucagggcgac

SEQ ID NO: 800097 - RNA, 23 nt, Mycobacterium avium subsp. paratuberculosis
uggccagcgucagggcgacuccg

SEQ ID NO: 800098 - RNA, 14 nt, Mycobacterium avium subsp. paratuberculosis
uggccagcgccucc

SEQ ID NO: 800099 - RNA, 16 nt, Mycobacterium avium subsp. paratuberculosis
uggccagcgccagcgc

SEQ ID NO: 800100 - RNA, 16 nt, Mycobacterium avium subsp. paratuberculosis
uggccagcuucaccgg

SEQ ID NO: 800101 - RNA, 14 nt, Mycobacterium avium subsp. paratuberculosis
uggccagcgcggcg

SEQ ID NO: 800102 - RNA, 12 nt, Mycobacterium avium subsp. paratuberculosis
uggccagcucgg

SEQ ID NO: 800103 - RNA, 15 nt, Mycobacterium avium subsp. paratuberculosis
uggccagcucggcca

SEQ ID NO: 800104 - RNA, 22 nt, Mycobacterium avium subsp. paratuberculosis
uggccagcucggcguggucgag

SEQ ID NO: 800105 - RNA, 21 nt, Mycobacterium avium subsp. paratuberculosis
uggccagcucggucagccggg

SEQ ID NO: 800106 - RNA, 17 nt, Mycobacterium avium subsp. paratuberculosis
uggccagcucgucgcgg

SEQ ID NO: 800107 - RNA, 16 nt, Mycobacterium avium subsp. paratuberculosis
uggccagguggccgcu

SEQ ID NO: 800108 - RNA, 22 nt, Mycobacterium avium subsp. paratuberculosis
uggccagguugcgccguccggc

SEQ ID NO: 800109 - RNA, 17 nt, Mycobacterium avium subsp. paratuberculosis
uggccaggcccugccag

SEQ ID NO: 800110 - RNA, 19 nt, Mycobacterium avium subsp. paratuberculosis
uggccaggcgggccaccac

SEQ ID NO: 800111 - RNA, 16 nt, Mycobacterium avium subsp. paratuberculosis
uggccaggcuggcguc

SEQ ID NO: 800112 - RNA, 23 nt, Mycobacterium avium subsp. paratuberculosis
uggccaggcuggcgucgaacgug

SEQ ID NO: 800113 - RNA, 19 nt, Mycobacterium avium subsp. paratuberculosis
uggccagguauucgcggga

SEQ ID NO: 800114 - RNA, 15 nt, Mycobacterium avium subsp. paratuberculosis
uggccaccacauugg

SEQ ID NO: 800115 - RNA, 20 nt, Mycobacterium avium subsp. paratuberculosis
uggccaccacauuggcgacc

SEQ ID NO: 800116 - RNA, 14 nt, Mycobacterium avium subsp. paratuberculosis
uggccaccaccacg

SEQ ID NO: 800117 - RNA, 15 nt, Mycobacterium avium subsp. paratuberculosis
uggccaacucgaccu

SEQ ID NO: 800118 - RNA, 14 nt, Mycobacterium avium subsp. paratuberculosis
uggccaacgcguuc

SEQ ID NO: 800119 - RNA, 22 nt, Mycobacterium avium subsp. paratuberculosis
uggccaccgaugcccgacaccg

SEQ ID NO: 800120 - RNA, 23 nt, Mycobacterium avium subsp. paratuberculosis
uggccaccgaugcccgacaccgc

SEQ ID NO: 800121 - RNA, 19 nt, Mycobacterium avium subsp. paratuberculosis
uggccaccaucaggccggc

SEQ ID NO: 800122 - RNA, 15 nt, Mycobacterium avium subsp. paratuberculosis
uggccaccacggguc

SEQ ID NO: 800123 - RNA, 18 nt, Mycobacterium avium subsp. paratuberculosis
uggccaccacgggucggu

SEQ ID NO: 800124 - RNA, 22 nt, Mycobacterium avium subsp. paratuberculosis
uggccaccacgggucggucggc

SEQ ID NO: 800125 - RNA, 17 nt, Mycobacterium avium subsp. paratuberculosis
uggccacccucgccgcc

SEQ ID NO: 800126 - RNA, 19 nt, Mycobacterium avium subsp. paratuberculosis
uggccacccucgccgccgc

SEQ ID NO: 800127 - RNA, 18 nt, Mycobacterium avium subsp. paratuberculosis
uggacaggcacucgccca

SEQ ID NO: 800128 - RNA, 19 nt, Mycobacterium avium subsp. paratuberculosis
uggacaggccggcgacggc

SEQ ID NO: 800129 - RNA, 15 nt, Mycobacterium avium subsp. paratuberculosis
uggacagaugccaga

SEQ ID NO: 800130 - RNA, 17 nt, Mycobacterium avium subsp. paratuberculosis
uggacagaugccagacg

SEQ ID NO: 800131 - RNA, 16 nt, Mycobacterium avium subsp. paratuberculosis
uggacagcagcagcuc

SEQ ID NO: 800132 - RNA, 12 nt, Mycobacterium avium subsp. paratuberculosis
uggacaccgcac

SEQ ID NO: 800133 - RNA, 17 nt, Mycobacterium avium subsp. paratuberculosis
uggaauucuggccgacc

SEQ ID NO: 800134 - RNA, 18 nt, Mycobacterium avium subsp. paratuberculosis
acgaucucccaacgcagc

SEQ ID NO: 800135 - RNA, 20 nt, Mycobacterium avium subsp. paratuberculosis
acgaucugcaggccgaggcu

SEQ ID NO: 800136 - RNA, 19 nt, Mycobacterium avium subsp. paratuberculosis
acgaugaagccgugcccgc

SEQ ID NO: 800137 - RNA, 17 nt, Mycobacterium avium subsp. paratuberculosis
acgaugaaaccccagcc

SEQ ID NO: 800138 - RNA, 18 nt, Mycobacterium avium subsp. paratuberculosis
acgaugaaaccccagccg

SEQ ID NO: 800139 - RNA, 22 nt, Mycobacterium avium subsp. paratuberculosis
acgaugaaaccccagccggccg

SEQ ID NO: 800140 - RNA, 13 nt, Mycobacterium avium subsp. paratuberculosis
acgauggcgcggc

SEQ ID NO: 800141 - RNA, 14 nt, Mycobacterium avium subsp. paratuberculosis
acgauggcgcggcg

SEQ ID NO: 800142 - RNA, 16 nt, Mycobacterium avium subsp. paratuberculosis
acgaugacgaccgggu

SEQ ID NO: 800143 - RNA, 13 nt, Mycobacterium avium subsp. paratuberculosis
acgagcccagccg

SEQ ID NO: 800144 - RNA, 14 nt, Mycobacterium avium subsp. paratuberculosis
acgagcccgccggc

SEQ ID NO: 800145 - RNA, 16 nt, Mycobacterium avium subsp. paratuberculosis
acgagcccgccggcgg

SEQ ID NO: 800146 - RNA, 17 nt, Mycobacterium avium subsp. paratuberculosis
acgagcccgccggcggg

SEQ ID NO: 800147 - RNA, 18 nt, Mycobacterium avium subsp. paratuberculosis
acgagcccgccggcgggu

SEQ ID NO: 800148 - RNA, 12 nt, Mycobacterium avium subsp. paratuberculosis
acgagccgacgu

SEQ ID NO: 800149 - RNA, 15 nt, Mycobacterium avium subsp. paratuberculosis
acgacuggcggcggc

SEQ ID NO: 800150 - RNA, 19 nt, Mycobacterium avium subsp. paratuberculosis
acgacucggccuccgcgcg

SEQ ID NO: 800151 - RNA, 17 nt, Mycobacterium avium subsp. paratuberculosis
acgagcagcgugcugac

SEQ ID NO: 800152 - RNA, 16 nt, Mycobacterium avium subsp. paratuberculosis
acgaggcacggcccgc

SEQ ID NO: 800153 - RNA, 21 nt, Mycobacterium avium subsp. paratuberculosis
acgaggcacggcccgcucggg

SEQ ID NO: 800154 - RNA, 16 nt, Mycobacterium avium subsp. paratuberculosis
acgaucgucgacguca

SEQ ID NO: 800155 - RNA, 14 nt, Mycobacterium avium subsp. paratuberculosis
acgaucgucgccgc

SEQ ID NO: 800156 - RNA, 15 nt, Mycobacterium avium subsp. paratuberculosis
acgaucgucuggccg

SEQ ID NO: 800157 - RNA, 22 nt, Mycobacterium avium subsp. paratuberculosis
acgagcgcgccgagguggcccg

SEQ ID NO: 800158 - RNA, 16 nt, Mycobacterium avium subsp. paratuberculosis
acgagcucaccgccga

SEQ ID NO: 800159 - RNA, 19 nt, Mycobacterium avium subsp. paratuberculosis
acgagcucgccgcugucgu

SEQ ID NO: 800160 - RNA, 21 nt, Mycobacterium avium subsp. paratuberculosis
acgcaaugcgucgcggcggcg

SEQ ID NO: 800161 - RNA, 23 nt, Mycobacterium avium subsp. paratuberculosis
acgcaaugcgucgcggcggcgcu

SEQ ID NO: 800162 - RNA, 15 nt, Mycobacterium avium subsp. paratuberculosis
acgcacaccgcgcgc

SEQ ID NO: 800163 - RNA, 17 nt, Mycobacterium avium subsp. paratuberculosis
acgcaaucgcccagucc

SEQ ID NO: 800164 - RNA, 20 nt, Mycobacterium avium subsp. paratuberculosis
acgauguugaugucgcgcgg

SEQ ID NO: 800165 - RNA, 22 nt, Mycobacterium avium subsp. paratuberculosis
acgauguuggcgacgacggcgg

SEQ ID NO: 800166 - RNA, 17 nt, Mycobacterium avium subsp. paratuberculosis
acgauguugggccaugc

SEQ ID NO: 800167 - RNA, 15 nt, Mycobacterium avium subsp. paratuberculosis
acgauguccgccggc

SEQ ID NO: 800168 - RNA, 19 nt, Mycobacterium avium subsp. paratuberculosis
acgauguccgccggccggu

SEQ ID NO: 800169 - RNA, 18 nt, Mycobacterium avium subsp. paratuberculosis
acgaugucgacccgcggc

SEQ ID NO: 800170 - RNA, 18 nt, Mycobacterium avium subsp. paratuberculosis
acgaugggccgcccgcug

SEQ ID NO: 800171 - RNA, 20 nt, Mycobacterium avium subsp. paratuberculosis
acgaugucgaugacggcggc

SEQ ID NO: 800172 - RNA, 20 nt, Mycobacterium avium subsp. paratuberculosis
acgcagcgcauccgacaccg

SEQ ID NO: 800173 - RNA, 21 nt, Mycobacterium avium subsp. paratuberculosis
acgcagccgucgaucuugacg

SEQ ID NO: 800174 - RNA, 15 nt, Mycobacterium avium subsp. paratuberculosis
acgcaccaccgcggu

SEQ ID NO: 800175 - RNA, 17 nt, Mycobacterium avium subsp. paratuberculosis
acgcccaacuacccgcc

SEQ ID NO: 800176 - RNA, 21 nt, Mycobacterium avium subsp. paratuberculosis
acgcccaacuacccgccgacg

SEQ ID NO: 800177 - RNA, 14 nt, Mycobacterium avium subsp. paratuberculosis
acgcccacagcgcc

SEQ ID NO: 800178 - RNA, 14 nt, Mycobacterium avium subsp. paratuberculosis
acgccaugucgaug

SEQ ID NO: 800179 - RNA, 15 nt, Mycobacterium avium subsp. paratuberculosis
acgccaugugccggc

SEQ ID NO: 800180 - RNA, 18 nt, Mycobacterium avium subsp. paratuberculosis
acgccaugugccggcgcu

SEQ ID NO: 800181 - RNA, 13 nt, Mycobacterium avium subsp. paratuberculosis
acgcccagcgccc

SEQ ID NO: 800182 - RNA, 20 nt, Mycobacterium avium subsp. paratuberculosis
acgcccagcccgcgggcggc

SEQ ID NO: 800183 - RNA, 15 nt, Mycobacterium avium subsp. paratuberculosis
acgcccagcgcggcg

SEQ ID NO: 800184 - RNA, 23 nt, Mycobacterium avium subsp. paratuberculosis
acgcccagaacgacgcgcucagc

SEQ ID NO: 800185 - RNA, 17 nt, Mycobacterium avium subsp. paratuberculosis
acgcccagaccguggag

SEQ ID NO: 800186 - RNA, 19 nt, Mycobacterium avium subsp. paratuberculosis
acgcccagaucgacgccga

SEQ ID NO: 800187 - RNA, 20 nt, Mycobacterium avium subsp. paratuberculosis
acgcccagaucgacgccgac

SEQ ID NO: 800188 - RNA, 14 nt, Mycobacterium avium subsp. paratuberculosis
acgcccagcaccga

SEQ ID NO: 800189 - RNA, 21 nt, Mycobacterium avium subsp. paratuberculosis
acgcccaccugguuggcccgc

SEQ ID NO: 800190 - RNA, 23 nt, Mycobacterium avium subsp. paratuberculosis
acgcccaccugguuggcccgcac

SEQ ID NO: 800191 - RNA, 15 nt, Mycobacterium avium subsp. paratuberculosis
acgcccacgccgagg

SEQ ID NO: 800192 - RNA, 22 nt, Mycobacterium avium subsp. paratuberculosis
acgccccguggaucaucccgac

SEQ ID NO: 800193 - RNA, 17 nt, Mycobacterium avium subsp. paratuberculosis
acgcccgaucccgggcc

SEQ ID NO: 800194 - RNA, 15 nt, Mycobacterium avium subsp. paratuberculosis
acgcccgcaccacga

SEQ ID NO: 800195 - RNA, 15 nt, Mycobacterium avium subsp. paratuberculosis
acgcccgcgacccga

SEQ ID NO: 800196 - RNA, 14 nt, Mycobacterium avium subsp. paratuberculosis
acgcccgcgaggug

SEQ ID NO: 800197 - RNA, 20 nt, Mycobacterium avium subsp. paratuberculosis
acgcccgcgaucggcgccac

SEQ ID NO: 800198 - RNA, 21 nt, Mycobacterium avium subsp. paratuberculosis
acgcccggacccgcucgccga

SEQ ID NO: 800199 - RNA, 17 nt, Mycobacterium avium subsp. paratuberculosis
acgccgacaccagcgcg

SEQ ID NO: 800200 - RNA, 19 nt, Mycobacterium avium subsp. paratuberculosis
acgccgacaccagcgcgca

SEQ ID NO: 800201 - RNA, 16 nt, Mycobacterium avium subsp. paratuberculosis
acgccgacaccgucgc

SEQ ID NO: 800202 - RNA, 21 nt, Mycobacterium avium subsp. paratuberculosis
acgccgacaccgucgccguga

SEQ ID NO: 800203 - RNA, 12 nt, Mycobacterium avium subsp. paratuberculosis
acgccgacagcg

SEQ ID NO: 800204 - RNA, 18 nt, Mycobacterium avium subsp. paratuberculosis
acgccgaagaucagcgcg

SEQ ID NO: 800205 - RNA, 20 nt, Mycobacterium avium subsp. paratuberculosis
acgccgaagaucagcgcguc

SEQ ID NO: 800206 - RNA, 21 nt, Mycobacterium avium subsp. paratuberculosis
acgccgaagaucagcgcgucc

SEQ ID NO: 800207 - RNA, 16 nt, Mycobacterium avium subsp. paratuberculosis
acgcagugccgcacca

SEQ ID NO: 800208 - RNA, 17 nt, Mycobacterium avium subsp. paratuberculosis
acgcagguuucucgacc

SEQ ID NO: 800209 - RNA, 18 nt, Mycobacterium avium subsp. paratuberculosis
acgcagguuucucgacca

SEQ ID NO: 800210 - RNA, 17 nt, Mycobacterium avium subsp. paratuberculosis
acgcaggugcgccgcuc

SEQ ID NO: 800211 - RNA, 19 nt, Mycobacterium avium subsp. paratuberculosis
acgcaggugcgccgcucgu

SEQ ID NO: 800212 - RNA, 20 nt, Mycobacterium avium subsp. paratuberculosis
acgcaggugcgccgcucguc

SEQ ID NO: 800213 - RNA, 18 nt, Mycobacterium avium subsp. paratuberculosis
acgccacaaacagcgcgg

SEQ ID NO: 800214 - RNA, 19 nt, Mycobacterium avium subsp. paratuberculosis
acgccacaaacagcgcggc

SEQ ID NO: 800215 - RNA, 14 nt, Mycobacterium avium subsp. paratuberculosis
acgcaucgccgaga

SEQ ID NO: 800216 - RNA, 16 nt, Mycobacterium avium subsp. paratuberculosis
acgcaucagggccagc

SEQ ID NO: 800217 - RNA, 20 nt, Mycobacterium avium subsp. paratuberculosis
acgcaucagggccagccgau

SEQ ID NO: 800218 - RNA, 18 nt, Mycobacterium avium subsp. paratuberculosis
acgccaccuucaccgcgc

SEQ ID NO: 800219 - RNA, 19 nt, Mycobacterium avium subsp. paratuberculosis
acgccaccuucaccgcgcc

SEQ ID NO: 800220 - RNA, 23 nt, Mycobacterium avium subsp. paratuberculosis
acgccaccaccuccucgcgggcg

SEQ ID NO: 800221 - RNA, 12 nt, Mycobacterium avium subsp. paratuberculosis
acgccaccacgg

SEQ ID NO: 800222 - RNA, 19 nt, Mycobacterium avium subsp. paratuberculosis
acgccaccacggcgucgcu

SEQ ID NO: 800223 - RNA, 21 nt, Mycobacterium avium subsp. paratuberculosis
acgccaccacggcgucgcuga

SEQ ID NO: 800224 - RNA, 12 nt, Mycobacterium avium subsp. paratuberculosis
acgccagcggca

SEQ ID NO: 800225 - RNA, 14 nt, Mycobacterium avium subsp. paratuberculosis
acgccagcggcagc

SEQ ID NO: 800226 - RNA, 15 nt, Mycobacterium avium subsp. paratuberculosis
acgccagcggcagcg

SEQ ID NO: 800227 - RNA, 16 nt, Mycobacterium avium subsp. paratuberculosis
acgccagcggcagcgc

SEQ ID NO: 800228 - RNA, 17 nt, Mycobacterium avium subsp. paratuberculosis
acgccagcggcagcgcc

SEQ ID NO: 800229 - RNA, 14 nt, Mycobacterium avium subsp. paratuberculosis
acgccagcgcgacc

SEQ ID NO: 800230 - RNA, 14 nt, Mycobacterium avium subsp. paratuberculosis
acgccagccgggug

SEQ ID NO: 800231 - RNA, 17 nt, Mycobacterium avium subsp. paratuberculosis
acgccagccggguggcc

SEQ ID NO: 800232 - RNA, 19 nt, Mycobacterium avium subsp. paratuberculosis
acgccagccggguggcccg

SEQ ID NO: 800233 - RNA, 21 nt, Mycobacterium avium subsp. paratuberculosis
acgccagccggguggcccgcg

SEQ ID NO: 800234 - RNA, 13 nt, Mycobacterium avium subsp. paratuberculosis
acgccagcgccgc

SEQ ID NO: 800235 - RNA, 16 nt, Mycobacterium avium subsp. paratuberculosis
acgccagcgccgcaac

SEQ ID NO: 800236 - RNA, 21 nt, Mycobacterium avium subsp. paratuberculosis
acgccagcgccgcaacggcuc

SEQ ID NO: 800237 - RNA, 23 nt, Mycobacterium avium subsp. paratuberculosis
acgccagcgggccgugccgccau

SEQ ID NO: 800238 - RNA, 14 nt, Mycobacterium avium subsp. paratuberculosis
acgccagcgugacg

SEQ ID NO: 800239 - RNA, 20 nt, Mycobacterium avium subsp. paratuberculosis
acgccagcgugacgcccggc

SEQ ID NO: 800240 - RNA, 22 nt, Mycobacterium avium subsp. paratuberculosis
acgccagcgugacgcccggcgc

SEQ ID NO: 800241 - RNA, 23 nt, Mycobacterium avium subsp. paratuberculosis
acgccagcgugacgcccggcgcc

SEQ ID NO: 800242 - RNA, 17 nt, Mycobacterium avium subsp. paratuberculosis
acgccagcgugacgcuc

SEQ ID NO: 800243 - RNA, 19 nt, Mycobacterium avium subsp. paratuberculosis
acgccagcgugacgcucgg

SEQ ID NO: 800244 - RNA, 20 nt, Mycobacterium avium subsp. paratuberculosis
acgccagcgugacgcucggg

SEQ ID NO: 800245 - RNA, 21 nt, Mycobacterium avium subsp. paratuberculosis
acgccagcgugacgcucgggc

SEQ ID NO: 800246 - RNA, 22 nt, Mycobacterium avium subsp. paratuberculosis
acgccagcgugacgcucgggcu

SEQ ID NO: 800247 - RNA, 17 nt, Mycobacterium avium subsp. paratuberculosis
acgccagcugccgcgac

SEQ ID NO: 800248 - RNA, 23 nt, Mycobacterium avium subsp. paratuberculosis
acgccagcugcggaucgggcgug

SEQ ID NO: 800249 - RNA, 21 nt, Mycobacterium avium subsp. paratuberculosis
acgccagcgcgacccgcucga

SEQ ID NO: 800250 - RNA, 20 nt, Mycobacterium avium subsp. paratuberculosis
acgcgccacgccccggcgcc

SEQ ID NO: 800251 - RNA, 22 nt, Mycobacterium avium subsp. paratuberculosis
acgcgccacgccccggcgccgu

SEQ ID NO: 800252 - RNA, 15 nt, Mycobacterium avium subsp. paratuberculosis
acgcgcaccagggcc

SEQ ID NO: 800253 - RNA, 17 nt, Mycobacterium avium subsp. paratuberculosis
acgcgcaccagggccgc

SEQ ID NO: 800254 - RNA, 24 nt, Mycobacterium avium subsp. paratuberculosis
acgcgcaccagggccgcgagcgcu

SEQ ID NO: 800255 - RNA, 12 nt, Mycobacterium avium subsp. paratuberculosis
acgcgcacccgg

SEQ ID NO: 800256 - RNA, 14 nt, Mycobacterium avium subsp. paratuberculosis
acgcgcaccgccac

SEQ ID NO: 800257 - RNA, 15 nt, Mycobacterium avium subsp. paratuberculosis
acgcgcaccgccacc

SEQ ID NO: 800258 - RNA, 16 nt, Mycobacterium avium subsp. paratuberculosis
acgcgcaccgccaccg

SEQ ID NO: 800259 - RNA, 17 nt, Mycobacterium avium subsp. paratuberculosis
acgcgcaccgccaccgc

SEQ ID NO: 800260 - RNA, 22 nt, Mycobacterium avium subsp. paratuberculosis
acgcgcaccgccaccgcccgcu

SEQ ID NO: 800261 - RNA, 19 nt, Mycobacterium avium subsp. paratuberculosis
acgcgauucucgcugcggc

SEQ ID NO: 800262 - RNA, 22 nt, Mycobacterium avium subsp. paratuberculosis
acgcgauucucgcugcggcgca

SEQ ID NO: 800263 - RNA, 15 nt, Mycobacterium avium subsp. paratuberculosis
acgcgcaauccugcc

SEQ ID NO: 800264 - RNA, 17 nt, Mycobacterium avium subsp. paratuberculosis
acgcgcaauccugcccg

SEQ ID NO: 800265 - RNA, 19 nt, Mycobacterium avium subsp. paratuberculosis
acgcgcaauccugcccggu

SEQ ID NO: 800266 - RNA, 23 nt, Mycobacterium avium subsp. paratuberculosis
acgcgcacacggccucgcccagc

SEQ ID NO: 800267 - RNA, 11 nt, Mycobacterium avium subsp. paratuberculosis
acgcgccggcc

SEQ ID NO: 800268 - RNA, 14 nt, Mycobacterium avium subsp. paratuberculosis
acgcgccggccagc

SEQ ID NO: 800269 - RNA, 15 nt, Mycobacterium avium subsp. paratuberculosis
acgcgccggccagcc

SEQ ID NO: 800270 - RNA, 16 nt, Mycobacterium avium subsp. paratuberculosis
acgcgccggccagccg

SEQ ID NO: 800271 - RNA, 20 nt, Mycobacterium avium subsp. paratuberculosis
acgcgccggccagccggcuc

SEQ ID NO: 800272 - RNA, 17 nt, Mycobacterium avium subsp. paratuberculosis
acgcgcgugacggcggg

SEQ ID NO: 800273 - RNA, 18 nt, Mycobacterium avium subsp. paratuberculosis
acgcgcgugacggcgggg

SEQ ID NO: 800274 - RNA, 15 nt, Mycobacterium avium subsp. paratuberculosis
acgcgcgggucgucg

SEQ ID NO: 800275 - RNA, 17 nt, Mycobacterium avium subsp. paratuberculosis
acgcgcgggucgucggc

SEQ ID NO: 800276 - RNA, 20 nt, Mycobacterium avium subsp. paratuberculosis
acgcgcgggucgucggccug

SEQ ID NO: 800277 - RNA, 19 nt, Mycobacterium avium subsp. paratuberculosis
acgcgcggaugcccaggcc

SEQ ID NO: 800278 - RNA, 17 nt, Mycobacterium avium subsp. paratuberculosis
acgcgccgaacaacggc

SEQ ID NO: 800279 - RNA, 15 nt, Mycobacterium avium subsp. paratuberculosis
acgcgccccgccggg

SEQ ID NO: 800280 - RNA, 20 nt, Mycobacterium avium subsp. paratuberculosis
acgcgcccggcgacgcggcg

SEQ ID NO: 800281 - RNA, 16 nt, Mycobacterium avium subsp. paratuberculosis
acgcgccgcacugcac

SEQ ID NO: 800282 - RNA, 12 nt, Mycobacterium avium subsp. paratuberculosis
acgcgccgaucg

SEQ ID NO: 800283 - RNA, 19 nt, Mycobacterium avium subsp. paratuberculosis
acgcgccgaucgagacgau

SEQ ID NO: 800284 - RNA, 19 nt, Mycobacterium avium subsp. paratuberculosis
acgcgccgaugccgaacgu

SEQ ID NO: 800285 - RNA, 13 nt, Mycobacterium avium subsp. paratuberculosis
acgcgccgccgag

SEQ ID NO: 800286 - RNA, 15 nt, Mycobacterium avium subsp. paratuberculosis
acgcgccgccgagca

SEQ ID NO: 800287 - RNA, 13 nt, Mycobacterium avium subsp. paratuberculosis
acgccuuggugcc

SEQ ID NO: 800288 - RNA, 15 nt, Mycobacterium avium subsp. paratuberculosis
acgccuuggugccgu

SEQ ID NO: 800289 - RNA, 20 nt, Mycobacterium avium subsp. paratuberculosis
acgccuugcacacggccuug

SEQ ID NO: 800290 - RNA, 23 nt, Mycobacterium avium subsp. paratuberculosis
acgcgauagaccucacggucggc

SEQ ID NO: 800291 - RNA, 16 nt, Mycobacterium avium subsp. paratuberculosis
acgcgaugaucagcuc

SEQ ID NO: 800292 - RNA, 23 nt, Mycobacterium avium subsp. paratuberculosis
acgcgaugaucagcucgcgcauc

SEQ ID NO: 800293 - RNA, 19 nt, Mycobacterium avium subsp. paratuberculosis
acgcgauggcgcuggccgc

SEQ ID NO: 800294 - RNA, 19 nt, Mycobacterium avium subsp. paratuberculosis
acgcgauggcggcgcgcuc

SEQ ID NO: 800295 - RNA, 22 nt, Mycobacterium avium subsp. paratuberculosis
acgcgauggcggcgcgcucguc

SEQ ID NO: 800296 - RNA, 19 nt, Mycobacterium avium subsp. paratuberculosis
acgccuccacauacgcggc

SEQ ID NO: 800297 - RNA, 22 nt, Mycobacterium avium subsp. paratuberculosis
acgccucccccacccgcacggu

SEQ ID NO: 800298 - RNA, 20 nt, Mycobacterium avium subsp. paratuberculosis
acgccuccgaauccagcgcg

SEQ ID NO: 800299 - RNA, 21 nt, Mycobacterium avium subsp. paratuberculosis
acgccuccgaauccagcgcgc

SEQ ID NO: 800300 - RNA, 23 nt, Mycobacterium avium subsp. paratuberculosis
acgccuccgccgccccgucgguc

SEQ ID NO: 800301 - RNA, 13 nt, Mycobacterium avium subsp. paratuberculosis
acgccuccggcag

SEQ ID NO: 800302 - RNA, 23 nt, Mycobacterium avium subsp. paratuberculosis
acgccuccggcaguacgcgccgg

SEQ ID NO: 800303 - RNA, 15 nt, Mycobacterium avium subsp. paratuberculosis
acgccucgagcgccc

SEQ ID NO: 800304 - RNA, 17 nt, Mycobacterium avium subsp. paratuberculosis
acgccucgagcgcccgg

SEQ ID NO: 800305 - RNA, 20 nt, Mycobacterium avium subsp. paratuberculosis
acgccucaccccagcgcgac

SEQ ID NO: 800306 - RNA, 21 nt, Mycobacterium avium subsp. paratuberculosis
acgccucaccccagcgcgacc

SEQ ID NO: 800307 - RNA, 21 nt, Mycobacterium avium subsp. paratuberculosis
acgccuggacagggucguuca

SEQ ID NO: 800308 - RNA, 23 nt, Mycobacterium avium subsp. paratuberculosis
acgccuggacagggucguucagc

SEQ ID NO: 800309 - RNA, 20 nt, Mycobacterium avium subsp. paratuberculosis
acgccuggcggaaggccgcg

SEQ ID NO: 800310 - RNA, 13 nt, Mycobacterium avium subsp. paratuberculosis
acgccgccgccga

SEQ ID NO: 800311 - RNA, 16 nt, Mycobacterium avium subsp. paratuberculosis
acgccgccgccgagcu

SEQ ID NO: 800312 - RNA, 21 nt, Mycobacterium avium subsp. paratuberculosis
acgccgccgccgagcucggcc

SEQ ID NO: 800313 - RNA, 22 nt, Mycobacterium avium subsp. paratuberculosis
acgccgccgccgagcucggcca

SEQ ID NO: 800314 - RNA, 15 nt, Mycobacterium avium subsp. paratuberculosis
acgccgcgcuugacg

SEQ ID NO: 800315 - RNA, 17 nt, Mycobacterium avium subsp. paratuberculosis
acgccgcgcuugacggc

SEQ ID NO: 800316 - RNA, 22 nt, Mycobacterium avium subsp. paratuberculosis
acgccgcgcuugacggccgggc

SEQ ID NO: 800317 - RNA, 21 nt, Mycobacterium avium subsp. paratuberculosis
acgccgcggaagccccaggcc

SEQ ID NO: 800318 - RNA, 20 nt, Mycobacterium avium subsp. paratuberculosis
acgccgcggaaggccagcuc

SEQ ID NO: 800319 - RNA, 18 nt, Mycobacterium avium subsp. paratuberculosis
acgccgccgaaccccagc

SEQ ID NO: 800320 - RNA, 21 nt, Mycobacterium avium subsp. paratuberculosis
acgccgcugggcguggugcgg

SEQ ID NO: 800321 - RNA, 13 nt, Mycobacterium avium subsp. paratuberculosis
acgccgcugccgg

SEQ ID NO: 800322 - RNA, 12 nt, Mycobacterium avium subsp. paratuberculosis
acgccgcucggc

SEQ ID NO: 800323 - RNA, 13 nt, Mycobacterium avium subsp. paratuberculosis
acgccgcucggcc

SEQ ID NO: 800324 - RNA, 15 nt, Mycobacterium avium subsp. paratuberculosis
acgccgcucggccag

SEQ ID NO: 800325 - RNA, 18 nt, Mycobacterium avium subsp. paratuberculosis
acgccgcucggccagcgc

SEQ ID NO: 800326 - RNA, 14 nt, Mycobacterium avium subsp. paratuberculosis
acgccgcguccucg

SEQ ID NO: 800327 - RNA, 18 nt, Mycobacterium avium subsp. paratuberculosis
acgccgcguccucgucga

SEQ ID NO: 800328 - RNA, 14 nt, Mycobacterium avium subsp. paratuberculosis
acgccgcggucgcu

SEQ ID NO: 800329 - RNA, 22 nt, Mycobacterium avium subsp. paratuberculosis
acgccgcggucgcugacccgcc

SEQ ID NO: 800330 - RNA, 21 nt, Mycobacterium avium subsp. paratuberculosis
acgccgcgguggccgggaugc

SEQ ID NO: 800331 - RNA, 20 nt, Mycobacterium avium subsp. paratuberculosis
acgccgcgguuggucaccag

SEQ ID NO: 800332 - RNA, 13 nt, Mycobacterium avium subsp. paratuberculosis
acgccgccgcgaa

SEQ ID NO: 800333 - RNA, 22 nt, Mycobacterium avium subsp. paratuberculosis
acgccgccgcgaacucaggcgc

SEQ ID NO: 800334 - RNA, 20 nt, Mycobacterium avium subsp. paratuberculosis
acgccgccgcgucgucaucg

SEQ ID NO: 800335 - RNA, 21 nt, Mycobacterium avium subsp. paratuberculosis
acgccgccgcgucgucaucgu

SEQ ID NO: 800336 - RNA, 21 nt, Mycobacterium avium subsp. paratuberculosis
acgccggaaucgauuggugcg

SEQ ID NO: 800337 - RNA, 23 nt, Mycobacterium avium subsp. paratuberculosis
acgccggaaucgauuggugcgca

SEQ ID NO: 800338 - RNA, 23 nt, Mycobacterium avium subsp. paratuberculosis
acgccggacagcuggcggucgcu

SEQ ID NO: 800339 - RNA, 12 nt, Mycobacterium avium subsp. paratuberculosis
acgccggacccc

SEQ ID NO: 800340 - RNA, 12 nt, Mycobacterium avium subsp. paratuberculosis
acgccggacgug

SEQ ID NO: 800341 - RNA, 16 nt, Mycobacterium avium subsp. paratuberculosis
acgccggcaucagcga

SEQ ID NO: 800342 - RNA, 20 nt, Mycobacterium avium subsp. paratuberculosis
acgccggcaucagcgagacg

SEQ ID NO: 800343 - RNA, 23 nt, Mycobacterium avium subsp. paratuberculosis
acgccggcaucagcgagacgacc

SEQ ID NO: 800344 - RNA, 16 nt, Mycobacterium avium subsp. paratuberculosis
acgccggccccggcga

SEQ ID NO: 800345 - RNA, 17 nt, Mycobacterium avium subsp. paratuberculosis
acgccggccccggcgac

SEQ ID NO: 800346 - RNA, 19 nt, Mycobacterium avium subsp. paratuberculosis
acgccggccccggcgacgg

SEQ ID NO: 800347 - RNA, 21 nt, Mycobacterium avium subsp. paratuberculosis
acgccggccucucgucgacga

SEQ ID NO: 800348 - RNA, 21 nt, Mycobacterium avium subsp. paratuberculosis
acgccguggcggcgggccagc

SEQ ID NO: 800349 - RNA, 15 nt, Mycobacterium avium subsp. paratuberculosis
acgccguguugacgu

SEQ ID NO: 800350 - RNA, 18 nt, Mycobacterium avium subsp. paratuberculosis
acgccguugacaccgggu

SEQ ID NO: 800351 - RNA, 21 nt, Mycobacterium avium subsp. paratuberculosis
acgccguugacaccgggugcg

SEQ ID NO: 800352 - RNA, 22 nt, Mycobacterium avium subsp. paratuberculosis
acgccguugaccccgacggcgc

SEQ ID NO: 800353 - RNA, 14 nt, Mycobacterium avium subsp. paratuberculosis
acgccggccggcgu

SEQ ID NO: 800354 - RNA, 15 nt, Mycobacterium avium subsp. paratuberculosis
acgccggccggcgug

SEQ ID NO: 800355 - RNA, 14 nt, Mycobacterium avium subsp. paratuberculosis
acgccgaccgcggu

SEQ ID NO: 800356 - RNA, 21 nt, Mycobacterium avium subsp. paratuberculosis
acgccgaccgcggucgcggcg

SEQ ID NO: 800357 - RNA, 18 nt, Mycobacterium avium subsp. paratuberculosis
acgccgaauccgggcaug

SEQ ID NO: 800358 - RNA, 14 nt, Mycobacterium avium subsp. paratuberculosis
acgccgaacugccg

SEQ ID NO: 800359 - RNA, 15 nt, Mycobacterium avium subsp. paratuberculosis
acgccgaacugccgg

SEQ ID NO: 800360 - RNA, 18 nt, Mycobacterium avium subsp. paratuberculosis
acgccgaacugccggacc

SEQ ID NO: 800361 - RNA, 21 nt, Mycobacterium avium subsp. paratuberculosis
acgccgacaucucccggucga

SEQ ID NO: 800362 - RNA, 19 nt, Mycobacterium avium subsp. paratuberculosis
acgccgaccacccccagcc

SEQ ID NO: 800363 - RNA, 20 nt, Mycobacterium avium subsp. paratuberculosis
acgccgacgucaggguggcc

SEQ ID NO: 800364 - RNA, 17 nt, Mycobacterium avium subsp. paratuberculosis
acgccgacuagcgcggc

SEQ ID NO: 800365 - RNA, 23 nt, Mycobacterium avium subsp. paratuberculosis
acgccgacuagcgcggcggccuc

SEQ ID NO: 800366 - RNA, 18 nt, Mycobacterium avium subsp. paratuberculosis
acgccgacgauccgcgcc

SEQ ID NO: 800367 - RNA, 19 nt, Mycobacterium avium subsp. paratuberculosis
acgccgacgauccgcgccg

SEQ ID NO: 800368 - RNA, 20 nt, Mycobacterium avium subsp. paratuberculosis
acgccgacgauccgcgccgc

SEQ ID NO: 800369 - RNA, 22 nt, Mycobacterium avium subsp. paratuberculosis
acgccgacgauccgcgccgcga

SEQ ID NO: 800370 - RNA, 22 nt, Mycobacterium avium subsp. paratuberculosis
acgccgacgcauguccgccguc

SEQ ID NO: 800371 - RNA, 15 nt, Mycobacterium avium subsp. paratuberculosis
acgccgacgcccagc

SEQ ID NO: 800372 - RNA, 13 nt, Mycobacterium avium subsp. paratuberculosis
acgccgagcagca

SEQ ID NO: 800373 - RNA, 14 nt, Mycobacterium avium subsp. paratuberculosis
acgccgagcagcac

SEQ ID NO: 800374 - RNA, 18 nt, Mycobacterium avium subsp. paratuberculosis
acgccgagcagcaccggc

SEQ ID NO: 800375 - RNA, 20 nt, Mycobacterium avium subsp. paratuberculosis
acgccgagcagcaccggcau

SEQ ID NO: 800376 - RNA, 21 nt, Mycobacterium avium subsp. paratuberculosis
acgccgagcagcaccggcaug

SEQ ID NO: 800377 - RNA, 22 nt, Mycobacterium avium subsp. paratuberculosis
acgccgagcagcaccggcaugu

SEQ ID NO: 800378 - RNA, 15 nt, Mycobacterium avium subsp. paratuberculosis
acgccgagcagcacc

SEQ ID NO: 800379 - RNA, 18 nt, Mycobacterium avium subsp. paratuberculosis
acgccgaggaggccgcgg

SEQ ID NO: 800380 - RNA, 19 nt, Mycobacterium avium subsp. paratuberculosis
acgccgaggaggccgcggc

SEQ ID NO: 800381 - RNA, 20 nt, Mycobacterium avium subsp. paratuberculosis
acgccgaggaggccgcggcg

SEQ ID NO: 800382 - RNA, 21 nt, Mycobacterium avium subsp. paratuberculosis
acgccgaggaggccgcggcga

SEQ ID NO: 800383 - RNA, 13 nt, Mycobacterium avium subsp. paratuberculosis
acgccgaggcgca

SEQ ID NO: 800384 - RNA, 16 nt, Mycobacterium avium subsp. paratuberculosis
acgccgaggcgugccg

SEQ ID NO: 800385 - RNA, 15 nt, Mycobacterium avium subsp. paratuberculosis
acgccgagggcggcg

SEQ ID NO: 800386 - RNA, 18 nt, Mycobacterium avium subsp. paratuberculosis
acgccgagggcggcggcu

SEQ ID NO: 800387 - RNA, 17 nt, Mycobacterium avium subsp. paratuberculosis
acgccgagggugccggc

SEQ ID NO: 800388 - RNA, 20 nt, Mycobacterium avium subsp. paratuberculosis
acgccgagggugccggccac

SEQ ID NO: 800389 - RNA, 21 nt, Mycobacterium avium subsp. paratuberculosis
acgccgagggugccggccacc

SEQ ID NO: 800390 - RNA, 22 nt, Mycobacterium avium subsp. paratuberculosis
acgccgagggugccggccaccg

SEQ ID NO: 800391 - RNA, 14 nt, Mycobacterium avium subsp. paratuberculosis
acgccgaucaccgc

SEQ ID NO: 800392 - RNA, 16 nt, Mycobacterium avium subsp. paratuberculosis
acgccgaucaccggca

SEQ ID NO: 800393 - RNA, 20 nt, Mycobacterium avium subsp. paratuberculosis
acgccgaucaccggcacgug

SEQ ID NO: 800394 - RNA, 18 nt, Mycobacterium avium subsp. paratuberculosis
acgccgauccgcagccgc

SEQ ID NO: 800395 - RNA, 20 nt, Mycobacterium avium subsp. paratuberculosis
acgccgauccgcagccgcug

SEQ ID NO: 800396 - RNA, 23 nt, Mycobacterium avium subsp. paratuberculosis
acgccgauccgcagccgcugccg

SEQ ID NO: 800397 - RNA, 17 nt, Mycobacterium avium subsp. paratuberculosis
acgccgauccgcugcgg

SEQ ID NO: 800398 - RNA, 13 nt, Mycobacterium avium subsp. paratuberculosis
acgccgcaccgca

SEQ ID NO: 800399 - RNA, 13 nt, Mycobacterium avium subsp. paratuberculosis
acgccgcacgcga

SEQ ID NO: 800400 - RNA, 14 nt, Mycobacterium avium subsp. paratuberculosis
acgccgcacgcgac

SEQ ID NO: 800401 - RNA, 22 nt, Mycobacterium avium subsp. paratuberculosis
acgccgcacgcgaccgcgucga

SEQ ID NO: 800402 - RNA, 23 nt, Mycobacterium avium subsp. paratuberculosis
acgccgaugcgguugaucaacgg

SEQ ID NO: 800403 - RNA, 21 nt, Mycobacterium avium subsp. paratuberculosis
acgccgauggccugguggccc

SEQ ID NO: 800404 - RNA, 19 nt, Mycobacterium avium subsp. paratuberculosis
acgccgauggugaccucgg

SEQ ID NO: 800405 - RNA, 21 nt, Mycobacterium avium subsp. paratuberculosis
acgccgauggugaccucgguc

SEQ ID NO: 800406 - RNA, 16 nt, Mycobacterium avium subsp. paratuberculosis
acgccgaugugcucgg

SEQ ID NO: 800407 - RNA, 21 nt, Mycobacterium avium subsp. paratuberculosis
acgccgaugugcucggucaac

SEQ ID NO: 800408 - RNA, 14 nt, Mycobacterium avium subsp. paratuberculosis
acgccgaugaucug

SEQ ID NO: 800409 - RNA, 15 nt, Mycobacterium avium subsp. paratuberculosis
acgccgaugaucugg

SEQ ID NO: 800410 - RNA, 13 nt, Mycobacterium avium subsp. paratuberculosis
acgccgcccaggc

SEQ ID NO: 800411 - RNA, 14 nt, Mycobacterium avium subsp. paratuberculosis
acgccgcccaggcc

SEQ ID NO: 800412 - RNA, 24 nt, Mycobacterium avium subsp. paratuberculosis
acgccgcccaggccccggccgagc

SEQ ID NO: 800413 - RNA, 18 nt, Mycobacterium avium subsp. paratuberculosis
acgccgcccccgccgcga

SEQ ID NO: 800414 - RNA, 20 nt, Mycobacterium avium subsp. paratuberculosis
acgccgcccccgccgcgagc

SEQ ID NO: 800415 - RNA, 21 nt, Mycobacterium avium subsp. paratuberculosis
acgccgcccccgccgcgagca

SEQ ID NO: 800416 - RNA, 17 nt, Mycobacterium avium subsp. paratuberculosis
acgaauugccgguggug

SEQ ID NO: 800417 - RNA, 17 nt, Mycobacterium avium subsp. paratuberculosis
acgaccaggaugcccag

SEQ ID NO: 800418 - RNA, 19 nt, Mycobacterium avium subsp. paratuberculosis
acgaccaggaugcccagga

SEQ ID NO: 800419 - RNA, 13 nt, Mycobacterium avium subsp. paratuberculosis
acgaccaggucca

SEQ ID NO: 800420 - RNA, 18 nt, Mycobacterium avium subsp. paratuberculosis
acgaccagugcccggcca

SEQ ID NO: 800421 - RNA, 14 nt, Mycobacterium avium subsp. paratuberculosis
acgacaccaccgug

SEQ ID NO: 800422 - RNA, 15 nt, Mycobacterium avium subsp. paratuberculosis
acgaccagcggcagc

SEQ ID NO: 800423 - RNA, 15 nt, Mycobacterium avium subsp. paratuberculosis
acgaccaucagcgcc

SEQ ID NO: 800424 - RNA, 13 nt, Mycobacterium avium subsp. paratuberculosis
acgaccagcggca

SEQ ID NO: 800425 - RNA, 13 nt, Mycobacterium avium subsp. paratuberculosis
acgaccccggcgg

SEQ ID NO: 800426 - RNA, 18 nt, Mycobacterium avium subsp. paratuberculosis
acgaccccggcggcaccg

SEQ ID NO: 800427 - RNA, 15 nt, Mycobacterium avium subsp. paratuberculosis
acgaccccgcccacg

SEQ ID NO: 800428 - RNA, 17 nt, Mycobacterium avium subsp. paratuberculosis
acgaccccgcccacgaa

SEQ ID NO: 800429 - RNA, 13 nt, Mycobacterium avium subsp. paratuberculosis
acgacccggccac

SEQ ID NO: 800430 - RNA, 16 nt, Mycobacterium avium subsp. paratuberculosis
acgacccggccaccgc

SEQ ID NO: 800431 - RNA, 17 nt, Mycobacterium avium subsp. paratuberculosis
acgacccggccaccgcc

SEQ ID NO: 800432 - RNA, 15 nt, Mycobacterium avium subsp. paratuberculosis
acgaagucgacggcg

SEQ ID NO: 800433 - RNA, 17 nt, Mycobacterium avium subsp. paratuberculosis
acgaaguugaucgcggc

SEQ ID NO: 800434 - RNA, 23 nt, Mycobacterium avium subsp. paratuberculosis
acgaaguugguguccacccgcgc

SEQ ID NO: 800435 - RNA, 20 nt, Mycobacterium avium subsp. paratuberculosis
acgaaguagaagaucagcgc

SEQ ID NO: 800436 - RNA, 19 nt, Mycobacterium avium subsp. paratuberculosis
accuugggcauccgcucgc

SEQ ID NO: 800437 - RNA, 16 nt, Mycobacterium avium subsp. paratuberculosis
accuuggucagcuccc

SEQ ID NO: 800438 - RNA, 16 nt, Mycobacterium avium subsp. paratuberculosis
accuugguggccgcgg

SEQ ID NO: 800439 - RNA, 20 nt, Mycobacterium avium subsp. paratuberculosis
accuugguggccgcggccgc

SEQ ID NO: 800440 - RNA, 15 nt, Mycobacterium avium subsp. paratuberculosis
acgaccgcgacggcg

SEQ ID NO: 800441 - RNA, 14 nt, Mycobacterium avium subsp. paratuberculosis
acgaccgcgacgug

SEQ ID NO: 800442 - RNA, 20 nt, Mycobacterium avium subsp. paratuberculosis
acgaccggcagcaccggccg

SEQ ID NO: 800443 - RNA, 17 nt, Mycobacterium avium subsp. paratuberculosis
acgaccggcagccgcgc

SEQ ID NO: 800444 - RNA, 18 nt, Mycobacterium avium subsp. paratuberculosis
acgaccggcagccgcgcc

SEQ ID NO: 800445 - RNA, 13 nt, Mycobacterium avium subsp. paratuberculosis
acgaccggguccg

SEQ ID NO: 800446 - RNA, 20 nt, Mycobacterium avium subsp. paratuberculosis
acgaccgggucugccacgcc

SEQ ID NO: 800447 - RNA, 22 nt, Mycobacterium avium subsp. paratuberculosis
acgaccgucaucaucaccggga

SEQ ID NO: 800448 - RNA, 20 nt, Mycobacterium avium subsp. paratuberculosis
acgaccgcaccgaccagcgg

SEQ ID NO: 800449 - RNA, 13 nt, Mycobacterium avium subsp. paratuberculosis
acgaccucccccg

SEQ ID NO: 800450 - RNA, 20 nt, Mycobacterium avium subsp. paratuberculosis
acgaccucccccgacgccga

SEQ ID NO: 800451 - RNA, 21 nt, Mycobacterium avium subsp. paratuberculosis
acgaccucccccgacgccgac

SEQ ID NO: 800452 - RNA, 22 nt, Mycobacterium avium subsp. paratuberculosis
acgaccucccccgacgccgaca

SEQ ID NO: 800453 - RNA, 20 nt, Mycobacterium avium subsp. paratuberculosis
acgaccucgcccgccgcgac

SEQ ID NO: 800454 - RNA, 14 nt, Mycobacterium avium subsp. paratuberculosis
acgaccucgccgac

SEQ ID NO: 800455 - RNA, 15 nt, Mycobacterium avium subsp. paratuberculosis
acgaccucgccgacg

SEQ ID NO: 800456 - RNA, 13 nt, Mycobacterium avium subsp. paratuberculosis
acgaccucggggu

SEQ ID NO: 800457 - RNA, 13 nt, Mycobacterium avium subsp. paratuberculosis
acgaccucgucgu

SEQ ID NO: 800458 - RNA, 12 nt, Mycobacterium avium subsp. paratuberculosis
acgacgacgucg

SEQ ID NO: 800459 - RNA, 16 nt, Mycobacterium avium subsp. paratuberculosis
acgacgacgucgacga

SEQ ID NO: 800460 - RNA, 14 nt, Mycobacterium avium subsp. paratuberculosis
acgacgagccgucg

SEQ ID NO: 800461 - RNA, 18 nt, Mycobacterium avium subsp. paratuberculosis
acgacgaacgcggugagc

SEQ ID NO: 800462 - RNA, 15 nt, Mycobacterium avium subsp. paratuberculosis
acgacgaacggguag

SEQ ID NO: 800463 - RNA, 18 nt, Mycobacterium avium subsp. paratuberculosis
acgacgaagucggucagc

SEQ ID NO: 800464 - RNA, 21 nt, Mycobacterium avium subsp. paratuberculosis
acgacgaagucggucagcguc

SEQ ID NO: 800465 - RNA, 22 nt, Mycobacterium avium subsp. paratuberculosis
acgacgaagucggucagcgucg

SEQ ID NO: 800466 - RNA, 24 nt, Mycobacterium avium subsp. paratuberculosis
acgacgaaucccgccucggugagc

SEQ ID NO: 800467 - RNA, 17 nt, Mycobacterium avium subsp. paratuberculosis
acgaccuugucgcgcac

SEQ ID NO: 800468 - RNA, 21 nt, Mycobacterium avium subsp. paratuberculosis
acgaccuugucgcgcacccgc

SEQ ID NO: 800469 - RNA, 22 nt, Mycobacterium avium subsp. paratuberculosis
acgaccuugucgcgcacccgca

SEQ ID NO: 800470 - RNA, 23 nt, Mycobacterium avium subsp. paratuberculosis
acgaccuugucgcgcacccgcac

SEQ ID NO: 800471 - RNA, 12 nt, Mycobacterium avium subsp. paratuberculosis
acgaccuggcgg

SEQ ID NO: 800472 - RNA, 14 nt, Mycobacterium avium subsp. paratuberculosis
acgaccuggcgggc

SEQ ID NO: 800473 - RNA, 19 nt, Mycobacterium avium subsp. paratuberculosis
acgaccugggcgccgucgc

SEQ ID NO: 800474 - RNA, 16 nt, Mycobacterium avium subsp. paratuberculosis
acgaccuggucgccgc

SEQ ID NO: 800475 - RNA, 20 nt, Mycobacterium avium subsp. paratuberculosis
acgaccuggucgccgccguc

SEQ ID NO: 800476 - RNA, 13 nt, Mycobacterium avium subsp. paratuberculosis
acgacgcggcgcg

SEQ ID NO: 800477 - RNA, 16 nt, Mycobacterium avium subsp. paratuberculosis
acgacgcggcgcgcga

SEQ ID NO: 800478 - RNA, 15 nt, Mycobacterium avium subsp. paratuberculosis
acgacgucgcgcagg

SEQ ID NO: 800479 - RNA, 14 nt, Mycobacterium avium subsp. paratuberculosis
acgacgcggcacgc

SEQ ID NO: 800480 - RNA, 21 nt, Mycobacterium avium subsp. paratuberculosis
acgacgcggcacgccgcucgu

SEQ ID NO: 800481 - RNA, 17 nt, Mycobacterium avium subsp. paratuberculosis
acgacgaccgcgacggc

SEQ ID NO: 800482 - RNA, 17 nt, Mycobacterium avium subsp. paratuberculosis
acgacgaccgcguccga

SEQ ID NO: 800483 - RNA, 23 nt, Mycobacterium avium subsp. paratuberculosis
acgacgaccucccccgacgccga

SEQ ID NO: 800484 - RNA, 15 nt, Mycobacterium avium subsp. paratuberculosis
acgacgccaccaucg

SEQ ID NO: 800485 - RNA, 16 nt, Mycobacterium avium subsp. paratuberculosis
acgacgccaccaucga

SEQ ID NO: 800486 - RNA, 20 nt, Mycobacterium avium subsp. paratuberculosis
acgacgccagcugccgcgac

SEQ ID NO: 800487 - RNA, 11 nt, Mycobacterium avium subsp. paratuberculosis
acgacgccgaa

SEQ ID NO: 800488 - RNA, 17 nt, Mycobacterium avium subsp. paratuberculosis
acgacgccgauccgcag

SEQ ID NO: 800489 - RNA, 21 nt, Mycobacterium avium subsp. paratuberculosis
acgacguugcgggccaggucg

SEQ ID NO: 800490 - RNA, 16 nt, Mycobacterium avium subsp. paratuberculosis
acgacguuggccagca

SEQ ID NO: 800491 - RNA, 18 nt, Mycobacterium avium subsp. paratuberculosis
acgacguuggccagcacc

SEQ ID NO: 800492 - RNA, 17 nt, Mycobacterium avium subsp. paratuberculosis
acgacgucgacgacccg

SEQ ID NO: 800493 - RNA, 19 nt, Mycobacterium avium subsp. paratuberculosis
acgacgucgucguccucgu

SEQ ID NO: 800494 - RNA, 15 nt, Mycobacterium avium subsp. paratuberculosis
acgacgugacgaccu

SEQ ID NO: 800495 - RNA, 21 nt, Mycobacterium avium subsp. paratuberculosis
acgacucguucgacgccggug

SEQ ID NO: 800496 - RNA, 15 nt, Mycobacterium avium subsp. paratuberculosis
acgacucuuccagga

SEQ ID NO: 800497 - RNA, 13 nt, Mycobacterium avium subsp. paratuberculosis
acgacugcgcggc

SEQ ID NO: 800498 - RNA, 17 nt, Mycobacterium avium subsp. paratuberculosis
acgacugcgcggccggc

SEQ ID NO: 800499 - RNA, 18 nt, Mycobacterium avium subsp. paratuberculosis
acgacugcgcggccggcg

SEQ ID NO: 800500 - RNA, 17 nt, Mycobacterium avium subsp. paratuberculosis
accuuccaccaccgcgg

SEQ ID NO: 800501 - RNA, 15 nt, Mycobacterium avium subsp. paratuberculosis
accuugcccgucgcg

SEQ ID NO: 800502 - RNA, 16 nt, Mycobacterium avium subsp. paratuberculosis
accuugcccgucgcgu

SEQ ID NO: 800503 - RNA, 17 nt, Mycobacterium avium subsp. paratuberculosis
accuucaccgaccagcu

SEQ ID NO: 800504 - RNA, 21 nt, Mycobacterium avium subsp. paratuberculosis
accuuggccggugcgccgacc

SEQ ID NO: 800505 - RNA, 18 nt, Mycobacterium avium subsp. paratuberculosis
accuugcgcagccggcag

SEQ ID NO: 800506 - RNA, 18 nt, Mycobacterium avium subsp. paratuberculosis
accuguuuggccagccag

SEQ ID NO: 800507 - RNA, 16 nt, Mycobacterium avium subsp. paratuberculosis
accuggucgccgaacg

SEQ ID NO: 800508 - RNA, 14 nt, Mycobacterium avium subsp. paratuberculosis
accuggcgcagcac

SEQ ID NO: 800509 - RNA, 14 nt, Mycobacterium avium subsp. paratuberculosis
accuggcggccgga

SEQ ID NO: 800510 - RNA, 14 nt, Mycobacterium avium subsp. paratuberculosis
accuggcgggccag

SEQ ID NO: 800511 - RNA, 16 nt, Mycobacterium avium subsp. paratuberculosis
accuggcgggccagcu

SEQ ID NO: 800512 - RNA, 20 nt, Mycobacterium avium subsp. paratuberculosis
accugggaugucuagccgcc

SEQ ID NO: 800513 - RNA, 23 nt, Mycobacterium avium subsp. paratuberculosis
accugggaugucuagccgccgag

SEQ ID NO: 800514 - RNA, 13 nt, Mycobacterium avium subsp. paratuberculosis
accugggcgccgu

SEQ ID NO: 800515 - RNA, 20 nt, Mycobacterium avium subsp. paratuberculosis
accugggcgccgucgccgac

SEQ ID NO: 800516 - RNA, 21 nt, Mycobacterium avium subsp. paratuberculosis
accugggcgccgucgccgacg

SEQ ID NO: 800517 - RNA, 14 nt, Mycobacterium avium subsp. paratuberculosis
accugggcggggcu

SEQ ID NO: 800518 - RNA, 22 nt, Mycobacterium avium subsp. paratuberculosis
accugggcgucgucggccggcu

SEQ ID NO: 800519 - RNA, 13 nt, Mycobacterium avium subsp. paratuberculosis
accuggucgccga

SEQ ID NO: 800520 - RNA, 14 nt, Mycobacterium avium subsp. paratuberculosis
accuggucgccgaa

SEQ ID NO: 800521 - RNA, 16 nt, Mycobacterium avium subsp. paratuberculosis
accugggucaucaccu

SEQ ID NO: 800522 - RNA, 20 nt, Mycobacterium avium subsp. paratuberculosis
accugggugaucuuggugaa

SEQ ID NO: 800523 - RNA, 22 nt, Mycobacterium avium subsp. paratuberculosis
accugcugggcggcaccacccg

SEQ ID NO: 800524 - RNA, 17 nt, Mycobacterium avium subsp. paratuberculosis
accugcugggcgggcag

SEQ ID NO: 800525 - RNA, 18 nt, Mycobacterium avium subsp. paratuberculosis
accugcugggcgggcagc

SEQ ID NO: 800526 - RNA, 14 nt, Mycobacterium avium subsp. paratuberculosis
accuggacgccgca

SEQ ID NO: 800527 - RNA, 17 nt, Mycobacterium avium subsp. paratuberculosis
accuggacgccgcacgc

SEQ ID NO: 800528 - RNA, 23 nt, Mycobacterium avium subsp. paratuberculosis
accuggacgguuucaccgccguc

SEQ ID NO: 800529 - RNA, 18 nt, Mycobacterium avium subsp. paratuberculosis
accugcuugagcccgucg

SEQ ID NO: 800530 - RNA, 21 nt, Mycobacterium avium subsp. paratuberculosis
accugcuugagcccgucgacg

SEQ ID NO: 800531 - RNA, 22 nt, Mycobacterium avium subsp. paratuberculosis
accugcuugagcccgucgacgu

SEQ ID NO: 800532 - RNA, 17 nt, Mycobacterium avium subsp. paratuberculosis
accuggaagcgcaucgc

SEQ ID NO: 800533 - RNA, 18 nt, Mycobacterium avium subsp. paratuberculosis
accuggaagcgcaucgcc

SEQ ID NO: 800534 - RNA, 21 nt, Mycobacterium avium subsp. paratuberculosis
accuggaagcgcaucgccggc

SEQ ID NO: 800535 - RNA, 14 nt, Mycobacterium avium subsp. paratuberculosis
accuggccggccau

SEQ ID NO: 800536 - RNA, 15 nt, Mycobacterium avium subsp. paratuberculosis
accuggccggccauc

SEQ ID NO: 800537 - RNA, 17 nt, Mycobacterium avium subsp. paratuberculosis
accuggcgcaccgccgc

SEQ ID NO: 800538 - RNA, 18 nt, Mycobacterium avium subsp. paratuberculosis
accuggcgcaccgccgcg

SEQ ID NO: 800539 - RNA, 19 nt, Mycobacterium avium subsp. paratuberculosis
accuggcagcauccgccga

SEQ ID NO: 800540 - RNA, 23 nt, Mycobacterium avium subsp. paratuberculosis
accuggcagcauccgccgacgau

SEQ ID NO: 800541 - RNA, 20 nt, Mycobacterium avium subsp. paratuberculosis
accuggccgguauuggccac

SEQ ID NO: 800542 - RNA, 13 nt, Mycobacterium avium subsp. paratuberculosis
accuggccgucgg

SEQ ID NO: 800543 - RNA, 16 nt, Mycobacterium avium subsp. paratuberculosis
accuggccguucaggu

SEQ ID NO: 800544 - RNA, 19 nt, Mycobacterium avium subsp. paratuberculosis
accugcucaccgagcuggg

SEQ ID NO: 800545 - RNA, 23 nt, Mycobacterium avium subsp. paratuberculosis
accugcucgaugcgcgccagcag

SEQ ID NO: 800546 - RNA, 18 nt, Mycobacterium avium subsp. paratuberculosis
accugcucgucggugacg

SEQ ID NO: 800547 - RNA, 19 nt, Mycobacterium avium subsp. paratuberculosis
accugcucgucggugacgg

SEQ ID NO: 800548 - RNA, 22 nt, Mycobacterium avium subsp. paratuberculosis
accugcggcggcagucgcagca

SEQ ID NO: 800549 - RNA, 24 nt, Mycobacterium avium subsp. paratuberculosis
accugcggcggcagucgcagcagc

SEQ ID NO: 800550 - RNA, 13 nt, Mycobacterium avium subsp. paratuberculosis
accugcgcgacgc

SEQ ID NO: 800551 - RNA, 14 nt, Mycobacterium avium subsp. paratuberculosis
accugcgcgacggc

SEQ ID NO: 800552 - RNA, 21 nt, Mycobacterium avium subsp. paratuberculosis
accugcguccgauaccagccg

SEQ ID NO: 800553 - RNA, 22 nt, Mycobacterium avium subsp. paratuberculosis
accugcguccgauaccagccgc

SEQ ID NO: 800554 - RNA, 15 nt, Mycobacterium avium subsp. paratuberculosis
accugcguugcggca

SEQ ID NO: 800555 - RNA, 17 nt, Mycobacterium avium subsp. paratuberculosis
accugcggcccgucgcc

SEQ ID NO: 800556 - RNA, 19 nt, Mycobacterium avium subsp. paratuberculosis
accugcggcccgucgccgu

SEQ ID NO: 800557 - RNA, 22 nt, Mycobacterium avium subsp. paratuberculosis
accugcgggcccaccgcgcgcu

SEQ ID NO: 800558 - RNA, 17 nt, Mycobacterium avium subsp. paratuberculosis
accgguccgccgccggc

SEQ ID NO: 800559 - RNA, 18 nt, Mycobacterium avium subsp. paratuberculosis
accgguccgccgccggcg

SEQ ID NO: 800560 - RNA, 14 nt, Mycobacterium avium subsp. paratuberculosis
accgguccgccguc

SEQ ID NO: 800561 - RNA, 15 nt, Mycobacterium avium subsp. paratuberculosis
accgguccgccgucg

SEQ ID NO: 800562 - RNA, 16 nt, Mycobacterium avium subsp. paratuberculosis
accgguccgccgucgg

SEQ ID NO: 800563 - RNA, 15 nt, Mycobacterium avium subsp. paratuberculosis
accuaggcgucgucg

SEQ ID NO: 800564 - RNA, 18 nt, Mycobacterium avium subsp. paratuberculosis
accuaggcgucgucggcc

SEQ ID NO: 800565 - RNA, 17 nt, Mycobacterium avium subsp. paratuberculosis
accgguagaagaugcgc

SEQ ID NO: 800566 - RNA, 22 nt, Mycobacterium avium subsp. paratuberculosis
accgguagaagaugcgccgggu

SEQ ID NO: 800567 - RNA, 18 nt, Mycobacterium avium subsp. paratuberculosis
accgguaggcgcaccgcc

SEQ ID NO: 800568 - RNA, 20 nt, Mycobacterium avium subsp. paratuberculosis
accgguaggcgcaccgccgg

SEQ ID NO: 800569 - RNA, 21 nt, Mycobacterium avium subsp. paratuberculosis
accgguaggcgcaccgccggg

SEQ ID NO: 800570 - RNA, 22 nt, Mycobacterium avium subsp. paratuberculosis
accgguaggcgcaccgccgggc

SEQ ID NO: 800571 - RNA, 18 nt, Mycobacterium avium subsp. paratuberculosis
accgguagucgucgaggu

SEQ ID NO: 800572 - RNA, 23 nt, Mycobacterium avium subsp. paratuberculosis
accgguacagcgacuccagcgcg

SEQ ID NO: 800573 - RNA, 23 nt, Mycobacterium avium subsp. paratuberculosis
accgguagcgguccucgaaccgc

SEQ ID NO: 800574 - RNA, 19 nt, Mycobacterium avium subsp. paratuberculosis
accuagggcccacgcucga

SEQ ID NO: 800575 - RNA, 20 nt, Mycobacterium avium subsp. paratuberculosis
accuagggcccacgcucgac

SEQ ID NO: 800576 - RNA, 21 nt, Mycobacterium avium subsp. paratuberculosis
accucaccccgcuugcgcagc

SEQ ID NO: 800577 - RNA, 16 nt, Mycobacterium avium subsp. paratuberculosis
accucacggucggcgu

SEQ ID NO: 800578 - RNA, 17 nt, Mycobacterium avium subsp. paratuberculosis
accuccaaugcgcccug

SEQ ID NO: 800579 - RNA, 19 nt, Mycobacterium avium subsp. paratuberculosis
accucaucgcccagccggc

SEQ ID NO: 800580 - RNA, 21 nt, Mycobacterium avium subsp. paratuberculosis
accuccaguugcgaccccgcc

SEQ ID NO: 800581 - RNA, 15 nt, Mycobacterium avium subsp. paratuberculosis
accucccccgacgcc

SEQ ID NO: 800582 - RNA, 14 nt, Mycobacterium avium subsp. paratuberculosis
accuccccgcggug

SEQ ID NO: 800583 - RNA, 15 nt, Mycobacterium avium subsp. paratuberculosis
accuccccgcggugc

SEQ ID NO: 800584 - RNA, 12 nt, Mycobacterium avium subsp. paratuberculosis
accucccggcgc

SEQ ID NO: 800585 - RNA, 13 nt, Mycobacterium avium subsp. paratuberculosis
accucccggcgcc

SEQ ID NO: 800586 - RNA, 17 nt, Mycobacterium avium subsp. paratuberculosis
accuccgacaucaggcc

SEQ ID NO: 800587 - RNA, 23 nt, Mycobacterium avium subsp. paratuberculosis
accuccuccaaagcggcuaagcc

SEQ ID NO: 800588 - RNA, 19 nt, Mycobacterium avium subsp. paratuberculosis
accuccuccgguccgggcu

SEQ ID NO: 800589 - RNA, 13 nt, Mycobacterium avium subsp. paratuberculosis
accuccucgcggg

SEQ ID NO: 800590 - RNA, 22 nt, Mycobacterium avium subsp. paratuberculosis
accuccucgguguacagcgcca

SEQ ID NO: 800591 - RNA, 13 nt, Mycobacterium avium subsp. paratuberculosis
accuccggagauc

SEQ ID NO: 800592 - RNA, 19 nt, Mycobacterium avium subsp. paratuberculosis
accuccggagaucgccccg

SEQ ID NO: 800593 - RNA, 14 nt, Mycobacterium avium subsp. paratuberculosis
accuccggcagcga

SEQ ID NO: 800594 - RNA, 18 nt, Mycobacterium avium subsp. paratuberculosis
accuccggcagcgaaacc

SEQ ID NO: 800595 - RNA, 15 nt, Mycobacterium avium subsp. paratuberculosis
accuccugcacccgu

SEQ ID NO: 800596 - RNA, 22 nt, Mycobacterium avium subsp. paratuberculosis
accuccugcuggcguucgccga

SEQ ID NO: 800597 - RNA, 17 nt, Mycobacterium avium subsp. paratuberculosis
accuccuugcccagcgc

SEQ ID NO: 800598 - RNA, 18 nt, Mycobacterium avium subsp. paratuberculosis
accuccuugcccagcgcg

SEQ ID NO: 800599 - RNA, 21 nt, Mycobacterium avium subsp. paratuberculosis
accuccuugcccagcgcggua

SEQ ID NO: 800600 - RNA, 20 nt, Mycobacterium avium subsp. paratuberculosis
accucgcccugcagccgggu

SEQ ID NO: 800601 - RNA, 13 nt, Mycobacterium avium subsp. paratuberculosis
accucgccgacgg

SEQ ID NO: 800602 - RNA, 14 nt, Mycobacterium avium subsp. paratuberculosis
accucgccgcaggc

SEQ ID NO: 800603 - RNA, 15 nt, Mycobacterium avium subsp. paratuberculosis
accucgccgcccucg

SEQ ID NO: 800604 - RNA, 18 nt, Mycobacterium avium subsp. paratuberculosis
accucgaucagcggcauc

SEQ ID NO: 800605 - RNA, 20 nt, Mycobacterium avium subsp. paratuberculosis
accucgaucagcggcaucga

SEQ ID NO: 800606 - RNA, 17 nt, Mycobacterium avium subsp. paratuberculosis
accucgagcucaccgac

SEQ ID NO: 800607 - RNA, 22 nt, Mycobacterium avium subsp. paratuberculosis
accucgaggaacuugcgccggg

SEQ ID NO: 800608 - RNA, 23 nt, Mycobacterium avium subsp. paratuberculosis
accucgaggaacuugcgccgggu

SEQ ID NO: 800609 - RNA, 18 nt, Mycobacterium avium subsp. paratuberculosis
accucgaggccgaggucg

SEQ ID NO: 800610 - RNA, 18 nt, Mycobacterium avium subsp. paratuberculosis
accucgaguacucggugu

SEQ ID NO: 800611 - RNA, 19 nt, Mycobacterium avium subsp. paratuberculosis
accucgaugccgugccggu

SEQ ID NO: 800612 - RNA, 13 nt, Mycobacterium avium subsp. paratuberculosis
accucgauggcga

SEQ ID NO: 800613 - RNA, 16 nt, Mycobacterium avium subsp. paratuberculosis
accucgauggcgacgc

SEQ ID NO: 800614 - RNA, 23 nt, Mycobacterium avium subsp. paratuberculosis
accucgauggguucuucgaccac

SEQ ID NO: 800615 - RNA, 17 nt, Mycobacterium avium subsp. paratuberculosis
accucgacacgggccgc

SEQ ID NO: 800616 - RNA, 19 nt, Mycobacterium avium subsp. paratuberculosis
accucgacacgggccgcgc

SEQ ID NO: 800617 - RNA, 21 nt, Mycobacterium avium subsp. paratuberculosis
accuccugggugagcggcgcg

SEQ ID NO: 800618 - RNA, 15 nt, Mycobacterium avium subsp. paratuberculosis
accucgaacgccggu

SEQ ID NO: 800619 - RNA, 16 nt, Mycobacterium avium subsp. paratuberculosis
accucgaagccgacgu

SEQ ID NO: 800620 - RNA, 18 nt, Mycobacterium avium subsp. paratuberculosis
accucgaagccgaucgcg

SEQ ID NO: 800621 - RNA, 23 nt, Mycobacterium avium subsp. paratuberculosis
accucgaagccgaucgcggcgau

SEQ ID NO: 800622 - RNA, 18 nt, Mycobacterium avium subsp. paratuberculosis
accucgaagggcgccagc

SEQ ID NO: 800623 - RNA, 20 nt, Mycobacterium avium subsp. paratuberculosis
accucgaagggcgccagccg

SEQ ID NO: 800624 - RNA, 16 nt, Mycobacterium avium subsp. paratuberculosis
accucgagcgucacgc

SEQ ID NO: 800625 - RNA, 18 nt, Mycobacterium avium subsp. paratuberculosis
accucgaacuugaccggg

SEQ ID NO: 800626 - RNA, 19 nt, Mycobacterium avium subsp. paratuberculosis
accucgaacuugaccgggc

SEQ ID NO: 800627 - RNA, 21 nt, Mycobacterium avium subsp. paratuberculosis
accucgaccgugaggcccggc

SEQ ID NO: 800628 - RNA, 15 nt, Mycobacterium avium subsp. paratuberculosis
accucgagcaaccgc

SEQ ID NO: 800629 - RNA, 16 nt, Mycobacterium avium subsp. paratuberculosis
accucgagcaaccgca

SEQ ID NO: 800630 - RNA, 17 nt, Mycobacterium avium subsp. paratuberculosis
accucgagcaccggcgg

SEQ ID NO: 800631 - RNA, 18 nt, Mycobacterium avium subsp. paratuberculosis
accucgagcaccggcggc

SEQ ID NO: 800632 - RNA, 14 nt, Mycobacterium avium subsp. paratuberculosis
accucgagcacgcc

SEQ ID NO: 800633 - RNA, 14 nt, Mycobacterium avium subsp. paratuberculosis
accucgagcagcgc

SEQ ID NO: 800634 - RNA, 20 nt, Mycobacterium avium subsp. paratuberculosis
accucgagcagcgcgcgcuu

SEQ ID NO: 800635 - RNA, 23 nt, Mycobacterium avium subsp. paratuberculosis
accucuugggacuggauggcgau

SEQ ID NO: 800636 - RNA, 15 nt, Mycobacterium avium subsp. paratuberculosis
accucuugggcgcug

SEQ ID NO: 800637 - RNA, 14 nt, Mycobacterium avium subsp. paratuberculosis
accugaaccgcgca

SEQ ID NO: 800638 - RNA, 12 nt, Mycobacterium avium subsp. paratuberculosis
accugaccgcgg

SEQ ID NO: 800639 - RNA, 19 nt, Mycobacterium avium subsp. paratuberculosis
accugaccgcgggcccgcc

SEQ ID NO: 800640 - RNA, 16 nt, Mycobacterium avium subsp. paratuberculosis
accugaccgucggcca

SEQ ID NO: 800641 - RNA, 17 nt, Mycobacterium avium subsp. paratuberculosis
accugacgcaucaccac

SEQ ID NO: 800642 - RNA, 14 nt, Mycobacterium avium subsp. paratuberculosis
accugacgcucggu

SEQ ID NO: 800643 - RNA, 19 nt, Mycobacterium avium subsp. paratuberculosis
accugauuucaucgcggcg

SEQ ID NO: 800644 - RNA, 22 nt, Mycobacterium avium subsp. paratuberculosis
accugauuucaucgcggcgacc

SEQ ID NO: 800645 - RNA, 23 nt, Mycobacterium avium subsp. paratuberculosis
accugaucgaguuccgcgucggc

SEQ ID NO: 800646 - RNA, 13 nt, Mycobacterium avium subsp. paratuberculosis
accugaucgaugc

SEQ ID NO: 800647 - RNA, 19 nt, Mycobacterium avium subsp. paratuberculosis
accugauaggggucggcga

SEQ ID NO: 800648 - RNA, 14 nt, Mycobacterium avium subsp. paratuberculosis
accugaucgcggcg

SEQ ID NO: 800649 - RNA, 15 nt, Mycobacterium avium subsp. paratuberculosis
accugaucgcggcga

SEQ ID NO: 800650 - RNA, 20 nt, Mycobacterium avium subsp. paratuberculosis
accugcaguucgaucaccga

SEQ ID NO: 800651 - RNA, 20 nt, Mycobacterium avium subsp. paratuberculosis
accugcaucucgacccgggc

SEQ ID NO: 800652 - RNA, 12 nt, Mycobacterium avium subsp. paratuberculosis
accugccgucga

SEQ ID NO: 800653 - RNA, 16 nt, Mycobacterium avium subsp. paratuberculosis
accugcccgggcccga

SEQ ID NO: 800654 - RNA, 20 nt, Mycobacterium avium subsp. paratuberculosis
accugccccacacgcucggc

SEQ ID NO: 800655 - RNA, 20 nt, Mycobacterium avium subsp. paratuberculosis
accugccgcaacgggccgca

SEQ ID NO: 800656 - RNA, 23 nt, Mycobacterium avium subsp. paratuberculosis
accucggagaugauggccgcgcc

SEQ ID NO: 800657 - RNA, 15 nt, Mycobacterium avium subsp. paratuberculosis
accucgcgcgcgagc

SEQ ID NO: 800658 - RNA, 16 nt, Mycobacterium avium subsp. paratuberculosis
accucgcgcgucacgc

SEQ ID NO: 800659 - RNA, 20 nt, Mycobacterium avium subsp. paratuberculosis
accucgcgcgucacgcuggc

SEQ ID NO: 800660 - RNA, 23 nt, Mycobacterium avium subsp. paratuberculosis
accucgcgcgucacgcuggcgug

SEQ ID NO: 800661 - RNA, 16 nt, Mycobacterium avium subsp. paratuberculosis
accucgcggcggcguc

SEQ ID NO: 800662 - RNA, 17 nt, Mycobacterium avium subsp. paratuberculosis
accucgcggcggcgucg

SEQ ID NO: 800663 - RNA, 15 nt, Mycobacterium avium subsp. paratuberculosis
accucgcuacgcgag

SEQ ID NO: 800664 - RNA, 14 nt, Mycobacterium avium subsp. paratuberculosis
accucgcucagccc

SEQ ID NO: 800665 - RNA, 16 nt, Mycobacterium avium subsp. paratuberculosis
accucgcugacgucga

SEQ ID NO: 800666 - RNA, 14 nt, Mycobacterium avium subsp. paratuberculosis
accucgcccgccgc

SEQ ID NO: 800667 - RNA, 13 nt, Mycobacterium avium subsp. paratuberculosis
accucgccggccg

SEQ ID NO: 800668 - RNA, 14 nt, Mycobacterium avium subsp. paratuberculosis
accucgccggccgc

SEQ ID NO: 800669 - RNA, 15 nt, Mycobacterium avium subsp. paratuberculosis
accucgccggccgcc

SEQ ID NO: 800670 - RNA, 21 nt, Mycobacterium avium subsp. paratuberculosis
accucgccggccgccguggcc

SEQ ID NO: 800671 - RNA, 22 nt, Mycobacterium avium subsp. paratuberculosis
accucgccggccgccguggccc

SEQ ID NO: 800672 - RNA, 15 nt, Mycobacterium avium subsp. paratuberculosis
accucgccggccggg

SEQ ID NO: 800673 - RNA, 16 nt, Mycobacterium avium subsp. paratuberculosis
accucgccggccgggc

SEQ ID NO: 800674 - RNA, 15 nt, Mycobacterium avium subsp. paratuberculosis
accucgcgcaccggc

SEQ ID NO: 800675 - RNA, 16 nt, Mycobacterium avium subsp. paratuberculosis
accucgcgcagccccc

SEQ ID NO: 800676 - RNA, 12 nt, Mycobacterium avium subsp. paratuberculosis
accucgcgcccg

SEQ ID NO: 800677 - RNA, 14 nt, Mycobacterium avium subsp. paratuberculosis
accucgcgcccggc

SEQ ID NO: 800678 - RNA, 17 nt, Mycobacterium avium subsp. paratuberculosis
accucgcgcccggcgcc

SEQ ID NO: 800679 - RNA, 20 nt, Mycobacterium avium subsp. paratuberculosis
accucgcgcccggcgccggc

SEQ ID NO: 800680 - RNA, 21 nt, Mycobacterium avium subsp. paratuberculosis
accucgcgcccggcgccggcc

SEQ ID NO: 800681 - RNA, 14 nt, Mycobacterium avium subsp. paratuberculosis
accucgcgccgcga

SEQ ID NO: 800682 - RNA, 16 nt, Mycobacterium avium subsp. paratuberculosis
accucgcgccgcgauc

SEQ ID NO: 800683 - RNA, 16 nt, Mycobacterium avium subsp. paratuberculosis
accucggcgucggcgc

SEQ ID NO: 800684 - RNA, 17 nt, Mycobacterium avium subsp. paratuberculosis
accucggcgucggcgcg

SEQ ID NO: 800685 - RNA, 19 nt, Mycobacterium avium subsp. paratuberculosis
accucggcgucggcgcgug

SEQ ID NO: 800686 - RNA, 13 nt, Mycobacterium avium subsp. paratuberculosis
accucggcggcgg

SEQ ID NO: 800687 - RNA, 14 nt, Mycobacterium avium subsp. paratuberculosis
accucggcggcggc

SEQ ID NO: 800688 - RNA, 17 nt, Mycobacterium avium subsp. paratuberculosis
accucggcggcggcgcg

SEQ ID NO: 800689 - RNA, 22 nt, Mycobacterium avium subsp. paratuberculosis
accucggcggcggcgcgccggc

SEQ ID NO: 800690 - RNA, 23 nt, Mycobacterium avium subsp. paratuberculosis
accucggcggcggcgcgccggcc

SEQ ID NO: 800691 - RNA, 20 nt, Mycobacterium avium subsp. paratuberculosis
accucgggcauuggcagcuc

SEQ ID NO: 800692 - RNA, 21 nt, Mycobacterium avium subsp. paratuberculosis
accucgggcauuggcagcucg

SEQ ID NO: 800693 - RNA, 14 nt, Mycobacterium avium subsp. paratuberculosis
accucgggccgggc

SEQ ID NO: 800694 - RNA, 19 nt, Mycobacterium avium subsp. paratuberculosis
accucgggccgggcgggca

SEQ ID NO: 800695 - RNA, 17 nt, Mycobacterium avium subsp. paratuberculosis
accucggggcguggcgg

SEQ ID NO: 800696 - RNA, 18 nt, Mycobacterium avium subsp. paratuberculosis
accucggggucggccgga

SEQ ID NO: 800697 - RNA, 22 nt, Mycobacterium avium subsp. paratuberculosis
accucggggucggccggaucga

SEQ ID NO: 800698 - RNA, 19 nt, Mycobacterium avium subsp. paratuberculosis
accucggguguaggcccga

SEQ ID NO: 800699 - RNA, 23 nt, Mycobacterium avium subsp. paratuberculosis
accucggccuugaccacggugcg

SEQ ID NO: 800700 - RNA, 15 nt, Mycobacterium avium subsp. paratuberculosis
accucggcgacgucc

SEQ ID NO: 800701 - RNA, 11 nt, Mycobacterium avium subsp. paratuberculosis
accucggccag

SEQ ID NO: 800702 - RNA, 14 nt, Mycobacterium avium subsp. paratuberculosis
accucggccagcgc

SEQ ID NO: 800703 - RNA, 15 nt, Mycobacterium avium subsp. paratuberculosis
accucggccagcgug

SEQ ID NO: 800704 - RNA, 16 nt, Mycobacterium avium subsp. paratuberculosis
accucggcgaccagcg

SEQ ID NO: 800705 - RNA, 13 nt, Mycobacterium avium subsp. paratuberculosis
accucggcgacga

SEQ ID NO: 800706 - RNA, 22 nt, Mycobacterium avium subsp. paratuberculosis
accucggcgacgauggccaggc

SEQ ID NO: 800707 - RNA, 16 nt, Mycobacterium avium subsp. paratuberculosis
accucgucccagcgca

SEQ ID NO: 800708 - RNA, 20 nt, Mycobacterium avium subsp. paratuberculosis
accucgucgacggcggcguc

SEQ ID NO: 800709 - RNA, 13 nt, Mycobacterium avium subsp. paratuberculosis
accucgucgaucu

SEQ ID NO: 800710 - RNA, 19 nt, Mycobacterium avium subsp. paratuberculosis
accucgggauccaggaacg

SEQ ID NO: 800711 - RNA, 17 nt, Mycobacterium avium subsp. paratuberculosis
accucggcggcaccgcc

SEQ ID NO: 800712 - RNA, 12 nt, Mycobacterium avium subsp. paratuberculosis
accucggcggcg

SEQ ID NO: 800713 - RNA, 21 nt, Mycobacterium avium subsp. paratuberculosis
accucgggcacguccagcccg

SEQ ID NO: 800714 - RNA, 14 nt, Mycobacterium avium subsp. paratuberculosis
accucgguggacgc

SEQ ID NO: 800715 - RNA, 17 nt, Mycobacterium avium subsp. paratuberculosis
accucgguggacgccgc

SEQ ID NO: 800716 - RNA, 16 nt, Mycobacterium avium subsp. paratuberculosis
accucggugucgaggu

SEQ ID NO: 800717 - RNA, 22 nt, Mycobacterium avium subsp. paratuberculosis
accucggugaucucaccggcgg

SEQ ID NO: 800718 - RNA, 14 nt, Mycobacterium avium subsp. paratuberculosis
accucugcgcgagc

SEQ ID NO: 800719 - RNA, 15 nt, Mycobacterium avium subsp. paratuberculosis
accucuucggcgccg

SEQ ID NO: 800720 - RNA, 18 nt, Mycobacterium avium subsp. paratuberculosis
accucuucgggcagcgcg

SEQ ID NO: 800721 - RNA, 14 nt, Mycobacterium avium subsp. paratuberculosis
accucuucgugcac

SEQ ID NO: 800722 - RNA, 14 nt, Mycobacterium avium subsp. paratuberculosis
accucuugcggcgc

SEQ ID NO: 800723 - RNA, 23 nt, Mycobacterium avium subsp. paratuberculosis
accucuugcggcgcaaccucuuc

SEQ ID NO: 800724 - RNA, 15 nt, Mycobacterium avium subsp. paratuberculosis
accucgucgcccggc

SEQ ID NO: 800725 - RNA, 14 nt, Mycobacterium avium subsp. paratuberculosis
accucgucgccguc

SEQ ID NO: 800726 - RNA, 16 nt, Mycobacterium avium subsp. paratuberculosis
accucgucgccgucgg

SEQ ID NO: 800727 - RNA, 21 nt, Mycobacterium avium subsp. paratuberculosis
accucgucggcggcgacggcg

SEQ ID NO: 800728 - RNA, 14 nt, Mycobacterium avium subsp. paratuberculosis
accucgucgggcgc

SEQ ID NO: 800729 - RNA, 17 nt, Mycobacterium avium subsp. paratuberculosis
accucgucgggcgccag

SEQ ID NO: 800730 - RNA, 22 nt, Mycobacterium avium subsp. paratuberculosis
acuccuccucggccagccccac

SEQ ID NO: 800731 - RNA, 15 nt, Mycobacterium avium subsp. paratuberculosis
acucgaagcugcgcc

SEQ ID NO: 800732 - RNA, 15 nt, Mycobacterium avium subsp. paratuberculosis
acucgacgucgacgu

SEQ ID NO: 800733 - RNA, 14 nt, Mycobacterium avium subsp. paratuberculosis
acucgacgcucggc

SEQ ID NO: 800734 - RNA, 13 nt, Mycobacterium avium subsp. paratuberculosis
acucgacggagug

SEQ ID NO: 800735 - RNA, 21 nt, Mycobacterium avium subsp. paratuberculosis
acucgacggagugcgugucac

SEQ ID NO: 800736 - RNA, 13 nt, Mycobacterium avium subsp. paratuberculosis
acucgacccgcac

SEQ ID NO: 800737 - RNA, 18 nt, Mycobacterium avium subsp. paratuberculosis
acucgaccugcccgggcc

SEQ ID NO: 800738 - RNA, 19 nt, Mycobacterium avium subsp. paratuberculosis
acucgaccugcccgggccc

SEQ ID NO: 800739 - RNA, 20 nt, Mycobacterium avium subsp. paratuberculosis
acucgaccugcccgggcccg

SEQ ID NO: 800740 - RNA, 22 nt, Mycobacterium avium subsp. paratuberculosis
acucgaccugcccgggcccgau

SEQ ID NO: 800741 - RNA, 19 nt, Mycobacterium avium subsp. paratuberculosis
acucgaccuucgagccgcc

SEQ ID NO: 800742 - RNA, 18 nt, Mycobacterium avium subsp. paratuberculosis
acucgaugggggugccgc

SEQ ID NO: 800743 - RNA, 20 nt, Mycobacterium avium subsp. paratuberculosis
acucgaugggggugccgcag

SEQ ID NO: 800744 - RNA, 17 nt, Mycobacterium avium subsp. paratuberculosis
acucgauguagccgggc

SEQ ID NO: 800745 - RNA, 18 nt, Mycobacterium avium subsp. paratuberculosis
acucgauguagccgggcu

SEQ ID NO: 800746 - RNA, 15 nt, Mycobacterium avium subsp. paratuberculosis
acucgaucgccaccg

SEQ ID NO: 800747 - RNA, 16 nt, Mycobacterium avium subsp. paratuberculosis
acucgaucgccaccga

SEQ ID NO: 800748 - RNA, 22 nt, Mycobacterium avium subsp. paratuberculosis
acucgagcgcgcucaaccgccc

SEQ ID NO: 800749 - RNA, 14 nt, Mycobacterium avium subsp. paratuberculosis
acucgacguucggc

SEQ ID NO: 800750 - RNA, 21 nt, Mycobacterium avium subsp. paratuberculosis
acucgaugcgcgugacgcgcg

SEQ ID NO: 800751 - RNA, 17 nt, Mycobacterium avium subsp. paratuberculosis
acucgaugcggcagcuu

SEQ ID NO: 800752 - RNA, 15 nt, Mycobacterium avium subsp. paratuberculosis
acucgcaggugccgg

SEQ ID NO: 800753 - RNA, 17 nt, Mycobacterium avium subsp. paratuberculosis
acucgcaggugccggug

SEQ ID NO: 800754 - RNA, 12 nt, Mycobacterium avium subsp. paratuberculosis
acucgcccaaug

SEQ ID NO: 800755 - RNA, 15 nt, Mycobacterium avium subsp. paratuberculosis
acuccuggccccgau

SEQ ID NO: 800756 - RNA, 19 nt, Mycobacterium avium subsp. paratuberculosis
acuccuggguaagccaggu

SEQ ID NO: 800757 - RNA, 22 nt, Mycobacterium avium subsp. paratuberculosis
acuccuggguaagccaggucac

SEQ ID NO: 800758 - RNA, 19 nt, Mycobacterium avium subsp. paratuberculosis
acuccgguaccacgccguc

SEQ ID NO: 800759 - RNA, 20 nt, Mycobacterium avium subsp. paratuberculosis
acuccgguaccacgccgucg

SEQ ID NO: 800760 - RNA, 21 nt, Mycobacterium avium subsp. paratuberculosis
acuccgguaccacgccgucga

SEQ ID NO: 800761 - RNA, 14 nt, Mycobacterium avium subsp. paratuberculosis
acuccggcgccggu

SEQ ID NO: 800762 - RNA, 17 nt, Mycobacterium avium subsp. paratuberculosis
acuccggcgccggucag

SEQ ID NO: 800763 - RNA, 18 nt, Mycobacterium avium subsp. paratuberculosis
acuccggcgccggucagc

SEQ ID NO: 800764 - RNA, 19 nt, Mycobacterium avium subsp. paratuberculosis
acucccgcgccgcggccag

SEQ ID NO: 800765 - RNA, 16 nt, Mycobacterium avium subsp. paratuberculosis
acuccgacuccagcag

SEQ ID NO: 800766 - RNA, 19 nt, Mycobacterium avium subsp. paratuberculosis
acuccgacuccagcagcgc

SEQ ID NO: 800767 - RNA, 19 nt, Mycobacterium avium subsp. paratuberculosis
acuccgcucgggcccgcgc

SEQ ID NO: 800768 - RNA, 22 nt, Mycobacterium avium subsp. paratuberculosis
acuccgcucgggcccgcgcacc

SEQ ID NO: 800769 - RNA, 14 nt, Mycobacterium avium subsp. paratuberculosis
acuccgcgauggcc

SEQ ID NO: 800770 - RNA, 18 nt, Mycobacterium avium subsp. paratuberculosis
acuccaauacggcccggc

SEQ ID NO: 800771 - RNA, 14 nt, Mycobacterium avium subsp. paratuberculosis
acuccagcaccgga

SEQ ID NO: 800772 - RNA, 17 nt, Mycobacterium avium subsp. paratuberculosis
acuccagcaccggcgcc

SEQ ID NO: 800773 - RNA, 19 nt, Mycobacterium avium subsp. paratuberculosis
acuccagcaccggcgccau

SEQ ID NO: 800774 - RNA, 20 nt, Mycobacterium avium subsp. paratuberculosis
acuccaggguucucgcggcg

SEQ ID NO: 800775 - RNA, 15 nt, Mycobacterium avium subsp. paratuberculosis
acuccaguugacggc

SEQ ID NO: 800776 - RNA, 17 nt, Mycobacterium avium subsp. paratuberculosis
acuccaguugacggcgc

SEQ ID NO: 800777 - RNA, 17 nt, Mycobacterium avium subsp. paratuberculosis
acuccaucacgaccucg

SEQ ID NO: 800778 - RNA, 15 nt, Mycobacterium avium subsp. paratuberculosis
acucccaggccgcgg

SEQ ID NO: 800779 - RNA, 16 nt, Mycobacterium avium subsp. paratuberculosis
acucccaggccgcggc

SEQ ID NO: 800780 - RNA, 16 nt, Mycobacterium avium subsp. paratuberculosis
acuccaccaccggccg

SEQ ID NO: 800781 - RNA, 19 nt, Mycobacterium avium subsp. paratuberculosis
acuccaccaccggccgcgc

SEQ ID NO: 800782 - RNA, 12 nt, Mycobacterium avium subsp. paratuberculosis
acuccaccaccu

SEQ ID NO: 800783 - RNA, 19 nt, Mycobacterium avium subsp. paratuberculosis
acuccaccaccuggccggc

SEQ ID NO: 800784 - RNA, 23 nt, Mycobacterium avium subsp. paratuberculosis
acuccacccugccgaccugcgcg

SEQ ID NO: 800785 - RNA, 16 nt, Mycobacterium avium subsp. paratuberculosis
acuccaccgccaccgc

SEQ ID NO: 800786 - RNA, 15 nt, Mycobacterium avium subsp. paratuberculosis
acuccaccgcccgga

SEQ ID NO: 800787 - RNA, 19 nt, Mycobacterium avium subsp. paratuberculosis
acucaugggcccggcccgu

SEQ ID NO: 800788 - RNA, 15 nt, Mycobacterium avium subsp. paratuberculosis
acuagguccggcgcg

SEQ ID NO: 800789 - RNA, 17 nt, Mycobacterium avium subsp. paratuberculosis
acuagguccggcgcgac

SEQ ID NO: 800790 - RNA, 16 nt, Mycobacterium avium subsp. paratuberculosis
acuagcuucacguucg

SEQ ID NO: 800791 - RNA, 13 nt, Mycobacterium avium subsp. paratuberculosis
acugaaagccgag

SEQ ID NO: 800792 - RNA, 19 nt, Mycobacterium avium subsp. paratuberculosis
acugauccgucaucucguc

SEQ ID NO: 800793 - RNA, 14 nt, Mycobacterium avium subsp. paratuberculosis
acugaucaccgcgc

SEQ ID NO: 800794 - RNA, 15 nt, Mycobacterium avium subsp. paratuberculosis
acugaucaccgcgcu

SEQ ID NO: 800795 - RNA, 16 nt, Mycobacterium avium subsp. paratuberculosis
acugaucaccgcgcuc

SEQ ID NO: 800796 - RNA, 22 nt, Mycobacterium avium subsp. paratuberculosis
acugaucaccgcgcucggcgac

SEQ ID NO: 800797 - RNA, 16 nt, Mycobacterium avium subsp. paratuberculosis
acucgcgaggccgcca

SEQ ID NO: 800798 - RNA, 16 nt, Mycobacterium avium subsp. paratuberculosis
acucgccggagcgccc

SEQ ID NO: 800799 - RNA, 19 nt, Mycobacterium avium subsp. paratuberculosis
acucgccggagcgccccag

SEQ ID NO: 800800 - RNA, 14 nt, Mycobacterium avium subsp. paratuberculosis
acucgccggcggcg

SEQ ID NO: 800801 - RNA, 16 nt, Mycobacterium avium subsp. paratuberculosis
acucgccggcggcgcc

SEQ ID NO: 800802 - RNA, 18 nt, Mycobacterium avium subsp. paratuberculosis
acucgccggcggcgccgg

SEQ ID NO: 800803 - RNA, 20 nt, Mycobacterium avium subsp. paratuberculosis
acucgcguccccgcgccggg

SEQ ID NO: 800804 - RNA, 17 nt, Mycobacterium avium subsp. paratuberculosis
acucgcgggcgagcagc

SEQ ID NO: 800805 - RNA, 21 nt, Mycobacterium avium subsp. paratuberculosis
acucgcgggcgagcagcgccc

SEQ ID NO: 800806 - RNA, 20 nt, Mycobacterium avium subsp. paratuberculosis
acucgcgcucccggcgccgc

SEQ ID NO: 800807 - RNA, 21 nt, Mycobacterium avium subsp. paratuberculosis
acucgcgcucccggcgccgcc

SEQ ID NO: 800808 - RNA, 22 nt, Mycobacterium avium subsp. paratuberculosis
acucgcggcgggucagcacccg

SEQ ID NO: 800809 - RNA, 23 nt, Mycobacterium avium subsp. paratuberculosis
acucuuccaggacaacgcagguu

SEQ ID NO: 800810 - RNA, 16 nt, Mycobacterium avium subsp. paratuberculosis
acucggacagguggcc

SEQ ID NO: 800811 - RNA, 14 nt, Mycobacterium avium subsp. paratuberculosis
acucggacgccggc

SEQ ID NO: 800812 - RNA, 17 nt, Mycobacterium avium subsp. paratuberculosis
acucggacgccggcagc

SEQ ID NO: 800813 - RNA, 14 nt, Mycobacterium avium subsp. paratuberculosis
acugcgaucgccga

SEQ ID NO: 800814 - RNA, 16 nt, Mycobacterium avium subsp. paratuberculosis
acugcgaucgccgacg

SEQ ID NO: 800815 - RNA, 19 nt, Mycobacterium avium subsp. paratuberculosis
acugcgcaccgccagcacc

SEQ ID NO: 800816 - RNA, 22 nt, Mycobacterium avium subsp. paratuberculosis
acugcgcaccgccagcaccgac

SEQ ID NO: 800817 - RNA, 16 nt, Mycobacterium avium subsp. paratuberculosis
acugccgcgcacugga

SEQ ID NO: 800818 - RNA, 17 nt, Mycobacterium avium subsp. paratuberculosis
acugccgcgcacuggag

SEQ ID NO: 800819 - RNA, 14 nt, Mycobacterium avium subsp. paratuberculosis
acugccgccgccca

SEQ ID NO: 800820 - RNA, 23 nt, Mycobacterium avium subsp. paratuberculosis
acugccccggcgaacgccucggu

SEQ ID NO: 800821 - RNA, 16 nt, Mycobacterium avium subsp. paratuberculosis
acugcccgaccgcgcc

SEQ ID NO: 800822 - RNA, 17 nt, Mycobacterium avium subsp. paratuberculosis
acugcccgaccgcgccg

SEQ ID NO: 800823 - RNA, 19 nt, Mycobacterium avium subsp. paratuberculosis
acugcccguagucggcggc

SEQ ID NO: 800824 - RNA, 20 nt, Mycobacterium avium subsp. paratuberculosis
acugcccguagucggcggcg

SEQ ID NO: 800825 - RNA, 16 nt, Mycobacterium avium subsp. paratuberculosis
acugccgacgcauuuc

SEQ ID NO: 800826 - RNA, 20 nt, Mycobacterium avium subsp. paratuberculosis
acugaugcccucgccgguca

SEQ ID NO: 800827 - RNA, 16 nt, Mycobacterium avium subsp. paratuberculosis
acugaugaagccgccg

SEQ ID NO: 800828 - RNA, 18 nt, Mycobacterium avium subsp. paratuberculosis
acugaugaagccgccgac

SEQ ID NO: 800829 - RNA, 20 nt, Mycobacterium avium subsp. paratuberculosis
acugaugaagccgccgacgg

SEQ ID NO: 800830 - RNA, 16 nt, Mycobacterium avium subsp. paratuberculosis
acugaugguggcgcgc

SEQ ID NO: 800831 - RNA, 17 nt, Mycobacterium avium subsp. paratuberculosis
acgugcugugcgggcgg

SEQ ID NO: 800832 - RNA, 22 nt, Mycobacterium avium subsp. paratuberculosis
acgugcuuggccagcucggcgg

SEQ ID NO: 800833 - RNA, 19 nt, Mycobacterium avium subsp. paratuberculosis
acguggaaauugcugacca

SEQ ID NO: 800834 - RNA, 18 nt, Mycobacterium avium subsp. paratuberculosis
acgugcucggcggccgcc

SEQ ID NO: 800835 - RNA, 23 nt, Mycobacterium avium subsp. paratuberculosis
acgugcucugccuacuugcggcc

SEQ ID NO: 800836 - RNA, 12 nt, Mycobacterium avium subsp. paratuberculosis
acgugcgccggc

SEQ ID NO: 800837 - RNA, 21 nt, Mycobacterium avium subsp. paratuberculosis
acgugcgccggcggugcggcg

SEQ ID NO: 800838 - RNA, 14 nt, Mycobacterium avium subsp. paratuberculosis
acgugcgcgccgac

SEQ ID NO: 800839 - RNA, 16 nt, Mycobacterium avium subsp. paratuberculosis
acgugcgcgccgaccg

SEQ ID NO: 800840 - RNA, 19 nt, Mycobacterium avium subsp. paratuberculosis
acgugcgcgccgaccgcga

SEQ ID NO: 800841 - RNA, 13 nt, Mycobacterium avium subsp. paratuberculosis
acgugcgcggcgc

SEQ ID NO: 800842 - RNA, 13 nt, Mycobacterium avium subsp. paratuberculosis
acgugcgcggcgu

SEQ ID NO: 800843 - RNA, 15 nt, Mycobacterium avium subsp. paratuberculosis
acgugcgcgggaacg

SEQ ID NO: 800844 - RNA, 14 nt, Mycobacterium avium subsp. paratuberculosis
acgugcgcguuggu

SEQ ID NO: 800845 - RNA, 22 nt, Mycobacterium avium subsp. paratuberculosis
acgugcggauggccccggcgag

SEQ ID NO: 800846 - RNA, 14 nt, Mycobacterium avium subsp. paratuberculosis
acgugcggcgcccu

SEQ ID NO: 800847 - RNA, 20 nt, Mycobacterium avium subsp. paratuberculosis
acguuccgaacgugcagcuu

SEQ ID NO: 800848 - RNA, 19 nt, Mycobacterium avium subsp. paratuberculosis
acguuccuggugggcgaau

SEQ ID NO: 800849 - RNA, 16 nt, Mycobacterium avium subsp. paratuberculosis
acguucgagucggcca

SEQ ID NO: 800850 - RNA, 22 nt, Mycobacterium avium subsp. paratuberculosis
acguucaccaccggagcggcgg

SEQ ID NO: 800851 - RNA, 14 nt, Mycobacterium avium subsp. paratuberculosis
acgugccggcgaug

SEQ ID NO: 800852 - RNA, 14 nt, Mycobacterium avium subsp. paratuberculosis
acgugccggcggca

SEQ ID NO: 800853 - RNA, 23 nt, Mycobacterium avium subsp. paratuberculosis
acgugccggcggcaggugaaggu

SEQ ID NO: 800854 - RNA, 19 nt, Mycobacterium avium subsp. paratuberculosis
acgugcccuuccccggcgg

SEQ ID NO: 800855 - RNA, 15 nt, Mycobacterium avium subsp. paratuberculosis
acgucgucguccucg

SEQ ID NO: 800856 - RNA, 23 nt, Mycobacterium avium subsp. paratuberculosis
acgucgucgugcgcgggcgaaau

SEQ ID NO: 800857 - RNA, 21 nt, Mycobacterium avium subsp. paratuberculosis
acgucgugcacgccguggcgg

SEQ ID NO: 800858 - RNA, 23 nt, Mycobacterium avium subsp. paratuberculosis
acgucgugggcgauccgcaggcc

SEQ ID NO: 800859 - RNA, 20 nt, Mycobacterium avium subsp. paratuberculosis
acgucguugaccgaggcgau

SEQ ID NO: 800860 - RNA, 19 nt, Mycobacterium avium subsp. paratuberculosis
acgucguugagcacaccca

SEQ ID NO: 800861 - RNA, 22 nt, Mycobacterium avium subsp. paratuberculosis
acgucguugagcacacccagcg

SEQ ID NO: 800862 - RNA, 17 nt, Mycobacterium avium subsp. paratuberculosis
acgucguuuuccagccg

SEQ ID NO: 800863 - RNA, 21 nt, Mycobacterium avium subsp. paratuberculosis
acgucguuuuccagccggcgc

SEQ ID NO: 800864 - RNA, 21 nt, Mycobacterium avium subsp. paratuberculosis
acgugccacuggcgccaccuc

SEQ ID NO: 800865 - RNA, 13 nt, Mycobacterium avium subsp. paratuberculosis
acgucgucggccu

SEQ ID NO: 800866 - RNA, 14 nt, Mycobacterium avium subsp. paratuberculosis
acgucggcggccgc

SEQ ID NO: 800867 - RNA, 14 nt, Mycobacterium avium subsp. paratuberculosis
acgucgucgcggcg

SEQ ID NO: 800868 - RNA, 15 nt, Mycobacterium avium subsp. paratuberculosis
acgucgucgcggcgc

SEQ ID NO: 800869 - RNA, 16 nt, Mycobacterium avium subsp. paratuberculosis
acgucgucgcggcgcu

SEQ ID NO: 800870 - RNA, 23 nt, Mycobacterium avium subsp. paratuberculosis
acgucgucagcaccgugggcccg

SEQ ID NO: 800871 - RNA, 15 nt, Mycobacterium avium subsp. paratuberculosis
acgucgucgacccgc

SEQ ID NO: 800872 - RNA, 17 nt, Mycobacterium avium subsp. paratuberculosis
acgucgucgacccgcuc

SEQ ID NO: 800873 - RNA, 13 nt, Mycobacterium avium subsp. paratuberculosis
acgucgucgacgu

SEQ ID NO: 800874 - RNA, 17 nt, Mycobacterium avium subsp. paratuberculosis
acgucgucgacguccac

SEQ ID NO: 800875 - RNA, 15 nt, Mycobacterium avium subsp. paratuberculosis
acgucguaggccauc

SEQ ID NO: 800876 - RNA, 12 nt, Mycobacterium avium subsp. paratuberculosis
acgucggcggcc

SEQ ID NO: 800877 - RNA, 22 nt, Mycobacterium avium subsp. paratuberculosis
acgucgguguagucggcgaucg

SEQ ID NO: 800878 - RNA, 21 nt, Mycobacterium avium subsp. paratuberculosis
acgucggcuggcgugcggcgc

SEQ ID NO: 800879 - RNA, 22 nt, Mycobacterium avium subsp. paratuberculosis
acgucggcuggcgugcggcgcg

SEQ ID NO: 800880 - RNA, 14 nt, Mycobacterium avium subsp. paratuberculosis
acgucgggcacggu

SEQ ID NO: 800881 - RNA, 11 nt, Mycobacterium avium subsp. paratuberculosis
acguuggugau

SEQ ID NO: 800882 - RNA, 17 nt, Mycobacterium avium subsp. paratuberculosis
acguuggugaucgccga

SEQ ID NO: 800883 - RNA, 14 nt, Mycobacterium avium subsp. paratuberculosis
acguugucgcggcc

SEQ ID NO: 800884 - RNA, 18 nt, Mycobacterium avium subsp. paratuberculosis
acguugucgcggcccagc

SEQ ID NO: 800885 - RNA, 19 nt, Mycobacterium avium subsp. paratuberculosis
acguugugggcgggcgcgu

SEQ ID NO: 800886 - RNA, 18 nt, Mycobacterium avium subsp. paratuberculosis
acguuggcggccagcgcg

SEQ ID NO: 800887 - RNA, 21 nt, Mycobacterium avium subsp. paratuberculosis
acguuggcggccagcgcgccg

SEQ ID NO: 800888 - RNA, 14 nt, Mycobacterium avium subsp. paratuberculosis
acguuggcggccag

SEQ ID NO: 800889 - RNA, 14 nt, Mycobacterium avium subsp. paratuberculosis
acggugaucgacau

SEQ ID NO: 800890 - RNA, 19 nt, Mycobacterium avium subsp. paratuberculosis
acguagcaccagucggcca

SEQ ID NO: 800891 - RNA, 18 nt, Mycobacterium avium subsp. paratuberculosis
acguagcagcagaccgcg

SEQ ID NO: 800892 - RNA, 14 nt, Mycobacterium avium subsp. paratuberculosis
acguagcccagcgc

SEQ ID NO: 800893 - RNA, 15 nt, Mycobacterium avium subsp. paratuberculosis
acguagcccagcgcg

SEQ ID NO: 800894 - RNA, 15 nt, Mycobacterium avium subsp. paratuberculosis
acguagcccgccgaa

SEQ ID NO: 800895 - RNA, 15 nt, Mycobacterium avium subsp. paratuberculosis
acggugaccggcgcg

SEQ ID NO: 800896 - RNA, 20 nt, Mycobacterium avium subsp. paratuberculosis
acggugacgccggauacccc

SEQ ID NO: 800897 - RNA, 17 nt, Mycobacterium avium subsp. paratuberculosis
acggugagcaccgccgu

SEQ ID NO: 800898 - RNA, 18 nt, Mycobacterium avium subsp. paratuberculosis
acguaggcgaucagcgcg

SEQ ID NO: 800899 - RNA, 14 nt, Mycobacterium avium subsp. paratuberculosis
acguaggcggccag

SEQ ID NO: 800900 - RNA, 17 nt, Mycobacterium avium subsp. paratuberculosis
acguaggcggccagcag

SEQ ID NO: 800901 - RNA, 13 nt, Mycobacterium avium subsp. paratuberculosis
acguagcgaucgg

SEQ ID NO: 800902 - RNA, 16 nt, Mycobacterium avium subsp. paratuberculosis
acguaggccgccugcc

SEQ ID NO: 800903 - RNA, 21 nt, Mycobacterium avium subsp. paratuberculosis
acguaggugagcaacgccagc

SEQ ID NO: 800904 - RNA, 16 nt, Mycobacterium avium subsp. paratuberculosis
acguaggacagcacca

SEQ ID NO: 800905 - RNA, 19 nt, Mycobacterium avium subsp. paratuberculosis
acguaggacagcaccacau

SEQ ID NO: 800906 - RNA, 13 nt, Mycobacterium avium subsp. paratuberculosis
acguagucgccga

SEQ ID NO: 800907 - RNA, 14 nt, Mycobacterium avium subsp. paratuberculosis
acguagucgcgcac

SEQ ID NO: 800908 - RNA, 16 nt, Mycobacterium avium subsp. paratuberculosis
acgguaugcccgccgc

SEQ ID NO: 800909 - RNA, 17 nt, Mycobacterium avium subsp. paratuberculosis
acggucacgcuggcgug

SEQ ID NO: 800910 - RNA, 14 nt, Mycobacterium avium subsp. paratuberculosis
acggucacggccgc

SEQ ID NO: 800911 - RNA, 22 nt, Mycobacterium avium subsp. paratuberculosis
acggucaccccgaguucggcca

SEQ ID NO: 800912 - RNA, 18 nt, Mycobacterium avium subsp. paratuberculosis
acgguaggcgcggucggu

SEQ ID NO: 800913 - RNA, 17 nt, Mycobacterium avium subsp. paratuberculosis
acggucggccccgcgca

SEQ ID NO: 800914 - RNA, 16 nt, Mycobacterium avium subsp. paratuberculosis
acggucaccggcaggc

SEQ ID NO: 800915 - RNA, 18 nt, Mycobacterium avium subsp. paratuberculosis
acggucggcguccagcgc

SEQ ID NO: 800916 - RNA, 19 nt, Mycobacterium avium subsp. paratuberculosis
acggucggcguccagcgcg

SEQ ID NO: 800917 - RNA, 21 nt, Mycobacterium avium subsp. paratuberculosis
acggucgcggugucggcgucg

SEQ ID NO: 800918 - RNA, 19 nt, Mycobacterium avium subsp. paratuberculosis
acggucggagcccagcgug

SEQ ID NO: 800919 - RNA, 14 nt, Mycobacterium avium subsp. paratuberculosis
acggucgccgcgcc

SEQ ID NO: 800920 - RNA, 16 nt, Mycobacterium avium subsp. paratuberculosis
acggucgccgcgccgc

SEQ ID NO: 800921 - RNA, 20 nt, Mycobacterium avium subsp. paratuberculosis
acggucgccgcgccgccggu

SEQ ID NO: 800922 - RNA, 11 nt, Mycobacterium avium subsp. paratuberculosis
acggucgccgg

SEQ ID NO: 800923 - RNA, 16 nt, Mycobacterium avium subsp. paratuberculosis
acggucuucccgccgc

SEQ ID NO: 800924 - RNA, 20 nt, Mycobacterium avium subsp. paratuberculosis
acggucuucccgccgccguc

SEQ ID NO: 800925 - RNA, 14 nt, Mycobacterium avium subsp. paratuberculosis
acggucuugcggcc

SEQ ID NO: 800926 - RNA, 18 nt, Mycobacterium avium subsp. paratuberculosis
acggucuuugccggccau

SEQ ID NO: 800927 - RNA, 20 nt, Mycobacterium avium subsp. paratuberculosis
acggucuuugccggccauga

SEQ ID NO: 800928 - RNA, 22 nt, Mycobacterium avium subsp. paratuberculosis
acggucgggaucugcggugagc

SEQ ID NO: 800929 - RNA, 14 nt, Mycobacterium avium subsp. paratuberculosis
acgucauccggcug

SEQ ID NO: 800930 - RNA, 20 nt, Mycobacterium avium subsp. paratuberculosis
acgucaggggugccggaggc

SEQ ID NO: 800931 - RNA, 21 nt, Mycobacterium avium subsp. paratuberculosis
acgucaggggugccggaggcg

SEQ ID NO: 800932 - RNA, 22 nt, Mycobacterium avium subsp. paratuberculosis
acgucaggguggccucgucggc

SEQ ID NO: 800933 - RNA, 23 nt, Mycobacterium avium subsp. paratuberculosis
acgucaggguggccucgucggcg

SEQ ID NO: 800934 - RNA, 15 nt, Mycobacterium avium subsp. paratuberculosis
acgucaggucgaccg

SEQ ID NO: 800935 - RNA, 18 nt, Mycobacterium avium subsp. paratuberculosis
acguccagcccgcgccag

SEQ ID NO: 800936 - RNA, 17 nt, Mycobacterium avium subsp. paratuberculosis
acguccacgccgcggga

SEQ ID NO: 800937 - RNA, 23 nt, Mycobacterium avium subsp. paratuberculosis
acguccacguugaugccgcccag

SEQ ID NO: 800938 - RNA, 15 nt, Mycobacterium avium subsp. paratuberculosis
acgucauggccagcu

SEQ ID NO: 800939 - RNA, 17 nt, Mycobacterium avium subsp. paratuberculosis
acgucauuucggucggc

SEQ ID NO: 800940 - RNA, 17 nt, Mycobacterium avium subsp. paratuberculosis
acguccaccaggguggc

SEQ ID NO: 800941 - RNA, 18 nt, Mycobacterium avium subsp. paratuberculosis
acguccaccaggguggcc

SEQ ID NO: 800942 - RNA, 20 nt, Mycobacterium avium subsp. paratuberculosis
acguccaccaggguggccgc

SEQ ID NO: 800943 - RNA, 23 nt, Mycobacterium avium subsp. paratuberculosis
acgucgaccuugcagcccgcguc

SEQ ID NO: 800944 - RNA, 18 nt, Mycobacterium avium subsp. paratuberculosis
acgucgacgccggucucg

SEQ ID NO: 800945 - RNA, 14 nt, Mycobacterium avium subsp. paratuberculosis
acgucgacgcgggc

SEQ ID NO: 800946 - RNA, 10 nt, Mycobacterium avium subsp. paratuberculosis
acgucgacgg

SEQ ID NO: 800947 - RNA, 14 nt, Mycobacterium avium subsp. paratuberculosis
acgucgacggcagc

SEQ ID NO: 800948 - RNA, 15 nt, Mycobacterium avium subsp. paratuberculosis
acgucgacggccgcc

SEQ ID NO: 800949 - RNA, 14 nt, Mycobacterium avium subsp. paratuberculosis
acgucgagcaccgc

SEQ ID NO: 800950 - RNA, 17 nt, Mycobacterium avium subsp. paratuberculosis
acgucgagcaccgcguc

SEQ ID NO: 800951 - RNA, 17 nt, Mycobacterium avium subsp. paratuberculosis
acguccaggccggcgcc

SEQ ID NO: 800952 - RNA, 19 nt, Mycobacterium avium subsp. paratuberculosis
acguccaggccggcgccgc

SEQ ID NO: 800953 - RNA, 22 nt, Mycobacterium avium subsp. paratuberculosis
acguccaggccggcgccgcggg

SEQ ID NO: 800954 - RNA, 23 nt, Mycobacterium avium subsp. paratuberculosis
acguccaucauggcgcugcgcga

SEQ ID NO: 800955 - RNA, 15 nt, Mycobacterium avium subsp. paratuberculosis
acguccccgggcacc

SEQ ID NO: 800956 - RNA, 15 nt, Mycobacterium avium subsp. paratuberculosis
acguccccgggcgug

SEQ ID NO: 800957 - RNA, 19 nt, Mycobacterium avium subsp. paratuberculosis
acguccccgugcagccggg

SEQ ID NO: 800958 - RNA, 16 nt, Mycobacterium avium subsp. paratuberculosis
acgucggcggccgcga

SEQ ID NO: 800959 - RNA, 12 nt, Mycobacterium avium subsp. paratuberculosis
acgucggcguca

SEQ ID NO: 800960 - RNA, 15 nt, Mycobacterium avium subsp. paratuberculosis
acgucggcgucaucg

SEQ ID NO: 800961 - RNA, 20 nt, Mycobacterium avium subsp. paratuberculosis
acgucgggguggccggccag

SEQ ID NO: 800962 - RNA, 21 nt, Mycobacterium avium subsp. paratuberculosis
acgucgggguggccggccagc

SEQ ID NO: 800963 - RNA, 22 nt, Mycobacterium avium subsp. paratuberculosis
acgucgggguggccggccagca

SEQ ID NO: 800964 - RNA, 17 nt, Mycobacterium avium subsp. paratuberculosis
acgucggguccgaccag

SEQ ID NO: 800965 - RNA, 21 nt, Mycobacterium avium subsp. paratuberculosis
acgucggguccgaccagcacc

SEQ ID NO: 800966 - RNA, 15 nt, Mycobacterium avium subsp. paratuberculosis
acgucggguucgccg

SEQ ID NO: 800967 - RNA, 14 nt, Mycobacterium avium subsp. paratuberculosis
acgucggucagcau

SEQ ID NO: 800968 - RNA, 14 nt, Mycobacterium avium subsp. paratuberculosis
acgucggugacgcc

SEQ ID NO: 800969 - RNA, 20 nt, Mycobacterium avium subsp. paratuberculosis
acgucggcgauggcggcgug

SEQ ID NO: 800970 - RNA, 12 nt, Mycobacterium avium subsp. paratuberculosis
acgucggcgcgc

SEQ ID NO: 800971 - RNA, 13 nt, Mycobacterium avium subsp. paratuberculosis
acgucggcgcgca

SEQ ID NO: 800972 - RNA, 16 nt, Mycobacterium avium subsp. paratuberculosis
acgucggcgcgcaggc

SEQ ID NO: 800973 - RNA, 20 nt, Mycobacterium avium subsp. paratuberculosis
acgucggcgcgcaggcuggc

SEQ ID NO: 800974 - RNA, 13 nt, Mycobacterium avium subsp. paratuberculosis
acgucggcgcgcu

SEQ ID NO: 800975 - RNA, 14 nt, Mycobacterium avium subsp. paratuberculosis
acgucggcgcgcuc

SEQ ID NO: 800976 - RNA, 19 nt, Mycobacterium avium subsp. paratuberculosis
acgucggcgcgcucggugc

SEQ ID NO: 800977 - RNA, 13 nt, Mycobacterium avium subsp. paratuberculosis
acgucgagccagc

SEQ ID NO: 800978 - RNA, 17 nt, Mycobacterium avium subsp. paratuberculosis
acgucgagcgcggcccg

SEQ ID NO: 800979 - RNA, 18 nt, Mycobacterium avium subsp. paratuberculosis
acgucgagcgcggcccgc

SEQ ID NO: 800980 - RNA, 19 nt, Mycobacterium avium subsp. paratuberculosis
acgucgagcgcggcccgcc

SEQ ID NO: 800981 - RNA, 20 nt, Mycobacterium avium subsp. paratuberculosis
acgucgagcgcggcccgccg

SEQ ID NO: 800982 - RNA, 16 nt, Mycobacterium avium subsp. paratuberculosis
acgucgagcggcccgu

SEQ ID NO: 800983 - RNA, 18 nt, Mycobacterium avium subsp. paratuberculosis
acgucgagcggcccgucg

SEQ ID NO: 800984 - RNA, 22 nt, Mycobacterium avium subsp. paratuberculosis
acgucgagcggcccgucgccga

SEQ ID NO: 800985 - RNA, 23 nt, Mycobacterium avium subsp. paratuberculosis
acgucgagcggcccgucgccgau

SEQ ID NO: 800986 - RNA, 17 nt, Mycobacterium avium subsp. paratuberculosis
acgucgagcuccucggc

SEQ ID NO: 800987 - RNA, 16 nt, Mycobacterium avium subsp. paratuberculosis
acgucgagggcgccgu

SEQ ID NO: 800988 - RNA, 17 nt, Mycobacterium avium subsp. paratuberculosis
acgucgaggucggacgc

SEQ ID NO: 800989 - RNA, 21 nt, Mycobacterium avium subsp. paratuberculosis
acgucgaucacgccgccgggg

SEQ ID NO: 800990 - RNA, 22 nt, Mycobacterium avium subsp. paratuberculosis
acgucgaucacgccgccggggc

SEQ ID NO: 800991 - RNA, 13 nt, Mycobacterium avium subsp. paratuberculosis
acgucgauccccg

SEQ ID NO: 800992 - RNA, 14 nt, Mycobacterium avium subsp. paratuberculosis
acgucgauccccgc

SEQ ID NO: 800993 - RNA, 19 nt, Mycobacterium avium subsp. paratuberculosis
acgucgauccccgcagcuc

SEQ ID NO: 800994 - RNA, 20 nt, Mycobacterium avium subsp. paratuberculosis
acgucgauccccgcagcucc

SEQ ID NO: 800995 - RNA, 15 nt, Mycobacterium avium subsp. paratuberculosis
acgucgaugccgaac

SEQ ID NO: 800996 - RNA, 17 nt, Mycobacterium avium subsp. paratuberculosis
acgucgaugccggccag

SEQ ID NO: 800997 - RNA, 18 nt, Mycobacterium avium subsp. paratuberculosis
acgucgaugccggccagc

SEQ ID NO: 800998 - RNA, 15 nt, Mycobacterium avium subsp. paratuberculosis
acgucgcagcccggg

SEQ ID NO: 800999 - RNA, 18 nt, Mycobacterium avium subsp. paratuberculosis
acgucggccacgccgggc

SEQ ID NO: 801000 - RNA, 19 nt, Mycobacterium avium subsp. paratuberculosis
acgucggccacgccgggca

SEQ ID NO: 801001 - RNA, 13 nt, Mycobacterium avium subsp. paratuberculosis
acgucggccagcg

SEQ ID NO: 801002 - RNA, 15 nt, Mycobacterium avium subsp. paratuberculosis
acgucggccagcgcg

SEQ ID NO: 801003 - RNA, 13 nt, Mycobacterium avium subsp. paratuberculosis
acgucggccagga

SEQ ID NO: 801004 - RNA, 14 nt, Mycobacterium avium subsp. paratuberculosis
acgucggagaucag

SEQ ID NO: 801005 - RNA, 18 nt, Mycobacterium avium subsp. paratuberculosis
acgucggccggcugcagc

SEQ ID NO: 801006 - RNA, 23 nt, Mycobacterium avium subsp. paratuberculosis
acgucggccggcugcagccgggc

SEQ ID NO: 801007 - RNA, 14 nt, Mycobacterium avium subsp. paratuberculosis
acgucggccggguc

SEQ ID NO: 801008 - RNA, 15 nt, Mycobacterium avium subsp. paratuberculosis
acgggugaccggcgg

SEQ ID NO: 801009 - RNA, 17 nt, Mycobacterium avium subsp. paratuberculosis
acgggugaccggcggcc

SEQ ID NO: 801010 - RNA, 18 nt, Mycobacterium avium subsp. paratuberculosis
acgggugcggcgcucggu

SEQ ID NO: 801011 - RNA, 19 nt, Mycobacterium avium subsp. paratuberculosis
acgggugcggcgcucggug

SEQ ID NO: 801012 - RNA, 20 nt, Mycobacterium avium subsp. paratuberculosis
acgggucguaggacaccacg

SEQ ID NO: 801013 - RNA, 21 nt, Mycobacterium avium subsp. paratuberculosis
acgggcggggggcgagccggc

SEQ ID NO: 801014 - RNA, 16 nt, Mycobacterium avium subsp. paratuberculosis
acgggcggucggacgc

SEQ ID NO: 801015 - RNA, 18 nt, Mycobacterium avium subsp. paratuberculosis
acgggcggucggacgcgg

SEQ ID NO: 801016 - RNA, 18 nt, Mycobacterium avium subsp. paratuberculosis
acgggcugaacucgacgu

SEQ ID NO: 801017 - RNA, 22 nt, Mycobacterium avium subsp. paratuberculosis
acgggcugaagaucaacagccg

SEQ ID NO: 801018 - RNA, 23 nt, Mycobacterium avium subsp. paratuberculosis
acgggcugaagaucaacagccgc

SEQ ID NO: 801019 - RNA, 12 nt, Mycobacterium avium subsp. paratuberculosis
acgggucgagca

SEQ ID NO: 801020 - RNA, 21 nt, Mycobacterium avium subsp. paratuberculosis
acgggucgcugugcagcgggu

SEQ ID NO: 801021 - RNA, 22 nt, Mycobacterium avium subsp. paratuberculosis
acgggucgcugugcagcggguu

SEQ ID NO: 801022 - RNA, 14 nt, Mycobacterium avium subsp. paratuberculosis
acgggucggcgacc

SEQ ID NO: 801023 - RNA, 14 nt, Mycobacterium avium subsp. paratuberculosis
acgggucggcggcg

SEQ ID NO: 801024 - RNA, 14 nt, Mycobacterium avium subsp. paratuberculosis
acgggucggucggc

SEQ ID NO: 801025 - RNA, 17 nt, Mycobacterium avium subsp. paratuberculosis
acgggucggucggcccg

SEQ ID NO: 801026 - RNA, 18 nt, Mycobacterium avium subsp. paratuberculosis
acgggucggucggcccgc

SEQ ID NO: 801027 - RNA, 13 nt, Mycobacterium avium subsp. paratuberculosis
acgggucgguggu

SEQ ID NO: 801028 - RNA, 22 nt, Mycobacterium avium subsp. paratuberculosis
acgggucggugguucgcgcgau

SEQ ID NO: 801029 - RNA, 18 nt, Mycobacterium avium subsp. paratuberculosis
acggguggguggagacgu

SEQ ID NO: 801030 - RNA, 19 nt, Mycobacterium avium subsp. paratuberculosis
acggguucggucucggcgg

SEQ ID NO: 801031 - RNA, 13 nt, Mycobacterium avium subsp. paratuberculosis
acggguugcaggc

SEQ ID NO: 801032 - RNA, 19 nt, Mycobacterium avium subsp. paratuberculosis
acggguugccgucgacgaa

SEQ ID NO: 801033 - RNA, 23 nt, Mycobacterium avium subsp. paratuberculosis
acggguugcggaucggugcaggc

SEQ ID NO: 801034 - RNA, 19 nt, Mycobacterium avium subsp. paratuberculosis
acggguuggucggcgcggc

SEQ ID NO: 801035 - RNA, 20 nt, Mycobacterium avium subsp. paratuberculosis
acggguuggucggcgcggcg

SEQ ID NO: 801036 - RNA, 22 nt, Mycobacterium avium subsp. paratuberculosis
acggguuggucggcgcggcgac

SEQ ID NO: 801037 - RNA, 17 nt, Mycobacterium avium subsp. paratuberculosis
acgguacgugcgccggc

SEQ ID NO: 801038 - RNA, 16 nt, Mycobacterium avium subsp. paratuberculosis
acgggccggcggggug

SEQ ID NO: 801039 - RNA, 14 nt, Mycobacterium avium subsp. paratuberculosis
acgggccgggcacc

SEQ ID NO: 801040 - RNA, 16 nt, Mycobacterium avium subsp. paratuberculosis
acgggccgggcaccgc

SEQ ID NO: 801041 - RNA, 19 nt, Mycobacterium avium subsp. paratuberculosis
acgggccgggcaccgcgcc

SEQ ID NO: 801042 - RNA, 19 nt, Mycobacterium avium subsp. paratuberculosis
acgggccgggcacgucgac

SEQ ID NO: 801043 - RNA, 17 nt, Mycobacterium avium subsp. paratuberculosis
acgggccguccaucccg

SEQ ID NO: 801044 - RNA, 17 nt, Mycobacterium avium subsp. paratuberculosis
acgggccgcagccgcgc

SEQ ID NO: 801045 - RNA, 18 nt, Mycobacterium avium subsp. paratuberculosis
acgggccgcagccgcgcg

SEQ ID NO: 801046 - RNA, 19 nt, Mycobacterium avium subsp. paratuberculosis
acgggccgcagccgcgcgg

SEQ ID NO: 801047 - RNA, 20 nt, Mycobacterium avium subsp. paratuberculosis
acgggccgcagccgcgcggc

SEQ ID NO: 801048 - RNA, 21 nt, Mycobacterium avium subsp. paratuberculosis
acgggccgcagccgcgcggcc

SEQ ID NO: 801049 - RNA, 19 nt, Mycobacterium avium subsp. paratuberculosis
acgggccgcauccgcgagc

SEQ ID NO: 801050 - RNA, 15 nt, Mycobacterium avium subsp. paratuberculosis
acgggccaccagcgc

SEQ ID NO: 801051 - RNA, 19 nt, Mycobacterium avium subsp. paratuberculosis
acgggcccgcgccuucuug

SEQ ID NO: 801052 - RNA, 13 nt, Mycobacterium avium subsp. paratuberculosis
acgggcccguccg

SEQ ID NO: 801053 - RNA, 15 nt, Mycobacterium avium subsp. paratuberculosis
acgggccgaucacgc

SEQ ID NO: 801054 - RNA, 16 nt, Mycobacterium avium subsp. paratuberculosis
acgggccgccucacgc

SEQ ID NO: 801055 - RNA, 15 nt, Mycobacterium avium subsp. paratuberculosis
acgggccgcgccgag

SEQ ID NO: 801056 - RNA, 12 nt, Mycobacterium avium subsp. paratuberculosis
acgggccgcggc

SEQ ID NO: 801057 - RNA, 18 nt, Mycobacterium avium subsp. paratuberculosis
acgggcguccgagaaggg

SEQ ID NO: 801058 - RNA, 22 nt, Mycobacterium avium subsp. paratuberculosis
acgggcgugacggaugugacgc

SEQ ID NO: 801059 - RNA, 16 nt, Mycobacterium avium subsp. paratuberculosis
acgggcgugccggcgg

SEQ ID NO: 801060 - RNA, 17 nt, Mycobacterium avium subsp. paratuberculosis
acgggcgugccggcggc

SEQ ID NO: 801061 - RNA, 18 nt, Mycobacterium avium subsp. paratuberculosis
acgggcgugccggcggcg

SEQ ID NO: 801062 - RNA, 22 nt, Mycobacterium avium subsp. paratuberculosis
acgggcggcagggccagcacca

SEQ ID NO: 801063 - RNA, 19 nt, Mycobacterium avium subsp. paratuberculosis
acgggcggcggaucagcac

SEQ ID NO: 801064 - RNA, 22 nt, Mycobacterium avium subsp. paratuberculosis
acgggcgcaccgcgcgccaggu

SEQ ID NO: 801065 - RNA, 14 nt, Mycobacterium avium subsp. paratuberculosis
acgggcgcagcgcc

SEQ ID NO: 801066 - RNA, 17 nt, Mycobacterium avium subsp. paratuberculosis
acgggcgcagcgccguc

SEQ ID NO: 801067 - RNA, 16 nt, Mycobacterium avium subsp. paratuberculosis
acggcggcgcgcacgu

SEQ ID NO: 801068 - RNA, 16 nt, Mycobacterium avium subsp. paratuberculosis
acggcuugcgcucggc

SEQ ID NO: 801069 - RNA, 17 nt, Mycobacterium avium subsp. paratuberculosis
acggcuugcgcucggcc

SEQ ID NO: 801070 - RNA, 20 nt, Mycobacterium avium subsp. paratuberculosis
acggcuugcgcucggccggg

SEQ ID NO: 801071 - RNA, 21 nt, Mycobacterium avium subsp. paratuberculosis
acggcuugaugaugcugucgg

SEQ ID NO: 801072 - RNA, 21 nt, Mycobacterium avium subsp. paratuberculosis
acggcuuuggugacgccgacg

SEQ ID NO: 801073 - RNA, 23 nt, Mycobacterium avium subsp. paratuberculosis
acggcuuuggugacgccgacgua

SEQ ID NO: 801074 - RNA, 15 nt, Mycobacterium avium subsp. paratuberculosis
acgggaagagcggcg

SEQ ID NO: 801075 - RNA, 13 nt, Mycobacterium avium subsp. paratuberculosis
acgggaagaucgc

SEQ ID NO: 801076 - RNA, 15 nt, Mycobacterium avium subsp. paratuberculosis
acgggccaggcgcgc

SEQ ID NO: 801077 - RNA, 17 nt, Mycobacterium avium subsp. paratuberculosis
acgggccaggcgcgcgc

SEQ ID NO: 801078 - RNA, 14 nt, Mycobacterium avium subsp. paratuberculosis
acgggcccagcgcg

SEQ ID NO: 801079 - RNA, 16 nt, Mycobacterium avium subsp. paratuberculosis
acgggcccagcgcgac

SEQ ID NO: 801080 - RNA, 21 nt, Mycobacterium avium subsp. paratuberculosis
acgggcccagcgcgacgucga

SEQ ID NO: 801081 - RNA, 23 nt, Mycobacterium avium subsp. paratuberculosis
acgggcagggugaccgaggccgc

SEQ ID NO: 801082 - RNA, 17 nt, Mycobacterium avium subsp. paratuberculosis
acgggcaugccgucggc

SEQ ID NO: 801083 - RNA, 20 nt, Mycobacterium avium subsp. paratuberculosis
acgggaccacccgcagcgcg

SEQ ID NO: 801084 - RNA, 16 nt, Mycobacterium avium subsp. paratuberculosis
acgggaccgcacgccg

SEQ ID NO: 801085 - RNA, 15 nt, Mycobacterium avium subsp. paratuberculosis
acggcgggcccgucg

SEQ ID NO: 801086 - RNA, 20 nt, Mycobacterium avium subsp. paratuberculosis
acggcgggcccgucgccggc

SEQ ID NO: 801087 - RNA, 14 nt, Mycobacterium avium subsp. paratuberculosis
acggcggcggcggc

SEQ ID NO: 801088 - RNA, 18 nt, Mycobacterium avium subsp. paratuberculosis
acggcggcggugccgcag

SEQ ID NO: 801089 - RNA, 20 nt, Mycobacterium avium subsp. paratuberculosis
acggcggcggugccgcaggc

SEQ ID NO: 801090 - RNA, 22 nt, Mycobacterium avium subsp. paratuberculosis
acggcggggaugcccgggggau

SEQ ID NO: 801091 - RNA, 22 nt, Mycobacterium avium subsp. paratuberculosis
acggcggggccuccaccagcgg

SEQ ID NO: 801092 - RNA, 22 nt, Mycobacterium avium subsp. paratuberculosis
acggcggggcggaugcgcuggu

SEQ ID NO: 801093 - RNA, 18 nt, Mycobacterium avium subsp. paratuberculosis
acggcggggugcgcggcg

SEQ ID NO: 801094 - RNA, 16 nt, Mycobacterium avium subsp. paratuberculosis
acggcgggugcgacgg

SEQ ID NO: 801095 - RNA, 17 nt, Mycobacterium avium subsp. paratuberculosis
acggcgggugcgacggc

SEQ ID NO: 801096 - RNA, 23 nt, Mycobacterium avium subsp. paratuberculosis
acggcgggugggggucuggucgg

SEQ ID NO: 801097 - RNA, 13 nt, Mycobacterium avium subsp. paratuberculosis
acggcggcgcggg

SEQ ID NO: 801098 - RNA, 14 nt, Mycobacterium avium subsp. paratuberculosis
acggcggcgcgggc

SEQ ID NO: 801099 - RNA, 19 nt, Mycobacterium avium subsp. paratuberculosis
acggcggcgcgggcggcgu

SEQ ID NO: 801100 - RNA, 17 nt, Mycobacterium avium subsp. paratuberculosis
acggcggcgcugaugcc

SEQ ID NO: 801101 - RNA, 19 nt, Mycobacterium avium subsp. paratuberculosis
acggcggcgcugaugccgu

SEQ ID NO: 801102 - RNA, 14 nt, Mycobacterium avium subsp. paratuberculosis
acggcggcggcacc

SEQ ID NO: 801103 - RNA, 18 nt, Mycobacterium avium subsp. paratuberculosis
acggcggcgaguucggcg

SEQ ID NO: 801104 - RNA, 12 nt, Mycobacterium avium subsp. paratuberculosis
acggcggccgcg

SEQ ID NO: 801105 - RNA, 14 nt, Mycobacterium avium subsp. paratuberculosis
acggcggccgcgga

SEQ ID NO: 801106 - RNA, 15 nt, Mycobacterium avium subsp. paratuberculosis
acggcggccgcggac

SEQ ID NO: 801107 - RNA, 20 nt, Mycobacterium avium subsp. paratuberculosis
acggcggccgcggacccgac

SEQ ID NO: 801108 - RNA, 13 nt, Mycobacterium avium subsp. paratuberculosis
acggcggccgucu

SEQ ID NO: 801109 - RNA, 22 nt, Mycobacterium avium subsp. paratuberculosis
acggcggccgucuugcccggcg

SEQ ID NO: 801110 - RNA, 12 nt, Mycobacterium avium subsp. paratuberculosis
acggcggcgacg

SEQ ID NO: 801111 - RNA, 19 nt, Mycobacterium avium subsp. paratuberculosis
acggcgcgaaccgggccag

SEQ ID NO: 801112 - RNA, 16 nt, Mycobacterium avium subsp. paratuberculosis
acggcgcgaggacgau

SEQ ID NO: 801113 - RNA, 18 nt, Mycobacterium avium subsp. paratuberculosis
acggcgcgcaccgcgggc

SEQ ID NO: 801114 - RNA, 21 nt, Mycobacterium avium subsp. paratuberculosis
acggcgcgcaccgcgggcagc

SEQ ID NO: 801115 - RNA, 20 nt, Mycobacterium avium subsp. paratuberculosis
acggcgccgcccgggcccgg

SEQ ID NO: 801116 - RNA, 13 nt, Mycobacterium avium subsp. paratuberculosis
acggcgccgcggc

SEQ ID NO: 801117 - RNA, 12 nt, Mycobacterium avium subsp. paratuberculosis
acggcgccgcgu

SEQ ID NO: 801118 - RNA, 15 nt, Mycobacterium avium subsp. paratuberculosis
acggcgccgcgucgg

SEQ ID NO: 801119 - RNA, 17 nt, Mycobacterium avium subsp. paratuberculosis
acggcgccgcgucggac

SEQ ID NO: 801120 - RNA, 20 nt, Mycobacterium avium subsp. paratuberculosis
acggcgccgcgucggacccc

SEQ ID NO: 801121 - RNA, 17 nt, Mycobacterium avium subsp. paratuberculosis
acggcgccggugcccac

SEQ ID NO: 801122 - RNA, 20 nt, Mycobacterium avium subsp. paratuberculosis
acggcgccgugccgcgcggc

SEQ ID NO: 801123 - RNA, 21 nt, Mycobacterium avium subsp. paratuberculosis
acggcgccgugccgcgcggcg

SEQ ID NO: 801124 - RNA, 15 nt, Mycobacterium avium subsp. paratuberculosis
acggcgccaugcgcc

SEQ ID NO: 801125 - RNA, 23 nt, Mycobacterium avium subsp. paratuberculosis
acggcgccaccagccacaccgcc

SEQ ID NO: 801126 - RNA, 22 nt, Mycobacterium avium subsp. paratuberculosis
acggcggcauguucgaugcggu

SEQ ID NO: 801127 - RNA, 20 nt, Mycobacterium avium subsp. paratuberculosis
acggcggcagcgaggcgcgc

SEQ ID NO: 801128 - RNA, 22 nt, Mycobacterium avium subsp. paratuberculosis
acggcggcagcgaggcgcgcag

SEQ ID NO: 801129 - RNA, 23 nt, Mycobacterium avium subsp. paratuberculosis
acggcggcagcgaggcgcgcagg

SEQ ID NO: 801130 - RNA, 14 nt, Mycobacterium avium subsp. paratuberculosis
acggcggccgaauc

SEQ ID NO: 801131 - RNA, 21 nt, Mycobacterium avium subsp. paratuberculosis
acggcggccgaauccggccgg

SEQ ID NO: 801132 - RNA, 14 nt, Mycobacterium avium subsp. paratuberculosis
acggcggaccggcg

SEQ ID NO: 801133 - RNA, 15 nt, Mycobacterium avium subsp. paratuberculosis
acggcggaccggcgg

SEQ ID NO: 801134 - RNA, 19 nt, Mycobacterium avium subsp. paratuberculosis
acggcgcuguggccguuga

SEQ ID NO: 801135 - RNA, 16 nt, Mycobacterium avium subsp. paratuberculosis
acggcggaaccgggcc

SEQ ID NO: 801136 - RNA, 21 nt, Mycobacterium avium subsp. paratuberculosis
acggcgcuggccgcggccagc

SEQ ID NO: 801137 - RNA, 16 nt, Mycobacterium avium subsp. paratuberculosis
acggcgcucaccggcg

SEQ ID NO: 801138 - RNA, 21 nt, Mycobacterium avium subsp. paratuberculosis
acggcgcucaccggcguggug

SEQ ID NO: 801139 - RNA, 20 nt, Mycobacterium avium subsp. paratuberculosis
acggcgcgguggcgugcagc

SEQ ID NO: 801140 - RNA, 21 nt, Mycobacterium avium subsp. paratuberculosis
acggcgcgucguagucgcucg

SEQ ID NO: 801141 - RNA, 12 nt, Mycobacterium avium subsp. paratuberculosis
acggcgcgugcu

SEQ ID NO: 801142 - RNA, 13 nt, Mycobacterium avium subsp. paratuberculosis
acggcgacgacca

SEQ ID NO: 801143 - RNA, 15 nt, Mycobacterium avium subsp. paratuberculosis
acggcgacgaccacc

SEQ ID NO: 801144 - RNA, 20 nt, Mycobacterium avium subsp. paratuberculosis
acggcgacgaccaccaggag

SEQ ID NO: 801145 - RNA, 22 nt, Mycobacterium avium subsp. paratuberculosis
acggcgacgaccaccaggagca

SEQ ID NO: 801146 - RNA, 17 nt, Mycobacterium avium subsp. paratuberculosis
acggcgacgaccgucau

SEQ ID NO: 801147 - RNA, 14 nt, Mycobacterium avium subsp. paratuberculosis
acggcgacggcagc

SEQ ID NO: 801148 - RNA, 23 nt, Mycobacterium avium subsp. paratuberculosis
acggcgacggcagcgcgauccgg

SEQ ID NO: 801149 - RNA, 14 nt, Mycobacterium avium subsp. paratuberculosis
acggcgacggccag

SEQ ID NO: 801150 - RNA, 15 nt, Mycobacterium avium subsp. paratuberculosis
acggcgacggcgucc

SEQ ID NO: 801151 - RNA, 20 nt, Mycobacterium avium subsp. paratuberculosis
acggcgacggcguccgggcg

SEQ ID NO: 801152 - RNA, 19 nt, Mycobacterium avium subsp. paratuberculosis
acggcgaggauggcgauca

SEQ ID NO: 801153 - RNA, 15 nt, Mycobacterium avium subsp. paratuberculosis
acggcgaggucggga

SEQ ID NO: 801154 - RNA, 13 nt, Mycobacterium avium subsp. paratuberculosis
acggcgagccggg

SEQ ID NO: 801155 - RNA, 14 nt, Mycobacterium avium subsp. paratuberculosis
acggcgagccgggc

SEQ ID NO: 801156 - RNA, 17 nt, Mycobacterium avium subsp. paratuberculosis
acggcgagccgggccgg

SEQ ID NO: 801157 - RNA, 20 nt, Mycobacterium avium subsp. paratuberculosis
acggcgagccgggccggguc

SEQ ID NO: 801158 - RNA, 14 nt, Mycobacterium avium subsp. paratuberculosis
acggcgagcggccc

SEQ ID NO: 801159 - RNA, 15 nt, Mycobacterium avium subsp. paratuberculosis
acggcgagcggcccu

SEQ ID NO: 801160 - RNA, 17 nt, Mycobacterium avium subsp. paratuberculosis
acggcgagcggcccugc

SEQ ID NO: 801161 - RNA, 16 nt, Mycobacterium avium subsp. paratuberculosis
acggcgaacggccgcg

SEQ ID NO: 801162 - RNA, 14 nt, Mycobacterium avium subsp. paratuberculosis
acggcgaacgucga

SEQ ID NO: 801163 - RNA, 15 nt, Mycobacterium avium subsp. paratuberculosis
acggcgaacgucgau

SEQ ID NO: 801164 - RNA, 16 nt, Mycobacterium avium subsp. paratuberculosis
acggcgaacgucgaug

SEQ ID NO: 801165 - RNA, 17 nt, Mycobacterium avium subsp. paratuberculosis
acggcgaacgucgaugu

SEQ ID NO: 801166 - RNA, 16 nt, Mycobacterium avium subsp. paratuberculosis
acggcgaacuuggccg

SEQ ID NO: 801167 - RNA, 19 nt, Mycobacterium avium subsp. paratuberculosis
acggcgaauauuucgccga

SEQ ID NO: 801168 - RNA, 20 nt, Mycobacterium avium subsp. paratuberculosis
acggcgaauauuucgccgau

SEQ ID NO: 801169 - RNA, 14 nt, Mycobacterium avium subsp. paratuberculosis
acggcgaccacacc

SEQ ID NO: 801170 - RNA, 15 nt, Mycobacterium avium subsp. paratuberculosis
acggcgaccacaccg

SEQ ID NO: 801171 - RNA, 21 nt, Mycobacterium avium subsp. paratuberculosis
acggcgaccacaccgucgacg

SEQ ID NO: 801172 - RNA, 14 nt, Mycobacterium avium subsp. paratuberculosis
acggcgaagccggc

SEQ ID NO: 801173 - RNA, 14 nt, Mycobacterium avium subsp. paratuberculosis
acggcgaccagcga

SEQ ID NO: 801174 - RNA, 12 nt, Mycobacterium avium subsp. paratuberculosis
acggcgaccccg

SEQ ID NO: 801175 - RNA, 21 nt, Mycobacterium avium subsp. paratuberculosis
acggcgaccccguucgccgac

SEQ ID NO: 801176 - RNA, 21 nt, Mycobacterium avium subsp. paratuberculosis
acggccugguacagcaccgcc

SEQ ID NO: 801177 - RNA, 20 nt, Mycobacterium avium subsp. paratuberculosis
acggccugcaccaccacacc

SEQ ID NO: 801178 - RNA, 22 nt, Mycobacterium avium subsp. paratuberculosis
acggccugcaccaccacaccca

SEQ ID NO: 801179 - RNA, 22 nt, Mycobacterium avium subsp. paratuberculosis
acggccucccacucgucgaucg

SEQ ID NO: 801180 - RNA, 15 nt, Mycobacterium avium subsp. paratuberculosis
acggccguccaggcg

SEQ ID NO: 801181 - RNA, 16 nt, Mycobacterium avium subsp. paratuberculosis
acggccguccaggcgc

SEQ ID NO: 801182 - RNA, 17 nt, Mycobacterium avium subsp. paratuberculosis
acggccguccaggcgcc

SEQ ID NO: 801183 - RNA, 16 nt, Mycobacterium avium subsp. paratuberculosis
acggccggcgccgccg

SEQ ID NO: 801184 - RNA, 21 nt, Mycobacterium avium subsp. paratuberculosis
acggccggcgccgccggggcg

SEQ ID NO: 801185 - RNA, 14 nt, Mycobacterium avium subsp. paratuberculosis
acggccggcgucac

SEQ ID NO: 801186 - RNA, 22 nt, Mycobacterium avium subsp. paratuberculosis
acggccgggauuucccgggcga

SEQ ID NO: 801187 - RNA, 22 nt, Mycobacterium avium subsp. paratuberculosis
acggccggggccagcacccaga

SEQ ID NO: 801188 - RNA, 17 nt, Mycobacterium avium subsp. paratuberculosis
acggccgugaugccggg

SEQ ID NO: 801189 - RNA, 20 nt, Mycobacterium avium subsp. paratuberculosis
acggccgugaugccgggcaa

SEQ ID NO: 801190 - RNA, 13 nt, Mycobacterium avium subsp. paratuberculosis
acggccucgauca

SEQ ID NO: 801191 - RNA, 20 nt, Mycobacterium avium subsp. paratuberculosis
acggccucgaucaucaccac

SEQ ID NO: 801192 - RNA, 22 nt, Mycobacterium avium subsp. paratuberculosis
acggccucgaucaucaccaccg

SEQ ID NO: 801193 - RNA, 18 nt, Mycobacterium avium subsp. paratuberculosis
acggccucgcccagcgcc

SEQ ID NO: 801194 - RNA, 19 nt, Mycobacterium avium subsp. paratuberculosis
acggccucgcccagcgccg

SEQ ID NO: 801195 - RNA, 20 nt, Mycobacterium avium subsp. paratuberculosis
acggccucgcccagcgccgc

SEQ ID NO: 801196 - RNA, 16 nt, Mycobacterium avium subsp. paratuberculosis
acggccucgccgucgc

SEQ ID NO: 801197 - RNA, 22 nt, Mycobacterium avium subsp. paratuberculosis
acggccucgccgucgcgaucgc

SEQ ID NO: 801198 - RNA, 17 nt, Mycobacterium avium subsp. paratuberculosis
acggcaucggcgcccuc

SEQ ID NO: 801199 - RNA, 18 nt, Mycobacterium avium subsp. paratuberculosis
acggcaucggcgcccucg

SEQ ID NO: 801200 - RNA, 15 nt, Mycobacterium avium subsp. paratuberculosis
acggcaucgauggcg

SEQ ID NO: 801201 - RNA, 19 nt, Mycobacterium avium subsp. paratuberculosis
acggcaucgauggcgggcg

SEQ ID NO: 801202 - RNA, 18 nt, Mycobacterium avium subsp. paratuberculosis
acggcaugccgggccagc

SEQ ID NO: 801203 - RNA, 23 nt, Mycobacterium avium subsp. paratuberculosis
acggcaugccgggccagccggcc

SEQ ID NO: 801204 - RNA, 14 nt, Mycobacterium avium subsp. paratuberculosis
acggccaaccgccc

SEQ ID NO: 801205 - RNA, 20 nt, Mycobacterium avium subsp. paratuberculosis
acggccaaccgcccggcgcc

SEQ ID NO: 801206 - RNA, 21 nt, Mycobacterium avium subsp. paratuberculosis
acggccaaccgcccggcgccg

SEQ ID NO: 801207 - RNA, 18 nt, Mycobacterium avium subsp. paratuberculosis
acggccaacugcaucgcc

SEQ ID NO: 801208 - RNA, 14 nt, Mycobacterium avium subsp. paratuberculosis
acggccaccacggc

SEQ ID NO: 801209 - RNA, 15 nt, Mycobacterium avium subsp. paratuberculosis
acggccaccacggca

SEQ ID NO: 801210 - RNA, 14 nt, Mycobacterium avium subsp. paratuberculosis
acggccaccagcag

SEQ ID NO: 801211 - RNA, 13 nt, Mycobacterium avium subsp. paratuberculosis
acggccaccgccg

SEQ ID NO: 801212 - RNA, 16 nt, Mycobacterium avium subsp. paratuberculosis
acggccaccuugucgg

SEQ ID NO: 801213 - RNA, 19 nt, Mycobacterium avium subsp. paratuberculosis
acggccaccuugucggcgc

SEQ ID NO: 801214 - RNA, 13 nt, Mycobacterium avium subsp. paratuberculosis
acggcagcaccgc

SEQ ID NO: 801215 - RNA, 20 nt, Mycobacterium avium subsp. paratuberculosis
acggcagcaccucgcgcagc

SEQ ID NO: 801216 - RNA, 24 nt, Mycobacterium avium subsp. paratuberculosis
acggcagaggcguuuucggugugc

SEQ ID NO: 801217 - RNA, 14 nt, Mycobacterium avium subsp. paratuberculosis
acggcagcccgacg

SEQ ID NO: 801218 - RNA, 19 nt, Mycobacterium avium subsp. paratuberculosis
acggcagcgcuaaccgcgg

SEQ ID NO: 801219 - RNA, 14 nt, Mycobacterium avium subsp. paratuberculosis
acggcagcggcacc

SEQ ID NO: 801220 - RNA, 21 nt, Mycobacterium avium subsp. paratuberculosis
acggcagugagggaacgccga

SEQ ID NO: 801221 - RNA, 22 nt, Mycobacterium avium subsp. paratuberculosis
acggcaguaucuuguucgccga

SEQ ID NO: 801222 - RNA, 23 nt, Mycobacterium avium subsp. paratuberculosis
acggcaguaucuuguucgccgac

SEQ ID NO: 801223 - RNA, 16 nt, Mycobacterium avium subsp. paratuberculosis
acggcagcucgucgac

SEQ ID NO: 801224 - RNA, 18 nt, Mycobacterium avium subsp. paratuberculosis
acggcagcucgucgacgu

SEQ ID NO: 801225 - RNA, 13 nt, Mycobacterium avium subsp. paratuberculosis
acggcaggcggcc

SEQ ID NO: 801226 - RNA, 16 nt, Mycobacterium avium subsp. paratuberculosis
acggcaggcggcccgc

SEQ ID NO: 801227 - RNA, 21 nt, Mycobacterium avium subsp. paratuberculosis
acggcaggcggcccgcucgau

SEQ ID NO: 801228 - RNA, 14 nt, Mycobacterium avium subsp. paratuberculosis
acggccaugcagac

SEQ ID NO: 801229 - RNA, 19 nt, Mycobacterium avium subsp. paratuberculosis
acggcccaucaccagcggc

SEQ ID NO: 801230 - RNA, 21 nt, Mycobacterium avium subsp. paratuberculosis
acggcccaucacgucggggcc

SEQ ID NO: 801231 - RNA, 20 nt, Mycobacterium avium subsp. paratuberculosis
acggcccacgucgcgccgau

SEQ ID NO: 801232 - RNA, 19 nt, Mycobacterium avium subsp. paratuberculosis
acggccccagccgccgcga

SEQ ID NO: 801233 - RNA, 22 nt, Mycobacterium avium subsp. paratuberculosis
acggcccgacgacgccgucacg

SEQ ID NO: 801234 - RNA, 13 nt, Mycobacterium avium subsp. paratuberculosis
acggcccccacga

SEQ ID NO: 801235 - RNA, 17 nt, Mycobacterium avium subsp. paratuberculosis
acggccccccgggcacc

SEQ ID NO: 801236 - RNA, 12 nt, Mycobacterium avium subsp. paratuberculosis
acggcccgccgc

SEQ ID NO: 801237 - RNA, 16 nt, Mycobacterium avium subsp. paratuberculosis
acggcccgccgccggc

SEQ ID NO: 801238 - RNA, 18 nt, Mycobacterium avium subsp. paratuberculosis
acggcccgccgccggcgg

SEQ ID NO: 801239 - RNA, 22 nt, Mycobacterium avium subsp. paratuberculosis
acggcccgccgccggcggcguc

SEQ ID NO: 801240 - RNA, 14 nt, Mycobacterium avium subsp. paratuberculosis
acggcccgccggag

SEQ ID NO: 801241 - RNA, 15 nt, Mycobacterium avium subsp. paratuberculosis
acggccagcgcggcg

SEQ ID NO: 801242 - RNA, 16 nt, Mycobacterium avium subsp. paratuberculosis
acggccagcgcggcgg

SEQ ID NO: 801243 - RNA, 16 nt, Mycobacterium avium subsp. paratuberculosis
acggccaguccaggcc

SEQ ID NO: 801244 - RNA, 16 nt, Mycobacterium avium subsp. paratuberculosis
acggccagcagcaccg

SEQ ID NO: 801245 - RNA, 14 nt, Mycobacterium avium subsp. paratuberculosis
acggccagcaccgc

SEQ ID NO: 801246 - RNA, 15 nt, Mycobacterium avium subsp. paratuberculosis
acggccagcaccgcc

SEQ ID NO: 801247 - RNA, 18 nt, Mycobacterium avium subsp. paratuberculosis
acggccagcaccgccagc

SEQ ID NO: 801248 - RNA, 16 nt, Mycobacterium avium subsp. paratuberculosis
acggccagccagccgc

SEQ ID NO: 801249 - RNA, 21 nt, Mycobacterium avium subsp. paratuberculosis
acggccagccagccgcccagc

SEQ ID NO: 801250 - RNA, 12 nt, Mycobacterium avium subsp. paratuberculosis
acggccagcccg

SEQ ID NO: 801251 - RNA, 12 nt, Mycobacterium avium subsp. paratuberculosis
acggccagcgcc

SEQ ID NO: 801252 - RNA, 23 nt, Mycobacterium avium subsp. paratuberculosis
acggccagcaggaugaugaccga

SEQ ID NO: 801253 - RNA, 16 nt, Mycobacterium avium subsp. paratuberculosis
acggccagcagggcgc

SEQ ID NO: 801254 - RNA, 22 nt, Mycobacterium avium subsp. paratuberculosis
acggccagcagggcgccgacga

SEQ ID NO: 801255 - RNA, 14 nt, Mycobacterium avium subsp. paratuberculosis
acggccgacgccca

SEQ ID NO: 801256 - RNA, 17 nt, Mycobacterium avium subsp. paratuberculosis
acggccgacgcccagca

SEQ ID NO: 801257 - RNA, 19 nt, Mycobacterium avium subsp. paratuberculosis
acggccgacgcccagcacc

SEQ ID NO: 801258 - RNA, 19 nt, Mycobacterium avium subsp. paratuberculosis
acggccgaaacgcccggcu

SEQ ID NO: 801259 - RNA, 12 nt, Mycobacterium avium subsp. paratuberculosis
acggccgcggcg

SEQ ID NO: 801260 - RNA, 13 nt, Mycobacterium avium subsp. paratuberculosis
acggccgcggcgc

SEQ ID NO: 801261 - RNA, 16 nt, Mycobacterium avium subsp. paratuberculosis
acggccgcggcgcggc

SEQ ID NO: 801262 - RNA, 19 nt, Mycobacterium avium subsp. paratuberculosis
acggccgcggcgcggcccg

SEQ ID NO: 801263 - RNA, 20 nt, Mycobacterium avium subsp. paratuberculosis
acggccgcggcgcggcccgg

SEQ ID NO: 801264 - RNA, 22 nt, Mycobacterium avium subsp. paratuberculosis
acggccgcggcgcggcccggcc

SEQ ID NO: 801265 - RNA, 15 nt, Mycobacterium avium subsp. paratuberculosis
acggccgcggcggug

SEQ ID NO: 801266 - RNA, 20 nt, Mycobacterium avium subsp. paratuberculosis
acggccgcggcggugccggu

SEQ ID NO: 801267 - RNA, 14 nt, Mycobacterium avium subsp. paratuberculosis
acggccgcaacggc

SEQ ID NO: 801268 - RNA, 18 nt, Mycobacterium avium subsp. paratuberculosis
acggccgcaacggcgguc

SEQ ID NO: 801269 - RNA, 15 nt, Mycobacterium avium subsp. paratuberculosis
acggccgcagcgacu

SEQ ID NO: 801270 - RNA, 12 nt, Mycobacterium avium subsp. paratuberculosis
acggccgccagc

SEQ ID NO: 801271 - RNA, 18 nt, Mycobacterium avium subsp. paratuberculosis
acggccggauggccagca

SEQ ID NO: 801272 - RNA, 21 nt, Mycobacterium avium subsp. paratuberculosis
acggccggcaacgacccgucg

SEQ ID NO: 801273 - RNA, 12 nt, Mycobacterium avium subsp. paratuberculosis
acggccggcagc

SEQ ID NO: 801274 - RNA, 15 nt, Mycobacterium avium subsp. paratuberculosis
acggccggccggccg

SEQ ID NO: 801275 - RNA, 18 nt, Mycobacterium avium subsp. paratuberculosis
acggccggccggccgagc

SEQ ID NO: 801276 - RNA, 12 nt, Mycobacterium avium subsp. paratuberculosis
acggccgccgag

SEQ ID NO: 801277 - RNA, 17 nt, Mycobacterium avium subsp. paratuberculosis
acggccgccgaggcgau

SEQ ID NO: 801278 - RNA, 20 nt, Mycobacterium avium subsp. paratuberculosis
acggccgccgaggcgaugcc

SEQ ID NO: 801279 - RNA, 20 nt, Mycobacterium avium subsp. paratuberculosis
acggccgccgauuccggccg

SEQ ID NO: 801280 - RNA, 15 nt, Mycobacterium avium subsp. paratuberculosis
acggccgccgcgacg

SEQ ID NO: 801281 - RNA, 13 nt, Mycobacterium avium subsp. paratuberculosis
acggccgcgcaga

SEQ ID NO: 801282 - RNA, 18 nt, Mycobacterium avium subsp. paratuberculosis
acggccgcgcagaucgcc

SEQ ID NO: 801283 - RNA, 14 nt, Mycobacterium avium subsp. paratuberculosis
acggccgcgccgaa

SEQ ID NO: 801284 - RNA, 21 nt, Mycobacterium avium subsp. paratuberculosis
acggccgcgccgaacaccacg

SEQ ID NO: 801285 - RNA, 16 nt, Mycobacterium avium subsp. paratuberculosis
acggccgcgccguuga

SEQ ID NO: 801286 - RNA, 22 nt, Mycobacterium avium subsp. paratuberculosis
acggccgcgccguugaccgcgg

SEQ ID NO: 801287 - RNA, 23 nt, Mycobacterium avium subsp. paratuberculosis
acggccgcgccguugaccgcggc

SEQ ID NO: 801288 - RNA, 14 nt, Mycobacterium avium subsp. paratuberculosis
acggccgcggccag

SEQ ID NO: 801289 - RNA, 13 nt, Mycobacterium avium subsp. paratuberculosis
acggccgcggccc

SEQ ID NO: 801290 - RNA, 14 nt, Mycobacterium avium subsp. paratuberculosis
acggccgcggcccg

SEQ ID NO: 801291 - RNA, 15 nt, Mycobacterium avium subsp. paratuberculosis
acggccgcggcccgg

SEQ ID NO: 801292 - RNA, 16 nt, Mycobacterium avium subsp. paratuberculosis
acggccgcggcccggc

SEQ ID NO: 801293 - RNA, 17 nt, Mycobacterium avium subsp. paratuberculosis
acggccgcggcccggcc

SEQ ID NO: 801294 - RNA, 19 nt, Mycobacterium avium subsp. paratuberculosis
acggccgcggcccggccac

SEQ ID NO: 801295 - RNA, 20 nt, Mycobacterium avium subsp. paratuberculosis
acggccgcggcccggccacc

SEQ ID NO: 801296 - RNA, 21 nt, Mycobacterium avium subsp. paratuberculosis
acggcccgcgccccggcggcc

SEQ ID NO: 801297 - RNA, 13 nt, Mycobacterium avium subsp. paratuberculosis
acggcccgcggca

SEQ ID NO: 801298 - RNA, 22 nt, Mycobacterium avium subsp. paratuberculosis
acggcccgcggcacgcugcgcc

SEQ ID NO: 801299 - RNA, 18 nt, Mycobacterium avium subsp. paratuberculosis
acggcccgcucgggccau

SEQ ID NO: 801300 - RNA, 13 nt, Mycobacterium avium subsp. paratuberculosis
acggcccggcgaa

SEQ ID NO: 801301 - RNA, 21 nt, Mycobacterium avium subsp. paratuberculosis
acggcccgggaagccgcagca

SEQ ID NO: 801302 - RNA, 17 nt, Mycobacterium avium subsp. paratuberculosis
acgcugcggaugucggu

SEQ ID NO: 801303 - RNA, 14 nt, Mycobacterium avium subsp. paratuberculosis
acgcugcggcgccg

SEQ ID NO: 801304 - RNA, 16 nt, Mycobacterium avium subsp. paratuberculosis
acgcugcggcgccggg

SEQ ID NO: 801305 - RNA, 18 nt, Mycobacterium avium subsp. paratuberculosis
acgcugcggcgccgggca

SEQ ID NO: 801306 - RNA, 19 nt, Mycobacterium avium subsp. paratuberculosis
acgcggcgaagcaggccag

SEQ ID NO: 801307 - RNA, 16 nt, Mycobacterium avium subsp. paratuberculosis
acgcggccaccaccgc

SEQ ID NO: 801308 - RNA, 13 nt, Mycobacterium avium subsp. paratuberculosis
acgcuggcgugac

SEQ ID NO: 801309 - RNA, 17 nt, Mycobacterium avium subsp. paratuberculosis
acgcuggcgugacgcuc

SEQ ID NO: 801310 - RNA, 20 nt, Mycobacterium avium subsp. paratuberculosis
acgcuggcgugacgcucgag

SEQ ID NO: 801311 - RNA, 19 nt, Mycobacterium avium subsp. paratuberculosis
acgcuggcgugacgcucgc

SEQ ID NO: 801312 - RNA, 22 nt, Mycobacterium avium subsp. paratuberculosis
acgcuggcgugacgcucggcgc

SEQ ID NO: 801313 - RNA, 23 nt, Mycobacterium avium subsp. paratuberculosis
acgcuggcgugacgcucggcggc

SEQ ID NO: 801314 - RNA, 20 nt, Mycobacterium avium subsp. paratuberculosis
acgcuggcgugacgcucggg

SEQ ID NO: 801315 - RNA, 21 nt, Mycobacterium avium subsp. paratuberculosis
acgcuggcgugacgcucgggg

SEQ ID NO: 801316 - RNA, 19 nt, Mycobacterium avium subsp. paratuberculosis
acgcuggccgagagccggu

SEQ ID NO: 801317 - RNA, 16 nt, Mycobacterium avium subsp. paratuberculosis
acgcuggccggcagcg

SEQ ID NO: 801318 - RNA, 19 nt, Mycobacterium avium subsp. paratuberculosis
acgcggcaugaccggccag

SEQ ID NO: 801319 - RNA, 16 nt, Mycobacterium avium subsp. paratuberculosis
acgcggcacgccgcuc

SEQ ID NO: 801320 - RNA, 18 nt, Mycobacterium avium subsp. paratuberculosis
acgcggcacgccgcucgu

SEQ ID NO: 801321 - RNA, 12 nt, Mycobacterium avium subsp. paratuberculosis
acgcggcacgcc

SEQ ID NO: 801322 - RNA, 18 nt, Mycobacterium avium subsp. paratuberculosis
acgcggauagcccagcgu

SEQ ID NO: 801323 - RNA, 21 nt, Mycobacterium avium subsp. paratuberculosis
acgcggccagcgcccgcgcga

SEQ ID NO: 801324 - RNA, 13 nt, Mycobacterium avium subsp. paratuberculosis
acgcggccagcgg

SEQ ID NO: 801325 - RNA, 13 nt, Mycobacterium avium subsp. paratuberculosis
acgcggccgccag

SEQ ID NO: 801326 - RNA, 16 nt, Mycobacterium avium subsp. paratuberculosis
acgcggccgccagcgc

SEQ ID NO: 801327 - RNA, 22 nt, Mycobacterium avium subsp. paratuberculosis
acgcggccgccagcgcaccgag

SEQ ID NO: 801328 - RNA, 14 nt, Mycobacterium avium subsp. paratuberculosis
acgcggccgccauc

SEQ ID NO: 801329 - RNA, 16 nt, Mycobacterium avium subsp. paratuberculosis
acgcggccgccaucga

SEQ ID NO: 801330 - RNA, 19 nt, Mycobacterium avium subsp. paratuberculosis
acgcggccgccaucgaucg

SEQ ID NO: 801331 - RNA, 16 nt, Mycobacterium avium subsp. paratuberculosis
acgcggccgcgccggc

SEQ ID NO: 801332 - RNA, 18 nt, Mycobacterium avium subsp. paratuberculosis
acgcggccgcgccggccg

SEQ ID NO: 801333 - RNA, 15 nt, Mycobacterium avium subsp. paratuberculosis
acgcgcucagcgcgg

SEQ ID NO: 801334 - RNA, 16 nt, Mycobacterium avium subsp. paratuberculosis
acgcgcucagcgcggc

SEQ ID NO: 801335 - RNA, 19 nt, Mycobacterium avium subsp. paratuberculosis
acgcgcucagcgcggccac

SEQ ID NO: 801336 - RNA, 20 nt, Mycobacterium avium subsp. paratuberculosis
acgcgcucagcgcggccaca

SEQ ID NO: 801337 - RNA, 17 nt, Mycobacterium avium subsp. paratuberculosis
acgcgcucggcgaccgc

SEQ ID NO: 801338 - RNA, 20 nt, Mycobacterium avium subsp. paratuberculosis
acgcgcucggcgaccgccgg

SEQ ID NO: 801339 - RNA, 17 nt, Mycobacterium avium subsp. paratuberculosis
acgcggaucgcgcugac

SEQ ID NO: 801340 - RNA, 19 nt, Mycobacterium avium subsp. paratuberculosis
acgcggaucgguggacgcg

SEQ ID NO: 801341 - RNA, 22 nt, Mycobacterium avium subsp. paratuberculosis
acgcggaucgguggacgcgguc

SEQ ID NO: 801342 - RNA, 17 nt, Mycobacterium avium subsp. paratuberculosis
acggauucagcgucgcc

SEQ ID NO: 801343 - RNA, 19 nt, Mycobacterium avium subsp. paratuberculosis
acggauucagcgucgccau

SEQ ID NO: 801344 - RNA, 16 nt, Mycobacterium avium subsp. paratuberculosis
acggauugcggacgcc

SEQ ID NO: 801345 - RNA, 21 nt, Mycobacterium avium subsp. paratuberculosis
acggauugcggacgccucgcc

SEQ ID NO: 801346 - RNA, 21 nt, Mycobacterium avium subsp. paratuberculosis
acggaugccccuugacgguga

SEQ ID NO: 801347 - RNA, 15 nt, Mycobacterium avium subsp. paratuberculosis
acggauccgggcgcc

SEQ ID NO: 801348 - RNA, 21 nt, Mycobacterium avium subsp. paratuberculosis
acggaucgagucccgcgcggc

SEQ ID NO: 801349 - RNA, 16 nt, Mycobacterium avium subsp. paratuberculosis
acggaucggccgcguc

SEQ ID NO: 801350 - RNA, 18 nt, Mycobacterium avium subsp. paratuberculosis
acggaucggccgcgucgg

SEQ ID NO: 801351 - RNA, 15 nt, Mycobacterium avium subsp. paratuberculosis
acggcaccucgauca

SEQ ID NO: 801352 - RNA, 18 nt, Mycobacterium avium subsp. paratuberculosis
acggauguggucggccac

SEQ ID NO: 801353 - RNA, 16 nt, Mycobacterium avium subsp. paratuberculosis
acggcaccccgcgguc

SEQ ID NO: 801354 - RNA, 18 nt, Mycobacterium avium subsp. paratuberculosis
acggcaccccgcggucgg

SEQ ID NO: 801355 - RNA, 23 nt, Mycobacterium avium subsp. paratuberculosis
acggcaccccgcggucggcggcg

SEQ ID NO: 801356 - RNA, 14 nt, Mycobacterium avium subsp. paratuberculosis
acggcacccggccc

SEQ ID NO: 801357 - RNA, 15 nt, Mycobacterium avium subsp. paratuberculosis
acggcacccggcccu

SEQ ID NO: 801358 - RNA, 21 nt, Mycobacterium avium subsp. paratuberculosis
acggcaccgacagggccagcg

SEQ ID NO: 801359 - RNA, 14 nt, Mycobacterium avium subsp. paratuberculosis
acggcaccgacgga

SEQ ID NO: 801360 - RNA, 18 nt, Mycobacterium avium subsp. paratuberculosis
acggcaccgccgcgcggc

SEQ ID NO: 801361 - RNA, 20 nt, Mycobacterium avium subsp. paratuberculosis
acggcaccgccgcgcggccg

SEQ ID NO: 801362 - RNA, 22 nt, Mycobacterium avium subsp. paratuberculosis
acggcaccgccgcgcggccggg

SEQ ID NO: 801363 - RNA, 16 nt, Mycobacterium avium subsp. paratuberculosis
acggcaccgccggcgg

SEQ ID NO: 801364 - RNA, 19 nt, Mycobacterium avium subsp. paratuberculosis
acgcuugggguuuggcgac

SEQ ID NO: 801365 - RNA, 18 nt, Mycobacterium avium subsp. paratuberculosis
acgcuuucgggucgacga

SEQ ID NO: 801366 - RNA, 18 nt, Mycobacterium avium subsp. paratuberculosis
acggagucgucggcgcgg

SEQ ID NO: 801367 - RNA, 18 nt, Mycobacterium avium subsp. paratuberculosis
acggaguuggaucgccgc

SEQ ID NO: 801368 - RNA, 21 nt, Mycobacterium avium subsp. paratuberculosis
acauacaccgggaucggcggc

SEQ ID NO: 801369 - RNA, 22 nt, Mycobacterium avium subsp. paratuberculosis
acauacgccucaccccagcgcg

SEQ ID NO: 801370 - RNA, 17 nt, Mycobacterium avium subsp. paratuberculosis
acauccaggaccgcgcg

SEQ ID NO: 801371 - RNA, 22 nt, Mycobacterium avium subsp. paratuberculosis
acauccaggaccgcgcgccggc

SEQ ID NO: 801372 - RNA, 20 nt, Mycobacterium avium subsp. paratuberculosis
acaucccggacaggucgggc

SEQ ID NO: 801373 - RNA, 21 nt, Mycobacterium avium subsp. paratuberculosis
acaucccggacaggucgggca

SEQ ID NO: 801374 - RNA, 17 nt, Mycobacterium avium subsp. paratuberculosis
acaucccggagccgucg

SEQ ID NO: 801375 - RNA, 17 nt, Mycobacterium avium subsp. paratuberculosis
acauccugguccggcgc

SEQ ID NO: 801376 - RNA, 17 nt, Mycobacterium avium subsp. paratuberculosis
acauccgguugcaccgc

SEQ ID NO: 801377 - RNA, 18 nt, Mycobacterium avium subsp. paratuberculosis
acauccgucacgcccguc

SEQ ID NO: 801378 - RNA, 19 nt, Mycobacterium avium subsp. paratuberculosis
acaucuccagauugcggau

SEQ ID NO: 801379 - RNA, 23 nt, Mycobacterium avium subsp. paratuberculosis
acaucguucccugcgcggcgaug

SEQ ID NO: 801380 - RNA, 22 nt, Mycobacterium avium subsp. paratuberculosis
acaucguggcgacgacgccgau

SEQ ID NO: 801381 - RNA, 16 nt, Mycobacterium avium subsp. paratuberculosis
acaucgucgcgcccag

SEQ ID NO: 801382 - RNA, 21 nt, Mycobacterium avium subsp. paratuberculosis
acaucggugaccgucgccgac

SEQ ID NO: 801383 - RNA, 16 nt, Mycobacterium avium subsp. paratuberculosis
acaucgacgacgggug

SEQ ID NO: 801384 - RNA, 16 nt, Mycobacterium avium subsp. paratuberculosis
acagugcgggcucgau

SEQ ID NO: 801385 - RNA, 16 nt, Mycobacterium avium subsp. paratuberculosis
acagugcacugccgac

SEQ ID NO: 801386 - RNA, 24 nt, Mycobacterium avium subsp. paratuberculosis
acagcgucaccaaugcgccggcgg

SEQ ID NO: 801387 - RNA, 12 nt, Mycobacterium avium subsp. paratuberculosis
acagcgucagca

SEQ ID NO: 801388 - RNA, 20 nt, Mycobacterium avium subsp. paratuberculosis
acagcgucagcaucgccguc

SEQ ID NO: 801389 - RNA, 22 nt, Mycobacterium avium subsp. paratuberculosis
acagcgucagcaucgccgucgu

SEQ ID NO: 801390 - RNA, 16 nt, Mycobacterium avium subsp. paratuberculosis
acagcgucgccgacgg

SEQ ID NO: 801391 - RNA, 22 nt, Mycobacterium avium subsp. paratuberculosis
acagcgucguccaugcccgccc

SEQ ID NO: 801392 - RNA, 23 nt, Mycobacterium avium subsp. paratuberculosis
acagcggguuguucuccagcggc

SEQ ID NO: 801393 - RNA, 13 nt, Mycobacterium avium subsp. paratuberculosis
acagcggcgcgcg

SEQ ID NO: 801394 - RNA, 15 nt, Mycobacterium avium subsp. paratuberculosis
acagcggcgcgcgcc

SEQ ID NO: 801395 - RNA, 23 nt, Mycobacterium avium subsp. paratuberculosis
acagcggcggccauucaucgcgc

SEQ ID NO: 801396 - RNA, 20 nt, Mycobacterium avium subsp. paratuberculosis
acagcggcgacagcggccua

SEQ ID NO: 801397 - RNA, 19 nt, Mycobacterium avium subsp. paratuberculosis
acagcgggccgacccggcc

SEQ ID NO: 801398 - RNA, 21 nt, Mycobacterium avium subsp. paratuberculosis
acagcgggccgacccggccga

SEQ ID NO: 801399 - RNA, 14 nt, Mycobacterium avium subsp. paratuberculosis
acagcgggccggcg

SEQ ID NO: 801400 - RNA, 20 nt, Mycobacterium avium subsp. paratuberculosis
acagcgggccggcgucgucg

SEQ ID NO: 801401 - RNA, 15 nt, Mycobacterium avium subsp. paratuberculosis
acagucgcgggcagc

SEQ ID NO: 801402 - RNA, 19 nt, Mycobacterium avium subsp. paratuberculosis
acagucgcgggcagccggc

SEQ ID NO: 801403 - RNA, 23 nt, Mycobacterium avium subsp. paratuberculosis
acagucgcgggcggggcgccgac

SEQ ID NO: 801404 - RNA, 15 nt, Mycobacterium avium subsp. paratuberculosis
accaagaccgcgguc

SEQ ID NO: 801405 - RNA, 16 nt, Mycobacterium avium subsp. paratuberculosis
accaacugagcgcggc

SEQ ID NO: 801406 - RNA, 14 nt, Mycobacterium avium subsp. paratuberculosis
accaacuccaccgc

SEQ ID NO: 801407 - RNA, 15 nt, Mycobacterium avium subsp. paratuberculosis
accaacgggcggcgg

SEQ ID NO: 801408 - RNA, 16 nt, Mycobacterium avium subsp. paratuberculosis
accaacggcucgccgc

SEQ ID NO: 801409 - RNA, 17 nt, Mycobacterium avium subsp. paratuberculosis
accaacggcucgccgcg

SEQ ID NO: 801410 - RNA, 14 nt, Mycobacterium avium subsp. paratuberculosis
accaacgcggcgcc

SEQ ID NO: 801411 - RNA, 15 nt, Mycobacterium avium subsp. paratuberculosis
accaacgcggcgccg

SEQ ID NO: 801412 - RNA, 19 nt, Mycobacterium avium subsp. paratuberculosis
accaacacccuugcgccgc

SEQ ID NO: 801413 - RNA, 14 nt, Mycobacterium avium subsp. paratuberculosis
accaacacgucgag

SEQ ID NO: 801414 - RNA, 23 nt, Mycobacterium avium subsp. paratuberculosis
accaacagcagcgaggcguccag

SEQ ID NO: 801415 - RNA, 14 nt, Mycobacterium avium subsp. paratuberculosis
accaacagcggccc

SEQ ID NO: 801416 - RNA, 17 nt, Mycobacterium avium subsp. paratuberculosis
accaacaggucggcgug

SEQ ID NO: 801417 - RNA, 12 nt, Mycobacterium avium subsp. paratuberculosis
accaacgccaug

SEQ ID NO: 801418 - RNA, 14 nt, Mycobacterium avium subsp. paratuberculosis
accaaccgcucggc

SEQ ID NO: 801419 - RNA, 13 nt, Mycobacterium avium subsp. paratuberculosis
acaugaucggcgc

SEQ ID NO: 801420 - RNA, 14 nt, Mycobacterium avium subsp. paratuberculosis
acaugaucggcgcg

SEQ ID NO: 801421 - RNA, 16 nt, Mycobacterium avium subsp. paratuberculosis
acaugcagccgccgcg

SEQ ID NO: 801422 - RNA, 18 nt, Mycobacterium avium subsp. paratuberculosis
acaugcagccgccgcgga

SEQ ID NO: 801423 - RNA, 17 nt, Mycobacterium avium subsp. paratuberculosis
acaugauuccgccgggc

SEQ ID NO: 801424 - RNA, 15 nt, Mycobacterium avium subsp. paratuberculosis
acaugauucguucgu

SEQ ID NO: 801425 - RNA, 21 nt, Mycobacterium avium subsp. paratuberculosis
acaucuugaucugggugccgc

SEQ ID NO: 801426 - RNA, 14 nt, Mycobacterium avium subsp. paratuberculosis
acaucugccggucg

SEQ ID NO: 801427 - RNA, 17 nt, Mycobacterium avium subsp. paratuberculosis
acaucugccggucgaug

SEQ ID NO: 801428 - RNA, 20 nt, Mycobacterium avium subsp. paratuberculosis
acaucucgacggugaccggc

SEQ ID NO: 801429 - RNA, 23 nt, Mycobacterium avium subsp. paratuberculosis
acaucucgacggugaccggcucg

SEQ ID NO: 801430 - RNA, 13 nt, Mycobacterium avium subsp. paratuberculosis
acaucucgguggu

SEQ ID NO: 801431 - RNA, 23 nt, Mycobacterium avium subsp. paratuberculosis
acaugcccggcgacggcgccuga

SEQ ID NO: 801432 - RNA, 12 nt, Mycobacterium avium subsp. paratuberculosis
acaugcccgucg

SEQ ID NO: 801433 - RNA, 16 nt, Mycobacterium avium subsp. paratuberculosis
acauuggccgcgcgca

SEQ ID NO: 801434 - RNA, 17 nt, Mycobacterium avium subsp. paratuberculosis
acauuggccgcgcgcag

SEQ ID NO: 801435 - RNA, 18 nt, Mycobacterium avium subsp. paratuberculosis
accacguugcacggcagc

SEQ ID NO: 801436 - RNA, 15 nt, Mycobacterium avium subsp. paratuberculosis
accacguugcgcccg

SEQ ID NO: 801437 - RNA, 17 nt, Mycobacterium avium subsp. paratuberculosis
accacguugcgcccggc

SEQ ID NO: 801438 - RNA, 20 nt, Mycobacterium avium subsp. paratuberculosis
accacguugcgcccggccau

SEQ ID NO: 801439 - RNA, 21 nt, Mycobacterium avium subsp. paratuberculosis
accacguugcgcccggccauc

SEQ ID NO: 801440 - RNA, 18 nt, Mycobacterium avium subsp. paratuberculosis
accacguugcgcggccgc

SEQ ID NO: 801441 - RNA, 22 nt, Mycobacterium avium subsp. paratuberculosis
accacuucuggcgcugcucgga

SEQ ID NO: 801442 - RNA, 12 nt, Mycobacterium avium subsp. paratuberculosis
accacugcgcgc

SEQ ID NO: 801443 - RNA, 16 nt, Mycobacterium avium subsp. paratuberculosis
accagcaggacgcgcc

SEQ ID NO: 801444 - RNA, 20 nt, Mycobacterium avium subsp. paratuberculosis
accagcaggacgcgcccggc

SEQ ID NO: 801445 - RNA, 16 nt, Mycobacterium avium subsp. paratuberculosis
accagaacacguuucg

SEQ ID NO: 801446 - RNA, 18 nt, Mycobacterium avium subsp. paratuberculosis
accagaaguggucgaucu

SEQ ID NO: 801447 - RNA, 19 nt, Mycobacterium avium subsp. paratuberculosis
accagcagcgcgacgccga

SEQ ID NO: 801448 - RNA, 13 nt, Mycobacterium avium subsp. paratuberculosis
accagcagccgca

SEQ ID NO: 801449 - RNA, 19 nt, Mycobacterium avium subsp. paratuberculosis
accagcagccgcagcgcgc

SEQ ID NO: 801450 - RNA, 11 nt, Mycobacterium avium subsp. paratuberculosis
accagcagcgc

SEQ ID NO: 801451 - RNA, 12 nt, Mycobacterium avium subsp. paratuberculosis
accagcagcgcc

SEQ ID NO: 801452 - RNA, 14 nt, Mycobacterium avium subsp. paratuberculosis
accagcagcgccac

SEQ ID NO: 801453 - RNA, 19 nt, Mycobacterium avium subsp. paratuberculosis
accagccgagaucgacccg

SEQ ID NO: 801454 - RNA, 20 nt, Mycobacterium avium subsp. paratuberculosis
accagccgcggacggccagc

SEQ ID NO: 801455 - RNA, 23 nt, Mycobacterium avium subsp. paratuberculosis
accagccgcaggugcucgccggc

SEQ ID NO: 801456 - RNA, 20 nt, Mycobacterium avium subsp. paratuberculosis
accagccggccggccgacaa

SEQ ID NO: 801457 - RNA, 20 nt, Mycobacterium avium subsp. paratuberculosis
accagccgguaggccugcgu

SEQ ID NO: 801458 - RNA, 20 nt, Mycobacterium avium subsp. paratuberculosis
accagccggucuuggacagc

SEQ ID NO: 801459 - RNA, 14 nt, Mycobacterium avium subsp. paratuberculosis
accagcccggccgc

SEQ ID NO: 801460 - RNA, 14 nt, Mycobacterium avium subsp. paratuberculosis
accagcccggcccg

SEQ ID NO: 801461 - RNA, 15 nt, Mycobacterium avium subsp. paratuberculosis
accagcccggccgcc

SEQ ID NO: 801462 - RNA, 17 nt, Mycobacterium avium subsp. paratuberculosis
accagcccggccgccga

SEQ ID NO: 801463 - RNA, 18 nt, Mycobacterium avium subsp. paratuberculosis
accagcccggccgccgag

SEQ ID NO: 801464 - RNA, 12 nt, Mycobacterium avium subsp. paratuberculosis
accagcggcgcc

SEQ ID NO: 801465 - RNA, 15 nt, Mycobacterium avium subsp. paratuberculosis
accagcgacgccagc

SEQ ID NO: 801466 - RNA, 21 nt, Mycobacterium avium subsp. paratuberculosis
accagcgacgccagcggcagc

SEQ ID NO: 801467 - RNA, 14 nt, Mycobacterium avium subsp. paratuberculosis
accagcgacggcag

SEQ ID NO: 801468 - RNA, 13 nt, Mycobacterium avium subsp. paratuberculosis
accagcggccguc

SEQ ID NO: 801469 - RNA, 15 nt, Mycobacterium avium subsp. paratuberculosis
accagcggccgucgc

SEQ ID NO: 801470 - RNA, 21 nt, Mycobacterium avium subsp. paratuberculosis
accagcggccgucgccgggcg

SEQ ID NO: 801471 - RNA, 22 nt, Mycobacterium avium subsp. paratuberculosis
accagcggccgucgccgggcgg

SEQ ID NO: 801472 - RNA, 17 nt, Mycobacterium avium subsp. paratuberculosis
accagcggccgucgcgc

SEQ ID NO: 801473 - RNA, 14 nt, Mycobacterium avium subsp. paratuberculosis
accagcggcgcgcc

SEQ ID NO: 801474 - RNA, 17 nt, Mycobacterium avium subsp. paratuberculosis
accagcggcgcgccggg

SEQ ID NO: 801475 - RNA, 19 nt, Mycobacterium avium subsp. paratuberculosis
accagcggcgcgccgggca

SEQ ID NO: 801476 - RNA, 21 nt, Mycobacterium avium subsp. paratuberculosis
accagcggcgcgccgggcagc

SEQ ID NO: 801477 - RNA, 21 nt, Mycobacterium avium subsp. paratuberculosis
accagcggcgcgucgcugggc

SEQ ID NO: 801478 - RNA, 18 nt, Mycobacterium avium subsp. paratuberculosis
accagcgacagcacccgc

SEQ ID NO: 801479 - RNA, 16 nt, Mycobacterium avium subsp. paratuberculosis
accagcguggccggca

SEQ ID NO: 801480 - RNA, 18 nt, Mycobacterium avium subsp. paratuberculosis
accagcguggugcgcccg

SEQ ID NO: 801481 - RNA, 20 nt, Mycobacterium avium subsp. paratuberculosis
accagcguggugcgcccguc

SEQ ID NO: 801482 - RNA, 17 nt, Mycobacterium avium subsp. paratuberculosis
accagcgugucgccggg

SEQ ID NO: 801483 - RNA, 18 nt, Mycobacterium avium subsp. paratuberculosis
accagcgguaaccacccg

SEQ ID NO: 801484 - RNA, 23 nt, Mycobacterium avium subsp. paratuberculosis
accagcggcugcagcagaugcgc

SEQ ID NO: 801485 - RNA, 15 nt, Mycobacterium avium subsp. paratuberculosis
accagcgggccgaca

SEQ ID NO: 801486 - RNA, 17 nt, Mycobacterium avium subsp. paratuberculosis
accagcgggccgacagc

SEQ ID NO: 801487 - RNA, 21 nt, Mycobacterium avium subsp. paratuberculosis
accagcgggccgacagcacgc

SEQ ID NO: 801488 - RNA, 21 nt, Mycobacterium avium subsp. paratuberculosis
accagcgggguguucaccgcg

SEQ ID NO: 801489 - RNA, 22 nt, Mycobacterium avium subsp. paratuberculosis
accagcgggguguucaccgcgc

SEQ ID NO: 801490 - RNA, 19 nt, Mycobacterium avium subsp. paratuberculosis
accagcgggucgauggcga

SEQ ID NO: 801491 - RNA, 19 nt, Mycobacterium avium subsp. paratuberculosis
accagcgugaccucgacgg

SEQ ID NO: 801492 - RNA, 12 nt, Mycobacterium avium subsp. paratuberculosis
accagcgugacg

SEQ ID NO: 801493 - RNA, 12 nt, Mycobacterium avium subsp. paratuberculosis
accagcguguug

SEQ ID NO: 801494 - RNA, 18 nt, Mycobacterium avium subsp. paratuberculosis
accagcucgaggccgcgg

SEQ ID NO: 801495 - RNA, 21 nt, Mycobacterium avium subsp. paratuberculosis
accagcugcgaaucgucggcg

SEQ ID NO: 801496 - RNA, 16 nt, Mycobacterium avium subsp. paratuberculosis
accagcucggugauca

SEQ ID NO: 801497 - RNA, 20 nt, Mycobacterium avium subsp. paratuberculosis
accagcucggugaucaccau

SEQ ID NO: 801498 - RNA, 13 nt, Mycobacterium avium subsp. paratuberculosis
accagcucgucgc

SEQ ID NO: 801499 - RNA, 15 nt, Mycobacterium avium subsp. paratuberculosis
accagcucgugcagc

SEQ ID NO: 801500 - RNA, 18 nt, Mycobacterium avium subsp. paratuberculosis
accagcuggauggcgccc

SEQ ID NO: 801501 - RNA, 20 nt, Mycobacterium avium subsp. paratuberculosis
accagcuggauggcgcccag

SEQ ID NO: 801502 - RNA, 21 nt, Mycobacterium avium subsp. paratuberculosis
accagcuggauggcgcccagc

SEQ ID NO: 801503 - RNA, 17 nt, Mycobacterium avium subsp. paratuberculosis
accacaguggccgccag

SEQ ID NO: 801504 - RNA, 12 nt, Mycobacterium avium subsp. paratuberculosis
accacaucggag

SEQ ID NO: 801505 - RNA, 14 nt, Mycobacterium avium subsp. paratuberculosis
accacaugccguug

SEQ ID NO: 801506 - RNA, 16 nt, Mycobacterium avium subsp. paratuberculosis
accacauucccgccgc

SEQ ID NO: 801507 - RNA, 17 nt, Mycobacterium avium subsp. paratuberculosis
accacauucccgccgcc

SEQ ID NO: 801508 - RNA, 13 nt, Mycobacterium avium subsp. paratuberculosis
accaccaccgccc

SEQ ID NO: 801509 - RNA, 13 nt, Mycobacterium avium subsp. paratuberculosis
accaccaacgcca

SEQ ID NO: 801510 - RNA, 19 nt, Mycobacterium avium subsp. paratuberculosis
accaccaacggcucgccgc

SEQ ID NO: 801511 - RNA, 17 nt, Mycobacterium avium subsp. paratuberculosis
accaccacacccagcgc

SEQ ID NO: 801512 - RNA, 18 nt, Mycobacterium avium subsp. paratuberculosis
accaccacacccagcgcc

SEQ ID NO: 801513 - RNA, 17 nt, Mycobacterium avium subsp. paratuberculosis
accaccacacccgcggc

SEQ ID NO: 801514 - RNA, 12 nt, Mycobacterium avium subsp. paratuberculosis
accacccggucc

SEQ ID NO: 801515 - RNA, 22 nt, Mycobacterium avium subsp. paratuberculosis
accacccggugggacugggcgc

SEQ ID NO: 801516 - RNA, 17 nt, Mycobacterium avium subsp. paratuberculosis
accacccgcagcgcggc

SEQ ID NO: 801517 - RNA, 18 nt, Mycobacterium avium subsp. paratuberculosis
accacccgcagcucgccg

SEQ ID NO: 801518 - RNA, 14 nt, Mycobacterium avium subsp. paratuberculosis
accaccgacacccc

SEQ ID NO: 801519 - RNA, 13 nt, Mycobacterium avium subsp. paratuberculosis
accaccgcggcga

SEQ ID NO: 801520 - RNA, 14 nt, Mycobacterium avium subsp. paratuberculosis
accaccgcggcgau

SEQ ID NO: 801521 - RNA, 15 nt, Mycobacterium avium subsp. paratuberculosis
accaccgcggcgccg

SEQ ID NO: 801522 - RNA, 17 nt, Mycobacterium avium subsp. paratuberculosis
accaccgcggcgccguc

SEQ ID NO: 801523 - RNA, 22 nt, Mycobacterium avium subsp. paratuberculosis
accaccgcggugagcggccgca

SEQ ID NO: 801524 - RNA, 22 nt, Mycobacterium avium subsp. paratuberculosis
accaccgcguugaucagcgcca

SEQ ID NO: 801525 - RNA, 18 nt, Mycobacterium avium subsp. paratuberculosis
accaccggcaaccgccac

SEQ ID NO: 801526 - RNA, 16 nt, Mycobacterium avium subsp. paratuberculosis
accaccagucggcgcg

SEQ ID NO: 801527 - RNA, 22 nt, Mycobacterium avium subsp. paratuberculosis
accaccaugauguagcggcggu

SEQ ID NO: 801528 - RNA, 15 nt, Mycobacterium avium subsp. paratuberculosis
accaccaugucguug

SEQ ID NO: 801529 - RNA, 20 nt, Mycobacterium avium subsp. paratuberculosis
accacccacucccagccgcc

SEQ ID NO: 801530 - RNA, 19 nt, Mycobacterium avium subsp. paratuberculosis
accacccccagcccgccgg

SEQ ID NO: 801531 - RNA, 19 nt, Mycobacterium avium subsp. paratuberculosis
accacccccgacccgaagc

SEQ ID NO: 801532 - RNA, 13 nt, Mycobacterium avium subsp. paratuberculosis
accaccccggugc

SEQ ID NO: 801533 - RNA, 21 nt, Mycobacterium avium subsp. paratuberculosis
accacccgcaccucgcccggc

SEQ ID NO: 801534 - RNA, 14 nt, Mycobacterium avium subsp. paratuberculosis
accaccggugacga

SEQ ID NO: 801535 - RNA, 18 nt, Mycobacterium avium subsp. paratuberculosis
accaccgucaccgccgca

SEQ ID NO: 801536 - RNA, 23 nt, Mycobacterium avium subsp. paratuberculosis
accaccgucaccgccgcaccguc

SEQ ID NO: 801537 - RNA, 17 nt, Mycobacterium avium subsp. paratuberculosis
accaccggagcggcggu

SEQ ID NO: 801538 - RNA, 14 nt, Mycobacterium avium subsp. paratuberculosis
accaccggccgcgc

SEQ ID NO: 801539 - RNA, 16 nt, Mycobacterium avium subsp. paratuberculosis
accaccugcaccugcg

SEQ ID NO: 801540 - RNA, 23 nt, Mycobacterium avium subsp. paratuberculosis
accaccucgcgcggggcggccgc

SEQ ID NO: 801541 - RNA, 14 nt, Mycobacterium avium subsp. paratuberculosis
accaccucggcgac

SEQ ID NO: 801542 - RNA, 15 nt, Mycobacterium avium subsp. paratuberculosis
accaccucggcgacg

SEQ ID NO: 801543 - RNA, 22 nt, Mycobacterium avium subsp. paratuberculosis
accaccucggcgacgauggcca

SEQ ID NO: 801544 - RNA, 15 nt, Mycobacterium avium subsp. paratuberculosis
accaccugccgcaac

SEQ ID NO: 801545 - RNA, 23 nt, Mycobacterium avium subsp. paratuberculosis
accaccugccgcaacgggccgca

SEQ ID NO: 801546 - RNA, 16 nt, Mycobacterium avium subsp. paratuberculosis
accaccugguccugcc

SEQ ID NO: 801547 - RNA, 20 nt, Mycobacterium avium subsp. paratuberculosis
accaccuccccgcggugccg

SEQ ID NO: 801548 - RNA, 14 nt, Mycobacterium avium subsp. paratuberculosis
accaccuccucgcg

SEQ ID NO: 801549 - RNA, 14 nt, Mycobacterium avium subsp. paratuberculosis
accaccgugccguc

SEQ ID NO: 801550 - RNA, 17 nt, Mycobacterium avium subsp. paratuberculosis
accaccuucaucgccgu

SEQ ID NO: 801551 - RNA, 18 nt, Mycobacterium avium subsp. paratuberculosis
accaccuucaucgccguc

SEQ ID NO: 801552 - RNA, 19 nt, Mycobacterium avium subsp. paratuberculosis
accaccuucaucgccgucg

SEQ ID NO: 801553 - RNA, 22 nt, Mycobacterium avium subsp. paratuberculosis
accaccucgguggacgccgcgc

SEQ ID NO: 801554 - RNA, 18 nt, Mycobacterium avium subsp. paratuberculosis
accacggcaccgccgcgc

SEQ ID NO: 801555 - RNA, 22 nt, Mycobacterium avium subsp. paratuberculosis
accacggccaucacggugccga

SEQ ID NO: 801556 - RNA, 13 nt, Mycobacterium avium subsp. paratuberculosis
accacggccccag

SEQ ID NO: 801557 - RNA, 12 nt, Mycobacterium avium subsp. paratuberculosis
accacggcccgc

SEQ ID NO: 801558 - RNA, 14 nt, Mycobacterium avium subsp. paratuberculosis
accacggcccgcgc

SEQ ID NO: 801559 - RNA, 18 nt, Mycobacterium avium subsp. paratuberculosis
accacggcccgcgccccg

SEQ ID NO: 801560 - RNA, 22 nt, Mycobacterium avium subsp. paratuberculosis
accacggcccgcgccccggcgg

SEQ ID NO: 801561 - RNA, 14 nt, Mycobacterium avium subsp. paratuberculosis
accacggccgccga

SEQ ID NO: 801562 - RNA, 12 nt, Mycobacterium avium subsp. paratuberculosis
accacggggcgg

SEQ ID NO: 801563 - RNA, 15 nt, Mycobacterium avium subsp. paratuberculosis
accacgggucggucg

SEQ ID NO: 801564 - RNA, 23 nt, Mycobacterium avium subsp. paratuberculosis
accacgggucggucggcccgcug

SEQ ID NO: 801565 - RNA, 12 nt, Mycobacterium avium subsp. paratuberculosis
accacggcgcgg

SEQ ID NO: 801566 - RNA, 12 nt, Mycobacterium avium subsp. paratuberculosis
accacggcgccc

SEQ ID NO: 801567 - RNA, 14 nt, Mycobacterium avium subsp. paratuberculosis
accacggcgcccuc

SEQ ID NO: 801568 - RNA, 20 nt, Mycobacterium avium subsp. paratuberculosis
accacgucggguucgccggu

SEQ ID NO: 801569 - RNA, 15 nt, Mycobacterium avium subsp. paratuberculosis
accacgucggugccg

SEQ ID NO: 801570 - RNA, 17 nt, Mycobacterium avium subsp. paratuberculosis
accacgucgucggccug

SEQ ID NO: 801571 - RNA, 20 nt, Mycobacterium avium subsp. paratuberculosis
accacgucgucggccugcac

SEQ ID NO: 801572 - RNA, 19 nt, Mycobacterium avium subsp. paratuberculosis
accacgugccacuggcgcc

SEQ ID NO: 801573 - RNA, 23 nt, Mycobacterium avium subsp. paratuberculosis
accacgugccccuccucggucag

SEQ ID NO: 801574 - RNA, 15 nt, Mycobacterium avium subsp. paratuberculosis
accacgugcgcgaag

SEQ ID NO: 801575 - RNA, 18 nt, Mycobacterium avium subsp. paratuberculosis
acaaucgcugcgagcccg

SEQ ID NO: 801576 - RNA, 18 nt, Mycobacterium avium subsp. paratuberculosis
acaacgcggugaccgcgg

SEQ ID NO: 801577 - RNA, 22 nt, Mycobacterium avium subsp. paratuberculosis
acaacgcguagaaccagugcgc

SEQ ID NO: 801578 - RNA, 23 nt, Mycobacterium avium subsp. paratuberculosis
acaacgccuccgaauccagcgcg

SEQ ID NO: 801579 - RNA, 20 nt, Mycobacterium avium subsp. paratuberculosis
acaacucgaagcugcgccac

SEQ ID NO: 801580 - RNA, 16 nt, Mycobacterium avium subsp. paratuberculosis
acaacucgccggagcg

SEQ ID NO: 801581 - RNA, 19 nt, Mycobacterium avium subsp. paratuberculosis
acaacucgccggagcgccc

SEQ ID NO: 801582 - RNA, 21 nt, Mycobacterium avium subsp. paratuberculosis
acaacucgccggagcgcccca

SEQ ID NO: 801583 - RNA, 18 nt, Mycobacterium avium subsp. paratuberculosis
acaacggcggaccggcgg

SEQ ID NO: 801584 - RNA, 22 nt, Mycobacterium avium subsp. paratuberculosis
acaacggcggaccggcggccgc

SEQ ID NO: 801585 - RNA, 22 nt, Mycobacterium avium subsp. paratuberculosis
acaagggccgggcgcuggccgu

SEQ ID NO: 801586 - RNA, 16 nt, Mycobacterium avium subsp. paratuberculosis
acaacagcacgaacag

SEQ ID NO: 801587 - RNA, 14 nt, Mycobacterium avium subsp. paratuberculosis
acaaagccggucac

SEQ ID NO: 801588 - RNA, 13 nt, Mycobacterium avium subsp. paratuberculosis
acaacagcgccga

SEQ ID NO: 801589 - RNA, 18 nt, Mycobacterium avium subsp. paratuberculosis
acaacccggacagcgcga

SEQ ID NO: 801590 - RNA, 21 nt, Mycobacterium avium subsp. paratuberculosis
acacacaggucgcccggcucg

SEQ ID NO: 801591 - RNA, 21 nt, Mycobacterium avium subsp. paratuberculosis
acacaccagcggucggcgguu

SEQ ID NO: 801592 - RNA, 18 nt, Mycobacterium avium subsp. paratuberculosis
acacagccaaucgccgau

SEQ ID NO: 801593 - RNA, 12 nt, Mycobacterium avium subsp. paratuberculosis
acacagcaccgg

SEQ ID NO: 801594 - RNA, 19 nt, Mycobacterium avium subsp. paratuberculosis
acacagcaccggcgucgac

SEQ ID NO: 801595 - RNA, 21 nt, Mycobacterium avium subsp. paratuberculosis
acacagccgcuuggcgcgccg

SEQ ID NO: 801596 - RNA, 14 nt, Mycobacterium avium subsp. paratuberculosis
acacaggaccagca

SEQ ID NO: 801597 - RNA, 19 nt, Mycobacterium avium subsp. paratuberculosis
acacccgucgacucggcgg

SEQ ID NO: 801598 - RNA, 20 nt, Mycobacterium avium subsp. paratuberculosis
acacccgucgacucggcggu

SEQ ID NO: 801599 - RNA, 19 nt, Mycobacterium avium subsp. paratuberculosis
acacccucaccccgcccag

SEQ ID NO: 801600 - RNA, 14 nt, Mycobacterium avium subsp. paratuberculosis
acacccucgacccg

SEQ ID NO: 801601 - RNA, 12 nt, Mycobacterium avium subsp. paratuberculosis
acacccucggcc

SEQ ID NO: 801602 - RNA, 14 nt, Mycobacterium avium subsp. paratuberculosis
acacccucggcccg

SEQ ID NO: 801603 - RNA, 13 nt, Mycobacterium avium subsp. paratuberculosis
acacccucggggu

SEQ ID NO: 801604 - RNA, 23 nt, Mycobacterium avium subsp. paratuberculosis
acacccucgggguagccggcccg

SEQ ID NO: 801605 - RNA, 13 nt, Mycobacterium avium subsp. paratuberculosis
acaccgccgcggc

SEQ ID NO: 801606 - RNA, 17 nt, Mycobacterium avium subsp. paratuberculosis
acaccgccgcggcggug

SEQ ID NO: 801607 - RNA, 15 nt, Mycobacterium avium subsp. paratuberculosis
acaccgccggccacg

SEQ ID NO: 801608 - RNA, 21 nt, Mycobacterium avium subsp. paratuberculosis
acaccgccuucgacggccggc

SEQ ID NO: 801609 - RNA, 20 nt, Mycobacterium avium subsp. paratuberculosis
acaccgccuugcccggcucg

SEQ ID NO: 801610 - RNA, 21 nt, Mycobacterium avium subsp. paratuberculosis
acaccgccuugcccggcucgg

SEQ ID NO: 801611 - RNA, 20 nt, Mycobacterium avium subsp. paratuberculosis
acaccgcgaguucgcgcacg

SEQ ID NO: 801612 - RNA, 23 nt, Mycobacterium avium subsp. paratuberculosis
acaccgcgcugagcaggcuggca

SEQ ID NO: 801613 - RNA, 18 nt, Mycobacterium avium subsp. paratuberculosis
acaccgcggaccaccgcg

SEQ ID NO: 801614 - RNA, 18 nt, Mycobacterium avium subsp. paratuberculosis
acaccgcggccagcgcgc

SEQ ID NO: 801615 - RNA, 13 nt, Mycobacterium avium subsp. paratuberculosis
acaccgcggcggc

SEQ ID NO: 801616 - RNA, 14 nt, Mycobacterium avium subsp. paratuberculosis
acaccgcguuggcc

SEQ ID NO: 801617 - RNA, 19 nt, Mycobacterium avium subsp. paratuberculosis
acaccgcguuggccgccac

SEQ ID NO: 801618 - RNA, 17 nt, Mycobacterium avium subsp. paratuberculosis
acaccgggucccccgcc

SEQ ID NO: 801619 - RNA, 20 nt, Mycobacterium avium subsp. paratuberculosis
acaccgggucccccgccgac

SEQ ID NO: 801620 - RNA, 21 nt, Mycobacterium avium subsp. paratuberculosis
acaccgggucccccgccgacc

SEQ ID NO: 801621 - RNA, 22 nt, Mycobacterium avium subsp. paratuberculosis
acaccgggugcguccagaccgg

SEQ ID NO: 801622 - RNA, 17 nt, Mycobacterium avium subsp. paratuberculosis
acaccgacaccggccgg

SEQ ID NO: 801623 - RNA, 19 nt, Mycobacterium avium subsp. paratuberculosis
acaccgaucagcaugccgg

SEQ ID NO: 801624 - RNA, 21 nt, Mycobacterium avium subsp. paratuberculosis
acacccuuuuccaucugggcg

SEQ ID NO: 801625 - RNA, 22 nt, Mycobacterium avium subsp. paratuberculosis
acacccuuuuccaucugggcgc

SEQ ID NO: 801626 - RNA, 14 nt, Mycobacterium avium subsp. paratuberculosis
acaccgaaagccga

SEQ ID NO: 801627 - RNA, 18 nt, Mycobacterium avium subsp. paratuberculosis
acaccgaaagccgacacc

SEQ ID NO: 801628 - RNA, 14 nt, Mycobacterium avium subsp. paratuberculosis
acaccgaaagccgu

SEQ ID NO: 801629 - RNA, 21 nt, Mycobacterium avium subsp. paratuberculosis
acaccgaaagccguagcgcaa

SEQ ID NO: 801630 - RNA, 20 nt, Mycobacterium avium subsp. paratuberculosis
acaccgaacccaccagcgcc

SEQ ID NO: 801631 - RNA, 24 nt, Mycobacterium avium subsp. paratuberculosis
acaccgaaccgccccgcgcgauca

SEQ ID NO: 801632 - RNA, 14 nt, Mycobacterium avium subsp. paratuberculosis
acaccgccagcacc

SEQ ID NO: 801633 - RNA, 15 nt, Mycobacterium avium subsp. paratuberculosis
acaccgccagcagcg

SEQ ID NO: 801634 - RNA, 19 nt, Mycobacterium avium subsp. paratuberculosis
acaccgccagcagcgccgc

SEQ ID NO: 801635 - RNA, 12 nt, Mycobacterium avium subsp. paratuberculosis
acacgcgccggc

SEQ ID NO: 801636 - RNA, 13 nt, Mycobacterium avium subsp. paratuberculosis
acacgcgccggcg

SEQ ID NO: 801637 - RNA, 21 nt, Mycobacterium avium subsp. paratuberculosis
acacgcggacagggcggcgac

SEQ ID NO: 801638 - RNA, 23 nt, Mycobacterium avium subsp. paratuberculosis
acacgcgguccacuuccgcgcag

SEQ ID NO: 801639 - RNA, 20 nt, Mycobacterium avium subsp. paratuberculosis
acacgcucacgcucggccag

SEQ ID NO: 801640 - RNA, 14 nt, Mycobacterium avium subsp. paratuberculosis
acacgcucggcgcg

SEQ ID NO: 801641 - RNA, 17 nt, Mycobacterium avium subsp. paratuberculosis
acacggaaaccgcugcg

SEQ ID NO: 801642 - RNA, 19 nt, Mycobacterium avium subsp. paratuberculosis
acacggaaaccgcugcggc

SEQ ID NO: 801643 - RNA, 20 nt, Mycobacterium avium subsp. paratuberculosis
acacggccgccuccagcacg

SEQ ID NO: 801644 - RNA, 22 nt, Mycobacterium avium subsp. paratuberculosis
acacggccgggauuucccgggc

SEQ ID NO: 801645 - RNA, 20 nt, Mycobacterium avium subsp. paratuberculosis
acacggcaggcggcccgcuc

SEQ ID NO: 801646 - RNA, 14 nt, Mycobacterium avium subsp. paratuberculosis
acacggccagcgcc

SEQ ID NO: 801647 - RNA, 17 nt, Mycobacterium avium subsp. paratuberculosis
acacggccagcgccguc

SEQ ID NO: 801648 - RNA, 14 nt, Mycobacterium avium subsp. paratuberculosis
acacggcccgcggc

SEQ ID NO: 801649 - RNA, 17 nt, Mycobacterium avium subsp. paratuberculosis
acacgcaggugcgccgc

SEQ ID NO: 801650 - RNA, 18 nt, Mycobacterium avium subsp. paratuberculosis
acacgcaggugcgccgcu

SEQ ID NO: 801651 - RNA, 23 nt, Mycobacterium avium subsp. paratuberculosis
acacgcaggugcgccgcucgucg

SEQ ID NO: 801652 - RNA, 16 nt, Mycobacterium avium subsp. paratuberculosis
acacgcccagcgccgc

SEQ ID NO: 801653 - RNA, 20 nt, Mycobacterium avium subsp. paratuberculosis
acacgccgacgauccgcgcc

SEQ ID NO: 801654 - RNA, 14 nt, Mycobacterium avium subsp. paratuberculosis
acacgccccggcgg

SEQ ID NO: 801655 - RNA, 16 nt, Mycobacterium avium subsp. paratuberculosis
acacgccccggcgggu

SEQ ID NO: 801656 - RNA, 19 nt, Mycobacterium avium subsp. paratuberculosis
acacgaugcccuuggccag

SEQ ID NO: 801657 - RNA, 21 nt, Mycobacterium avium subsp. paratuberculosis
acacgccggccguucgccggc

SEQ ID NO: 801658 - RNA, 23 nt, Mycobacterium avium subsp. paratuberculosis
acacgccggccguucgccggcca

SEQ ID NO: 801659 - RNA, 12 nt, Mycobacterium avium subsp. paratuberculosis
acacgccuggac

SEQ ID NO: 801660 - RNA, 12 nt, Mycobacterium avium subsp. paratuberculosis
acaccgugccgu

SEQ ID NO: 801661 - RNA, 13 nt, Mycobacterium avium subsp. paratuberculosis
acaccgugccguc

SEQ ID NO: 801662 - RNA, 17 nt, Mycobacterium avium subsp. paratuberculosis
acaccgugguggcggcg

SEQ ID NO: 801663 - RNA, 20 nt, Mycobacterium avium subsp. paratuberculosis
acacgaugcgcugugcgggu

SEQ ID NO: 801664 - RNA, 18 nt, Mycobacterium avium subsp. paratuberculosis
acacgauggcggcccaga

SEQ ID NO: 801665 - RNA, 21 nt, Mycobacterium avium subsp. paratuberculosis
acacgauguugaugucgcgcg

SEQ ID NO: 801666 - RNA, 12 nt, Mycobacterium avium subsp. paratuberculosis
acacgaucggca

SEQ ID NO: 801667 - RNA, 20 nt, Mycobacterium avium subsp. paratuberculosis
acacgaucucguagguggcc

SEQ ID NO: 801668 - RNA, 13 nt, Mycobacterium avium subsp. paratuberculosis
acaccgucggcga

SEQ ID NO: 801669 - RNA, 14 nt, Mycobacterium avium subsp. paratuberculosis
acaccgucggcgau

SEQ ID NO: 801670 - RNA, 16 nt, Mycobacterium avium subsp. paratuberculosis
acaccguccagcucag

SEQ ID NO: 801671 - RNA, 23 nt, Mycobacterium avium subsp. paratuberculosis
acaccguccagcucagcgcgcac

SEQ ID NO: 801672 - RNA, 14 nt, Mycobacterium avium subsp. paratuberculosis
acaccgucgacgac

SEQ ID NO: 801673 - RNA, 18 nt, Mycobacterium avium subsp. paratuberculosis
acaccgucgcccgcccag

SEQ ID NO: 801674 - RNA, 18 nt, Mycobacterium avium subsp. paratuberculosis
acaccgguccggccgugc

SEQ ID NO: 801675 - RNA, 17 nt, Mycobacterium avium subsp. paratuberculosis
acaccgguugcgccgag

SEQ ID NO: 801676 - RNA, 16 nt, Mycobacterium avium subsp. paratuberculosis
acagcccgaccgucgu

SEQ ID NO: 801677 - RNA, 23 nt, Mycobacterium avium subsp. paratuberculosis
acagccagcccguggccagcgcc

SEQ ID NO: 801678 - RNA, 16 nt, Mycobacterium avium subsp. paratuberculosis
acagcccccgcagccc

SEQ ID NO: 801679 - RNA, 19 nt, Mycobacterium avium subsp. paratuberculosis
acagccccgagccgcggau

SEQ ID NO: 801680 - RNA, 21 nt, Mycobacterium avium subsp. paratuberculosis
acagcccccacgcucggcgca

SEQ ID NO: 801681 - RNA, 15 nt, Mycobacterium avium subsp. paratuberculosis
acagcgacgucugcg

SEQ ID NO: 801682 - RNA, 23 nt, Mycobacterium avium subsp. paratuberculosis
acagcgacgucugcggcucggcg

SEQ ID NO: 801683 - RNA, 15 nt, Mycobacterium avium subsp. paratuberculosis
acagcgacuccagcg

SEQ ID NO: 801684 - RNA, 17 nt, Mycobacterium avium subsp. paratuberculosis
acagcgacuccagcgcg

SEQ ID NO: 801685 - RNA, 13 nt, Mycobacterium avium subsp. paratuberculosis
acagcgccagcgg

SEQ ID NO: 801686 - RNA, 23 nt, Mycobacterium avium subsp. paratuberculosis
acagcgccgcggccagccggucg

SEQ ID NO: 801687 - RNA, 15 nt, Mycobacterium avium subsp. paratuberculosis
acagcgccucgcggu

SEQ ID NO: 801688 - RNA, 16 nt, Mycobacterium avium subsp. paratuberculosis
acagcgccucgcgguc

SEQ ID NO: 801689 - RNA, 14 nt, Mycobacterium avium subsp. paratuberculosis
acagcgccucgucg

SEQ ID NO: 801690 - RNA, 17 nt, Mycobacterium avium subsp. paratuberculosis
acagcgccucgucgagc

SEQ ID NO: 801691 - RNA, 21 nt, Mycobacterium avium subsp. paratuberculosis
acagcgcgacgcacgccggcg

SEQ ID NO: 801692 - RNA, 23 nt, Mycobacterium avium subsp. paratuberculosis
acagcgcgacgcacgccggcggg

SEQ ID NO: 801693 - RNA, 23 nt, Mycobacterium avium subsp. paratuberculosis
acagcgcgacgggcacccgcgcg

SEQ ID NO: 801694 - RNA, 15 nt, Mycobacterium avium subsp. paratuberculosis
acagcgccggaccga

SEQ ID NO: 801695 - RNA, 13 nt, Mycobacterium avium subsp. paratuberculosis
acagcgcccggcc

SEQ ID NO: 801696 - RNA, 17 nt, Mycobacterium avium subsp. paratuberculosis
acagcgcccggccguga

SEQ ID NO: 801697 - RNA, 11 nt, Mycobacterium avium subsp. paratuberculosis
acagcgccgac

SEQ ID NO: 801698 - RNA, 11 nt, Mycobacterium avium subsp. paratuberculosis
acagcgccgag

SEQ ID NO: 801699 - RNA, 15 nt, Mycobacterium avium subsp. paratuberculosis
acagcgccgagacgu

SEQ ID NO: 801700 - RNA, 17 nt, Mycobacterium avium subsp. paratuberculosis
acagcgacagggugccg

SEQ ID NO: 801701 - RNA, 12 nt, Mycobacterium avium subsp. paratuberculosis
acagcggcccga

SEQ ID NO: 801702 - RNA, 20 nt, Mycobacterium avium subsp. paratuberculosis
acagcggcccgaucaccgcc

SEQ ID NO: 801703 - RNA, 21 nt, Mycobacterium avium subsp. paratuberculosis
acagcggccuaugcgcccggg

SEQ ID NO: 801704 - RNA, 14 nt, Mycobacterium avium subsp. paratuberculosis
acagcgcggccgga

SEQ ID NO: 801705 - RNA, 21 nt, Mycobacterium avium subsp. paratuberculosis
acagcgcgguggucagcggcg

SEQ ID NO: 801706 - RNA, 15 nt, Mycobacterium avium subsp. paratuberculosis
acagcgcgucggcga

SEQ ID NO: 801707 - RNA, 13 nt, Mycobacterium avium subsp. paratuberculosis
acagcgcgccgaa

SEQ ID NO: 801708 - RNA, 13 nt, Mycobacterium avium subsp. paratuberculosis
acagcgcgccgcg

SEQ ID NO: 801709 - RNA, 16 nt, Mycobacterium avium subsp. paratuberculosis
acagcgcgccggccgg

SEQ ID NO: 801710 - RNA, 12 nt, Mycobacterium avium subsp. paratuberculosis
acagcgcgacgc

SEQ ID NO: 801711 - RNA, 13 nt, Mycobacterium avium subsp. paratuberculosis
acagcgcgcccga

SEQ ID NO: 801712 - RNA, 18 nt, Mycobacterium avium subsp. paratuberculosis
acagcgcgcccgacgguc

SEQ ID NO: 801713 - RNA, 20 nt, Mycobacterium avium subsp. paratuberculosis
acagcgcgcccgacggucgc

SEQ ID NO: 801714 - RNA, 17 nt, Mycobacterium avium subsp. paratuberculosis
acagcaccagcaccacc

SEQ ID NO: 801715 - RNA, 13 nt, Mycobacterium avium subsp. paratuberculosis
acagcaccaguug

SEQ ID NO: 801716 - RNA, 16 nt, Mycobacterium avium subsp. paratuberculosis
acacugcugcgcagac

SEQ ID NO: 801717 - RNA, 13 nt, Mycobacterium avium subsp. paratuberculosis
acacuggccaugc

SEQ ID NO: 801718 - RNA, 18 nt, Mycobacterium avium subsp. paratuberculosis
acacuggcgugacgcucg

SEQ ID NO: 801719 - RNA, 19 nt, Mycobacterium avium subsp. paratuberculosis
acacggcggcgcgcacguc

SEQ ID NO: 801720 - RNA, 14 nt, Mycobacterium avium subsp. paratuberculosis
acacugaaagccga

SEQ ID NO: 801721 - RNA, 13 nt, Mycobacterium avium subsp. paratuberculosis
acacucgagcgcg

SEQ ID NO: 801722 - RNA, 14 nt, Mycobacterium avium subsp. paratuberculosis
acacucgagcgcgc

SEQ ID NO: 801723 - RNA, 17 nt, Mycobacterium avium subsp. paratuberculosis
acacucgagcgcgcuca

SEQ ID NO: 801724 - RNA, 13 nt, Mycobacterium avium subsp. paratuberculosis
acacggcgcugag

SEQ ID NO: 801725 - RNA, 12 nt, Mycobacterium avium subsp. paratuberculosis
acacggcgccgu

SEQ ID NO: 801726 - RNA, 21 nt, Mycobacterium avium subsp. paratuberculosis
acacggcgccgugcgccucga

SEQ ID NO: 801727 - RNA, 19 nt, Mycobacterium avium subsp. paratuberculosis
acacggccucgcccagcgc

SEQ ID NO: 801728 - RNA, 20 nt, Mycobacterium avium subsp. paratuberculosis
acacggccucgcccagcgcc

SEQ ID NO: 801729 - RNA, 21 nt, Mycobacterium avium subsp. paratuberculosis
acacggccucgcccagcgccg

SEQ ID NO: 801730 - RNA, 22 nt, Mycobacterium avium subsp. paratuberculosis
acacggccucgcccagcgccgc

SEQ ID NO: 801731 - RNA, 18 nt, Mycobacterium avium subsp. paratuberculosis
acagcacccccucggcgc

SEQ ID NO: 801732 - RNA, 17 nt, Mycobacterium avium subsp. paratuberculosis
acagcacccgcugcagc

SEQ ID NO: 801733 - RNA, 22 nt, Mycobacterium avium subsp. paratuberculosis
acagcacccgcugcagccgguc

SEQ ID NO: 801734 - RNA, 13 nt, Mycobacterium avium subsp. paratuberculosis
acagcaccgccac

SEQ ID NO: 801735 - RNA, 14 nt, Mycobacterium avium subsp. paratuberculosis
acagcaccgccgcg

SEQ ID NO: 801736 - RNA, 17 nt, Mycobacterium avium subsp. paratuberculosis
acagcaccgccgcgggc

SEQ ID NO: 801737 - RNA, 20 nt, Mycobacterium avium subsp. paratuberculosis
acagcaccggcgucgacagc

SEQ ID NO: 801738 - RNA, 17 nt, Mycobacterium avium subsp. paratuberculosis
acagcacgugcccgccg

SEQ ID NO: 801739 - RNA, 22 nt, Mycobacterium avium subsp. paratuberculosis
acagcacgugcccgccgugcgc

SEQ ID NO: 801740 - RNA, 20 nt, Mycobacterium avium subsp. paratuberculosis
acagcacguuguucaggucg

SEQ ID NO: 801741 - RNA, 15 nt, Mycobacterium avium subsp. paratuberculosis
acagcacgccggccg

SEQ ID NO: 801742 - RNA, 14 nt, Mycobacterium avium subsp. paratuberculosis
acagcacgccgggc

SEQ ID NO: 801743 - RNA, 15 nt, Mycobacterium avium subsp. paratuberculosis
acagcaccucgucgc

SEQ ID NO: 801744 - RNA, 23 nt, Mycobacterium avium subsp. paratuberculosis
acagcaccucgucgcccggcguc

SEQ ID NO: 801745 - RNA, 22 nt, Mycobacterium avium subsp. paratuberculosis
acagcacgaacagcagcgggac

SEQ ID NO: 801746 - RNA, 23 nt, Mycobacterium avium subsp. paratuberculosis
acagcacgaacagcagcgggacg

SEQ ID NO: 801747 - RNA, 21 nt, Mycobacterium avium subsp. paratuberculosis
acagccaggugugcggcacga

SEQ ID NO: 801748 - RNA, 16 nt, Mycobacterium avium subsp. paratuberculosis
acagccagcgcccggc

SEQ ID NO: 801749 - RNA, 13 nt, Mycobacterium avium subsp. paratuberculosis
acagccaggcgaa

SEQ ID NO: 801750 - RNA, 15 nt, Mycobacterium avium subsp. paratuberculosis
acagccaaucgccga

SEQ ID NO: 801751 - RNA, 17 nt, Mycobacterium avium subsp. paratuberculosis
acagccacagcucgggc

SEQ ID NO: 801752 - RNA, 20 nt, Mycobacterium avium subsp. paratuberculosis
acagccacagcucgggcagc

SEQ ID NO: 801753 - RNA, 13 nt, Mycobacterium avium subsp. paratuberculosis
acagcagcacgcc

SEQ ID NO: 801754 - RNA, 23 nt, Mycobacterium avium subsp. paratuberculosis
acagcagcacguugucgcccggg

SEQ ID NO: 801755 - RNA, 17 nt, Mycobacterium avium subsp. paratuberculosis
acagcagcaccagcgcg

SEQ ID NO: 801756 - RNA, 22 nt, Mycobacterium avium subsp. paratuberculosis
accccuacgggcgcaccgcgcg

SEQ ID NO: 801757 - RNA, 23 nt, Mycobacterium avium subsp. paratuberculosis
accccuacgggcgcaccgcgcgc

SEQ ID NO: 801758 - RNA, 17 nt, Mycobacterium avium subsp. paratuberculosis
accccucagccggaacc

SEQ ID NO: 801759 - RNA, 16 nt, Mycobacterium avium subsp. paratuberculosis
accccuccaacggccg

SEQ ID NO: 801760 - RNA, 15 nt, Mycobacterium avium subsp. paratuberculosis
accccguucgccgac

SEQ ID NO: 801761 - RNA, 17 nt, Mycobacterium avium subsp. paratuberculosis
accccguugagcagcgg

SEQ ID NO: 801762 - RNA, 17 nt, Mycobacterium avium subsp. paratuberculosis
accccguugccgccggc

SEQ ID NO: 801763 - RNA, 18 nt, Mycobacterium avium subsp. paratuberculosis
accccguugccgccggcg

SEQ ID NO: 801764 - RNA, 20 nt, Mycobacterium avium subsp. paratuberculosis
accccguugccgccggcgcc

SEQ ID NO: 801765 - RNA, 21 nt, Mycobacterium avium subsp. paratuberculosis
accccugcacuaccccgucga

SEQ ID NO: 801766 - RNA, 15 nt, Mycobacterium avium subsp. paratuberculosis
accccugccgccacc

SEQ ID NO: 801767 - RNA, 23 nt, Mycobacterium avium subsp. paratuberculosis
acccgaaaagguauucgcgcaac

SEQ ID NO: 801768 - RNA, 13 nt, Mycobacterium avium subsp. paratuberculosis
acccgccagcccg

SEQ ID NO: 801769 - RNA, 17 nt, Mycobacterium avium subsp. paratuberculosis
acccgccagcccgcguc

SEQ ID NO: 801770 - RNA, 20 nt, Mycobacterium avium subsp. paratuberculosis
acccgccagcccgcgucgug

SEQ ID NO: 801771 - RNA, 18 nt, Mycobacterium avium subsp. paratuberculosis
acccgcauccgccgggcg

SEQ ID NO: 801772 - RNA, 23 nt, Mycobacterium avium subsp. paratuberculosis
acccgcauccgccgggcggcguc

SEQ ID NO: 801773 - RNA, 17 nt, Mycobacterium avium subsp. paratuberculosis
acccgaauuccgcuggg

SEQ ID NO: 801774 - RNA, 18 nt, Mycobacterium avium subsp. paratuberculosis
acccgaaguaggcggggu

SEQ ID NO: 801775 - RNA, 18 nt, Mycobacterium avium subsp. paratuberculosis
accccuuggcguccaugu

SEQ ID NO: 801776 - RNA, 14 nt, Mycobacterium avium subsp. paratuberculosis
acccgaacccagcg

SEQ ID NO: 801777 - RNA, 18 nt, Mycobacterium avium subsp. paratuberculosis
acccgaacggaccgggcg

SEQ ID NO: 801778 - RNA, 14 nt, Mycobacterium avium subsp. paratuberculosis
acccgcccggacgc

SEQ ID NO: 801779 - RNA, 21 nt, Mycobacterium avium subsp. paratuberculosis
acccgcccgggugugggcgcc

SEQ ID NO: 801780 - RNA, 22 nt, Mycobacterium avium subsp. paratuberculosis
acccgcccgggugugggcgccg

SEQ ID NO: 801781 - RNA, 14 nt, Mycobacterium avium subsp. paratuberculosis
acccgccccgccgc

SEQ ID NO: 801782 - RNA, 19 nt, Mycobacterium avium subsp. paratuberculosis
acccgccccgccgcggcca

SEQ ID NO: 801783 - RNA, 22 nt, Mycobacterium avium subsp. paratuberculosis
acccgccccgccgcggccaggu

SEQ ID NO: 801784 - RNA, 13 nt, Mycobacterium avium subsp. paratuberculosis
acccgcccgccgg

SEQ ID NO: 801785 - RNA, 15 nt, Mycobacterium avium subsp. paratuberculosis
acccgcccgccgggc

SEQ ID NO: 801786 - RNA, 18 nt, Mycobacterium avium subsp. paratuberculosis
acccgcccgccgggcacc

SEQ ID NO: 801787 - RNA, 19 nt, Mycobacterium avium subsp. paratuberculosis
acccgcccgccgggcaccc

SEQ ID NO: 801788 - RNA, 16 nt, Mycobacterium avium subsp. paratuberculosis
acccgccauggcggca

SEQ ID NO: 801789 - RNA, 18 nt, Mycobacterium avium subsp. paratuberculosis
acccgccauggcggcauc

SEQ ID NO: 801790 - RNA, 14 nt, Mycobacterium avium subsp. paratuberculosis
acccgcccagcacc

SEQ ID NO: 801791 - RNA, 16 nt, Mycobacterium avium subsp. paratuberculosis
acccgcccaugcacga

SEQ ID NO: 801792 - RNA, 17 nt, Mycobacterium avium subsp. paratuberculosis
acccgcccaugcacgau

SEQ ID NO: 801793 - RNA, 23 nt, Mycobacterium avium subsp. paratuberculosis
acccgccggcgaacgacgucgag

SEQ ID NO: 801794 - RNA, 20 nt, Mycobacterium avium subsp. paratuberculosis
acccgccggguggccgccac

SEQ ID NO: 801795 - RNA, 23 nt, Mycobacterium avium subsp. paratuberculosis
acccgccgcggcaacgccagcca

SEQ ID NO: 801796 - RNA, 18 nt, Mycobacterium avium subsp. paratuberculosis
acccgccgcggccgaacc

SEQ ID NO: 801797 - RNA, 15 nt, Mycobacterium avium subsp. paratuberculosis
acccgccgagcguga

SEQ ID NO: 801798 - RNA, 23 nt, Mycobacterium avium subsp. paratuberculosis
acccgccgcaccucgccggccgc

SEQ ID NO: 801799 - RNA, 14 nt, Mycobacterium avium subsp. paratuberculosis
acccggacagcgcg

SEQ ID NO: 801800 - RNA, 15 nt, Mycobacterium avium subsp. paratuberculosis
acccggacagcgcga

SEQ ID NO: 801801 - RNA, 16 nt, Mycobacterium avium subsp. paratuberculosis
acccggacagcgcgac

SEQ ID NO: 801802 - RNA, 19 nt, Mycobacterium avium subsp. paratuberculosis
acccggacagcgcgacgca

SEQ ID NO: 801803 - RNA, 20 nt, Mycobacterium avium subsp. paratuberculosis
acccgcuccccgauccggcu

SEQ ID NO: 801804 - RNA, 16 nt, Mycobacterium avium subsp. paratuberculosis
acccgcuuuugccguc

SEQ ID NO: 801805 - RNA, 17 nt, Mycobacterium avium subsp. paratuberculosis
acccggaggcggcgggg

SEQ ID NO: 801806 - RNA, 23 nt, Mycobacterium avium subsp. paratuberculosis
acccggaggcggcgggggcgggc

SEQ ID NO: 801807 - RNA, 22 nt, Mycobacterium avium subsp. paratuberculosis
acccggaccgggugaccggcgc

SEQ ID NO: 801808 - RNA, 18 nt, Mycobacterium avium subsp. paratuberculosis
acccggacgugaucgcgg

SEQ ID NO: 801809 - RNA, 20 nt, Mycobacterium avium subsp. paratuberculosis
acccggacgugaucgcggug

SEQ ID NO: 801810 - RNA, 13 nt, Mycobacterium avium subsp. paratuberculosis
acccggccaccgc

SEQ ID NO: 801811 - RNA, 18 nt, Mycobacterium avium subsp. paratuberculosis
acccggccaccgccgcca

SEQ ID NO: 801812 - RNA, 12 nt, Mycobacterium avium subsp. paratuberculosis
acccggccagcg

SEQ ID NO: 801813 - RNA, 15 nt, Mycobacterium avium subsp. paratuberculosis
acccggccagcggca

SEQ ID NO: 801814 - RNA, 17 nt, Mycobacterium avium subsp. paratuberculosis
acccggccagcggcagc

SEQ ID NO: 801815 - RNA, 22 nt, Mycobacterium avium subsp. paratuberculosis
acccggccagcggcagcggcgu

SEQ ID NO: 801816 - RNA, 21 nt, Mycobacterium avium subsp. paratuberculosis
acccggcccaccaccgccucg

SEQ ID NO: 801817 - RNA, 14 nt, Mycobacterium avium subsp. paratuberculosis
acccggcccaccgg

SEQ ID NO: 801818 - RNA, 18 nt, Mycobacterium avium subsp. paratuberculosis
acccggcccacgccgucg

SEQ ID NO: 801819 - RNA, 18 nt, Mycobacterium avium subsp. paratuberculosis
acccggaugucgugcggu

SEQ ID NO: 801820 - RNA, 19 nt, Mycobacterium avium subsp. paratuberculosis
acccggaugucgugcgguc

SEQ ID NO: 801821 - RNA, 18 nt, Mycobacterium avium subsp. paratuberculosis
acccggauggucugcagc

SEQ ID NO: 801822 - RNA, 21 nt, Mycobacterium avium subsp. paratuberculosis
acccggauggucugcagcgac

SEQ ID NO: 801823 - RNA, 22 nt, Mycobacterium avium subsp. paratuberculosis
acccggauggucugcagcgacg

SEQ ID NO: 801824 - RNA, 16 nt, Mycobacterium avium subsp. paratuberculosis
acccggaucggccaug

SEQ ID NO: 801825 - RNA, 23 nt, Mycobacterium avium subsp. paratuberculosis
acccggaucggccauggugccgc

SEQ ID NO: 801826 - RNA, 20 nt, Mycobacterium avium subsp. paratuberculosis
acccgcgucaucgggcccga

SEQ ID NO: 801827 - RNA, 16 nt, Mycobacterium avium subsp. paratuberculosis
acccgcuucgcccggc

SEQ ID NO: 801828 - RNA, 17 nt, Mycobacterium avium subsp. paratuberculosis
acccgcuucgcccggcu

SEQ ID NO: 801829 - RNA, 21 nt, Mycobacterium avium subsp. paratuberculosis
acccgcucaggucggccgcgg

SEQ ID NO: 801830 - RNA, 23 nt, Mycobacterium avium subsp. paratuberculosis
acccgcucaggucggccgcggcc

SEQ ID NO: 801831 - RNA, 15 nt, Mycobacterium avium subsp. paratuberculosis
acccgcuccagcggc

SEQ ID NO: 801832 - RNA, 14 nt, Mycobacterium avium subsp. paratuberculosis
acccgcggccgcug

SEQ ID NO: 801833 - RNA, 13 nt, Mycobacterium avium subsp. paratuberculosis
acccgcggccggc

SEQ ID NO: 801834 - RNA, 12 nt, Mycobacterium avium subsp. paratuberculosis
acccgcggccuc

SEQ ID NO: 801835 - RNA, 13 nt, Mycobacterium avium subsp. paratuberculosis
acccgcggccucc

SEQ ID NO: 801836 - RNA, 14 nt, Mycobacterium avium subsp. paratuberculosis
acccgcggccuccg

SEQ ID NO: 801837 - RNA, 13 nt, Mycobacterium avium subsp. paratuberculosis
acccgcggcgccg

SEQ ID NO: 801838 - RNA, 20 nt, Mycobacterium avium subsp. paratuberculosis
acccgccuggccaccucgac

SEQ ID NO: 801839 - RNA, 17 nt, Mycobacterium avium subsp. paratuberculosis
acccgcggcgccgcggc

SEQ ID NO: 801840 - RNA, 12 nt, Mycobacterium avium subsp. paratuberculosis
acccgcggcgcg

SEQ ID NO: 801841 - RNA, 15 nt, Mycobacterium avium subsp. paratuberculosis
acccgcggcgcgaug

SEQ ID NO: 801842 - RNA, 23 nt, Mycobacterium avium subsp. paratuberculosis
acccgcgggucgucgggcggcag

SEQ ID NO: 801843 - RNA, 17 nt, Mycobacterium avium subsp. paratuberculosis
acccggcucuccaucuu

SEQ ID NO: 801844 - RNA, 19 nt, Mycobacterium avium subsp. paratuberculosis
acccggcucuccaucuucg

SEQ ID NO: 801845 - RNA, 15 nt, Mycobacterium avium subsp. paratuberculosis
acccguccagcagca

SEQ ID NO: 801846 - RNA, 23 nt, Mycobacterium avium subsp. paratuberculosis
acccguccagcgugugcguggug

SEQ ID NO: 801847 - RNA, 17 nt, Mycobacterium avium subsp. paratuberculosis
acccgucgacucggcgg

SEQ ID NO: 801848 - RNA, 19 nt, Mycobacterium avium subsp. paratuberculosis
acccgucgacucggcggug

SEQ ID NO: 801849 - RNA, 21 nt, Mycobacterium avium subsp. paratuberculosis
acccgucgacucggcggugcc

SEQ ID NO: 801850 - RNA, 17 nt, Mycobacterium avium subsp. paratuberculosis
acccgucgcgggucagc

SEQ ID NO: 801851 - RNA, 19 nt, Mycobacterium avium subsp. paratuberculosis
acccgucggggugcgccag

SEQ ID NO: 801852 - RNA, 23 nt, Mycobacterium avium subsp. paratuberculosis
acccgucggugaaguuggcggcg

SEQ ID NO: 801853 - RNA, 16 nt, Mycobacterium avium subsp. paratuberculosis
acccguggauggacgc

SEQ ID NO: 801854 - RNA, 22 nt, Mycobacterium avium subsp. paratuberculosis
acccgugggccgaccggccggu

SEQ ID NO: 801855 - RNA, 15 nt, Mycobacterium avium subsp. paratuberculosis
acccguuccccggcc

SEQ ID NO: 801856 - RNA, 20 nt, Mycobacterium avium subsp. paratuberculosis
acccucgggguagccggccc

SEQ ID NO: 801857 - RNA, 14 nt, Mycobacterium avium subsp. paratuberculosis
acccucggucgggc

SEQ ID NO: 801858 - RNA, 17 nt, Mycobacterium avium subsp. paratuberculosis
acccucggucgggcgau

SEQ ID NO: 801859 - RNA, 18 nt, Mycobacterium avium subsp. paratuberculosis
acccggccguugggccag

SEQ ID NO: 801860 - RNA, 20 nt, Mycobacterium avium subsp. paratuberculosis
acccggccguugggccagcg

SEQ ID NO: 801861 - RNA, 15 nt, Mycobacterium avium subsp. paratuberculosis
acccggccggucgcc

SEQ ID NO: 801862 - RNA, 15 nt, Mycobacterium avium subsp. paratuberculosis
acccggccguggacc

SEQ ID NO: 801863 - RNA, 12 nt, Mycobacterium avium subsp. paratuberculosis
acccggccgcga

SEQ ID NO: 801864 - RNA, 12 nt, Mycobacterium avium subsp. paratuberculosis
acccggccgcgc

SEQ ID NO: 801865 - RNA, 13 nt, Mycobacterium avium subsp. paratuberculosis
acccggccgcgcc

SEQ ID NO: 801866 - RNA, 13 nt, Mycobacterium avium subsp. paratuberculosis
acccggcccauca

SEQ ID NO: 801867 - RNA, 23 nt, Mycobacterium avium subsp. paratuberculosis
acccggcccaucaccggaccggc

SEQ ID NO: 801868 - RNA, 20 nt, Mycobacterium avium subsp. paratuberculosis
acccggcccccgagcuucgg

SEQ ID NO: 801869 - RNA, 22 nt, Mycobacterium avium subsp. paratuberculosis
acccggcccuauggcaucgcca

SEQ ID NO: 801870 - RNA, 19 nt, Mycobacterium avium subsp. paratuberculosis
acccggccgauggugugga

SEQ ID NO: 801871 - RNA, 12 nt, Mycobacterium avium subsp. paratuberculosis
acccggccgcac

SEQ ID NO: 801872 - RNA, 11 nt, Mycobacterium avium subsp. paratuberculosis
acccggccggc

SEQ ID NO: 801873 - RNA, 14 nt, Mycobacterium avium subsp. paratuberculosis
acccggcgcccggc

SEQ ID NO: 801874 - RNA, 16 nt, Mycobacterium avium subsp. paratuberculosis
acccggcgcccggccg

SEQ ID NO: 801875 - RNA, 17 nt, Mycobacterium avium subsp. paratuberculosis
acccggcgcccggccgg

SEQ ID NO: 801876 - RNA, 21 nt, Mycobacterium avium subsp. paratuberculosis
acccggcgcccggccggugcu

SEQ ID NO: 801877 - RNA, 15 nt, Mycobacterium avium subsp. paratuberculosis
acccggcgcggccgc

SEQ ID NO: 801878 - RNA, 16 nt, Mycobacterium avium subsp. paratuberculosis
acccggcgcggccgcc

SEQ ID NO: 801879 - RNA, 17 nt, Mycobacterium avium subsp. paratuberculosis
acccggcgcggccgccc

SEQ ID NO: 801880 - RNA, 19 nt, Mycobacterium avium subsp. paratuberculosis
acccggcgcggccgcccag

SEQ ID NO: 801881 - RNA, 14 nt, Mycobacterium avium subsp. paratuberculosis
acccggcggcaccg

SEQ ID NO: 801882 - RNA, 16 nt, Mycobacterium avium subsp. paratuberculosis
acccggcggcaccgcg

SEQ ID NO: 801883 - RNA, 14 nt, Mycobacterium avium subsp. paratuberculosis
acccggcgggccag

SEQ ID NO: 801884 - RNA, 17 nt, Mycobacterium avium subsp. paratuberculosis
accgacaccggccggga

SEQ ID NO: 801885 - RNA, 16 nt, Mycobacterium avium subsp. paratuberculosis
accgacaccucgccgu

SEQ ID NO: 801886 - RNA, 17 nt, Mycobacterium avium subsp. paratuberculosis
accgacaccucgccguc

SEQ ID NO: 801887 - RNA, 18 nt, Mycobacterium avium subsp. paratuberculosis
accgacaccucgccgucc

SEQ ID NO: 801888 - RNA, 19 nt, Mycobacterium avium subsp. paratuberculosis
accgacaccucgccguccu

SEQ ID NO: 801889 - RNA, 14 nt, Mycobacterium avium subsp. paratuberculosis
accgacauggccag

SEQ ID NO: 801890 - RNA, 16 nt, Mycobacterium avium subsp. paratuberculosis
accgacauggccagca

SEQ ID NO: 801891 - RNA, 16 nt, Mycobacterium avium subsp. paratuberculosis
accgacagccgcacca

SEQ ID NO: 801892 - RNA, 15 nt, Mycobacterium avium subsp. paratuberculosis
accgacaccaccggc

SEQ ID NO: 801893 - RNA, 23 nt, Mycobacterium avium subsp. paratuberculosis
accgacagcaaaccgaccgccgc

SEQ ID NO: 801894 - RNA, 18 nt, Mycobacterium avium subsp. paratuberculosis
accgacagcacccggccc

SEQ ID NO: 801895 - RNA, 14 nt, Mycobacterium avium subsp. paratuberculosis
accgacagggccag

SEQ ID NO: 801896 - RNA, 15 nt, Mycobacterium avium subsp. paratuberculosis
accgacagggccagc

SEQ ID NO: 801897 - RNA, 21 nt, Mycobacterium avium subsp. paratuberculosis
accgacagggccagcgccaug

SEQ ID NO: 801898 - RNA, 21 nt, Mycobacterium avium subsp. paratuberculosis
accgacaguucggcgcgcauc

SEQ ID NO: 801899 - RNA, 23 nt, Mycobacterium avium subsp. paratuberculosis
accgacaucaccaaccgcucggc

SEQ ID NO: 801900 - RNA, 16 nt, Mycobacterium avium subsp. paratuberculosis
accgacaucagaucgc

SEQ ID NO: 801901 - RNA, 19 nt, Mycobacterium avium subsp. paratuberculosis
accgacaucagaucgccga

SEQ ID NO: 801902 - RNA, 20 nt, Mycobacterium avium subsp. paratuberculosis
accgacaucagaucgccgac

SEQ ID NO: 801903 - RNA, 15 nt, Mycobacterium avium subsp. paratuberculosis
acccucggcgucccg

SEQ ID NO: 801904 - RNA, 17 nt, Mycobacterium avium subsp. paratuberculosis
acccucugccacggcgg

SEQ ID NO: 801905 - RNA, 16 nt, Mycobacterium avium subsp. paratuberculosis
acccugcguccggccc

SEQ ID NO: 801906 - RNA, 19 nt, Mycobacterium avium subsp. paratuberculosis
acccugcguccggcccggc

SEQ ID NO: 801907 - RNA, 20 nt, Mycobacterium avium subsp. paratuberculosis
acccugccgucaccggccau

SEQ ID NO: 801908 - RNA, 13 nt, Mycobacterium avium subsp. paratuberculosis
acccugccgaccu

SEQ ID NO: 801909 - RNA, 20 nt, Mycobacterium avium subsp. paratuberculosis
acccugccgaccugcgcgac

SEQ ID NO: 801910 - RNA, 17 nt, Mycobacterium avium subsp. paratuberculosis
acccuuuugccgaucgu

SEQ ID NO: 801911 - RNA, 15 nt, Mycobacterium avium subsp. paratuberculosis
accgaaacggcaggu

SEQ ID NO: 801912 - RNA, 15 nt, Mycobacterium avium subsp. paratuberculosis
acccuugucggugac

SEQ ID NO: 801913 - RNA, 15 nt, Mycobacterium avium subsp. paratuberculosis
accccacccgcgcga

SEQ ID NO: 801914 - RNA, 17 nt, Mycobacterium avium subsp. paratuberculosis
accccacccgcgcgaca

SEQ ID NO: 801915 - RNA, 19 nt, Mycobacterium avium subsp. paratuberculosis
accccagcaaaaccccgcc

SEQ ID NO: 801916 - RNA, 14 nt, Mycobacterium avium subsp. paratuberculosis
accccagccggccg

SEQ ID NO: 801917 - RNA, 17 nt, Mycobacterium avium subsp. paratuberculosis
accccagccggccgagc

SEQ ID NO: 801918 - RNA, 18 nt, Mycobacterium avium subsp. paratuberculosis
accccaccggaagcgcgc

SEQ ID NO: 801919 - RNA, 13 nt, Mycobacterium avium subsp. paratuberculosis
accccacggccgc

SEQ ID NO: 801920 - RNA, 21 nt, Mycobacterium avium subsp. paratuberculosis
accccagcgugacgucgacgu

SEQ ID NO: 801921 - RNA, 20 nt, Mycobacterium avium subsp. paratuberculosis
accccaggcgaugccgccga

SEQ ID NO: 801922 - RNA, 21 nt, Mycobacterium avium subsp. paratuberculosis
accccaggcgaugccgccgac

SEQ ID NO: 801923 - RNA, 14 nt, Mycobacterium avium subsp. paratuberculosis
accccagugcaggc

SEQ ID NO: 801924 - RNA, 22 nt, Mycobacterium avium subsp. paratuberculosis
accccagugcaggcugacgcga

SEQ ID NO: 801925 - RNA, 23 nt, Mycobacterium avium subsp. paratuberculosis
accccgaaggcguuggagccgac

SEQ ID NO: 801926 - RNA, 15 nt, Mycobacterium avium subsp. paratuberculosis
accccgagcucgggc

SEQ ID NO: 801927 - RNA, 19 nt, Mycobacterium avium subsp. paratuberculosis
acccccgcacgccagcauc

SEQ ID NO: 801928 - RNA, 21 nt, Mycobacterium avium subsp. paratuberculosis
acccccgcacgccagcaucga

SEQ ID NO: 801929 - RNA, 13 nt, Mycobacterium avium subsp. paratuberculosis
acccccggcgcga

SEQ ID NO: 801930 - RNA, 19 nt, Mycobacterium avium subsp. paratuberculosis
acccccuucuccacgcucg

SEQ ID NO: 801931 - RNA, 20 nt, Mycobacterium avium subsp. paratuberculosis
accccgaaccaguucgccac

SEQ ID NO: 801932 - RNA, 16 nt, Mycobacterium avium subsp. paratuberculosis
accccgaacccggcca

SEQ ID NO: 801933 - RNA, 17 nt, Mycobacterium avium subsp. paratuberculosis
accccgaaccgcccgcc

SEQ ID NO: 801934 - RNA, 18 nt, Mycobacterium avium subsp. paratuberculosis
accccgaaccgcccgccc

SEQ ID NO: 801935 - RNA, 18 nt, Mycobacterium avium subsp. paratuberculosis
acccccaauugccgggcc

SEQ ID NO: 801936 - RNA, 13 nt, Mycobacterium avium subsp. paratuberculosis
acccccaccgcga

SEQ ID NO: 801937 - RNA, 12 nt, Mycobacterium avium subsp. paratuberculosis
acccccagcucg

SEQ ID NO: 801938 - RNA, 17 nt, Mycobacterium avium subsp. paratuberculosis
acccccagcucgacgac

SEQ ID NO: 801939 - RNA, 22 nt, Mycobacterium avium subsp. paratuberculosis
acccccagcccgccgggcugac

SEQ ID NO: 801940 - RNA, 16 nt, Mycobacterium avium subsp. paratuberculosis
accccccacgcucggc

SEQ ID NO: 801941 - RNA, 14 nt, Mycobacterium avium subsp. paratuberculosis
accccgccagcacc

SEQ ID NO: 801942 - RNA, 16 nt, Mycobacterium avium subsp. paratuberculosis
accccgccagcaccga

SEQ ID NO: 801943 - RNA, 17 nt, Mycobacterium avium subsp. paratuberculosis
accccgccagcaccgac

SEQ ID NO: 801944 - RNA, 21 nt, Mycobacterium avium subsp. paratuberculosis
accccgcagaacaccagcgca

SEQ ID NO: 801945 - RNA, 17 nt, Mycobacterium avium subsp. paratuberculosis
accccgccaaucaccgc

SEQ ID NO: 801946 - RNA, 19 nt, Mycobacterium avium subsp. paratuberculosis
accccgccaaucaccgcgg

SEQ ID NO: 801947 - RNA, 21 nt, Mycobacterium avium subsp. paratuberculosis
accccgccaaucaccgcggug

SEQ ID NO: 801948 - RNA, 20 nt, Mycobacterium avium subsp. paratuberculosis
accccgaucaacaccgccag

SEQ ID NO: 801949 - RNA, 17 nt, Mycobacterium avium subsp. paratuberculosis
accccgaguucggccag

SEQ ID NO: 801950 - RNA, 23 nt, Mycobacterium avium subsp. paratuberculosis
accccgaguucggccagaucggc

SEQ ID NO: 801951 - RNA, 14 nt, Mycobacterium avium subsp. paratuberculosis
accccgaugccgaa

SEQ ID NO: 801952 - RNA, 16 nt, Mycobacterium avium subsp. paratuberculosis
accccgaugccgaacu

SEQ ID NO: 801953 - RNA, 20 nt, Mycobacterium avium subsp. paratuberculosis
accccgaugcgcucgccgau

SEQ ID NO: 801954 - RNA, 14 nt, Mycobacterium avium subsp. paratuberculosis
accccgaugcggug

SEQ ID NO: 801955 - RNA, 20 nt, Mycobacterium avium subsp. paratuberculosis
accccgaugcggugccgggc

SEQ ID NO: 801956 - RNA, 21 nt, Mycobacterium avium subsp. paratuberculosis
accccgaugcggugccgggcc

SEQ ID NO: 801957 - RNA, 18 nt, Mycobacterium avium subsp. paratuberculosis
accccgcgcgcgggccag

SEQ ID NO: 801958 - RNA, 15 nt, Mycobacterium avium subsp. paratuberculosis
accccgcucggccag

SEQ ID NO: 801959 - RNA, 18 nt, Mycobacterium avium subsp. paratuberculosis
accccgcucggccagcgc

SEQ ID NO: 801960 - RNA, 21 nt, Mycobacterium avium subsp. paratuberculosis
accccgcucggccagcgcgcc

SEQ ID NO: 801961 - RNA, 20 nt, Mycobacterium avium subsp. paratuberculosis
accccgcucggcguggcgcu

SEQ ID NO: 801962 - RNA, 24 nt, Mycobacterium avium subsp. paratuberculosis
accccgcucggcguggcgcucagc

SEQ ID NO: 801963 - RNA, 22 nt, Mycobacterium avium subsp. paratuberculosis
accccgcuugcgcagcgucgug

SEQ ID NO: 801964 - RNA, 15 nt, Mycobacterium avium subsp. paratuberculosis
accccgcccagcgac

SEQ ID NO: 801965 - RNA, 23 nt, Mycobacterium avium subsp. paratuberculosis
accccgcccagcgacucggccag

SEQ ID NO: 801966 - RNA, 15 nt, Mycobacterium avium subsp. paratuberculosis
accccgccgcagccc

SEQ ID NO: 801967 - RNA, 21 nt, Mycobacterium avium subsp. paratuberculosis
accccgccgcagcccaggccc

SEQ ID NO: 801968 - RNA, 21 nt, Mycobacterium avium subsp. paratuberculosis
accccgccggcccggucgacu

SEQ ID NO: 801969 - RNA, 14 nt, Mycobacterium avium subsp. paratuberculosis
accccgcggucggc

SEQ ID NO: 801970 - RNA, 19 nt, Mycobacterium avium subsp. paratuberculosis
accccgcggucggcggcgu

SEQ ID NO: 801971 - RNA, 19 nt, Mycobacterium avium subsp. paratuberculosis
accccggagauccggccgc

SEQ ID NO: 801972 - RNA, 20 nt, Mycobacterium avium subsp. paratuberculosis
accccggagauccggccgcu

SEQ ID NO: 801973 - RNA, 18 nt, Mycobacterium avium subsp. paratuberculosis
accccggccagggugccg

SEQ ID NO: 801974 - RNA, 14 nt, Mycobacterium avium subsp. paratuberculosis
accccggccccggc

SEQ ID NO: 801975 - RNA, 15 nt, Mycobacterium avium subsp. paratuberculosis
accccggccccggcc

SEQ ID NO: 801976 - RNA, 22 nt, Mycobacterium avium subsp. paratuberculosis
accccggccccggccggcgggu

SEQ ID NO: 801977 - RNA, 16 nt, Mycobacterium avium subsp. paratuberculosis
accccggcgcggaacg

SEQ ID NO: 801978 - RNA, 17 nt, Mycobacterium avium subsp. paratuberculosis
accccggcggcaccgcc

SEQ ID NO: 801979 - RNA, 22 nt, Mycobacterium avium subsp. paratuberculosis
accccggcggcaccgccgcggu

SEQ ID NO: 801980 - RNA, 19 nt, Mycobacterium avium subsp. paratuberculosis
accccggccaccagggcga

SEQ ID NO: 801981 - RNA, 14 nt, Mycobacterium avium subsp. paratuberculosis
accccggcggccgc

SEQ ID NO: 801982 - RNA, 15 nt, Mycobacterium avium subsp. paratuberculosis
accccggcggccgcg

SEQ ID NO: 801983 - RNA, 17 nt, Mycobacterium avium subsp. paratuberculosis
accccggcggccgcguc

SEQ ID NO: 801984 - RNA, 23 nt, Mycobacterium avium subsp. paratuberculosis
accccggcggccgcgucggcggu

SEQ ID NO: 801985 - RNA, 11 nt, Mycobacterium avium subsp. paratuberculosis
accccggcggu

SEQ ID NO: 801986 - RNA, 18 nt, Mycobacterium avium subsp. paratuberculosis
accccggcguccacgccg

SEQ ID NO: 801987 - RNA, 18 nt, Mycobacterium avium subsp. paratuberculosis
accccggcguccaguagc

SEQ ID NO: 801988 - RNA, 16 nt, Mycobacterium avium subsp. paratuberculosis
accccgugguagacgc

SEQ ID NO: 801989 - RNA, 20 nt, Mycobacterium avium subsp. paratuberculosis
accccguccaggaugagcug

SEQ ID NO: 801990 - RNA, 16 nt, Mycobacterium avium subsp. paratuberculosis
accccgucgagcagcc

SEQ ID NO: 801991 - RNA, 13 nt, Mycobacterium avium subsp. paratuberculosis
accccgucgaggu

SEQ ID NO: 801992 - RNA, 16 nt, Mycobacterium avium subsp. paratuberculosis
accccguaccagcgcu

SEQ ID NO: 801993 - RNA, 19 nt, Mycobacterium avium subsp. paratuberculosis
accccguaccagcgcucga

SEQ ID NO: 801994 - RNA, 22 nt, Mycobacterium avium subsp. paratuberculosis
accccguaccagcgcucgacga

SEQ ID NO: 801995 - RNA, 15 nt, Mycobacterium avium subsp. paratuberculosis
accccggcgacggcg

SEQ ID NO: 801996 - RNA, 18 nt, Mycobacterium avium subsp. paratuberculosis
accccggcgagcgcgugc

SEQ ID NO: 801997 - RNA, 21 nt, Mycobacterium avium subsp. paratuberculosis
acccauugucgccgugcggcg

SEQ ID NO: 801998 - RNA, 15 nt, Mycobacterium avium subsp. paratuberculosis
acccauucgucggcg

SEQ ID NO: 801999 - RNA, 12 nt, Mycobacterium avium subsp. paratuberculosis
acccaugaucgc

SEQ ID NO: 802000 - RNA, 14 nt, Mycobacterium avium subsp. paratuberculosis
acccaggucggcgu

SEQ ID NO: 802001 - RNA, 18 nt, Mycobacterium avium subsp. paratuberculosis
acccagguguccggcccg

SEQ ID NO: 802002 - RNA, 11 nt, Mycobacterium avium subsp. paratuberculosis
acccagcggcg

SEQ ID NO: 802003 - RNA, 20 nt, Mycobacterium avium subsp. paratuberculosis
acccagcggaaccgggggcc

SEQ ID NO: 802004 - RNA, 23 nt, Mycobacterium avium subsp. paratuberculosis
acccagcggaaccgggggccguc

SEQ ID NO: 802005 - RNA, 13 nt, Mycobacterium avium subsp. paratuberculosis
acccagcggcgcg

SEQ ID NO: 802006 - RNA, 16 nt, Mycobacterium avium subsp. paratuberculosis
acccagcggcgcggcc

SEQ ID NO: 802007 - RNA, 17 nt, Mycobacterium avium subsp. paratuberculosis
acccagcggcgcggccg

SEQ ID NO: 802008 - RNA, 14 nt, Mycobacterium avium subsp. paratuberculosis
acccagcgggcgac

SEQ ID NO: 802009 - RNA, 21 nt, Mycobacterium avium subsp. paratuberculosis
acccagcgggcgacgucgggg

SEQ ID NO: 802010 - RNA, 17 nt, Mycobacterium avium subsp. paratuberculosis
acccagcgccucgagca

SEQ ID NO: 802011 - RNA, 21 nt, Mycobacterium avium subsp. paratuberculosis
acccagcgccucgagcaccac

SEQ ID NO: 802012 - RNA, 14 nt, Mycobacterium avium subsp. paratuberculosis
acccagcgccagga

SEQ ID NO: 802013 - RNA, 22 nt, Mycobacterium avium subsp. paratuberculosis
acccagggcaacgaacgcggcg

SEQ ID NO: 802014 - RNA, 23 nt, Mycobacterium avium subsp. paratuberculosis
acccagggcaacgaacgcggcgc

SEQ ID NO: 802015 - RNA, 18 nt, Mycobacterium avium subsp. paratuberculosis
acccaggucaugguggcg

SEQ ID NO: 802016 - RNA, 21 nt, Mycobacterium avium subsp. paratuberculosis
acccaggucaugguggcggcg

SEQ ID NO: 802017 - RNA, 23 nt, Mycobacterium avium subsp. paratuberculosis
acccaggucaugguggcggcgcc

SEQ ID NO: 802018 - RNA, 22 nt, Mycobacterium avium subsp. paratuberculosis
acccaggcagcgcgacugggug

SEQ ID NO: 802019 - RNA, 17 nt, Mycobacterium avium subsp. paratuberculosis
acccaggccacccgggc

SEQ ID NO: 802020 - RNA, 23 nt, Mycobacterium avium subsp. paratuberculosis
acccaggccgaguauccgcgcag

SEQ ID NO: 802021 - RNA, 22 nt, Mycobacterium avium subsp. paratuberculosis
acccagcuccucggccagcacc

SEQ ID NO: 802022 - RNA, 18 nt, Mycobacterium avium subsp. paratuberculosis
acccagcuugaccacccg

SEQ ID NO: 802023 - RNA, 23 nt, Mycobacterium avium subsp. paratuberculosis
acccagcuugaccacccggucga

SEQ ID NO: 802024 - RNA, 16 nt, Mycobacterium avium subsp. paratuberculosis
accaggaagaugccga

SEQ ID NO: 802025 - RNA, 21 nt, Mycobacterium avium subsp. paratuberculosis
accaggaaggcgaccgcguag

SEQ ID NO: 802026 - RNA, 20 nt, Mycobacterium avium subsp. paratuberculosis
accaggaaguacaccaccgc

SEQ ID NO: 802027 - RNA, 14 nt, Mycobacterium avium subsp. paratuberculosis
accaggaccagguu

SEQ ID NO: 802028 - RNA, 19 nt, Mycobacterium avium subsp. paratuberculosis
accaggacgcgaccggcca

SEQ ID NO: 802029 - RNA, 20 nt, Mycobacterium avium subsp. paratuberculosis
accaggacgcgaccggccau

SEQ ID NO: 802030 - RNA, 14 nt, Mycobacterium avium subsp. paratuberculosis
accaggacgucggc

SEQ ID NO: 802031 - RNA, 18 nt, Mycobacterium avium subsp. paratuberculosis
accaggacgucggccggc

SEQ ID NO: 802032 - RNA, 20 nt, Mycobacterium avium subsp. paratuberculosis
accaggagcaccugcgcgac

SEQ ID NO: 802033 - RNA, 20 nt, Mycobacterium avium subsp. paratuberculosis
accaggaugcccaggaugau

SEQ ID NO: 802034 - RNA, 20 nt, Mycobacterium avium subsp. paratuberculosis
accaggaugucuccgcgcag

SEQ ID NO: 802035 - RNA, 21 nt, Mycobacterium avium subsp. paratuberculosis
accaggaugucuccgcgcagc

SEQ ID NO: 802036 - RNA, 12 nt, Mycobacterium avium subsp. paratuberculosis
acccacgccagc

SEQ ID NO: 802037 - RNA, 15 nt, Mycobacterium avium subsp. paratuberculosis
accaggcccaccacc

SEQ ID NO: 802038 - RNA, 13 nt, Mycobacterium avium subsp. paratuberculosis
acccagcagcggc

SEQ ID NO: 802039 - RNA, 17 nt, Mycobacterium avium subsp. paratuberculosis
acccagcagcggccggc

SEQ ID NO: 802040 - RNA, 21 nt, Mycobacterium avium subsp. paratuberculosis
acccagcagcggccggcgcag

SEQ ID NO: 802041 - RNA, 15 nt, Mycobacterium avium subsp. paratuberculosis
acccagcaucgccgc

SEQ ID NO: 802042 - RNA, 16 nt, Mycobacterium avium subsp. paratuberculosis
acccagcaucgccgcg

SEQ ID NO: 802043 - RNA, 17 nt, Mycobacterium avium subsp. paratuberculosis
acccagcaucgccgcgg

SEQ ID NO: 802044 - RNA, 22 nt, Mycobacterium avium subsp. paratuberculosis
acccagcaucgccgcggugcgc

SEQ ID NO: 802045 - RNA, 16 nt, Mycobacterium avium subsp. paratuberculosis
acccagcccggcgacg

SEQ ID NO: 802046 - RNA, 17 nt, Mycobacterium avium subsp. paratuberculosis
acccagcccggcgacga

SEQ ID NO: 802047 - RNA, 19 nt, Mycobacterium avium subsp. paratuberculosis
acccagcaccaacagcggc

SEQ ID NO: 802048 - RNA, 20 nt, Mycobacterium avium subsp. paratuberculosis
acccagcaccaacagcggcc

SEQ ID NO: 802049 - RNA, 21 nt, Mycobacterium avium subsp. paratuberculosis
acccagcaccaccacgcuggc

SEQ ID NO: 802050 - RNA, 19 nt, Mycobacterium avium subsp. paratuberculosis
acccagcaccccgguccag

SEQ ID NO: 802051 - RNA, 22 nt, Mycobacterium avium subsp. paratuberculosis
acccagacguguggcacccggg

SEQ ID NO: 802052 - RNA, 20 nt, Mycobacterium avium subsp. paratuberculosis
acccacggccacaacgucuc

SEQ ID NO: 802053 - RNA, 13 nt, Mycobacterium avium subsp. paratuberculosis
acccacgugcggc

SEQ ID NO: 802054 - RNA, 14 nt, Mycobacterium avium subsp. paratuberculosis
acccacgugcggcg

SEQ ID NO: 802055 - RNA, 16 nt, Mycobacterium avium subsp. paratuberculosis
acccacgugcggcgcc

SEQ ID NO: 802056 - RNA, 17 nt, Mycobacterium avium subsp. paratuberculosis
acccacgugcggcgccc

SEQ ID NO: 802057 - RNA, 20 nt, Mycobacterium avium subsp. paratuberculosis
acccagaucgcccgggcggc

SEQ ID NO: 802058 - RNA, 21 nt, Mycobacterium avium subsp. paratuberculosis
acccagaucgcccgggcggcg

SEQ ID NO: 802059 - RNA, 17 nt, Mycobacterium avium subsp. paratuberculosis
acccagaugcccagcgg

SEQ ID NO: 802060 - RNA, 14 nt, Mycobacterium avium subsp. paratuberculosis
accgcuuggcccac

SEQ ID NO: 802061 - RNA, 17 nt, Mycobacterium avium subsp. paratuberculosis
accgcuuggcccaccga

SEQ ID NO: 802062 - RNA, 21 nt, Mycobacterium avium subsp. paratuberculosis
accgcuuugugaggcgcgccg

SEQ ID NO: 802063 - RNA, 15 nt, Mycobacterium avium subsp. paratuberculosis
accgcuugacgccgc

SEQ ID NO: 802064 - RNA, 18 nt, Mycobacterium avium subsp. paratuberculosis
accgcuugacgccgccga

SEQ ID NO: 802065 - RNA, 19 nt, Mycobacterium avium subsp. paratuberculosis
accgcuugacgccgccgaa

SEQ ID NO: 802066 - RNA, 14 nt, Mycobacterium avium subsp. paratuberculosis
accgcuugcccagc

SEQ ID NO: 802067 - RNA, 16 nt, Mycobacterium avium subsp. paratuberculosis
accgcuugcccagccc

SEQ ID NO: 802068 - RNA, 13 nt, Mycobacterium avium subsp. paratuberculosis
accgcuugcggcu

SEQ ID NO: 802069 - RNA, 14 nt, Mycobacterium avium subsp. paratuberculosis
accgcuugcggcuc

SEQ ID NO: 802070 - RNA, 19 nt, Mycobacterium avium subsp. paratuberculosis
accgcuugcggcucaacga

SEQ ID NO: 802071 - RNA, 13 nt, Mycobacterium avium subsp. paratuberculosis
accgcugcaugcc

SEQ ID NO: 802072 - RNA, 18 nt, Mycobacterium avium subsp. paratuberculosis
accgcugcaugccgucga

SEQ ID NO: 802073 - RNA, 21 nt, Mycobacterium avium subsp. paratuberculosis
accgcugcaugccgucgaucu

SEQ ID NO: 802074 - RNA, 21 nt, Mycobacterium avium subsp. paratuberculosis
accgcugccacgguuucgccg

SEQ ID NO: 802075 - RNA, 17 nt, Mycobacterium avium subsp. paratuberculosis
accgcugaugccgccga

SEQ ID NO: 802076 - RNA, 18 nt, Mycobacterium avium subsp. paratuberculosis
accgcugaugccgccgaa

SEQ ID NO: 802077 - RNA, 22 nt, Mycobacterium avium subsp. paratuberculosis
accgcugagguagucccgcgcc

SEQ ID NO: 802078 - RNA, 23 nt, Mycobacterium avium subsp. paratuberculosis
accgcugagguagucccgcgccu

SEQ ID NO: 802079 - RNA, 21 nt, Mycobacterium avium subsp. paratuberculosis
accgcucgucgggcucgucgu

SEQ ID NO: 802080 - RNA, 16 nt, Mycobacterium avium subsp. paratuberculosis
accggaagaucagcag

SEQ ID NO: 802081 - RNA, 18 nt, Mycobacterium avium subsp. paratuberculosis
accggaagaucagcaggc

SEQ ID NO: 802082 - RNA, 16 nt, Mycobacterium avium subsp. paratuberculosis
accggaggccgcgggu

SEQ ID NO: 802083 - RNA, 21 nt, Mycobacterium avium subsp. paratuberculosis
accggaucggcugcgggccag

SEQ ID NO: 802084 - RNA, 15 nt, Mycobacterium avium subsp. paratuberculosis
accggaucaugucgg

SEQ ID NO: 802085 - RNA, 23 nt, Mycobacterium avium subsp. paratuberculosis
accggauccaccaauucgcgcug

SEQ ID NO: 802086 - RNA, 21 nt, Mycobacterium avium subsp. paratuberculosis
accggaugaaggacuggccca

SEQ ID NO: 802087 - RNA, 23 nt, Mycobacterium avium subsp. paratuberculosis
accggaugaugcccuuggcggcc

SEQ ID NO: 802088 - RNA, 18 nt, Mycobacterium avium subsp. paratuberculosis
accggaugcaccggcagc

SEQ ID NO: 802089 - RNA, 21 nt, Mycobacterium avium subsp. paratuberculosis
accggaugcaccggcagccag

SEQ ID NO: 802090 - RNA, 14 nt, Mycobacterium avium subsp. paratuberculosis
accggaugcacgug

SEQ ID NO: 802091 - RNA, 17 nt, Mycobacterium avium subsp. paratuberculosis
accggaugcacgugcac

SEQ ID NO: 802092 - RNA, 21 nt, Mycobacterium avium subsp. paratuberculosis
accggaugcacgugcaccgcg

SEQ ID NO: 802093 - RNA, 21 nt, Mycobacterium avium subsp. paratuberculosis
accggaugcucaccggucagc

SEQ ID NO: 802094 - RNA, 15 nt, Mycobacterium avium subsp. paratuberculosis
accggauggcgcccg

SEQ ID NO: 802095 - RNA, 17 nt, Mycobacterium avium subsp. paratuberculosis
accggauggcgcccggc

SEQ ID NO: 802096 - RNA, 19 nt, Mycobacterium avium subsp. paratuberculosis
accggauggcgcccggcag

SEQ ID NO: 802097 - RNA, 14 nt, Mycobacterium avium subsp. paratuberculosis
accggcaaccgcca

SEQ ID NO: 802098 - RNA, 17 nt, Mycobacterium avium subsp. paratuberculosis
accggcaaccgccacga

SEQ ID NO: 802099 - RNA, 19 nt, Mycobacterium avium subsp. paratuberculosis
accggcaaggugccguccg

SEQ ID NO: 802100 - RNA, 19 nt, Mycobacterium avium subsp. paratuberculosis
accgcgugcgagccgagca

SEQ ID NO: 802101 - RNA, 15 nt, Mycobacterium avium subsp. paratuberculosis
accgcgcuugccgcg

SEQ ID NO: 802102 - RNA, 18 nt, Mycobacterium avium subsp. paratuberculosis
accgcgcuugccgcgacc

SEQ ID NO: 802103 - RNA, 22 nt, Mycobacterium avium subsp. paratuberculosis
accgcgcuuuggaccagggcgg

SEQ ID NO: 802104 - RNA, 23 nt, Mycobacterium avium subsp. paratuberculosis
accgcgcuccugccagcggcgca

SEQ ID NO: 802105 - RNA, 12 nt, Mycobacterium avium subsp. paratuberculosis
accgcgcucggc

SEQ ID NO: 802106 - RNA, 16 nt, Mycobacterium avium subsp. paratuberculosis
accgcgcucggcgacg

SEQ ID NO: 802107 - RNA, 23 nt, Mycobacterium avium subsp. paratuberculosis
accgcgcguucgaguucgucgac

SEQ ID NO: 802108 - RNA, 18 nt, Mycobacterium avium subsp. paratuberculosis
accgcgcucaccgcgggg

SEQ ID NO: 802109 - RNA, 14 nt, Mycobacterium avium subsp. paratuberculosis
accgcgcggcgccc

SEQ ID NO: 802110 - RNA, 20 nt, Mycobacterium avium subsp. paratuberculosis
accgcgcggcgcccccgcga

SEQ ID NO: 802111 - RNA, 14 nt, Mycobacterium avium subsp. paratuberculosis
accgcgcgggccag

SEQ ID NO: 802112 - RNA, 17 nt, Mycobacterium avium subsp. paratuberculosis
accgcgcgggccagcgc

SEQ ID NO: 802113 - RNA, 18 nt, Mycobacterium avium subsp. paratuberculosis
accgcgcgggccagcgcc

SEQ ID NO: 802114 - RNA, 14 nt, Mycobacterium avium subsp. paratuberculosis
accgcgcggcgguc

SEQ ID NO: 802115 - RNA, 19 nt, Mycobacterium avium subsp. paratuberculosis
accgcgcgcugccgcgccc

SEQ ID NO: 802116 - RNA, 21 nt, Mycobacterium avium subsp. paratuberculosis
accgcgcgcugccgcgccccg

SEQ ID NO: 802117 - RNA, 20 nt, Mycobacterium avium subsp. paratuberculosis
accgcgcggccagcggcgcc

SEQ ID NO: 802118 - RNA, 12 nt, Mycobacterium avium subsp. paratuberculosis
accgcgcggcga

SEQ ID NO: 802119 - RNA, 13 nt, Mycobacterium avium subsp. paratuberculosis
accgcgcggcgag

SEQ ID NO: 802120 - RNA, 16 nt, Mycobacterium avium subsp. paratuberculosis
accgcgcgcggcgccg

SEQ ID NO: 802121 - RNA, 18 nt, Mycobacterium avium subsp. paratuberculosis
accgcgcgcggcgccgcg

SEQ ID NO: 802122 - RNA, 12 nt, Mycobacterium avium subsp. paratuberculosis
accgcgcgcggg

SEQ ID NO: 802123 - RNA, 19 nt, Mycobacterium avium subsp. paratuberculosis
accgcgcgcggguagacgu

SEQ ID NO: 802124 - RNA, 17 nt, Mycobacterium avium subsp. paratuberculosis
accgcgccuucgacccg

SEQ ID NO: 802125 - RNA, 20 nt, Mycobacterium avium subsp. paratuberculosis
accgcgcgcaacgaggcggu

SEQ ID NO: 802126 - RNA, 18 nt, Mycobacterium avium subsp. paratuberculosis
accgcgcgcaccacgugc

SEQ ID NO: 802127 - RNA, 17 nt, Mycobacterium avium subsp. paratuberculosis
accgcgcgccggccagc

SEQ ID NO: 802128 - RNA, 13 nt, Mycobacterium avium subsp. paratuberculosis
accgcgcgcaggc

SEQ ID NO: 802129 - RNA, 23 nt, Mycobacterium avium subsp. paratuberculosis
accgcgcgcaggccccggcgcgc

SEQ ID NO: 802130 - RNA, 14 nt, Mycobacterium avium subsp. paratuberculosis
accgcucgauggcg

SEQ ID NO: 802131 - RNA, 14 nt, Mycobacterium avium subsp. paratuberculosis
accgcucggcggcg

SEQ ID NO: 802132 - RNA, 16 nt, Mycobacterium avium subsp. paratuberculosis
accgcucggcggcgcc

SEQ ID NO: 802133 - RNA, 17 nt, Mycobacterium avium subsp. paratuberculosis
accgcucggcggcgccg

SEQ ID NO: 802134 - RNA, 18 nt, Mycobacterium avium subsp. paratuberculosis
accgcucggcggcgccgu

SEQ ID NO: 802135 - RNA, 20 nt, Mycobacterium avium subsp. paratuberculosis
accgcucggcggcgccgucg

SEQ ID NO: 802136 - RNA, 21 nt, Mycobacterium avium subsp. paratuberculosis
accgcucggcggcgccgucgu

SEQ ID NO: 802137 - RNA, 16 nt, Mycobacterium avium subsp. paratuberculosis
accgcguugucggcga

SEQ ID NO: 802138 - RNA, 19 nt, Mycobacterium avium subsp. paratuberculosis
accgcguugucggcgacgg

SEQ ID NO: 802139 - RNA, 20 nt, Mycobacterium avium subsp. paratuberculosis
accgcguugucggcgacggc

SEQ ID NO: 802140 - RNA, 15 nt, Mycobacterium avium subsp. paratuberculosis
accgcguggcgcaca

SEQ ID NO: 802141 - RNA, 17 nt, Mycobacterium avium subsp. paratuberculosis
accgcgugucggcacac

SEQ ID NO: 802142 - RNA, 14 nt, Mycobacterium avium subsp. paratuberculosis
accgcgugugcccg

SEQ ID NO: 802143 - RNA, 15 nt, Mycobacterium avium subsp. paratuberculosis
accgcgugugcccgc

SEQ ID NO: 802144 - RNA, 14 nt, Mycobacterium avium subsp. paratuberculosis
accgcguucucggc

SEQ ID NO: 802145 - RNA, 17 nt, Mycobacterium avium subsp. paratuberculosis
accgcguucucggcgga

SEQ ID NO: 802146 - RNA, 15 nt, Mycobacterium avium subsp. paratuberculosis
accgcguuggccgcc

SEQ ID NO: 802147 - RNA, 17 nt, Mycobacterium avium subsp. paratuberculosis
accgcguuggccgccac

SEQ ID NO: 802148 - RNA, 19 nt, Mycobacterium avium subsp. paratuberculosis
accgcguuggccgccacga

SEQ ID NO: 802149 - RNA, 23 nt, Mycobacterium avium subsp. paratuberculosis
accgcguuggcgccgacgucagg

SEQ ID NO: 802150 - RNA, 14 nt, Mycobacterium avium subsp. paratuberculosis
accggcgaauccga

SEQ ID NO: 802151 - RNA, 14 nt, Mycobacterium avium subsp. paratuberculosis
accggccgguccgc

SEQ ID NO: 802152 - RNA, 17 nt, Mycobacterium avium subsp. paratuberculosis
accggccgguccgccca

SEQ ID NO: 802153 - RNA, 23 nt, Mycobacterium avium subsp. paratuberculosis
accggccgguccgcccagacgcg

SEQ ID NO: 802154 - RNA, 20 nt, Mycobacterium avium subsp. paratuberculosis
accggccgguuguugcgguc

SEQ ID NO: 802155 - RNA, 16 nt, Mycobacterium avium subsp. paratuberculosis
accggccgugcgcguc

SEQ ID NO: 802156 - RNA, 19 nt, Mycobacterium avium subsp. paratuberculosis
accggccgugcgcgucgac

SEQ ID NO: 802157 - RNA, 16 nt, Mycobacterium avium subsp. paratuberculosis
accggccugcagcgcg

SEQ ID NO: 802158 - RNA, 17 nt, Mycobacterium avium subsp. paratuberculosis
accggccugcagcgcgg

SEQ ID NO: 802159 - RNA, 23 nt, Mycobacterium avium subsp. paratuberculosis
accggccugcagcgcggucaucg

SEQ ID NO: 802160 - RNA, 18 nt, Mycobacterium avium subsp. paratuberculosis
accggcacggcaccgcga

SEQ ID NO: 802161 - RNA, 20 nt, Mycobacterium avium subsp. paratuberculosis
accggcacggcaccgcgagc

SEQ ID NO: 802162 - RNA, 14 nt, Mycobacterium avium subsp. paratuberculosis
accggcacggugca

SEQ ID NO: 802163 - RNA, 19 nt, Mycobacterium avium subsp. paratuberculosis
accggcacggugcacacgc

SEQ ID NO: 802164 - RNA, 21 nt, Mycobacterium avium subsp. paratuberculosis
accggccggcgcggcggcgac

SEQ ID NO: 802165 - RNA, 23 nt, Mycobacterium avium subsp. paratuberculosis
accggccggcgcggcggcgacgu

SEQ ID NO: 802166 - RNA, 22 nt, Mycobacterium avium subsp. paratuberculosis
accggccggggcgggcacgucg

SEQ ID NO: 802167 - RNA, 17 nt, Mycobacterium avium subsp. paratuberculosis
accggcaccgccagcca

SEQ ID NO: 802168 - RNA, 21 nt, Mycobacterium avium subsp. paratuberculosis
accggcaccgccagccaccac

SEQ ID NO: 802169 - RNA, 20 nt, Mycobacterium avium subsp. paratuberculosis
accggcacgaucgucgccgc

SEQ ID NO: 802170 - RNA, 17 nt, Mycobacterium avium subsp. paratuberculosis
accggcaaucgggacgc

SEQ ID NO: 802171 - RNA, 10 nt, Mycobacterium avium subsp. paratuberculosis
accggcacca

SEQ ID NO: 802172 - RNA, 13 nt, Mycobacterium avium subsp. paratuberculosis
accggcaccacga

SEQ ID NO: 802173 - RNA, 15 nt, Mycobacterium avium subsp. paratuberculosis
accggcaccagcagc

SEQ ID NO: 802174 - RNA, 16 nt, Mycobacterium avium subsp. paratuberculosis
accggcaccagcaggc

SEQ ID NO: 802175 - RNA, 17 nt, Mycobacterium avium subsp. paratuberculosis
accggcaccagcaggcc

SEQ ID NO: 802176 - RNA, 20 nt, Mycobacterium avium subsp. paratuberculosis
accggcaccagcaggccccg

SEQ ID NO: 802177 - RNA, 12 nt, Mycobacterium avium subsp. paratuberculosis
accggcaccgcg

SEQ ID NO: 802178 - RNA, 16 nt, Mycobacterium avium subsp. paratuberculosis
accggcaccgcggcga

SEQ ID NO: 802179 - RNA, 18 nt, Mycobacterium avium subsp. paratuberculosis
accggcaccgcggucugc

SEQ ID NO: 802180 - RNA, 13 nt, Mycobacterium avium subsp. paratuberculosis
accggcgcgacgg

SEQ ID NO: 802181 - RNA, 14 nt, Mycobacterium avium subsp. paratuberculosis
accggcgcgacggc

SEQ ID NO: 802182 - RNA, 16 nt, Mycobacterium avium subsp. paratuberculosis
accggcgcgcagcauc

SEQ ID NO: 802183 - RNA, 14 nt, Mycobacterium avium subsp. paratuberculosis
accggcgacggcgg

SEQ ID NO: 802184 - RNA, 16 nt, Mycobacterium avium subsp. paratuberculosis
accggcgaggugcgcc

SEQ ID NO: 802185 - RNA, 14 nt, Mycobacterium avium subsp. paratuberculosis
accggcgaucguca

SEQ ID NO: 802186 - RNA, 14 nt, Mycobacterium avium subsp. paratuberculosis
accggcgcugcccg

SEQ ID NO: 802187 - RNA, 21 nt, Mycobacterium avium subsp. paratuberculosis
accggcggauucucgcucugc

SEQ ID NO: 802188 - RNA, 14 nt, Mycobacterium avium subsp. paratuberculosis
accggcgcgcccga

SEQ ID NO: 802189 - RNA, 22 nt, Mycobacterium avium subsp. paratuberculosis
accggcgcgcccgagucacccg

SEQ ID NO: 802190 - RNA, 14 nt, Mycobacterium avium subsp. paratuberculosis
accggcgcgccgcg

SEQ ID NO: 802191 - RNA, 14 nt, Mycobacterium avium subsp. paratuberculosis
accggcggcgaucg

SEQ ID NO: 802192 - RNA, 21 nt, Mycobacterium avium subsp. paratuberculosis
accggcggcgaucggcgcggc

SEQ ID NO: 802193 - RNA, 22 nt, Mycobacterium avium subsp. paratuberculosis
accggcggcgaucggcgcggcg

SEQ ID NO: 802194 - RNA, 14 nt, Mycobacterium avium subsp. paratuberculosis
accggcggcggccu

SEQ ID NO: 802195 - RNA, 12 nt, Mycobacterium avium subsp. paratuberculosis
accggcggcagc

SEQ ID NO: 802196 - RNA, 12 nt, Mycobacterium avium subsp. paratuberculosis
accggcggccgc

SEQ ID NO: 802197 - RNA, 14 nt, Mycobacterium avium subsp. paratuberculosis
accggcggccgcca

SEQ ID NO: 802198 - RNA, 15 nt, Mycobacterium avium subsp. paratuberculosis
accggcggcgacggc

SEQ ID NO: 802199 - RNA, 14 nt, Mycobacterium avium subsp. paratuberculosis
accggcggcgacgg

SEQ ID NO: 802200 - RNA, 13 nt, Mycobacterium avium subsp. paratuberculosis
accggcugcccga

SEQ ID NO: 802201 - RNA, 19 nt, Mycobacterium avium subsp. paratuberculosis
accggcugcccgacccgca

SEQ ID NO: 802202 - RNA, 21 nt, Mycobacterium avium subsp. paratuberculosis
accggcugcccgacccgcacc

SEQ ID NO: 802203 - RNA, 22 nt, Mycobacterium avium subsp. paratuberculosis
accggcugcccgacccgcacca

SEQ ID NO: 802204 - RNA, 17 nt, Mycobacterium avium subsp. paratuberculosis
accggcugcucgcgcug

SEQ ID NO: 802205 - RNA, 16 nt, Mycobacterium avium subsp. paratuberculosis
accggcuggacacccc

SEQ ID NO: 802206 - RNA, 16 nt, Mycobacterium avium subsp. paratuberculosis
accggcucagcccggc

SEQ ID NO: 802207 - RNA, 14 nt, Mycobacterium avium subsp. paratuberculosis
accggcucggcccg

SEQ ID NO: 802208 - RNA, 23 nt, Mycobacterium avium subsp. paratuberculosis
accggcucgggaacggucagccg

SEQ ID NO: 802209 - RNA, 14 nt, Mycobacterium avium subsp. paratuberculosis
accggcucgccggc

SEQ ID NO: 802210 - RNA, 20 nt, Mycobacterium avium subsp. paratuberculosis
accggcucgccggcgcgcac

SEQ ID NO: 802211 - RNA, 15 nt, Mycobacterium avium subsp. paratuberculosis
accggcucgcggggu

SEQ ID NO: 802212 - RNA, 16 nt, Mycobacterium avium subsp. paratuberculosis
accggcucgcggggug

SEQ ID NO: 802213 - RNA, 13 nt, Mycobacterium avium subsp. paratuberculosis
accggcucgcuga

SEQ ID NO: 802214 - RNA, 14 nt, Mycobacterium avium subsp. paratuberculosis
accgggcgcgcaga

SEQ ID NO: 802215 - RNA, 16 nt, Mycobacterium avium subsp. paratuberculosis
accgggcgcgcagauc

SEQ ID NO: 802216 - RNA, 17 nt, Mycobacterium avium subsp. paratuberculosis
accgggccgcuggccgc

SEQ ID NO: 802217 - RNA, 16 nt, Mycobacterium avium subsp. paratuberculosis
accgggccugcgcgcc

SEQ ID NO: 802218 - RNA, 19 nt, Mycobacterium avium subsp. paratuberculosis
accgggccugcgcgccgau

SEQ ID NO: 802219 - RNA, 13 nt, Mycobacterium avium subsp. paratuberculosis
accggcuggccga

SEQ ID NO: 802220 - RNA, 19 nt, Mycobacterium avium subsp. paratuberculosis
accggcuggccgagcggcu

SEQ ID NO: 802221 - RNA, 20 nt, Mycobacterium avium subsp. paratuberculosis
accggcuggccgagcggcug

SEQ ID NO: 802222 - RNA, 17 nt, Mycobacterium avium subsp. paratuberculosis
accgggcuccagcgggu

SEQ ID NO: 802223 - RNA, 15 nt, Mycobacterium avium subsp. paratuberculosis
accgggcucggucac

SEQ ID NO: 802224 - RNA, 13 nt, Mycobacterium avium subsp. paratuberculosis
accgggcgucggc

SEQ ID NO: 802225 - RNA, 17 nt, Mycobacterium avium subsp. paratuberculosis
accgggcgucggcggug

SEQ ID NO: 802226 - RNA, 14 nt, Mycobacterium avium subsp. paratuberculosis
accgggcgucgggg

SEQ ID NO: 802227 - RNA, 21 nt, Mycobacterium avium subsp. paratuberculosis
accgggucagcaccaccaaca

SEQ ID NO: 802228 - RNA, 18 nt, Mycobacterium avium subsp. paratuberculosis
accgggucccccgccgac

SEQ ID NO: 802229 - RNA, 19 nt, Mycobacterium avium subsp. paratuberculosis
accgggucccccgccgacc

SEQ ID NO: 802230 - RNA, 22 nt, Mycobacterium avium subsp. paratuberculosis
accggguccgaggugaucgcga

SEQ ID NO: 802231 - RNA, 13 nt, Mycobacterium avium subsp. paratuberculosis
accggggugccgc

SEQ ID NO: 802232 - RNA, 14 nt, Mycobacterium avium subsp. paratuberculosis
accggggugccgcc

SEQ ID NO: 802233 - RNA, 19 nt, Mycobacterium avium subsp. paratuberculosis
accggguacaccggcucgc

SEQ ID NO: 802234 - RNA, 19 nt, Mycobacterium avium subsp. paratuberculosis
accggggccagcacgcccc

SEQ ID NO: 802235 - RNA, 12 nt, Mycobacterium avium subsp. paratuberculosis
accggggccgca

SEQ ID NO: 802236 - RNA, 17 nt, Mycobacterium avium subsp. paratuberculosis
accggggccgcaccuga

SEQ ID NO: 802237 - RNA, 12 nt, Mycobacterium avium subsp. paratuberculosis
accggggccggc

SEQ ID NO: 802238 - RNA, 15 nt, Mycobacterium avium subsp. paratuberculosis
accggggcgccccgc

SEQ ID NO: 802239 - RNA, 19 nt, Mycobacterium avium subsp. paratuberculosis
accggggcgccccgcuggu

SEQ ID NO: 802240 - RNA, 21 nt, Mycobacterium avium subsp. paratuberculosis
accggggcgccccgcugguag

SEQ ID NO: 802241 - RNA, 16 nt, Mycobacterium avium subsp. paratuberculosis
accgggcugucgggca

SEQ ID NO: 802242 - RNA, 14 nt, Mycobacterium avium subsp. paratuberculosis
accgggggccguca

SEQ ID NO: 802243 - RNA, 14 nt, Mycobacterium avium subsp. paratuberculosis
accggggucggcgc

SEQ ID NO: 802244 - RNA, 21 nt, Mycobacterium avium subsp. paratuberculosis
accggggucggcgcccucggc

SEQ ID NO: 802245 - RNA, 22 nt, Mycobacterium avium subsp. paratuberculosis
accgggugcguccagaccggcc

SEQ ID NO: 802246 - RNA, 15 nt, Mycobacterium avium subsp. paratuberculosis
accggguggccguga

SEQ ID NO: 802247 - RNA, 23 nt, Mycobacterium avium subsp. paratuberculosis
accgggugggccgaccugcacgc

SEQ ID NO: 802248 - RNA, 17 nt, Mycobacterium avium subsp. paratuberculosis
accggguuggcgcgcac

SEQ ID NO: 802249 - RNA, 20 nt, Mycobacterium avium subsp. paratuberculosis
accggguuugaggcccacgu

SEQ ID NO: 802250 - RNA, 13 nt, Mycobacterium avium subsp. paratuberculosis
accgggucgccga

SEQ ID NO: 802251 - RNA, 13 nt, Mycobacterium avium subsp. paratuberculosis
accgggucguccg

SEQ ID NO: 802252 - RNA, 19 nt, Mycobacterium avium subsp. paratuberculosis
accgggucguccgcgacgc

SEQ ID NO: 802253 - RNA, 21 nt, Mycobacterium avium subsp. paratuberculosis
accgggucguccgcgacgcug

SEQ ID NO: 802254 - RNA, 13 nt, Mycobacterium avium subsp. paratuberculosis
accgggucgucgc

SEQ ID NO: 802255 - RNA, 14 nt, Mycobacterium avium subsp. paratuberculosis
accgggucugccac

SEQ ID NO: 802256 - RNA, 21 nt, Mycobacterium avium subsp. paratuberculosis
accgggugaacgaggccgcgc

SEQ ID NO: 802257 - RNA, 12 nt, Mycobacterium avium subsp. paratuberculosis
accgggugacga

SEQ ID NO: 802258 - RNA, 21 nt, Mycobacterium avium subsp. paratuberculosis
accgggugauaccggcccagc

SEQ ID NO: 802259 - RNA, 19 nt, Mycobacterium avium subsp. paratuberculosis
accgggugaugucgccgac

SEQ ID NO: 802260 - RNA, 16 nt, Mycobacterium avium subsp. paratuberculosis
accgaccccucggcgg

SEQ ID NO: 802261 - RNA, 19 nt, Mycobacterium avium subsp. paratuberculosis
accgaccccucggcggccg

SEQ ID NO: 802262 - RNA, 13 nt, Mycobacterium avium subsp. paratuberculosis
accgacccggcca

SEQ ID NO: 802263 - RNA, 15 nt, Mycobacterium avium subsp. paratuberculosis
accgacccggccagc

SEQ ID NO: 802264 - RNA, 13 nt, Mycobacterium avium subsp. paratuberculosis
accgaccgccgcg

SEQ ID NO: 802265 - RNA, 16 nt, Mycobacterium avium subsp. paratuberculosis
accgaccgccgcggcc

SEQ ID NO: 802266 - RNA, 17 nt, Mycobacterium avium subsp. paratuberculosis
accgaccgccgcggccg

SEQ ID NO: 802267 - RNA, 14 nt, Mycobacterium avium subsp. paratuberculosis
accgaccuguccga

SEQ ID NO: 802268 - RNA, 22 nt, Mycobacterium avium subsp. paratuberculosis
accgacgaaaucgucgggcacc

SEQ ID NO: 802269 - RNA, 21 nt, Mycobacterium avium subsp. paratuberculosis
accgcacgucuuacggauauc

SEQ ID NO: 802270 - RNA, 12 nt, Mycobacterium avium subsp. paratuberculosis
accgacgaccau

SEQ ID NO: 802271 - RNA, 18 nt, Mycobacterium avium subsp. paratuberculosis
accgacgaccaucagcgc

SEQ ID NO: 802272 - RNA, 20 nt, Mycobacterium avium subsp. paratuberculosis
accgacgacgugacgaccug

SEQ ID NO: 802273 - RNA, 23 nt, Mycobacterium avium subsp. paratuberculosis
accgacgagaucagcaccaggug

SEQ ID NO: 802274 - RNA, 16 nt, Mycobacterium avium subsp. paratuberculosis
accgacgaggagaccu

SEQ ID NO: 802275 - RNA, 20 nt, Mycobacterium avium subsp. paratuberculosis
accgacgaggagaccuccug

SEQ ID NO: 802276 - RNA, 24 nt, Mycobacterium avium subsp. paratuberculosis
accgcacggcccaucaccagcggc

SEQ ID NO: 802277 - RNA, 17 nt, Mycobacterium avium subsp. paratuberculosis
accgcauagcgggagcc

SEQ ID NO: 802278 - RNA, 16 nt, Mycobacterium avium subsp. paratuberculosis
accgcaucgccgaggg

SEQ ID NO: 802279 - RNA, 21 nt, Mycobacterium avium subsp. paratuberculosis
accgcaucgccgagggcgacg

SEQ ID NO: 802280 - RNA, 18 nt, Mycobacterium avium subsp. paratuberculosis
accgcaucgaaccgccgc

SEQ ID NO: 802281 - RNA, 19 nt, Mycobacterium avium subsp. paratuberculosis
accgcaucgaaccgccgcg

SEQ ID NO: 802282 - RNA, 20 nt, Mycobacterium avium subsp. paratuberculosis
accgcaucgaaccgccgcgc

SEQ ID NO: 802283 - RNA, 22 nt, Mycobacterium avium subsp. paratuberculosis
accgcaucgaaccgccgcgcuc

SEQ ID NO: 802284 - RNA, 23 nt, Mycobacterium avium subsp. paratuberculosis
accgcauauaggugcugagcgug

SEQ ID NO: 802285 - RNA, 15 nt, Mycobacterium avium subsp. paratuberculosis
accgcauggccggcg

SEQ ID NO: 802286 - RNA, 16 nt, Mycobacterium avium subsp. paratuberculosis
accgcauggccggcga

SEQ ID NO: 802287 - RNA, 15 nt, Mycobacterium avium subsp. paratuberculosis
accgcauucggccgc

SEQ ID NO: 802288 - RNA, 18 nt, Mycobacterium avium subsp. paratuberculosis
accgcauucggccgccac

SEQ ID NO: 802289 - RNA, 21 nt, Mycobacterium avium subsp. paratuberculosis
accgcauucggccgccaccga

SEQ ID NO: 802290 - RNA, 21 nt, Mycobacterium avium subsp. paratuberculosis
accgcagucguucggccagca

SEQ ID NO: 802291 - RNA, 18 nt, Mycobacterium avium subsp. paratuberculosis
accgcagcaggcggacgg

SEQ ID NO: 802292 - RNA, 22 nt, Mycobacterium avium subsp. paratuberculosis
accgcagcaggcggacggcgac

SEQ ID NO: 802293 - RNA, 13 nt, Mycobacterium avium subsp. paratuberculosis
accgcagccggau

SEQ ID NO: 802294 - RNA, 14 nt, Mycobacterium avium subsp. paratuberculosis
accgcagccgggug

SEQ ID NO: 802295 - RNA, 21 nt, Mycobacterium avium subsp. paratuberculosis
accgccagacugaugcccucg

SEQ ID NO: 802296 - RNA, 17 nt, Mycobacterium avium subsp. paratuberculosis
accgcauuugccgacau

SEQ ID NO: 802297 - RNA, 16 nt, Mycobacterium avium subsp. paratuberculosis
accgccagcagcagcc

SEQ ID NO: 802298 - RNA, 20 nt, Mycobacterium avium subsp. paratuberculosis
accgccagcagcagccgcgc

SEQ ID NO: 802299 - RNA, 22 nt, Mycobacterium avium subsp. paratuberculosis
accgccagcagcagccgcgccg

SEQ ID NO: 802300 - RNA, 13 nt, Mycobacterium avium subsp. paratuberculosis
accgccagcagcg

SEQ ID NO: 802301 - RNA, 14 nt, Mycobacterium avium subsp. paratuberculosis
accgccagcagcgc

SEQ ID NO: 802302 - RNA, 15 nt, Mycobacterium avium subsp. paratuberculosis
accgccagcagcgca

SEQ ID NO: 802303 - RNA, 19 nt, Mycobacterium avium subsp. paratuberculosis
accgccagcagcgcaagcu

SEQ ID NO: 802304 - RNA, 15 nt, Mycobacterium avium subsp. paratuberculosis
accgccagcagcgcc

SEQ ID NO: 802305 - RNA, 17 nt, Mycobacterium avium subsp. paratuberculosis
accgccagcagcgccgc

SEQ ID NO: 802306 - RNA, 13 nt, Mycobacterium avium subsp. paratuberculosis
accgccagcagca

SEQ ID NO: 802307 - RNA, 14 nt, Mycobacterium avium subsp. paratuberculosis
accgccagcaccga

SEQ ID NO: 802308 - RNA, 15 nt, Mycobacterium avium subsp. paratuberculosis
accgccagcaccgac

SEQ ID NO: 802309 - RNA, 14 nt, Mycobacterium avium subsp. paratuberculosis
accgccagcaccgc

SEQ ID NO: 802310 - RNA, 18 nt, Mycobacterium avium subsp. paratuberculosis
accgccagcaccgccacc

SEQ ID NO: 802311 - RNA, 15 nt, Mycobacterium avium subsp. paratuberculosis
accgccagcaccgcg

SEQ ID NO: 802312 - RNA, 18 nt, Mycobacterium avium subsp. paratuberculosis
accgccagcaccgcgggg

SEQ ID NO: 802313 - RNA, 14 nt, Mycobacterium avium subsp. paratuberculosis
accgccgacaccac

SEQ ID NO: 802314 - RNA, 15 nt, Mycobacterium avium subsp. paratuberculosis
accgccgacaccacc

SEQ ID NO: 802315 - RNA, 16 nt, Mycobacterium avium subsp. paratuberculosis
accgccgacaccaccg

SEQ ID NO: 802316 - RNA, 21 nt, Mycobacterium avium subsp. paratuberculosis
accgccgacaccaccgcgcgc

SEQ ID NO: 802317 - RNA, 22 nt, Mycobacterium avium subsp. paratuberculosis
accgccgacaccaccgcgcgca

SEQ ID NO: 802318 - RNA, 20 nt, Mycobacterium avium subsp. paratuberculosis
accgccgacaucgcccgguc

SEQ ID NO: 802319 - RNA, 20 nt, Mycobacterium avium subsp. paratuberculosis
accgccgaaacaccggcuuc

SEQ ID NO: 802320 - RNA, 15 nt, Mycobacterium avium subsp. paratuberculosis
accgccagcgccggc

SEQ ID NO: 802321 - RNA, 18 nt, Mycobacterium avium subsp. paratuberculosis
accgccagcgccggcagc

SEQ ID NO: 802322 - RNA, 12 nt, Mycobacterium avium subsp. paratuberculosis
accgccagcgcg

SEQ ID NO: 802323 - RNA, 14 nt, Mycobacterium avium subsp. paratuberculosis
accgccagcgcgcc

SEQ ID NO: 802324 - RNA, 17 nt, Mycobacterium avium subsp. paratuberculosis
accgccagcgcgccgau

SEQ ID NO: 802325 - RNA, 19 nt, Mycobacterium avium subsp. paratuberculosis
accgccagcgcgccgaucg

SEQ ID NO: 802326 - RNA, 23 nt, Mycobacterium avium subsp. paratuberculosis
accgccagcgcgccgaucgccca

SEQ ID NO: 802327 - RNA, 13 nt, Mycobacterium avium subsp. paratuberculosis
accgccagcgcgg

SEQ ID NO: 802328 - RNA, 15 nt, Mycobacterium avium subsp. paratuberculosis
accgccagcgcggcg

SEQ ID NO: 802329 - RNA, 16 nt, Mycobacterium avium subsp. paratuberculosis
accgccagcgcggcgg

SEQ ID NO: 802330 - RNA, 20 nt, Mycobacterium avium subsp. paratuberculosis
accgccagcgcggcggcgcc

SEQ ID NO: 802331 - RNA, 12 nt, Mycobacterium avium subsp. paratuberculosis
accgccggcagc

SEQ ID NO: 802332 - RNA, 13 nt, Mycobacterium avium subsp. paratuberculosis
accgccgcugcgc

SEQ ID NO: 802333 - RNA, 16 nt, Mycobacterium avium subsp. paratuberculosis
accgccgcugcgcgcg

SEQ ID NO: 802334 - RNA, 17 nt, Mycobacterium avium subsp. paratuberculosis
accgccgcugcgcgcgc

SEQ ID NO: 802335 - RNA, 23 nt, Mycobacterium avium subsp. paratuberculosis
accgccgcugcgcgcgcgaucgg

SEQ ID NO: 802336 - RNA, 22 nt, Mycobacterium avium subsp. paratuberculosis
accgccggacaccaccgcggug

SEQ ID NO: 802337 - RNA, 23 nt, Mycobacterium avium subsp. paratuberculosis
accgccggacaccaccgcggugg

SEQ ID NO: 802338 - RNA, 21 nt, Mycobacterium avium subsp. paratuberculosis
accgccgcguacagccagccc

SEQ ID NO: 802339 - RNA, 23 nt, Mycobacterium avium subsp. paratuberculosis
accgccgcguacagccagcccgu

SEQ ID NO: 802340 - RNA, 13 nt, Mycobacterium avium subsp. paratuberculosis
accgccgcggccg

SEQ ID NO: 802341 - RNA, 17 nt, Mycobacterium avium subsp. paratuberculosis
accgccgcggccgcgau

SEQ ID NO: 802342 - RNA, 14 nt, Mycobacterium avium subsp. paratuberculosis
accgccgcggcgcc

SEQ ID NO: 802343 - RNA, 15 nt, Mycobacterium avium subsp. paratuberculosis
accgccgcggcgccc

SEQ ID NO: 802344 - RNA, 18 nt, Mycobacterium avium subsp. paratuberculosis
accgccgcggcgcccggc

SEQ ID NO: 802345 - RNA, 13 nt, Mycobacterium avium subsp. paratuberculosis
accgccgcggcgg

SEQ ID NO: 802346 - RNA, 14 nt, Mycobacterium avium subsp. paratuberculosis
accgccgcggcggc

SEQ ID NO: 802347 - RNA, 16 nt, Mycobacterium avium subsp. paratuberculosis
accgccgcggcggccu

SEQ ID NO: 802348 - RNA, 20 nt, Mycobacterium avium subsp. paratuberculosis
accgccgcggcgguggccug

SEQ ID NO: 802349 - RNA, 22 nt, Mycobacterium avium subsp. paratuberculosis
accgccgcgcucgcaccagcgc

SEQ ID NO: 802350 - RNA, 14 nt, Mycobacterium avium subsp. paratuberculosis
accgccgcgcucgg

SEQ ID NO: 802351 - RNA, 16 nt, Mycobacterium avium subsp. paratuberculosis
accgccgcgcucggcc

SEQ ID NO: 802352 - RNA, 13 nt, Mycobacterium avium subsp. paratuberculosis
accgccgccagca

SEQ ID NO: 802353 - RNA, 22 nt, Mycobacterium avium subsp. paratuberculosis
accgccgccagcagcagcgccg

SEQ ID NO: 802354 - RNA, 23 nt, Mycobacterium avium subsp. paratuberculosis
accgccgccagcagcagcgccgc

SEQ ID NO: 802355 - RNA, 14 nt, Mycobacterium avium subsp. paratuberculosis
accgccgaucguga

SEQ ID NO: 802356 - RNA, 20 nt, Mycobacterium avium subsp. paratuberculosis
accgccgaucgugacgccgu

SEQ ID NO: 802357 - RNA, 24 nt, Mycobacterium avium subsp. paratuberculosis
accgccgaucgugacgccguccga

SEQ ID NO: 802358 - RNA, 22 nt, Mycobacterium avium subsp. paratuberculosis
accgccgauggcgacggucugc

SEQ ID NO: 802359 - RNA, 20 nt, Mycobacterium avium subsp. paratuberculosis
accgccgcaccgucgugcca

SEQ ID NO: 802360 - RNA, 15 nt, Mycobacterium avium subsp. paratuberculosis
accgccgagcgugaa

SEQ ID NO: 802361 - RNA, 20 nt, Mycobacterium avium subsp. paratuberculosis
accgccgagggcccgggcag

SEQ ID NO: 802362 - RNA, 15 nt, Mycobacterium avium subsp. paratuberculosis
accgccgagccgcuc

SEQ ID NO: 802363 - RNA, 15 nt, Mycobacterium avium subsp. paratuberculosis
accgccgagccgucg

SEQ ID NO: 802364 - RNA, 14 nt, Mycobacterium avium subsp. paratuberculosis
accgccgagcgggc

SEQ ID NO: 802365 - RNA, 16 nt, Mycobacterium avium subsp. paratuberculosis
accgcgcagucggcgu

SEQ ID NO: 802366 - RNA, 18 nt, Mycobacterium avium subsp. paratuberculosis
accgcgcagucggcgucg

SEQ ID NO: 802367 - RNA, 19 nt, Mycobacterium avium subsp. paratuberculosis
accgcgcagucggcgucgc

SEQ ID NO: 802368 - RNA, 16 nt, Mycobacterium avium subsp. paratuberculosis
accgcgcaggcggcga

SEQ ID NO: 802369 - RNA, 17 nt, Mycobacterium avium subsp. paratuberculosis
accgcgcaggcggcgac

SEQ ID NO: 802370 - RNA, 20 nt, Mycobacterium avium subsp. paratuberculosis
accgcgcaggcggcgacggc

SEQ ID NO: 802371 - RNA, 16 nt, Mycobacterium avium subsp. paratuberculosis
accgcgccccggcgca

SEQ ID NO: 802372 - RNA, 18 nt, Mycobacterium avium subsp. paratuberculosis
accgcgccccggcgcagc

SEQ ID NO: 802373 - RNA, 20 nt, Mycobacterium avium subsp. paratuberculosis
accgcgccccggcgcagcgc

SEQ ID NO: 802374 - RNA, 23 nt, Mycobacterium avium subsp. paratuberculosis
accgcgccccggcgcagcgccgc

SEQ ID NO: 802375 - RNA, 11 nt, Mycobacterium avium subsp. paratuberculosis
accgcgccgaa

SEQ ID NO: 802376 - RNA, 13 nt, Mycobacterium avium subsp. paratuberculosis
accgcgccgcggg

SEQ ID NO: 802377 - RNA, 14 nt, Mycobacterium avium subsp. paratuberculosis
accgcgccgcgggu

SEQ ID NO: 802378 - RNA, 15 nt, Mycobacterium avium subsp. paratuberculosis
accgcgccgcgggug

SEQ ID NO: 802379 - RNA, 13 nt, Mycobacterium avium subsp. paratuberculosis
accgcgccggcgg

SEQ ID NO: 802380 - RNA, 15 nt, Mycobacterium avium subsp. paratuberculosis
accgcgccgggcacc

SEQ ID NO: 802381 - RNA, 19 nt, Mycobacterium avium subsp. paratuberculosis
accgcgccgggcaccacca

SEQ ID NO: 802382 - RNA, 18 nt, Mycobacterium avium subsp. paratuberculosis
accgcgccggggugggcc

SEQ ID NO: 802383 - RNA, 14 nt, Mycobacterium avium subsp. paratuberculosis
accgcgccggcggc

SEQ ID NO: 802384 - RNA, 13 nt, Mycobacterium avium subsp. paratuberculosis
accgcgccgucgu

SEQ ID NO: 802385 - RNA, 16 nt, Mycobacterium avium subsp. paratuberculosis
accgcgccgucgucgu

SEQ ID NO: 802386 - RNA, 19 nt, Mycobacterium avium subsp. paratuberculosis
accgcgcccagccccagca

SEQ ID NO: 802387 - RNA, 20 nt, Mycobacterium avium subsp. paratuberculosis
accgcgagcaccgcgaucgc

SEQ ID NO: 802388 - RNA, 23 nt, Mycobacterium avium subsp. paratuberculosis
accgcgagcaccgcgaucgccga

SEQ ID NO: 802389 - RNA, 18 nt, Mycobacterium avium subsp. paratuberculosis
accgcgagaucagcgcca

SEQ ID NO: 802390 - RNA, 19 nt, Mycobacterium avium subsp. paratuberculosis
accgcgagaucagcgccau

SEQ ID NO: 802391 - RNA, 20 nt, Mycobacterium avium subsp. paratuberculosis
accgcgagaucagcgccaug

SEQ ID NO: 802392 - RNA, 18 nt, Mycobacterium avium subsp. paratuberculosis
accgcgacgcugccggug

SEQ ID NO: 802393 - RNA, 13 nt, Mycobacterium avium subsp. paratuberculosis
accgcgacggcgc

SEQ ID NO: 802394 - RNA, 14 nt, Mycobacterium avium subsp. paratuberculosis
accgcgacggcgcc

SEQ ID NO: 802395 - RNA, 16 nt, Mycobacterium avium subsp. paratuberculosis
accgcgacgaucgcga

SEQ ID NO: 802396 - RNA, 17 nt, Mycobacterium avium subsp. paratuberculosis
accgcgacgaucgcgac

SEQ ID NO: 802397 - RNA, 18 nt, Mycobacterium avium subsp. paratuberculosis
accgcgacggcgcccgcc

SEQ ID NO: 802398 - RNA, 16 nt, Mycobacterium avium subsp. paratuberculosis
accgcgacccggccga

SEQ ID NO: 802399 - RNA, 13 nt, Mycobacterium avium subsp. paratuberculosis
accgcgaccgccu

SEQ ID NO: 802400 - RNA, 15 nt, Mycobacterium avium subsp. paratuberculosis
accgcgaccgguccg

SEQ ID NO: 802401 - RNA, 22 nt, Mycobacterium avium subsp. paratuberculosis
accgcgacgaccucgcccgccg

SEQ ID NO: 802402 - RNA, 16 nt, Mycobacterium avium subsp. paratuberculosis
accgcgacgcccaggu

SEQ ID NO: 802403 - RNA, 16 nt, Mycobacterium avium subsp. paratuberculosis
accgcgacgcgaucga

SEQ ID NO: 802404 - RNA, 13 nt, Mycobacterium avium subsp. paratuberculosis
accgcgcaccggc

SEQ ID NO: 802405 - RNA, 15 nt, Mycobacterium avium subsp. paratuberculosis
accgcgcaccggcgc

SEQ ID NO: 802406 - RNA, 17 nt, Mycobacterium avium subsp. paratuberculosis
accgcgcaccggcgcug

SEQ ID NO: 802407 - RNA, 22 nt, Mycobacterium avium subsp. paratuberculosis
accgcgcacucgaacggcccgg

SEQ ID NO: 802408 - RNA, 17 nt, Mycobacterium avium subsp. paratuberculosis
accgcgcagaaccgcac

SEQ ID NO: 802409 - RNA, 18 nt, Mycobacterium avium subsp. paratuberculosis
accgcgcagaaccgcacc

SEQ ID NO: 802410 - RNA, 16 nt, Mycobacterium avium subsp. paratuberculosis
accgcgauggcccgcg

SEQ ID NO: 802411 - RNA, 17 nt, Mycobacterium avium subsp. paratuberculosis
accgcgauggcccgcgc

SEQ ID NO: 802412 - RNA, 18 nt, Mycobacterium avium subsp. paratuberculosis
accgcgaugguggcguca

SEQ ID NO: 802413 - RNA, 19 nt, Mycobacterium avium subsp. paratuberculosis
accgcgaugguggcgucac

SEQ ID NO: 802414 - RNA, 22 nt, Mycobacterium avium subsp. paratuberculosis
accgcgaugauggcgucgacgu

SEQ ID NO: 802415 - RNA, 23 nt, Mycobacterium avium subsp. paratuberculosis
accgcgaugauggcgucgacgug

SEQ ID NO: 802416 - RNA, 16 nt, Mycobacterium avium subsp. paratuberculosis
accgcgagcgcgcggu

SEQ ID NO: 802417 - RNA, 17 nt, Mycobacterium avium subsp. paratuberculosis
accgcgagcgcgcggug

SEQ ID NO: 802418 - RNA, 15 nt, Mycobacterium avium subsp. paratuberculosis
accgcgacggugagc

SEQ ID NO: 802419 - RNA, 17 nt, Mycobacterium avium subsp. paratuberculosis
accgcgacggugagcaa

SEQ ID NO: 802420 - RNA, 16 nt, Mycobacterium avium subsp. paratuberculosis
accgcgagacccgguc

SEQ ID NO: 802421 - RNA, 19 nt, Mycobacterium avium subsp. paratuberculosis
accgcgaguucgcgcacgc

SEQ ID NO: 802422 - RNA, 23 nt, Mycobacterium avium subsp. paratuberculosis
accgcgaguucgcgcacgcuggc

SEQ ID NO: 802423 - RNA, 17 nt, Mycobacterium avium subsp. paratuberculosis
accgcgaucagccccag

SEQ ID NO: 802424 - RNA, 20 nt, Mycobacterium avium subsp. paratuberculosis
accgcgaucagggccgcggc

SEQ ID NO: 802425 - RNA, 17 nt, Mycobacterium avium subsp. paratuberculosis
accgcgaucgccgacgu

SEQ ID NO: 802426 - RNA, 18 nt, Mycobacterium avium subsp. paratuberculosis
accgcgaucugcucggug

SEQ ID NO: 802427 - RNA, 19 nt, Mycobacterium avium subsp. paratuberculosis
accgcgaucuugcccucgu

SEQ ID NO: 802428 - RNA, 20 nt, Mycobacterium avium subsp. paratuberculosis
accgcgaaacgcaacagcga

SEQ ID NO: 802429 - RNA, 18 nt, Mycobacterium avium subsp. paratuberculosis
accgcgaaagcgucggcu

SEQ ID NO: 802430 - RNA, 20 nt, Mycobacterium avium subsp. paratuberculosis
accgcgaaagcgucggcuag

SEQ ID NO: 802431 - RNA, 22 nt, Mycobacterium avium subsp. paratuberculosis
accgcgaaagugcaacuggcaa

SEQ ID NO: 802432 - RNA, 14 nt, Mycobacterium avium subsp. paratuberculosis
accgcgaccacgcc

SEQ ID NO: 802433 - RNA, 20 nt, Mycobacterium avium subsp. paratuberculosis
accgcgaccaugcccggcgc

SEQ ID NO: 802434 - RNA, 16 nt, Mycobacterium avium subsp. paratuberculosis
accgcgacccaggccg

SEQ ID NO: 802435 - RNA, 17 nt, Mycobacterium avium subsp. paratuberculosis
accgcgacccaggccgc

SEQ ID NO: 802436 - RNA, 22 nt, Mycobacterium avium subsp. paratuberculosis
accgcgacccaggccgccgcca

SEQ ID NO: 802437 - RNA, 16 nt, Mycobacterium avium subsp. paratuberculosis
accgcgaagguggcac

SEQ ID NO: 802438 - RNA, 15 nt, Mycobacterium avium subsp. paratuberculosis
accgcgaauugaggu

SEQ ID NO: 802439 - RNA, 12 nt, Mycobacterium avium subsp. paratuberculosis
accgccugugcg

SEQ ID NO: 802440 - RNA, 14 nt, Mycobacterium avium subsp. paratuberculosis
accgccugugcgac

SEQ ID NO: 802441 - RNA, 16 nt, Mycobacterium avium subsp. paratuberculosis
accgccugugcgacgg

SEQ ID NO: 802442 - RNA, 15 nt, Mycobacterium avium subsp. paratuberculosis
accgccuuccgccac

SEQ ID NO: 802443 - RNA, 18 nt, Mycobacterium avium subsp. paratuberculosis
accgccuuccgccacgcc

SEQ ID NO: 802444 - RNA, 21 nt, Mycobacterium avium subsp. paratuberculosis
accgccuucgacggccggccc

SEQ ID NO: 802445 - RNA, 13 nt, Mycobacterium avium subsp. paratuberculosis
accgccuugcccg

SEQ ID NO: 802446 - RNA, 16 nt, Mycobacterium avium subsp. paratuberculosis
accgccuugcccggcu

SEQ ID NO: 802447 - RNA, 21 nt, Mycobacterium avium subsp. paratuberculosis
accgccuugcccggcucggug

SEQ ID NO: 802448 - RNA, 22 nt, Mycobacterium avium subsp. paratuberculosis
accgccuugcccggcucggugc

SEQ ID NO: 802449 - RNA, 16 nt, Mycobacterium avium subsp. paratuberculosis
accgccuuggccacgu

SEQ ID NO: 802450 - RNA, 22 nt, Mycobacterium avium subsp. paratuberculosis
accgccuuggccacgucgaagc

SEQ ID NO: 802451 - RNA, 14 nt, Mycobacterium avium subsp. paratuberculosis
accgccuuggcgcg

SEQ ID NO: 802452 - RNA, 13 nt, Mycobacterium avium subsp. paratuberculosis
accgccuugucgg

SEQ ID NO: 802453 - RNA, 22 nt, Mycobacterium avium subsp. paratuberculosis
accgccguggcguuacacccgc

SEQ ID NO: 802454 - RNA, 17 nt, Mycobacterium avium subsp. paratuberculosis
accgccguuccgaugaa

SEQ ID NO: 802455 - RNA, 18 nt, Mycobacterium avium subsp. paratuberculosis
accgccguuccgaugaag

SEQ ID NO: 802456 - RNA, 17 nt, Mycobacterium avium subsp. paratuberculosis
accgccggcagcggcug

SEQ ID NO: 802457 - RNA, 19 nt, Mycobacterium avium subsp. paratuberculosis
accgccggcagcggcugcu

SEQ ID NO: 802458 - RNA, 17 nt, Mycobacterium avium subsp. paratuberculosis
accgccggccaggcgac

SEQ ID NO: 802459 - RNA, 12 nt, Mycobacterium avium subsp. paratuberculosis
accgccggccca

SEQ ID NO: 802460 - RNA, 14 nt, Mycobacterium avium subsp. paratuberculosis
accgccggcccagg

SEQ ID NO: 802461 - RNA, 14 nt, Mycobacterium avium subsp. paratuberculosis
accgccggcccggc

SEQ ID NO: 802462 - RNA, 13 nt, Mycobacterium avium subsp. paratuberculosis
accgccgucgggg

SEQ ID NO: 802463 - RNA, 15 nt, Mycobacterium avium subsp. paratuberculosis
accgccgucggggcg

SEQ ID NO: 802464 - RNA, 12 nt, Mycobacterium avium subsp. paratuberculosis
accgccguggca

SEQ ID NO: 802465 - RNA, 21 nt, Mycobacterium avium subsp. paratuberculosis
accgccguggcagggccagca

SEQ ID NO: 802466 - RNA, 24 nt, Mycobacterium avium subsp. paratuberculosis
accgccguggcagggccagcagcc

SEQ ID NO: 802467 - RNA, 13 nt, Mycobacterium avium subsp. paratuberculosis
accgccugcgcga

SEQ ID NO: 802468 - RNA, 16 nt, Mycobacterium avium subsp. paratuberculosis
accgccugcgcgaucg

SEQ ID NO: 802469 - RNA, 18 nt, Mycobacterium avium subsp. paratuberculosis
accgccugcgcgaucgcc

SEQ ID NO: 802470 - RNA, 16 nt, Mycobacterium avium subsp. paratuberculosis
accgccucgauggccc

SEQ ID NO: 802471 - RNA, 18 nt, Mycobacterium avium subsp. paratuberculosis
accgccucgauggcccgc

SEQ ID NO: 802472 - RNA, 20 nt, Mycobacterium avium subsp. paratuberculosis
accgccucgauggcccgcuc

SEQ ID NO: 802473 - RNA, 15 nt, Mycobacterium avium subsp. paratuberculosis
accgccucgccagcc

SEQ ID NO: 802474 - RNA, 17 nt, Mycobacterium avium subsp. paratuberculosis
accgccucgccagcccc

SEQ ID NO: 802475 - RNA, 13 nt, Mycobacterium avium subsp. paratuberculosis
accgccucaugcc

SEQ ID NO: 802476 - RNA, 14 nt, Mycobacterium avium subsp. paratuberculosis
accgccucaugcca

SEQ ID NO: 802477 - RNA, 14 nt, Mycobacterium avium subsp. paratuberculosis
ugaggcgcgccggu

SEQ ID NO: 802478 - RNA, 16 nt, Mycobacterium avium subsp. paratuberculosis
ugaggacaccacgauc

SEQ ID NO: 802479 - RNA, 14 nt, Mycobacterium avium subsp. paratuberculosis
ugacggugccgccg

SEQ ID NO: 802480 - RNA, 16 nt, Mycobacterium avium subsp. paratuberculosis
ugacggugccgccgug

SEQ ID NO: 802481 - RNA, 18 nt, Mycobacterium avium subsp. paratuberculosis
ugacggugaccggcgcgc

SEQ ID NO: 802482 - RNA, 22 nt, Mycobacterium avium subsp. paratuberculosis
ugacggucgaccucgagcguca

SEQ ID NO: 802483 - RNA, 13 nt, Mycobacterium avium subsp. paratuberculosis
ugacggucgccga

SEQ ID NO: 802484 - RNA, 21 nt, Mycobacterium avium subsp. paratuberculosis
ugacgguggcguccucgacgg

SEQ ID NO: 802485 - RNA, 22 nt, Mycobacterium avium subsp. paratuberculosis
ugacgguggcguccucgacggu

SEQ ID NO: 802486 - RNA, 16 nt, Mycobacterium avium subsp. paratuberculosis
ugacguggcggccguc

SEQ ID NO: 802487 - RNA, 17 nt, Mycobacterium avium subsp. paratuberculosis
ugacgugguugcguucg

SEQ ID NO: 802488 - RNA, 19 nt, Mycobacterium avium subsp. paratuberculosis
ugacguuccagccgugcug

SEQ ID NO: 802489 - RNA, 18 nt, Mycobacterium avium subsp. paratuberculosis
ugacguugagcacccgga

SEQ ID NO: 802490 - RNA, 20 nt, Mycobacterium avium subsp. paratuberculosis
ugacguugaucgcgccgauc

SEQ ID NO: 802491 - RNA, 21 nt, Mycobacterium avium subsp. paratuberculosis
ugacguuggugaucgccgacg

SEQ ID NO: 802492 - RNA, 13 nt, Mycobacterium avium subsp. paratuberculosis
ugacguugcgcgc

SEQ ID NO: 802493 - RNA, 14 nt, Mycobacterium avium subsp. paratuberculosis
ugaggacgaggcgg

SEQ ID NO: 802494 - RNA, 14 nt, Mycobacterium avium subsp. paratuberculosis
ugaggacgcccggc

SEQ ID NO: 802495 - RNA, 15 nt, Mycobacterium avium subsp. paratuberculosis
ugaggacgcccggcg

SEQ ID NO: 802496 - RNA, 16 nt, Mycobacterium avium subsp. paratuberculosis
ugagcuucugcccggc

SEQ ID NO: 802497 - RNA, 15 nt, Mycobacterium avium subsp. paratuberculosis
ugaggaacgcgaccg

SEQ ID NO: 802498 - RNA, 12 nt, Mycobacterium avium subsp. paratuberculosis
ugagcgcccggu

SEQ ID NO: 802499 - RNA, 15 nt, Mycobacterium avium subsp. paratuberculosis
ugagcgcgucgucgc

SEQ ID NO: 802500 - RNA, 19 nt, Mycobacterium avium subsp. paratuberculosis
ugagcgccaccccgaaccc

SEQ ID NO: 802501 - RNA, 22 nt, Mycobacterium avium subsp. paratuberculosis
ugagcgccaccccgaacccggc

SEQ ID NO: 802502 - RNA, 17 nt, Mycobacterium avium subsp. paratuberculosis
ugagcgccagcgcggug

SEQ ID NO: 802503 - RNA, 15 nt, Mycobacterium avium subsp. paratuberculosis
ugagcgacaccaggu

SEQ ID NO: 802504 - RNA, 19 nt, Mycobacterium avium subsp. paratuberculosis
ugagcgagaugaucagccg

SEQ ID NO: 802505 - RNA, 16 nt, Mycobacterium avium subsp. paratuberculosis
ugagcgacauggucgg

SEQ ID NO: 802506 - RNA, 14 nt, Mycobacterium avium subsp. paratuberculosis
ugaucgucggcagc

SEQ ID NO: 802507 - RNA, 17 nt, Mycobacterium avium subsp. paratuberculosis
ugaucgucucggccgcg

SEQ ID NO: 802508 - RNA, 14 nt, Mycobacterium avium subsp. paratuberculosis
ugaucggugcccgc

SEQ ID NO: 802509 - RNA, 13 nt, Mycobacterium avium subsp. paratuberculosis
ugaucggccaggc

SEQ ID NO: 802510 - RNA, 17 nt, Mycobacterium avium subsp. paratuberculosis
ugaucucgucgaugacg

SEQ ID NO: 802511 - RNA, 14 nt, Mycobacterium avium subsp. paratuberculosis
ugaucucgucgcgg

SEQ ID NO: 802512 - RNA, 20 nt, Mycobacterium avium subsp. paratuberculosis
ugaucuccgcggcgaugacc

SEQ ID NO: 802513 - RNA, 14 nt, Mycobacterium avium subsp. paratuberculosis
ugaucucgccgcgg

SEQ ID NO: 802514 - RNA, 22 nt, Mycobacterium avium subsp. paratuberculosis
ugaucuuggcacgggcccgcgg

SEQ ID NO: 802515 - RNA, 17 nt, Mycobacterium avium subsp. paratuberculosis
ugaugaagccgccgacg

SEQ ID NO: 802516 - RNA, 22 nt, Mycobacterium avium subsp. paratuberculosis
ugaugaacgccucgagcgcccg

SEQ ID NO: 802517 - RNA, 18 nt, Mycobacterium avium subsp. paratuberculosis
ugaugaagaccuggccgg

SEQ ID NO: 802518 - RNA, 21 nt, Mycobacterium avium subsp. paratuberculosis
ugaugaaaccggccagcagca

SEQ ID NO: 802519 - RNA, 17 nt, Mycobacterium avium subsp. paratuberculosis
ugaugaaaaccgggccc

SEQ ID NO: 802520 - RNA, 18 nt, Mycobacterium avium subsp. paratuberculosis
ugaugaacacggucgccg

SEQ ID NO: 802521 - RNA, 19 nt, Mycobacterium avium subsp. paratuberculosis
ugaugaacacggucgccgg

SEQ ID NO: 802522 - RNA, 14 nt, Mycobacterium avium subsp. paratuberculosis
ugaugacgacguga

SEQ ID NO: 802523 - RNA, 21 nt, Mycobacterium avium subsp. paratuberculosis
ugaugacguuggugaucgccg

SEQ ID NO: 802524 - RNA, 18 nt, Mycobacterium avium subsp. paratuberculosis
ugaugcgcaagcaccggc

SEQ ID NO: 802525 - RNA, 16 nt, Mycobacterium avium subsp. paratuberculosis
ugaugcgcaccgcggc

SEQ ID NO: 802526 - RNA, 16 nt, Mycobacterium avium subsp. paratuberculosis
ugaugcgcggcgacgg

SEQ ID NO: 802527 - RNA, 18 nt, Mycobacterium avium subsp. paratuberculosis
ugaucacaccgucggcga

SEQ ID NO: 802528 - RNA, 19 nt, Mycobacterium avium subsp. paratuberculosis
ugaucgacgagccgggcca

SEQ ID NO: 802529 - RNA, 22 nt, Mycobacterium avium subsp. paratuberculosis
ugaucacccgccggguggccgc

SEQ ID NO: 802530 - RNA, 20 nt, Mycobacterium avium subsp. paratuberculosis
ugaucacgaaguugaucgcg

SEQ ID NO: 802531 - RNA, 15 nt, Mycobacterium avium subsp. paratuberculosis
ugaucacguugucgc

SEQ ID NO: 802532 - RNA, 19 nt, Mycobacterium avium subsp. paratuberculosis
ugaucgcguagcgccggua

SEQ ID NO: 802533 - RNA, 20 nt, Mycobacterium avium subsp. paratuberculosis
ugaucgcccgcuccgcggug

SEQ ID NO: 802534 - RNA, 20 nt, Mycobacterium avium subsp. paratuberculosis
ugaucgcggcccacccgcag

SEQ ID NO: 802535 - RNA, 15 nt, Mycobacterium avium subsp. paratuberculosis
ugaucgcggcccgcg

SEQ ID NO: 802536 - RNA, 15 nt, Mycobacterium avium subsp. paratuberculosis
ugaucgcggcggaca

SEQ ID NO: 802537 - RNA, 17 nt, Mycobacterium avium subsp. paratuberculosis
ugaucgccggggcgcug

SEQ ID NO: 802538 - RNA, 14 nt, Mycobacterium avium subsp. paratuberculosis
ugaucgcgaagacc

SEQ ID NO: 802539 - RNA, 12 nt, Mycobacterium avium subsp. paratuberculosis
ugaucgccgcgg

SEQ ID NO: 802540 - RNA, 11 nt, Mycobacterium avium subsp. paratuberculosis
ugaucgccgcu

SEQ ID NO: 802541 - RNA, 17 nt, Mycobacterium avium subsp. paratuberculosis
ugaucgcgauccgggcg

SEQ ID NO: 802542 - RNA, 17 nt, Mycobacterium avium subsp. paratuberculosis
ugaucgccacggcggug

SEQ ID NO: 802543 - RNA, 14 nt, Mycobacterium avium subsp. paratuberculosis
ugaucgccagcccg

SEQ ID NO: 802544 - RNA, 16 nt, Mycobacterium avium subsp. paratuberculosis
ugaucgccagcccggc

SEQ ID NO: 802545 - RNA, 15 nt, Mycobacterium avium subsp. paratuberculosis
ugaucgagccgcggc

SEQ ID NO: 802546 - RNA, 16 nt, Mycobacterium avium subsp. paratuberculosis
ugaucgagccgcggcc

SEQ ID NO: 802547 - RNA, 16 nt, Mycobacterium avium subsp. paratuberculosis
ugaucgagcaccagcg

SEQ ID NO: 802548 - RNA, 17 nt, Mycobacterium avium subsp. paratuberculosis
ugaucgagcaccgggcg

SEQ ID NO: 802549 - RNA, 20 nt, Mycobacterium avium subsp. paratuberculosis
ugacgaggagggugucggcg

SEQ ID NO: 802550 - RNA, 23 nt, Mycobacterium avium subsp. paratuberculosis
ugacgaucuguaguugcaacccg

SEQ ID NO: 802551 - RNA, 18 nt, Mycobacterium avium subsp. paratuberculosis
ugacgaugaugucgcccg

SEQ ID NO: 802552 - RNA, 20 nt, Mycobacterium avium subsp. paratuberculosis
ugacgaugaugucgcccggc

SEQ ID NO: 802553 - RNA, 22 nt, Mycobacterium avium subsp. paratuberculosis
ugacgaugaugucgcccggcgg

SEQ ID NO: 802554 - RNA, 20 nt, Mycobacterium avium subsp. paratuberculosis
ugacgaugaugucggccggc

SEQ ID NO: 802555 - RNA, 17 nt, Mycobacterium avium subsp. paratuberculosis
ugacgaugcggccggcg

SEQ ID NO: 802556 - RNA, 18 nt, Mycobacterium avium subsp. paratuberculosis
ugacgaugcggccggcgg

SEQ ID NO: 802557 - RNA, 14 nt, Mycobacterium avium subsp. paratuberculosis
ugacgagcagcgug

SEQ ID NO: 802558 - RNA, 18 nt, Mycobacterium avium subsp. paratuberculosis
ugacgacggucaccggca

SEQ ID NO: 802559 - RNA, 22 nt, Mycobacterium avium subsp. paratuberculosis
ugacgacgugauaguggucguc

SEQ ID NO: 802560 - RNA, 18 nt, Mycobacterium avium subsp. paratuberculosis
ugacgacguuggccagca

SEQ ID NO: 802561 - RNA, 19 nt, Mycobacterium avium subsp. paratuberculosis
ugacgaccuugucgcgcac

SEQ ID NO: 802562 - RNA, 15 nt, Mycobacterium avium subsp. paratuberculosis
ugacgaccggguccg

SEQ ID NO: 802563 - RNA, 13 nt, Mycobacterium avium subsp. paratuberculosis
ugacgaccugguc

SEQ ID NO: 802564 - RNA, 15 nt, Mycobacterium avium subsp. paratuberculosis
ugacgaccuggucgc

SEQ ID NO: 802565 - RNA, 18 nt, Mycobacterium avium subsp. paratuberculosis
ugacgaccuggucgccgc

SEQ ID NO: 802566 - RNA, 19 nt, Mycobacterium avium subsp. paratuberculosis
ugacgaccuggucgccgcc

SEQ ID NO: 802567 - RNA, 20 nt, Mycobacterium avium subsp. paratuberculosis
ugacgaccuggucgccgccg

SEQ ID NO: 802568 - RNA, 22 nt, Mycobacterium avium subsp. paratuberculosis
ugacgaccuggucgccgccguc

SEQ ID NO: 802569 - RNA, 13 nt, Mycobacterium avium subsp. paratuberculosis
ugacgaccggcag

SEQ ID NO: 802570 - RNA, 14 nt, Mycobacterium avium subsp. paratuberculosis
ugacgaccggcagc

SEQ ID NO: 802571 - RNA, 19 nt, Mycobacterium avium subsp. paratuberculosis
ugacgaccggcagccgcgc

SEQ ID NO: 802572 - RNA, 22 nt, Mycobacterium avium subsp. paratuberculosis
ugacgaccggcagccgcgccca

SEQ ID NO: 802573 - RNA, 13 nt, Mycobacterium avium subsp. paratuberculosis
ugacgccgacgua

SEQ ID NO: 802574 - RNA, 13 nt, Mycobacterium avium subsp. paratuberculosis
ugacgccgggccg

SEQ ID NO: 802575 - RNA, 17 nt, Mycobacterium avium subsp. paratuberculosis
ugacgccgggccgccgc

SEQ ID NO: 802576 - RNA, 22 nt, Mycobacterium avium subsp. paratuberculosis
ugacgccgggccgccgcggcca

SEQ ID NO: 802577 - RNA, 21 nt, Mycobacterium avium subsp. paratuberculosis
ugacgccggucgcugcgauga

SEQ ID NO: 802578 - RNA, 19 nt, Mycobacterium avium subsp. paratuberculosis
ugacgccugcggcccagcg

SEQ ID NO: 802579 - RNA, 16 nt, Mycobacterium avium subsp. paratuberculosis
ugacgccacgcgucag

SEQ ID NO: 802580 - RNA, 19 nt, Mycobacterium avium subsp. paratuberculosis
ugacgcccccggugacgau

SEQ ID NO: 802581 - RNA, 15 nt, Mycobacterium avium subsp. paratuberculosis
ugacgcccggcgccg

SEQ ID NO: 802582 - RNA, 13 nt, Mycobacterium avium subsp. paratuberculosis
ugacgccgcgccg

SEQ ID NO: 802583 - RNA, 19 nt, Mycobacterium avium subsp. paratuberculosis
ugacgccgcgccgcccggc

SEQ ID NO: 802584 - RNA, 11 nt, Mycobacterium avium subsp. paratuberculosis
ugacgccgcgg

SEQ ID NO: 802585 - RNA, 20 nt, Mycobacterium avium subsp. paratuberculosis
ugacgccgcgguuggucacc

SEQ ID NO: 802586 - RNA, 19 nt, Mycobacterium avium subsp. paratuberculosis
ugacgccgcucggccagcg

SEQ ID NO: 802587 - RNA, 21 nt, Mycobacterium avium subsp. paratuberculosis
ugacgccgcuguccucgucgg

SEQ ID NO: 802588 - RNA, 20 nt, Mycobacterium avium subsp. paratuberculosis
ugacgccggacagcuggcgg

SEQ ID NO: 802589 - RNA, 22 nt, Mycobacterium avium subsp. paratuberculosis
ugacgcaccucgcucagcccgg

SEQ ID NO: 802590 - RNA, 14 nt, Mycobacterium avium subsp. paratuberculosis
ugacgcggcgucgg

SEQ ID NO: 802591 - RNA, 21 nt, Mycobacterium avium subsp. paratuberculosis
ugacgcgggaccgggcccggc

SEQ ID NO: 802592 - RNA, 18 nt, Mycobacterium avium subsp. paratuberculosis
ugacgcgaaugucgacca

SEQ ID NO: 802593 - RNA, 21 nt, Mycobacterium avium subsp. paratuberculosis
ugacgcgaaugucgaccaccg

SEQ ID NO: 802594 - RNA, 17 nt, Mycobacterium avium subsp. paratuberculosis
ugacgcgaccgcgcggc

SEQ ID NO: 802595 - RNA, 19 nt, Mycobacterium avium subsp. paratuberculosis
ugacgcgccggcccagacg

SEQ ID NO: 802596 - RNA, 20 nt, Mycobacterium avium subsp. paratuberculosis
ugacgcgcgugacggcgggg

SEQ ID NO: 802597 - RNA, 21 nt, Mycobacterium avium subsp. paratuberculosis
ugacggacuugggcgucucga

SEQ ID NO: 802598 - RNA, 15 nt, Mycobacterium avium subsp. paratuberculosis
ugacgcucacccggc

SEQ ID NO: 802599 - RNA, 16 nt, Mycobacterium avium subsp. paratuberculosis
ugacgcucgacggccg

SEQ ID NO: 802600 - RNA, 18 nt, Mycobacterium avium subsp. paratuberculosis
ugacgcucgacggccggc

SEQ ID NO: 802601 - RNA, 22 nt, Mycobacterium avium subsp. paratuberculosis
ugacgcucgacggccggcguca

SEQ ID NO: 802602 - RNA, 24 nt, Mycobacterium avium subsp. paratuberculosis
ugacgcucgaggccccgcgugacg

SEQ ID NO: 802603 - RNA, 13 nt, Mycobacterium avium subsp. paratuberculosis
ugacgcucgccgg

SEQ ID NO: 802604 - RNA, 14 nt, Mycobacterium avium subsp. paratuberculosis
ugacgcucgccggc

SEQ ID NO: 802605 - RNA, 17 nt, Mycobacterium avium subsp. paratuberculosis
ugacgcucgccggcggc

SEQ ID NO: 802606 - RNA, 13 nt, Mycobacterium avium subsp. paratuberculosis
ugacgcucggccg

SEQ ID NO: 802607 - RNA, 19 nt, Mycobacterium avium subsp. paratuberculosis
ugacgcucggccguggccg

SEQ ID NO: 802608 - RNA, 13 nt, Mycobacterium avium subsp. paratuberculosis
ugacgcucggcgc

SEQ ID NO: 802609 - RNA, 15 nt, Mycobacterium avium subsp. paratuberculosis
ugacgcucggcgcgu

SEQ ID NO: 802610 - RNA, 14 nt, Mycobacterium avium subsp. paratuberculosis
ugacgcucggcggc

SEQ ID NO: 802611 - RNA, 12 nt, Mycobacterium avium subsp. paratuberculosis
ugacgcucgggg

SEQ ID NO: 802612 - RNA, 20 nt, Mycobacterium avium subsp. paratuberculosis
ugacggcucuucggcgccga

SEQ ID NO: 802613 - RNA, 22 nt, Mycobacterium avium subsp. paratuberculosis
ugacggcucuucggcgccgagc

SEQ ID NO: 802614 - RNA, 16 nt, Mycobacterium avium subsp. paratuberculosis
ugacggcgucggcgau

SEQ ID NO: 802615 - RNA, 17 nt, Mycobacterium avium subsp. paratuberculosis
ugacggcgucggcgauc

SEQ ID NO: 802616 - RNA, 19 nt, Mycobacterium avium subsp. paratuberculosis
ugacggauccgggcgccgg

SEQ ID NO: 802617 - RNA, 20 nt, Mycobacterium avium subsp. paratuberculosis
ugacggauccgggcgccggu

SEQ ID NO: 802618 - RNA, 24 nt, Mycobacterium avium subsp. paratuberculosis
ugacggauguggucggccacgacg

SEQ ID NO: 802619 - RNA, 18 nt, Mycobacterium avium subsp. paratuberculosis
ugacggccgggcccucgg

SEQ ID NO: 802620 - RNA, 22 nt, Mycobacterium avium subsp. paratuberculosis
ugacggccucccacucgucgau

SEQ ID NO: 802621 - RNA, 23 nt, Mycobacterium avium subsp. paratuberculosis
ugacggccucccacucgucgauc

SEQ ID NO: 802622 - RNA, 18 nt, Mycobacterium avium subsp. paratuberculosis
ugacggccugggcgacca

SEQ ID NO: 802623 - RNA, 21 nt, Mycobacterium avium subsp. paratuberculosis
ugacggccaugaauucgaacu

SEQ ID NO: 802624 - RNA, 12 nt, Mycobacterium avium subsp. paratuberculosis
ugacggcccacg

SEQ ID NO: 802625 - RNA, 19 nt, Mycobacterium avium subsp. paratuberculosis
ugacggcccacgucgcgcc

SEQ ID NO: 802626 - RNA, 11 nt, Mycobacterium avium subsp. paratuberculosis
ugacgggccgc

SEQ ID NO: 802627 - RNA, 16 nt, Mycobacterium avium subsp. paratuberculosis
ugacgggccgcggcca

SEQ ID NO: 802628 - RNA, 14 nt, Mycobacterium avium subsp. paratuberculosis
ugacgggcgucggc

SEQ ID NO: 802629 - RNA, 16 nt, Mycobacterium avium subsp. paratuberculosis
ugacggucuugcggcc

SEQ ID NO: 802630 - RNA, 18 nt, Mycobacterium avium subsp. paratuberculosis
ugacggguuggucggcgc

SEQ ID NO: 802631 - RNA, 18 nt, Mycobacterium avium subsp. paratuberculosis
ugacggucaugccgagcc

SEQ ID NO: 802632 - RNA, 19 nt, Mycobacterium avium subsp. paratuberculosis
ugacggucaugccgagccg

SEQ ID NO: 802633 - RNA, 18 nt, Mycobacterium avium subsp. paratuberculosis
ugacgaacaucgacgacg

SEQ ID NO: 802634 - RNA, 19 nt, Mycobacterium avium subsp. paratuberculosis
ugacgaacaucgacgacgg

SEQ ID NO: 802635 - RNA, 21 nt, Mycobacterium avium subsp. paratuberculosis
ugacgaacaugcugccgccgg

SEQ ID NO: 802636 - RNA, 18 nt, Mycobacterium avium subsp. paratuberculosis
ugacgaacccgccgcggc

SEQ ID NO: 802637 - RNA, 15 nt, Mycobacterium avium subsp. paratuberculosis
ugacgaacgacgugu

SEQ ID NO: 802638 - RNA, 14 nt, Mycobacterium avium subsp. paratuberculosis
ugacgaacgcgccg

SEQ ID NO: 802639 - RNA, 15 nt, Mycobacterium avium subsp. paratuberculosis
ugacgaacgcgccgc

SEQ ID NO: 802640 - RNA, 16 nt, Mycobacterium avium subsp. paratuberculosis
ugacgaacgcgccgcc

SEQ ID NO: 802641 - RNA, 21 nt, Mycobacterium avium subsp. paratuberculosis
ugacgaacucguuggcguggc

SEQ ID NO: 802642 - RNA, 19 nt, Mycobacterium avium subsp. paratuberculosis
ugacgaauuccgcaccggu

SEQ ID NO: 802643 - RNA, 16 nt, Mycobacterium avium subsp. paratuberculosis
ugaccuucucccgcgg

SEQ ID NO: 802644 - RNA, 16 nt, Mycobacterium avium subsp. paratuberculosis
ugaccuugcgggcggu

SEQ ID NO: 802645 - RNA, 20 nt, Mycobacterium avium subsp. paratuberculosis
ugaccuugcgggcggucagc

SEQ ID NO: 802646 - RNA, 20 nt, Mycobacterium avium subsp. paratuberculosis
ugaccugcuugagcccgucg

SEQ ID NO: 802647 - RNA, 14 nt, Mycobacterium avium subsp. paratuberculosis
ugaccgucgccgac

SEQ ID NO: 802648 - RNA, 17 nt, Mycobacterium avium subsp. paratuberculosis
ugaccgucgccgaccag

SEQ ID NO: 802649 - RNA, 22 nt, Mycobacterium avium subsp. paratuberculosis
ugaccgucacccccggcgcgac

SEQ ID NO: 802650 - RNA, 17 nt, Mycobacterium avium subsp. paratuberculosis
ugaccgggucgccgauc

SEQ ID NO: 802651 - RNA, 17 nt, Mycobacterium avium subsp. paratuberculosis
ugaccggugcgcccgcg

SEQ ID NO: 802652 - RNA, 20 nt, Mycobacterium avium subsp. paratuberculosis
ugaccggugcgcccgcgauc

SEQ ID NO: 802653 - RNA, 17 nt, Mycobacterium avium subsp. paratuberculosis
ugaccggcgccgggucg

SEQ ID NO: 802654 - RNA, 15 nt, Mycobacterium avium subsp. paratuberculosis
ugaccggcgcgcagc

SEQ ID NO: 802655 - RNA, 13 nt, Mycobacterium avium subsp. paratuberculosis
ugaccggccaccu

SEQ ID NO: 802656 - RNA, 21 nt, Mycobacterium avium subsp. paratuberculosis
ugaccggccugcagcgcgguc

SEQ ID NO: 802657 - RNA, 17 nt, Mycobacterium avium subsp. paratuberculosis
ugaccuccuugcccagc

SEQ ID NO: 802658 - RNA, 18 nt, Mycobacterium avium subsp. paratuberculosis
ugaccucgagcaccggcg

SEQ ID NO: 802659 - RNA, 16 nt, Mycobacterium avium subsp. paratuberculosis
ugaccucgagcagcgc

SEQ ID NO: 802660 - RNA, 15 nt, Mycobacterium avium subsp. paratuberculosis
ugaccucgcgcccgg

SEQ ID NO: 802661 - RNA, 20 nt, Mycobacterium avium subsp. paratuberculosis
ugaccucgcgcccggcgccg

SEQ ID NO: 802662 - RNA, 15 nt, Mycobacterium avium subsp. paratuberculosis
ugaccucgcgccgcg

SEQ ID NO: 802663 - RNA, 19 nt, Mycobacterium avium subsp. paratuberculosis
ugaccgccuuggcgcgcuc

SEQ ID NO: 802664 - RNA, 15 nt, Mycobacterium avium subsp. paratuberculosis
ugaccgcgacgcugc

SEQ ID NO: 802665 - RNA, 16 nt, Mycobacterium avium subsp. paratuberculosis
ugaccgccugcggcag

SEQ ID NO: 802666 - RNA, 12 nt, Mycobacterium avium subsp. paratuberculosis
ugaccgcccggg

SEQ ID NO: 802667 - RNA, 14 nt, Mycobacterium avium subsp. paratuberculosis
ugaccgccgacacc

SEQ ID NO: 802668 - RNA, 13 nt, Mycobacterium avium subsp. paratuberculosis
ugaccgcccagga

SEQ ID NO: 802669 - RNA, 14 nt, Mycobacterium avium subsp. paratuberculosis
ugaccggcggccag

SEQ ID NO: 802670 - RNA, 20 nt, Mycobacterium avium subsp. paratuberculosis
ugaccggcggugccggccag

SEQ ID NO: 802671 - RNA, 16 nt, Mycobacterium avium subsp. paratuberculosis
ugaccggcccggcggc

SEQ ID NO: 802672 - RNA, 22 nt, Mycobacterium avium subsp. paratuberculosis
ugaccggcccggcggccggccg

SEQ ID NO: 802673 - RNA, 21 nt, Mycobacterium avium subsp. paratuberculosis
ugaccgcggccucgucgaggu

SEQ ID NO: 802674 - RNA, 23 nt, Mycobacterium avium subsp. paratuberculosis
ugaccgcgggugaggggcgcgcg

SEQ ID NO: 802675 - RNA, 17 nt, Mycobacterium avium subsp. paratuberculosis
ugaccggaucggccagc

SEQ ID NO: 802676 - RNA, 15 nt, Mycobacterium avium subsp. paratuberculosis
ugaccgcgccgcggg

SEQ ID NO: 802677 - RNA, 13 nt, Mycobacterium avium subsp. paratuberculosis
ugaccgcggacac

SEQ ID NO: 802678 - RNA, 14 nt, Mycobacterium avium subsp. paratuberculosis
ugaccgcgucggcg

SEQ ID NO: 802679 - RNA, 19 nt, Mycobacterium avium subsp. paratuberculosis
ugaccgcgucggcgccgua

SEQ ID NO: 802680 - RNA, 16 nt, Mycobacterium avium subsp. paratuberculosis
ugaacgccucgggccg

SEQ ID NO: 802681 - RNA, 18 nt, Mycobacterium avium subsp. paratuberculosis
ugaacgccucgggccggc

SEQ ID NO: 802682 - RNA, 13 nt, Mycobacterium avium subsp. paratuberculosis
ugaacgccgcguc

SEQ ID NO: 802683 - RNA, 12 nt, Mycobacterium avium subsp. paratuberculosis
ugaacgccgcca

SEQ ID NO: 802684 - RNA, 17 nt, Mycobacterium avium subsp. paratuberculosis
ugaacgccgcccccgcc

SEQ ID NO: 802685 - RNA, 15 nt, Mycobacterium avium subsp. paratuberculosis
ugacccggcccauca

SEQ ID NO: 802686 - RNA, 23 nt, Mycobacterium avium subsp. paratuberculosis
ugacccggcccaucaccggaccg

SEQ ID NO: 802687 - RNA, 13 nt, Mycobacterium avium subsp. paratuberculosis
ugacccggccggu

SEQ ID NO: 802688 - RNA, 19 nt, Mycobacterium avium subsp. paratuberculosis
ugacccggccgugcgcagc

SEQ ID NO: 802689 - RNA, 22 nt, Mycobacterium avium subsp. paratuberculosis
ugacccggccguugggccagcg

SEQ ID NO: 802690 - RNA, 16 nt, Mycobacterium avium subsp. paratuberculosis
ugaccgauccgccggc

SEQ ID NO: 802691 - RNA, 17 nt, Mycobacterium avium subsp. paratuberculosis
ugaccgauccgccggcg

SEQ ID NO: 802692 - RNA, 18 nt, Mycobacterium avium subsp. paratuberculosis
ugaccgauggccgcccgc

SEQ ID NO: 802693 - RNA, 17 nt, Mycobacterium avium subsp. paratuberculosis
ugaccgacgacgugacg

SEQ ID NO: 802694 - RNA, 18 nt, Mycobacterium avium subsp. paratuberculosis
ugaccgacauggccagca

SEQ ID NO: 802695 - RNA, 21 nt, Mycobacterium avium subsp. paratuberculosis
ugaccgacauggccagcacca

SEQ ID NO: 802696 - RNA, 22 nt, Mycobacterium avium subsp. paratuberculosis
ugaccgacauggccagcaccau

SEQ ID NO: 802697 - RNA, 15 nt, Mycobacterium avium subsp. paratuberculosis
ugacccugccgucac

SEQ ID NO: 802698 - RNA, 20 nt, Mycobacterium avium subsp. paratuberculosis
ugacccugccgucaccggcc

SEQ ID NO: 802699 - RNA, 22 nt, Mycobacterium avium subsp. paratuberculosis
ugcagaacaauguuuuucugcu

SEQ ID NO: 802700 - RNA, 14 nt, Mycobacterium avium subsp. paratuberculosis
ugcagaacagccgg

SEQ ID NO: 802701 - RNA, 18 nt, Mycobacterium avium subsp. paratuberculosis
ugcagaacagccgguccg

SEQ ID NO: 802702 - RNA, 14 nt, Mycobacterium avium subsp. paratuberculosis
ugcacugccgaccc

SEQ ID NO: 802703 - RNA, 15 nt, Mycobacterium avium subsp. paratuberculosis
ugcacucggcgaugc

SEQ ID NO: 802704 - RNA, 20 nt, Mycobacterium avium subsp. paratuberculosis
ugcacucggcgaugcgccgu

SEQ ID NO: 802705 - RNA, 19 nt, Mycobacterium avium subsp. paratuberculosis
ugcacggcgcuggcgacca

SEQ ID NO: 802706 - RNA, 13 nt, Mycobacterium avium subsp. paratuberculosis
ugcacggcggcga

SEQ ID NO: 802707 - RNA, 21 nt, Mycobacterium avium subsp. paratuberculosis
ugcacggucagcucgcgcccg

SEQ ID NO: 802708 - RNA, 15 nt, Mycobacterium avium subsp. paratuberculosis
ugcacggcgccacca

SEQ ID NO: 802709 - RNA, 14 nt, Mycobacterium avium subsp. paratuberculosis
ugcacggcgccgug

SEQ ID NO: 802710 - RNA, 12 nt, Mycobacterium avium subsp. paratuberculosis
ugcacggccaac

SEQ ID NO: 802711 - RNA, 15 nt, Mycobacterium avium subsp. paratuberculosis
ugcacggugcgccgg

SEQ ID NO: 802712 - RNA, 16 nt, Mycobacterium avium subsp. paratuberculosis
ugcacggugcgccggc

SEQ ID NO: 802713 - RNA, 20 nt, Mycobacterium avium subsp. paratuberculosis
ugcacgguguagacgcgggc

SEQ ID NO: 802714 - RNA, 20 nt, Mycobacterium avium subsp. paratuberculosis
ugcacguccgccuccgacca

SEQ ID NO: 802715 - RNA, 17 nt, Mycobacterium avium subsp. paratuberculosis
ugcacgucggcggccgc

SEQ ID NO: 802716 - RNA, 19 nt, Mycobacterium avium subsp. paratuberculosis
ugcacgugcaccgcggcca

SEQ ID NO: 802717 - RNA, 15 nt, Mycobacterium avium subsp. paratuberculosis
ugcacgcacggcgaa

SEQ ID NO: 802718 - RNA, 22 nt, Mycobacterium avium subsp. paratuberculosis
ugcacgcaaaaaccaugccagu

SEQ ID NO: 802719 - RNA, 16 nt, Mycobacterium avium subsp. paratuberculosis
ugcacgaucucggcgg

SEQ ID NO: 802720 - RNA, 21 nt, Mycobacterium avium subsp. paratuberculosis
ugcacgagcgucgugcgggcu

SEQ ID NO: 802721 - RNA, 17 nt, Mycobacterium avium subsp. paratuberculosis
ugcacgacgaccgcgac

SEQ ID NO: 802722 - RNA, 20 nt, Mycobacterium avium subsp. paratuberculosis
ugcacgacgaccgcgacggc

SEQ ID NO: 802723 - RNA, 19 nt, Mycobacterium avium subsp. paratuberculosis
ugcacgacgaccgcguccg

SEQ ID NO: 802724 - RNA, 20 nt, Mycobacterium avium subsp. paratuberculosis
ugcacgaaauaaccgcgcgg

SEQ ID NO: 802725 - RNA, 23 nt, Mycobacterium avium subsp. paratuberculosis
ugcacgcguugcagcgccgcggc

SEQ ID NO: 802726 - RNA, 13 nt, Mycobacterium avium subsp. paratuberculosis
ugcacgcucggcg

SEQ ID NO: 802727 - RNA, 22 nt, Mycobacterium avium subsp. paratuberculosis
ugcaccagggcgucgagcgcgu

SEQ ID NO: 802728 - RNA, 22 nt, Mycobacterium avium subsp. paratuberculosis
ugcacgccguggcggcgggcca

SEQ ID NO: 802729 - RNA, 17 nt, Mycobacterium avium subsp. paratuberculosis
ugaugggcagcgccccg

SEQ ID NO: 802730 - RNA, 16 nt, Mycobacterium avium subsp. paratuberculosis
ugaugggugggcagcu

SEQ ID NO: 802731 - RNA, 19 nt, Mycobacterium avium subsp. paratuberculosis
ugaugggugggcagcucgg

SEQ ID NO: 802732 - RNA, 15 nt, Mycobacterium avium subsp. paratuberculosis
ugauggucagccgca

SEQ ID NO: 802733 - RNA, 21 nt, Mycobacterium avium subsp. paratuberculosis
ugauggcgaaccagcgcccgc

SEQ ID NO: 802734 - RNA, 15 nt, Mycobacterium avium subsp. paratuberculosis
ugauggcgucgacgu

SEQ ID NO: 802735 - RNA, 23 nt, Mycobacterium avium subsp. paratuberculosis
ugauggcgucgacgugcgcggcg

SEQ ID NO: 802736 - RNA, 18 nt, Mycobacterium avium subsp. paratuberculosis
ugaugcggucggcgcggg

SEQ ID NO: 802737 - RNA, 21 nt, Mycobacterium avium subsp. paratuberculosis
ugaugcgucccguuggcgccg

SEQ ID NO: 802738 - RNA, 15 nt, Mycobacterium avium subsp. paratuberculosis
ugaugcggcccgacc

SEQ ID NO: 802739 - RNA, 14 nt, Mycobacterium avium subsp. paratuberculosis
ugaugcugcccggc

SEQ ID NO: 802740 - RNA, 16 nt, Mycobacterium avium subsp. paratuberculosis
ugaugcuggcaacguc

SEQ ID NO: 802741 - RNA, 12 nt, Mycobacterium avium subsp. paratuberculosis
ugauggccgccg

SEQ ID NO: 802742 - RNA, 24 nt, Mycobacterium avium subsp. paratuberculosis
ugauggccgcgccgccgcccuggc

SEQ ID NO: 802743 - RNA, 18 nt, Mycobacterium avium subsp. paratuberculosis
ugauggccaucuggccgc

SEQ ID NO: 802744 - RNA, 13 nt, Mycobacterium avium subsp. paratuberculosis
ugcaccagcgugg

SEQ ID NO: 802745 - RNA, 14 nt, Mycobacterium avium subsp. paratuberculosis
ugcaccagcguggu

SEQ ID NO: 802746 - RNA, 13 nt, Mycobacterium avium subsp. paratuberculosis
ugcaccagcucgg

SEQ ID NO: 802747 - RNA, 21 nt, Mycobacterium avium subsp. paratuberculosis
ugcaccagcucggugaucacc

SEQ ID NO: 802748 - RNA, 21 nt, Mycobacterium avium subsp. paratuberculosis
ugcaccagcacgacaccgacg

SEQ ID NO: 802749 - RNA, 15 nt, Mycobacterium avium subsp. paratuberculosis
ugcacccaccggccc

SEQ ID NO: 802750 - RNA, 21 nt, Mycobacterium avium subsp. paratuberculosis
ugcacccaccggcccagccgg

SEQ ID NO: 802751 - RNA, 15 nt, Mycobacterium avium subsp. paratuberculosis
ugcacccaccggcgc

SEQ ID NO: 802752 - RNA, 19 nt, Mycobacterium avium subsp. paratuberculosis
ugcaccaccacacccagcg

SEQ ID NO: 802753 - RNA, 13 nt, Mycobacterium avium subsp. paratuberculosis
ugcaccacccagg

SEQ ID NO: 802754 - RNA, 20 nt, Mycobacterium avium subsp. paratuberculosis
ugcaccacgaagcgggcggc

SEQ ID NO: 802755 - RNA, 13 nt, Mycobacterium avium subsp. paratuberculosis
ugaugguggcgcg

SEQ ID NO: 802756 - RNA, 17 nt, Mycobacterium avium subsp. paratuberculosis
ugauguagcggcggucg

SEQ ID NO: 802757 - RNA, 14 nt, Mycobacterium avium subsp. paratuberculosis
ugcagaccggacag

SEQ ID NO: 802758 - RNA, 12 nt, Mycobacterium avium subsp. paratuberculosis
ugcagaccagcc

SEQ ID NO: 802759 - RNA, 21 nt, Mycobacterium avium subsp. paratuberculosis
ugcagagcgaugggcgcgauc

SEQ ID NO: 802760 - RNA, 20 nt, Mycobacterium avium subsp. paratuberculosis
ugcagauccagaugccgggu

SEQ ID NO: 802761 - RNA, 15 nt, Mycobacterium avium subsp. paratuberculosis
ugcagcaacaugauu

SEQ ID NO: 802762 - RNA, 14 nt, Mycobacterium avium subsp. paratuberculosis
ugcagcacaacggc

SEQ ID NO: 802763 - RNA, 15 nt, Mycobacterium avium subsp. paratuberculosis
ugcagcacaccggca

SEQ ID NO: 802764 - RNA, 13 nt, Mycobacterium avium subsp. paratuberculosis
ugcagcacagcgg

SEQ ID NO: 802765 - RNA, 14 nt, Mycobacterium avium subsp. paratuberculosis
ugcagcacagcggg

SEQ ID NO: 802766 - RNA, 18 nt, Mycobacterium avium subsp. paratuberculosis
ugcagcaccgaaccggcg

SEQ ID NO: 802767 - RNA, 21 nt, Mycobacterium avium subsp. paratuberculosis
ugcagcaccgaaccggcgggg

SEQ ID NO: 802768 - RNA, 14 nt, Mycobacterium avium subsp. paratuberculosis
ugcagcaccgccag

SEQ ID NO: 802769 - RNA, 12 nt, Mycobacterium avium subsp. paratuberculosis
ugcagcagccgg

SEQ ID NO: 802770 - RNA, 22 nt, Mycobacterium avium subsp. paratuberculosis
ugcagcacgcccagaucgacgc

SEQ ID NO: 802771 - RNA, 13 nt, Mycobacterium avium subsp. paratuberculosis
ugcagcacgccgc

SEQ ID NO: 802772 - RNA, 17 nt, Mycobacterium avium subsp. paratuberculosis
ugcagcaacucgcgcuc

SEQ ID NO: 802773 - RNA, 15 nt, Mycobacterium avium subsp. paratuberculosis
ugcagcagggcgcgc

SEQ ID NO: 802774 - RNA, 23 nt, Mycobacterium avium subsp. paratuberculosis
ugcagcagcgacuugaccagcag

SEQ ID NO: 802775 - RNA, 14 nt, Mycobacterium avium subsp. paratuberculosis
ugcagcagcgccgc

SEQ ID NO: 802776 - RNA, 19 nt, Mycobacterium avium subsp. paratuberculosis
ugcagcagcgccgcgacga

SEQ ID NO: 802777 - RNA, 16 nt, Mycobacterium avium subsp. paratuberculosis
ugcagcagcucggcga

SEQ ID NO: 802778 - RNA, 21 nt, Mycobacterium avium subsp. paratuberculosis
ugcagcagcucggcgaucacc

SEQ ID NO: 802779 - RNA, 23 nt, Mycobacterium avium subsp. paratuberculosis
ugcagcagcucggcgaucaccgc

SEQ ID NO: 802780 - RNA, 12 nt, Mycobacterium avium subsp. paratuberculosis
ugcagcgucggg

SEQ ID NO: 802781 - RNA, 13 nt, Mycobacterium avium subsp. paratuberculosis
ugcagcgcggcga

SEQ ID NO: 802782 - RNA, 15 nt, Mycobacterium avium subsp. paratuberculosis
ugcagcgcggcgauc

SEQ ID NO: 802783 - RNA, 17 nt, Mycobacterium avium subsp. paratuberculosis
ugcagcgccguccgcac

SEQ ID NO: 802784 - RNA, 21 nt, Mycobacterium avium subsp. paratuberculosis
ugcagcgagaccucccggcgc

SEQ ID NO: 802785 - RNA, 13 nt, Mycobacterium avium subsp. paratuberculosis
ugcagcgccgagg

SEQ ID NO: 802786 - RNA, 12 nt, Mycobacterium avium subsp. paratuberculosis
ugcagcgccgcg

SEQ ID NO: 802787 - RNA, 20 nt, Mycobacterium avium subsp. paratuberculosis
ugcagcgacggaucggccgc

SEQ ID NO: 802788 - RNA, 17 nt, Mycobacterium avium subsp. paratuberculosis
ugcagcgccagcaccgg

SEQ ID NO: 802789 - RNA, 21 nt, Mycobacterium avium subsp. paratuberculosis
ugcagcgccagcaccgggccc

SEQ ID NO: 802790 - RNA, 16 nt, Mycobacterium avium subsp. paratuberculosis
ugcagcgcccagccga

SEQ ID NO: 802791 - RNA, 17 nt, Mycobacterium avium subsp. paratuberculosis
ugcagcgcccagccgag

SEQ ID NO: 802792 - RNA, 21 nt, Mycobacterium avium subsp. paratuberculosis
ugcagccggccaacagcagcg

SEQ ID NO: 802793 - RNA, 21 nt, Mycobacterium avium subsp. paratuberculosis
ugcagccggccaucucggcgg

SEQ ID NO: 802794 - RNA, 17 nt, Mycobacterium avium subsp. paratuberculosis
ugcagccggcgcggcag

SEQ ID NO: 802795 - RNA, 18 nt, Mycobacterium avium subsp. paratuberculosis
ugcagcccgcguccagca

SEQ ID NO: 802796 - RNA, 13 nt, Mycobacterium avium subsp. paratuberculosis
ugcagccgggccu

SEQ ID NO: 802797 - RNA, 19 nt, Mycobacterium avium subsp. paratuberculosis
ugcagccgggcggcgccga

SEQ ID NO: 802798 - RNA, 18 nt, Mycobacterium avium subsp. paratuberculosis
ugcagccgggugcggugc

SEQ ID NO: 802799 - RNA, 19 nt, Mycobacterium avium subsp. paratuberculosis
ugcagccggguggcccgcc

SEQ ID NO: 802800 - RNA, 14 nt, Mycobacterium avium subsp. paratuberculosis
ugcagccgguccgg

SEQ ID NO: 802801 - RNA, 23 nt, Mycobacterium avium subsp. paratuberculosis
ugcagccgguccggcggcaccac

SEQ ID NO: 802802 - RNA, 19 nt, Mycobacterium avium subsp. paratuberculosis
ugcaggauccgcucgacga

SEQ ID NO: 802803 - RNA, 20 nt, Mycobacterium avium subsp. paratuberculosis
ugcaggaugaccgcgucggc

SEQ ID NO: 802804 - RNA, 15 nt, Mycobacterium avium subsp. paratuberculosis
ugcaggccacgccca

SEQ ID NO: 802805 - RNA, 18 nt, Mycobacterium avium subsp. paratuberculosis
ugcaggcaggccggcagc

SEQ ID NO: 802806 - RNA, 22 nt, Mycobacterium avium subsp. paratuberculosis
ugcagcuggcgaauccgggccu

SEQ ID NO: 802807 - RNA, 21 nt, Mycobacterium avium subsp. paratuberculosis
ugcagcuccucggcggccucg

SEQ ID NO: 802808 - RNA, 18 nt, Mycobacterium avium subsp. paratuberculosis
ugcagcuccuugagccgc

SEQ ID NO: 802809 - RNA, 18 nt, Mycobacterium avium subsp. paratuberculosis
ugcauagucggcccgauc

SEQ ID NO: 802810 - RNA, 16 nt, Mycobacterium avium subsp. paratuberculosis
ugcaggcccucgacgu

SEQ ID NO: 802811 - RNA, 15 nt, Mycobacterium avium subsp. paratuberculosis
ugccagaacggcggc

SEQ ID NO: 802812 - RNA, 22 nt, Mycobacterium avium subsp. paratuberculosis
ugccagaacggcggcagcgagg

SEQ ID NO: 802813 - RNA, 20 nt, Mycobacterium avium subsp. paratuberculosis
ugccagaagaucugccggug

SEQ ID NO: 802814 - RNA, 19 nt, Mycobacterium avium subsp. paratuberculosis
ugccacugagcgcaggccg

SEQ ID NO: 802815 - RNA, 17 nt, Mycobacterium avium subsp. paratuberculosis
ugccacguacaccggga

SEQ ID NO: 802816 - RNA, 15 nt, Mycobacterium avium subsp. paratuberculosis
ugcauagcuggcgcc

SEQ ID NO: 802817 - RNA, 12 nt, Mycobacterium avium subsp. paratuberculosis
ugccacggccgc

SEQ ID NO: 802818 - RNA, 20 nt, Mycobacterium avium subsp. paratuberculosis
ugccagacgaacgcggccgc

SEQ ID NO: 802819 - RNA, 24 nt, Mycobacterium avium subsp. paratuberculosis
ugccaugccggguuucggcccggc

SEQ ID NO: 802820 - RNA, 17 nt, Mycobacterium avium subsp. paratuberculosis
ugcccagauacgccgcg

SEQ ID NO: 802821 - RNA, 12 nt, Mycobacterium avium subsp. paratuberculosis
ugcccagcacga

SEQ ID NO: 802822 - RNA, 15 nt, Mycobacterium avium subsp. paratuberculosis
ugcccagcacgacgc

SEQ ID NO: 802823 - RNA, 20 nt, Mycobacterium avium subsp. paratuberculosis
ugcccagcacgacgccgcug

SEQ ID NO: 802824 - RNA, 12 nt, Mycobacterium avium subsp. paratuberculosis
ugcccagcgcga

SEQ ID NO: 802825 - RNA, 19 nt, Mycobacterium avium subsp. paratuberculosis
ugcccagcgcgaggucgac

SEQ ID NO: 802826 - RNA, 17 nt, Mycobacterium avium subsp. paratuberculosis
ugcccagcgcgcggugc

SEQ ID NO: 802827 - RNA, 12 nt, Mycobacterium avium subsp. paratuberculosis
ugcccagcgcgg

SEQ ID NO: 802828 - RNA, 18 nt, Mycobacterium avium subsp. paratuberculosis
ugcccagcgcggucgcca

SEQ ID NO: 802829 - RNA, 23 nt, Mycobacterium avium subsp. paratuberculosis
ugcccagcggcauggcgaugacc

SEQ ID NO: 802830 - RNA, 12 nt, Mycobacterium avium subsp. paratuberculosis
ugcccagccgca

SEQ ID NO: 802831 - RNA, 16 nt, Mycobacterium avium subsp. paratuberculosis
ugcccagccgcaggug

SEQ ID NO: 802832 - RNA, 20 nt, Mycobacterium avium subsp. paratuberculosis
ugcccagcagggcggcgauc

SEQ ID NO: 802833 - RNA, 19 nt, Mycobacterium avium subsp. paratuberculosis
ugcccagcaguccggcggu

SEQ ID NO: 802834 - RNA, 15 nt, Mycobacterium avium subsp. paratuberculosis
ugcccagccaggccg

SEQ ID NO: 802835 - RNA, 17 nt, Mycobacterium avium subsp. paratuberculosis
ugcccagccaucugcug

SEQ ID NO: 802836 - RNA, 18 nt, Mycobacterium avium subsp. paratuberculosis
ugcccagccccucgacgu

SEQ ID NO: 802837 - RNA, 21 nt, Mycobacterium avium subsp. paratuberculosis
ugccagcagguccgccggugc

SEQ ID NO: 802838 - RNA, 21 nt, Mycobacterium avium subsp. paratuberculosis
ugccagcccguuguggcggcc

SEQ ID NO: 802839 - RNA, 14 nt, Mycobacterium avium subsp. paratuberculosis
ugccagccggccgc

SEQ ID NO: 802840 - RNA, 15 nt, Mycobacterium avium subsp. paratuberculosis
ugccagccgggccga

SEQ ID NO: 802841 - RNA, 16 nt, Mycobacterium avium subsp. paratuberculosis
ugccagcgcccgcugc

SEQ ID NO: 802842 - RNA, 16 nt, Mycobacterium avium subsp. paratuberculosis
ugccaucgugggcgcc

SEQ ID NO: 802843 - RNA, 20 nt, Mycobacterium avium subsp. paratuberculosis
ugccaucgcugguggugaga

SEQ ID NO: 802844 - RNA, 20 nt, Mycobacterium avium subsp. paratuberculosis
ugcccgcugacaaagcacaa

SEQ ID NO: 802845 - RNA, 20 nt, Mycobacterium avium subsp. paratuberculosis
ugcccgcgaucgccagcgcg

SEQ ID NO: 802846 - RNA, 12 nt, Mycobacterium avium subsp. paratuberculosis
ugcccgcgcagg

SEQ ID NO: 802847 - RNA, 15 nt, Mycobacterium avium subsp. paratuberculosis
ugcccgcgcaggccc

SEQ ID NO: 802848 - RNA, 15 nt, Mycobacterium avium subsp. paratuberculosis
ugcccgcgccccggc

SEQ ID NO: 802849 - RNA, 13 nt, Mycobacterium avium subsp. paratuberculosis
ugcccgcgccgac

SEQ ID NO: 802850 - RNA, 15 nt, Mycobacterium avium subsp. paratuberculosis
ugcccgcgccgacca

SEQ ID NO: 802851 - RNA, 16 nt, Mycobacterium avium subsp. paratuberculosis
ugcccgcgccgaccag

SEQ ID NO: 802852 - RNA, 22 nt, Mycobacterium avium subsp. paratuberculosis
ugcccgcgcggcucacagcgcg

SEQ ID NO: 802853 - RNA, 22 nt, Mycobacterium avium subsp. paratuberculosis
ugcccgcggccgccgccgcggc

SEQ ID NO: 802854 - RNA, 24 nt, Mycobacterium avium subsp. paratuberculosis
ugcccgcggccgccgccgcggccg

SEQ ID NO: 802855 - RNA, 22 nt, Mycobacterium avium subsp. paratuberculosis
ugcccgcgggacacggcggcgc

SEQ ID NO: 802856 - RNA, 20 nt, Mycobacterium avium subsp. paratuberculosis
ugcccgcggguagcccgucg

SEQ ID NO: 802857 - RNA, 17 nt, Mycobacterium avium subsp. paratuberculosis
ugcccgcggguggccuu

SEQ ID NO: 802858 - RNA, 22 nt, Mycobacterium avium subsp. paratuberculosis
ugcccgcggguggccuucauca

SEQ ID NO: 802859 - RNA, 23 nt, Mycobacterium avium subsp. paratuberculosis
ugcccgcggguguuucggucggc

SEQ ID NO: 802860 - RNA, 15 nt, Mycobacterium avium subsp. paratuberculosis
ugcccggaucgccga

SEQ ID NO: 802861 - RNA, 18 nt, Mycobacterium avium subsp. paratuberculosis
ugcccggagaaaccgucg

SEQ ID NO: 802862 - RNA, 16 nt, Mycobacterium avium subsp. paratuberculosis
ugcccggcccgccgcu

SEQ ID NO: 802863 - RNA, 11 nt, Mycobacterium avium subsp. paratuberculosis
ugcccggcgau

SEQ ID NO: 802864 - RNA, 15 nt, Mycobacterium avium subsp. paratuberculosis
ugcccggcgccggac

SEQ ID NO: 802865 - RNA, 19 nt, Mycobacterium avium subsp. paratuberculosis
ugcccggcgccggucguua

SEQ ID NO: 802866 - RNA, 16 nt, Mycobacterium avium subsp. paratuberculosis
ugcccggcgcggacag

SEQ ID NO: 802867 - RNA, 23 nt, Mycobacterium avium subsp. paratuberculosis
ugcccggcgcuaaagccgaccgc

SEQ ID NO: 802868 - RNA, 16 nt, Mycobacterium avium subsp. paratuberculosis
ugcccggucugcggcc

SEQ ID NO: 802869 - RNA, 20 nt, Mycobacterium avium subsp. paratuberculosis
ugcccggggugcuggcguag

SEQ ID NO: 802870 - RNA, 20 nt, Mycobacterium avium subsp. paratuberculosis
ugcccggguccuggaucagc

SEQ ID NO: 802871 - RNA, 22 nt, Mycobacterium avium subsp. paratuberculosis
ugcccgggcuguugaccacggc

SEQ ID NO: 802872 - RNA, 17 nt, Mycobacterium avium subsp. paratuberculosis
ugcccgggguccaccgg

SEQ ID NO: 802873 - RNA, 20 nt, Mycobacterium avium subsp. paratuberculosis
ugcccgggguccaccggccg

SEQ ID NO: 802874 - RNA, 21 nt, Mycobacterium avium subsp. paratuberculosis
ugcccgggguccaccggccga

SEQ ID NO: 802875 - RNA, 15 nt, Mycobacterium avium subsp. paratuberculosis
ugcccggcucggugc

SEQ ID NO: 802876 - RNA, 23 nt, Mycobacterium avium subsp. paratuberculosis
ugcccggcucggugcgccagauc

SEQ ID NO: 802877 - RNA, 17 nt, Mycobacterium avium subsp. paratuberculosis
ugcccguagucggcggc

SEQ ID NO: 802878 - RNA, 15 nt, Mycobacterium avium subsp. paratuberculosis
ugcccgucgaccucc

SEQ ID NO: 802879 - RNA, 22 nt, Mycobacterium avium subsp. paratuberculosis
ugcccgucgaccuccucgaccc

SEQ ID NO: 802880 - RNA, 14 nt, Mycobacterium avium subsp. paratuberculosis
ugcccgucgccucc

SEQ ID NO: 802881 - RNA, 15 nt, Mycobacterium avium subsp. paratuberculosis
ugcccgucgcguccc

SEQ ID NO: 802882 - RNA, 12 nt, Mycobacterium avium subsp. paratuberculosis
ugcccgucgggc

SEQ ID NO: 802883 - RNA, 18 nt, Mycobacterium avium subsp. paratuberculosis
ugcccugcgugcagacaa

SEQ ID NO: 802884 - RNA, 17 nt, Mycobacterium avium subsp. paratuberculosis
ugcccgucacggccguc

SEQ ID NO: 802885 - RNA, 17 nt, Mycobacterium avium subsp. paratuberculosis
ugcccgccccgcccggc

SEQ ID NO: 802886 - RNA, 20 nt, Mycobacterium avium subsp. paratuberculosis
ugcccgccccgcccggcggc

SEQ ID NO: 802887 - RNA, 16 nt, Mycobacterium avium subsp. paratuberculosis
ugcccgccccggacau

SEQ ID NO: 802888 - RNA, 17 nt, Mycobacterium avium subsp. paratuberculosis
ugcccgcccacgggucg

SEQ ID NO: 802889 - RNA, 22 nt, Mycobacterium avium subsp. paratuberculosis
ugcccgcccacgggucgccgau

SEQ ID NO: 802890 - RNA, 14 nt, Mycobacterium avium subsp. paratuberculosis
ugcccgccacggcc

SEQ ID NO: 802891 - RNA, 19 nt, Mycobacterium avium subsp. paratuberculosis
ugcccgccuuugagcgaca

SEQ ID NO: 802892 - RNA, 13 nt, Mycobacterium avium subsp. paratuberculosis
ugcccgccgacca

SEQ ID NO: 802893 - RNA, 19 nt, Mycobacterium avium subsp. paratuberculosis
ugcccgccucgcagcgaca

SEQ ID NO: 802894 - RNA, 20 nt, Mycobacterium avium subsp. paratuberculosis
ugcccgccucgcagcgacaa

SEQ ID NO: 802895 - RNA, 15 nt, Mycobacterium avium subsp. paratuberculosis
ugcccgcgaacgccu

SEQ ID NO: 802896 - RNA, 18 nt, Mycobacterium avium subsp. paratuberculosis
ugcccgcgacggcgagcc

SEQ ID NO: 802897 - RNA, 19 nt, Mycobacterium avium subsp. paratuberculosis
ugcccgcgacugucggcgc

SEQ ID NO: 802898 - RNA, 20 nt, Mycobacterium avium subsp. paratuberculosis
ugcccgcccuugucgauccg

SEQ ID NO: 802899 - RNA, 22 nt, Mycobacterium avium subsp. paratuberculosis
ugcccgcccuugucgauccggu

SEQ ID NO: 802900 - RNA, 21 nt, Mycobacterium avium subsp. paratuberculosis
ugcccgccgaucgaucagccg

SEQ ID NO: 802901 - RNA, 12 nt, Mycobacterium avium subsp. paratuberculosis
ugcccgccgcga

SEQ ID NO: 802902 - RNA, 12 nt, Mycobacterium avium subsp. paratuberculosis
ugcccgccgcgg

SEQ ID NO: 802903 - RNA, 13 nt, Mycobacterium avium subsp. paratuberculosis
ugcccgccgcggc

SEQ ID NO: 802904 - RNA, 15 nt, Mycobacterium avium subsp. paratuberculosis
ugcccgccgcggccg

SEQ ID NO: 802905 - RNA, 12 nt, Mycobacterium avium subsp. paratuberculosis
ugcccgccgcgu

SEQ ID NO: 802906 - RNA, 23 nt, Mycobacterium avium subsp. paratuberculosis
ugcccgccgcgucagcggcgggc

SEQ ID NO: 802907 - RNA, 23 nt, Mycobacterium avium subsp. paratuberculosis
ugcccgccgcugacgcggcgggc

SEQ ID NO: 802908 - RNA, 14 nt, Mycobacterium avium subsp. paratuberculosis
ugcccgccggcguc

SEQ ID NO: 802909 - RNA, 15 nt, Mycobacterium avium subsp. paratuberculosis
ugcccgccggcgucu

SEQ ID NO: 802910 - RNA, 22 nt, Mycobacterium avium subsp. paratuberculosis
ugcccgccggcgucugcauccg

SEQ ID NO: 802911 - RNA, 23 nt, Mycobacterium avium subsp. paratuberculosis
ugcccgccggcgucugcauccgg

SEQ ID NO: 802912 - RNA, 14 nt, Mycobacterium avium subsp. paratuberculosis
ugcccgaucagccg

SEQ ID NO: 802913 - RNA, 18 nt, Mycobacterium avium subsp. paratuberculosis
ugcccgaucucgucggug

SEQ ID NO: 802914 - RNA, 22 nt, Mycobacterium avium subsp. paratuberculosis
ugcccgaggugaauaccacugc

SEQ ID NO: 802915 - RNA, 23 nt, Mycobacterium avium subsp. paratuberculosis
ugcccgagcugaucgcggccggc

SEQ ID NO: 802916 - RNA, 18 nt, Mycobacterium avium subsp. paratuberculosis
ugcccgagaucaccggcu

SEQ ID NO: 802917 - RNA, 14 nt, Mycobacterium avium subsp. paratuberculosis
ugcccgagcaccug

SEQ ID NO: 802918 - RNA, 16 nt, Mycobacterium avium subsp. paratuberculosis
ugcccaucgccacgcc

SEQ ID NO: 802919 - RNA, 22 nt, Mycobacterium avium subsp. paratuberculosis
ugcccauccaggccagcaccug

SEQ ID NO: 802920 - RNA, 13 nt, Mycobacterium avium subsp. paratuberculosis
ugcccaggccggc

SEQ ID NO: 802921 - RNA, 17 nt, Mycobacterium avium subsp. paratuberculosis
ugcccagggcgcgucca

SEQ ID NO: 802922 - RNA, 21 nt, Mycobacterium avium subsp. paratuberculosis
ugcccaggccggcgagcucgc

SEQ ID NO: 802923 - RNA, 15 nt, Mycobacterium avium subsp. paratuberculosis
ugcccaggcccacca

SEQ ID NO: 802924 - RNA, 23 nt, Mycobacterium avium subsp. paratuberculosis
ugcccaggaaguagccggccagc

SEQ ID NO: 802925 - RNA, 17 nt, Mycobacterium avium subsp. paratuberculosis
ugcccaggaucaccggg

SEQ ID NO: 802926 - RNA, 12 nt, Mycobacterium avium subsp. paratuberculosis
ucuugggcggcc

SEQ ID NO: 802927 - RNA, 15 nt, Mycobacterium avium subsp. paratuberculosis
ucuuggucagccgcg

SEQ ID NO: 802928 - RNA, 14 nt, Mycobacterium avium subsp. paratuberculosis
ucuuggcggcggcc

SEQ ID NO: 802929 - RNA, 17 nt, Mycobacterium avium subsp. paratuberculosis
ucuuggccggagccuug

SEQ ID NO: 802930 - RNA, 16 nt, Mycobacterium avium subsp. paratuberculosis
ucuuggccuccaccgg

SEQ ID NO: 802931 - RNA, 20 nt, Mycobacterium avium subsp. paratuberculosis
ugaaacuaguuucacguucg

SEQ ID NO: 802932 - RNA, 15 nt, Mycobacterium avium subsp. paratuberculosis
ugaaaccggccagca

SEQ ID NO: 802933 - RNA, 22 nt, Mycobacterium avium subsp. paratuberculosis
ugaacagcacgugcccgccgug

SEQ ID NO: 802934 - RNA, 18 nt, Mycobacterium avium subsp. paratuberculosis
ugaacaccaccaggccgu

SEQ ID NO: 802935 - RNA, 12 nt, Mycobacterium avium subsp. paratuberculosis
ugaaauccgggg

SEQ ID NO: 802936 - RNA, 15 nt, Mycobacterium avium subsp. paratuberculosis
ugaaccuggccacca

SEQ ID NO: 802937 - RNA, 17 nt, Mycobacterium avium subsp. paratuberculosis
ugaacgcacucggugug

SEQ ID NO: 802938 - RNA, 14 nt, Mycobacterium avium subsp. paratuberculosis
ugaacgaggccgcg

SEQ ID NO: 802939 - RNA, 15 nt, Mycobacterium avium subsp. paratuberculosis
ugaacgaggccgcgc

SEQ ID NO: 802940 - RNA, 17 nt, Mycobacterium avium subsp. paratuberculosis
ugaacgaggccgcgccg

SEQ ID NO: 802941 - RNA, 18 nt, Mycobacterium avium subsp. paratuberculosis
ugaaccgcgacgcgaucg

SEQ ID NO: 802942 - RNA, 22 nt, Mycobacterium avium subsp. paratuberculosis
ugaaccgcugcugcucggccgc

SEQ ID NO: 802943 - RNA, 15 nt, Mycobacterium avium subsp. paratuberculosis
ugaacaucggccggg

SEQ ID NO: 802944 - RNA, 16 nt, Mycobacterium avium subsp. paratuberculosis
ugaacagucggccggc

SEQ ID NO: 802945 - RNA, 17 nt, Mycobacterium avium subsp. paratuberculosis
ugaacagcgccggaccg

SEQ ID NO: 802946 - RNA, 15 nt, Mycobacterium avium subsp. paratuberculosis
ucuuggacgcccggu

SEQ ID NO: 802947 - RNA, 18 nt, Mycobacterium avium subsp. paratuberculosis
ucuugcguuccucgacgg

SEQ ID NO: 802948 - RNA, 18 nt, Mycobacterium avium subsp. paratuberculosis
ucuugccggcuuccucgc

SEQ ID NO: 802949 - RNA, 18 nt, Mycobacterium avium subsp. paratuberculosis
ucuugccgucggccgccg

SEQ ID NO: 802950 - RNA, 23 nt, Mycobacterium avium subsp. paratuberculosis
ucuugcgcggcgcgaagcccucg

SEQ ID NO: 802951 - RNA, 13 nt, Mycobacterium avium subsp. paratuberculosis
ucuucgggcugcg

SEQ ID NO: 802952 - RNA, 13 nt, Mycobacterium avium subsp. paratuberculosis
ucuucucggccag

SEQ ID NO: 802953 - RNA, 16 nt, Mycobacterium avium subsp. paratuberculosis
ucuugcccggcgagcg

SEQ ID NO: 802954 - RNA, 19 nt, Mycobacterium avium subsp. paratuberculosis
ucuugcccggcgagcgacg

SEQ ID NO: 802955 - RNA, 23 nt, Mycobacterium avium subsp. paratuberculosis
ucuucacgaagugcccggcgccg

SEQ ID NO: 802956 - RNA, 16 nt, Mycobacterium avium subsp. paratuberculosis
ucuucagcgcgacagc

SEQ ID NO: 802957 - RNA, 15 nt, Mycobacterium avium subsp. paratuberculosis
ucuuccacgccggug

SEQ ID NO: 802958 - RNA, 17 nt, Mycobacterium avium subsp. paratuberculosis
ucuucgaucaggcgcag

SEQ ID NO: 802959 - RNA, 15 nt, Mycobacterium avium subsp. paratuberculosis
ucuucgaugccggug

SEQ ID NO: 802960 - RNA, 18 nt, Mycobacterium avium subsp. paratuberculosis
ucuucggcacgaagccga

SEQ ID NO: 802961 - RNA, 17 nt, Mycobacterium avium subsp. paratuberculosis
ucuucggcgcgccggcg

SEQ ID NO: 802962 - RNA, 21 nt, Mycobacterium avium subsp. paratuberculosis
ucuucgcugccgccgccgcug

SEQ ID NO: 802963 - RNA, 21 nt, Mycobacterium avium subsp. paratuberculosis
ucuggccggagcggugcggcu

SEQ ID NO: 802964 - RNA, 16 nt, Mycobacterium avium subsp. paratuberculosis
ucuggcccgccaucgc

SEQ ID NO: 802965 - RNA, 20 nt, Mycobacterium avium subsp. paratuberculosis
ucuggcccgccaucgcccgg

SEQ ID NO: 802966 - RNA, 14 nt, Mycobacterium avium subsp. paratuberculosis
ucuggccaccgaag

SEQ ID NO: 802967 - RNA, 18 nt, Mycobacterium avium subsp. paratuberculosis
ucuggcagccggccggca

SEQ ID NO: 802968 - RNA, 18 nt, Mycobacterium avium subsp. paratuberculosis
ucuggaagauguccucgg

SEQ ID NO: 802969 - RNA, 21 nt, Mycobacterium avium subsp. paratuberculosis
ucugcuuugccuuagcccggc

SEQ ID NO: 802970 - RNA, 21 nt, Mycobacterium avium subsp. paratuberculosis
ucuggaacgcgaaguccgacg

SEQ ID NO: 802971 - RNA, 22 nt, Mycobacterium avium subsp. paratuberculosis
ucugcuugaugaugucggcggc

SEQ ID NO: 802972 - RNA, 21 nt, Mycobacterium avium subsp. paratuberculosis
ucugcuugugaaugggcugcg

SEQ ID NO: 802973 - RNA, 17 nt, Mycobacterium avium subsp. paratuberculosis
ucugcuggauggucucg

SEQ ID NO: 802974 - RNA, 22 nt, Mycobacterium avium subsp. paratuberculosis
ucugcgcgacgaauccggugac

SEQ ID NO: 802975 - RNA, 18 nt, Mycobacterium avium subsp. paratuberculosis
ucugcgcgaugucgacgg

SEQ ID NO: 802976 - RNA, 17 nt, Mycobacterium avium subsp. paratuberculosis
ucugcgcgccgucggcg

SEQ ID NO: 802977 - RNA, 16 nt, Mycobacterium avium subsp. paratuberculosis
ucugcgcgcggugcac

SEQ ID NO: 802978 - RNA, 17 nt, Mycobacterium avium subsp. paratuberculosis
ucugcgccgucaccggc

SEQ ID NO: 802979 - RNA, 20 nt, Mycobacterium avium subsp. paratuberculosis
ucugcgccuuuugcacccgc

SEQ ID NO: 802980 - RNA, 13 nt, Mycobacterium avium subsp. paratuberculosis
ucugcgccccggc

SEQ ID NO: 802981 - RNA, 14 nt, Mycobacterium avium subsp. paratuberculosis
ucugcgccccggcg

SEQ ID NO: 802982 - RNA, 17 nt, Mycobacterium avium subsp. paratuberculosis
ucugcgccccggcgucg

SEQ ID NO: 802983 - RNA, 19 nt, Mycobacterium avium subsp. paratuberculosis
ucugcgccccggcgucgau

SEQ ID NO: 802984 - RNA, 15 nt, Mycobacterium avium subsp. paratuberculosis
ucugcgcccgaucgg

SEQ ID NO: 802985 - RNA, 19 nt, Mycobacterium avium subsp. paratuberculosis
ucugcgcaagaagggcgaa

SEQ ID NO: 802986 - RNA, 23 nt, Mycobacterium avium subsp. paratuberculosis
ucucacaggugacgacgcucuug

SEQ ID NO: 802987 - RNA, 18 nt, Mycobacterium avium subsp. paratuberculosis
ucguguccgcgccggcgc

SEQ ID NO: 802988 - RNA, 14 nt, Mycobacterium avium subsp. paratuberculosis
ucguggcgacgacg

SEQ ID NO: 802989 - RNA, 17 nt, Mycobacterium avium subsp. paratuberculosis
ucgugguucuccgcgac

SEQ ID NO: 802990 - RNA, 18 nt, Mycobacterium avium subsp. paratuberculosis
ucguggcgacaucgccgc

SEQ ID NO: 802991 - RNA, 21 nt, Mycobacterium avium subsp. paratuberculosis
ucguggcgggcccgggcgcug

SEQ ID NO: 802992 - RNA, 23 nt, Mycobacterium avium subsp. paratuberculosis
ucgugggcaacacgucguccggc

SEQ ID NO: 802993 - RNA, 17 nt, Mycobacterium avium subsp. paratuberculosis
ucgugggccaccacgua

SEQ ID NO: 802994 - RNA, 13 nt, Mycobacterium avium subsp. paratuberculosis
ucgugggcgugcc

SEQ ID NO: 802995 - RNA, 20 nt, Mycobacterium avium subsp. paratuberculosis
ucguggguggucugcugggc

SEQ ID NO: 802996 - RNA, 15 nt, Mycobacterium avium subsp. paratuberculosis
ucgugguaccggcgc

SEQ ID NO: 802997 - RNA, 20 nt, Mycobacterium avium subsp. paratuberculosis
ucgugguaccggcgccaggc

SEQ ID NO: 802998 - RNA, 14 nt, Mycobacterium avium subsp. paratuberculosis
ucucaccggcggcg

SEQ ID NO: 802999 - RNA, 18 nt, Mycobacterium avium subsp. paratuberculosis
ucucccgggugcgcgucg

SEQ ID NO: 803000 - RNA, 14 nt, Mycobacterium avium subsp. paratuberculosis
ucucccgcggcagc

SEQ ID NO: 803001 - RNA, 22 nt, Mycobacterium avium subsp. paratuberculosis
ucuccggccccgagccgacgau

SEQ ID NO: 803002 - RNA, 13 nt, Mycobacterium avium subsp. paratuberculosis
ucuccggcccgcu

SEQ ID NO: 803003 - RNA, 13 nt, Mycobacterium avium subsp. paratuberculosis
ucuccggcccggc

SEQ ID NO: 803004 - RNA, 22 nt, Mycobacterium avium subsp. paratuberculosis
ucuccggcgggcuggugcgcag

SEQ ID NO: 803005 - RNA, 17 nt, Mycobacterium avium subsp. paratuberculosis
ucucgaccgcggcgccg

SEQ ID NO: 803006 - RNA, 20 nt, Mycobacterium avium subsp. paratuberculosis
ucucgaccgcggcgccgaug

SEQ ID NO: 803007 - RNA, 22 nt, Mycobacterium avium subsp. paratuberculosis
ucucgaccgcgguggcggugcg

SEQ ID NO: 803008 - RNA, 15 nt, Mycobacterium avium subsp. paratuberculosis
ucucgaccucgucgg

SEQ ID NO: 803009 - RNA, 13 nt, Mycobacterium avium subsp. paratuberculosis
ucucgaccuucuu

SEQ ID NO: 803010 - RNA, 20 nt, Mycobacterium avium subsp. paratuberculosis
ucucgcccaccuuggcgucg

SEQ ID NO: 803011 - RNA, 17 nt, Mycobacterium avium subsp. paratuberculosis
ucucgcaccugccgucg

SEQ ID NO: 803012 - RNA, 20 nt, Mycobacterium avium subsp. paratuberculosis
ucucgaugguguagccgugc

SEQ ID NO: 803013 - RNA, 18 nt, Mycobacterium avium subsp. paratuberculosis
ucucgauggccacgcucu

SEQ ID NO: 803014 - RNA, 18 nt, Mycobacterium avium subsp. paratuberculosis
ucucgauggccucgucga

SEQ ID NO: 803015 - RNA, 17 nt, Mycobacterium avium subsp. paratuberculosis
ucuccgccuucgacgau

SEQ ID NO: 803016 - RNA, 19 nt, Mycobacterium avium subsp. paratuberculosis
ucucgacggcgccgacgau

SEQ ID NO: 803017 - RNA, 14 nt, Mycobacterium avium subsp. paratuberculosis
ucucgaucgacgac

SEQ ID NO: 803018 - RNA, 20 nt, Mycobacterium avium subsp. paratuberculosis
ucucgaugacccaccagccg

SEQ ID NO: 803019 - RNA, 22 nt, Mycobacterium avium subsp. paratuberculosis
ucucgaugacccaccagccgag

SEQ ID NO: 803020 - RNA, 19 nt, Mycobacterium avium subsp. paratuberculosis
ucucgccguuuugccgccg

SEQ ID NO: 803021 - RNA, 15 nt, Mycobacterium avium subsp. paratuberculosis
ucucgccggucagca

SEQ ID NO: 803022 - RNA, 16 nt, Mycobacterium avium subsp. paratuberculosis
ucucgccggucagcac

SEQ ID NO: 803023 - RNA, 19 nt, Mycobacterium avium subsp. paratuberculosis
ucucgcccggcuccacgau

SEQ ID NO: 803024 - RNA, 13 nt, Mycobacterium avium subsp. paratuberculosis
ucucgccgagcac

SEQ ID NO: 803025 - RNA, 19 nt, Mycobacterium avium subsp. paratuberculosis
ucucgcugaucucgacggu

SEQ ID NO: 803026 - RNA, 13 nt, Mycobacterium avium subsp. paratuberculosis
ucucgcugcggcg

SEQ ID NO: 803027 - RNA, 24 nt, Mycobacterium avium subsp. paratuberculosis
ucucgcugcucugcgcgcggugca

SEQ ID NO: 803028 - RNA, 13 nt, Mycobacterium avium subsp. paratuberculosis
ucucgcgcaccgc

SEQ ID NO: 803029 - RNA, 13 nt, Mycobacterium avium subsp. paratuberculosis
ucucgcggcggcc

SEQ ID NO: 803030 - RNA, 16 nt, Mycobacterium avium subsp. paratuberculosis
ucucggcgaucagcug

SEQ ID NO: 803031 - RNA, 17 nt, Mycobacterium avium subsp. paratuberculosis
ucucggcgaucagcugc

SEQ ID NO: 803032 - RNA, 14 nt, Mycobacterium avium subsp. paratuberculosis
ucucggcgccgucg

SEQ ID NO: 803033 - RNA, 19 nt, Mycobacterium avium subsp. paratuberculosis
ucucggcggacaucgccuc

SEQ ID NO: 803034 - RNA, 14 nt, Mycobacterium avium subsp. paratuberculosis
ucucggcggccgcg

SEQ ID NO: 803035 - RNA, 12 nt, Mycobacterium avium subsp. paratuberculosis
ucucggccagcc

SEQ ID NO: 803036 - RNA, 15 nt, Mycobacterium avium subsp. paratuberculosis
ucucggacgcccguc

SEQ ID NO: 803037 - RNA, 15 nt, Mycobacterium avium subsp. paratuberculosis
ucucggucaccgagc

SEQ ID NO: 803038 - RNA, 19 nt, Mycobacterium avium subsp. paratuberculosis
ucucggucgccagcaccgu

SEQ ID NO: 803039 - RNA, 14 nt, Mycobacterium avium subsp. paratuberculosis
ucucggucgcggcg

SEQ ID NO: 803040 - RNA, 18 nt, Mycobacterium avium subsp. paratuberculosis
ucucgggaaacgcgucgc

SEQ ID NO: 803041 - RNA, 15 nt, Mycobacterium avium subsp. paratuberculosis
ucucgggaucgccga

SEQ ID NO: 803042 - RNA, 21 nt, Mycobacterium avium subsp. paratuberculosis
ucucgggcagcagcaccagcg

SEQ ID NO: 803043 - RNA, 17 nt, Mycobacterium avium subsp. paratuberculosis
ucucggcggucugucgc

SEQ ID NO: 803044 - RNA, 23 nt, Mycobacterium avium subsp. paratuberculosis
ucucggcggucuuugccaucccg

SEQ ID NO: 803045 - RNA, 17 nt, Mycobacterium avium subsp. paratuberculosis
ucucggcguacagcccg

SEQ ID NO: 803046 - RNA, 12 nt, Mycobacterium avium subsp. paratuberculosis
ucucgucgucgg

SEQ ID NO: 803047 - RNA, 16 nt, Mycobacterium avium subsp. paratuberculosis
ucucgucgaugacgau

SEQ ID NO: 803048 - RNA, 14 nt, Mycobacterium avium subsp. paratuberculosis
ucucgucgcggcug

SEQ ID NO: 803049 - RNA, 14 nt, Mycobacterium avium subsp. paratuberculosis
ucucgucggccgcg

SEQ ID NO: 803050 - RNA, 14 nt, Mycobacterium avium subsp. paratuberculosis
ucucgucggcggcg

SEQ ID NO: 803051 - RNA, 21 nt, Mycobacterium avium subsp. paratuberculosis
ucucgucggcggcggccugca

SEQ ID NO: 803052 - RNA, 15 nt, Mycobacterium avium subsp. paratuberculosis
ucucgucgggccaca

SEQ ID NO: 803053 - RNA, 13 nt, Mycobacterium avium subsp. paratuberculosis
ucucgugccgcac

SEQ ID NO: 803054 - RNA, 14 nt, Mycobacterium avium subsp. paratuberculosis
ucucgucccacggc

SEQ ID NO: 803055 - RNA, 17 nt, Mycobacterium avium subsp. paratuberculosis
ucucguagcccaccucg

SEQ ID NO: 803056 - RNA, 18 nt, Mycobacterium avium subsp. paratuberculosis
ucucguagcccaccucga

SEQ ID NO: 803057 - RNA, 13 nt, Mycobacterium avium subsp. paratuberculosis
ucucguagccgug

SEQ ID NO: 803058 - RNA, 15 nt, Mycobacterium avium subsp. paratuberculosis
ucugagcccgggcag

SEQ ID NO: 803059 - RNA, 21 nt, Mycobacterium avium subsp. paratuberculosis
ucugagcccgggcaggcggcg

SEQ ID NO: 803060 - RNA, 16 nt, Mycobacterium avium subsp. paratuberculosis
ucugcaccagcgcgga

SEQ ID NO: 803061 - RNA, 20 nt, Mycobacterium avium subsp. paratuberculosis
ucugcacucagagcagcgcc

SEQ ID NO: 803062 - RNA, 17 nt, Mycobacterium avium subsp. paratuberculosis
ucugcacugcgguucac

SEQ ID NO: 803063 - RNA, 14 nt, Mycobacterium avium subsp. paratuberculosis
ucugcagagcggug

SEQ ID NO: 803064 - RNA, 18 nt, Mycobacterium avium subsp. paratuberculosis
ucugcaggguuuccucga

SEQ ID NO: 803065 - RNA, 20 nt, Mycobacterium avium subsp. paratuberculosis
ucugcacgucggcggccgcg

SEQ ID NO: 803066 - RNA, 12 nt, Mycobacterium avium subsp. paratuberculosis
ucugcagccgca

SEQ ID NO: 803067 - RNA, 15 nt, Mycobacterium avium subsp. paratuberculosis
ucugcagccggcgcg

SEQ ID NO: 803068 - RNA, 12 nt, Mycobacterium avium subsp. paratuberculosis
ucugcagcgacg

SEQ ID NO: 803069 - RNA, 14 nt, Mycobacterium avium subsp. paratuberculosis
ucugccacgcccac

SEQ ID NO: 803070 - RNA, 16 nt, Mycobacterium avium subsp. paratuberculosis
ucugccacgcccaccg

SEQ ID NO: 803071 - RNA, 16 nt, Mycobacterium avium subsp. paratuberculosis
ucugccacucgucgau

SEQ ID NO: 803072 - RNA, 17 nt, Mycobacterium avium subsp. paratuberculosis
ucugccagaacggcggc

SEQ ID NO: 803073 - RNA, 11 nt, Mycobacterium avium subsp. paratuberculosis
ucugcccgacc

SEQ ID NO: 803074 - RNA, 16 nt, Mycobacterium avium subsp. paratuberculosis
ucugccggugccgccg

SEQ ID NO: 803075 - RNA, 14 nt, Mycobacterium avium subsp. paratuberculosis
ucugccgggccgca

SEQ ID NO: 803076 - RNA, 16 nt, Mycobacterium avium subsp. paratuberculosis
ucugccgggccgcauc

SEQ ID NO: 803077 - RNA, 20 nt, Mycobacterium avium subsp. paratuberculosis
ucugccgggcggcgacgucg

SEQ ID NO: 803078 - RNA, 20 nt, Mycobacterium avium subsp. paratuberculosis
ucugccuacuugcggccgcg

SEQ ID NO: 803079 - RNA, 20 nt, Mycobacterium avium subsp. paratuberculosis
ucugcgagaugcccacccgc

SEQ ID NO: 803080 - RNA, 21 nt, Mycobacterium avium subsp. paratuberculosis
ucgucaaaccguuuucggcgc

SEQ ID NO: 803081 - RNA, 22 nt, Mycobacterium avium subsp. paratuberculosis
ucgucaaaccguuuucggcgcg

SEQ ID NO: 803082 - RNA, 23 nt, Mycobacterium avium subsp. paratuberculosis
ucgucaaaccguuuucggcgcgc

SEQ ID NO: 803083 - RNA, 15 nt, Mycobacterium avium subsp. paratuberculosis
ucgucaacgacccgg

SEQ ID NO: 803084 - RNA, 14 nt, Mycobacterium avium subsp. paratuberculosis
ucguccacgcccag

SEQ ID NO: 803085 - RNA, 13 nt, Mycobacterium avium subsp. paratuberculosis
ucgucaacgcccc

SEQ ID NO: 803086 - RNA, 14 nt, Mycobacterium avium subsp. paratuberculosis
ucguccaccgacag

SEQ ID NO: 803087 - RNA, 21 nt, Mycobacterium avium subsp. paratuberculosis
ucguagguggccagcacgauc

SEQ ID NO: 803088 - RNA, 14 nt, Mycobacterium avium subsp. paratuberculosis
ucguagggcucggc

SEQ ID NO: 803089 - RNA, 14 nt, Mycobacterium avium subsp. paratuberculosis
ucguaguugcggcc

SEQ ID NO: 803090 - RNA, 18 nt, Mycobacterium avium subsp. paratuberculosis
ucguaguuggggccggcc

SEQ ID NO: 803091 - RNA, 19 nt, Mycobacterium avium subsp. paratuberculosis
ucguagucgcucggcggcg

SEQ ID NO: 803092 - RNA, 15 nt, Mycobacterium avium subsp. paratuberculosis
ucgucccacggcggg

SEQ ID NO: 803093 - RNA, 20 nt, Mycobacterium avium subsp. paratuberculosis
ucgucccagcgcaacggcgu

SEQ ID NO: 803094 - RNA, 22 nt, Mycobacterium avium subsp. paratuberculosis
ucgucccagcgcaacggcgucg

SEQ ID NO: 803095 - RNA, 14 nt, Mycobacterium avium subsp. paratuberculosis
ucguccuggcgcug

SEQ ID NO: 803096 - RNA, 23 nt, Mycobacterium avium subsp. paratuberculosis
ucgucgaacaggaugcagccggc

SEQ ID NO: 803097 - RNA, 19 nt, Mycobacterium avium subsp. paratuberculosis
ucgucgaacuccauccgcc

SEQ ID NO: 803098 - RNA, 15 nt, Mycobacterium avium subsp. paratuberculosis
ucgucgaacucgggc

SEQ ID NO: 803099 - RNA, 17 nt, Mycobacterium avium subsp. paratuberculosis
ucgucgaacucgggccc

SEQ ID NO: 803100 - RNA, 18 nt, Mycobacterium avium subsp. paratuberculosis
ucgucgaacucgggcccg

SEQ ID NO: 803101 - RNA, 17 nt, Mycobacterium avium subsp. paratuberculosis
ucgucgaagagcugguc

SEQ ID NO: 803102 - RNA, 22 nt, Mycobacterium avium subsp. paratuberculosis
ucgucgaagagcuggucgccca

SEQ ID NO: 803103 - RNA, 17 nt, Mycobacterium avium subsp. paratuberculosis
ucgucgaagccgaucac

SEQ ID NO: 803104 - RNA, 21 nt, Mycobacterium avium subsp. paratuberculosis
ucgucgaagccgaucaccggc

SEQ ID NO: 803105 - RNA, 13 nt, Mycobacterium avium subsp. paratuberculosis
ucguccagcccga

SEQ ID NO: 803106 - RNA, 17 nt, Mycobacterium avium subsp. paratuberculosis
ucguccagcccggucac

SEQ ID NO: 803107 - RNA, 20 nt, Mycobacterium avium subsp. paratuberculosis
ucguccaggugcacccgcgg

SEQ ID NO: 803108 - RNA, 22 nt, Mycobacterium avium subsp. paratuberculosis
ucguccaggugcacccgcggcg

SEQ ID NO: 803109 - RNA, 17 nt, Mycobacterium avium subsp. paratuberculosis
ucguccagugacgccug

SEQ ID NO: 803110 - RNA, 14 nt, Mycobacterium avium subsp. paratuberculosis
ucguccauccgcuu

SEQ ID NO: 803111 - RNA, 19 nt, Mycobacterium avium subsp. paratuberculosis
ucguccaggguggccagca

SEQ ID NO: 803112 - RNA, 22 nt, Mycobacterium avium subsp. paratuberculosis
ucguccaggguggccagcacgc

SEQ ID NO: 803113 - RNA, 16 nt, Mycobacterium avium subsp. paratuberculosis
ucguccaucgcgucgu

SEQ ID NO: 803114 - RNA, 19 nt, Mycobacterium avium subsp. paratuberculosis
ucguccaugcccgcccacg

SEQ ID NO: 803115 - RNA, 12 nt, Mycobacterium avium subsp. paratuberculosis
ucguagccggca

SEQ ID NO: 803116 - RNA, 15 nt, Mycobacterium avium subsp. paratuberculosis
ucguagccggcacgc

SEQ ID NO: 803117 - RNA, 16 nt, Mycobacterium avium subsp. paratuberculosis
ucguagaucacggcgu

SEQ ID NO: 803118 - RNA, 22 nt, Mycobacterium avium subsp. paratuberculosis
ucguagcuggugcgcagcccgc

SEQ ID NO: 803119 - RNA, 22 nt, Mycobacterium avium subsp. paratuberculosis
ucguagcggccgcacgcgaaca

SEQ ID NO: 803120 - RNA, 13 nt, Mycobacterium avium subsp. paratuberculosis
ucguagcggcgcc

SEQ ID NO: 803121 - RNA, 19 nt, Mycobacterium avium subsp. paratuberculosis
ucguagcggcgccaccggc

SEQ ID NO: 803122 - RNA, 19 nt, Mycobacterium avium subsp. paratuberculosis
ucguagccgugcaucgggc

SEQ ID NO: 803123 - RNA, 20 nt, Mycobacterium avium subsp. paratuberculosis
ucguagccgugcaucgggcg

SEQ ID NO: 803124 - RNA, 17 nt, Mycobacterium avium subsp. paratuberculosis
ucguagcgucgggggcg

SEQ ID NO: 803125 - RNA, 14 nt, Mycobacterium avium subsp. paratuberculosis
ucguagagcugacg

SEQ ID NO: 803126 - RNA, 18 nt, Mycobacterium avium subsp. paratuberculosis
ucggugugcagcagcucg

SEQ ID NO: 803127 - RNA, 20 nt, Mycobacterium avium subsp. paratuberculosis
ucggugugcagcagcucggc

SEQ ID NO: 803128 - RNA, 14 nt, Mycobacterium avium subsp. paratuberculosis
ucggugugccgcug

SEQ ID NO: 803129 - RNA, 18 nt, Mycobacterium avium subsp. paratuberculosis
ucggugucccgcgcccgc

SEQ ID NO: 803130 - RNA, 23 nt, Mycobacterium avium subsp. paratuberculosis
ucggugucccgcgcccgcgaaca

SEQ ID NO: 803131 - RNA, 21 nt, Mycobacterium avium subsp. paratuberculosis
ucggugucgaaguacgccguc

SEQ ID NO: 803132 - RNA, 20 nt, Mycobacterium avium subsp. paratuberculosis
ucgguguagcgagugccggc

SEQ ID NO: 803133 - RNA, 13 nt, Mycobacterium avium subsp. paratuberculosis
ucggugucgcuca

SEQ ID NO: 803134 - RNA, 17 nt, Mycobacterium avium subsp. paratuberculosis
ucgguguagagcaccuc

SEQ ID NO: 803135 - RNA, 15 nt, Mycobacterium avium subsp. paratuberculosis
ucggucgcgacccgg

SEQ ID NO: 803136 - RNA, 17 nt, Mycobacterium avium subsp. paratuberculosis
ucggucgcgacccgguc

SEQ ID NO: 803137 - RNA, 20 nt, Mycobacterium avium subsp. paratuberculosis
ucggucgcgccgaccugguc

SEQ ID NO: 803138 - RNA, 16 nt, Mycobacterium avium subsp. paratuberculosis
ucggucgcggcgucgc

SEQ ID NO: 803139 - RNA, 12 nt, Mycobacterium avium subsp. paratuberculosis
ucggucgcgguc

SEQ ID NO: 803140 - RNA, 16 nt, Mycobacterium avium subsp. paratuberculosis
ucggucgcggucggcg

SEQ ID NO: 803141 - RNA, 17 nt, Mycobacterium avium subsp. paratuberculosis
ucggucgcggucggcgc

SEQ ID NO: 803142 - RNA, 20 nt, Mycobacterium avium subsp. paratuberculosis
ucggucgcggucggcgcccg

SEQ ID NO: 803143 - RNA, 23 nt, Mycobacterium avium subsp. paratuberculosis
ucggucgcggugaucaggcccuc

SEQ ID NO: 803144 - RNA, 15 nt, Mycobacterium avium subsp. paratuberculosis
ucggucccgacgcgg

SEQ ID NO: 803145 - RNA, 17 nt, Mycobacterium avium subsp. paratuberculosis
ucggucccgacgcggcg

SEQ ID NO: 803146 - RNA, 20 nt, Mycobacterium avium subsp. paratuberculosis
ucggucccgacgcggcgcga

SEQ ID NO: 803147 - RNA, 18 nt, Mycobacterium avium subsp. paratuberculosis
ucggucagucgcgccgcc

SEQ ID NO: 803148 - RNA, 21 nt, Mycobacterium avium subsp. paratuberculosis
ucggucccggcgggggcggcg

SEQ ID NO: 803149 - RNA, 23 nt, Mycobacterium avium subsp. paratuberculosis
ucgguccggcgaauccgaccggc

SEQ ID NO: 803150 - RNA, 11 nt, Mycobacterium avium subsp. paratuberculosis
ucggucgagcc

SEQ ID NO: 803151 - RNA, 16 nt, Mycobacterium avium subsp. paratuberculosis
ucggucgagccuggcg

SEQ ID NO: 803152 - RNA, 18 nt, Mycobacterium avium subsp. paratuberculosis
ucggucgagccuggcgcg

SEQ ID NO: 803153 - RNA, 20 nt, Mycobacterium avium subsp. paratuberculosis
ucggucgagccuggcgcgca

SEQ ID NO: 803154 - RNA, 15 nt, Mycobacterium avium subsp. paratuberculosis
ucggucgccagcacc

SEQ ID NO: 803155 - RNA, 19 nt, Mycobacterium avium subsp. paratuberculosis
ucggucgccgaauccggcg

SEQ ID NO: 803156 - RNA, 14 nt, Mycobacterium avium subsp. paratuberculosis
ucgucuguggaucg

SEQ ID NO: 803157 - RNA, 18 nt, Mycobacterium avium subsp. paratuberculosis
ucgucucggaccgguagg

SEQ ID NO: 803158 - RNA, 20 nt, Mycobacterium avium subsp. paratuberculosis
ucgucguuguuggcggcggu

SEQ ID NO: 803159 - RNA, 15 nt, Mycobacterium avium subsp. paratuberculosis
ucgucuuggccugcu

SEQ ID NO: 803160 - RNA, 15 nt, Mycobacterium avium subsp. paratuberculosis
ucgucguucucgggg

SEQ ID NO: 803161 - RNA, 16 nt, Mycobacterium avium subsp. paratuberculosis
ucgucuacuccaccaa

SEQ ID NO: 803162 - RNA, 19 nt, Mycobacterium avium subsp. paratuberculosis
ucgucuccgcugucgucgu

SEQ ID NO: 803163 - RNA, 14 nt, Mycobacterium avium subsp. paratuberculosis
ucgucucggccgcg

SEQ ID NO: 803164 - RNA, 19 nt, Mycobacterium avium subsp. paratuberculosis
ucgucucggccgcggugcg

SEQ ID NO: 803165 - RNA, 17 nt, Mycobacterium avium subsp. paratuberculosis
ucgucucuuccucgggc

SEQ ID NO: 803166 - RNA, 15 nt, Mycobacterium avium subsp. paratuberculosis
ucgugaaacauggcg

SEQ ID NO: 803167 - RNA, 18 nt, Mycobacterium avium subsp. paratuberculosis
ucgugaagaucagcgaag

SEQ ID NO: 803168 - RNA, 17 nt, Mycobacterium avium subsp. paratuberculosis
ucgugaccgaccuccaa

SEQ ID NO: 803169 - RNA, 14 nt, Mycobacterium avium subsp. paratuberculosis
ucgugaccggcggu

SEQ ID NO: 803170 - RNA, 15 nt, Mycobacterium avium subsp. paratuberculosis
ucgugaccggcggug

SEQ ID NO: 803171 - RNA, 12 nt, Mycobacterium avium subsp. paratuberculosis
ucgugacgccgu

SEQ ID NO: 803172 - RNA, 13 nt, Mycobacterium avium subsp. paratuberculosis
ucgugacgccguc

SEQ ID NO: 803173 - RNA, 12 nt, Mycobacterium avium subsp. paratuberculosis
ucgugacgcggc

SEQ ID NO: 803174 - RNA, 13 nt, Mycobacterium avium subsp. paratuberculosis
ucgugacgcggcg

SEQ ID NO: 803175 - RNA, 18 nt, Mycobacterium avium subsp. paratuberculosis
ucgugacgcggcgucggg

SEQ ID NO: 803176 - RNA, 17 nt, Mycobacterium avium subsp. paratuberculosis
ucgugagcgguggccac

SEQ ID NO: 803177 - RNA, 16 nt, Mycobacterium avium subsp. paratuberculosis
ucgucggugggccgcc

SEQ ID NO: 803178 - RNA, 20 nt, Mycobacterium avium subsp. paratuberculosis
ucgucggugggccgccgcgg

SEQ ID NO: 803179 - RNA, 22 nt, Mycobacterium avium subsp. paratuberculosis
ucgucggugggccgccgcggcg

SEQ ID NO: 803180 - RNA, 12 nt, Mycobacterium avium subsp. paratuberculosis
ucgucggucagg

SEQ ID NO: 803181 - RNA, 23 nt, Mycobacterium avium subsp. paratuberculosis
ucgucggucaggaacgcggacag

SEQ ID NO: 803182 - RNA, 17 nt, Mycobacterium avium subsp. paratuberculosis
ucgucggucaggccggc

SEQ ID NO: 803183 - RNA, 22 nt, Mycobacterium avium subsp. paratuberculosis
ucgucggucaggccggcgccgg

SEQ ID NO: 803184 - RNA, 18 nt, Mycobacterium avium subsp. paratuberculosis
ucgucggugaacgccggu

SEQ ID NO: 803185 - RNA, 16 nt, Mycobacterium avium subsp. paratuberculosis
ucgucggucacccggu

SEQ ID NO: 803186 - RNA, 23 nt, Mycobacterium avium subsp. paratuberculosis
ucgucgggugucaggucggcgau

SEQ ID NO: 803187 - RNA, 18 nt, Mycobacterium avium subsp. paratuberculosis
ucgucggguguggcgccg

SEQ ID NO: 803188 - RNA, 19 nt, Mycobacterium avium subsp. paratuberculosis
ucgucggguuggccagggc

SEQ ID NO: 803189 - RNA, 14 nt, Mycobacterium avium subsp. paratuberculosis
ucgucguggugacg

SEQ ID NO: 803190 - RNA, 19 nt, Mycobacterium avium subsp. paratuberculosis
ucgucgugggugacccggc

SEQ ID NO: 803191 - RNA, 22 nt, Mycobacterium avium subsp. paratuberculosis
ucgucgugggugacccggccgu

SEQ ID NO: 803192 - RNA, 15 nt, Mycobacterium avium subsp. paratuberculosis
ucgucgucggagacg

SEQ ID NO: 803193 - RNA, 18 nt, Mycobacterium avium subsp. paratuberculosis
ucgucgucccgucggcgc

SEQ ID NO: 803194 - RNA, 13 nt, Mycobacterium avium subsp. paratuberculosis
ucgucgucgacgc

SEQ ID NO: 803195 - RNA, 21 nt, Mycobacterium avium subsp. paratuberculosis
ucgucgucgagccgcucgcgc

SEQ ID NO: 803196 - RNA, 13 nt, Mycobacterium avium subsp. paratuberculosis
ucgucgucgccga

SEQ ID NO: 803197 - RNA, 13 nt, Mycobacterium avium subsp. paratuberculosis
ucgucgucgccgc

SEQ ID NO: 803198 - RNA, 16 nt, Mycobacterium avium subsp. paratuberculosis
ucgucgucgccgccgg

SEQ ID NO: 803199 - RNA, 15 nt, Mycobacterium avium subsp. paratuberculosis
ucgucgucgccgcgc

SEQ ID NO: 803200 - RNA, 16 nt, Mycobacterium avium subsp. paratuberculosis
ucgucgucggcgacga

SEQ ID NO: 803201 - RNA, 15 nt, Mycobacterium avium subsp. paratuberculosis
ucgucgucggcgggg

SEQ ID NO: 803202 - RNA, 13 nt, Mycobacterium avium subsp. paratuberculosis
ucgucgcaccggc

SEQ ID NO: 803203 - RNA, 15 nt, Mycobacterium avium subsp. paratuberculosis
ucgucgcaccggcag

SEQ ID NO: 803204 - RNA, 22 nt, Mycobacterium avium subsp. paratuberculosis
ucgucgcaccggcagugaucgg

SEQ ID NO: 803205 - RNA, 22 nt, Mycobacterium avium subsp. paratuberculosis
ucgucgaugcgcagcagcggcu

SEQ ID NO: 803206 - RNA, 14 nt, Mycobacterium avium subsp. paratuberculosis
ucgucgauggccac

SEQ ID NO: 803207 - RNA, 19 nt, Mycobacterium avium subsp. paratuberculosis
ucgucgaugggcucgagca

SEQ ID NO: 803208 - RNA, 16 nt, Mycobacterium avium subsp. paratuberculosis
ucgucgaugucggcgg

SEQ ID NO: 803209 - RNA, 18 nt, Mycobacterium avium subsp. paratuberculosis
ucgucgaugcacgccgga

SEQ ID NO: 803210 - RNA, 14 nt, Mycobacterium avium subsp. paratuberculosis
ucgucgaugacgau

SEQ ID NO: 803211 - RNA, 15 nt, Mycobacterium avium subsp. paratuberculosis
ucgucgaugacgucc

SEQ ID NO: 803212 - RNA, 13 nt, Mycobacterium avium subsp. paratuberculosis
ucgucgaugccgu

SEQ ID NO: 803213 - RNA, 17 nt, Mycobacterium avium subsp. paratuberculosis
ucgucgaucgcggcgau

SEQ ID NO: 803214 - RNA, 17 nt, Mycobacterium avium subsp. paratuberculosis
ucgucgaucucggugag

SEQ ID NO: 803215 - RNA, 15 nt, Mycobacterium avium subsp. paratuberculosis
ucgucgaucuucgcg

SEQ ID NO: 803216 - RNA, 19 nt, Mycobacterium avium subsp. paratuberculosis
ucgucgaucuucgcggcgu

SEQ ID NO: 803217 - RNA, 14 nt, Mycobacterium avium subsp. paratuberculosis
ucgucgaugaacag

SEQ ID NO: 803218 - RNA, 16 nt, Mycobacterium avium subsp. paratuberculosis
ucgucgaccgcggccu

SEQ ID NO: 803219 - RNA, 12 nt, Mycobacterium avium subsp. paratuberculosis
ucgucgaucgac

SEQ ID NO: 803220 - RNA, 13 nt, Mycobacterium avium subsp. paratuberculosis
ucgucgaccguca

SEQ ID NO: 803221 - RNA, 17 nt, Mycobacterium avium subsp. paratuberculosis
ucgucgaccgucacgcu

SEQ ID NO: 803222 - RNA, 13 nt, Mycobacterium avium subsp. paratuberculosis
ucgucgaccugcu

SEQ ID NO: 803223 - RNA, 17 nt, Mycobacterium avium subsp. paratuberculosis
ucgucgacgauggcccg

SEQ ID NO: 803224 - RNA, 23 nt, Mycobacterium avium subsp. paratuberculosis
ucgucgacgauggcccggaccgc

SEQ ID NO: 803225 - RNA, 16 nt, Mycobacterium avium subsp. paratuberculosis
ucgucgacgcccaccu

SEQ ID NO: 803226 - RNA, 19 nt, Mycobacterium avium subsp. paratuberculosis
ucgucgaccagggcgauca

SEQ ID NO: 803227 - RNA, 23 nt, Mycobacterium avium subsp. paratuberculosis
ucgucgaccagggcgaucaccgc

SEQ ID NO: 803228 - RNA, 13 nt, Mycobacterium avium subsp. paratuberculosis
ucgucgaccacca

SEQ ID NO: 803229 - RNA, 16 nt, Mycobacterium avium subsp. paratuberculosis
ucgucgaccaccacga

SEQ ID NO: 803230 - RNA, 17 nt, Mycobacterium avium subsp. paratuberculosis
ucgucgaccaccacgac

SEQ ID NO: 803231 - RNA, 18 nt, Mycobacterium avium subsp. paratuberculosis
ucgucgggaacgccgauc

SEQ ID NO: 803232 - RNA, 19 nt, Mycobacterium avium subsp. paratuberculosis
ucgucgggaacgccgauca

SEQ ID NO: 803233 - RNA, 23 nt, Mycobacterium avium subsp. paratuberculosis
ucgucgggaacgccgaucaccgc

SEQ ID NO: 803234 - RNA, 13 nt, Mycobacterium avium subsp. paratuberculosis
ucgucggcggugc

SEQ ID NO: 803235 - RNA, 22 nt, Mycobacterium avium subsp. paratuberculosis
ucgucggcggugccgagcccgc

SEQ ID NO: 803236 - RNA, 14 nt, Mycobacterium avium subsp. paratuberculosis
ucgucggcgguuuc

SEQ ID NO: 803237 - RNA, 23 nt, Mycobacterium avium subsp. paratuberculosis
ucgucggcucguguccgaugacg

SEQ ID NO: 803238 - RNA, 12 nt, Mycobacterium avium subsp. paratuberculosis
ucgucgggcacc

SEQ ID NO: 803239 - RNA, 14 nt, Mycobacterium avium subsp. paratuberculosis
ucgucgggcaccgc

SEQ ID NO: 803240 - RNA, 16 nt, Mycobacterium avium subsp. paratuberculosis
ucgucgggccgcagca

SEQ ID NO: 803241 - RNA, 16 nt, Mycobacterium avium subsp. paratuberculosis
ucgucgggcgccagcc

SEQ ID NO: 803242 - RNA, 13 nt, Mycobacterium avium subsp. paratuberculosis
ucgucgggcgccg

SEQ ID NO: 803243 - RNA, 14 nt, Mycobacterium avium subsp. paratuberculosis
ucgucgggcgccgg

SEQ ID NO: 803244 - RNA, 13 nt, Mycobacterium avium subsp. paratuberculosis
ucgucgggcggca

SEQ ID NO: 803245 - RNA, 19 nt, Mycobacterium avium subsp. paratuberculosis
ucgucggggaucagcgucg

SEQ ID NO: 803246 - RNA, 12 nt, Mycobacterium avium subsp. paratuberculosis
ucgucggggcug

SEQ ID NO: 803247 - RNA, 16 nt, Mycobacterium avium subsp. paratuberculosis
ucgucggggcuggcgg

SEQ ID NO: 803248 - RNA, 18 nt, Mycobacterium avium subsp. paratuberculosis
ucgucggggcuggcggcg

SEQ ID NO: 803249 - RNA, 14 nt, Mycobacterium avium subsp. paratuberculosis
ucgucggcggacug

SEQ ID NO: 803250 - RNA, 13 nt, Mycobacterium avium subsp. paratuberculosis
ucgucggcgggcu

SEQ ID NO: 803251 - RNA, 15 nt, Mycobacterium avium subsp. paratuberculosis
ucgucggcgccgucg

SEQ ID NO: 803252 - RNA, 15 nt, Mycobacterium avium subsp. paratuberculosis
ucgucggcgcgggcc

SEQ ID NO: 803253 - RNA, 13 nt, Mycobacterium avium subsp. paratuberculosis
ucgucggcgcggu

SEQ ID NO: 803254 - RNA, 12 nt, Mycobacterium avium subsp. paratuberculosis
ucgucggcgccg

SEQ ID NO: 803255 - RNA, 15 nt, Mycobacterium avium subsp. paratuberculosis
ucgucggcgccgcgc

SEQ ID NO: 803256 - RNA, 13 nt, Mycobacterium avium subsp. paratuberculosis
ucgucggcgccgg

SEQ ID NO: 803257 - RNA, 14 nt, Mycobacterium avium subsp. paratuberculosis
ucgucggcgccggc

SEQ ID NO: 803258 - RNA, 16 nt, Mycobacterium avium subsp. paratuberculosis
ucgucgcccacccgcc

SEQ ID NO: 803259 - RNA, 15 nt, Mycobacterium avium subsp. paratuberculosis
ucgucgcccaccgac

SEQ ID NO: 803260 - RNA, 19 nt, Mycobacterium avium subsp. paratuberculosis
ucgucgcccaccgacgcgg

SEQ ID NO: 803261 - RNA, 15 nt, Mycobacterium avium subsp. paratuberculosis
ucgucgcccaccgug

SEQ ID NO: 803262 - RNA, 17 nt, Mycobacterium avium subsp. paratuberculosis
ucgucgcccaccguguu

SEQ ID NO: 803263 - RNA, 13 nt, Mycobacterium avium subsp. paratuberculosis
ucgucggcgagca

SEQ ID NO: 803264 - RNA, 20 nt, Mycobacterium avium subsp. paratuberculosis
ucgucggcgagcagcagcgc

SEQ ID NO: 803265 - RNA, 13 nt, Mycobacterium avium subsp. paratuberculosis
ucgucggcgaucg

SEQ ID NO: 803266 - RNA, 13 nt, Mycobacterium avium subsp. paratuberculosis
ucgucggcgaugg

SEQ ID NO: 803267 - RNA, 21 nt, Mycobacterium avium subsp. paratuberculosis
ucggucaagccggccagcagc

SEQ ID NO: 803268 - RNA, 15 nt, Mycobacterium avium subsp. paratuberculosis
ucggucaccagcggc

SEQ ID NO: 803269 - RNA, 15 nt, Mycobacterium avium subsp. paratuberculosis
ucgguagggucgggu

SEQ ID NO: 803270 - RNA, 23 nt, Mycobacterium avium subsp. paratuberculosis
ucgguagggucgggugcggcggu

SEQ ID NO: 803271 - RNA, 17 nt, Mycobacterium avium subsp. paratuberculosis
ucgguaguugcacucuc

SEQ ID NO: 803272 - RNA, 20 nt, Mycobacterium avium subsp. paratuberculosis
ucgguaguugcacucucgcg

SEQ ID NO: 803273 - RNA, 20 nt, Mycobacterium avium subsp. paratuberculosis
ucggguguaggcccgaucag

SEQ ID NO: 803274 - RNA, 14 nt, Mycobacterium avium subsp. paratuberculosis
ucgggugucgccga

SEQ ID NO: 803275 - RNA, 18 nt, Mycobacterium avium subsp. paratuberculosis
ucgggugucgccgagccg

SEQ ID NO: 803276 - RNA, 13 nt, Mycobacterium avium subsp. paratuberculosis
ucggguggcgucg

SEQ ID NO: 803277 - RNA, 14 nt, Mycobacterium avium subsp. paratuberculosis
ucggguggcgucgc

SEQ ID NO: 803278 - RNA, 17 nt, Mycobacterium avium subsp. paratuberculosis
ucggguggcgucgccgc

SEQ ID NO: 803279 - RNA, 14 nt, Mycobacterium avium subsp. paratuberculosis
ucgggugacgccuc

SEQ ID NO: 803280 - RNA, 23 nt, Mycobacterium avium subsp. paratuberculosis
ucgggugacgccucaggcgagca

SEQ ID NO: 803281 - RNA, 21 nt, Mycobacterium avium subsp. paratuberculosis
ucgggugaguaguccagcacc

SEQ ID NO: 803282 - RNA, 16 nt, Mycobacterium avium subsp. paratuberculosis
ucgggugcggcgugcg

SEQ ID NO: 803283 - RNA, 15 nt, Mycobacterium avium subsp. paratuberculosis
ucgggugcgggugcg

SEQ ID NO: 803284 - RNA, 24 nt, Mycobacterium avium subsp. paratuberculosis
ucggucacccgguugagcaccgca

SEQ ID NO: 803285 - RNA, 18 nt, Mycobacterium avium subsp. paratuberculosis
ucggucacggacagccgg

SEQ ID NO: 803286 - RNA, 14 nt, Mycobacterium avium subsp. paratuberculosis
ucggucagcacgac

SEQ ID NO: 803287 - RNA, 17 nt, Mycobacterium avium subsp. paratuberculosis
ucggucagccgggcggc

SEQ ID NO: 803288 - RNA, 13 nt, Mycobacterium avium subsp. paratuberculosis
ucggucagcgagc

SEQ ID NO: 803289 - RNA, 16 nt, Mycobacterium avium subsp. paratuberculosis
ucggucagcaggcgcc

SEQ ID NO: 803290 - RNA, 17 nt, Mycobacterium avium subsp. paratuberculosis
ucggucagcaggcgccg

SEQ ID NO: 803291 - RNA, 15 nt, Mycobacterium avium subsp. paratuberculosis
ucggucagcggcguc

SEQ ID NO: 803292 - RNA, 14 nt, Mycobacterium avium subsp. paratuberculosis
ucggucagcgucgc

SEQ ID NO: 803293 - RNA, 15 nt, Mycobacterium avium subsp. paratuberculosis
ucggucagcgucgcc

SEQ ID NO: 803294 - RNA, 13 nt, Mycobacterium avium subsp. paratuberculosis
ucggucagcucga

SEQ ID NO: 803295 - RNA, 18 nt, Mycobacterium avium subsp. paratuberculosis
ucggucaggaacgcggac

SEQ ID NO: 803296 - RNA, 19 nt, Mycobacterium avium subsp. paratuberculosis
ucggucaggaacgcggaca

SEQ ID NO: 803297 - RNA, 20 nt, Mycobacterium avium subsp. paratuberculosis
ucggucaggcacucgaucag

SEQ ID NO: 803298 - RNA, 16 nt, Mycobacterium avium subsp. paratuberculosis
ucggucaggccggcgc

SEQ ID NO: 803299 - RNA, 12 nt, Mycobacterium avium subsp. paratuberculosis
ucgggucgcccg

SEQ ID NO: 803300 - RNA, 18 nt, Mycobacterium avium subsp. paratuberculosis
ucgggucgguggcgauga

SEQ ID NO: 803301 - RNA, 14 nt, Mycobacterium avium subsp. paratuberculosis
ucggguccagcgcc

SEQ ID NO: 803302 - RNA, 14 nt, Mycobacterium avium subsp. paratuberculosis
ucggguccgaccag

SEQ ID NO: 803303 - RNA, 14 nt, Mycobacterium avium subsp. paratuberculosis
ucggguccgcgguc

SEQ ID NO: 803304 - RNA, 15 nt, Mycobacterium avium subsp. paratuberculosis
ucgggucgacgagca

SEQ ID NO: 803305 - RNA, 18 nt, Mycobacterium avium subsp. paratuberculosis
ucgggucgacgagcaggc

SEQ ID NO: 803306 - RNA, 16 nt, Mycobacterium avium subsp. paratuberculosis
ucggguacaccgagcc

SEQ ID NO: 803307 - RNA, 15 nt, Mycobacterium avium subsp. paratuberculosis
ucggguagacgauca

SEQ ID NO: 803308 - RNA, 15 nt, Mycobacterium avium subsp. paratuberculosis
ucgggucaccgugcg

SEQ ID NO: 803309 - RNA, 20 nt, Mycobacterium avium subsp. paratuberculosis
ucgggucaccgugcgggucg

SEQ ID NO: 803310 - RNA, 18 nt, Mycobacterium avium subsp. paratuberculosis
ucgggguggggacgacgc

SEQ ID NO: 803311 - RNA, 17 nt, Mycobacterium avium subsp. paratuberculosis
ucgggguggucaccggc

SEQ ID NO: 803312 - RNA, 21 nt, Mycobacterium avium subsp. paratuberculosis
ucggggugguugaucacgggc

SEQ ID NO: 803313 - RNA, 16 nt, Mycobacterium avium subsp. paratuberculosis
ucgggggugucguagc

SEQ ID NO: 803314 - RNA, 17 nt, Mycobacterium avium subsp. paratuberculosis
ucgggguacucggcggc

SEQ ID NO: 803315 - RNA, 22 nt, Mycobacterium avium subsp. paratuberculosis
ucgggguacucggcggcgggca

SEQ ID NO: 803316 - RNA, 13 nt, Mycobacterium avium subsp. paratuberculosis
ucgggguccaggc

SEQ ID NO: 803317 - RNA, 22 nt, Mycobacterium avium subsp. paratuberculosis
ucggggucgaacaucacccggc

SEQ ID NO: 803318 - RNA, 13 nt, Mycobacterium avium subsp. paratuberculosis
ucggggucgccgu

SEQ ID NO: 803319 - RNA, 15 nt, Mycobacterium avium subsp. paratuberculosis
ucggggucggcgucg

SEQ ID NO: 803320 - RNA, 17 nt, Mycobacterium avium subsp. paratuberculosis
ucggggucggcgucggg

SEQ ID NO: 803321 - RNA, 13 nt, Mycobacterium avium subsp. paratuberculosis
ucggggucgucga

SEQ ID NO: 803322 - RNA, 17 nt, Mycobacterium avium subsp. paratuberculosis
ucggggucgucgacggc

SEQ ID NO: 803323 - RNA, 19 nt, Mycobacterium avium subsp. paratuberculosis
ucggggugccgccggggac

SEQ ID NO: 803324 - RNA, 23 nt, Mycobacterium avium subsp. paratuberculosis
ucggggugcgccaggcaggcggc

SEQ ID NO: 803325 - RNA, 19 nt, Mycobacterium avium subsp. paratuberculosis
ucggggugcggucggcgac

SEQ ID NO: 803326 - RNA, 15 nt, Mycobacterium avium subsp. paratuberculosis
ucgggguggacgcga

SEQ ID NO: 803327 - RNA, 17 nt, Mycobacterium avium subsp. paratuberculosis
ucgggguggaucgccca

SEQ ID NO: 803328 - RNA, 15 nt, Mycobacterium avium subsp. paratuberculosis
ucgggguggccggcc

SEQ ID NO: 803329 - RNA, 17 nt, Mycobacterium avium subsp. paratuberculosis
ucgggguggccggccag

SEQ ID NO: 803330 - RNA, 23 nt, Mycobacterium avium subsp. paratuberculosis
ucgggcuaagcgauuacgaccag

SEQ ID NO: 803331 - RNA, 14 nt, Mycobacterium avium subsp. paratuberculosis
ucgggcucgcgguc

SEQ ID NO: 803332 - RNA, 14 nt, Mycobacterium avium subsp. paratuberculosis
ucgggcucgucgug

SEQ ID NO: 803333 - RNA, 17 nt, Mycobacterium avium subsp. paratuberculosis
ucgggcucgucgugaug

SEQ ID NO: 803334 - RNA, 20 nt, Mycobacterium avium subsp. paratuberculosis
ucgggcucgucgugauggcg

SEQ ID NO: 803335 - RNA, 18 nt, Mycobacterium avium subsp. paratuberculosis
ucgggcgcggugugggcg

SEQ ID NO: 803336 - RNA, 22 nt, Mycobacterium avium subsp. paratuberculosis
ucgggcgcggugugggcgaugg

SEQ ID NO: 803337 - RNA, 15 nt, Mycobacterium avium subsp. paratuberculosis
ucgggcgcucggcca

SEQ ID NO: 803338 - RNA, 18 nt, Mycobacterium avium subsp. paratuberculosis
ucgggcgcucggccagca

SEQ ID NO: 803339 - RNA, 21 nt, Mycobacterium avium subsp. paratuberculosis
ucgggcggccugccggccgcc

SEQ ID NO: 803340 - RNA, 21 nt, Mycobacterium avium subsp. paratuberculosis
ucgggcggguggaucuugacg

SEQ ID NO: 803341 - RNA, 16 nt, Mycobacterium avium subsp. paratuberculosis
ucgggcgacgacgcgg

SEQ ID NO: 803342 - RNA, 13 nt, Mycobacterium avium subsp. paratuberculosis
ucgggccugacca

SEQ ID NO: 803343 - RNA, 12 nt, Mycobacterium avium subsp. paratuberculosis
ucgggcgcacca

SEQ ID NO: 803344 - RNA, 21 nt, Mycobacterium avium subsp. paratuberculosis
ucgggcgcaccacgaccuccg

SEQ ID NO: 803345 - RNA, 22 nt, Mycobacterium avium subsp. paratuberculosis
ucgggcgcagaaaaaggccgcc

SEQ ID NO: 803346 - RNA, 21 nt, Mycobacterium avium subsp. paratuberculosis
ucgggcgccagcccgcccagc

SEQ ID NO: 803347 - RNA, 11 nt, Mycobacterium avium subsp. paratuberculosis
ucgggcgccgg

SEQ ID NO: 803348 - RNA, 21 nt, Mycobacterium avium subsp. paratuberculosis
ucgggcgccgguuccuccgac

SEQ ID NO: 803349 - RNA, 21 nt, Mycobacterium avium subsp. paratuberculosis
ucgggcgcgaacagcgccgac

SEQ ID NO: 803350 - RNA, 14 nt, Mycobacterium avium subsp. paratuberculosis
ucgggccggcgccg

SEQ ID NO: 803351 - RNA, 17 nt, Mycobacterium avium subsp. paratuberculosis
ucgggccggcgccgacg

SEQ ID NO: 803352 - RNA, 19 nt, Mycobacterium avium subsp. paratuberculosis
ucgggccggcgccgacgac

SEQ ID NO: 803353 - RNA, 17 nt, Mycobacterium avium subsp. paratuberculosis
ucgggccgggggcggcg

SEQ ID NO: 803354 - RNA, 21 nt, Mycobacterium avium subsp. paratuberculosis
ucgggccgggggcggcggcgc

SEQ ID NO: 803355 - RNA, 16 nt, Mycobacterium avium subsp. paratuberculosis
ucgggccggucagcgc

SEQ ID NO: 803356 - RNA, 18 nt, Mycobacterium avium subsp. paratuberculosis
ucgggccggucagcgcga

SEQ ID NO: 803357 - RNA, 19 nt, Mycobacterium avium subsp. paratuberculosis
ucgggccggucagcgcgac

SEQ ID NO: 803358 - RNA, 15 nt, Mycobacterium avium subsp. paratuberculosis
ucgggccguccgccg

SEQ ID NO: 803359 - RNA, 22 nt, Mycobacterium avium subsp. paratuberculosis
ucgggccguccgccggcuggcg

SEQ ID NO: 803360 - RNA, 12 nt, Mycobacterium avium subsp. paratuberculosis
ucgggccggcag

SEQ ID NO: 803361 - RNA, 13 nt, Mycobacterium avium subsp. paratuberculosis
ucgggccggcagc

SEQ ID NO: 803362 - RNA, 17 nt, Mycobacterium avium subsp. paratuberculosis
ucgggccggcagccggc

SEQ ID NO: 803363 - RNA, 19 nt, Mycobacterium avium subsp. paratuberculosis
ucgggccggcagccggcca

SEQ ID NO: 803364 - RNA, 20 nt, Mycobacterium avium subsp. paratuberculosis
ucgggccggcagccggccac

SEQ ID NO: 803365 - RNA, 12 nt, Mycobacterium avium subsp. paratuberculosis
ucgggccggccg

SEQ ID NO: 803366 - RNA, 14 nt, Mycobacterium avium subsp. paratuberculosis
ucgggcccgacgac

SEQ ID NO: 803367 - RNA, 17 nt, Mycobacterium avium subsp. paratuberculosis
ucgggcccgacgacgau

SEQ ID NO: 803368 - RNA, 17 nt, Mycobacterium avium subsp. paratuberculosis
ucggggaauuccggcgc

SEQ ID NO: 803369 - RNA, 13 nt, Mycobacterium avium subsp. paratuberculosis
ucggggaccgucc

SEQ ID NO: 803370 - RNA, 20 nt, Mycobacterium avium subsp. paratuberculosis
ucggggaccguccccguccg

SEQ ID NO: 803371 - RNA, 14 nt, Mycobacterium avium subsp. paratuberculosis
ucggggacgaagac

SEQ ID NO: 803372 - RNA, 15 nt, Mycobacterium avium subsp. paratuberculosis
ucggggaucagcguc

SEQ ID NO: 803373 - RNA, 23 nt, Mycobacterium avium subsp. paratuberculosis
ucggggaucccgaaaccgucgac

SEQ ID NO: 803374 - RNA, 16 nt, Mycobacterium avium subsp. paratuberculosis
ucggggaucgccaggc

SEQ ID NO: 803375 - RNA, 13 nt, Mycobacterium avium subsp. paratuberculosis
ucggggccaccag

SEQ ID NO: 803376 - RNA, 21 nt, Mycobacterium avium subsp. paratuberculosis
ucgggcugcgcuugcggcgca

SEQ ID NO: 803377 - RNA, 21 nt, Mycobacterium avium subsp. paratuberculosis
ucggggcccaccccggacaac

SEQ ID NO: 803378 - RNA, 23 nt, Mycobacterium avium subsp. paratuberculosis
ucggggcccguccccaccaccga

SEQ ID NO: 803379 - RNA, 23 nt, Mycobacterium avium subsp. paratuberculosis
ucggggccgcacucuugcgugcg

SEQ ID NO: 803380 - RNA, 16 nt, Mycobacterium avium subsp. paratuberculosis
ucggggcgaccuggac

SEQ ID NO: 803381 - RNA, 17 nt, Mycobacterium avium subsp. paratuberculosis
ucggggcgcagcccggc

SEQ ID NO: 803382 - RNA, 21 nt, Mycobacterium avium subsp. paratuberculosis
ucggggcgccuaccggguggc

SEQ ID NO: 803383 - RNA, 23 nt, Mycobacterium avium subsp. paratuberculosis
ucggggcgccuaccggguggcca

SEQ ID NO: 803384 - RNA, 22 nt, Mycobacterium avium subsp. paratuberculosis
ucggggcucgcggugugggcgg

SEQ ID NO: 803385 - RNA, 15 nt, Mycobacterium avium subsp. paratuberculosis
ucggggcuggcggcg

SEQ ID NO: 803386 - RNA, 24 nt, Mycobacterium avium subsp. paratuberculosis
ucggggcggaugugccuggcccag

SEQ ID NO: 803387 - RNA, 17 nt, Mycobacterium avium subsp. paratuberculosis
ucggggcgucggcggcc

SEQ ID NO: 803388 - RNA, 23 nt, Mycobacterium avium subsp. paratuberculosis
ucgggggcgggcaccucgaugcc

SEQ ID NO: 803389 - RNA, 22 nt, Mycobacterium avium subsp. paratuberculosis
ucgggauccaggaacggcaccc

SEQ ID NO: 803390 - RNA, 21 nt, Mycobacterium avium subsp. paratuberculosis
ucgggauccucgccgcgggcc

SEQ ID NO: 803391 - RNA, 16 nt, Mycobacterium avium subsp. paratuberculosis
ucgggauagccgagcg

SEQ ID NO: 803392 - RNA, 13 nt, Mycobacterium avium subsp. paratuberculosis
ucgggauagggcg

SEQ ID NO: 803393 - RNA, 14 nt, Mycobacterium avium subsp. paratuberculosis
ucgggauagggcgc

SEQ ID NO: 803394 - RNA, 13 nt, Mycobacterium avium subsp. paratuberculosis
ucgggaucggcgc

SEQ ID NO: 803395 - RNA, 16 nt, Mycobacterium avium subsp. paratuberculosis
ucgggaucgucgccgg

SEQ ID NO: 803396 - RNA, 15 nt, Mycobacterium avium subsp. paratuberculosis
ucgggagugcggccc

SEQ ID NO: 803397 - RNA, 22 nt, Mycobacterium avium subsp. paratuberculosis
ucgggagugcggcccacccgga

SEQ ID NO: 803398 - RNA, 15 nt, Mycobacterium avium subsp. paratuberculosis
ucgggaguuggucug

SEQ ID NO: 803399 - RNA, 15 nt, Mycobacterium avium subsp. paratuberculosis
ucgggacgucggcgc

SEQ ID NO: 803400 - RNA, 22 nt, Mycobacterium avium subsp. paratuberculosis
ucgggacgucggcgcgcucggu

SEQ ID NO: 803401 - RNA, 15 nt, Mycobacterium avium subsp. paratuberculosis
ucgggacggccagca

SEQ ID NO: 803402 - RNA, 23 nt, Mycobacterium avium subsp. paratuberculosis
ucgggagcaaggucgucgcggcc

SEQ ID NO: 803403 - RNA, 14 nt, Mycobacterium avium subsp. paratuberculosis
ucgggauggcggcg

SEQ ID NO: 803404 - RNA, 13 nt, Mycobacterium avium subsp. paratuberculosis
ucgggauggucga

SEQ ID NO: 803405 - RNA, 16 nt, Mycobacterium avium subsp. paratuberculosis
ucgggauggucgaucc

SEQ ID NO: 803406 - RNA, 22 nt, Mycobacterium avium subsp. paratuberculosis
ucgggauugaggcuggcgauca

SEQ ID NO: 803407 - RNA, 18 nt, Mycobacterium avium subsp. paratuberculosis
ucgggcaacgcgccggcg

SEQ ID NO: 803408 - RNA, 20 nt, Mycobacterium avium subsp. paratuberculosis
ucgggcaacgcgccggcggu

SEQ ID NO: 803409 - RNA, 17 nt, Mycobacterium avium subsp. paratuberculosis
ucgggcaaucggaccca

SEQ ID NO: 803410 - RNA, 23 nt, Mycobacterium avium subsp. paratuberculosis
ucgggcaaucggacccagcccga

SEQ ID NO: 803411 - RNA, 15 nt, Mycobacterium avium subsp. paratuberculosis
ucgggcaccacgccg

SEQ ID NO: 803412 - RNA, 17 nt, Mycobacterium avium subsp. paratuberculosis
ucgggcaccacgccgac

SEQ ID NO: 803413 - RNA, 14 nt, Mycobacterium avium subsp. paratuberculosis
ucgggcaccagcac

SEQ ID NO: 803414 - RNA, 22 nt, Mycobacterium avium subsp. paratuberculosis
ucgggcaccccugccgccaccg

SEQ ID NO: 803415 - RNA, 23 nt, Mycobacterium avium subsp. paratuberculosis
ucgggcaccccugccgccaccgc

SEQ ID NO: 803416 - RNA, 14 nt, Mycobacterium avium subsp. paratuberculosis
ucgggcaccgccag

SEQ ID NO: 803417 - RNA, 13 nt, Mycobacterium avium subsp. paratuberculosis
ucgggcagcccgc

SEQ ID NO: 803418 - RNA, 18 nt, Mycobacterium avium subsp. paratuberculosis
ucgggcagcccgccgacc

SEQ ID NO: 803419 - RNA, 23 nt, Mycobacterium avium subsp. paratuberculosis
ucgggcagcgugucccgguacag

SEQ ID NO: 803420 - RNA, 23 nt, Mycobacterium avium subsp. paratuberculosis
ucgggcagcagcaccagcgccgc

SEQ ID NO: 803421 - RNA, 21 nt, Mycobacterium avium subsp. paratuberculosis
ucgggcagauggucgccgacg

SEQ ID NO: 803422 - RNA, 19 nt, Mycobacterium avium subsp. paratuberculosis
ucgggcacguccagcccgc

SEQ ID NO: 803423 - RNA, 14 nt, Mycobacterium avium subsp. paratuberculosis
ucgggccgcgggcc

SEQ ID NO: 803424 - RNA, 13 nt, Mycobacterium avium subsp. paratuberculosis
ucgggccggacag

SEQ ID NO: 803425 - RNA, 15 nt, Mycobacterium avium subsp. paratuberculosis
ucgggcccagcagcc

SEQ ID NO: 803426 - RNA, 23 nt, Mycobacterium avium subsp. paratuberculosis
ucgggcccgcgcaccgucaucgc

SEQ ID NO: 803427 - RNA, 14 nt, Mycobacterium avium subsp. paratuberculosis
ucgggcccggccgc

SEQ ID NO: 803428 - RNA, 15 nt, Mycobacterium avium subsp. paratuberculosis
ucgggcccggccgcc

SEQ ID NO: 803429 - RNA, 18 nt, Mycobacterium avium subsp. paratuberculosis
ucgggccagcgccgagcc

SEQ ID NO: 803430 - RNA, 19 nt, Mycobacterium avium subsp. paratuberculosis
ucgggcagugcacgacgac

SEQ ID NO: 803431 - RNA, 14 nt, Mycobacterium avium subsp. paratuberculosis
ucgggcaugaugaa

SEQ ID NO: 803432 - RNA, 15 nt, Mycobacterium avium subsp. paratuberculosis
ucggcuuucucgcca

SEQ ID NO: 803433 - RNA, 18 nt, Mycobacterium avium subsp. paratuberculosis
ucggcuugcgucgcuguc

SEQ ID NO: 803434 - RNA, 23 nt, Mycobacterium avium subsp. paratuberculosis
ucggcuugcgucgcugucggcga

SEQ ID NO: 803435 - RNA, 15 nt, Mycobacterium avium subsp. paratuberculosis
ucggcuucgucgggu

SEQ ID NO: 803436 - RNA, 18 nt, Mycobacterium avium subsp. paratuberculosis
ucggcuuggggaagccgg

SEQ ID NO: 803437 - RNA, 22 nt, Mycobacterium avium subsp. paratuberculosis
ucggcuuggggaagccggccag

SEQ ID NO: 803438 - RNA, 12 nt, Mycobacterium avium subsp. paratuberculosis
ucggcgcgggcc

SEQ ID NO: 803439 - RNA, 13 nt, Mycobacterium avium subsp. paratuberculosis
ucggcgcggcgac

SEQ ID NO: 803440 - RNA, 19 nt, Mycobacterium avium subsp. paratuberculosis
ucggcuuccuccucggcgc

SEQ ID NO: 803441 - RNA, 22 nt, Mycobacterium avium subsp. paratuberculosis
ucggcuuccuccucggcgcgga

SEQ ID NO: 803442 - RNA, 21 nt, Mycobacterium avium subsp. paratuberculosis
ucgggaaaucggacccagccc

SEQ ID NO: 803443 - RNA, 17 nt, Mycobacterium avium subsp. paratuberculosis
ucgggaaaugcgucgcc

SEQ ID NO: 803444 - RNA, 18 nt, Mycobacterium avium subsp. paratuberculosis
ucgggaaaugcgucgcca

SEQ ID NO: 803445 - RNA, 14 nt, Mycobacterium avium subsp. paratuberculosis
ucgggaaacgcguc

SEQ ID NO: 803446 - RNA, 17 nt, Mycobacterium avium subsp. paratuberculosis
ucgggaaacgcgucgcu

SEQ ID NO: 803447 - RNA, 15 nt, Mycobacterium avium subsp. paratuberculosis
ucgggaacgccgauc

SEQ ID NO: 803448 - RNA, 19 nt, Mycobacterium avium subsp. paratuberculosis
ucgggaacggguagugcac

SEQ ID NO: 803449 - RNA, 18 nt, Mycobacterium avium subsp. paratuberculosis
ucgggaccgaugccgcug

SEQ ID NO: 803450 - RNA, 15 nt, Mycobacterium avium subsp. paratuberculosis
ucgggaccgcgggcg

SEQ ID NO: 803451 - RNA, 15 nt, Mycobacterium avium subsp. paratuberculosis
ucgggaaugucggcg

SEQ ID NO: 803452 - RNA, 20 nt, Mycobacterium avium subsp. paratuberculosis
ucgggaaugucggcguuggu

SEQ ID NO: 803453 - RNA, 15 nt, Mycobacterium avium subsp. paratuberculosis
ucgggaccgggaagc

SEQ ID NO: 803454 - RNA, 19 nt, Mycobacterium avium subsp. paratuberculosis
ucgggaccgggaagccgag

SEQ ID NO: 803455 - RNA, 12 nt, Mycobacterium avium subsp. paratuberculosis
ucgggacgcggc

SEQ ID NO: 803456 - RNA, 14 nt, Mycobacterium avium subsp. paratuberculosis
ucgggacgcggcag

SEQ ID NO: 803457 - RNA, 16 nt, Mycobacterium avium subsp. paratuberculosis
ucggcgcggagcgucg

SEQ ID NO: 803458 - RNA, 22 nt, Mycobacterium avium subsp. paratuberculosis
ucggcgcggagcgucgcgauga

SEQ ID NO: 803459 - RNA, 14 nt, Mycobacterium avium subsp. paratuberculosis
ucggcgcggccgga

SEQ ID NO: 803460 - RNA, 20 nt, Mycobacterium avium subsp. paratuberculosis
ucggcgcgcggggccggcgc

SEQ ID NO: 803461 - RNA, 23 nt, Mycobacterium avium subsp. paratuberculosis
ucggcgcgccgaagauggccagc

SEQ ID NO: 803462 - RNA, 14 nt, Mycobacterium avium subsp. paratuberculosis
ucggcgcgccggcg

SEQ ID NO: 803463 - RNA, 16 nt, Mycobacterium avium subsp. paratuberculosis
ucggcgcgccggcgau

SEQ ID NO: 803464 - RNA, 21 nt, Mycobacterium avium subsp. paratuberculosis
ucggcgcgcaucuugaucucg

SEQ ID NO: 803465 - RNA, 15 nt, Mycobacterium avium subsp. paratuberculosis
ucggcgcgccacccg

SEQ ID NO: 803466 - RNA, 17 nt, Mycobacterium avium subsp. paratuberculosis
ucggcgcgccacccgac

SEQ ID NO: 803467 - RNA, 20 nt, Mycobacterium avium subsp. paratuberculosis
ucggcgcgcagcucgcgcag

SEQ ID NO: 803468 - RNA, 15 nt, Mycobacterium avium subsp. paratuberculosis
ucggcgccgucgccg

SEQ ID NO: 803469 - RNA, 18 nt, Mycobacterium avium subsp. paratuberculosis
ucggcgccgucgccggac

SEQ ID NO: 803470 - RNA, 15 nt, Mycobacterium avium subsp. paratuberculosis
ucggcgccucggcgu

SEQ ID NO: 803471 - RNA, 21 nt, Mycobacterium avium subsp. paratuberculosis
ucggcgccucggcgucccggc

SEQ ID NO: 803472 - RNA, 17 nt, Mycobacterium avium subsp. paratuberculosis
ucggcgccugcgagcac

SEQ ID NO: 803473 - RNA, 19 nt, Mycobacterium avium subsp. paratuberculosis
uccgaauccagcgcgccgc

SEQ ID NO: 803474 - RNA, 14 nt, Mycobacterium avium subsp. paratuberculosis
uccgcccgccggug

SEQ ID NO: 803475 - RNA, 14 nt, Mycobacterium avium subsp. paratuberculosis
uccgcccggaccag

SEQ ID NO: 803476 - RNA, 14 nt, Mycobacterium avium subsp. paratuberculosis
uccgccccgagauc

SEQ ID NO: 803477 - RNA, 21 nt, Mycobacterium avium subsp. paratuberculosis
uccgccgcagcggcgccgcag

SEQ ID NO: 803478 - RNA, 19 nt, Mycobacterium avium subsp. paratuberculosis
uccgccgacaccagggugc

SEQ ID NO: 803479 - RNA, 20 nt, Mycobacterium avium subsp. paratuberculosis
uccgccgacaccagggugcg

SEQ ID NO: 803480 - RNA, 23 nt, Mycobacterium avium subsp. paratuberculosis
uccgccgacgauacgugcucccg

SEQ ID NO: 803481 - RNA, 17 nt, Mycobacterium avium subsp. paratuberculosis
uccgccgaaccgaucac

SEQ ID NO: 803482 - RNA, 16 nt, Mycobacterium avium subsp. paratuberculosis
uccgaaaaacgcgucg

SEQ ID NO: 803483 - RNA, 19 nt, Mycobacterium avium subsp. paratuberculosis
uccgaaaaacgcgucgcgu

SEQ ID NO: 803484 - RNA, 14 nt, Mycobacterium avium subsp. paratuberculosis
uccgaacgugcagc

SEQ ID NO: 803485 - RNA, 22 nt, Mycobacterium avium subsp. paratuberculosis
ucccuguuagggcgaccaccac

SEQ ID NO: 803486 - RNA, 14 nt, Mycobacterium avium subsp. paratuberculosis
ucccuugccgccga

SEQ ID NO: 803487 - RNA, 19 nt, Mycobacterium avium subsp. paratuberculosis
ucccuggugaccgacgacg

SEQ ID NO: 803488 - RNA, 22 nt, Mycobacterium avium subsp. paratuberculosis
uccgcgguucgaucuccucggc

SEQ ID NO: 803489 - RNA, 16 nt, Mycobacterium avium subsp. paratuberculosis
uccgcggucagacgau

SEQ ID NO: 803490 - RNA, 14 nt, Mycobacterium avium subsp. paratuberculosis
uccgcggucgacca

SEQ ID NO: 803491 - RNA, 12 nt, Mycobacterium avium subsp. paratuberculosis
uccgcggccgcg

SEQ ID NO: 803492 - RNA, 19 nt, Mycobacterium avium subsp. paratuberculosis
uccgcggccgcggcgcgca

SEQ ID NO: 803493 - RNA, 13 nt, Mycobacterium avium subsp. paratuberculosis
uccgcgggcagcg

SEQ ID NO: 803494 - RNA, 14 nt, Mycobacterium avium subsp. paratuberculosis
uccgcgggcagcga

SEQ ID NO: 803495 - RNA, 19 nt, Mycobacterium avium subsp. paratuberculosis
uccgcgggcagcgagcaca

SEQ ID NO: 803496 - RNA, 22 nt, Mycobacterium avium subsp. paratuberculosis
uccgcgggcagcgagcacagcg

SEQ ID NO: 803497 - RNA, 16 nt, Mycobacterium avium subsp. paratuberculosis
uccgcgggcguggcgg

SEQ ID NO: 803498 - RNA, 20 nt, Mycobacterium avium subsp. paratuberculosis
uccgcgggcguggcggucgg

SEQ ID NO: 803499 - RNA, 12 nt, Mycobacterium avium subsp. paratuberculosis
uccgcgcgucgg

SEQ ID NO: 803500 - RNA, 14 nt, Mycobacterium avium subsp. paratuberculosis
uccgcgcgucgggc

SEQ ID NO: 803501 - RNA, 20 nt, Mycobacterium avium subsp. paratuberculosis
uccgcgcgucgggcucgcgg

SEQ ID NO: 803502 - RNA, 17 nt, Mycobacterium avium subsp. paratuberculosis
uccgcgcgucucccccg

SEQ ID NO: 803503 - RNA, 20 nt, Mycobacterium avium subsp. paratuberculosis
uccgcgcgucucccccgauc

SEQ ID NO: 803504 - RNA, 16 nt, Mycobacterium avium subsp. paratuberculosis
uccgcggaggcgagca

SEQ ID NO: 803505 - RNA, 14 nt, Mycobacterium avium subsp. paratuberculosis
uccgcggccaccgg

SEQ ID NO: 803506 - RNA, 19 nt, Mycobacterium avium subsp. paratuberculosis
uccgcggccaccgggaccg

SEQ ID NO: 803507 - RNA, 13 nt, Mycobacterium avium subsp. paratuberculosis
uccgcggccagcu

SEQ ID NO: 803508 - RNA, 20 nt, Mycobacterium avium subsp. paratuberculosis
uccgcggccagcucggucgc

SEQ ID NO: 803509 - RNA, 22 nt, Mycobacterium avium subsp. paratuberculosis
uccgcggccagcucggucgcgg

SEQ ID NO: 803510 - RNA, 15 nt, Mycobacterium avium subsp. paratuberculosis
uccgcggcgaugacc

SEQ ID NO: 803511 - RNA, 19 nt, Mycobacterium avium subsp. paratuberculosis
uccgcggcgaugaccggac

SEQ ID NO: 803512 - RNA, 14 nt, Mycobacterium avium subsp. paratuberculosis
uccgcggcgccggg

SEQ ID NO: 803513 - RNA, 17 nt, Mycobacterium avium subsp. paratuberculosis
uccgcggcgccgggcgg

SEQ ID NO: 803514 - RNA, 20 nt, Mycobacterium avium subsp. paratuberculosis
uccgcggcgccguagguggc

SEQ ID NO: 803515 - RNA, 14 nt, Mycobacterium avium subsp. paratuberculosis
uccgcggcgcgguu

SEQ ID NO: 803516 - RNA, 15 nt, Mycobacterium avium subsp. paratuberculosis
uccgcggcggccggc

SEQ ID NO: 803517 - RNA, 13 nt, Mycobacterium avium subsp. paratuberculosis
uccgcggcgggcg

SEQ ID NO: 803518 - RNA, 16 nt, Mycobacterium avium subsp. paratuberculosis
uccgcgaacucgucga

SEQ ID NO: 803519 - RNA, 21 nt, Mycobacterium avium subsp. paratuberculosis
uccgccuucgaaugcgaugag

SEQ ID NO: 803520 - RNA, 15 nt, Mycobacterium avium subsp. paratuberculosis
uccgccuucgacgau

SEQ ID NO: 803521 - RNA, 16 nt, Mycobacterium avium subsp. paratuberculosis
uccgccuucgacgaug

SEQ ID NO: 803522 - RNA, 19 nt, Mycobacterium avium subsp. paratuberculosis
uccgcgacaaggucgaccg

SEQ ID NO: 803523 - RNA, 23 nt, Mycobacterium avium subsp. paratuberculosis
uccgcgacaaggucgaccgcgca

SEQ ID NO: 803524 - RNA, 22 nt, Mycobacterium avium subsp. paratuberculosis
uccgcgccggcgcaacucgucc

SEQ ID NO: 803525 - RNA, 17 nt, Mycobacterium avium subsp. paratuberculosis
uccgcgcgaccaucagc

SEQ ID NO: 803526 - RNA, 16 nt, Mycobacterium avium subsp. paratuberculosis
uccgcgcgagcgcgcu

SEQ ID NO: 803527 - RNA, 18 nt, Mycobacterium avium subsp. paratuberculosis
uccgcgcgagcgcgcugu

SEQ ID NO: 803528 - RNA, 13 nt, Mycobacterium avium subsp. paratuberculosis
uccgcgcgcggca

SEQ ID NO: 803529 - RNA, 13 nt, Mycobacterium avium subsp. paratuberculosis
uccgcgcgcggcc

SEQ ID NO: 803530 - RNA, 21 nt, Mycobacterium avium subsp. paratuberculosis
uccgcgcggccaccagcgcgg

SEQ ID NO: 803531 - RNA, 17 nt, Mycobacterium avium subsp. paratuberculosis
uccgcgcggcgacgauc

SEQ ID NO: 803532 - RNA, 18 nt, Mycobacterium avium subsp. paratuberculosis
uccgccuccgaccagccg

SEQ ID NO: 803533 - RNA, 23 nt, Mycobacterium avium subsp. paratuberculosis
uccgccugcgcgggcgcggacag

SEQ ID NO: 803534 - RNA, 19 nt, Mycobacterium avium subsp. paratuberculosis
uccgccguugaccggugcg

SEQ ID NO: 803535 - RNA, 15 nt, Mycobacterium avium subsp. paratuberculosis
uccgccgucgaccac

SEQ ID NO: 803536 - RNA, 12 nt, Mycobacterium avium subsp. paratuberculosis
uccgccgucgag

SEQ ID NO: 803537 - RNA, 13 nt, Mycobacterium avium subsp. paratuberculosis
uccgccgucgagu

SEQ ID NO: 803538 - RNA, 14 nt, Mycobacterium avium subsp. paratuberculosis
uccgccgucgaguc

SEQ ID NO: 803539 - RNA, 17 nt, Mycobacterium avium subsp. paratuberculosis
uccgccgucaucggcgg

SEQ ID NO: 803540 - RNA, 13 nt, Mycobacterium avium subsp. paratuberculosis
uccgccgucgggg

SEQ ID NO: 803541 - RNA, 16 nt, Mycobacterium avium subsp. paratuberculosis
uccgccgucggggugc

SEQ ID NO: 803542 - RNA, 14 nt, Mycobacterium avium subsp. paratuberculosis
uccgcuggggccca

SEQ ID NO: 803543 - RNA, 18 nt, Mycobacterium avium subsp. paratuberculosis
uccgcuggugcgcgccgg

SEQ ID NO: 803544 - RNA, 18 nt, Mycobacterium avium subsp. paratuberculosis
uccgcugaugcggccgga

SEQ ID NO: 803545 - RNA, 12 nt, Mycobacterium avium subsp. paratuberculosis
uccgcugaacgg

SEQ ID NO: 803546 - RNA, 14 nt, Mycobacterium avium subsp. paratuberculosis
uccgcucgccgcgg

SEQ ID NO: 803547 - RNA, 17 nt, Mycobacterium avium subsp. paratuberculosis
uccgcgugaaugcccag

SEQ ID NO: 803548 - RNA, 19 nt, Mycobacterium avium subsp. paratuberculosis
uccgcgugacaagccggcg

SEQ ID NO: 803549 - RNA, 13 nt, Mycobacterium avium subsp. paratuberculosis
uccgcguggccga

SEQ ID NO: 803550 - RNA, 18 nt, Mycobacterium avium subsp. paratuberculosis
uccgcgucggcgccggcc

SEQ ID NO: 803551 - RNA, 19 nt, Mycobacterium avium subsp. paratuberculosis
uccgcguggcucucguccu

SEQ ID NO: 803552 - RNA, 13 nt, Mycobacterium avium subsp. paratuberculosis
uccgcuccaccag

SEQ ID NO: 803553 - RNA, 21 nt, Mycobacterium avium subsp. paratuberculosis
uccgcucaacuugaucagcuc

SEQ ID NO: 803554 - RNA, 22 nt, Mycobacterium avium subsp. paratuberculosis
uccgcucaacuugaucagcucg

SEQ ID NO: 803555 - RNA, 17 nt, Mycobacterium avium subsp. paratuberculosis
uccggcacccgccagcc

SEQ ID NO: 803556 - RNA, 21 nt, Mycobacterium avium subsp. paratuberculosis
uccggcaacgaggccagggcc

SEQ ID NO: 803557 - RNA, 21 nt, Mycobacterium avium subsp. paratuberculosis
uccggauugccgggcagcggc

SEQ ID NO: 803558 - RNA, 13 nt, Mycobacterium avium subsp. paratuberculosis
uccggaugcggcg

SEQ ID NO: 803559 - RNA, 20 nt, Mycobacterium avium subsp. paratuberculosis
uccggauggcggucgcgcca

SEQ ID NO: 803560 - RNA, 18 nt, Mycobacterium avium subsp. paratuberculosis
uccggccaggucgccgcg

SEQ ID NO: 803561 - RNA, 13 nt, Mycobacterium avium subsp. paratuberculosis
uccggccagucca

SEQ ID NO: 803562 - RNA, 17 nt, Mycobacterium avium subsp. paratuberculosis
uccggcccgagcaccac

SEQ ID NO: 803563 - RNA, 19 nt, Mycobacterium avium subsp. paratuberculosis
uccggcccgcucggcgggu

SEQ ID NO: 803564 - RNA, 17 nt, Mycobacterium avium subsp. paratuberculosis
uccggcccggggacacc

SEQ ID NO: 803565 - RNA, 17 nt, Mycobacterium avium subsp. paratuberculosis
uccggcccuggucggcc

SEQ ID NO: 803566 - RNA, 21 nt, Mycobacterium avium subsp. paratuberculosis
uccggguucgacgccucggug

SEQ ID NO: 803567 - RNA, 18 nt, Mycobacterium avium subsp. paratuberculosis
uccgggucgcggaucucg

SEQ ID NO: 803568 - RNA, 18 nt, Mycobacterium avium subsp. paratuberculosis
uccggcgucucagucggc

SEQ ID NO: 803569 - RNA, 13 nt, Mycobacterium avium subsp. paratuberculosis
uccggggugagca

SEQ ID NO: 803570 - RNA, 22 nt, Mycobacterium avium subsp. paratuberculosis
uccggggugagcagggccagcg

SEQ ID NO: 803571 - RNA, 23 nt, Mycobacterium avium subsp. paratuberculosis
uccgggguggccuuguggucgau

SEQ ID NO: 803572 - RNA, 20 nt, Mycobacterium avium subsp. paratuberculosis
uccgggguguaggcgucggc

SEQ ID NO: 803573 - RNA, 18 nt, Mycobacterium avium subsp. paratuberculosis
uccggguaggacaccguc

SEQ ID NO: 803574 - RNA, 22 nt, Mycobacterium avium subsp. paratuberculosis
uccggcggccggcggcagugcg

SEQ ID NO: 803575 - RNA, 21 nt, Mycobacterium avium subsp. paratuberculosis
uccggcggcgcucagcgcggc

SEQ ID NO: 803576 - RNA, 22 nt, Mycobacterium avium subsp. paratuberculosis
uccggcggcgcucagcgcggcg

SEQ ID NO: 803577 - RNA, 19 nt, Mycobacterium avium subsp. paratuberculosis
uccggcggggacgugucgg

SEQ ID NO: 803578 - RNA, 15 nt, Mycobacterium avium subsp. paratuberculosis
uccggcggucagcac

SEQ ID NO: 803579 - RNA, 14 nt, Mycobacterium avium subsp. paratuberculosis
uccggcguccaccg

SEQ ID NO: 803580 - RNA, 16 nt, Mycobacterium avium subsp. paratuberculosis
uccggccggccgccgg

SEQ ID NO: 803581 - RNA, 13 nt, Mycobacterium avium subsp. paratuberculosis
uccggccggcgag

SEQ ID NO: 803582 - RNA, 13 nt, Mycobacterium avium subsp. paratuberculosis
uccggccgcgccg

SEQ ID NO: 803583 - RNA, 14 nt, Mycobacterium avium subsp. paratuberculosis
uccggccgcgccgg

SEQ ID NO: 803584 - RNA, 22 nt, Mycobacterium avium subsp. paratuberculosis
uccggccgcggaugaccagguc

SEQ ID NO: 803585 - RNA, 18 nt, Mycobacterium avium subsp. paratuberculosis
uccggccgucgucgggca

SEQ ID NO: 803586 - RNA, 17 nt, Mycobacterium avium subsp. paratuberculosis
uccggccgccucgucga

SEQ ID NO: 803587 - RNA, 20 nt, Mycobacterium avium subsp. paratuberculosis
uccggcgccggucagcggca

SEQ ID NO: 803588 - RNA, 17 nt, Mycobacterium avium subsp. paratuberculosis
uccggcgcgaccagguu

SEQ ID NO: 803589 - RNA, 20 nt, Mycobacterium avium subsp. paratuberculosis
uccggcgcgaccagguucuc

SEQ ID NO: 803590 - RNA, 12 nt, Mycobacterium avium subsp. paratuberculosis
uccggcgcgauc

SEQ ID NO: 803591 - RNA, 14 nt, Mycobacterium avium subsp. paratuberculosis
uccggcgcgaucgg

SEQ ID NO: 803592 - RNA, 12 nt, Mycobacterium avium subsp. paratuberculosis
uccccaccguga

SEQ ID NO: 803593 - RNA, 17 nt, Mycobacterium avium subsp. paratuberculosis
ucccauucgugguugcc

SEQ ID NO: 803594 - RNA, 20 nt, Mycobacterium avium subsp. paratuberculosis
ucccagugccaguaccagcg

SEQ ID NO: 803595 - RNA, 20 nt, Mycobacterium avium subsp. paratuberculosis
ucccagugcgugaccugcug

SEQ ID NO: 803596 - RNA, 18 nt, Mycobacterium avium subsp. paratuberculosis
ucccaguucccggcgggc

SEQ ID NO: 803597 - RNA, 19 nt, Mycobacterium avium subsp. paratuberculosis
ucccaguucccggcgggca

SEQ ID NO: 803598 - RNA, 20 nt, Mycobacterium avium subsp. paratuberculosis
ucccaggugggcgcgcagca

SEQ ID NO: 803599 - RNA, 19 nt, Mycobacterium avium subsp. paratuberculosis
ucccaucagugcggcccgc

SEQ ID NO: 803600 - RNA, 14 nt, Mycobacterium avium subsp. paratuberculosis
uccccauccgcggc

SEQ ID NO: 803601 - RNA, 18 nt, Mycobacterium avium subsp. paratuberculosis
uccccaggauggccgcuu

SEQ ID NO: 803602 - RNA, 15 nt, Mycobacterium avium subsp. paratuberculosis
uccccccgcgccgcc

SEQ ID NO: 803603 - RNA, 16 nt, Mycobacterium avium subsp. paratuberculosis
uccccccgcgccgccc

SEQ ID NO: 803604 - RNA, 17 nt, Mycobacterium avium subsp. paratuberculosis
ucccccgacccgccgug

SEQ ID NO: 803605 - RNA, 19 nt, Mycobacterium avium subsp. paratuberculosis
ucccccgacgccgacacca

SEQ ID NO: 803606 - RNA, 22 nt, Mycobacterium avium subsp. paratuberculosis
ucccccgacgccgacaccagcg

SEQ ID NO: 803607 - RNA, 19 nt, Mycobacterium avium subsp. paratuberculosis
ucccccaccacguaggcga

SEQ ID NO: 803608 - RNA, 16 nt, Mycobacterium avium subsp. paratuberculosis
ucccccacccgcacgg

SEQ ID NO: 803609 - RNA, 23 nt, Mycobacterium avium subsp. paratuberculosis
ucccccgucgggccguccgccgg

SEQ ID NO: 803610 - RNA, 18 nt, Mycobacterium avium subsp. paratuberculosis
uccaggguucucgcggcg

SEQ ID NO: 803611 - RNA, 18 nt, Mycobacterium avium subsp. paratuberculosis
uccagggcgggucgucga

SEQ ID NO: 803612 - RNA, 14 nt, Mycobacterium avium subsp. paratuberculosis
uccagguccgggaa

SEQ ID NO: 803613 - RNA, 21 nt, Mycobacterium avium subsp. paratuberculosis
ucccacucguagucguuggug

SEQ ID NO: 803614 - RNA, 22 nt, Mycobacterium avium subsp. paratuberculosis
uccagguagcccaugucgccgg

SEQ ID NO: 803615 - RNA, 19 nt, Mycobacterium avium subsp. paratuberculosis
uccaggguggugguggugc

SEQ ID NO: 803616 - RNA, 20 nt, Mycobacterium avium subsp. paratuberculosis
uccagguacacguagcgguc

SEQ ID NO: 803617 - RNA, 15 nt, Mycobacterium avium subsp. paratuberculosis
uccagguacugggcg

SEQ ID NO: 803618 - RNA, 21 nt, Mycobacterium avium subsp. paratuberculosis
uccagguagggcacaccggug

SEQ ID NO: 803619 - RNA, 16 nt, Mycobacterium avium subsp. paratuberculosis
ucccagacgucgaccu

SEQ ID NO: 803620 - RNA, 21 nt, Mycobacterium avium subsp. paratuberculosis
ucccagaauucgccggggcac

SEQ ID NO: 803621 - RNA, 20 nt, Mycobacterium avium subsp. paratuberculosis
ucccagaucguagggcucgg

SEQ ID NO: 803622 - RNA, 14 nt, Mycobacterium avium subsp. paratuberculosis
ucccagaugcgcga

SEQ ID NO: 803623 - RNA, 13 nt, Mycobacterium avium subsp. paratuberculosis
ucccagccgccgg

SEQ ID NO: 803624 - RNA, 15 nt, Mycobacterium avium subsp. paratuberculosis
ucccagccgccggcc

SEQ ID NO: 803625 - RNA, 21 nt, Mycobacterium avium subsp. paratuberculosis
ucccagccauacugacgccgg

SEQ ID NO: 803626 - RNA, 19 nt, Mycobacterium avium subsp. paratuberculosis
ucccagcccucgucgauga

SEQ ID NO: 803627 - RNA, 18 nt, Mycobacterium avium subsp. paratuberculosis
ucccagcgccacuggcug

SEQ ID NO: 803628 - RNA, 13 nt, Mycobacterium avium subsp. paratuberculosis
ucccagcggccga

SEQ ID NO: 803629 - RNA, 20 nt, Mycobacterium avium subsp. paratuberculosis
ucccagcgggacagcaccac

SEQ ID NO: 803630 - RNA, 15 nt, Mycobacterium avium subsp. paratuberculosis
ucccaggacgcggug

SEQ ID NO: 803631 - RNA, 15 nt, Mycobacterium avium subsp. paratuberculosis
ucccaggacggcgcg

SEQ ID NO: 803632 - RNA, 17 nt, Mycobacterium avium subsp. paratuberculosis
ucccaggacggcgcggu

SEQ ID NO: 803633 - RNA, 15 nt, Mycobacterium avium subsp. paratuberculosis
ucccaggcgucgucg

SEQ ID NO: 803634 - RNA, 16 nt, Mycobacterium avium subsp. paratuberculosis
ucccaggcgucgucgu

SEQ ID NO: 803635 - RNA, 13 nt, Mycobacterium avium subsp. paratuberculosis
ucccaggcguggu

SEQ ID NO: 803636 - RNA, 18 nt, Mycobacterium avium subsp. paratuberculosis
ucccaggcguggucggcg

SEQ ID NO: 803637 - RNA, 17 nt, Mycobacterium avium subsp. paratuberculosis
ucccaggguuggucgga

SEQ ID NO: 803638 - RNA, 20 nt, Mycobacterium avium subsp. paratuberculosis
uccccgcagcucccccggcg

SEQ ID NO: 803639 - RNA, 16 nt, Mycobacterium avium subsp. paratuberculosis
uccccgccgccgugca

SEQ ID NO: 803640 - RNA, 20 nt, Mycobacterium avium subsp. paratuberculosis
uccccgaccacaccggcgcu

SEQ ID NO: 803641 - RNA, 14 nt, Mycobacterium avium subsp. paratuberculosis
uccccgagcacguc

SEQ ID NO: 803642 - RNA, 15 nt, Mycobacterium avium subsp. paratuberculosis
uccccgagcacgucg

SEQ ID NO: 803643 - RNA, 23 nt, Mycobacterium avium subsp. paratuberculosis
uccccgauccggcugagcagcuc

SEQ ID NO: 803644 - RNA, 18 nt, Mycobacterium avium subsp. paratuberculosis
uccccgauuucgcggccg

SEQ ID NO: 803645 - RNA, 19 nt, Mycobacterium avium subsp. paratuberculosis
uccccgcaaacacgagcag

SEQ ID NO: 803646 - RNA, 16 nt, Mycobacterium avium subsp. paratuberculosis
uccccggccagcacgc

SEQ ID NO: 803647 - RNA, 14 nt, Mycobacterium avium subsp. paratuberculosis
uccccgcuggcgcc

SEQ ID NO: 803648 - RNA, 18 nt, Mycobacterium avium subsp. paratuberculosis
uccccgcguuggccagcg

SEQ ID NO: 803649 - RNA, 22 nt, Mycobacterium avium subsp. paratuberculosis
uccccgcguuggccagcgccuc

SEQ ID NO: 803650 - RNA, 18 nt, Mycobacterium avium subsp. paratuberculosis
uccccgcgggugacgcug

SEQ ID NO: 803651 - RNA, 21 nt, Mycobacterium avium subsp. paratuberculosis
uccccgcgggugacgcugacc

SEQ ID NO: 803652 - RNA, 18 nt, Mycobacterium avium subsp. paratuberculosis
uccccgcggugccgcagc

SEQ ID NO: 803653 - RNA, 15 nt, Mycobacterium avium subsp. paratuberculosis
uccccgcgcccgccg

SEQ ID NO: 803654 - RNA, 16 nt, Mycobacterium avium subsp. paratuberculosis
uccccgcgcccgccgc

SEQ ID NO: 803655 - RNA, 11 nt, Mycobacterium avium subsp. paratuberculosis
uccccgcgccg

SEQ ID NO: 803656 - RNA, 16 nt, Mycobacterium avium subsp. paratuberculosis
uccccgcgcggcucgc

SEQ ID NO: 803657 - RNA, 23 nt, Mycobacterium avium subsp. paratuberculosis
uccccgcgcugggcuggccgucc

SEQ ID NO: 803658 - RNA, 18 nt, Mycobacterium avium subsp. paratuberculosis
uccccgguugucgcucag

SEQ ID NO: 803659 - RNA, 18 nt, Mycobacterium avium subsp. paratuberculosis
uccccguagucacccggc

SEQ ID NO: 803660 - RNA, 18 nt, Mycobacterium avium subsp. paratuberculosis
uccccgggcccagcacca

SEQ ID NO: 803661 - RNA, 22 nt, Mycobacterium avium subsp. paratuberculosis
uccccgggcccagcaccaccac

SEQ ID NO: 803662 - RNA, 17 nt, Mycobacterium avium subsp. paratuberculosis
uccccgggcgagcgucg

SEQ ID NO: 803663 - RNA, 22 nt, Mycobacterium avium subsp. paratuberculosis
uccccggcgaccacccucacca

SEQ ID NO: 803664 - RNA, 12 nt, Mycobacterium avium subsp. paratuberculosis
ucccgccgccgc

SEQ ID NO: 803665 - RNA, 12 nt, Mycobacterium avium subsp. paratuberculosis
ucccgccgccgu

SEQ ID NO: 803666 - RNA, 14 nt, Mycobacterium avium subsp. paratuberculosis
ucccgccgccgucg

SEQ ID NO: 803667 - RNA, 12 nt, Mycobacterium avium subsp. paratuberculosis
ucccgccgaccc

SEQ ID NO: 803668 - RNA, 20 nt, Mycobacterium avium subsp. paratuberculosis
ucccgcccggcgccggccga

SEQ ID NO: 803669 - RNA, 22 nt, Mycobacterium avium subsp. paratuberculosis
ucccgcccucaggcguccagca

SEQ ID NO: 803670 - RNA, 22 nt, Mycobacterium avium subsp. paratuberculosis
uccccgugcggggccucgucgc

SEQ ID NO: 803671 - RNA, 22 nt, Mycobacterium avium subsp. paratuberculosis
uccccgugcagccgggccugca

SEQ ID NO: 803672 - RNA, 16 nt, Mycobacterium avium subsp. paratuberculosis
ucccgccggcgaucga

SEQ ID NO: 803673 - RNA, 21 nt, Mycobacterium avium subsp. paratuberculosis
ucccgccggcgaucgacguca

SEQ ID NO: 803674 - RNA, 14 nt, Mycobacterium avium subsp. paratuberculosis
ucccgccggcggcc

SEQ ID NO: 803675 - RNA, 18 nt, Mycobacterium avium subsp. paratuberculosis
ucccgccgagauccaccg

SEQ ID NO: 803676 - RNA, 17 nt, Mycobacterium avium subsp. paratuberculosis
ucccgcgccugccuggc

SEQ ID NO: 803677 - RNA, 19 nt, Mycobacterium avium subsp. paratuberculosis
ucccgcgcgagcagacgca

SEQ ID NO: 803678 - RNA, 14 nt, Mycobacterium avium subsp. paratuberculosis
ucccgcgcggcgca

SEQ ID NO: 803679 - RNA, 17 nt, Mycobacterium avium subsp. paratuberculosis
ucccgcguggccgccag

SEQ ID NO: 803680 - RNA, 17 nt, Mycobacterium avium subsp. paratuberculosis
ucccgcguugugcacca

SEQ ID NO: 803681 - RNA, 15 nt, Mycobacterium avium subsp. paratuberculosis
ucccgcggcggcgcc

SEQ ID NO: 803682 - RNA, 17 nt, Mycobacterium avium subsp. paratuberculosis
ucccgcggcggcgccau

SEQ ID NO: 803683 - RNA, 20 nt, Mycobacterium avium subsp. paratuberculosis
ucccgcgcgggggccgccgc

SEQ ID NO: 803684 - RNA, 18 nt, Mycobacterium avium subsp. paratuberculosis
ucccgcuucuggcgggcg

SEQ ID NO: 803685 - RNA, 20 nt, Mycobacterium avium subsp. paratuberculosis
ucccgcuuggcggucugcgc

SEQ ID NO: 803686 - RNA, 13 nt, Mycobacterium avium subsp. paratuberculosis
ucccguagccgua

SEQ ID NO: 803687 - RNA, 14 nt, Mycobacterium avium subsp. paratuberculosis
ucccguagccguag

SEQ ID NO: 803688 - RNA, 21 nt, Mycobacterium avium subsp. paratuberculosis
ucccguagccguagaucgucg

SEQ ID NO: 803689 - RNA, 20 nt, Mycobacterium avium subsp. paratuberculosis
ucccggcaacaccggcggcg

SEQ ID NO: 803690 - RNA, 20 nt, Mycobacterium avium subsp. paratuberculosis
ucccggcaccaccacccccg

SEQ ID NO: 803691 - RNA, 21 nt, Mycobacterium avium subsp. paratuberculosis
ucccggcaccaccacccccga

SEQ ID NO: 803692 - RNA, 17 nt, Mycobacterium avium subsp. paratuberculosis
ucccggcagaacgacgc

SEQ ID NO: 803693 - RNA, 18 nt, Mycobacterium avium subsp. paratuberculosis
ucccgguugaccccggcc

SEQ ID NO: 803694 - RNA, 23 nt, Mycobacterium avium subsp. paratuberculosis
ucccgguugaccccggccccggc

SEQ ID NO: 803695 - RNA, 14 nt, Mycobacterium avium subsp. paratuberculosis
ucccggaacagcuu

SEQ ID NO: 803696 - RNA, 19 nt, Mycobacterium avium subsp. paratuberculosis
ucccggaagugccggcgaa

SEQ ID NO: 803697 - RNA, 17 nt, Mycobacterium avium subsp. paratuberculosis
ucccggacaggucgggc

SEQ ID NO: 803698 - RNA, 18 nt, Mycobacterium avium subsp. paratuberculosis
ucccggacauaggcgucg

SEQ ID NO: 803699 - RNA, 17 nt, Mycobacterium avium subsp. paratuberculosis
ucccggacuccucggug

SEQ ID NO: 803700 - RNA, 19 nt, Mycobacterium avium subsp. paratuberculosis
ucccugagcuuuucgucgg

SEQ ID NO: 803701 - RNA, 14 nt, Mycobacterium avium subsp. paratuberculosis
ucccguugaucucg

SEQ ID NO: 803702 - RNA, 20 nt, Mycobacterium avium subsp. paratuberculosis
ucccguugcgccgcaacggc

SEQ ID NO: 803703 - RNA, 14 nt, Mycobacterium avium subsp. paratuberculosis
ucccgugcuggcca

SEQ ID NO: 803704 - RNA, 21 nt, Mycobacterium avium subsp. paratuberculosis
ucccgucccgguugaccccgg

SEQ ID NO: 803705 - RNA, 20 nt, Mycobacterium avium subsp. paratuberculosis
ucccgucgcgacgagcgggc

SEQ ID NO: 803706 - RNA, 15 nt, Mycobacterium avium subsp. paratuberculosis
ucccgucggccauca

SEQ ID NO: 803707 - RNA, 20 nt, Mycobacterium avium subsp. paratuberculosis
ucccgucggccaucagccgc

SEQ ID NO: 803708 - RNA, 23 nt, Mycobacterium avium subsp. paratuberculosis
ucccgucggccaucagccgccgu

SEQ ID NO: 803709 - RNA, 12 nt, Mycobacterium avium subsp. paratuberculosis
ucccgucgucgg

SEQ ID NO: 803710 - RNA, 21 nt, Mycobacterium avium subsp. paratuberculosis
ucccgucgucggcgccgcgcc

SEQ ID NO: 803711 - RNA, 21 nt, Mycobacterium avium subsp. paratuberculosis
ucccgucguugaaggccugca

SEQ ID NO: 803712 - RNA, 18 nt, Mycobacterium avium subsp. paratuberculosis
uccucguucuggcccgcc

SEQ ID NO: 803713 - RNA, 16 nt, Mycobacterium avium subsp. paratuberculosis
uccucgucgguccagg

SEQ ID NO: 803714 - RNA, 16 nt, Mycobacterium avium subsp. paratuberculosis
uccucggucagcggcg

SEQ ID NO: 803715 - RNA, 16 nt, Mycobacterium avium subsp. paratuberculosis
uccucggucucgucca

SEQ ID NO: 803716 - RNA, 17 nt, Mycobacterium avium subsp. paratuberculosis
uccucggugagcguggu

SEQ ID NO: 803717 - RNA, 17 nt, Mycobacterium avium subsp. paratuberculosis
uccgguuugcgccggcu

SEQ ID NO: 803718 - RNA, 13 nt, Mycobacterium avium subsp. paratuberculosis
uccucggcgaugc

SEQ ID NO: 803719 - RNA, 17 nt, Mycobacterium avium subsp. paratuberculosis
uccucggcgcucgccgc

SEQ ID NO: 803720 - RNA, 18 nt, Mycobacterium avium subsp. paratuberculosis
uccgguagaagaccaccu

SEQ ID NO: 803721 - RNA, 19 nt, Mycobacterium avium subsp. paratuberculosis
uccgguagaagaccaccuc

SEQ ID NO: 803722 - RNA, 20 nt, Mycobacterium avium subsp. paratuberculosis
uccggucaacgccgcgcgca

SEQ ID NO: 803723 - RNA, 10 nt, Mycobacterium avium subsp. paratuberculosis
uccggucagc

SEQ ID NO: 803724 - RNA, 13 nt, Mycobacterium avium subsp. paratuberculosis
uccggucagcacc

SEQ ID NO: 803725 - RNA, 17 nt, Mycobacterium avium subsp. paratuberculosis
uccgguccacucgucgg

SEQ ID NO: 803726 - RNA, 16 nt, Mycobacterium avium subsp. paratuberculosis
uccgguccagcccggu

SEQ ID NO: 803727 - RNA, 16 nt, Mycobacterium avium subsp. paratuberculosis
uccgguccgggcugcg

SEQ ID NO: 803728 - RNA, 21 nt, Mycobacterium avium subsp. paratuberculosis
uccggucgaucaccucgucga

SEQ ID NO: 803729 - RNA, 15 nt, Mycobacterium avium subsp. paratuberculosis
uccggucggcgcucg

SEQ ID NO: 803730 - RNA, 17 nt, Mycobacterium avium subsp. paratuberculosis
uccggucugcuccggug

SEQ ID NO: 803731 - RNA, 17 nt, Mycobacterium avium subsp. paratuberculosis
uccggucuucucggcca

SEQ ID NO: 803732 - RNA, 21 nt, Mycobacterium avium subsp. paratuberculosis
uccggucuucucggccaggcu

SEQ ID NO: 803733 - RNA, 19 nt, Mycobacterium avium subsp. paratuberculosis
uccggugccgagcgcgcuu

SEQ ID NO: 803734 - RNA, 17 nt, Mycobacterium avium subsp. paratuberculosis
uccggugccacgcggcu

SEQ ID NO: 803735 - RNA, 21 nt, Mycobacterium avium subsp. paratuberculosis
uccgguggcgcgaaucccggc

SEQ ID NO: 803736 - RNA, 14 nt, Mycobacterium avium subsp. paratuberculosis
uccgguuccucggc

SEQ ID NO: 803737 - RNA, 14 nt, Mycobacterium avium subsp. paratuberculosis
uccgguucgaccgg

SEQ ID NO: 803738 - RNA, 16 nt, Mycobacterium avium subsp. paratuberculosis
uccgguucgaccggcg

SEQ ID NO: 803739 - RNA, 17 nt, Mycobacterium avium subsp. paratuberculosis
uccugcggugggcgcug

SEQ ID NO: 803740 - RNA, 14 nt, Mycobacterium avium subsp. paratuberculosis
uccugcucgcgggc

SEQ ID NO: 803741 - RNA, 22 nt, Mycobacterium avium subsp. paratuberculosis
uccugcucgcgggccaccgcgg

SEQ ID NO: 803742 - RNA, 15 nt, Mycobacterium avium subsp. paratuberculosis
uccugcgccgcggug

SEQ ID NO: 803743 - RNA, 23 nt, Mycobacterium avium subsp. paratuberculosis
uccugcgccgcggugcgccacgc

SEQ ID NO: 803744 - RNA, 14 nt, Mycobacterium avium subsp. paratuberculosis
uccugcgcaucgag

SEQ ID NO: 803745 - RNA, 18 nt, Mycobacterium avium subsp. paratuberculosis
uccugcgcaucgagcugc

SEQ ID NO: 803746 - RNA, 22 nt, Mycobacterium avium subsp. paratuberculosis
uccugcccggucugcggccgcg

SEQ ID NO: 803747 - RNA, 19 nt, Mycobacterium avium subsp. paratuberculosis
uccucuucgcugccgccgc

SEQ ID NO: 803748 - RNA, 13 nt, Mycobacterium avium subsp. paratuberculosis
uccugcaccgagu

SEQ ID NO: 803749 - RNA, 16 nt, Mycobacterium avium subsp. paratuberculosis
uccugauuuuggggac

SEQ ID NO: 803750 - RNA, 17 nt, Mycobacterium avium subsp. paratuberculosis
uccugcagcucgccggc

SEQ ID NO: 803751 - RNA, 20 nt, Mycobacterium avium subsp. paratuberculosis
uccugcaggccgagccgccg

SEQ ID NO: 803752 - RNA, 14 nt, Mycobacterium avium subsp. paratuberculosis
uccugcagcgccgu

SEQ ID NO: 803753 - RNA, 14 nt, Mycobacterium avium subsp. paratuberculosis
uccugccagcggcg

SEQ ID NO: 803754 - RNA, 17 nt, Mycobacterium avium subsp. paratuberculosis
ucgaccacccggcgggc

SEQ ID NO: 803755 - RNA, 12 nt, Mycobacterium avium subsp. paratuberculosis
ucgaccaccgcc

SEQ ID NO: 803756 - RNA, 15 nt, Mycobacterium avium subsp. paratuberculosis
ucgaccaccgccggc

SEQ ID NO: 803757 - RNA, 17 nt, Mycobacterium avium subsp. paratuberculosis
ucgaccaccgccggccc

SEQ ID NO: 803758 - RNA, 16 nt, Mycobacterium avium subsp. paratuberculosis
ucgaccaacuccaccg

SEQ ID NO: 803759 - RNA, 18 nt, Mycobacterium avium subsp. paratuberculosis
ucgaccaacuccaccgcc

SEQ ID NO: 803760 - RNA, 22 nt, Mycobacterium avium subsp. paratuberculosis
ucgaccaagacggugggcccgc

SEQ ID NO: 803761 - RNA, 14 nt, Mycobacterium avium subsp. paratuberculosis
ucgacaugcccggc

SEQ ID NO: 803762 - RNA, 17 nt, Mycobacterium avium subsp. paratuberculosis
ucgacaugcccggcgac

SEQ ID NO: 803763 - RNA, 18 nt, Mycobacterium avium subsp. paratuberculosis
ucgacaugcccggcgacg

SEQ ID NO: 803764 - RNA, 22 nt, Mycobacterium avium subsp. paratuberculosis
ucgacaugcuguuccagacguc

SEQ ID NO: 803765 - RNA, 14 nt, Mycobacterium avium subsp. paratuberculosis
ucgaaggugaugaa

SEQ ID NO: 803766 - RNA, 17 nt, Mycobacterium avium subsp. paratuberculosis
ucgaaguagagccgcug

SEQ ID NO: 803767 - RNA, 23 nt, Mycobacterium avium subsp. paratuberculosis
ucgaaggcggccgcgagcccggc

SEQ ID NO: 803768 - RNA, 21 nt, Mycobacterium avium subsp. paratuberculosis
ucgaaggcgccgauggugacg

SEQ ID NO: 803769 - RNA, 16 nt, Mycobacterium avium subsp. paratuberculosis
ucgaagggcaucgggu

SEQ ID NO: 803770 - RNA, 15 nt, Mycobacterium avium subsp. paratuberculosis
ucgaagggcgccagc

SEQ ID NO: 803771 - RNA, 16 nt, Mycobacterium avium subsp. paratuberculosis
ucgaagggcgccagcc

SEQ ID NO: 803772 - RNA, 21 nt, Mycobacterium avium subsp. paratuberculosis
ucgaaggccgggcugguccgg

SEQ ID NO: 803773 - RNA, 22 nt, Mycobacterium avium subsp. paratuberculosis
ucgaaggaggccagcugcaccg

SEQ ID NO: 803774 - RNA, 17 nt, Mycobacterium avium subsp. paratuberculosis
ucgaaccacgcggcggc

SEQ ID NO: 803775 - RNA, 17 nt, Mycobacterium avium subsp. paratuberculosis
ucgaacaggcuggccag

SEQ ID NO: 803776 - RNA, 15 nt, Mycobacterium avium subsp. paratuberculosis
ucgaacagggcggcg

SEQ ID NO: 803777 - RNA, 23 nt, Mycobacterium avium subsp. paratuberculosis
ucgaacagggcggcgggcccggc

SEQ ID NO: 803778 - RNA, 20 nt, Mycobacterium avium subsp. paratuberculosis
ucgaacaucacccggcggca

SEQ ID NO: 803779 - RNA, 18 nt, Mycobacterium avium subsp. paratuberculosis
ucgaacagcgcgcccgac

SEQ ID NO: 803780 - RNA, 19 nt, Mycobacterium avium subsp. paratuberculosis
ucgaacagcgcgcccgacg

SEQ ID NO: 803781 - RNA, 16 nt, Mycobacterium avium subsp. paratuberculosis
ucgaacagcacgccgg

SEQ ID NO: 803782 - RNA, 17 nt, Mycobacterium avium subsp. paratuberculosis
ucgaacagcacgccggc

SEQ ID NO: 803783 - RNA, 15 nt, Mycobacterium avium subsp. paratuberculosis
ucgaacagccgggcc

SEQ ID NO: 803784 - RNA, 17 nt, Mycobacterium avium subsp. paratuberculosis
ucgaacagccgggccgc

SEQ ID NO: 803785 - RNA, 18 nt, Mycobacterium avium subsp. paratuberculosis
ucgaacagccgggccgcc

SEQ ID NO: 803786 - RNA, 20 nt, Mycobacterium avium subsp. paratuberculosis
ucgaacccgaccccggcgag

SEQ ID NO: 803787 - RNA, 22 nt, Mycobacterium avium subsp. paratuberculosis
ucgaacccgaccccggcgagcg

SEQ ID NO: 803788 - RNA, 20 nt, Mycobacterium avium subsp. paratuberculosis
ucgaagccguccaggccgcu

SEQ ID NO: 803789 - RNA, 24 nt, Mycobacterium avium subsp. paratuberculosis
ucgaagccguccaggccgcugauc

SEQ ID NO: 803790 - RNA, 17 nt, Mycobacterium avium subsp. paratuberculosis
ucgaagccguggcaggc

SEQ ID NO: 803791 - RNA, 14 nt, Mycobacterium avium subsp. paratuberculosis
ucgaaccgccgcgc

SEQ ID NO: 803792 - RNA, 16 nt, Mycobacterium avium subsp. paratuberculosis
ucgaaccgccgcgcuc

SEQ ID NO: 803793 - RNA, 15 nt, Mycobacterium avium subsp. paratuberculosis
ucgaaccucgcggcg

SEQ ID NO: 803794 - RNA, 16 nt, Mycobacterium avium subsp. paratuberculosis
ucgaaccucgcggcgg

SEQ ID NO: 803795 - RNA, 16 nt, Mycobacterium avium subsp. paratuberculosis
ucgaagcgcagcagcu

SEQ ID NO: 803796 - RNA, 19 nt, Mycobacterium avium subsp. paratuberculosis
uccuggccaacucgaccug

SEQ ID NO: 803797 - RNA, 23 nt, Mycobacterium avium subsp. paratuberculosis
uccuggcccccgccccagcccgg

SEQ ID NO: 803798 - RNA, 13 nt, Mycobacterium avium subsp. paratuberculosis
uccuggccgccgu

SEQ ID NO: 803799 - RNA, 22 nt, Mycobacterium avium subsp. paratuberculosis
uccuggccggacgggucgaccg

SEQ ID NO: 803800 - RNA, 16 nt, Mycobacterium avium subsp. paratuberculosis
uccuggaucagccagu

SEQ ID NO: 803801 - RNA, 13 nt, Mycobacterium avium subsp. paratuberculosis
uccuggaucgcgc

SEQ ID NO: 803802 - RNA, 16 nt, Mycobacterium avium subsp. paratuberculosis
uccuggcggguggcga

SEQ ID NO: 803803 - RNA, 16 nt, Mycobacterium avium subsp. paratuberculosis
uccuggccuggucggc

SEQ ID NO: 803804 - RNA, 17 nt, Mycobacterium avium subsp. paratuberculosis
uccuggugcaccaggua

SEQ ID NO: 803805 - RNA, 19 nt, Mycobacterium avium subsp. paratuberculosis
uccuggugcaccagguaga

SEQ ID NO: 803806 - RNA, 19 nt, Mycobacterium avium subsp. paratuberculosis
uccugggugaguucgucgg

SEQ ID NO: 803807 - RNA, 21 nt, Mycobacterium avium subsp. paratuberculosis
uccuggguaagccaggucacg

SEQ ID NO: 803808 - RNA, 15 nt, Mycobacterium avium subsp. paratuberculosis
uccugggccggggcu

SEQ ID NO: 803809 - RNA, 15 nt, Mycobacterium avium subsp. paratuberculosis
uccuugagccgccgc

SEQ ID NO: 803810 - RNA, 17 nt, Mycobacterium avium subsp. paratuberculosis
uccugguuucagguggc

SEQ ID NO: 803811 - RNA, 22 nt, Mycobacterium avium subsp. paratuberculosis
uccuugaggaugcgcaccacgc

SEQ ID NO: 803812 - RNA, 20 nt, Mycobacterium avium subsp. paratuberculosis
uccuugagguagucgcgcag

SEQ ID NO: 803813 - RNA, 13 nt, Mycobacterium avium subsp. paratuberculosis
uccuuggccaggc

SEQ ID NO: 803814 - RNA, 22 nt, Mycobacterium avium subsp. paratuberculosis
ucgaaaaacccggugccggccg

SEQ ID NO: 803815 - RNA, 21 nt, Mycobacterium avium subsp. paratuberculosis
ucgacugcgaugcuucccauu

SEQ ID NO: 803816 - RNA, 14 nt, Mycobacterium avium subsp. paratuberculosis
ucgacuugccgccg

SEQ ID NO: 803817 - RNA, 17 nt, Mycobacterium avium subsp. paratuberculosis
ucgagacacgcgccggc

SEQ ID NO: 803818 - RNA, 19 nt, Mycobacterium avium subsp. paratuberculosis
ucgagaccaugucggccag

SEQ ID NO: 803819 - RNA, 12 nt, Mycobacterium avium subsp. paratuberculosis
ucgacucggcgg

SEQ ID NO: 803820 - RNA, 12 nt, Mycobacterium avium subsp. paratuberculosis
ucgacugcaccg

SEQ ID NO: 803821 - RNA, 14 nt, Mycobacterium avium subsp. paratuberculosis
ucgacugcaggaac

SEQ ID NO: 803822 - RNA, 13 nt, Mycobacterium avium subsp. paratuberculosis
ucgacgucgucga

SEQ ID NO: 803823 - RNA, 15 nt, Mycobacterium avium subsp. paratuberculosis
ucgacgugcgcggcg

SEQ ID NO: 803824 - RNA, 16 nt, Mycobacterium avium subsp. paratuberculosis
ucgacgugcucggcgg

SEQ ID NO: 803825 - RNA, 16 nt, Mycobacterium avium subsp. paratuberculosis
ucgacuccagcaccgg

SEQ ID NO: 803826 - RNA, 16 nt, Mycobacterium avium subsp. paratuberculosis
ucgacuccggcgacac

SEQ ID NO: 803827 - RNA, 18 nt, Mycobacterium avium subsp. paratuberculosis
ucgacgguuugcccggcg

SEQ ID NO: 803828 - RNA, 20 nt, Mycobacterium avium subsp. paratuberculosis
ucgacgguuugcccggcgau

SEQ ID NO: 803829 - RNA, 22 nt, Mycobacterium avium subsp. paratuberculosis
ucgacgguuugcccggcgaugu

SEQ ID NO: 803830 - RNA, 14 nt, Mycobacterium avium subsp. paratuberculosis
ucgacggacggguc

SEQ ID NO: 803831 - RNA, 18 nt, Mycobacterium avium subsp. paratuberculosis
ucgacgguugccucggcc

SEQ ID NO: 803832 - RNA, 22 nt, Mycobacterium avium subsp. paratuberculosis
ucgacgguugccucggccagca

SEQ ID NO: 803833 - RNA, 14 nt, Mycobacterium avium subsp. paratuberculosis
ucgacguagcccgc

SEQ ID NO: 803834 - RNA, 17 nt, Mycobacterium avium subsp. paratuberculosis
ucgacggccccccgggc

SEQ ID NO: 803835 - RNA, 19 nt, Mycobacterium avium subsp. paratuberculosis
ucgacggagugcgugucac

SEQ ID NO: 803836 - RNA, 18 nt, Mycobacterium avium subsp. paratuberculosis
ucgacggaucgcccuggc

SEQ ID NO: 803837 - RNA, 14 nt, Mycobacterium avium subsp. paratuberculosis
ucgacggcacccgg

SEQ ID NO: 803838 - RNA, 15 nt, Mycobacterium avium subsp. paratuberculosis
ucgacggcacccggc

SEQ ID NO: 803839 - RNA, 16 nt, Mycobacterium avium subsp. paratuberculosis
ucgacggcacccggcc

SEQ ID NO: 803840 - RNA, 13 nt, Mycobacterium avium subsp. paratuberculosis
ucgacggcagcgc

SEQ ID NO: 803841 - RNA, 14 nt, Mycobacterium avium subsp. paratuberculosis
ucgacggcagcgcu

SEQ ID NO: 803842 - RNA, 14 nt, Mycobacterium avium subsp. paratuberculosis
ucgacguccaccgg

SEQ ID NO: 803843 - RNA, 22 nt, Mycobacterium avium subsp. paratuberculosis
ucgacguccaccggauggcgcc

SEQ ID NO: 803844 - RNA, 23 nt, Mycobacterium avium subsp. paratuberculosis
ucgacguccaccggauggcgccc

SEQ ID NO: 803845 - RNA, 21 nt, Mycobacterium avium subsp. paratuberculosis
ucgacguccaggccggcgccg

SEQ ID NO: 803846 - RNA, 20 nt, Mycobacterium avium subsp. paratuberculosis
ucgacguaggugagcaacgc

SEQ ID NO: 803847 - RNA, 16 nt, Mycobacterium avium subsp. paratuberculosis
ucgacguaguccggcc

SEQ ID NO: 803848 - RNA, 17 nt, Mycobacterium avium subsp. paratuberculosis
ucgacguaguccggcca

SEQ ID NO: 803849 - RNA, 15 nt, Mycobacterium avium subsp. paratuberculosis
ucgacguagucgcgc

SEQ ID NO: 803850 - RNA, 12 nt, Mycobacterium avium subsp. paratuberculosis
ucgacgucacca

SEQ ID NO: 803851 - RNA, 16 nt, Mycobacterium avium subsp. paratuberculosis
ucgacgucacgacggu

SEQ ID NO: 803852 - RNA, 19 nt, Mycobacterium avium subsp. paratuberculosis
ucgacgucagcucccccga

SEQ ID NO: 803853 - RNA, 16 nt, Mycobacterium avium subsp. paratuberculosis
ucgacgucauccggcu

SEQ ID NO: 803854 - RNA, 13 nt, Mycobacterium avium subsp. paratuberculosis
ucgacgucgacgu

SEQ ID NO: 803855 - RNA, 21 nt, Mycobacterium avium subsp. paratuberculosis
ucgacgucgagaaaggccagc

SEQ ID NO: 803856 - RNA, 22 nt, Mycobacterium avium subsp. paratuberculosis
ucgacgucgagaaaggccagca

SEQ ID NO: 803857 - RNA, 16 nt, Mycobacterium avium subsp. paratuberculosis
ucgacgucgagggcgc

SEQ ID NO: 803858 - RNA, 21 nt, Mycobacterium avium subsp. paratuberculosis
ucgacguccucgaugccgacc

SEQ ID NO: 803859 - RNA, 17 nt, Mycobacterium avium subsp. paratuberculosis
ucgacguccucgcccgg

SEQ ID NO: 803860 - RNA, 18 nt, Mycobacterium avium subsp. paratuberculosis
ucgacguccucgcccggg

SEQ ID NO: 803861 - RNA, 12 nt, Mycobacterium avium subsp. paratuberculosis
ucgacgucgggc

SEQ ID NO: 803862 - RNA, 16 nt, Mycobacterium avium subsp. paratuberculosis
ucgacgcgcacccggg

SEQ ID NO: 803863 - RNA, 14 nt, Mycobacterium avium subsp. paratuberculosis
ucgacgcgccgcac

SEQ ID NO: 803864 - RNA, 22 nt, Mycobacterium avium subsp. paratuberculosis
ucgacgcgccgcacugcacggc

SEQ ID NO: 803865 - RNA, 15 nt, Mycobacterium avium subsp. paratuberculosis
ucgacgcgugcguca

SEQ ID NO: 803866 - RNA, 19 nt, Mycobacterium avium subsp. paratuberculosis
ucgacgcgugcgucaucgc

SEQ ID NO: 803867 - RNA, 13 nt, Mycobacterium avium subsp. paratuberculosis
ucgacgcucggcg

SEQ ID NO: 803868 - RNA, 17 nt, Mycobacterium avium subsp. paratuberculosis
ucgacgcucggcgaugg

SEQ ID NO: 803869 - RNA, 16 nt, Mycobacterium avium subsp. paratuberculosis
ucgacgcugaccagcu

SEQ ID NO: 803870 - RNA, 14 nt, Mycobacterium avium subsp. paratuberculosis
ucgacgcugaccgu

SEQ ID NO: 803871 - RNA, 16 nt, Mycobacterium avium subsp. paratuberculosis
ucgacgcugagcaccc

SEQ ID NO: 803872 - RNA, 19 nt, Mycobacterium avium subsp. paratuberculosis
ucgacgcugagcacccgcc

SEQ ID NO: 803873 - RNA, 23 nt, Mycobacterium avium subsp. paratuberculosis
ucgacgcugagcacccgcccgga

SEQ ID NO: 803874 - RNA, 17 nt, Mycobacterium avium subsp. paratuberculosis
ucgacgcugagccgcuc

SEQ ID NO: 803875 - RNA, 19 nt, Mycobacterium avium subsp. paratuberculosis
ucgacgcugcagguggccc

SEQ ID NO: 803876 - RNA, 20 nt, Mycobacterium avium subsp. paratuberculosis
ucgacgauguuggcgacgac

SEQ ID NO: 803877 - RNA, 17 nt, Mycobacterium avium subsp. paratuberculosis
ucgacgauugucggggc

SEQ ID NO: 803878 - RNA, 15 nt, Mycobacterium avium subsp. paratuberculosis
ucgacgaugccguag

SEQ ID NO: 803879 - RNA, 17 nt, Mycobacterium avium subsp. paratuberculosis
ucgacgagguugucccg

SEQ ID NO: 803880 - RNA, 20 nt, Mycobacterium avium subsp. paratuberculosis
ucgacgaugaaauccgggac

SEQ ID NO: 803881 - RNA, 20 nt, Mycobacterium avium subsp. paratuberculosis
ucgacgacuucggccucggu

SEQ ID NO: 803882 - RNA, 18 nt, Mycobacterium avium subsp. paratuberculosis
ucgacgacggcgccgcgu

SEQ ID NO: 803883 - RNA, 21 nt, Mycobacterium avium subsp. paratuberculosis
ucgacgacggcgccgcgucgg

SEQ ID NO: 803884 - RNA, 13 nt, Mycobacterium avium subsp. paratuberculosis
ucgacgagcccgc

SEQ ID NO: 803885 - RNA, 19 nt, Mycobacterium avium subsp. paratuberculosis
ucgacgagcccgccggcgg

SEQ ID NO: 803886 - RNA, 14 nt, Mycobacterium avium subsp. paratuberculosis
ucgacgagcccgcg

SEQ ID NO: 803887 - RNA, 18 nt, Mycobacterium avium subsp. paratuberculosis
ucgacgagcccgcgccca

SEQ ID NO: 803888 - RNA, 13 nt, Mycobacterium avium subsp. paratuberculosis
ucgaccagcgccg

SEQ ID NO: 803889 - RNA, 24 nt, Mycobacterium avium subsp. paratuberculosis
ucgaccagcgccgagaccagccag

SEQ ID NO: 803890 - RNA, 15 nt, Mycobacterium avium subsp. paratuberculosis
ucgaccagcgcgccg

SEQ ID NO: 803891 - RNA, 17 nt, Mycobacterium avium subsp. paratuberculosis
ucgaccagcgcgccgcc

SEQ ID NO: 803892 - RNA, 19 nt, Mycobacterium avium subsp. paratuberculosis
ucgaccagcgcgccgccca

SEQ ID NO: 803893 - RNA, 21 nt, Mycobacterium avium subsp. paratuberculosis
ucgaccagcgcgccgcccagc

SEQ ID NO: 803894 - RNA, 21 nt, Mycobacterium avium subsp. paratuberculosis
ucgaccaggacgucggccggc

SEQ ID NO: 803895 - RNA, 15 nt, Mycobacterium avium subsp. paratuberculosis
ucgaccacggccggu

SEQ ID NO: 803896 - RNA, 23 nt, Mycobacterium avium subsp. paratuberculosis
ucgaccacgcacaccaccgacgc

SEQ ID NO: 803897 - RNA, 15 nt, Mycobacterium avium subsp. paratuberculosis
ucgacgacccgaucc

SEQ ID NO: 803898 - RNA, 18 nt, Mycobacterium avium subsp. paratuberculosis
ucgacgaccucgccgacg

SEQ ID NO: 803899 - RNA, 15 nt, Mycobacterium avium subsp. paratuberculosis
ucgacgacgccagcu

SEQ ID NO: 803900 - RNA, 18 nt, Mycobacterium avium subsp. paratuberculosis
ucgacgacgccagcugcc

SEQ ID NO: 803901 - RNA, 23 nt, Mycobacterium avium subsp. paratuberculosis
ucgaccaggcuuggcccgccgcc

SEQ ID NO: 803902 - RNA, 22 nt, Mycobacterium avium subsp. paratuberculosis
ucgaccaggguuugggcgugcg

SEQ ID NO: 803903 - RNA, 21 nt, Mycobacterium avium subsp. paratuberculosis
ucgaccagguaggcgcccugc

SEQ ID NO: 803904 - RNA, 17 nt, Mycobacterium avium subsp. paratuberculosis
ucgaccaucugccggcg

SEQ ID NO: 803905 - RNA, 16 nt, Mycobacterium avium subsp. paratuberculosis
ucgaguucgcggcgca

SEQ ID NO: 803906 - RNA, 20 nt, Mycobacterium avium subsp. paratuberculosis
ucgaguguguacacagggcg

SEQ ID NO: 803907 - RNA, 22 nt, Mycobacterium avium subsp. paratuberculosis
ucgaguguguacacagggcggc

SEQ ID NO: 803908 - RNA, 15 nt, Mycobacterium avium subsp. paratuberculosis
ucgaguaggcgacca

SEQ ID NO: 803909 - RNA, 16 nt, Mycobacterium avium subsp. paratuberculosis
ucgagucccgcgcggc

SEQ ID NO: 803910 - RNA, 17 nt, Mycobacterium avium subsp. paratuberculosis
ucgagucccgcgcggcg

SEQ ID NO: 803911 - RNA, 23 nt, Mycobacterium avium subsp. paratuberculosis
ucgaguccguugggggcgccgcg

SEQ ID NO: 803912 - RNA, 14 nt, Mycobacterium avium subsp. paratuberculosis
ucgaggucgccgac

SEQ ID NO: 803913 - RNA, 14 nt, Mycobacterium avium subsp. paratuberculosis
ucgaggucggccag

SEQ ID NO: 803914 - RNA, 16 nt, Mycobacterium avium subsp. paratuberculosis
ucgaggucggccagca

SEQ ID NO: 803915 - RNA, 15 nt, Mycobacterium avium subsp. paratuberculosis
ucgaggucgucgggc

SEQ ID NO: 803916 - RNA, 22 nt, Mycobacterium avium subsp. paratuberculosis
ucgaggugauguuggccgcgac

SEQ ID NO: 803917 - RNA, 16 nt, Mycobacterium avium subsp. paratuberculosis
ucgagguugaugccga

SEQ ID NO: 803918 - RNA, 15 nt, Mycobacterium avium subsp. paratuberculosis
ucgagguccucggcg

SEQ ID NO: 803919 - RNA, 22 nt, Mycobacterium avium subsp. paratuberculosis
ucgaggucgaaccacgcggcgg

SEQ ID NO: 803920 - RNA, 21 nt, Mycobacterium avium subsp. paratuberculosis
ucgaucauguagcgcugguag

SEQ ID NO: 803921 - RNA, 22 nt, Mycobacterium avium subsp. paratuberculosis
ucgauaaacgguugcgccagug

SEQ ID NO: 803922 - RNA, 22 nt, Mycobacterium avium subsp. paratuberculosis
ucgaguucgucgaccagcgggc

SEQ ID NO: 803923 - RNA, 18 nt, Mycobacterium avium subsp. paratuberculosis
ucgaguuuggccagcucg

SEQ ID NO: 803924 - RNA, 19 nt, Mycobacterium avium subsp. paratuberculosis
ucgaucccgucggccauca

SEQ ID NO: 803925 - RNA, 15 nt, Mycobacterium avium subsp. paratuberculosis
ucgaucccgccggcg

SEQ ID NO: 803926 - RNA, 17 nt, Mycobacterium avium subsp. paratuberculosis
ucgaucccuuggcggcg

SEQ ID NO: 803927 - RNA, 20 nt, Mycobacterium avium subsp. paratuberculosis
ucgaucccuuggcggcggcc

SEQ ID NO: 803928 - RNA, 16 nt, Mycobacterium avium subsp. paratuberculosis
ucgaucgccgcgccca

SEQ ID NO: 803929 - RNA, 18 nt, Mycobacterium avium subsp. paratuberculosis
ucgaucgccgcgcccagc

SEQ ID NO: 803930 - RNA, 12 nt, Mycobacterium avium subsp. paratuberculosis
ucgaucgcgguc

SEQ ID NO: 803931 - RNA, 13 nt, Mycobacterium avium subsp. paratuberculosis
ucgaucgccaccg

SEQ ID NO: 803932 - RNA, 23 nt, Mycobacterium avium subsp. paratuberculosis
ucgaucgaauacaccugccgcac

SEQ ID NO: 803933 - RNA, 22 nt, Mycobacterium avium subsp. paratuberculosis
ucgaucgacgacgccagcugcc

SEQ ID NO: 803934 - RNA, 16 nt, Mycobacterium avium subsp. paratuberculosis
ucgagcugggcccgcg

SEQ ID NO: 803935 - RNA, 21 nt, Mycobacterium avium subsp. paratuberculosis
ucgagcuugccgucguugacg

SEQ ID NO: 803936 - RNA, 21 nt, Mycobacterium avium subsp. paratuberculosis
ucgagcugcaacgcgucggcg

SEQ ID NO: 803937 - RNA, 18 nt, Mycobacterium avium subsp. paratuberculosis
ucgaggaacuugcgccgg

SEQ ID NO: 803938 - RNA, 15 nt, Mycobacterium avium subsp. paratuberculosis
ucgaggaucgcggcc

SEQ ID NO: 803939 - RNA, 16 nt, Mycobacterium avium subsp. paratuberculosis
ucgaggaucgcggcca

SEQ ID NO: 803940 - RNA, 21 nt, Mycobacterium avium subsp. paratuberculosis
ucgagguagcgugcgcccgac

SEQ ID NO: 803941 - RNA, 17 nt, Mycobacterium avium subsp. paratuberculosis
ucgagguaggccaccgg

SEQ ID NO: 803942 - RNA, 15 nt, Mycobacterium avium subsp. paratuberculosis
ucgagguaggcgaga

SEQ ID NO: 803943 - RNA, 14 nt, Mycobacterium avium subsp. paratuberculosis
ucgaggaccggcgc

SEQ ID NO: 803944 - RNA, 16 nt, Mycobacterium avium subsp. paratuberculosis
ucgaggaccggcgccg

SEQ ID NO: 803945 - RNA, 18 nt, Mycobacterium avium subsp. paratuberculosis
ucgaggaccggcgccggc

SEQ ID NO: 803946 - RNA, 15 nt, Mycobacterium avium subsp. paratuberculosis
ucgagccgccugcgc

SEQ ID NO: 803947 - RNA, 20 nt, Mycobacterium avium subsp. paratuberculosis
ucgagccgccugcgcgccgu

SEQ ID NO: 803948 - RNA, 15 nt, Mycobacterium avium subsp. paratuberculosis
ucgagcuccucggcc

SEQ ID NO: 803949 - RNA, 18 nt, Mycobacterium avium subsp. paratuberculosis
ucgagcuccucggccagc

SEQ ID NO: 803950 - RNA, 20 nt, Mycobacterium avium subsp. paratuberculosis
ucgagcucgcagucgaucag

SEQ ID NO: 803951 - RNA, 21 nt, Mycobacterium avium subsp. paratuberculosis
ucgagcucggccuugagccgg

SEQ ID NO: 803952 - RNA, 15 nt, Mycobacterium avium subsp. paratuberculosis
ucgagcucgucgggu

SEQ ID NO: 803953 - RNA, 15 nt, Mycobacterium avium subsp. paratuberculosis
ucgagccgccgccgg

SEQ ID NO: 803954 - RNA, 12 nt, Mycobacterium avium subsp. paratuberculosis
ucgagccggccg

SEQ ID NO: 803955 - RNA, 14 nt, Mycobacterium avium subsp. paratuberculosis
ucgagccggccgga

SEQ ID NO: 803956 - RNA, 20 nt, Mycobacterium avium subsp. paratuberculosis
ucgagccggccgucaggaac

SEQ ID NO: 803957 - RNA, 14 nt, Mycobacterium avium subsp. paratuberculosis
ucgagcgucacgcu

SEQ ID NO: 803958 - RNA, 15 nt, Mycobacterium avium subsp. paratuberculosis
ucgagcgugcccgcg

SEQ ID NO: 803959 - RNA, 19 nt, Mycobacterium avium subsp. paratuberculosis
ucgagcgugcccgcgccca

SEQ ID NO: 803960 - RNA, 19 nt, Mycobacterium avium subsp. paratuberculosis
ucgagccgcagucgaucac

SEQ ID NO: 803961 - RNA, 20 nt, Mycobacterium avium subsp. paratuberculosis
ucgagccgcagucgaucacc

SEQ ID NO: 803962 - RNA, 13 nt, Mycobacterium avium subsp. paratuberculosis
ucgagccgagcac

SEQ ID NO: 803963 - RNA, 15 nt, Mycobacterium avium subsp. paratuberculosis
ucgagccgagcaccg

SEQ ID NO: 803964 - RNA, 18 nt, Mycobacterium avium subsp. paratuberculosis
ucgagccgagcaccggca

SEQ ID NO: 803965 - RNA, 19 nt, Mycobacterium avium subsp. paratuberculosis
ucgagccgagcaccggcag

SEQ ID NO: 803966 - RNA, 21 nt, Mycobacterium avium subsp. paratuberculosis
ucgagccgagcaccggcagca

SEQ ID NO: 803967 - RNA, 15 nt, Mycobacterium avium subsp. paratuberculosis
ucgagaugaccgucg

SEQ ID NO: 803968 - RNA, 19 nt, Mycobacterium avium subsp. paratuberculosis
ucgagaugcguucggccgc

SEQ ID NO: 803969 - RNA, 16 nt, Mycobacterium avium subsp. paratuberculosis
ucgagaucagcaccgg

SEQ ID NO: 803970 - RNA, 18 nt, Mycobacterium avium subsp. paratuberculosis
ucgagaucagcaccgggu

SEQ ID NO: 803971 - RNA, 14 nt, Mycobacterium avium subsp. paratuberculosis
ucgagagccgcauc

SEQ ID NO: 803972 - RNA, 21 nt, Mycobacterium avium subsp. paratuberculosis
ucgagccaccacugcgccguc

SEQ ID NO: 803973 - RNA, 17 nt, Mycobacterium avium subsp. paratuberculosis
ucgagcaugcguccggu

SEQ ID NO: 803974 - RNA, 21 nt, Mycobacterium avium subsp. paratuberculosis
ucgagccauaaaccggccggc

SEQ ID NO: 803975 - RNA, 22 nt, Mycobacterium avium subsp. paratuberculosis
ucgagccauaaaccggccggcg

SEQ ID NO: 803976 - RNA, 17 nt, Mycobacterium avium subsp. paratuberculosis
ucgagcacacgaucucg

SEQ ID NO: 803977 - RNA, 17 nt, Mycobacterium avium subsp. paratuberculosis
ucgagcaccagcgucga

SEQ ID NO: 803978 - RNA, 19 nt, Mycobacterium avium subsp. paratuberculosis
ucgagcaguagacgccgcc

SEQ ID NO: 803979 - RNA, 20 nt, Mycobacterium avium subsp. paratuberculosis
ucgagcaguagacgccgccg

SEQ ID NO: 803980 - RNA, 17 nt, Mycobacterium avium subsp. paratuberculosis
ucgagcauccggugccg

SEQ ID NO: 803981 - RNA, 20 nt, Mycobacterium avium subsp. paratuberculosis
ucgagcaucuccagccggcg

SEQ ID NO: 803982 - RNA, 15 nt, Mycobacterium avium subsp. paratuberculosis
aauacggcccggcga

SEQ ID NO: 803983 - RNA, 16 nt, Mycobacterium avium subsp. paratuberculosis
ucgcgggugcgcucga

SEQ ID NO: 803984 - RNA, 14 nt, Mycobacterium avium subsp. paratuberculosis
ucgcgggugcgcug

SEQ ID NO: 803985 - RNA, 16 nt, Mycobacterium avium subsp. paratuberculosis
ucgcgggugcggcgcu

SEQ ID NO: 803986 - RNA, 22 nt, Mycobacterium avium subsp. paratuberculosis
aauacccgaccagcaccgcggc

SEQ ID NO: 803987 - RNA, 20 nt, Mycobacterium avium subsp. paratuberculosis
ucgcgggugaccggcgccgg

SEQ ID NO: 803988 - RNA, 12 nt, Mycobacterium avium subsp. paratuberculosis
ucgcgcggcgcc

SEQ ID NO: 803989 - RNA, 22 nt, Mycobacterium avium subsp. paratuberculosis
ucgcgggucuggcucggcacca

SEQ ID NO: 803990 - RNA, 19 nt, Mycobacterium avium subsp. paratuberculosis
ucgcgggggccgcgaugag

SEQ ID NO: 803991 - RNA, 12 nt, Mycobacterium avium subsp. paratuberculosis
ucgcgcgcggcg

SEQ ID NO: 803992 - RNA, 16 nt, Mycobacterium avium subsp. paratuberculosis
ucgcgcgcggcgacgg

SEQ ID NO: 803993 - RNA, 20 nt, Mycobacterium avium subsp. paratuberculosis
ucgcgcgcggcggccaccgc

SEQ ID NO: 803994 - RNA, 21 nt, Mycobacterium avium subsp. paratuberculosis
ucgcgcgcggcggccaccgcg

SEQ ID NO: 803995 - RNA, 13 nt, Mycobacterium avium subsp. paratuberculosis
ucgcgcgcggcgu

SEQ ID NO: 803996 - RNA, 12 nt, Mycobacterium avium subsp. paratuberculosis
ucgcgcgccggc

SEQ ID NO: 803997 - RNA, 14 nt, Mycobacterium avium subsp. paratuberculosis
ucgcgcgccggcgc

SEQ ID NO: 803998 - RNA, 15 nt, Mycobacterium avium subsp. paratuberculosis
ucgcgcgacugggcg

SEQ ID NO: 803999 - RNA, 18 nt, Mycobacterium avium subsp. paratuberculosis
ucgcgguaguuguccccg

SEQ ID NO: 804000 - RNA, 14 nt, Mycobacterium avium subsp. paratuberculosis
ucgcggucgacgga

SEQ ID NO: 804001 - RNA, 14 nt, Mycobacterium avium subsp. paratuberculosis
ucgcgguccaccag

SEQ ID NO: 804002 - RNA, 14 nt, Mycobacterium avium subsp. paratuberculosis
ucgcgguccacgcc

SEQ ID NO: 804003 - RNA, 15 nt, Mycobacterium avium subsp. paratuberculosis
ucgcgguccacgccg

SEQ ID NO: 804004 - RNA, 23 nt, Mycobacterium avium subsp. paratuberculosis
ucgcgguccaucuccagcuccgc

SEQ ID NO: 804005 - RNA, 21 nt, Mycobacterium avium subsp. paratuberculosis
ucgcgguagaucgacagggcg

SEQ ID NO: 804006 - RNA, 23 nt, Mycobacterium avium subsp. paratuberculosis
ucgcgguagaucgacagggcguc

SEQ ID NO: 804007 - RNA, 18 nt, Mycobacterium avium subsp. paratuberculosis
ucgcgggugucgagccac

SEQ ID NO: 804008 - RNA, 21 nt, Mycobacterium avium subsp. paratuberculosis
ucgcggucggcgcccggccca

SEQ ID NO: 804009 - RNA, 17 nt, Mycobacterium avium subsp. paratuberculosis
ucgcggucggcgucgcu

SEQ ID NO: 804010 - RNA, 16 nt, Mycobacterium avium subsp. paratuberculosis
ucgcggugaccgccgc

SEQ ID NO: 804011 - RNA, 17 nt, Mycobacterium avium subsp. paratuberculosis
ucgcggugaccgccgcc

SEQ ID NO: 804012 - RNA, 19 nt, Mycobacterium avium subsp. paratuberculosis
ucgcggugaccgccgccau

SEQ ID NO: 804013 - RNA, 18 nt, Mycobacterium avium subsp. paratuberculosis
ucgcggugcaacgccgcc

SEQ ID NO: 804014 - RNA, 23 nt, Mycobacterium avium subsp. paratuberculosis
ucgcggugcaacgccgccgacag

SEQ ID NO: 804015 - RNA, 13 nt, Mycobacterium avium subsp. paratuberculosis
ucgcggugcccag

SEQ ID NO: 804016 - RNA, 20 nt, Mycobacterium avium subsp. paratuberculosis
ucgcggugcgcgcgcgcucg

SEQ ID NO: 804017 - RNA, 22 nt, Mycobacterium avium subsp. paratuberculosis
ucgcggugcgcgcgcgcucggc

SEQ ID NO: 804018 - RNA, 20 nt, Mycobacterium avium subsp. paratuberculosis
ucgcggugcggggccgcggc

SEQ ID NO: 804019 - RNA, 22 nt, Mycobacterium avium subsp. paratuberculosis
ucgcggugcggggccgcggccg

SEQ ID NO: 804020 - RNA, 22 nt, Mycobacterium avium subsp. paratuberculosis
ucgcgguggagcacagcacggc

SEQ ID NO: 804021 - RNA, 20 nt, Mycobacterium avium subsp. paratuberculosis
ucgcgguggcgcccgcggug

SEQ ID NO: 804022 - RNA, 14 nt, Mycobacterium avium subsp. paratuberculosis
ucgcggugucggcg

SEQ ID NO: 804023 - RNA, 18 nt, Mycobacterium avium subsp. paratuberculosis
ucgcggugggcgcgggcc

SEQ ID NO: 804024 - RNA, 17 nt, Mycobacterium avium subsp. paratuberculosis
ucgcggugggcucggcg

SEQ ID NO: 804025 - RNA, 21 nt, Mycobacterium avium subsp. paratuberculosis
ucgcgguugggccgccggccg

SEQ ID NO: 804026 - RNA, 15 nt, Mycobacterium avium subsp. paratuberculosis
ucgcguacccgggca

SEQ ID NO: 804027 - RNA, 19 nt, Mycobacterium avium subsp. paratuberculosis
ucgcguacccgggcaauga

SEQ ID NO: 804028 - RNA, 14 nt, Mycobacterium avium subsp. paratuberculosis
ucgcguagcgaggu

SEQ ID NO: 804029 - RNA, 15 nt, Mycobacterium avium subsp. paratuberculosis
ucgcguagcgaggug

SEQ ID NO: 804030 - RNA, 15 nt, Mycobacterium avium subsp. paratuberculosis
ucgcguaguccagca

SEQ ID NO: 804031 - RNA, 21 nt, Mycobacterium avium subsp. paratuberculosis
ucgcguaguccagcacggcga

SEQ ID NO: 804032 - RNA, 16 nt, Mycobacterium avium subsp. paratuberculosis
ucgcguccccgcgccg

SEQ ID NO: 804033 - RNA, 17 nt, Mycobacterium avium subsp. paratuberculosis
ucgcguccccgcgccgg

SEQ ID NO: 804034 - RNA, 16 nt, Mycobacterium avium subsp. paratuberculosis
ucgcguccgcgaucgu

SEQ ID NO: 804035 - RNA, 13 nt, Mycobacterium avium subsp. paratuberculosis
ucgcgucgacgau

SEQ ID NO: 804036 - RNA, 13 nt, Mycobacterium avium subsp. paratuberculosis
ucgcgucgacguc

SEQ ID NO: 804037 - RNA, 15 nt, Mycobacterium avium subsp. paratuberculosis
ucgcgucgacgucgg

SEQ ID NO: 804038 - RNA, 17 nt, Mycobacterium avium subsp. paratuberculosis
ucgcgucgacgucgggc

SEQ ID NO: 804039 - RNA, 18 nt, Mycobacterium avium subsp. paratuberculosis
ucgcgucgacgucgggca

SEQ ID NO: 804040 - RNA, 15 nt, Mycobacterium avium subsp. paratuberculosis
ucgcgucgaugccgg

SEQ ID NO: 804041 - RNA, 17 nt, Mycobacterium avium subsp. paratuberculosis
ucgcgucggugucgccg

SEQ ID NO: 804042 - RNA, 17 nt, Mycobacterium avium subsp. paratuberculosis
ucgcucaaaggcgggca

SEQ ID NO: 804043 - RNA, 20 nt, Mycobacterium avium subsp. paratuberculosis
ucgcucaacggcuccaggua

SEQ ID NO: 804044 - RNA, 16 nt, Mycobacterium avium subsp. paratuberculosis
ucgcucaucgugaucg

SEQ ID NO: 804045 - RNA, 13 nt, Mycobacterium avium subsp. paratuberculosis
ucgcucggcggcg

SEQ ID NO: 804046 - RNA, 23 nt, Mycobacterium avium subsp. paratuberculosis
ucgcucuucucguucugcgugcg

SEQ ID NO: 804047 - RNA, 18 nt, Mycobacterium avium subsp. paratuberculosis
ucgcguugagcgucgcca

SEQ ID NO: 804048 - RNA, 14 nt, Mycobacterium avium subsp. paratuberculosis
ucgcguucgggcag

SEQ ID NO: 804049 - RNA, 17 nt, Mycobacterium avium subsp. paratuberculosis
ucgcguucgggcagcgc

SEQ ID NO: 804050 - RNA, 14 nt, Mycobacterium avium subsp. paratuberculosis
ucgcguucgggccc

SEQ ID NO: 804051 - RNA, 16 nt, Mycobacterium avium subsp. paratuberculosis
ucgcgugugcccagca

SEQ ID NO: 804052 - RNA, 20 nt, Mycobacterium avium subsp. paratuberculosis
ucgcguucugcaccagcucg

SEQ ID NO: 804053 - RNA, 17 nt, Mycobacterium avium subsp. paratuberculosis
ucgcguugaaagccgcg

SEQ ID NO: 804054 - RNA, 20 nt, Mycobacterium avium subsp. paratuberculosis
ucgcuaguugcacuuucgcg

SEQ ID NO: 804055 - RNA, 19 nt, Mycobacterium avium subsp. paratuberculosis
ucgcuauaucgcaccggcg

SEQ ID NO: 804056 - RNA, 14 nt, Mycobacterium avium subsp. paratuberculosis
ucgcuaaucgccgc

SEQ ID NO: 804057 - RNA, 15 nt, Mycobacterium avium subsp. paratuberculosis
ucgcgucgucggcgg

SEQ ID NO: 804058 - RNA, 23 nt, Mycobacterium avium subsp. paratuberculosis
ucgcgucgugcggccggcgccgg

SEQ ID NO: 804059 - RNA, 21 nt, Mycobacterium avium subsp. paratuberculosis
ucgcgucugcucgccggcuac

SEQ ID NO: 804060 - RNA, 15 nt, Mycobacterium avium subsp. paratuberculosis
ucgcgugaccggcgg

SEQ ID NO: 804061 - RNA, 18 nt, Mycobacterium avium subsp. paratuberculosis
ucgcgugaccggcggugc

SEQ ID NO: 804062 - RNA, 13 nt, Mycobacterium avium subsp. paratuberculosis
ucgcgugcgucac

SEQ ID NO: 804063 - RNA, 17 nt, Mycobacterium avium subsp. paratuberculosis
ucgcgugcgucacgcug

SEQ ID NO: 804064 - RNA, 20 nt, Mycobacterium avium subsp. paratuberculosis
ucgcguggcaauucgaccgu

SEQ ID NO: 804065 - RNA, 20 nt, Mycobacterium avium subsp. paratuberculosis
ucgcguggccugggcgacca

SEQ ID NO: 804066 - RNA, 15 nt, Mycobacterium avium subsp. paratuberculosis
ucggacgagccgucg

SEQ ID NO: 804067 - RNA, 20 nt, Mycobacterium avium subsp. paratuberculosis
ucggacgagccgucgcggga

SEQ ID NO: 804068 - RNA, 16 nt, Mycobacterium avium subsp. paratuberculosis
ucggacgcggccgagc

SEQ ID NO: 804069 - RNA, 18 nt, Mycobacterium avium subsp. paratuberculosis
ucggacgcggccgagccg

SEQ ID NO: 804070 - RNA, 14 nt, Mycobacterium avium subsp. paratuberculosis
ucggacgcggggaa

SEQ ID NO: 804071 - RNA, 16 nt, Mycobacterium avium subsp. paratuberculosis
ucggacgccggcagcc

SEQ ID NO: 804072 - RNA, 12 nt, Mycobacterium avium subsp. paratuberculosis
ucggacccagcc

SEQ ID NO: 804073 - RNA, 17 nt, Mycobacterium avium subsp. paratuberculosis
ucggacccagcccggcg

SEQ ID NO: 804074 - RNA, 19 nt, Mycobacterium avium subsp. paratuberculosis
ucggacccagcccggcgac

SEQ ID NO: 804075 - RNA, 13 nt, Mycobacterium avium subsp. paratuberculosis
ucggaccccgaug

SEQ ID NO: 804076 - RNA, 22 nt, Mycobacterium avium subsp. paratuberculosis
ucggaccccgaugcgcucaccc

SEQ ID NO: 804077 - RNA, 20 nt, Mycobacterium avium subsp. paratuberculosis
ucggaccgguaggcgcaccg

SEQ ID NO: 804078 - RNA, 16 nt, Mycobacterium avium subsp. paratuberculosis
ucgcuuacugcgaggc

SEQ ID NO: 804079 - RNA, 14 nt, Mycobacterium avium subsp. paratuberculosis
ucgcuugcgccgca

SEQ ID NO: 804080 - RNA, 15 nt, Mycobacterium avium subsp. paratuberculosis
ucgcuugcgccgcag

SEQ ID NO: 804081 - RNA, 18 nt, Mycobacterium avium subsp. paratuberculosis
ucgcugccgccgccggcg

SEQ ID NO: 804082 - RNA, 14 nt, Mycobacterium avium subsp. paratuberculosis
ucgcugccggccgg

SEQ ID NO: 804083 - RNA, 13 nt, Mycobacterium avium subsp. paratuberculosis
ucgcugcggcgca

SEQ ID NO: 804084 - RNA, 13 nt, Mycobacterium avium subsp. paratuberculosis
ucgcugccgucca

SEQ ID NO: 804085 - RNA, 19 nt, Mycobacterium avium subsp. paratuberculosis
ucgcugccguccacccggc

SEQ ID NO: 804086 - RNA, 13 nt, Mycobacterium avium subsp. paratuberculosis
ucgcugcgcccgc

SEQ ID NO: 804087 - RNA, 22 nt, Mycobacterium avium subsp. paratuberculosis
ucgcugcgagcccggccagucc

SEQ ID NO: 804088 - RNA, 16 nt, Mycobacterium avium subsp. paratuberculosis
ucgcugcgaggcgggc

SEQ ID NO: 804089 - RNA, 14 nt, Mycobacterium avium subsp. paratuberculosis
ucgcuggacagcca

SEQ ID NO: 804090 - RNA, 21 nt, Mycobacterium avium subsp. paratuberculosis
ucgcuggacagccacagcucg

SEQ ID NO: 804091 - RNA, 17 nt, Mycobacterium avium subsp. paratuberculosis
ucgcugcucaugagccc

SEQ ID NO: 804092 - RNA, 20 nt, Mycobacterium avium subsp. paratuberculosis
ucgcuguuggcgacggcgcu

SEQ ID NO: 804093 - RNA, 20 nt, Mycobacterium avium subsp. paratuberculosis
ucgcuguuagccucgccagc

SEQ ID NO: 804094 - RNA, 15 nt, Mycobacterium avium subsp. paratuberculosis
ucgcugcucugcgcg

SEQ ID NO: 804095 - RNA, 19 nt, Mycobacterium avium subsp. paratuberculosis
ucgcugcucugcgcgcggu

SEQ ID NO: 804096 - RNA, 13 nt, Mycobacterium avium subsp. paratuberculosis
ucggcgaccagcg

SEQ ID NO: 804097 - RNA, 16 nt, Mycobacterium avium subsp. paratuberculosis
ucggcgaccagcgacg

SEQ ID NO: 804098 - RNA, 20 nt, Mycobacterium avium subsp. paratuberculosis
ucggcgaccagcgacggcag

SEQ ID NO: 804099 - RNA, 15 nt, Mycobacterium avium subsp. paratuberculosis
ucggcgaaggcgcgc

SEQ ID NO: 804100 - RNA, 20 nt, Mycobacterium avium subsp. paratuberculosis
ucggcgacaacagcgccgag

SEQ ID NO: 804101 - RNA, 21 nt, Mycobacterium avium subsp. paratuberculosis
ucggcgacaacagcgccgaga

SEQ ID NO: 804102 - RNA, 22 nt, Mycobacterium avium subsp. paratuberculosis
ucggcgaagucaucaccgggga

SEQ ID NO: 804103 - RNA, 23 nt, Mycobacterium avium subsp. paratuberculosis
ucggcgaacagugcacugccgac

SEQ ID NO: 804104 - RNA, 16 nt, Mycobacterium avium subsp. paratuberculosis
ucggcgaaccagggca

SEQ ID NO: 804105 - RNA, 23 nt, Mycobacterium avium subsp. paratuberculosis
ucggcgaaccagggcagccagcc

SEQ ID NO: 804106 - RNA, 16 nt, Mycobacterium avium subsp. paratuberculosis
ucggcgaacgcccggu

SEQ ID NO: 804107 - RNA, 22 nt, Mycobacterium avium subsp. paratuberculosis
ucggcgaacgcccggucgauga

SEQ ID NO: 804108 - RNA, 15 nt, Mycobacterium avium subsp. paratuberculosis
ucggccuugaccacg

SEQ ID NO: 804109 - RNA, 15 nt, Mycobacterium avium subsp. paratuberculosis
ucggccuugcgccac

SEQ ID NO: 804110 - RNA, 22 nt, Mycobacterium avium subsp. paratuberculosis
ucggccuugcgccacuugucca

SEQ ID NO: 804111 - RNA, 14 nt, Mycobacterium avium subsp. paratuberculosis
ucggccuucagcgu

SEQ ID NO: 804112 - RNA, 21 nt, Mycobacterium avium subsp. paratuberculosis
ucggccuucgggguggucacc

SEQ ID NO: 804113 - RNA, 14 nt, Mycobacterium avium subsp. paratuberculosis
ucggccgcgucggg

SEQ ID NO: 804114 - RNA, 17 nt, Mycobacterium avium subsp. paratuberculosis
ucggccgcggggccggc

SEQ ID NO: 804115 - RNA, 21 nt, Mycobacterium avium subsp. paratuberculosis
ucggccgcggggccggcgcug

SEQ ID NO: 804116 - RNA, 22 nt, Mycobacterium avium subsp. paratuberculosis
ucggccgcgcgugcccgcgguc

SEQ ID NO: 804117 - RNA, 18 nt, Mycobacterium avium subsp. paratuberculosis
ucggccgcggauggugac

SEQ ID NO: 804118 - RNA, 19 nt, Mycobacterium avium subsp. paratuberculosis
ucggccgcggccggcggca

SEQ ID NO: 804119 - RNA, 15 nt, Mycobacterium avium subsp. paratuberculosis
ucggccgccaccgag

SEQ ID NO: 804120 - RNA, 17 nt, Mycobacterium avium subsp. paratuberculosis
ucggccgccaccgccau

SEQ ID NO: 804121 - RNA, 15 nt, Mycobacterium avium subsp. paratuberculosis
ucggccgagucgacg

SEQ ID NO: 804122 - RNA, 22 nt, Mycobacterium avium subsp. paratuberculosis
ucggccgcacgucccgcccggc

SEQ ID NO: 804123 - RNA, 17 nt, Mycobacterium avium subsp. paratuberculosis
ucggccgcaagcgaagc

SEQ ID NO: 804124 - RNA, 15 nt, Mycobacterium avium subsp. paratuberculosis
ucggccgcccguccg

SEQ ID NO: 804125 - RNA, 20 nt, Mycobacterium avium subsp. paratuberculosis
ucggccgccgacaccaccac

SEQ ID NO: 804126 - RNA, 15 nt, Mycobacterium avium subsp. paratuberculosis
ucggccgcgacgacc

SEQ ID NO: 804127 - RNA, 12 nt, Mycobacterium avium subsp. paratuberculosis
ucggcgccggug

SEQ ID NO: 804128 - RNA, 16 nt, Mycobacterium avium subsp. paratuberculosis
ucggcgccguccagcu

SEQ ID NO: 804129 - RNA, 17 nt, Mycobacterium avium subsp. paratuberculosis
ucggcgccggcuccgca

SEQ ID NO: 804130 - RNA, 15 nt, Mycobacterium avium subsp. paratuberculosis
ucggcgccgcgcgcc

SEQ ID NO: 804131 - RNA, 15 nt, Mycobacterium avium subsp. paratuberculosis
ucggcgccggcaucc

SEQ ID NO: 804132 - RNA, 14 nt, Mycobacterium avium subsp. paratuberculosis
ucggcgccggccgu

SEQ ID NO: 804133 - RNA, 20 nt, Mycobacterium avium subsp. paratuberculosis
ucggcgccggccgucacgcu

SEQ ID NO: 804134 - RNA, 16 nt, Mycobacterium avium subsp. paratuberculosis
ucggcgccggcgcgca

SEQ ID NO: 804135 - RNA, 22 nt, Mycobacterium avium subsp. paratuberculosis
ucggcgauggugaugugcggcg

SEQ ID NO: 804136 - RNA, 23 nt, Mycobacterium avium subsp. paratuberculosis
ucggcgauggugaugugcggcgc

SEQ ID NO: 804137 - RNA, 19 nt, Mycobacterium avium subsp. paratuberculosis
ucggcgccgaucacgccgg

SEQ ID NO: 804138 - RNA, 18 nt, Mycobacterium avium subsp. paratuberculosis
ucggcgccgaugcagcac

SEQ ID NO: 804139 - RNA, 14 nt, Mycobacterium avium subsp. paratuberculosis
ucggcgccgccgag

SEQ ID NO: 804140 - RNA, 16 nt, Mycobacterium avium subsp. paratuberculosis
ucggcgccgccgagcc

SEQ ID NO: 804141 - RNA, 17 nt, Mycobacterium avium subsp. paratuberculosis
ucggcgccgccgagccg

SEQ ID NO: 804142 - RNA, 13 nt, Mycobacterium avium subsp. paratuberculosis
ucggcgccgccgg

SEQ ID NO: 804143 - RNA, 13 nt, Mycobacterium avium subsp. paratuberculosis
ucggcgcagcgca

SEQ ID NO: 804144 - RNA, 11 nt, Mycobacterium avium subsp. paratuberculosis
ucggcgccgcg

SEQ ID NO: 804145 - RNA, 18 nt, Mycobacterium avium subsp. paratuberculosis
ucggcgccgcgaccccgg

SEQ ID NO: 804146 - RNA, 20 nt, Mycobacterium avium subsp. paratuberculosis
ucggcgccgcgaccccggac

SEQ ID NO: 804147 - RNA, 15 nt, Mycobacterium avium subsp. paratuberculosis
ucggcgauggcggcg

SEQ ID NO: 804148 - RNA, 19 nt, Mycobacterium avium subsp. paratuberculosis
ucggcgauggcggcgugca

SEQ ID NO: 804149 - RNA, 14 nt, Mycobacterium avium subsp. paratuberculosis
ucggcgauguugac

SEQ ID NO: 804150 - RNA, 19 nt, Mycobacterium avium subsp. paratuberculosis
ucggcgaugcguugcgcca

SEQ ID NO: 804151 - RNA, 22 nt, Mycobacterium avium subsp. paratuberculosis
ucggcgaugccuuccucggcgc

SEQ ID NO: 804152 - RNA, 16 nt, Mycobacterium avium subsp. paratuberculosis
ucggcgaugcgcacca

SEQ ID NO: 804153 - RNA, 20 nt, Mycobacterium avium subsp. paratuberculosis
ucggcgaugcgcaccaucac

SEQ ID NO: 804154 - RNA, 12 nt, Mycobacterium avium subsp. paratuberculosis
ucggcgaucucg

SEQ ID NO: 804155 - RNA, 20 nt, Mycobacterium avium subsp. paratuberculosis
ucggcgacgcucaggcgucc

SEQ ID NO: 804156 - RNA, 23 nt, Mycobacterium avium subsp. paratuberculosis
ucggcgacguccuugaucagcau

SEQ ID NO: 804157 - RNA, 13 nt, Mycobacterium avium subsp. paratuberculosis
ucggcgagcaccg

SEQ ID NO: 804158 - RNA, 18 nt, Mycobacterium avium subsp. paratuberculosis
ucggcgagcaccgugccg

SEQ ID NO: 804159 - RNA, 14 nt, Mycobacterium avium subsp. paratuberculosis
ucggcgaucgccgg

SEQ ID NO: 804160 - RNA, 15 nt, Mycobacterium avium subsp. paratuberculosis
ucggcgaucggcgug

SEQ ID NO: 804161 - RNA, 17 nt, Mycobacterium avium subsp. paratuberculosis
ucggcgagcagcagcgc

SEQ ID NO: 804162 - RNA, 18 nt, Mycobacterium avium subsp. paratuberculosis
ucggcgagcagccgcgcc

SEQ ID NO: 804163 - RNA, 18 nt, Mycobacterium avium subsp. paratuberculosis
ucggcgaucucggucacc

SEQ ID NO: 804164 - RNA, 16 nt, Mycobacterium avium subsp. paratuberculosis
ucggcgaucucguccc

SEQ ID NO: 804165 - RNA, 17 nt, Mycobacterium avium subsp. paratuberculosis
ucggcgaucucgucgcg

SEQ ID NO: 804166 - RNA, 12 nt, Mycobacterium avium subsp. paratuberculosis
ucggcgacgacc

SEQ ID NO: 804167 - RNA, 20 nt, Mycobacterium avium subsp. paratuberculosis
ucggcgaccuccugcaaggc

SEQ ID NO: 804168 - RNA, 12 nt, Mycobacterium avium subsp. paratuberculosis
ucggcgaccgcc

SEQ ID NO: 804169 - RNA, 13 nt, Mycobacterium avium subsp. paratuberculosis
ucggcgaccgccc

SEQ ID NO: 804170 - RNA, 18 nt, Mycobacterium avium subsp. paratuberculosis
ucggcgaccgcgcgcggc

SEQ ID NO: 804171 - RNA, 20 nt, Mycobacterium avium subsp. paratuberculosis
ucggcgaccgcgcgcggcgc

SEQ ID NO: 804172 - RNA, 17 nt, Mycobacterium avium subsp. paratuberculosis
ucggcgacgauggccag

SEQ ID NO: 804173 - RNA, 22 nt, Mycobacterium avium subsp. paratuberculosis
ucggcgacgauggccaggccca

SEQ ID NO: 804174 - RNA, 13 nt, Mycobacterium avium subsp. paratuberculosis
ucggcgacgccgc

SEQ ID NO: 804175 - RNA, 14 nt, Mycobacterium avium subsp. paratuberculosis
ucggcgacgccgcc

SEQ ID NO: 804176 - RNA, 16 nt, Mycobacterium avium subsp. paratuberculosis
ucggcgacgccgccgu

SEQ ID NO: 804177 - RNA, 15 nt, Mycobacterium avium subsp. paratuberculosis
ucggcgacgccgucg

SEQ ID NO: 804178 - RNA, 16 nt, Mycobacterium avium subsp. paratuberculosis
ucggcgacgcuggugg

SEQ ID NO: 804179 - RNA, 19 nt, Mycobacterium avium subsp. paratuberculosis
ucggcgacggcgacggcgu

SEQ ID NO: 804180 - RNA, 21 nt, Mycobacterium avium subsp. paratuberculosis
ucggcgacggcgacggcgucc

SEQ ID NO: 804181 - RNA, 16 nt, Mycobacterium avium subsp. paratuberculosis
ucggcgacggcgcuca

SEQ ID NO: 804182 - RNA, 21 nt, Mycobacterium avium subsp. paratuberculosis
ucggcgacggcgcucaccggc

SEQ ID NO: 804183 - RNA, 22 nt, Mycobacterium avium subsp. paratuberculosis
ucggcgacggcgcucaccggcg

SEQ ID NO: 804184 - RNA, 13 nt, Mycobacterium avium subsp. paratuberculosis
ucggcgacggcgg

SEQ ID NO: 804185 - RNA, 13 nt, Mycobacterium avium subsp. paratuberculosis
ucggcgacggcgu

SEQ ID NO: 804186 - RNA, 19 nt, Mycobacterium avium subsp. paratuberculosis
ucggcgacggcguccagcu

SEQ ID NO: 804187 - RNA, 17 nt, Mycobacterium avium subsp. paratuberculosis
ucggcaucucggccgga

SEQ ID NO: 804188 - RNA, 19 nt, Mycobacterium avium subsp. paratuberculosis
ucggcaucucggccggaag

SEQ ID NO: 804189 - RNA, 13 nt, Mycobacterium avium subsp. paratuberculosis
ucggcacgccggg

SEQ ID NO: 804190 - RNA, 22 nt, Mycobacterium avium subsp. paratuberculosis
ucggcacguguccgacgccguc

SEQ ID NO: 804191 - RNA, 17 nt, Mycobacterium avium subsp. paratuberculosis
ucggcacugcccgcauc

SEQ ID NO: 804192 - RNA, 22 nt, Mycobacterium avium subsp. paratuberculosis
ucggcacccgcaacaccacguc

SEQ ID NO: 804193 - RNA, 18 nt, Mycobacterium avium subsp. paratuberculosis
ucggcaccagagcgccgg

SEQ ID NO: 804194 - RNA, 19 nt, Mycobacterium avium subsp. paratuberculosis
ucggcaccagcggcaucgc

SEQ ID NO: 804195 - RNA, 16 nt, Mycobacterium avium subsp. paratuberculosis
ucggcaccgugccgcg

SEQ ID NO: 804196 - RNA, 15 nt, Mycobacterium avium subsp. paratuberculosis
ucggcacaccaggua

SEQ ID NO: 804197 - RNA, 16 nt, Mycobacterium avium subsp. paratuberculosis
ucggcacaccagguag

SEQ ID NO: 804198 - RNA, 17 nt, Mycobacterium avium subsp. paratuberculosis
ucggcacaccagguagg

SEQ ID NO: 804199 - RNA, 17 nt, Mycobacterium avium subsp. paratuberculosis
ucggcacacgcggacag

SEQ ID NO: 804200 - RNA, 14 nt, Mycobacterium avium subsp. paratuberculosis
ucggacucgcgccg

SEQ ID NO: 804201 - RNA, 19 nt, Mycobacterium avium subsp. paratuberculosis
ucggagacccgcccggaga

SEQ ID NO: 804202 - RNA, 18 nt, Mycobacterium avium subsp. paratuberculosis
ucggagaccuuggcgcug

SEQ ID NO: 804203 - RNA, 19 nt, Mycobacterium avium subsp. paratuberculosis
ucggagaccuuggcgcuga

SEQ ID NO: 804204 - RNA, 22 nt, Mycobacterium avium subsp. paratuberculosis
ucggccagauagaugagccgca

SEQ ID NO: 804205 - RNA, 14 nt, Mycobacterium avium subsp. paratuberculosis
ucggccagcaccac

SEQ ID NO: 804206 - RNA, 13 nt, Mycobacterium avium subsp. paratuberculosis
ucggccagcagca

SEQ ID NO: 804207 - RNA, 16 nt, Mycobacterium avium subsp. paratuberculosis
ucggccagcggcagcg

SEQ ID NO: 804208 - RNA, 15 nt, Mycobacterium avium subsp. paratuberculosis
ucggccagcgggcgg

SEQ ID NO: 804209 - RNA, 13 nt, Mycobacterium avium subsp. paratuberculosis
ucggccagcgguu

SEQ ID NO: 804210 - RNA, 20 nt, Mycobacterium avium subsp. paratuberculosis
ucggccagcgguugcacggu

SEQ ID NO: 804211 - RNA, 21 nt, Mycobacterium avium subsp. paratuberculosis
ucggccagcgguugcacgguc

SEQ ID NO: 804212 - RNA, 14 nt, Mycobacterium avium subsp. paratuberculosis
ucggccagcguguu

SEQ ID NO: 804213 - RNA, 20 nt, Mycobacterium avium subsp. paratuberculosis
ucggccaguucaccgcgcuc

SEQ ID NO: 804214 - RNA, 18 nt, Mycobacterium avium subsp. paratuberculosis
ucggccaggcucacguag

SEQ ID NO: 804215 - RNA, 20 nt, Mycobacterium avium subsp. paratuberculosis
ucggccagguacugaucacc

SEQ ID NO: 804216 - RNA, 21 nt, Mycobacterium avium subsp. paratuberculosis
ucggccaggaucucgcgggcc

SEQ ID NO: 804217 - RNA, 17 nt, Mycobacterium avium subsp. paratuberculosis
ucggccaggcgcccagc

SEQ ID NO: 804218 - RNA, 13 nt, Mycobacterium avium subsp. paratuberculosis
ucggccagggcgu

SEQ ID NO: 804219 - RNA, 19 nt, Mycobacterium avium subsp. paratuberculosis
ucggccacgacgcggcgcg

SEQ ID NO: 804220 - RNA, 20 nt, Mycobacterium avium subsp. paratuberculosis
ucggccacgacgcggcgcgc

SEQ ID NO: 804221 - RNA, 15 nt, Mycobacterium avium subsp. paratuberculosis
ucggccacgccgggc

SEQ ID NO: 804222 - RNA, 13 nt, Mycobacterium avium subsp. paratuberculosis
ucggccaccgcgc

SEQ ID NO: 804223 - RNA, 15 nt, Mycobacterium avium subsp. paratuberculosis
ucggccaccgcgcgg

SEQ ID NO: 804224 - RNA, 16 nt, Mycobacterium avium subsp. paratuberculosis
ucggccaccgcgcggc

SEQ ID NO: 804225 - RNA, 17 nt, Mycobacterium avium subsp. paratuberculosis
ucggccaccgcgcggcg

SEQ ID NO: 804226 - RNA, 16 nt, Mycobacterium avium subsp. paratuberculosis
ucggccaccgcgcggu

SEQ ID NO: 804227 - RNA, 20 nt, Mycobacterium avium subsp. paratuberculosis
ucggccaccgcggucgacgg

SEQ ID NO: 804228 - RNA, 22 nt, Mycobacterium avium subsp. paratuberculosis
ucggccaccgcggucgacggga

SEQ ID NO: 804229 - RNA, 14 nt, Mycobacterium avium subsp. paratuberculosis
ucggccaccgcguc

SEQ ID NO: 804230 - RNA, 14 nt, Mycobacterium avium subsp. paratuberculosis
ucggccaccaccuc

SEQ ID NO: 804231 - RNA, 20 nt, Mycobacterium avium subsp. paratuberculosis
ucggccaccaccucgcgggc

SEQ ID NO: 804232 - RNA, 23 nt, Mycobacterium avium subsp. paratuberculosis
ucggccaccaccucgcgggcgac

SEQ ID NO: 804233 - RNA, 15 nt, Mycobacterium avium subsp. paratuberculosis
ucggccaccagcgcc

SEQ ID NO: 804234 - RNA, 16 nt, Mycobacterium avium subsp. paratuberculosis
ucggccaccagcgccc

SEQ ID NO: 804235 - RNA, 20 nt, Mycobacterium avium subsp. paratuberculosis
ucggccaacggauagcgucc

SEQ ID NO: 804236 - RNA, 22 nt, Mycobacterium avium subsp. paratuberculosis
ucggccaccaugucggcgucgc

SEQ ID NO: 804237 - RNA, 21 nt, Mycobacterium avium subsp. paratuberculosis
ucggccaauuccucagcccgg

SEQ ID NO: 804238 - RNA, 22 nt, Mycobacterium avium subsp. paratuberculosis
ucggccaauuccucagcccggc

SEQ ID NO: 804239 - RNA, 15 nt, Mycobacterium avium subsp. paratuberculosis
ucggccaacagugcg

SEQ ID NO: 804240 - RNA, 23 nt, Mycobacterium avium subsp. paratuberculosis
ucggccaacagugcgcaggcggc

SEQ ID NO: 804241 - RNA, 21 nt, Mycobacterium avium subsp. paratuberculosis
ucgcauagcgguccauccagc

SEQ ID NO: 804242 - RNA, 13 nt, Mycobacterium avium subsp. paratuberculosis
ucgcaucagcucg

SEQ ID NO: 804243 - RNA, 19 nt, Mycobacterium avium subsp. paratuberculosis
ucgccaccaccagcgggcu

SEQ ID NO: 804244 - RNA, 16 nt, Mycobacterium avium subsp. paratuberculosis
ucgccaccaccgcgcc

SEQ ID NO: 804245 - RNA, 15 nt, Mycobacterium avium subsp. paratuberculosis
ucgccaccacggcgc

SEQ ID NO: 804246 - RNA, 16 nt, Mycobacterium avium subsp. paratuberculosis
ucgccaccacggcgcc

SEQ ID NO: 804247 - RNA, 19 nt, Mycobacterium avium subsp. paratuberculosis
ucgccaccagaccggcgaa

SEQ ID NO: 804248 - RNA, 18 nt, Mycobacterium avium subsp. paratuberculosis
ucgccaauaaagcgggcc

SEQ ID NO: 804249 - RNA, 18 nt, Mycobacterium avium subsp. paratuberculosis
ucgccaauccggcgggcc

SEQ ID NO: 804250 - RNA, 16 nt, Mycobacterium avium subsp. paratuberculosis
ucgccacccgcaccuc

SEQ ID NO: 804251 - RNA, 23 nt, Mycobacterium avium subsp. paratuberculosis
ucgccaccgagaucaugccggcg

SEQ ID NO: 804252 - RNA, 20 nt, Mycobacterium avium subsp. paratuberculosis
ucgccaccgaugcgggccag

SEQ ID NO: 804253 - RNA, 12 nt, Mycobacterium avium subsp. paratuberculosis
ucgccaccgucg

SEQ ID NO: 804254 - RNA, 17 nt, Mycobacterium avium subsp. paratuberculosis
ucgccaccgucgucgag

SEQ ID NO: 804255 - RNA, 13 nt, Mycobacterium avium subsp. paratuberculosis
ucgccacgaucac

SEQ ID NO: 804256 - RNA, 14 nt, Mycobacterium avium subsp. paratuberculosis
ucgccacgaucacc

SEQ ID NO: 804257 - RNA, 18 nt, Mycobacterium avium subsp. paratuberculosis
ucgccacgaucaccacca

SEQ ID NO: 804258 - RNA, 12 nt, Mycobacterium avium subsp. paratuberculosis
ucgccacgccgu

SEQ ID NO: 804259 - RNA, 13 nt, Mycobacterium avium subsp. paratuberculosis
ucgccacgccgug

SEQ ID NO: 804260 - RNA, 23 nt, Mycobacterium avium subsp. paratuberculosis
ucgccacgccguggcccgcccag

SEQ ID NO: 804261 - RNA, 15 nt, Mycobacterium avium subsp. paratuberculosis
ucgaucucggccagc

SEQ ID NO: 804262 - RNA, 19 nt, Mycobacterium avium subsp. paratuberculosis
ucgaucucggugagccgcu

SEQ ID NO: 804263 - RNA, 14 nt, Mycobacterium avium subsp. paratuberculosis
ucgaucgggcgucg

SEQ ID NO: 804264 - RNA, 15 nt, Mycobacterium avium subsp. paratuberculosis
ucgaucgggcgucgc

SEQ ID NO: 804265 - RNA, 22 nt, Mycobacterium avium subsp. paratuberculosis
ucgaucgucaggaaugcgacga

SEQ ID NO: 804266 - RNA, 13 nt, Mycobacterium avium subsp. paratuberculosis
ucgaucucgucgc

SEQ ID NO: 804267 - RNA, 15 nt, Mycobacterium avium subsp. paratuberculosis
ucgaucucgucgggu

SEQ ID NO: 804268 - RNA, 13 nt, Mycobacterium avium subsp. paratuberculosis
ucgaucugcagcc

SEQ ID NO: 804269 - RNA, 20 nt, Mycobacterium avium subsp. paratuberculosis
ucgaucugcagccggcgcgg

SEQ ID NO: 804270 - RNA, 13 nt, Mycobacterium avium subsp. paratuberculosis
ucgaucugcggca

SEQ ID NO: 804271 - RNA, 14 nt, Mycobacterium avium subsp. paratuberculosis
ucgaucuggcggac

SEQ ID NO: 804272 - RNA, 20 nt, Mycobacterium avium subsp. paratuberculosis
ucgaucugguucaccgccac

SEQ ID NO: 804273 - RNA, 21 nt, Mycobacterium avium subsp. paratuberculosis
ucgaucugguucaccgccacc

SEQ ID NO: 804274 - RNA, 14 nt, Mycobacterium avium subsp. paratuberculosis
ucgaucuugacgug

SEQ ID NO: 804275 - RNA, 13 nt, Mycobacterium avium subsp. paratuberculosis
ucgaugaaccgcu

SEQ ID NO: 804276 - RNA, 20 nt, Mycobacterium avium subsp. paratuberculosis
ucgaugaaguugaagacgcg

SEQ ID NO: 804277 - RNA, 21 nt, Mycobacterium avium subsp. paratuberculosis
ucgaugaauccgcgcagcagc

SEQ ID NO: 804278 - RNA, 15 nt, Mycobacterium avium subsp. paratuberculosis
ucgaucuugucgucc

SEQ ID NO: 804279 - RNA, 19 nt, Mycobacterium avium subsp. paratuberculosis
ucgaugaacucgcgggcga

SEQ ID NO: 804280 - RNA, 20 nt, Mycobacterium avium subsp. paratuberculosis
ucgaugacccaccagccgag

SEQ ID NO: 804281 - RNA, 14 nt, Mycobacterium avium subsp. paratuberculosis
ucgaugaccucgcg

SEQ ID NO: 804282 - RNA, 20 nt, Mycobacterium avium subsp. paratuberculosis
ucgaugaccucgcgcccggc

SEQ ID NO: 804283 - RNA, 21 nt, Mycobacterium avium subsp. paratuberculosis
ucgcagcagcagcccgaacag

SEQ ID NO: 804284 - RNA, 22 nt, Mycobacterium avium subsp. paratuberculosis
ucgcagcagcagcccgaacagc

SEQ ID NO: 804285 - RNA, 19 nt, Mycobacterium avium subsp. paratuberculosis
ucgcagcgacaaucggcuc

SEQ ID NO: 804286 - RNA, 11 nt, Mycobacterium avium subsp. paratuberculosis
ucgcagcgcgc

SEQ ID NO: 804287 - RNA, 16 nt, Mycobacterium avium subsp. paratuberculosis
ucgcagcgcgcggcgc

SEQ ID NO: 804288 - RNA, 21 nt, Mycobacterium avium subsp. paratuberculosis
ucgcaggcagcagcaccccga

SEQ ID NO: 804289 - RNA, 14 nt, Mycobacterium avium subsp. paratuberculosis
ucgcagcggcacgu

SEQ ID NO: 804290 - RNA, 14 nt, Mycobacterium avium subsp. paratuberculosis
ucgcagcggugaca

SEQ ID NO: 804291 - RNA, 19 nt, Mycobacterium avium subsp. paratuberculosis
ucgcagucgaucagcgacg

SEQ ID NO: 804292 - RNA, 18 nt, Mycobacterium avium subsp. paratuberculosis
ucgcagugcccgcccagc

SEQ ID NO: 804293 - RNA, 19 nt, Mycobacterium avium subsp. paratuberculosis
ucgcagugcccgcccagcu

SEQ ID NO: 804294 - RNA, 16 nt, Mycobacterium avium subsp. paratuberculosis
ucgcaggccgcccggc

SEQ ID NO: 804295 - RNA, 21 nt, Mycobacterium avium subsp. paratuberculosis
ucgccacugggcgucggcgcc

SEQ ID NO: 804296 - RNA, 22 nt, Mycobacterium avium subsp. paratuberculosis
ucgccagacucacggcggcagc

SEQ ID NO: 804297 - RNA, 21 nt, Mycobacterium avium subsp. paratuberculosis
ucgccagcaacgacccggcca

SEQ ID NO: 804298 - RNA, 13 nt, Mycobacterium avium subsp. paratuberculosis
ucgccacgccgac

SEQ ID NO: 804299 - RNA, 14 nt, Mycobacterium avium subsp. paratuberculosis
ucgccacgccgacc

SEQ ID NO: 804300 - RNA, 16 nt, Mycobacterium avium subsp. paratuberculosis
ucgccacgccgaccag

SEQ ID NO: 804301 - RNA, 14 nt, Mycobacterium avium subsp. paratuberculosis
ucgccacggccggc

SEQ ID NO: 804302 - RNA, 15 nt, Mycobacterium avium subsp. paratuberculosis
ucgccacggccggca

SEQ ID NO: 804303 - RNA, 16 nt, Mycobacterium avium subsp. paratuberculosis
ucgccacggccggcag

SEQ ID NO: 804304 - RNA, 21 nt, Mycobacterium avium subsp. paratuberculosis
ucgccacggcggugucggcgg

SEQ ID NO: 804305 - RNA, 12 nt, Mycobacterium avium subsp. paratuberculosis
ucgccagcgcgc

SEQ ID NO: 804306 - RNA, 14 nt, Mycobacterium avium subsp. paratuberculosis
ucgccagcgcgcag

SEQ ID NO: 804307 - RNA, 16 nt, Mycobacterium avium subsp. paratuberculosis
ucgccagcgcgguguc

SEQ ID NO: 804308 - RNA, 13 nt, Mycobacterium avium subsp. paratuberculosis
ucgccagccgucc

SEQ ID NO: 804309 - RNA, 13 nt, Mycobacterium avium subsp. paratuberculosis
ucgccagcgccac

SEQ ID NO: 804310 - RNA, 17 nt, Mycobacterium avium subsp. paratuberculosis
ucgccagcgccacgcuc

SEQ ID NO: 804311 - RNA, 12 nt, Mycobacterium avium subsp. paratuberculosis
ucgccagcacau

SEQ ID NO: 804312 - RNA, 22 nt, Mycobacterium avium subsp. paratuberculosis
ucgccagcaccaccucgcgcgg

SEQ ID NO: 804313 - RNA, 13 nt, Mycobacterium avium subsp. paratuberculosis
ucgccagcaccgg

SEQ ID NO: 804314 - RNA, 21 nt, Mycobacterium avium subsp. paratuberculosis
ucgccagcaccggcgcgccgc

SEQ ID NO: 804315 - RNA, 16 nt, Mycobacterium avium subsp. paratuberculosis
ucgccagcaccgugcu

SEQ ID NO: 804316 - RNA, 21 nt, Mycobacterium avium subsp. paratuberculosis
ucgccagccccaccggccacu

SEQ ID NO: 804317 - RNA, 14 nt, Mycobacterium avium subsp. paratuberculosis
ucgccagccgccgg

SEQ ID NO: 804318 - RNA, 21 nt, Mycobacterium avium subsp. paratuberculosis
ucgccagccgccggcucagcg

SEQ ID NO: 804319 - RNA, 20 nt, Mycobacterium avium subsp. paratuberculosis
ucgccaggccaccgcacguc

SEQ ID NO: 804320 - RNA, 15 nt, Mycobacterium avium subsp. paratuberculosis
ucgcccaccccggcg

SEQ ID NO: 804321 - RNA, 18 nt, Mycobacterium avium subsp. paratuberculosis
ucgcccacccgcacgccc

SEQ ID NO: 804322 - RNA, 21 nt, Mycobacterium avium subsp. paratuberculosis
ucgcccacccgcacgcccggg

SEQ ID NO: 804323 - RNA, 21 nt, Mycobacterium avium subsp. paratuberculosis
ucgcccacccgccagcccgcg

SEQ ID NO: 804324 - RNA, 13 nt, Mycobacterium avium subsp. paratuberculosis
ucgcccacccggg

SEQ ID NO: 804325 - RNA, 21 nt, Mycobacterium avium subsp. paratuberculosis
ucgcccacccggggccguccg

SEQ ID NO: 804326 - RNA, 16 nt, Mycobacterium avium subsp. paratuberculosis
ucgcccaccgacgcgg

SEQ ID NO: 804327 - RNA, 20 nt, Mycobacterium avium subsp. paratuberculosis
ucgcccaccacgacgacgug

SEQ ID NO: 804328 - RNA, 20 nt, Mycobacterium avium subsp. paratuberculosis
ucgcccaccugguucucccg

SEQ ID NO: 804329 - RNA, 18 nt, Mycobacterium avium subsp. paratuberculosis
ucgcccaccuuggcgucg

SEQ ID NO: 804330 - RNA, 16 nt, Mycobacterium avium subsp. paratuberculosis
ucgcccagcagcccgg

SEQ ID NO: 804331 - RNA, 17 nt, Mycobacterium avium subsp. paratuberculosis
ucgcccagcagcccggc

SEQ ID NO: 804332 - RNA, 21 nt, Mycobacterium avium subsp. paratuberculosis
ucgcccagcagcccggccagc

SEQ ID NO: 804333 - RNA, 13 nt, Mycobacterium avium subsp. paratuberculosis
ucgccccggccgc

SEQ ID NO: 804334 - RNA, 19 nt, Mycobacterium avium subsp. paratuberculosis
ucgccccgcuggaacgccg

SEQ ID NO: 804335 - RNA, 22 nt, Mycobacterium avium subsp. paratuberculosis
ucgccccgcuggaacgccgagg

SEQ ID NO: 804336 - RNA, 15 nt, Mycobacterium avium subsp. paratuberculosis
ucgccccggaugacc

SEQ ID NO: 804337 - RNA, 15 nt, Mycobacterium avium subsp. paratuberculosis
ucgccccgcaccgag

SEQ ID NO: 804338 - RNA, 17 nt, Mycobacterium avium subsp. paratuberculosis
ucgcccccucggccggu

SEQ ID NO: 804339 - RNA, 17 nt, Mycobacterium avium subsp. paratuberculosis
ucgcccagcaccgcgac

SEQ ID NO: 804340 - RNA, 17 nt, Mycobacterium avium subsp. paratuberculosis
ucgcccauuugccggug

SEQ ID NO: 804341 - RNA, 18 nt, Mycobacterium avium subsp. paratuberculosis
ucgcccuccccggccagc

SEQ ID NO: 804342 - RNA, 17 nt, Mycobacterium avium subsp. paratuberculosis
ucgcccucgaucgcgac

SEQ ID NO: 804343 - RNA, 15 nt, Mycobacterium avium subsp. paratuberculosis
ucgcccgcagcacgc

SEQ ID NO: 804344 - RNA, 14 nt, Mycobacterium avium subsp. paratuberculosis
ucgcccuggcaucc

SEQ ID NO: 804345 - RNA, 15 nt, Mycobacterium avium subsp. paratuberculosis
ucgcccuggcauccg

SEQ ID NO: 804346 - RNA, 21 nt, Mycobacterium avium subsp. paratuberculosis
ucgcccuggcauccgucggcc

SEQ ID NO: 804347 - RNA, 13 nt, Mycobacterium avium subsp. paratuberculosis
ucgcccucgcuga

SEQ ID NO: 804348 - RNA, 23 nt, Mycobacterium avium subsp. paratuberculosis
ucgcccugacacagcaccggcgu

SEQ ID NO: 804349 - RNA, 19 nt, Mycobacterium avium subsp. paratuberculosis
ucgcccugcagccgggugg

SEQ ID NO: 804350 - RNA, 22 nt, Mycobacterium avium subsp. paratuberculosis
ucgccgaccaguucggccaccg

SEQ ID NO: 804351 - RNA, 17 nt, Mycobacterium avium subsp. paratuberculosis
ucgcccugggggucggu

SEQ ID NO: 804352 - RNA, 13 nt, Mycobacterium avium subsp. paratuberculosis
ucgccgacgccgu

SEQ ID NO: 804353 - RNA, 14 nt, Mycobacterium avium subsp. paratuberculosis
ucgccgacgccguc

SEQ ID NO: 804354 - RNA, 21 nt, Mycobacterium avium subsp. paratuberculosis
ucgccgacgccgucgaugacg

SEQ ID NO: 804355 - RNA, 15 nt, Mycobacterium avium subsp. paratuberculosis
ucgccgacgcgcugc

SEQ ID NO: 804356 - RNA, 20 nt, Mycobacterium avium subsp. paratuberculosis
ucgccgacgcgcugcgcgcc

SEQ ID NO: 804357 - RNA, 15 nt, Mycobacterium avium subsp. paratuberculosis
ucgccgacgggccca

SEQ ID NO: 804358 - RNA, 23 nt, Mycobacterium avium subsp. paratuberculosis
ucgccgacgggcccagcgcgacg

SEQ ID NO: 804359 - RNA, 14 nt, Mycobacterium avium subsp. paratuberculosis
ucgccgacggugag

SEQ ID NO: 804360 - RNA, 16 nt, Mycobacterium avium subsp. paratuberculosis
ucgccgacggugagca

SEQ ID NO: 804361 - RNA, 22 nt, Mycobacterium avium subsp. paratuberculosis
ucgccgacggugagcaccgccg

SEQ ID NO: 804362 - RNA, 23 nt, Mycobacterium avium subsp. paratuberculosis
ucgccgacggugagcaccgccgu

SEQ ID NO: 804363 - RNA, 15 nt, Mycobacterium avium subsp. paratuberculosis
ucgccgacgguggcg

SEQ ID NO: 804364 - RNA, 13 nt, Mycobacterium avium subsp. paratuberculosis
ucgccgacgucgg

SEQ ID NO: 804365 - RNA, 23 nt, Mycobacterium avium subsp. paratuberculosis
ucgccgacgucugguuggccggc

SEQ ID NO: 804366 - RNA, 23 nt, Mycobacterium avium subsp. paratuberculosis
ucgccgacguuguugucgaugau

SEQ ID NO: 804367 - RNA, 22 nt, Mycobacterium avium subsp. paratuberculosis
ucgccgacucgcaggugccggu

SEQ ID NO: 804368 - RNA, 23 nt, Mycobacterium avium subsp. paratuberculosis
ucgccgacucgcaggugccggug

SEQ ID NO: 804369 - RNA, 15 nt, Mycobacterium avium subsp. paratuberculosis
ucgccuguccgacca

SEQ ID NO: 804370 - RNA, 18 nt, Mycobacterium avium subsp. paratuberculosis
ucgccuguccgaccagcg

SEQ ID NO: 804371 - RNA, 19 nt, Mycobacterium avium subsp. paratuberculosis
ucgccugcuucuggaugcg

SEQ ID NO: 804372 - RNA, 23 nt, Mycobacterium avium subsp. paratuberculosis
ucgccugcuucuggaugcggucg

SEQ ID NO: 804373 - RNA, 20 nt, Mycobacterium avium subsp. paratuberculosis
ucgccugauacgacguccgg

SEQ ID NO: 804374 - RNA, 21 nt, Mycobacterium avium subsp. paratuberculosis
ucgccugauacgacguccggg

SEQ ID NO: 804375 - RNA, 16 nt, Mycobacterium avium subsp. paratuberculosis
ucgccugcagccgccg

SEQ ID NO: 804376 - RNA, 16 nt, Mycobacterium avium subsp. paratuberculosis
ucgccucggucgcgug

SEQ ID NO: 804377 - RNA, 13 nt, Mycobacterium avium subsp. paratuberculosis
ucgccucgucccu

SEQ ID NO: 804378 - RNA, 14 nt, Mycobacterium avium subsp. paratuberculosis
ucgccguugcgggu

SEQ ID NO: 804379 - RNA, 14 nt, Mycobacterium avium subsp. paratuberculosis
ucgccucguucgag

SEQ ID NO: 804380 - RNA, 21 nt, Mycobacterium avium subsp. paratuberculosis
ucgcgaaguagacgagcucac

SEQ ID NO: 804381 - RNA, 14 nt, Mycobacterium avium subsp. paratuberculosis
ucgcgaccaccggc

SEQ ID NO: 804382 - RNA, 16 nt, Mycobacterium avium subsp. paratuberculosis
ucgcgaccaccggccg

SEQ ID NO: 804383 - RNA, 17 nt, Mycobacterium avium subsp. paratuberculosis
ucgcgaccaccggccga

SEQ ID NO: 804384 - RNA, 18 nt, Mycobacterium avium subsp. paratuberculosis
ucgcgacccgguccaccu

SEQ ID NO: 804385 - RNA, 18 nt, Mycobacterium avium subsp. paratuberculosis
ucgcgauagggccggccg

SEQ ID NO: 804386 - RNA, 24 nt, Mycobacterium avium subsp. paratuberculosis
ucgcgaucacaccaccacgcgauc

SEQ ID NO: 804387 - RNA, 13 nt, Mycobacterium avium subsp. paratuberculosis
ucgcgaucaccgc

SEQ ID NO: 804388 - RNA, 15 nt, Mycobacterium avium subsp. paratuberculosis
ucgcgaacuucaggc

SEQ ID NO: 804389 - RNA, 19 nt, Mycobacterium avium subsp. paratuberculosis
ucgcgaacuucaggcccuc

SEQ ID NO: 804390 - RNA, 22 nt, Mycobacterium avium subsp. paratuberculosis
ucgcgaagaacgacgccaccgc

SEQ ID NO: 804391 - RNA, 17 nt, Mycobacterium avium subsp. paratuberculosis
ucgccuuugaugacgac

SEQ ID NO: 804392 - RNA, 20 nt, Mycobacterium avium subsp. paratuberculosis
ucgccuuugaugacgacgug

SEQ ID NO: 804393 - RNA, 18 nt, Mycobacterium avium subsp. paratuberculosis
ucgccuuggcucgggcca

SEQ ID NO: 804394 - RNA, 13 nt, Mycobacterium avium subsp. paratuberculosis
ucgcgauggcggg

SEQ ID NO: 804395 - RNA, 18 nt, Mycobacterium avium subsp. paratuberculosis
ucgcgcaacaacuucgcg

SEQ ID NO: 804396 - RNA, 14 nt, Mycobacterium avium subsp. paratuberculosis
ucgcgaucgaggau

SEQ ID NO: 804397 - RNA, 20 nt, Mycobacterium avium subsp. paratuberculosis
ucgcgaucgccgauccggcg

SEQ ID NO: 804398 - RNA, 23 nt, Mycobacterium avium subsp. paratuberculosis
ucgcgaucgccgauccggcgccg

SEQ ID NO: 804399 - RNA, 14 nt, Mycobacterium avium subsp. paratuberculosis
ucgcgaucgcgguc

SEQ ID NO: 804400 - RNA, 15 nt, Mycobacterium avium subsp. paratuberculosis
ucgcgauccgggcgc

SEQ ID NO: 804401 - RNA, 16 nt, Mycobacterium avium subsp. paratuberculosis
ucgcgauccgggcgcc

SEQ ID NO: 804402 - RNA, 20 nt, Mycobacterium avium subsp. paratuberculosis
ucgcgcagcauccgcaccag

SEQ ID NO: 804403 - RNA, 18 nt, Mycobacterium avium subsp. paratuberculosis
ucgcgcacuucgcgggcg

SEQ ID NO: 804404 - RNA, 21 nt, Mycobacterium avium subsp. paratuberculosis
ucgcgcagcacgaugaucccg

SEQ ID NO: 804405 - RNA, 16 nt, Mycobacterium avium subsp. paratuberculosis
ucgcgcagcaacggua

SEQ ID NO: 804406 - RNA, 18 nt, Mycobacterium avium subsp. paratuberculosis
ucgcgcagcaacgguacg

SEQ ID NO: 804407 - RNA, 15 nt, Mycobacterium avium subsp. paratuberculosis
ucgcgcagcaccgau

SEQ ID NO: 804408 - RNA, 19 nt, Mycobacterium avium subsp. paratuberculosis
ucgcgcagaaagcgauugg

SEQ ID NO: 804409 - RNA, 19 nt, Mycobacterium avium subsp. paratuberculosis
ucgcgcaaugccgccgcga

SEQ ID NO: 804410 - RNA, 12 nt, Mycobacterium avium subsp. paratuberculosis
ucgcgcacgucg

SEQ ID NO: 804411 - RNA, 22 nt, Mycobacterium avium subsp. paratuberculosis
ucgcgcaauaacggagcggccu

SEQ ID NO: 804412 - RNA, 14 nt, Mycobacterium avium subsp. paratuberculosis
ucgcgcccggccag

SEQ ID NO: 804413 - RNA, 13 nt, Mycobacterium avium subsp. paratuberculosis
ucgcgcccggcgc

SEQ ID NO: 804414 - RNA, 15 nt, Mycobacterium avium subsp. paratuberculosis
ucgcgcccggcgccg

SEQ ID NO: 804415 - RNA, 15 nt, Mycobacterium avium subsp. paratuberculosis
ucgcgcccggcgucg

SEQ ID NO: 804416 - RNA, 21 nt, Mycobacterium avium subsp. paratuberculosis
ucgcgcccaggaacgcgccgg

SEQ ID NO: 804417 - RNA, 22 nt, Mycobacterium avium subsp. paratuberculosis
ucgcgcccaggaacgcgccggc

SEQ ID NO: 804418 - RNA, 22 nt, Mycobacterium avium subsp. paratuberculosis
ucgcgcagcagcugcacccgcu

SEQ ID NO: 804419 - RNA, 15 nt, Mycobacterium avium subsp. paratuberculosis
ucgcgcagccaccgc

SEQ ID NO: 804420 - RNA, 19 nt, Mycobacterium avium subsp. paratuberculosis
ucgcgcagcccccggacca

SEQ ID NO: 804421 - RNA, 14 nt, Mycobacterium avium subsp. paratuberculosis
ucgcgcagcccgau

SEQ ID NO: 804422 - RNA, 14 nt, Mycobacterium avium subsp. paratuberculosis
ucgcgcagccgccg

SEQ ID NO: 804423 - RNA, 17 nt, Mycobacterium avium subsp. paratuberculosis
ucgcgcagccgccgggc

SEQ ID NO: 804424 - RNA, 13 nt, Mycobacterium avium subsp. paratuberculosis
ucgcgcagccgcg

SEQ ID NO: 804425 - RNA, 22 nt, Mycobacterium avium subsp. paratuberculosis
ucgcgcagccgcgguggcggug

SEQ ID NO: 804426 - RNA, 17 nt, Mycobacterium avium subsp. paratuberculosis
ucgcgcagccggccgac

SEQ ID NO: 804427 - RNA, 16 nt, Mycobacterium avium subsp. paratuberculosis
ucgcgcagccgggcgg

SEQ ID NO: 804428 - RNA, 17 nt, Mycobacterium avium subsp. paratuberculosis
ucgcgcagccgggcggc

SEQ ID NO: 804429 - RNA, 20 nt, Mycobacterium avium subsp. paratuberculosis
ucgcgcagccgggcggcgcu

SEQ ID NO: 804430 - RNA, 22 nt, Mycobacterium avium subsp. paratuberculosis
ucgcgcagcgaagcgaggcgcc

SEQ ID NO: 804431 - RNA, 13 nt, Mycobacterium avium subsp. paratuberculosis
ucgccgucguuga

SEQ ID NO: 804432 - RNA, 20 nt, Mycobacterium avium subsp. paratuberculosis
ucgccgucguugaucaggug

SEQ ID NO: 804433 - RNA, 22 nt, Mycobacterium avium subsp. paratuberculosis
ucgccgucguugaucaggugca

SEQ ID NO: 804434 - RNA, 14 nt, Mycobacterium avium subsp. paratuberculosis
ucgccgugcagcac

SEQ ID NO: 804435 - RNA, 17 nt, Mycobacterium avium subsp. paratuberculosis
ucgccgugcagcaccuc

SEQ ID NO: 804436 - RNA, 18 nt, Mycobacterium avium subsp. paratuberculosis
ucgccguugccggcccgc

SEQ ID NO: 804437 - RNA, 21 nt, Mycobacterium avium subsp. paratuberculosis
ucgccguuuugccgccgagcg

SEQ ID NO: 804438 - RNA, 18 nt, Mycobacterium avium subsp. paratuberculosis
ucgccuccugcuggcgcu

SEQ ID NO: 804439 - RNA, 12 nt, Mycobacterium avium subsp. paratuberculosis
ucgccucgacca

SEQ ID NO: 804440 - RNA, 18 nt, Mycobacterium avium subsp. paratuberculosis
ucgccucggaggccaccg

SEQ ID NO: 804441 - RNA, 16 nt, Mycobacterium avium subsp. paratuberculosis
ucgccucggccaccag

SEQ ID NO: 804442 - RNA, 15 nt, Mycobacterium avium subsp. paratuberculosis
ucgccucggccgcgg

SEQ ID NO: 804443 - RNA, 18 nt, Mycobacterium avium subsp. paratuberculosis
ucgccucggcggccgccc

SEQ ID NO: 804444 - RNA, 20 nt, Mycobacterium avium subsp. paratuberculosis
ucgccucggcggccgcccgg

SEQ ID NO: 804445 - RNA, 21 nt, Mycobacterium avium subsp. paratuberculosis
ucgccuccgagauggacagca

SEQ ID NO: 804446 - RNA, 15 nt, Mycobacterium avium subsp. paratuberculosis
ucgccgugccggacc

SEQ ID NO: 804447 - RNA, 16 nt, Mycobacterium avium subsp. paratuberculosis
ucgccgugccggaccg

SEQ ID NO: 804448 - RNA, 18 nt, Mycobacterium avium subsp. paratuberculosis
ucgccgugccggaccgcg

SEQ ID NO: 804449 - RNA, 14 nt, Mycobacterium avium subsp. paratuberculosis
ucgccgugcggcgu

SEQ ID NO: 804450 - RNA, 19 nt, Mycobacterium avium subsp. paratuberculosis
ucgccgugcggcguucggu

SEQ ID NO: 804451 - RNA, 19 nt, Mycobacterium avium subsp. paratuberculosis
ucgccguggaauucgaagu

SEQ ID NO: 804452 - RNA, 19 nt, Mycobacterium avium subsp. paratuberculosis
ucgccguggcggcccgacc

SEQ ID NO: 804453 - RNA, 20 nt, Mycobacterium avium subsp. paratuberculosis
ucgccguggcggcccgacca

SEQ ID NO: 804454 - RNA, 14 nt, Mycobacterium avium subsp. paratuberculosis
ucgccgucgacggu

SEQ ID NO: 804455 - RNA, 15 nt, Mycobacterium avium subsp. paratuberculosis
ucgccgucgccaccg

SEQ ID NO: 804456 - RNA, 16 nt, Mycobacterium avium subsp. paratuberculosis
ucgccgucgccaccga

SEQ ID NO: 804457 - RNA, 17 nt, Mycobacterium avium subsp. paratuberculosis
ucgccgucgccaccgag

SEQ ID NO: 804458 - RNA, 12 nt, Mycobacterium avium subsp. paratuberculosis
ucgccgucgcga

SEQ ID NO: 804459 - RNA, 16 nt, Mycobacterium avium subsp. paratuberculosis
ucgccgucgcgaucgc

SEQ ID NO: 804460 - RNA, 17 nt, Mycobacterium avium subsp. paratuberculosis
ucgccgucgcgaucgcg

SEQ ID NO: 804461 - RNA, 15 nt, Mycobacterium avium subsp. paratuberculosis
ucgccgucggccagc

SEQ ID NO: 804462 - RNA, 21 nt, Mycobacterium avium subsp. paratuberculosis
ucgccgucggggucgcgccgg

SEQ ID NO: 804463 - RNA, 22 nt, Mycobacterium avium subsp. paratuberculosis
ucgccgucggggucgcgccggu

SEQ ID NO: 804464 - RNA, 16 nt, Mycobacterium avium subsp. paratuberculosis
ucgccgucggugauga

SEQ ID NO: 804465 - RNA, 19 nt, Mycobacterium avium subsp. paratuberculosis
ucgccgucguauucgacgg

SEQ ID NO: 804466 - RNA, 20 nt, Mycobacterium avium subsp. paratuberculosis
ucgccgucguauucgacggc

SEQ ID NO: 804467 - RNA, 23 nt, Mycobacterium avium subsp. paratuberculosis
ucgccgucguauucgacggcgac

SEQ ID NO: 804468 - RNA, 13 nt, Mycobacterium avium subsp. paratuberculosis
ucgccguccccac

SEQ ID NO: 804469 - RNA, 17 nt, Mycobacterium avium subsp. paratuberculosis
ucgccgucauggugucc

SEQ ID NO: 804470 - RNA, 16 nt, Mycobacterium avium subsp. paratuberculosis
ucgccguccacggguc

SEQ ID NO: 804471 - RNA, 21 nt, Mycobacterium avium subsp. paratuberculosis
ucgccguccggggccggugcg

SEQ ID NO: 804472 - RNA, 22 nt, Mycobacterium avium subsp. paratuberculosis
ucgccguccucgcgucgcgcgg

SEQ ID NO: 804473 - RNA, 21 nt, Mycobacterium avium subsp. paratuberculosis
ucgccggcguagaccagcgac

SEQ ID NO: 804474 - RNA, 23 nt, Mycobacterium avium subsp. paratuberculosis
ucgccggcguagaccagcgacgc

SEQ ID NO: 804475 - RNA, 16 nt, Mycobacterium avium subsp. paratuberculosis
ucgccgucagugcgca

SEQ ID NO: 804476 - RNA, 13 nt, Mycobacterium avium subsp. paratuberculosis
ucgccggcgcgcu

SEQ ID NO: 804477 - RNA, 23 nt, Mycobacterium avium subsp. paratuberculosis
ucgccggcgcggaacagcgucgc

SEQ ID NO: 804478 - RNA, 18 nt, Mycobacterium avium subsp. paratuberculosis
ucgccggcgcgggccgca

SEQ ID NO: 804479 - RNA, 20 nt, Mycobacterium avium subsp. paratuberculosis
ucgccggcgcgggccgcagc

SEQ ID NO: 804480 - RNA, 16 nt, Mycobacterium avium subsp. paratuberculosis
ucgccggcggccgaca

SEQ ID NO: 804481 - RNA, 14 nt, Mycobacterium avium subsp. paratuberculosis
ucgccggcggccgc

SEQ ID NO: 804482 - RNA, 17 nt, Mycobacterium avium subsp. paratuberculosis
ucgccggcggccgccac

SEQ ID NO: 804483 - RNA, 12 nt, Mycobacterium avium subsp. paratuberculosis
ucgccggcggcg

SEQ ID NO: 804484 - RNA, 14 nt, Mycobacterium avium subsp. paratuberculosis
ucgccggcggcgcc

SEQ ID NO: 804485 - RNA, 22 nt, Mycobacterium avium subsp. paratuberculosis
ucgccggcggcgcccgcggccu

SEQ ID NO: 804486 - RNA, 21 nt, Mycobacterium avium subsp. paratuberculosis
ucgccgcuggugaacucgccg

SEQ ID NO: 804487 - RNA, 14 nt, Mycobacterium avium subsp. paratuberculosis
ucgccggacagccg

SEQ ID NO: 804488 - RNA, 15 nt, Mycobacterium avium subsp. paratuberculosis
ucgccggacagccgg

SEQ ID NO: 804489 - RNA, 18 nt, Mycobacterium avium subsp. paratuberculosis
ucgccggacagccggggc

SEQ ID NO: 804490 - RNA, 16 nt, Mycobacterium avium subsp. paratuberculosis
ucgccggacagcgggc

SEQ ID NO: 804491 - RNA, 22 nt, Mycobacterium avium subsp. paratuberculosis
ucgccggacagcgggccgaccc

SEQ ID NO: 804492 - RNA, 19 nt, Mycobacterium avium subsp. paratuberculosis
ucgccgcucguaacgccac

SEQ ID NO: 804493 - RNA, 21 nt, Mycobacterium avium subsp. paratuberculosis
ucgccgcucguaacgccacgg

SEQ ID NO: 804494 - RNA, 13 nt, Mycobacterium avium subsp. paratuberculosis
ucgccgcgggcca

SEQ ID NO: 804495 - RNA, 22 nt, Mycobacterium avium subsp. paratuberculosis
ucgccggacucgaucgccaccg

SEQ ID NO: 804496 - RNA, 19 nt, Mycobacterium avium subsp. paratuberculosis
ucgccggccuccagcuguu

SEQ ID NO: 804497 - RNA, 19 nt, Mycobacterium avium subsp. paratuberculosis
ucgccggccugcccgccgc

SEQ ID NO: 804498 - RNA, 21 nt, Mycobacterium avium subsp. paratuberculosis
ucgccggccugcccgccgcgg

SEQ ID NO: 804499 - RNA, 13 nt, Mycobacterium avium subsp. paratuberculosis
ucgccggcgaccg

SEQ ID NO: 804500 - RNA, 17 nt, Mycobacterium avium subsp. paratuberculosis
ucgccggcgaccgccac

SEQ ID NO: 804501 - RNA, 16 nt, Mycobacterium avium subsp. paratuberculosis
ucgccggcgaccgccu

SEQ ID NO: 804502 - RNA, 22 nt, Mycobacterium avium subsp. paratuberculosis
ucgccggcgaccgugcccacca

SEQ ID NO: 804503 - RNA, 14 nt, Mycobacterium avium subsp. paratuberculosis
ucgccggcgacggc

SEQ ID NO: 804504 - RNA, 19 nt, Mycobacterium avium subsp. paratuberculosis
ucgccggcgcgcaccccgg

SEQ ID NO: 804505 - RNA, 13 nt, Mycobacterium avium subsp. paratuberculosis
ucgccggcgccgg

SEQ ID NO: 804506 - RNA, 14 nt, Mycobacterium avium subsp. paratuberculosis
ucgccggcgccggg

SEQ ID NO: 804507 - RNA, 20 nt, Mycobacterium avium subsp. paratuberculosis
ucgccggcgccgggcgggcg

SEQ ID NO: 804508 - RNA, 13 nt, Mycobacterium avium subsp. paratuberculosis
ucgccggcgaugc

SEQ ID NO: 804509 - RNA, 20 nt, Mycobacterium avium subsp. paratuberculosis
ucgccgccgcaauacaccgc

SEQ ID NO: 804510 - RNA, 22 nt, Mycobacterium avium subsp. paratuberculosis
ucgccgccgcaauacaccgcga

SEQ ID NO: 804511 - RNA, 12 nt, Mycobacterium avium subsp. paratuberculosis
ucgccgccgcac

SEQ ID NO: 804512 - RNA, 17 nt, Mycobacterium avium subsp. paratuberculosis
ucgccgccgcaccggcc

SEQ ID NO: 804513 - RNA, 18 nt, Mycobacterium avium subsp. paratuberculosis
ucgccgccgcaccggccg

SEQ ID NO: 804514 - RNA, 17 nt, Mycobacterium avium subsp. paratuberculosis
ucgccgccgccagcacc

SEQ ID NO: 804515 - RNA, 18 nt, Mycobacterium avium subsp. paratuberculosis
ucgccgccgccagcacca

SEQ ID NO: 804516 - RNA, 19 nt, Mycobacterium avium subsp. paratuberculosis
ucgccgccgccagcaccac

SEQ ID NO: 804517 - RNA, 13 nt, Mycobacterium avium subsp. paratuberculosis
ucgccgccgccau

SEQ ID NO: 804518 - RNA, 13 nt, Mycobacterium avium subsp. paratuberculosis
ucgccgcggucau

SEQ ID NO: 804519 - RNA, 22 nt, Mycobacterium avium subsp. paratuberculosis
ucgccgcggugcgcgaguaggc

SEQ ID NO: 804520 - RNA, 15 nt, Mycobacterium avium subsp. paratuberculosis
ucgccgcgguggcgc

SEQ ID NO: 804521 - RNA, 19 nt, Mycobacterium avium subsp. paratuberculosis
ucgccgcgguggcgccgcg

SEQ ID NO: 804522 - RNA, 20 nt, Mycobacterium avium subsp. paratuberculosis
ucgccgcguacgccgccuug

SEQ ID NO: 804523 - RNA, 12 nt, Mycobacterium avium subsp. paratuberculosis
ucgccgccgcgc

SEQ ID NO: 804524 - RNA, 13 nt, Mycobacterium avium subsp. paratuberculosis
ucgccgccgcgca

SEQ ID NO: 804525 - RNA, 16 nt, Mycobacterium avium subsp. paratuberculosis
ucgccgccgcgcaccg

SEQ ID NO: 804526 - RNA, 19 nt, Mycobacterium avium subsp. paratuberculosis
ucgccgcccgggccgcgcc

SEQ ID NO: 804527 - RNA, 17 nt, Mycobacterium avium subsp. paratuberculosis
ucgccgcccaucggcag

SEQ ID NO: 804528 - RNA, 13 nt, Mycobacterium avium subsp. paratuberculosis
ucgccgccccgag

SEQ ID NO: 804529 - RNA, 17 nt, Mycobacterium avium subsp. paratuberculosis
ucgccgcccacgccgug

SEQ ID NO: 804530 - RNA, 20 nt, Mycobacterium avium subsp. paratuberculosis
ucgccgcccacgccgugcag

SEQ ID NO: 804531 - RNA, 12 nt, Mycobacterium avium subsp. paratuberculosis
ucgccgacgccg

SEQ ID NO: 804532 - RNA, 13 nt, Mycobacterium avium subsp. paratuberculosis
ucgccgacgccga

SEQ ID NO: 804533 - RNA, 17 nt, Mycobacterium avium subsp. paratuberculosis
ucgccgagacgaucccg

SEQ ID NO: 804534 - RNA, 23 nt, Mycobacterium avium subsp. paratuberculosis
ucgccgagacgaucccguagccg

SEQ ID NO: 804535 - RNA, 16 nt, Mycobacterium avium subsp. paratuberculosis
ucagaagucgcccgcg

SEQ ID NO: 804536 - RNA, 16 nt, Mycobacterium avium subsp. paratuberculosis
ucacugucggcgcgga

SEQ ID NO: 804537 - RNA, 14 nt, Mycobacterium avium subsp. paratuberculosis
ucacugcccagcca

SEQ ID NO: 804538 - RNA, 20 nt, Mycobacterium avium subsp. paratuberculosis
ucacugcgguagaggcgggc

SEQ ID NO: 804539 - RNA, 21 nt, Mycobacterium avium subsp. paratuberculosis
ucagacgaugggccgcccgcu

SEQ ID NO: 804540 - RNA, 18 nt, Mycobacterium avium subsp. paratuberculosis
ucagaccauggcgcggcg

SEQ ID NO: 804541 - RNA, 18 nt, Mycobacterium avium subsp. paratuberculosis
ucagacccugugggucga

SEQ ID NO: 804542 - RNA, 18 nt, Mycobacterium avium subsp. paratuberculosis
ucagaccgcggcggucgc

SEQ ID NO: 804543 - RNA, 17 nt, Mycobacterium avium subsp. paratuberculosis
ucagagcccgaacacgg

SEQ ID NO: 804544 - RNA, 20 nt, Mycobacterium avium subsp. paratuberculosis
ucagagcccgaacacgggcg

SEQ ID NO: 804545 - RNA, 15 nt, Mycobacterium avium subsp. paratuberculosis
ucagcaccacaucgg

SEQ ID NO: 804546 - RNA, 15 nt, Mycobacterium avium subsp. paratuberculosis
ucagcaccaccaaca

SEQ ID NO: 804547 - RNA, 16 nt, Mycobacterium avium subsp. paratuberculosis
ucagcaccaccaacag

SEQ ID NO: 804548 - RNA, 21 nt, Mycobacterium avium subsp. paratuberculosis
ucagcaccagguggcccgacc

SEQ ID NO: 804549 - RNA, 22 nt, Mycobacterium avium subsp. paratuberculosis
ucagcaccagguugucgccgcg

SEQ ID NO: 804550 - RNA, 23 nt, Mycobacterium avium subsp. paratuberculosis
ucagcaccagguugucgccgcgc

SEQ ID NO: 804551 - RNA, 20 nt, Mycobacterium avium subsp. paratuberculosis
ucagcaccacguugcgcccg

SEQ ID NO: 804552 - RNA, 22 nt, Mycobacterium avium subsp. paratuberculosis
ucagcaccacguugcgcccggc

SEQ ID NO: 804553 - RNA, 23 nt, Mycobacterium avium subsp. paratuberculosis
ucagcaccacguugcgcccggcc

SEQ ID NO: 804554 - RNA, 12 nt, Mycobacterium avium subsp. paratuberculosis
ucacgguggccg

SEQ ID NO: 804555 - RNA, 15 nt, Mycobacterium avium subsp. paratuberculosis
ucacggugucggcgg

SEQ ID NO: 804556 - RNA, 20 nt, Mycobacterium avium subsp. paratuberculosis
ucacgguguuguucaccggc

SEQ ID NO: 804557 - RNA, 21 nt, Mycobacterium avium subsp. paratuberculosis
ucacgguguuguucaccggcg

SEQ ID NO: 804558 - RNA, 23 nt, Mycobacterium avium subsp. paratuberculosis
ucacggucggcguccagcgcggu

SEQ ID NO: 804559 - RNA, 15 nt, Mycobacterium avium subsp. paratuberculosis
ucacggugaucgccg

SEQ ID NO: 804560 - RNA, 20 nt, Mycobacterium avium subsp. paratuberculosis
ucacguagucgaccgggauc

SEQ ID NO: 804561 - RNA, 23 nt, Mycobacterium avium subsp. paratuberculosis
ucacguagcgcggccgcccgucg

SEQ ID NO: 804562 - RNA, 19 nt, Mycobacterium avium subsp. paratuberculosis
ucacguccacgccgcggga

SEQ ID NO: 804563 - RNA, 15 nt, Mycobacterium avium subsp. paratuberculosis
ucacugcacgcacgg

SEQ ID NO: 804564 - RNA, 16 nt, Mycobacterium avium subsp. paratuberculosis
ucacucuggcgugacg

SEQ ID NO: 804565 - RNA, 16 nt, Mycobacterium avium subsp. paratuberculosis
ucacuccagcggcggc

SEQ ID NO: 804566 - RNA, 22 nt, Mycobacterium avium subsp. paratuberculosis
ucacucgaccuucgagccgccg

SEQ ID NO: 804567 - RNA, 14 nt, Mycobacterium avium subsp. paratuberculosis
ucacgucccgcucg

SEQ ID NO: 804568 - RNA, 20 nt, Mycobacterium avium subsp. paratuberculosis
ucacgucgagcggcccgucg

SEQ ID NO: 804569 - RNA, 21 nt, Mycobacterium avium subsp. paratuberculosis
ucacgucgaucacgccgccgg

SEQ ID NO: 804570 - RNA, 16 nt, Mycobacterium avium subsp. paratuberculosis
ucacgucgacggccgc

SEQ ID NO: 804571 - RNA, 16 nt, Mycobacterium avium subsp. paratuberculosis
ucacgccccaggcgcc

SEQ ID NO: 804572 - RNA, 22 nt, Mycobacterium avium subsp. paratuberculosis
ucacgauauggaucagacccag

SEQ ID NO: 804573 - RNA, 19 nt, Mycobacterium avium subsp. paratuberculosis
ucacgaggccgggcuggcg

SEQ ID NO: 804574 - RNA, 22 nt, Mycobacterium avium subsp. paratuberculosis
ucacgaggccgggcuggcgcug

SEQ ID NO: 804575 - RNA, 17 nt, Mycobacterium avium subsp. paratuberculosis
ucacgccgcgcccgucg

SEQ ID NO: 804576 - RNA, 22 nt, Mycobacterium avium subsp. paratuberculosis
ucacgccgggguagaggccgcg

SEQ ID NO: 804577 - RNA, 23 nt, Mycobacterium avium subsp. paratuberculosis
ucagcggcagcgucgccagccgc

SEQ ID NO: 804578 - RNA, 13 nt, Mycobacterium avium subsp. paratuberculosis
ucagcggcccgau

SEQ ID NO: 804579 - RNA, 18 nt, Mycobacterium avium subsp. paratuberculosis
ucagcggcgccaccggga

SEQ ID NO: 804580 - RNA, 23 nt, Mycobacterium avium subsp. paratuberculosis
ucagcggcaggucccaggccagg

SEQ ID NO: 804581 - RNA, 15 nt, Mycobacterium avium subsp. paratuberculosis
ucagcggcaggugcg

SEQ ID NO: 804582 - RNA, 16 nt, Mycobacterium avium subsp. paratuberculosis
ucagcggcaggugcgc

SEQ ID NO: 804583 - RNA, 13 nt, Mycobacterium avium subsp. paratuberculosis
ucagcggcaucga

SEQ ID NO: 804584 - RNA, 22 nt, Mycobacterium avium subsp. paratuberculosis
ucagcggcaucgaggaccggcg

SEQ ID NO: 804585 - RNA, 18 nt, Mycobacterium avium subsp. paratuberculosis
ucagcggccaucgccgcc

SEQ ID NO: 804586 - RNA, 14 nt, Mycobacterium avium subsp. paratuberculosis
ucagcgcggcccgc

SEQ ID NO: 804587 - RNA, 15 nt, Mycobacterium avium subsp. paratuberculosis
ucagcgcggcccgcg

SEQ ID NO: 804588 - RNA, 16 nt, Mycobacterium avium subsp. paratuberculosis
ucagccggagccggcc

SEQ ID NO: 804589 - RNA, 17 nt, Mycobacterium avium subsp. paratuberculosis
ucagccggcgagcgcgc

SEQ ID NO: 804590 - RNA, 20 nt, Mycobacterium avium subsp. paratuberculosis
ucagccggcgggcgcucgau

SEQ ID NO: 804591 - RNA, 15 nt, Mycobacterium avium subsp. paratuberculosis
ucagccggcucggua

SEQ ID NO: 804592 - RNA, 22 nt, Mycobacterium avium subsp. paratuberculosis
ucagccggcucgguaugcggcg

SEQ ID NO: 804593 - RNA, 15 nt, Mycobacterium avium subsp. paratuberculosis
ucagccgggccagcc

SEQ ID NO: 804594 - RNA, 23 nt, Mycobacterium avium subsp. paratuberculosis
ucagcgaggcguagcugcaggcg

SEQ ID NO: 804595 - RNA, 15 nt, Mycobacterium avium subsp. paratuberculosis
ucagccgcggcggca

SEQ ID NO: 804596 - RNA, 16 nt, Mycobacterium avium subsp. paratuberculosis
ucagcgcaccgccguc

SEQ ID NO: 804597 - RNA, 17 nt, Mycobacterium avium subsp. paratuberculosis
ucagcgauugcggccgc

SEQ ID NO: 804598 - RNA, 19 nt, Mycobacterium avium subsp. paratuberculosis
ucagcgauugcggccgccg

SEQ ID NO: 804599 - RNA, 22 nt, Mycobacterium avium subsp. paratuberculosis
ucagcgauugcggccgccggcc

SEQ ID NO: 804600 - RNA, 14 nt, Mycobacterium avium subsp. paratuberculosis
ucagcgagugguac

SEQ ID NO: 804601 - RNA, 23 nt, Mycobacterium avium subsp. paratuberculosis
ucagcgcauccucauagccggcc

SEQ ID NO: 804602 - RNA, 19 nt, Mycobacterium avium subsp. paratuberculosis
ucagcgccaccagcaccgg

SEQ ID NO: 804603 - RNA, 21 nt, Mycobacterium avium subsp. paratuberculosis
ucagcgccagcaacacccagc

SEQ ID NO: 804604 - RNA, 13 nt, Mycobacterium avium subsp. paratuberculosis
ucagcgcccagga

SEQ ID NO: 804605 - RNA, 21 nt, Mycobacterium avium subsp. paratuberculosis
ucagcgcccaggaugacgccg

SEQ ID NO: 804606 - RNA, 14 nt, Mycobacterium avium subsp. paratuberculosis
ucagcgccgcccgc

SEQ ID NO: 804607 - RNA, 16 nt, Mycobacterium avium subsp. paratuberculosis
ucagcgcccgcccggc

SEQ ID NO: 804608 - RNA, 18 nt, Mycobacterium avium subsp. paratuberculosis
ucagcgcccgcccggccc

SEQ ID NO: 804609 - RNA, 13 nt, Mycobacterium avium subsp. paratuberculosis
ucagcgcccgcgc

SEQ ID NO: 804610 - RNA, 17 nt, Mycobacterium avium subsp. paratuberculosis
ucagcaguuuggucaug

SEQ ID NO: 804611 - RNA, 17 nt, Mycobacterium avium subsp. paratuberculosis
ucagcagugccccgucc

SEQ ID NO: 804612 - RNA, 19 nt, Mycobacterium avium subsp. paratuberculosis
ucagcaggcuggcggcgau

SEQ ID NO: 804613 - RNA, 21 nt, Mycobacterium avium subsp. paratuberculosis
ucagcaggcuggcggcgauca

SEQ ID NO: 804614 - RNA, 15 nt, Mycobacterium avium subsp. paratuberculosis
ucagcagggccucgc

SEQ ID NO: 804615 - RNA, 16 nt, Mycobacterium avium subsp. paratuberculosis
ucagcagggcggcacc

SEQ ID NO: 804616 - RNA, 18 nt, Mycobacterium avium subsp. paratuberculosis
ucagcagggcggcaccga

SEQ ID NO: 804617 - RNA, 22 nt, Mycobacterium avium subsp. paratuberculosis
ucagcagggcggcaccgaucgg

SEQ ID NO: 804618 - RNA, 12 nt, Mycobacterium avium subsp. paratuberculosis
ucagcagcgcgg

SEQ ID NO: 804619 - RNA, 18 nt, Mycobacterium avium subsp. paratuberculosis
ucagcaggcccucggcca

SEQ ID NO: 804620 - RNA, 15 nt, Mycobacterium avium subsp. paratuberculosis
ucagcaggcgccgca

SEQ ID NO: 804621 - RNA, 23 nt, Mycobacterium avium subsp. paratuberculosis
ucagcccggcgcucaccgcgaug

SEQ ID NO: 804622 - RNA, 17 nt, Mycobacterium avium subsp. paratuberculosis
ucagcccggcgcugcgc

SEQ ID NO: 804623 - RNA, 22 nt, Mycobacterium avium subsp. paratuberculosis
ucagcccggcgcugcgcccggu

SEQ ID NO: 804624 - RNA, 20 nt, Mycobacterium avium subsp. paratuberculosis
ucagccgagacauagacguu

SEQ ID NO: 804625 - RNA, 16 nt, Mycobacterium avium subsp. paratuberculosis
ucagccgcccgaucau

SEQ ID NO: 804626 - RNA, 16 nt, Mycobacterium avium subsp. paratuberculosis
ucagccgaagccggcg

SEQ ID NO: 804627 - RNA, 16 nt, Mycobacterium avium subsp. paratuberculosis
ucagccgccgucgcgc

SEQ ID NO: 804628 - RNA, 21 nt, Mycobacterium avium subsp. paratuberculosis
ucagccgccgucgcgccagga

SEQ ID NO: 804629 - RNA, 13 nt, Mycobacterium avium subsp. paratuberculosis
ucagccgccuggc

SEQ ID NO: 804630 - RNA, 16 nt, Mycobacterium avium subsp. paratuberculosis
ucagccgcgacagccg

SEQ ID NO: 804631 - RNA, 14 nt, Mycobacterium avium subsp. paratuberculosis
ucagcaccgacgcg

SEQ ID NO: 804632 - RNA, 15 nt, Mycobacterium avium subsp. paratuberculosis
ucagcaccgacgcgg

SEQ ID NO: 804633 - RNA, 16 nt, Mycobacterium avium subsp. paratuberculosis
ucagcaccgccucggc

SEQ ID NO: 804634 - RNA, 17 nt, Mycobacterium avium subsp. paratuberculosis
ucagcaccgccucggcc

SEQ ID NO: 804635 - RNA, 20 nt, Mycobacterium avium subsp. paratuberculosis
ucagcaccgccucggccacc

SEQ ID NO: 804636 - RNA, 14 nt, Mycobacterium avium subsp. paratuberculosis
ucagcaccgcgaac

SEQ ID NO: 804637 - RNA, 19 nt, Mycobacterium avium subsp. paratuberculosis
ucagcaccgcgaacaucgc

SEQ ID NO: 804638 - RNA, 23 nt, Mycobacterium avium subsp. paratuberculosis
ucagcaccgcgaacaucgccagc

SEQ ID NO: 804639 - RNA, 15 nt, Mycobacterium avium subsp. paratuberculosis
ucagcaccgucaccg

SEQ ID NO: 804640 - RNA, 15 nt, Mycobacterium avium subsp. paratuberculosis
ucagcaccgcgacgg

SEQ ID NO: 804641 - RNA, 13 nt, Mycobacterium avium subsp. paratuberculosis
ucagcaccgcgcg

SEQ ID NO: 804642 - RNA, 23 nt, Mycobacterium avium subsp. paratuberculosis
ucagcacgucggucagcgagcgg

SEQ ID NO: 804643 - RNA, 17 nt, Mycobacterium avium subsp. paratuberculosis
ucagcacgcggaucgcg

SEQ ID NO: 804644 - RNA, 18 nt, Mycobacterium avium subsp. paratuberculosis
ucagcacgcggaucgcgc

SEQ ID NO: 804645 - RNA, 17 nt, Mycobacterium avium subsp. paratuberculosis
ucagcagcacccgggcc

SEQ ID NO: 804646 - RNA, 15 nt, Mycobacterium avium subsp. paratuberculosis
ucagcagcacccggu

SEQ ID NO: 804647 - RNA, 14 nt, Mycobacterium avium subsp. paratuberculosis
ucagcagcaccggc

SEQ ID NO: 804648 - RNA, 20 nt, Mycobacterium avium subsp. paratuberculosis
ucacgaacuccuugacccgg

SEQ ID NO: 804649 - RNA, 22 nt, Mycobacterium avium subsp. paratuberculosis
ucacgaagaaguauucgccguc

SEQ ID NO: 804650 - RNA, 17 nt, Mycobacterium avium subsp. paratuberculosis
ucacgaagugcccggcg

SEQ ID NO: 804651 - RNA, 20 nt, Mycobacterium avium subsp. paratuberculosis
ucacgaaguugaucgcggcg

SEQ ID NO: 804652 - RNA, 21 nt, Mycobacterium avium subsp. paratuberculosis
ucacgaaguugaucgcggcgg

SEQ ID NO: 804653 - RNA, 19 nt, Mycobacterium avium subsp. paratuberculosis
ucacgaccggcagcaccgg

SEQ ID NO: 804654 - RNA, 20 nt, Mycobacterium avium subsp. paratuberculosis
ucacgaccggcagcaccggc

SEQ ID NO: 804655 - RNA, 14 nt, Mycobacterium avium subsp. paratuberculosis
ucacgacgcgaccg

SEQ ID NO: 804656 - RNA, 19 nt, Mycobacterium avium subsp. paratuberculosis
ucacgacggucacggccgc

SEQ ID NO: 804657 - RNA, 21 nt, Mycobacterium avium subsp. paratuberculosis
ucacgacggucacggccgcca

SEQ ID NO: 804658 - RNA, 18 nt, Mycobacterium avium subsp. paratuberculosis
ucaccuccuuggccaggc

SEQ ID NO: 804659 - RNA, 22 nt, Mycobacterium avium subsp. paratuberculosis
ucaccuccuuggccaggcgggc

SEQ ID NO: 804660 - RNA, 21 nt, Mycobacterium avium subsp. paratuberculosis
ucaccucgagcacucgcggga

SEQ ID NO: 804661 - RNA, 14 nt, Mycobacterium avium subsp. paratuberculosis
ucaccucgccggcc

SEQ ID NO: 804662 - RNA, 15 nt, Mycobacterium avium subsp. paratuberculosis
ucaccucgccggccg

SEQ ID NO: 804663 - RNA, 21 nt, Mycobacterium avium subsp. paratuberculosis
ucaccuugucgcugaccaccg

SEQ ID NO: 804664 - RNA, 13 nt, Mycobacterium avium subsp. paratuberculosis
ucaccguggcggg

SEQ ID NO: 804665 - RNA, 19 nt, Mycobacterium avium subsp. paratuberculosis
ucaccguggugugcccgcg

SEQ ID NO: 804666 - RNA, 17 nt, Mycobacterium avium subsp. paratuberculosis
ucaccgugucggcgggc

SEQ ID NO: 804667 - RNA, 21 nt, Mycobacterium avium subsp. paratuberculosis
ucaccucaucgcccagccggc

SEQ ID NO: 804668 - RNA, 19 nt, Mycobacterium avium subsp. paratuberculosis
ucaccgucagggugacgug

SEQ ID NO: 804669 - RNA, 15 nt, Mycobacterium avium subsp. paratuberculosis
ucaccgucgcgguca

SEQ ID NO: 804670 - RNA, 21 nt, Mycobacterium avium subsp. paratuberculosis
ucaccgucguacucgaccgcg

SEQ ID NO: 804671 - RNA, 17 nt, Mycobacterium avium subsp. paratuberculosis
ucaccgugggcggcgcg

SEQ ID NO: 804672 - RNA, 18 nt, Mycobacterium avium subsp. paratuberculosis
ucaccgugggcggcgcga

SEQ ID NO: 804673 - RNA, 21 nt, Mycobacterium avium subsp. paratuberculosis
ucaccgugggcggcgcgaucg

SEQ ID NO: 804674 - RNA, 18 nt, Mycobacterium avium subsp. paratuberculosis
ucaccgguccggucacgc

SEQ ID NO: 804675 - RNA, 13 nt, Mycobacterium avium subsp. paratuberculosis
ucaccggucgcgu

SEQ ID NO: 804676 - RNA, 21 nt, Mycobacterium avium subsp. paratuberculosis
ucaccgggugaugucgccgac

SEQ ID NO: 804677 - RNA, 15 nt, Mycobacterium avium subsp. paratuberculosis
ucaccgguggccgcg

SEQ ID NO: 804678 - RNA, 16 nt, Mycobacterium avium subsp. paratuberculosis
ucaccgguggccgcgu

SEQ ID NO: 804679 - RNA, 17 nt, Mycobacterium avium subsp. paratuberculosis
ucaccgguggccgcguc

SEQ ID NO: 804680 - RNA, 18 nt, Mycobacterium avium subsp. paratuberculosis
ucaccgguggccgcgucg

SEQ ID NO: 804681 - RNA, 18 nt, Mycobacterium avium subsp. paratuberculosis
ucaccggugucacgcugg

SEQ ID NO: 804682 - RNA, 20 nt, Mycobacterium avium subsp. paratuberculosis
ucaccggugucacgcuggcg

SEQ ID NO: 804683 - RNA, 17 nt, Mycobacterium avium subsp. paratuberculosis
ucaccgcgcucggcgac

SEQ ID NO: 804684 - RNA, 21 nt, Mycobacterium avium subsp. paratuberculosis
ucaccggcagcagcgcgucgu

SEQ ID NO: 804685 - RNA, 14 nt, Mycobacterium avium subsp. paratuberculosis
ucaccggcaggcgg

SEQ ID NO: 804686 - RNA, 14 nt, Mycobacterium avium subsp. paratuberculosis
ucaccggccagggc

SEQ ID NO: 804687 - RNA, 16 nt, Mycobacterium avium subsp. paratuberculosis
ucaccggccagggccg

SEQ ID NO: 804688 - RNA, 20 nt, Mycobacterium avium subsp. paratuberculosis
ucaccggccagggccgccgc

SEQ ID NO: 804689 - RNA, 23 nt, Mycobacterium avium subsp. paratuberculosis
ucaccggccagggccgccgcaua

SEQ ID NO: 804690 - RNA, 14 nt, Mycobacterium avium subsp. paratuberculosis
ucaccggccgagcc

SEQ ID NO: 804691 - RNA, 15 nt, Mycobacterium avium subsp. paratuberculosis
ucaccggccgagccg

SEQ ID NO: 804692 - RNA, 13 nt, Mycobacterium avium subsp. paratuberculosis
ucaccggcguggu

SEQ ID NO: 804693 - RNA, 13 nt, Mycobacterium avium subsp. paratuberculosis
ucaccggcucgcg

SEQ ID NO: 804694 - RNA, 20 nt, Mycobacterium avium subsp. paratuberculosis
ucaccggcuuggcggugaug

SEQ ID NO: 804695 - RNA, 17 nt, Mycobacterium avium subsp. paratuberculosis
ucaccgggacaccgcug

SEQ ID NO: 804696 - RNA, 17 nt, Mycobacterium avium subsp. paratuberculosis
ucaccgggacgggggug

SEQ ID NO: 804697 - RNA, 13 nt, Mycobacterium avium subsp. paratuberculosis
ucaccgggcggcc

SEQ ID NO: 804698 - RNA, 21 nt, Mycobacterium avium subsp. paratuberculosis
ucaccgggcggccguggucga

SEQ ID NO: 804699 - RNA, 15 nt, Mycobacterium avium subsp. paratuberculosis
ucaccggggaucacc

SEQ ID NO: 804700 - RNA, 17 nt, Mycobacterium avium subsp. paratuberculosis
ucaccggggaucaccuc

SEQ ID NO: 804701 - RNA, 14 nt, Mycobacterium avium subsp. paratuberculosis
ucaccccgcccagc

SEQ ID NO: 804702 - RNA, 17 nt, Mycobacterium avium subsp. paratuberculosis
ucaccccgcuugcgcag

SEQ ID NO: 804703 - RNA, 15 nt, Mycobacterium avium subsp. paratuberculosis
ucaccccggccauca

SEQ ID NO: 804704 - RNA, 11 nt, Mycobacterium avium subsp. paratuberculosis
ucaccccggcg

SEQ ID NO: 804705 - RNA, 13 nt, Mycobacterium avium subsp. paratuberculosis
ucaccccggcgac

SEQ ID NO: 804706 - RNA, 13 nt, Mycobacterium avium subsp. paratuberculosis
ucaccccggcgcg

SEQ ID NO: 804707 - RNA, 21 nt, Mycobacterium avium subsp. paratuberculosis
ucaccccggcgcggaacgcgc

SEQ ID NO: 804708 - RNA, 22 nt, Mycobacterium avium subsp. paratuberculosis
ucaccccggcgcggaacgcgcc

SEQ ID NO: 804709 - RNA, 16 nt, Mycobacterium avium subsp. paratuberculosis
ucacccacuggcggcc

SEQ ID NO: 804710 - RNA, 19 nt, Mycobacterium avium subsp. paratuberculosis
ucacccacuggcggccggc

SEQ ID NO: 804711 - RNA, 22 nt, Mycobacterium avium subsp. paratuberculosis
ucacccacuggcggccggccgc

SEQ ID NO: 804712 - RNA, 17 nt, Mycobacterium avium subsp. paratuberculosis
ucacccagaucgcccgg

SEQ ID NO: 804713 - RNA, 19 nt, Mycobacterium avium subsp. paratuberculosis
ucacccagcgagcucaggc

SEQ ID NO: 804714 - RNA, 23 nt, Mycobacterium avium subsp. paratuberculosis
ucacccagcgagcucaggccggc

SEQ ID NO: 804715 - RNA, 14 nt, Mycobacterium avium subsp. paratuberculosis
ucaccccagcgcga

SEQ ID NO: 804716 - RNA, 13 nt, Mycobacterium avium subsp. paratuberculosis
ucacccccaccca

SEQ ID NO: 804717 - RNA, 15 nt, Mycobacterium avium subsp. paratuberculosis
ucacccccgacaccg

SEQ ID NO: 804718 - RNA, 14 nt, Mycobacterium avium subsp. paratuberculosis
ucacccccggcgcg

SEQ ID NO: 804719 - RNA, 19 nt, Mycobacterium avium subsp. paratuberculosis
ucaccccgaguucggccag

SEQ ID NO: 804720 - RNA, 20 nt, Mycobacterium avium subsp. paratuberculosis
ucaccccgaguucggccaga

SEQ ID NO: 804721 - RNA, 14 nt, Mycobacterium avium subsp. paratuberculosis
ucaccgccgagccg

SEQ ID NO: 804722 - RNA, 22 nt, Mycobacterium avium subsp. paratuberculosis
ucaccgccgagggcccgggcag

SEQ ID NO: 804723 - RNA, 15 nt, Mycobacterium avium subsp. paratuberculosis
ucacccuggaacuug

SEQ ID NO: 804724 - RNA, 22 nt, Mycobacterium avium subsp. paratuberculosis
ucaccgccuuccgccacgccca

SEQ ID NO: 804725 - RNA, 18 nt, Mycobacterium avium subsp. paratuberculosis
ucaccgcgaccaugcccg

SEQ ID NO: 804726 - RNA, 13 nt, Mycobacterium avium subsp. paratuberculosis
ucaccgcgaugau

SEQ ID NO: 804727 - RNA, 11 nt, Mycobacterium avium subsp. paratuberculosis
ucaccgcgccg

SEQ ID NO: 804728 - RNA, 13 nt, Mycobacterium avium subsp. paratuberculosis
ucaccgcgccggu

SEQ ID NO: 804729 - RNA, 19 nt, Mycobacterium avium subsp. paratuberculosis
ucaccgccaggaccaccca

SEQ ID NO: 804730 - RNA, 12 nt, Mycobacterium avium subsp. paratuberculosis
ucaccgcccacg

SEQ ID NO: 804731 - RNA, 18 nt, Mycobacterium avium subsp. paratuberculosis
ucaccgccccgacgaucg

SEQ ID NO: 804732 - RNA, 23 nt, Mycobacterium avium subsp. paratuberculosis
ucaccgccccgacgaucgcgccg

SEQ ID NO: 804733 - RNA, 16 nt, Mycobacterium avium subsp. paratuberculosis
ucacccggcccaccgg

SEQ ID NO: 804734 - RNA, 20 nt, Mycobacterium avium subsp. paratuberculosis
ucacccggcccaccggcccg

SEQ ID NO: 804735 - RNA, 16 nt, Mycobacterium avium subsp. paratuberculosis
ucacccggcccccgag

SEQ ID NO: 804736 - RNA, 12 nt, Mycobacterium avium subsp. paratuberculosis
ucacccggcgcg

SEQ ID NO: 804737 - RNA, 15 nt, Mycobacterium avium subsp. paratuberculosis
ucacccggcggcacc

SEQ ID NO: 804738 - RNA, 16 nt, Mycobacterium avium subsp. paratuberculosis
ucacccggcuggccgc

SEQ ID NO: 804739 - RNA, 21 nt, Mycobacterium avium subsp. paratuberculosis
ucacccgugggccgaccggcc

SEQ ID NO: 804740 - RNA, 22 nt, Mycobacterium avium subsp. paratuberculosis
ucacccgugggccgaccggccg

SEQ ID NO: 804741 - RNA, 23 nt, Mycobacterium avium subsp. paratuberculosis
ucacccgugggccgaccggccgg

SEQ ID NO: 804742 - RNA, 18 nt, Mycobacterium avium subsp. paratuberculosis
ucacccuccucgcggcgg

SEQ ID NO: 804743 - RNA, 20 nt, Mycobacterium avium subsp. paratuberculosis
ucacccucgaggccgacgug

SEQ ID NO: 804744 - RNA, 15 nt, Mycobacterium avium subsp. paratuberculosis
ucacccucggcgucc

SEQ ID NO: 804745 - RNA, 18 nt, Mycobacterium avium subsp. paratuberculosis
ucacccgggucgagcggc

SEQ ID NO: 804746 - RNA, 12 nt, Mycobacterium avium subsp. paratuberculosis
ucacccgccggg

SEQ ID NO: 804747 - RNA, 23 nt, Mycobacterium avium subsp. paratuberculosis
ucaccaaauagccgucggcggcc

SEQ ID NO: 804748 - RNA, 23 nt, Mycobacterium avium subsp. paratuberculosis
ucacaugggcgcguuggccggcu

SEQ ID NO: 804749 - RNA, 14 nt, Mycobacterium avium subsp. paratuberculosis
ucacacccucggcc

SEQ ID NO: 804750 - RNA, 19 nt, Mycobacterium avium subsp. paratuberculosis
ucacacgcgcgccccgguc

SEQ ID NO: 804751 - RNA, 13 nt, Mycobacterium avium subsp. paratuberculosis
ucacagcgacaac

SEQ ID NO: 804752 - RNA, 19 nt, Mycobacterium avium subsp. paratuberculosis
ucacagcgacaacgggccg

SEQ ID NO: 804753 - RNA, 17 nt, Mycobacterium avium subsp. paratuberculosis
ucacagcgcggcgguga

SEQ ID NO: 804754 - RNA, 17 nt, Mycobacterium avium subsp. paratuberculosis
ucacaccgcugagguag

SEQ ID NO: 804755 - RNA, 17 nt, Mycobacterium avium subsp. paratuberculosis
ucacaccgucggcgauc

SEQ ID NO: 804756 - RNA, 18 nt, Mycobacterium avium subsp. paratuberculosis
ucacaccgucggcgaucg

SEQ ID NO: 804757 - RNA, 20 nt, Mycobacterium avium subsp. paratuberculosis
ucaacgugaccaccgugcug

SEQ ID NO: 804758 - RNA, 20 nt, Mycobacterium avium subsp. paratuberculosis
ucaacgccgggucgacgccg

SEQ ID NO: 804759 - RNA, 22 nt, Mycobacterium avium subsp. paratuberculosis
ucaacggccaaccgcccggcgc

SEQ ID NO: 804760 - RNA, 14 nt, Mycobacterium avium subsp. paratuberculosis
ucaacggccggcgc

SEQ ID NO: 804761 - RNA, 18 nt, Mycobacterium avium subsp. paratuberculosis
ucaacggccggcgccgcc

SEQ ID NO: 804762 - RNA, 12 nt, Mycobacterium avium subsp. paratuberculosis
ucaccagcucgc

SEQ ID NO: 804763 - RNA, 16 nt, Mycobacterium avium subsp. paratuberculosis
ucaccagcucgccgau

SEQ ID NO: 804764 - RNA, 16 nt, Mycobacterium avium subsp. paratuberculosis
ucaccagcggcugcag

SEQ ID NO: 804765 - RNA, 15 nt, Mycobacterium avium subsp. paratuberculosis
ucaccaggcccaggc

SEQ ID NO: 804766 - RNA, 16 nt, Mycobacterium avium subsp. paratuberculosis
ucaccaggcccaggcc

SEQ ID NO: 804767 - RNA, 17 nt, Mycobacterium avium subsp. paratuberculosis
ucaccagcgccucggcc

SEQ ID NO: 804768 - RNA, 13 nt, Mycobacterium avium subsp. paratuberculosis
ucaccagcgcggu

SEQ ID NO: 804769 - RNA, 14 nt, Mycobacterium avium subsp. paratuberculosis
ucaccagcgcgguc

SEQ ID NO: 804770 - RNA, 12 nt, Mycobacterium avium subsp. paratuberculosis
ucaccagcgcgu

SEQ ID NO: 804771 - RNA, 18 nt, Mycobacterium avium subsp. paratuberculosis
ucaccagcagacccgacg

SEQ ID NO: 804772 - RNA, 21 nt, Mycobacterium avium subsp. paratuberculosis
ucaccaguuucacgucggcga

SEQ ID NO: 804773 - RNA, 11 nt, Mycobacterium avium subsp. paratuberculosis
ucaccaucagc

SEQ ID NO: 804774 - RNA, 19 nt, Mycobacterium avium subsp. paratuberculosis
ucaccaucagcggcucgcg

SEQ ID NO: 804775 - RNA, 20 nt, Mycobacterium avium subsp. paratuberculosis
ucacccaaaaaggcgcgggu

SEQ ID NO: 804776 - RNA, 22 nt, Mycobacterium avium subsp. paratuberculosis
ucaccacgcuguagggccacca

SEQ ID NO: 804777 - RNA, 16 nt, Mycobacterium avium subsp. paratuberculosis
ucaccacgugccacug

SEQ ID NO: 804778 - RNA, 13 nt, Mycobacterium avium subsp. paratuberculosis
ucaccaccgccgc

SEQ ID NO: 804779 - RNA, 15 nt, Mycobacterium avium subsp. paratuberculosis
ucaccaccgccgccg

SEQ ID NO: 804780 - RNA, 16 nt, Mycobacterium avium subsp. paratuberculosis
ucaccaccgccgccga

SEQ ID NO: 804781 - RNA, 16 nt, Mycobacterium avium subsp. paratuberculosis
ucaccaccgccggggu

SEQ ID NO: 804782 - RNA, 13 nt, Mycobacterium avium subsp. paratuberculosis
ucaccaccgcgcu

SEQ ID NO: 804783 - RNA, 20 nt, Mycobacterium avium subsp. paratuberculosis
ucaccaccggagcggcggua

SEQ ID NO: 804784 - RNA, 15 nt, Mycobacterium avium subsp. paratuberculosis
ucaccaccaccgccg

SEQ ID NO: 804785 - RNA, 15 nt, Mycobacterium avium subsp. paratuberculosis
ucaccaccgagccgg

SEQ ID NO: 804786 - RNA, 13 nt, Mycobacterium avium subsp. paratuberculosis
ucaccaagcgcga

SEQ ID NO: 804787 - RNA, 19 nt, Mycobacterium avium subsp. paratuberculosis
ucaccaaugcgccggcggc

SEQ ID NO: 804788 - RNA, 22 nt, Mycobacterium avium subsp. paratuberculosis
ucaccaaugcgccggcggccgc

SEQ ID NO: 804789 - RNA, 21 nt, Mycobacterium avium subsp. paratuberculosis
uccaacaggugcuuggucagc

SEQ ID NO: 804790 - RNA, 18 nt, Mycobacterium avium subsp. paratuberculosis
uccaacgggcucagcacc

SEQ ID NO: 804791 - RNA, 20 nt, Mycobacterium avium subsp. paratuberculosis
uccaacgggcucagcaccac

SEQ ID NO: 804792 - RNA, 23 nt, Mycobacterium avium subsp. paratuberculosis
ucauggccuccccauccgcggcc

SEQ ID NO: 804793 - RNA, 15 nt, Mycobacterium avium subsp. paratuberculosis
ucauggccagcucgu

SEQ ID NO: 804794 - RNA, 16 nt, Mycobacterium avium subsp. paratuberculosis
ucauggcgcugcgcga

SEQ ID NO: 804795 - RNA, 17 nt, Mycobacterium avium subsp. paratuberculosis
ucauggcgaacgccuug

SEQ ID NO: 804796 - RNA, 16 nt, Mycobacterium avium subsp. paratuberculosis
ucauggcgaccgcgac

SEQ ID NO: 804797 - RNA, 23 nt, Mycobacterium avium subsp. paratuberculosis
ucaugccagacgcgcaccgccac

SEQ ID NO: 804798 - RNA, 21 nt, Mycobacterium avium subsp. paratuberculosis
ucaugcccaccaucccgccgc

SEQ ID NO: 804799 - RNA, 15 nt, Mycobacterium avium subsp. paratuberculosis
ucaugcacggcgcug

SEQ ID NO: 804800 - RNA, 16 nt, Mycobacterium avium subsp. paratuberculosis
ucaugcccgccacggc

SEQ ID NO: 804801 - RNA, 22 nt, Mycobacterium avium subsp. paratuberculosis
ucaugcguuugccgucgagggg

SEQ ID NO: 804802 - RNA, 22 nt, Mycobacterium avium subsp. paratuberculosis
ucaugccggcgaacucgcggcg

SEQ ID NO: 804803 - RNA, 16 nt, Mycobacterium avium subsp. paratuberculosis
ucaugccgucgacgac

SEQ ID NO: 804804 - RNA, 20 nt, Mycobacterium avium subsp. paratuberculosis
ucaugccguugaugaagacc

SEQ ID NO: 804805 - RNA, 21 nt, Mycobacterium avium subsp. paratuberculosis
uccaccaccacacccgcggcc

SEQ ID NO: 804806 - RNA, 13 nt, Mycobacterium avium subsp. paratuberculosis
uccaccaccgcgg

SEQ ID NO: 804807 - RNA, 17 nt, Mycobacterium avium subsp. paratuberculosis
uccaccaauucgcgcug

SEQ ID NO: 804808 - RNA, 14 nt, Mycobacterium avium subsp. paratuberculosis
uccaccagcggccg

SEQ ID NO: 804809 - RNA, 16 nt, Mycobacterium avium subsp. paratuberculosis
uccaccagcggccguc

SEQ ID NO: 804810 - RNA, 22 nt, Mycobacterium avium subsp. paratuberculosis
uccaccagcggccgucgccggg

SEQ ID NO: 804811 - RNA, 13 nt, Mycobacterium avium subsp. paratuberculosis
uccaccagcggcg

SEQ ID NO: 804812 - RNA, 18 nt, Mycobacterium avium subsp. paratuberculosis
uccaccagcggcgcgucg

SEQ ID NO: 804813 - RNA, 22 nt, Mycobacterium avium subsp. paratuberculosis
uccaccaucggggugaccguca

SEQ ID NO: 804814 - RNA, 19 nt, Mycobacterium avium subsp. paratuberculosis
uccaccagguucgcgcagc

SEQ ID NO: 804815 - RNA, 17 nt, Mycobacterium avium subsp. paratuberculosis
uccaccaguguccgggc

SEQ ID NO: 804816 - RNA, 20 nt, Mycobacterium avium subsp. paratuberculosis
uccaccaggguggccgccac

SEQ ID NO: 804817 - RNA, 13 nt, Mycobacterium avium subsp. paratuberculosis
uccacccgcgccc

SEQ ID NO: 804818 - RNA, 22 nt, Mycobacterium avium subsp. paratuberculosis
uccacccggcccaccaccgccu

SEQ ID NO: 804819 - RNA, 21 nt, Mycobacterium avium subsp. paratuberculosis
uccacccguuccucgacguag

SEQ ID NO: 804820 - RNA, 14 nt, Mycobacterium avium subsp. paratuberculosis
uccacccugccgac

SEQ ID NO: 804821 - RNA, 22 nt, Mycobacterium avium subsp. paratuberculosis
uccaccgagugcggcgcggugc

SEQ ID NO: 804822 - RNA, 15 nt, Mycobacterium avium subsp. paratuberculosis
uccaccugcggcacc

SEQ ID NO: 804823 - RNA, 19 nt, Mycobacterium avium subsp. paratuberculosis
uccaccguugucucggcgc

SEQ ID NO: 804824 - RNA, 22 nt, Mycobacterium avium subsp. paratuberculosis
uccaccgggccgccaucaccgc

SEQ ID NO: 804825 - RNA, 20 nt, Mycobacterium avium subsp. paratuberculosis
uccacgacuucacaggccgc

SEQ ID NO: 804826 - RNA, 15 nt, Mycobacterium avium subsp. paratuberculosis
uccaccuggcugugc

SEQ ID NO: 804827 - RNA, 20 nt, Mycobacterium avium subsp. paratuberculosis
uccacgacguccucgacgau

SEQ ID NO: 804828 - RNA, 17 nt, Mycobacterium avium subsp. paratuberculosis
uccacgaccccggcggc

SEQ ID NO: 804829 - RNA, 16 nt, Mycobacterium avium subsp. paratuberculosis
uccacgaccuggcggg

SEQ ID NO: 804830 - RNA, 21 nt, Mycobacterium avium subsp. paratuberculosis
uccaccgcccggaugccggcg

SEQ ID NO: 804831 - RNA, 17 nt, Mycobacterium avium subsp. paratuberculosis
uccaccgccgcgccgag

SEQ ID NO: 804832 - RNA, 12 nt, Mycobacterium avium subsp. paratuberculosis
uccaccgcgccg

SEQ ID NO: 804833 - RNA, 17 nt, Mycobacterium avium subsp. paratuberculosis
uccaccgcgccggcggc

SEQ ID NO: 804834 - RNA, 15 nt, Mycobacterium avium subsp. paratuberculosis
uccaccgcgccgucg

SEQ ID NO: 804835 - RNA, 18 nt, Mycobacterium avium subsp. paratuberculosis
uccaccgcgcggcgcagu

SEQ ID NO: 804836 - RNA, 15 nt, Mycobacterium avium subsp. paratuberculosis
uccaccgcggcggcc

SEQ ID NO: 804837 - RNA, 19 nt, Mycobacterium avium subsp. paratuberculosis
uccaccggcaaucgggacg

SEQ ID NO: 804838 - RNA, 20 nt, Mycobacterium avium subsp. paratuberculosis
uccaccggcaaucgggacgc

SEQ ID NO: 804839 - RNA, 17 nt, Mycobacterium avium subsp. paratuberculosis
uccaccggccgauggcc

SEQ ID NO: 804840 - RNA, 23 nt, Mycobacterium avium subsp. paratuberculosis
uccaccggccgauggcccaggcc

SEQ ID NO: 804841 - RNA, 22 nt, Mycobacterium avium subsp. paratuberculosis
uccaggcguucgaccccaaccc

SEQ ID NO: 804842 - RNA, 15 nt, Mycobacterium avium subsp. paratuberculosis
uccaggccgcugauc

SEQ ID NO: 804843 - RNA, 20 nt, Mycobacterium avium subsp. paratuberculosis
uccaggccgucgaggcgcug

SEQ ID NO: 804844 - RNA, 15 nt, Mycobacterium avium subsp. paratuberculosis
uccaggaaacggccc

SEQ ID NO: 804845 - RNA, 18 nt, Mycobacterium avium subsp. paratuberculosis
uccaggaauucgggcacc

SEQ ID NO: 804846 - RNA, 20 nt, Mycobacterium avium subsp. paratuberculosis
uccaggaugucgacgacacc

SEQ ID NO: 804847 - RNA, 22 nt, Mycobacterium avium subsp. paratuberculosis
uccaggaugagcugggcggcgc

SEQ ID NO: 804848 - RNA, 14 nt, Mycobacterium avium subsp. paratuberculosis
uccagcggcaccgc

SEQ ID NO: 804849 - RNA, 18 nt, Mycobacterium avium subsp. paratuberculosis
uccagcggcaccgccauc

SEQ ID NO: 804850 - RNA, 14 nt, Mycobacterium avium subsp. paratuberculosis
uccagcgcuggccg

SEQ ID NO: 804851 - RNA, 15 nt, Mycobacterium avium subsp. paratuberculosis
uccagcgcuggccgg

SEQ ID NO: 804852 - RNA, 21 nt, Mycobacterium avium subsp. paratuberculosis
uccagcgcguagucggcgucg

SEQ ID NO: 804853 - RNA, 12 nt, Mycobacterium avium subsp. paratuberculosis
uccagcgcggcg

SEQ ID NO: 804854 - RNA, 15 nt, Mycobacterium avium subsp. paratuberculosis
uccagcgcggcgauc

SEQ ID NO: 804855 - RNA, 16 nt, Mycobacterium avium subsp. paratuberculosis
uccagcgcggcgaucg

SEQ ID NO: 804856 - RNA, 15 nt, Mycobacterium avium subsp. paratuberculosis
uccagcgccggcacc

SEQ ID NO: 804857 - RNA, 14 nt, Mycobacterium avium subsp. paratuberculosis
uccagcgcgccgcu

SEQ ID NO: 804858 - RNA, 21 nt, Mycobacterium avium subsp. paratuberculosis
uccagcgcgaucaacgggucg

SEQ ID NO: 804859 - RNA, 17 nt, Mycobacterium avium subsp. paratuberculosis
uccagcugcgcgccggc

SEQ ID NO: 804860 - RNA, 20 nt, Mycobacterium avium subsp. paratuberculosis
uccagcuguugacgggccgc

SEQ ID NO: 804861 - RNA, 21 nt, Mycobacterium avium subsp. paratuberculosis
uccagcuguugacgggccgcg

SEQ ID NO: 804862 - RNA, 20 nt, Mycobacterium avium subsp. paratuberculosis
uccagcuggagaggcccggc

SEQ ID NO: 804863 - RNA, 20 nt, Mycobacterium avium subsp. paratuberculosis
uccagcuugucguagcggcg

SEQ ID NO: 804864 - RNA, 13 nt, Mycobacterium avium subsp. paratuberculosis
uccagcaggcgcg

SEQ ID NO: 804865 - RNA, 18 nt, Mycobacterium avium subsp. paratuberculosis
uccagcaggcgcgccgag

SEQ ID NO: 804866 - RNA, 15 nt, Mycobacterium avium subsp. paratuberculosis
uccagcgccagcgag

SEQ ID NO: 804867 - RNA, 14 nt, Mycobacterium avium subsp. paratuberculosis
uccagccagccgcg

SEQ ID NO: 804868 - RNA, 13 nt, Mycobacterium avium subsp. paratuberculosis
uccagccagcgcg

SEQ ID NO: 804869 - RNA, 14 nt, Mycobacterium avium subsp. paratuberculosis
uccagccagcgcgc

SEQ ID NO: 804870 - RNA, 12 nt, Mycobacterium avium subsp. paratuberculosis
uccagcgccgag

SEQ ID NO: 804871 - RNA, 12 nt, Mycobacterium avium subsp. paratuberculosis
uccagcgccgcc

SEQ ID NO: 804872 - RNA, 17 nt, Mycobacterium avium subsp. paratuberculosis
uccagcgccgccaucgc

SEQ ID NO: 804873 - RNA, 19 nt, Mycobacterium avium subsp. paratuberculosis
uccacgcguagccgaccaa

SEQ ID NO: 804874 - RNA, 16 nt, Mycobacterium avium subsp. paratuberculosis
uccacgcuggcggugu

SEQ ID NO: 804875 - RNA, 20 nt, Mycobacterium avium subsp. paratuberculosis
uccacgaugcccgucacggc

SEQ ID NO: 804876 - RNA, 21 nt, Mycobacterium avium subsp. paratuberculosis
uccacgccgagggcggcggcu

SEQ ID NO: 804877 - RNA, 13 nt, Mycobacterium avium subsp. paratuberculosis
uccacgcccagcg

SEQ ID NO: 804878 - RNA, 19 nt, Mycobacterium avium subsp. paratuberculosis
uccacggcauggugaugau

SEQ ID NO: 804879 - RNA, 20 nt, Mycobacterium avium subsp. paratuberculosis
uccacggucagcgcgucggc

SEQ ID NO: 804880 - RNA, 16 nt, Mycobacterium avium subsp. paratuberculosis
uccacgucgcccagcg

SEQ ID NO: 804881 - RNA, 20 nt, Mycobacterium avium subsp. paratuberculosis
uccagcagcgccagcaccgc

SEQ ID NO: 804882 - RNA, 15 nt, Mycobacterium avium subsp. paratuberculosis
uccagcagcgccggc

SEQ ID NO: 804883 - RNA, 18 nt, Mycobacterium avium subsp. paratuberculosis
uccagcagcgccggcagc

SEQ ID NO: 804884 - RNA, 22 nt, Mycobacterium avium subsp. paratuberculosis
uccagcagcgccucggcgaucg

SEQ ID NO: 804885 - RNA, 13 nt, Mycobacterium avium subsp. paratuberculosis
uccagcagcggcu

SEQ ID NO: 804886 - RNA, 21 nt, Mycobacterium avium subsp. paratuberculosis
ucaguuaguuaaccgaagcgg

SEQ ID NO: 804887 - RNA, 16 nt, Mycobacterium avium subsp. paratuberculosis
ucagugcgggcaucgg

SEQ ID NO: 804888 - RNA, 19 nt, Mycobacterium avium subsp. paratuberculosis
ucagugaccagugcagagc

SEQ ID NO: 804889 - RNA, 20 nt, Mycobacterium avium subsp. paratuberculosis
ucagugaccagugcagagcg

SEQ ID NO: 804890 - RNA, 21 nt, Mycobacterium avium subsp. paratuberculosis
ucagugaccgcacgaucaggg

SEQ ID NO: 804891 - RNA, 14 nt, Mycobacterium avium subsp. paratuberculosis
ucaguccgccccga

SEQ ID NO: 804892 - RNA, 15 nt, Mycobacterium avium subsp. paratuberculosis
ucagucggccaccgc

SEQ ID NO: 804893 - RNA, 15 nt, Mycobacterium avium subsp. paratuberculosis
ucagugcacgcucgg

SEQ ID NO: 804894 - RNA, 13 nt, Mycobacterium avium subsp. paratuberculosis
ucagugccgcgcc

SEQ ID NO: 804895 - RNA, 17 nt, Mycobacterium avium subsp. paratuberculosis
ucagugccgcgccaacg

SEQ ID NO: 804896 - RNA, 19 nt, Mycobacterium avium subsp. paratuberculosis
ucagugcgcauucggcgac

SEQ ID NO: 804897 - RNA, 21 nt, Mycobacterium avium subsp. paratuberculosis
ucagucgaagaugucgcggcg

SEQ ID NO: 804898 - RNA, 23 nt, Mycobacterium avium subsp. paratuberculosis
ucagucgaagaugucgcggcgca

SEQ ID NO: 804899 - RNA, 21 nt, Mycobacterium avium subsp. paratuberculosis
ucagucgaucuugcgccagau

SEQ ID NO: 804900 - RNA, 18 nt, Mycobacterium avium subsp. paratuberculosis
ucagguugcgcagcagcc

SEQ ID NO: 804901 - RNA, 13 nt, Mycobacterium avium subsp. paratuberculosis
ucauccagccgug

SEQ ID NO: 804902 - RNA, 12 nt, Mycobacterium avium subsp. paratuberculosis
ucaucccgccga

SEQ ID NO: 804903 - RNA, 14 nt, Mycobacterium avium subsp. paratuberculosis
ucauccccuggccg

SEQ ID NO: 804904 - RNA, 21 nt, Mycobacterium avium subsp. paratuberculosis
ucauccccuggccgaaggugg

SEQ ID NO: 804905 - RNA, 17 nt, Mycobacterium avium subsp. paratuberculosis
ucaucgcccagccggcg

SEQ ID NO: 804906 - RNA, 20 nt, Mycobacterium avium subsp. paratuberculosis
ucaucgcccagccggcggau

SEQ ID NO: 804907 - RNA, 15 nt, Mycobacterium avium subsp. paratuberculosis
ucaucgcggccgccg

SEQ ID NO: 804908 - RNA, 17 nt, Mycobacterium avium subsp. paratuberculosis
ucaucggcggaagcuca

SEQ ID NO: 804909 - RNA, 15 nt, Mycobacterium avium subsp. paratuberculosis
ucagguugacgccga

SEQ ID NO: 804910 - RNA, 17 nt, Mycobacterium avium subsp. paratuberculosis
ucagguggauggucacc

SEQ ID NO: 804911 - RNA, 18 nt, Mycobacterium avium subsp. paratuberculosis
ucagguggauggucaccg

SEQ ID NO: 804912 - RNA, 19 nt, Mycobacterium avium subsp. paratuberculosis
ucagguggcgucggcgucg

SEQ ID NO: 804913 - RNA, 23 nt, Mycobacterium avium subsp. paratuberculosis
ucagguggggcaggaacgccuug

SEQ ID NO: 804914 - RNA, 17 nt, Mycobacterium avium subsp. paratuberculosis
ucaggucgcugcgcucg

SEQ ID NO: 804915 - RNA, 23 nt, Mycobacterium avium subsp. paratuberculosis
ucaggucgcugcgcucgccgucg

SEQ ID NO: 804916 - RNA, 18 nt, Mycobacterium avium subsp. paratuberculosis
ucaggucggugccgcggc

SEQ ID NO: 804917 - RNA, 15 nt, Mycobacterium avium subsp. paratuberculosis
ucagguccgcgaguu

SEQ ID NO: 804918 - RNA, 22 nt, Mycobacterium avium subsp. paratuberculosis
ucagguaccgguuccgggcgac

SEQ ID NO: 804919 - RNA, 18 nt, Mycobacterium avium subsp. paratuberculosis
ucaggucgaucagcgguc

SEQ ID NO: 804920 - RNA, 13 nt, Mycobacterium avium subsp. paratuberculosis
ucagguaggcgcg

SEQ ID NO: 804921 - RNA, 14 nt, Mycobacterium avium subsp. paratuberculosis
ucaggucaccgagc

SEQ ID NO: 804922 - RNA, 20 nt, Mycobacterium avium subsp. paratuberculosis
ucaggggugccagccgugcg

SEQ ID NO: 804923 - RNA, 15 nt, Mycobacterium avium subsp. paratuberculosis
ucaggguccagggcg

SEQ ID NO: 804924 - RNA, 17 nt, Mycobacterium avium subsp. paratuberculosis
ucagggguuggcgcgca

SEQ ID NO: 804925 - RNA, 20 nt, Mycobacterium avium subsp. paratuberculosis
ucagggguuggcgcgcagau

SEQ ID NO: 804926 - RNA, 24 nt, Mycobacterium avium subsp. paratuberculosis
ucagggcggugcggugcgccgcau

SEQ ID NO: 804927 - RNA, 21 nt, Mycobacterium avium subsp. paratuberculosis
ucagggugcaggcccgggcgg

SEQ ID NO: 804928 - RNA, 18 nt, Mycobacterium avium subsp. paratuberculosis
ucagggugcucagccgca

SEQ ID NO: 804929 - RNA, 21 nt, Mycobacterium avium subsp. paratuberculosis
ucagggccagcaacaccagcu

SEQ ID NO: 804930 - RNA, 22 nt, Mycobacterium avium subsp. paratuberculosis
ucagggcccacagcagccgcac

SEQ ID NO: 804931 - RNA, 18 nt, Mycobacterium avium subsp. paratuberculosis
ucagggcgacuccggcgc

SEQ ID NO: 804932 - RNA, 20 nt, Mycobacterium avium subsp. paratuberculosis
ucagggcgacuccggcgccg

SEQ ID NO: 804933 - RNA, 12 nt, Mycobacterium avium subsp. paratuberculosis
ucaggcgcgcac

SEQ ID NO: 804934 - RNA, 16 nt, Mycobacterium avium subsp. paratuberculosis
ucaggcgcugggugcg

SEQ ID NO: 804935 - RNA, 19 nt, Mycobacterium avium subsp. paratuberculosis
ucaggcgcagccagcgguc

SEQ ID NO: 804936 - RNA, 15 nt, Mycobacterium avium subsp. paratuberculosis
ucaggcgcagcccga

SEQ ID NO: 804937 - RNA, 19 nt, Mycobacterium avium subsp. paratuberculosis
ucaggcgcagcccgagcgg

SEQ ID NO: 804938 - RNA, 21 nt, Mycobacterium avium subsp. paratuberculosis
ucaggccguagcggcucgcca

SEQ ID NO: 804939 - RNA, 12 nt, Mycobacterium avium subsp. paratuberculosis
ucaggcggucga

SEQ ID NO: 804940 - RNA, 22 nt, Mycobacterium avium subsp. paratuberculosis
ucaggccgucucgagccggcgc

SEQ ID NO: 804941 - RNA, 19 nt, Mycobacterium avium subsp. paratuberculosis
ucaggccgugaucggccag

SEQ ID NO: 804942 - RNA, 19 nt, Mycobacterium avium subsp. paratuberculosis
ucaggccggccugccaccg

SEQ ID NO: 804943 - RNA, 15 nt, Mycobacterium avium subsp. paratuberculosis
ucaggccggccacca

SEQ ID NO: 804944 - RNA, 16 nt, Mycobacterium avium subsp. paratuberculosis
ucaggccggcgccggg

SEQ ID NO: 804945 - RNA, 22 nt, Mycobacterium avium subsp. paratuberculosis
ucaggcccuugccccaccaccg

SEQ ID NO: 804946 - RNA, 17 nt, Mycobacterium avium subsp. paratuberculosis
ucagcgggcggccagcc

SEQ ID NO: 804947 - RNA, 19 nt, Mycobacterium avium subsp. paratuberculosis
ucagcgggcggccagccgc

SEQ ID NO: 804948 - RNA, 22 nt, Mycobacterium avium subsp. paratuberculosis
ucagcgggcggccagccgcucc

SEQ ID NO: 804949 - RNA, 20 nt, Mycobacterium avium subsp. paratuberculosis
ucagcggggcguccagcgag

SEQ ID NO: 804950 - RNA, 12 nt, Mycobacterium avium subsp. paratuberculosis
ucagcggcgggc

SEQ ID NO: 804951 - RNA, 15 nt, Mycobacterium avium subsp. paratuberculosis
ucagcggcgggccca

SEQ ID NO: 804952 - RNA, 22 nt, Mycobacterium avium subsp. paratuberculosis
ucagcggcgucaggauggugaa

SEQ ID NO: 804953 - RNA, 12 nt, Mycobacterium avium subsp. paratuberculosis
ucagcggcgugc

SEQ ID NO: 804954 - RNA, 15 nt, Mycobacterium avium subsp. paratuberculosis
ucagcgggcgcagcu

SEQ ID NO: 804955 - RNA, 17 nt, Mycobacterium avium subsp. paratuberculosis
uaccgcaacaccgaaag

SEQ ID NO: 804956 - RNA, 15 nt, Mycobacterium avium subsp. paratuberculosis
uacccuucggccggc

SEQ ID NO: 804957 - RNA, 18 nt, Mycobacterium avium subsp. paratuberculosis
uacccuucggccggcagc

SEQ ID NO: 804958 - RNA, 13 nt, Mycobacterium avium subsp. paratuberculosis
uacccgcgcggcg

SEQ ID NO: 804959 - RNA, 16 nt, Mycobacterium avium subsp. paratuberculosis
uacccgcgcggcgucg

SEQ ID NO: 804960 - RNA, 14 nt, Mycobacterium avium subsp. paratuberculosis
uacccguugcgccc

SEQ ID NO: 804961 - RNA, 15 nt, Mycobacterium avium subsp. paratuberculosis
uacccguccagcgcg

SEQ ID NO: 804962 - RNA, 19 nt, Mycobacterium avium subsp. paratuberculosis
uaccccccacgcucggcga

SEQ ID NO: 804963 - RNA, 17 nt, Mycobacterium avium subsp. paratuberculosis
uacccccgccggggccg

SEQ ID NO: 804964 - RNA, 17 nt, Mycobacterium avium subsp. paratuberculosis
uacccgaacccagcgcc

SEQ ID NO: 804965 - RNA, 12 nt, Mycobacterium avium subsp. paratuberculosis
uacccgcccagc

SEQ ID NO: 804966 - RNA, 20 nt, Mycobacterium avium subsp. paratuberculosis
uaccccgucgaaaccgucuc

SEQ ID NO: 804967 - RNA, 14 nt, Mycobacterium avium subsp. paratuberculosis
uacccgaccagcac

SEQ ID NO: 804968 - RNA, 18 nt, Mycobacterium avium subsp. paratuberculosis
uacccgaccagcaccgcg

SEQ ID NO: 804969 - RNA, 21 nt, Mycobacterium avium subsp. paratuberculosis
uaccggcccagcgcgguguac

SEQ ID NO: 804970 - RNA, 19 nt, Mycobacterium avium subsp. paratuberculosis
uaccgcggcggcgucgacc

SEQ ID NO: 804971 - RNA, 13 nt, Mycobacterium avium subsp. paratuberculosis
uaccgccucgcca

SEQ ID NO: 804972 - RNA, 18 nt, Mycobacterium avium subsp. paratuberculosis
uaccgccgggcgggccgc

SEQ ID NO: 804973 - RNA, 17 nt, Mycobacterium avium subsp. paratuberculosis
uaccgcgcggagauggu

SEQ ID NO: 804974 - RNA, 17 nt, Mycobacterium avium subsp. paratuberculosis
uaccgcgcucaccgucg

SEQ ID NO: 804975 - RNA, 20 nt, Mycobacterium avium subsp. paratuberculosis
uaccggcguagaacaccgaa

SEQ ID NO: 804976 - RNA, 12 nt, Mycobacterium avium subsp. paratuberculosis
uaccggccggcc

SEQ ID NO: 804977 - RNA, 14 nt, Mycobacterium avium subsp. paratuberculosis
uaccggccggccgc

SEQ ID NO: 804978 - RNA, 24 nt, Mycobacterium avium subsp. paratuberculosis
uaccggugcacgagcgucgugcgg

SEQ ID NO: 804979 - RNA, 15 nt, Mycobacterium avium subsp. paratuberculosis
uaccgguugcccggu

SEQ ID NO: 804980 - RNA, 16 nt, Mycobacterium avium subsp. paratuberculosis
uaccgguacagcgacu

SEQ ID NO: 804981 - RNA, 16 nt, Mycobacterium avium subsp. paratuberculosis
uaccucugcgcgagca

SEQ ID NO: 804982 - RNA, 21 nt, Mycobacterium avium subsp. paratuberculosis
uaccugaccagcggcgcgccg

SEQ ID NO: 804983 - RNA, 18 nt, Mycobacterium avium subsp. paratuberculosis
uacgcccgaucccgggcc

SEQ ID NO: 804984 - RNA, 16 nt, Mycobacterium avium subsp. paratuberculosis
uacgccgccuugacgc

SEQ ID NO: 804985 - RNA, 18 nt, Mycobacterium avium subsp. paratuberculosis
uacgccgccuugacgccg

SEQ ID NO: 804986 - RNA, 23 nt, Mycobacterium avium subsp. paratuberculosis
uacgccgcgacgaugucgacccg

SEQ ID NO: 804987 - RNA, 21 nt, Mycobacterium avium subsp. paratuberculosis
uacgccgacgcauguccgccg

SEQ ID NO: 804988 - RNA, 13 nt, Mycobacterium avium subsp. paratuberculosis
uacgccgacguca

SEQ ID NO: 804989 - RNA, 20 nt, Mycobacterium avium subsp. paratuberculosis
uacgccgacgucaggguggc

SEQ ID NO: 804990 - RNA, 17 nt, Mycobacterium avium subsp. paratuberculosis
uacgccggggucgacag

SEQ ID NO: 804991 - RNA, 22 nt, Mycobacterium avium subsp. paratuberculosis
uacgccucaccccagcgcgacc

SEQ ID NO: 804992 - RNA, 17 nt, Mycobacterium avium subsp. paratuberculosis
uacgccgucugguccac

SEQ ID NO: 804993 - RNA, 15 nt, Mycobacterium avium subsp. paratuberculosis
uacgcugcgcgaccu

SEQ ID NO: 804994 - RNA, 13 nt, Mycobacterium avium subsp. paratuberculosis
uacuggcgccggu

SEQ ID NO: 804995 - RNA, 18 nt, Mycobacterium avium subsp. paratuberculosis
uacucggacgccggcagc

SEQ ID NO: 804996 - RNA, 22 nt, Mycobacterium avium subsp. paratuberculosis
uacucggacgccggcagccgcu

SEQ ID NO: 804997 - RNA, 20 nt, Mycobacterium avium subsp. paratuberculosis
uacucgggcaacgcgccggc

SEQ ID NO: 804998 - RNA, 22 nt, Mycobacterium avium subsp. paratuberculosis
uacucaaaccgggccugcgcgc

SEQ ID NO: 804999 - RNA, 17 nt, Mycobacterium avium subsp. paratuberculosis
uacucgagcgugcccgc

SEQ ID NO: 805000 - RNA, 20 nt, Mycobacterium avium subsp. paratuberculosis
uacuccgguaccacgccguc

SEQ ID NO: 805001 - RNA, 13 nt, Mycobacterium avium subsp. paratuberculosis
uacuccucgcggu

SEQ ID NO: 805002 - RNA, 14 nt, Mycobacterium avium subsp. paratuberculosis
uacuccucgcgguc

SEQ ID NO: 805003 - RNA, 13 nt, Mycobacterium avium subsp. paratuberculosis
uacggaugccccu

SEQ ID NO: 805004 - RNA, 18 nt, Mycobacterium avium subsp. paratuberculosis
uacggacgcauccacggc

SEQ ID NO: 805005 - RNA, 14 nt, Mycobacterium avium subsp. paratuberculosis
uagaaggcgccguc

SEQ ID NO: 805006 - RNA, 20 nt, Mycobacterium avium subsp. paratuberculosis
uagacguagugcagccgccc

SEQ ID NO: 805007 - RNA, 17 nt, Mycobacterium avium subsp. paratuberculosis
uagaucucgcgccgcgc

SEQ ID NO: 805008 - RNA, 20 nt, Mycobacterium avium subsp. paratuberculosis
uagagcaggaccgagccgcg

SEQ ID NO: 805009 - RNA, 21 nt, Mycobacterium avium subsp. paratuberculosis
uagagcaggaccgagccgcgc

SEQ ID NO: 805010 - RNA, 22 nt, Mycobacterium avium subsp. paratuberculosis
uagagcaguucgaugcgcucgg

SEQ ID NO: 805011 - RNA, 16 nt, Mycobacterium avium subsp. paratuberculosis
uagaggugcagcgggc

SEQ ID NO: 805012 - RNA, 13 nt, Mycobacterium avium subsp. paratuberculosis
uagaggccgcgga

SEQ ID NO: 805013 - RNA, 21 nt, Mycobacterium avium subsp. paratuberculosis
uagagcgggauccccaccgug

SEQ ID NO: 805014 - RNA, 16 nt, Mycobacterium avium subsp. paratuberculosis
uagagcugacgggacc

SEQ ID NO: 805015 - RNA, 19 nt, Mycobacterium avium subsp. paratuberculosis
uagagcuggugggccaucg

SEQ ID NO: 805016 - RNA, 20 nt, Mycobacterium avium subsp. paratuberculosis
uagccggugaucgcggcgcu

SEQ ID NO: 805017 - RNA, 16 nt, Mycobacterium avium subsp. paratuberculosis
uagcgcaccggucagc

SEQ ID NO: 805018 - RNA, 17 nt, Mycobacterium avium subsp. paratuberculosis
uagcgcauaggccgcga

SEQ ID NO: 805019 - RNA, 18 nt, Mycobacterium avium subsp. paratuberculosis
uagccguacacggcggcg

SEQ ID NO: 805020 - RNA, 21 nt, Mycobacterium avium subsp. paratuberculosis
uagccguacacggcggcgaag

SEQ ID NO: 805021 - RNA, 16 nt, Mycobacterium avium subsp. paratuberculosis
uagccggucggcccgc

SEQ ID NO: 805022 - RNA, 14 nt, Mycobacterium avium subsp. paratuberculosis
uagccggcgaucgu

SEQ ID NO: 805023 - RNA, 22 nt, Mycobacterium avium subsp. paratuberculosis
uagccggcgaucgucgccguca

SEQ ID NO: 805024 - RNA, 20 nt, Mycobacterium avium subsp. paratuberculosis
uagccgggcucgagcaccga

SEQ ID NO: 805025 - RNA, 17 nt, Mycobacterium avium subsp. paratuberculosis
uagccggggacggugca

SEQ ID NO: 805026 - RNA, 12 nt, Mycobacterium avium subsp. paratuberculosis
uagccggcacgc

SEQ ID NO: 805027 - RNA, 13 nt, Mycobacterium avium subsp. paratuberculosis
uagccggccagcg

SEQ ID NO: 805028 - RNA, 13 nt, Mycobacterium avium subsp. paratuberculosis
uagccggccagcu

SEQ ID NO: 805029 - RNA, 22 nt, Mycobacterium avium subsp. paratuberculosis
uagccggcccgcagccagcgca

SEQ ID NO: 805030 - RNA, 14 nt, Mycobacterium avium subsp. paratuberculosis
uagccggccgcguc

SEQ ID NO: 805031 - RNA, 22 nt, Mycobacterium avium subsp. paratuberculosis
uagcgcauguaggacaccccgg

SEQ ID NO: 805032 - RNA, 15 nt, Mycobacterium avium subsp. paratuberculosis
uagcgccgccggggc

SEQ ID NO: 805033 - RNA, 21 nt, Mycobacterium avium subsp. paratuberculosis
uagcggcggcugaagcgcugg

SEQ ID NO: 805034 - RNA, 18 nt, Mycobacterium avium subsp. paratuberculosis
uagcggcgccaccggcug

SEQ ID NO: 805035 - RNA, 12 nt, Mycobacterium avium subsp. paratuberculosis
uagcggccgcgg

SEQ ID NO: 805036 - RNA, 23 nt, Mycobacterium avium subsp. paratuberculosis
uagcgguccauccagcgccgcag

SEQ ID NO: 805037 - RNA, 17 nt, Mycobacterium avium subsp. paratuberculosis
uagcggcguaccgcggc

SEQ ID NO: 805038 - RNA, 14 nt, Mycobacterium avium subsp. paratuberculosis
uagcguccgcccac

SEQ ID NO: 805039 - RNA, 15 nt, Mycobacterium avium subsp. paratuberculosis
uagcaggcgcgcagc

SEQ ID NO: 805040 - RNA, 15 nt, Mycobacterium avium subsp. paratuberculosis
uagcaggcgguggug

SEQ ID NO: 805041 - RNA, 20 nt, Mycobacterium avium subsp. paratuberculosis
uagaugcggcccagcccggc

SEQ ID NO: 805042 - RNA, 18 nt, Mycobacterium avium subsp. paratuberculosis
uagaugguggccgucggc

SEQ ID NO: 805043 - RNA, 15 nt, Mycobacterium avium subsp. paratuberculosis
uagcccggccgcggc

SEQ ID NO: 805044 - RNA, 21 nt, Mycobacterium avium subsp. paratuberculosis
uagccgcucgcccagcgcggc

SEQ ID NO: 805045 - RNA, 22 nt, Mycobacterium avium subsp. paratuberculosis
uagccgcucgcccagcgcggcg

SEQ ID NO: 805046 - RNA, 19 nt, Mycobacterium avium subsp. paratuberculosis
uagccggaccgcuugacgc

SEQ ID NO: 805047 - RNA, 21 nt, Mycobacterium avium subsp. paratuberculosis
uagccggaccgcuugacgccg

SEQ ID NO: 805048 - RNA, 13 nt, Mycobacterium avium subsp. paratuberculosis
uagcccaugucgc

SEQ ID NO: 805049 - RNA, 17 nt, Mycobacterium avium subsp. paratuberculosis
uagcccaccucgagcac

SEQ ID NO: 805050 - RNA, 23 nt, Mycobacterium avium subsp. paratuberculosis
uagcccagcgcguugcggccguc

SEQ ID NO: 805051 - RNA, 22 nt, Mycobacterium avium subsp. paratuberculosis
uagcccaggauucccgaccccg

SEQ ID NO: 805052 - RNA, 17 nt, Mycobacterium avium subsp. paratuberculosis
uaguuggugcugggcac

SEQ ID NO: 805053 - RNA, 17 nt, Mycobacterium avium subsp. paratuberculosis
uaguagccagcaucguu

SEQ ID NO: 805054 - RNA, 22 nt, Mycobacterium avium subsp. paratuberculosis
uaggugcccgggucgugcggcg

SEQ ID NO: 805055 - RNA, 16 nt, Mycobacterium avium subsp. paratuberculosis
uagguggccagccggg

SEQ ID NO: 805056 - RNA, 20 nt, Mycobacterium avium subsp. paratuberculosis
uagguggccagccgggcgac

SEQ ID NO: 805057 - RNA, 14 nt, Mycobacterium avium subsp. paratuberculosis
uaggucguggcgcc

SEQ ID NO: 805058 - RNA, 15 nt, Mycobacterium avium subsp. paratuberculosis
uaggucguggcgccg

SEQ ID NO: 805059 - RNA, 22 nt, Mycobacterium avium subsp. paratuberculosis
uaggugcacagcccgugcagga

SEQ ID NO: 805060 - RNA, 23 nt, Mycobacterium avium subsp. paratuberculosis
uagcuugggugagcuaucagcuc

SEQ ID NO: 805061 - RNA, 14 nt, Mycobacterium avium subsp. paratuberculosis
uagcuucacgcucg

SEQ ID NO: 805062 - RNA, 15 nt, Mycobacterium avium subsp. paratuberculosis
uagcuucacgcucgg

SEQ ID NO: 805063 - RNA, 19 nt, Mycobacterium avium subsp. paratuberculosis
uagcuucacgcucggcagg

SEQ ID NO: 805064 - RNA, 13 nt, Mycobacterium avium subsp. paratuberculosis
uagcuggcgccga

SEQ ID NO: 805065 - RNA, 20 nt, Mycobacterium avium subsp. paratuberculosis
uagcgugacagucgaccucg

SEQ ID NO: 805066 - RNA, 15 nt, Mycobacterium avium subsp. paratuberculosis
uagcgugacgcucgc

SEQ ID NO: 805067 - RNA, 15 nt, Mycobacterium avium subsp. paratuberculosis
uaguucuucgucagg

SEQ ID NO: 805068 - RNA, 16 nt, Mycobacterium avium subsp. paratuberculosis
uaguucuugacgccga

SEQ ID NO: 805069 - RNA, 16 nt, Mycobacterium avium subsp. paratuberculosis
uagugggucggcggcu

SEQ ID NO: 805070 - RNA, 20 nt, Mycobacterium avium subsp. paratuberculosis
uaguggugcaggugcccguc

SEQ ID NO: 805071 - RNA, 14 nt, Mycobacterium avium subsp. paratuberculosis
uagucgcucggcgg

SEQ ID NO: 805072 - RNA, 13 nt, Mycobacterium avium subsp. paratuberculosis
uagucggcccgcc

SEQ ID NO: 805073 - RNA, 23 nt, Mycobacterium avium subsp. paratuberculosis
uagucgcgcagcugcgccgcguc

SEQ ID NO: 805074 - RNA, 14 nt, Mycobacterium avium subsp. paratuberculosis
uagucggcgccgac

SEQ ID NO: 805075 - RNA, 14 nt, Mycobacterium avium subsp. paratuberculosis
uagucggcgucggc

SEQ ID NO: 805076 - RNA, 15 nt, Mycobacterium avium subsp. paratuberculosis
uaguccggccagucc

SEQ ID NO: 805077 - RNA, 18 nt, Mycobacterium avium subsp. paratuberculosis
uagucgcccagcagcccg

SEQ ID NO: 805078 - RNA, 17 nt, Mycobacterium avium subsp. paratuberculosis
uagucgccgauggagac

SEQ ID NO: 805079 - RNA, 15 nt, Mycobacterium avium subsp. paratuberculosis
uagucgaccacccgc

SEQ ID NO: 805080 - RNA, 24 nt, Mycobacterium avium subsp. paratuberculosis
uagucgaggggcuugagcgcgucg

SEQ ID NO: 805081 - RNA, 17 nt, Mycobacterium avium subsp. paratuberculosis
uaguccagcacggcgaa

SEQ ID NO: 805082 - RNA, 21 nt, Mycobacterium avium subsp. paratuberculosis
ucaacaccgccagcaccgcca

SEQ ID NO: 805083 - RNA, 18 nt, Mycobacterium avium subsp. paratuberculosis
uaugucggugcggcgggc

SEQ ID NO: 805084 - RNA, 13 nt, Mycobacterium avium subsp. paratuberculosis
uauggcaucgcca

SEQ ID NO: 805085 - RNA, 21 nt, Mycobacterium avium subsp. paratuberculosis
uauggcaucgccaaggcgcug

SEQ ID NO: 805086 - RNA, 20 nt, Mycobacterium avium subsp. paratuberculosis
uauucaucgcggccgccggg

SEQ ID NO: 805087 - RNA, 17 nt, Mycobacterium avium subsp. paratuberculosis
uauucgccgucguggug

SEQ ID NO: 805088 - RNA, 16 nt, Mycobacterium avium subsp. paratuberculosis
uaucggccccggccga

SEQ ID NO: 805089 - RNA, 20 nt, Mycobacterium avium subsp. paratuberculosis
uaugccuuggcccgcgcggc

SEQ ID NO: 805090 - RNA, 20 nt, Mycobacterium avium subsp. paratuberculosis
uaugcugcaacggcuggcgc

SEQ ID NO: 805091 - RNA, 15 nt, Mycobacterium avium subsp. paratuberculosis
guguucggcgccagc

SEQ ID NO: 805092 - RNA, 23 nt, Mycobacterium avium subsp. paratuberculosis
guguucgggaucggcgcccaccg

SEQ ID NO: 805093 - RNA, 12 nt, Mycobacterium avium subsp. paratuberculosis
guguucgccgag

SEQ ID NO: 805094 - RNA, 22 nt, Mycobacterium avium subsp. paratuberculosis
guguucgccgaggaaccggcag

SEQ ID NO: 805095 - RNA, 16 nt, Mycobacterium avium subsp. paratuberculosis
guguugaucucgucga

SEQ ID NO: 805096 - RNA, 19 nt, Mycobacterium avium subsp. paratuberculosis
guuaaccgaagcggcccga

SEQ ID NO: 805097 - RNA, 23 nt, Mycobacterium avium subsp. paratuberculosis
aagugucguggggcucagccgaa

SEQ ID NO: 805098 - RNA, 16 nt, Mycobacterium avium subsp. paratuberculosis
gugggcuuagcggggu

SEQ ID NO: 805099 - RNA, 21 nt, Mycobacterium avium subsp. paratuberculosis
gugggcuuagcggggugagcu

SEQ ID NO: 805100 - RNA, 15 nt, Mycobacterium avium subsp. paratuberculosis
gugggcucgcccggg

SEQ ID NO: 805101 - RNA, 16 nt, Mycobacterium avium subsp. paratuberculosis
gugggcucggccaucc

SEQ ID NO: 805102 - RNA, 13 nt, Mycobacterium avium subsp. paratuberculosis
gugggccaccacg

SEQ ID NO: 805103 - RNA, 14 nt, Mycobacterium avium subsp. paratuberculosis
gugggccagcagcg

SEQ ID NO: 805104 - RNA, 23 nt, Mycobacterium avium subsp. paratuberculosis
gugggcggugcgcagucgcuggu

SEQ ID NO: 805105 - RNA, 13 nt, Mycobacterium avium subsp. paratuberculosis
gugggcgucgugg

SEQ ID NO: 805106 - RNA, 17 nt, Mycobacterium avium subsp. paratuberculosis
gugggcgugcaggccgc

SEQ ID NO: 805107 - RNA, 16 nt, Mycobacterium avium subsp. paratuberculosis
gugggcgugccgggau

SEQ ID NO: 805108 - RNA, 19 nt, Mycobacterium avium subsp. paratuberculosis
gugggggucgacccgccgc

SEQ ID NO: 805109 - RNA, 22 nt, Mycobacterium avium subsp. paratuberculosis
guggguauccgccgccagcgcc

SEQ ID NO: 805110 - RNA, 15 nt, Mycobacterium avium subsp. paratuberculosis
guggggcuggccgca

SEQ ID NO: 805111 - RNA, 17 nt, Mycobacterium avium subsp. paratuberculosis
guggggcuggccgcacg

SEQ ID NO: 805112 - RNA, 22 nt, Mycobacterium avium subsp. paratuberculosis
guggggaucaggaugacgccgc

SEQ ID NO: 805113 - RNA, 13 nt, Mycobacterium avium subsp. paratuberculosis
guggggcaccaga

SEQ ID NO: 805114 - RNA, 16 nt, Mycobacterium avium subsp. paratuberculosis
guggggccgaagccga

SEQ ID NO: 805115 - RNA, 18 nt, Mycobacterium avium subsp. paratuberculosis
guggggccgaagccgaca

SEQ ID NO: 805116 - RNA, 13 nt, Mycobacterium avium subsp. paratuberculosis
guggugcccccgc

SEQ ID NO: 805117 - RNA, 17 nt, Mycobacterium avium subsp. paratuberculosis
guggugcccccgcccgg

SEQ ID NO: 805118 - RNA, 21 nt, Mycobacterium avium subsp. paratuberculosis
guggugcccccgcccggccgg

SEQ ID NO: 805119 - RNA, 23 nt, Mycobacterium avium subsp. paratuberculosis
guggugccggaaguucucgccgu

SEQ ID NO: 805120 - RNA, 12 nt, Mycobacterium avium subsp. paratuberculosis
guggugaucgcc

SEQ ID NO: 805121 - RNA, 14 nt, Mycobacterium avium subsp. paratuberculosis
guggugaucgccgc

SEQ ID NO: 805122 - RNA, 16 nt, Mycobacterium avium subsp. paratuberculosis
guggugaucgccgcgg

SEQ ID NO: 805123 - RNA, 13 nt, Mycobacterium avium subsp. paratuberculosis
guggugaucgcgg

SEQ ID NO: 805124 - RNA, 15 nt, Mycobacterium avium subsp. paratuberculosis
guggugaucgcggcg

SEQ ID NO: 805125 - RNA, 15 nt, Mycobacterium avium subsp. paratuberculosis
guggugaucggccag

SEQ ID NO: 805126 - RNA, 13 nt, Mycobacterium avium subsp. paratuberculosis
guggugcacgaac

SEQ ID NO: 805127 - RNA, 14 nt, Mycobacterium avium subsp. paratuberculosis
guggugcacgaacg

SEQ ID NO: 805128 - RNA, 19 nt, Mycobacterium avium subsp. paratuberculosis
guggugcacgaacggcacg

SEQ ID NO: 805129 - RNA, 22 nt, Mycobacterium avium subsp. paratuberculosis
gugguggaaggugacgucgccg

SEQ ID NO: 805130 - RNA, 22 nt, Mycobacterium avium subsp. paratuberculosis
gugguggacaacuccuggaucc

SEQ ID NO: 805131 - RNA, 18 nt, Mycobacterium avium subsp. paratuberculosis
guggugcucgccccgccc

SEQ ID NO: 805132 - RNA, 14 nt, Mycobacterium avium subsp. paratuberculosis
guguaacgcgucga

SEQ ID NO: 805133 - RNA, 18 nt, Mycobacterium avium subsp. paratuberculosis
guguaacaacucgccgga

SEQ ID NO: 805134 - RNA, 18 nt, Mycobacterium avium subsp. paratuberculosis
guguacacagggcggcga

SEQ ID NO: 805135 - RNA, 18 nt, Mycobacterium avium subsp. paratuberculosis
gugugaucgagcaccagc

SEQ ID NO: 805136 - RNA, 19 nt, Mycobacterium avium subsp. paratuberculosis
gugugcauccugggcgucg

SEQ ID NO: 805137 - RNA, 16 nt, Mycobacterium avium subsp. paratuberculosis
gugugcagcagcucgg

SEQ ID NO: 805138 - RNA, 16 nt, Mycobacterium avium subsp. paratuberculosis
gugucuuucucgauga

SEQ ID NO: 805139 - RNA, 16 nt, Mycobacterium avium subsp. paratuberculosis
gugucaggaucgccgg

SEQ ID NO: 805140 - RNA, 14 nt, Mycobacterium avium subsp. paratuberculosis
gugugcaaggcgau

SEQ ID NO: 805141 - RNA, 20 nt, Mycobacterium avium subsp. paratuberculosis
guguucaacgcgccgaugcc

SEQ ID NO: 805142 - RNA, 17 nt, Mycobacterium avium subsp. paratuberculosis
guguucaagccggcgug

SEQ ID NO: 805143 - RNA, 14 nt, Mycobacterium avium subsp. paratuberculosis
guguucaccgcgcc

SEQ ID NO: 805144 - RNA, 15 nt, Mycobacterium avium subsp. paratuberculosis
gugugcccagcacga

SEQ ID NO: 805145 - RNA, 17 nt, Mycobacterium avium subsp. paratuberculosis
gugugcccagcacgacg

SEQ ID NO: 805146 - RNA, 16 nt, Mycobacterium avium subsp. paratuberculosis
gugugcccgcgggcca

SEQ ID NO: 805147 - RNA, 17 nt, Mycobacterium avium subsp. paratuberculosis
gugugcccgcgggccag

SEQ ID NO: 805148 - RNA, 19 nt, Mycobacterium avium subsp. paratuberculosis
gugugccgcugcauccgca

SEQ ID NO: 805149 - RNA, 14 nt, Mycobacterium avium subsp. paratuberculosis
gugugccgcuggua

SEQ ID NO: 805150 - RNA, 20 nt, Mycobacterium avium subsp. paratuberculosis
gugugccgcugguaggcggc

SEQ ID NO: 805151 - RNA, 14 nt, Mycobacterium avium subsp. paratuberculosis
guguaggcggccac

SEQ ID NO: 805152 - RNA, 16 nt, Mycobacterium avium subsp. paratuberculosis
guguaggcgucggcgg

SEQ ID NO: 805153 - RNA, 14 nt, Mycobacterium avium subsp. paratuberculosis
guguaggcguggca

SEQ ID NO: 805154 - RNA, 15 nt, Mycobacterium avium subsp. paratuberculosis
guguagggcaacacg

SEQ ID NO: 805155 - RNA, 16 nt, Mycobacterium avium subsp. paratuberculosis
guguagggcaacacga

SEQ ID NO: 805156 - RNA, 22 nt, Mycobacterium avium subsp. paratuberculosis
guguagggcaacacgaccagga

SEQ ID NO: 805157 - RNA, 22 nt, Mycobacterium avium subsp. paratuberculosis
guguaguccaggucgaucucgg

SEQ ID NO: 805158 - RNA, 15 nt, Mycobacterium avium subsp. paratuberculosis
guguagucggcgauc

SEQ ID NO: 805159 - RNA, 15 nt, Mycobacterium avium subsp. paratuberculosis
guguacucggcgucg

SEQ ID NO: 805160 - RNA, 20 nt, Mycobacterium avium subsp. paratuberculosis
guguagaucggcucaccgaa

SEQ ID NO: 805161 - RNA, 15 nt, Mycobacterium avium subsp. paratuberculosis
gugucaccgacgcca

SEQ ID NO: 805162 - RNA, 14 nt, Mycobacterium avium subsp. paratuberculosis
gugucacgcuggcg

SEQ ID NO: 805163 - RNA, 16 nt, Mycobacterium avium subsp. paratuberculosis
gugucacgcuggcgug

SEQ ID NO: 805164 - RNA, 17 nt, Mycobacterium avium subsp. paratuberculosis
gugucacgcuggcguga

SEQ ID NO: 805165 - RNA, 20 nt, Mycobacterium avium subsp. paratuberculosis
gugucacguccacgccgcgg

SEQ ID NO: 805166 - RNA, 22 nt, Mycobacterium avium subsp. paratuberculosis
guggcguuuuccuucggugcgu

SEQ ID NO: 805167 - RNA, 15 nt, Mycobacterium avium subsp. paratuberculosis
guggcguucgaugcc

SEQ ID NO: 805168 - RNA, 13 nt, Mycobacterium avium subsp. paratuberculosis
guggcguuggcga

SEQ ID NO: 805169 - RNA, 21 nt, Mycobacterium avium subsp. paratuberculosis
guggcugaacagcgcgccgaa

SEQ ID NO: 805170 - RNA, 15 nt, Mycobacterium avium subsp. paratuberculosis
guggcucggcccgcc

SEQ ID NO: 805171 - RNA, 17 nt, Mycobacterium avium subsp. paratuberculosis
guggcucggcccgccgg

SEQ ID NO: 805172 - RNA, 21 nt, Mycobacterium avium subsp. paratuberculosis
gugggcagccaaccgccgggg

SEQ ID NO: 805173 - RNA, 15 nt, Mycobacterium avium subsp. paratuberculosis
gugggcagccggcaa

SEQ ID NO: 805174 - RNA, 15 nt, Mycobacterium avium subsp. paratuberculosis
gugggcagcgcgauc

SEQ ID NO: 805175 - RNA, 13 nt, Mycobacterium avium subsp. paratuberculosis
gugggcagcgcgg

SEQ ID NO: 805176 - RNA, 13 nt, Mycobacterium avium subsp. paratuberculosis
gugggcagcucgu

SEQ ID NO: 805177 - RNA, 19 nt, Mycobacterium avium subsp. paratuberculosis
gugggcagcucgucggcgc

SEQ ID NO: 805178 - RNA, 12 nt, Mycobacterium avium subsp. paratuberculosis
gugggcaccgcg

SEQ ID NO: 805179 - RNA, 16 nt, Mycobacterium avium subsp. paratuberculosis
gugggcaccagcagcg

SEQ ID NO: 805180 - RNA, 16 nt, Mycobacterium avium subsp. paratuberculosis
gugggcaccccgauca

SEQ ID NO: 805181 - RNA, 20 nt, Mycobacterium avium subsp. paratuberculosis
gugggcaacacgucguccgg

SEQ ID NO: 805182 - RNA, 17 nt, Mycobacterium avium subsp. paratuberculosis
guggcggucccggcgga

SEQ ID NO: 805183 - RNA, 19 nt, Mycobacterium avium subsp. paratuberculosis
guggcggucccggcggacc

SEQ ID NO: 805184 - RNA, 14 nt, Mycobacterium avium subsp. paratuberculosis
guggcggucggugc

SEQ ID NO: 805185 - RNA, 13 nt, Mycobacterium avium subsp. paratuberculosis
guggcgguggcca

SEQ ID NO: 805186 - RNA, 15 nt, Mycobacterium avium subsp. paratuberculosis
guggcgguggccacg

SEQ ID NO: 805187 - RNA, 16 nt, Mycobacterium avium subsp. paratuberculosis
guggcgguggcggcga

SEQ ID NO: 805188 - RNA, 13 nt, Mycobacterium avium subsp. paratuberculosis
guggcguagcggu

SEQ ID NO: 805189 - RNA, 16 nt, Mycobacterium avium subsp. paratuberculosis
guggcguagucgucga

SEQ ID NO: 805190 - RNA, 22 nt, Mycobacterium avium subsp. paratuberculosis
guggcguagucgucgaucucgg

SEQ ID NO: 805191 - RNA, 22 nt, Mycobacterium avium subsp. paratuberculosis
guggcggggcguugcccgucgc

SEQ ID NO: 805192 - RNA, 19 nt, Mycobacterium avium subsp. paratuberculosis
guggcgggggagccgugca

SEQ ID NO: 805193 - RNA, 16 nt, Mycobacterium avium subsp. paratuberculosis
guggcggcggugucgc

SEQ ID NO: 805194 - RNA, 15 nt, Mycobacterium avium subsp. paratuberculosis
guggcgggccgccgg

SEQ ID NO: 805195 - RNA, 22 nt, Mycobacterium avium subsp. paratuberculosis
guggcgugcggccucggcaccg

SEQ ID NO: 805196 - RNA, 18 nt, Mycobacterium avium subsp. paratuberculosis
guggcguuacacccgcgg

SEQ ID NO: 805197 - RNA, 20 nt, Mycobacterium avium subsp. paratuberculosis
guggcguucacaguaggcgg

SEQ ID NO: 805198 - RNA, 21 nt, Mycobacterium avium subsp. paratuberculosis
guggcguucacaguaggcggc

SEQ ID NO: 805199 - RNA, 22 nt, Mycobacterium avium subsp. paratuberculosis
guggcguucacaguaggcggcu

SEQ ID NO: 805200 - RNA, 16 nt, Mycobacterium avium subsp. paratuberculosis
guggcguccagaugcc

SEQ ID NO: 805201 - RNA, 19 nt, Mycobacterium avium subsp. paratuberculosis
guggcguccuugccgauca

SEQ ID NO: 805202 - RNA, 22 nt, Mycobacterium avium subsp. paratuberculosis
guggcguccuugccgaucagcg

SEQ ID NO: 805203 - RNA, 12 nt, Mycobacterium avium subsp. paratuberculosis
guggcgucgaug

SEQ ID NO: 805204 - RNA, 15 nt, Mycobacterium avium subsp. paratuberculosis
guggcgucgccgccg

SEQ ID NO: 805205 - RNA, 15 nt, Mycobacterium avium subsp. paratuberculosis
guggcgucggccggg

SEQ ID NO: 805206 - RNA, 18 nt, Mycobacterium avium subsp. paratuberculosis
guggcgucggccgggggc

SEQ ID NO: 805207 - RNA, 21 nt, Mycobacterium avium subsp. paratuberculosis
guggcgucggcgcgcaccgcg

SEQ ID NO: 805208 - RNA, 13 nt, Mycobacterium avium subsp. paratuberculosis
guggcgucggcgu

SEQ ID NO: 805209 - RNA, 15 nt, Mycobacterium avium subsp. paratuberculosis
guggcgucggugaug

SEQ ID NO: 805210 - RNA, 18 nt, Mycobacterium avium subsp. paratuberculosis
guggcgucggugaugccg

SEQ ID NO: 805211 - RNA, 17 nt, Mycobacterium avium subsp. paratuberculosis
guggcgaucaccgcggc

SEQ ID NO: 805212 - RNA, 17 nt, Mycobacterium avium subsp. paratuberculosis
guggcgcacgcugcugg

SEQ ID NO: 805213 - RNA, 13 nt, Mycobacterium avium subsp. paratuberculosis
guggcgcacaacc

SEQ ID NO: 805214 - RNA, 23 nt, Mycobacterium avium subsp. paratuberculosis
guggcgaugacgaauuccgcacc

SEQ ID NO: 805215 - RNA, 22 nt, Mycobacterium avium subsp. paratuberculosis
guggcgaugaggaacgucucgg

SEQ ID NO: 805216 - RNA, 18 nt, Mycobacterium avium subsp. paratuberculosis
guggcgaugaucaccucg

SEQ ID NO: 805217 - RNA, 16 nt, Mycobacterium avium subsp. paratuberculosis
guggcgcccgcggugg

SEQ ID NO: 805218 - RNA, 11 nt, Mycobacterium avium subsp. paratuberculosis
guggcgccgcg

SEQ ID NO: 805219 - RNA, 16 nt, Mycobacterium avium subsp. paratuberculosis
guggcgccgcgcagcc

SEQ ID NO: 805220 - RNA, 18 nt, Mycobacterium avium subsp. paratuberculosis
guggcgccggcaucgacc

SEQ ID NO: 805221 - RNA, 12 nt, Mycobacterium avium subsp. paratuberculosis
guggcgccggcc

SEQ ID NO: 805222 - RNA, 14 nt, Mycobacterium avium subsp. paratuberculosis
guggcgccggccag

SEQ ID NO: 805223 - RNA, 16 nt, Mycobacterium avium subsp. paratuberculosis
guggcgccggccagca

SEQ ID NO: 805224 - RNA, 21 nt, Mycobacterium avium subsp. paratuberculosis
guggcgccggccagcaccacg

SEQ ID NO: 805225 - RNA, 13 nt, Mycobacterium avium subsp. paratuberculosis
guggcgccggcgc

SEQ ID NO: 805226 - RNA, 23 nt, Mycobacterium avium subsp. paratuberculosis
guggcgcaucaccuucugcgucg

SEQ ID NO: 805227 - RNA, 19 nt, Mycobacterium avium subsp. paratuberculosis
guggcggcgaugucgucga

SEQ ID NO: 805228 - RNA, 14 nt, Mycobacterium avium subsp. paratuberculosis
guggcggcgccgga

SEQ ID NO: 805229 - RNA, 11 nt, Mycobacterium avium subsp. paratuberculosis
guggcggcggu

SEQ ID NO: 805230 - RNA, 24 nt, Mycobacterium avium subsp. paratuberculosis
guggcggcgaacgcgcggucgucg

SEQ ID NO: 805231 - RNA, 17 nt, Mycobacterium avium subsp. paratuberculosis
guggcggccgucgcgca

SEQ ID NO: 805232 - RNA, 19 nt, Mycobacterium avium subsp. paratuberculosis
guggcggcccaauucguag

SEQ ID NO: 805233 - RNA, 18 nt, Mycobacterium avium subsp. paratuberculosis
guggcggcccgaccagcg

SEQ ID NO: 805234 - RNA, 13 nt, Mycobacterium avium subsp. paratuberculosis
guggcggccacca

SEQ ID NO: 805235 - RNA, 23 nt, Mycobacterium avium subsp. paratuberculosis
guggcggccaccaugccggcguc

SEQ ID NO: 805236 - RNA, 14 nt, Mycobacterium avium subsp. paratuberculosis
guggcggccacgau

SEQ ID NO: 805237 - RNA, 17 nt, Mycobacterium avium subsp. paratuberculosis
guggcggccacgaucgc

SEQ ID NO: 805238 - RNA, 16 nt, Mycobacterium avium subsp. paratuberculosis
guggcgcucagcggca

SEQ ID NO: 805239 - RNA, 17 nt, Mycobacterium avium subsp. paratuberculosis
guggcgcgccccggccc

SEQ ID NO: 805240 - RNA, 21 nt, Mycobacterium avium subsp. paratuberculosis
guggcgcgaaucccggccucg

SEQ ID NO: 805241 - RNA, 13 nt, Mycobacterium avium subsp. paratuberculosis
guggcgcgacgcg

SEQ ID NO: 805242 - RNA, 14 nt, Mycobacterium avium subsp. paratuberculosis
guggcgccggcgcg

SEQ ID NO: 805243 - RNA, 13 nt, Mycobacterium avium subsp. paratuberculosis
guggcgccgguuu

SEQ ID NO: 805244 - RNA, 13 nt, Mycobacterium avium subsp. paratuberculosis
guggcgccgugca

SEQ ID NO: 805245 - RNA, 13 nt, Mycobacterium avium subsp. paratuberculosis
guggccgaccgac

SEQ ID NO: 805246 - RNA, 22 nt, Mycobacterium avium subsp. paratuberculosis
guggccgaccgacaguucggcg

SEQ ID NO: 805247 - RNA, 23 nt, Mycobacterium avium subsp. paratuberculosis
guggccgaccgacaguucggcgc

SEQ ID NO: 805248 - RNA, 23 nt, Mycobacterium avium subsp. paratuberculosis
guggccgaacgggucggcgacca

SEQ ID NO: 805249 - RNA, 17 nt, Mycobacterium avium subsp. paratuberculosis
guggccgaaccgcucgu

SEQ ID NO: 805250 - RNA, 20 nt, Mycobacterium avium subsp. paratuberculosis
guggccgaaccgcucgucgg

SEQ ID NO: 805251 - RNA, 22 nt, Mycobacterium avium subsp. paratuberculosis
guggccgaacgggucggcgacc

SEQ ID NO: 805252 - RNA, 22 nt, Mycobacterium avium subsp. paratuberculosis
guggccgcgaaaauaccgccgg

SEQ ID NO: 805253 - RNA, 23 nt, Mycobacterium avium subsp. paratuberculosis
guggccgcgaaaauaccgccggc

SEQ ID NO: 805254 - RNA, 21 nt, Mycobacterium avium subsp. paratuberculosis
guggccgccagcaccucgcgg

SEQ ID NO: 805255 - RNA, 14 nt, Mycobacterium avium subsp. paratuberculosis
guggccgaucagcg

SEQ ID NO: 805256 - RNA, 15 nt, Mycobacterium avium subsp. paratuberculosis
guggccgaucagcug

SEQ ID NO: 805257 - RNA, 11 nt, Mycobacterium avium subsp. paratuberculosis
guggccgccac

SEQ ID NO: 805258 - RNA, 15 nt, Mycobacterium avium subsp. paratuberculosis
guggccgccaccaac

SEQ ID NO: 805259 - RNA, 16 nt, Mycobacterium avium subsp. paratuberculosis
guggccgccaccaggc

SEQ ID NO: 805260 - RNA, 19 nt, Mycobacterium avium subsp. paratuberculosis
guggccgcuuuccaccccg

SEQ ID NO: 805261 - RNA, 14 nt, Mycobacterium avium subsp. paratuberculosis
guggccggccagca

SEQ ID NO: 805262 - RNA, 18 nt, Mycobacterium avium subsp. paratuberculosis
guggccgguaucggguca

SEQ ID NO: 805263 - RNA, 13 nt, Mycobacterium avium subsp. paratuberculosis
guggccggcgucc

SEQ ID NO: 805264 - RNA, 14 nt, Mycobacterium avium subsp. paratuberculosis
guggccggcgucca

SEQ ID NO: 805265 - RNA, 17 nt, Mycobacterium avium subsp. paratuberculosis
guggccggcguccaggc

SEQ ID NO: 805266 - RNA, 14 nt, Mycobacterium avium subsp. paratuberculosis
guggccgcgucgac

SEQ ID NO: 805267 - RNA, 20 nt, Mycobacterium avium subsp. paratuberculosis
guggccgcgucgaccagccg

SEQ ID NO: 805268 - RNA, 13 nt, Mycobacterium avium subsp. paratuberculosis
guggccgcgcugg

SEQ ID NO: 805269 - RNA, 14 nt, Mycobacterium avium subsp. paratuberculosis
guggccgcggcggc

SEQ ID NO: 805270 - RNA, 18 nt, Mycobacterium avium subsp. paratuberculosis
guggccgcggcggcccgg

SEQ ID NO: 805271 - RNA, 17 nt, Mycobacterium avium subsp. paratuberculosis
guggccugggcgaccag

SEQ ID NO: 805272 - RNA, 22 nt, Mycobacterium avium subsp. paratuberculosis
guggccuggucgaacagcacgc

SEQ ID NO: 805273 - RNA, 16 nt, Mycobacterium avium subsp. paratuberculosis
guggccuggucggcga

SEQ ID NO: 805274 - RNA, 15 nt, Mycobacterium avium subsp. paratuberculosis
guggccucgucggcg

SEQ ID NO: 805275 - RNA, 15 nt, Mycobacterium avium subsp. paratuberculosis
guggccugcccggcg

SEQ ID NO: 805276 - RNA, 17 nt, Mycobacterium avium subsp. paratuberculosis
guggccugcccggcggu

SEQ ID NO: 805277 - RNA, 13 nt, Mycobacterium avium subsp. paratuberculosis
guggccucggcgc

SEQ ID NO: 805278 - RNA, 20 nt, Mycobacterium avium subsp. paratuberculosis
guggccucggcgcugcccgc

SEQ ID NO: 805279 - RNA, 18 nt, Mycobacterium avium subsp. paratuberculosis
guggccggugggcggcgc

SEQ ID NO: 805280 - RNA, 20 nt, Mycobacterium avium subsp. paratuberculosis
guggccggugggcggcgccc

SEQ ID NO: 805281 - RNA, 17 nt, Mycobacterium avium subsp. paratuberculosis
guggccguaaccgccgu

SEQ ID NO: 805282 - RNA, 18 nt, Mycobacterium avium subsp. paratuberculosis
guggccgucucgucggcc

SEQ ID NO: 805283 - RNA, 16 nt, Mycobacterium avium subsp. paratuberculosis
guggccgugaaggggu

SEQ ID NO: 805284 - RNA, 16 nt, Mycobacterium avium subsp. paratuberculosis
guggccuugcugaucc

SEQ ID NO: 805285 - RNA, 21 nt, Mycobacterium avium subsp. paratuberculosis
guggccuugcugauccccagc

SEQ ID NO: 805286 - RNA, 16 nt, Mycobacterium avium subsp. paratuberculosis
guggccuuggccacca

SEQ ID NO: 805287 - RNA, 19 nt, Mycobacterium avium subsp. paratuberculosis
guggccuuguggucgaucc

SEQ ID NO: 805288 - RNA, 22 nt, Mycobacterium avium subsp. paratuberculosis
guggccuuguggucgaucccgc

SEQ ID NO: 805289 - RNA, 21 nt, Mycobacterium avium subsp. paratuberculosis
guggcgaacgcgaccugcauc

SEQ ID NO: 805290 - RNA, 19 nt, Mycobacterium avium subsp. paratuberculosis
guggcgaacugcaccagca

SEQ ID NO: 805291 - RNA, 20 nt, Mycobacterium avium subsp. paratuberculosis
guggcgaacugcaccagcac

SEQ ID NO: 805292 - RNA, 21 nt, Mycobacterium avium subsp. paratuberculosis
guggcgaacugcaccagcacg

SEQ ID NO: 805293 - RNA, 17 nt, Mycobacterium avium subsp. paratuberculosis
guggcgacaacaggcga

SEQ ID NO: 805294 - RNA, 16 nt, Mycobacterium avium subsp. paratuberculosis
guggcgacaucgccgc

SEQ ID NO: 805295 - RNA, 18 nt, Mycobacterium avium subsp. paratuberculosis
guggcgacaucgccgcgg

SEQ ID NO: 805296 - RNA, 15 nt, Mycobacterium avium subsp. paratuberculosis
guggcgaacagcggg

SEQ ID NO: 805297 - RNA, 19 nt, Mycobacterium avium subsp. paratuberculosis
guggcgacgaaccuggcug

SEQ ID NO: 805298 - RNA, 15 nt, Mycobacterium avium subsp. paratuberculosis
guggcgacgacgccg

SEQ ID NO: 805299 - RNA, 19 nt, Mycobacterium avium subsp. paratuberculosis
guggcgacgacgccgaucc

SEQ ID NO: 805300 - RNA, 16 nt, Mycobacterium avium subsp. paratuberculosis
gugcugcgcagcagcg

SEQ ID NO: 805301 - RNA, 17 nt, Mycobacterium avium subsp. paratuberculosis
gugcugcgcagcagcgc

SEQ ID NO: 805302 - RNA, 17 nt, Mycobacterium avium subsp. paratuberculosis
gugcugccugccguugg

SEQ ID NO: 805303 - RNA, 16 nt, Mycobacterium avium subsp. paratuberculosis
gugcuggccaccacgg

SEQ ID NO: 805304 - RNA, 21 nt, Mycobacterium avium subsp. paratuberculosis
gugcuggccagcaccagcgcg

SEQ ID NO: 805305 - RNA, 20 nt, Mycobacterium avium subsp. paratuberculosis
gugcuggacggcccgacgac

SEQ ID NO: 805306 - RNA, 23 nt, Mycobacterium avium subsp. paratuberculosis
gugcuggacggcccgacgacgcc

SEQ ID NO: 805307 - RNA, 22 nt, Mycobacterium avium subsp. paratuberculosis
guggccagcaccacguccgcgg

SEQ ID NO: 805308 - RNA, 15 nt, Mycobacterium avium subsp. paratuberculosis
guggccagcaccagc

SEQ ID NO: 805309 - RNA, 18 nt, Mycobacterium avium subsp. paratuberculosis
guggccagcaccagcccg

SEQ ID NO: 805310 - RNA, 14 nt, Mycobacterium avium subsp. paratuberculosis
guggccagcaccgc

SEQ ID NO: 805311 - RNA, 15 nt, Mycobacterium avium subsp. paratuberculosis
guggccagcaccgcg

SEQ ID NO: 805312 - RNA, 16 nt, Mycobacterium avium subsp. paratuberculosis
guggccagcaccgcgu

SEQ ID NO: 805313 - RNA, 18 nt, Mycobacterium avium subsp. paratuberculosis
guggccagcaccgcgucg

SEQ ID NO: 805314 - RNA, 16 nt, Mycobacterium avium subsp. paratuberculosis
guggccagcaccguca

SEQ ID NO: 805315 - RNA, 23 nt, Mycobacterium avium subsp. paratuberculosis
guggccaccgaugcccgacaccg

SEQ ID NO: 805316 - RNA, 18 nt, Mycobacterium avium subsp. paratuberculosis
guggccaccgcgacgccc

SEQ ID NO: 805317 - RNA, 20 nt, Mycobacterium avium subsp. paratuberculosis
guggccaccgcgacgcccag

SEQ ID NO: 805318 - RNA, 21 nt, Mycobacterium avium subsp. paratuberculosis
guggccaccuuggacaggccc

SEQ ID NO: 805319 - RNA, 21 nt, Mycobacterium avium subsp. paratuberculosis
gugcugggcggauccgcgugg

SEQ ID NO: 805320 - RNA, 16 nt, Mycobacterium avium subsp. paratuberculosis
gugcuggggguggcgu

SEQ ID NO: 805321 - RNA, 23 nt, Mycobacterium avium subsp. paratuberculosis
gugcugggccacgauccgcgcgg

SEQ ID NO: 805322 - RNA, 16 nt, Mycobacterium avium subsp. paratuberculosis
guggcccagccggugc

SEQ ID NO: 805323 - RNA, 18 nt, Mycobacterium avium subsp. paratuberculosis
guggcccagccggugcga

SEQ ID NO: 805324 - RNA, 22 nt, Mycobacterium avium subsp. paratuberculosis
guggcccagccggugcgagccg

SEQ ID NO: 805325 - RNA, 12 nt, Mycobacterium avium subsp. paratuberculosis
guggcccagccg

SEQ ID NO: 805326 - RNA, 13 nt, Mycobacterium avium subsp. paratuberculosis
guggcccgcgcgc

SEQ ID NO: 805327 - RNA, 13 nt, Mycobacterium avium subsp. paratuberculosis
guggcccgccacg

SEQ ID NO: 805328 - RNA, 18 nt, Mycobacterium avium subsp. paratuberculosis
guggcccgccacgugcgg

SEQ ID NO: 805329 - RNA, 21 nt, Mycobacterium avium subsp. paratuberculosis
guggcccgguacagcgccgcg

SEQ ID NO: 805330 - RNA, 22 nt, Mycobacterium avium subsp. paratuberculosis
guggcccgguacagcgccgcgg

SEQ ID NO: 805331 - RNA, 14 nt, Mycobacterium avium subsp. paratuberculosis
guggcccggucgga

SEQ ID NO: 805332 - RNA, 19 nt, Mycobacterium avium subsp. paratuberculosis
guggccccacgggccaugu

SEQ ID NO: 805333 - RNA, 15 nt, Mycobacterium avium subsp. paratuberculosis
guggcccagccggcc

SEQ ID NO: 805334 - RNA, 22 nt, Mycobacterium avium subsp. paratuberculosis
guggcccacgggaugcggcacg

SEQ ID NO: 805335 - RNA, 20 nt, Mycobacterium avium subsp. paratuberculosis
guggccagcuucaccggucg

SEQ ID NO: 805336 - RNA, 24 nt, Mycobacterium avium subsp. paratuberculosis
guggccaguucgucgcgcgacugg

SEQ ID NO: 805337 - RNA, 14 nt, Mycobacterium avium subsp. paratuberculosis
guggccagcgccag

SEQ ID NO: 805338 - RNA, 20 nt, Mycobacterium avium subsp. paratuberculosis
guggccagcgccagcgccag

SEQ ID NO: 805339 - RNA, 18 nt, Mycobacterium avium subsp. paratuberculosis
guggccacggcguugacc

SEQ ID NO: 805340 - RNA, 13 nt, Mycobacterium avium subsp. paratuberculosis
gugcgcaccccgu

SEQ ID NO: 805341 - RNA, 23 nt, Mycobacterium avium subsp. paratuberculosis
gugcgcaccccguugccgccggc

SEQ ID NO: 805342 - RNA, 13 nt, Mycobacterium avium subsp. paratuberculosis
gugcgcaccgaca

SEQ ID NO: 805343 - RNA, 16 nt, Mycobacterium avium subsp. paratuberculosis
gugcgcacgaacggcg

SEQ ID NO: 805344 - RNA, 18 nt, Mycobacterium avium subsp. paratuberculosis
gugcgcacgaacggcgcg

SEQ ID NO: 805345 - RNA, 16 nt, Mycobacterium avium subsp. paratuberculosis
aagugcacgccgaggc

SEQ ID NO: 805346 - RNA, 15 nt, Mycobacterium avium subsp. paratuberculosis
aagugcacucggcga

SEQ ID NO: 805347 - RNA, 18 nt, Mycobacterium avium subsp. paratuberculosis
aagugccgguccagccgc

SEQ ID NO: 805348 - RNA, 15 nt, Mycobacterium avium subsp. paratuberculosis
aagucuucggcgaug

SEQ ID NO: 805349 - RNA, 18 nt, Mycobacterium avium subsp. paratuberculosis
gugccgucgaucgcccgc

SEQ ID NO: 805350 - RNA, 12 nt, Mycobacterium avium subsp. paratuberculosis
gugccgucgcgg

SEQ ID NO: 805351 - RNA, 18 nt, Mycobacterium avium subsp. paratuberculosis
gugccgucgcgggcgucg

SEQ ID NO: 805352 - RNA, 20 nt, Mycobacterium avium subsp. paratuberculosis
gugccgucgcgggcgucggg

SEQ ID NO: 805353 - RNA, 12 nt, Mycobacterium avium subsp. paratuberculosis
gugccgucggcg

SEQ ID NO: 805354 - RNA, 15 nt, Mycobacterium avium subsp. paratuberculosis
gugccgucggcgucg

SEQ ID NO: 805355 - RNA, 12 nt, Mycobacterium avium subsp. paratuberculosis
gugccggcggcg

SEQ ID NO: 805356 - RNA, 14 nt, Mycobacterium avium subsp. paratuberculosis
gugccggcucggcg

SEQ ID NO: 805357 - RNA, 16 nt, Mycobacterium avium subsp. paratuberculosis
gugccggcucggcggc

SEQ ID NO: 805358 - RNA, 20 nt, Mycobacterium avium subsp. paratuberculosis
gugccggcugaaccugcugg

SEQ ID NO: 805359 - RNA, 19 nt, Mycobacterium avium subsp. paratuberculosis
gugccguccagcuccgccg

SEQ ID NO: 805360 - RNA, 17 nt, Mycobacterium avium subsp. paratuberculosis
gugccugcgggcccagc

SEQ ID NO: 805361 - RNA, 18 nt, Mycobacterium avium subsp. paratuberculosis
gugccugcgggcccagcu

SEQ ID NO: 805362 - RNA, 23 nt, Mycobacterium avium subsp. paratuberculosis
gugccucuucgucggccggcagu

SEQ ID NO: 805363 - RNA, 19 nt, Mycobacterium avium subsp. paratuberculosis
gugccguugaucagggcgg

SEQ ID NO: 805364 - RNA, 19 nt, Mycobacterium avium subsp. paratuberculosis
gugccguggucggugcccu

SEQ ID NO: 805365 - RNA, 12 nt, Mycobacterium avium subsp. paratuberculosis
gugccgcggcgg

SEQ ID NO: 805366 - RNA, 14 nt, Mycobacterium avium subsp. paratuberculosis
gugccgcggcggcg

SEQ ID NO: 805367 - RNA, 14 nt, Mycobacterium avium subsp. paratuberculosis
gugccgaagcgcca

SEQ ID NO: 805368 - RNA, 16 nt, Mycobacterium avium subsp. paratuberculosis
gugccgaagcgccgca

SEQ ID NO: 805369 - RNA, 21 nt, Mycobacterium avium subsp. paratuberculosis
gugccgaagggcaaccgcagc

SEQ ID NO: 805370 - RNA, 15 nt, Mycobacterium avium subsp. paratuberculosis
gugccgaccagccga

SEQ ID NO: 805371 - RNA, 21 nt, Mycobacterium avium subsp. paratuberculosis
gugccgaccgcgugucggcac

SEQ ID NO: 805372 - RNA, 13 nt, Mycobacterium avium subsp. paratuberculosis
gugccgacgaccu

SEQ ID NO: 805373 - RNA, 19 nt, Mycobacterium avium subsp. paratuberculosis
gugccgacgaccucgucgu

SEQ ID NO: 805374 - RNA, 23 nt, Mycobacterium avium subsp. paratuberculosis
gugccgacgaccucgucgucgau

SEQ ID NO: 805375 - RNA, 18 nt, Mycobacterium avium subsp. paratuberculosis
gugccgacgagcucgccg

SEQ ID NO: 805376 - RNA, 19 nt, Mycobacterium avium subsp. paratuberculosis
gugccgacgagcucgccgc

SEQ ID NO: 805377 - RNA, 20 nt, Mycobacterium avium subsp. paratuberculosis
gugccgacgagcucgccgcu

SEQ ID NO: 805378 - RNA, 22 nt, Mycobacterium avium subsp. paratuberculosis
gugccgacgauccgggcgcccu

SEQ ID NO: 805379 - RNA, 19 nt, Mycobacterium avium subsp. paratuberculosis
gugcccgaucucgucggug

SEQ ID NO: 805380 - RNA, 20 nt, Mycobacterium avium subsp. paratuberculosis
gugcccgaucucgucgguga

SEQ ID NO: 805381 - RNA, 16 nt, Mycobacterium avium subsp. paratuberculosis
gugccccguccggcgc

SEQ ID NO: 805382 - RNA, 16 nt, Mycobacterium avium subsp. paratuberculosis
gugccccucgacccga

SEQ ID NO: 805383 - RNA, 18 nt, Mycobacterium avium subsp. paratuberculosis
gugcccgaacgcgcgucg

SEQ ID NO: 805384 - RNA, 20 nt, Mycobacterium avium subsp. paratuberculosis
gugcccgacggcgcgcccga

SEQ ID NO: 805385 - RNA, 22 nt, Mycobacterium avium subsp. paratuberculosis
gugcccgacggcgcgcccgacg

SEQ ID NO: 805386 - RNA, 16 nt, Mycobacterium avium subsp. paratuberculosis
gugcccgagaucaccg

SEQ ID NO: 805387 - RNA, 19 nt, Mycobacterium avium subsp. paratuberculosis
gugcccgagaucaccggcu

SEQ ID NO: 805388 - RNA, 12 nt, Mycobacterium avium subsp. paratuberculosis
gugcccgagcac

SEQ ID NO: 805389 - RNA, 20 nt, Mycobacterium avium subsp. paratuberculosis
gugcccuuccccggcggccg

SEQ ID NO: 805390 - RNA, 22 nt, Mycobacterium avium subsp. paratuberculosis
gugcccuuccccggcggccggc

SEQ ID NO: 805391 - RNA, 15 nt, Mycobacterium avium subsp. paratuberculosis
gugcccuucgaguug

SEQ ID NO: 805392 - RNA, 14 nt, Mycobacterium avium subsp. paratuberculosis
gugcccucguggug

SEQ ID NO: 805393 - RNA, 23 nt, Mycobacterium avium subsp. paratuberculosis
gugccgaacacguacagcggcgg

SEQ ID NO: 805394 - RNA, 13 nt, Mycobacterium avium subsp. paratuberculosis
gugccgaacggcg

SEQ ID NO: 805395 - RNA, 14 nt, Mycobacterium avium subsp. paratuberculosis
gugccgaacggcgc

SEQ ID NO: 805396 - RNA, 17 nt, Mycobacterium avium subsp. paratuberculosis
gugccggaugcggucga

SEQ ID NO: 805397 - RNA, 19 nt, Mycobacterium avium subsp. paratuberculosis
gugccgcugguaggcggcg

SEQ ID NO: 805398 - RNA, 19 nt, Mycobacterium avium subsp. paratuberculosis
gugccgcguuccccggcgu

SEQ ID NO: 805399 - RNA, 15 nt, Mycobacterium avium subsp. paratuberculosis
gugccggaagcggcg

SEQ ID NO: 805400 - RNA, 19 nt, Mycobacterium avium subsp. paratuberculosis
gugccggaaguucucgccg

SEQ ID NO: 805401 - RNA, 16 nt, Mycobacterium avium subsp. paratuberculosis
gugccggccagcucgc

SEQ ID NO: 805402 - RNA, 18 nt, Mycobacterium avium subsp. paratuberculosis
gugccggccagcucgccg

SEQ ID NO: 805403 - RNA, 13 nt, Mycobacterium avium subsp. paratuberculosis
gugccggccaccg

SEQ ID NO: 805404 - RNA, 16 nt, Mycobacterium avium subsp. paratuberculosis
gugccggccaccggcg

SEQ ID NO: 805405 - RNA, 17 nt, Mycobacterium avium subsp. paratuberculosis
gugccggccaccggcgc

SEQ ID NO: 805406 - RNA, 18 nt, Mycobacterium avium subsp. paratuberculosis
gugccggccaccggcgcg

SEQ ID NO: 805407 - RNA, 14 nt, Mycobacterium avium subsp. paratuberculosis
gugccggcagcccg

SEQ ID NO: 805408 - RNA, 15 nt, Mycobacterium avium subsp. paratuberculosis
gugccggcagcccgg

SEQ ID NO: 805409 - RNA, 12 nt, Mycobacterium avium subsp. paratuberculosis
gugccggccggg

SEQ ID NO: 805410 - RNA, 16 nt, Mycobacterium avium subsp. paratuberculosis
gugccggccgggucga

SEQ ID NO: 805411 - RNA, 12 nt, Mycobacterium avium subsp. paratuberculosis
gugccggccggu

SEQ ID NO: 805412 - RNA, 14 nt, Mycobacterium avium subsp. paratuberculosis
gugccggccggucg

SEQ ID NO: 805413 - RNA, 19 nt, Mycobacterium avium subsp. paratuberculosis
gugccggccucgucggcga

SEQ ID NO: 805414 - RNA, 20 nt, Mycobacterium avium subsp. paratuberculosis
gugccggccucgucggcgag

SEQ ID NO: 805415 - RNA, 14 nt, Mycobacterium avium subsp. paratuberculosis
gugccggcgaaccu

SEQ ID NO: 805416 - RNA, 19 nt, Mycobacterium avium subsp. paratuberculosis
gugccggcgaugguggcgc

SEQ ID NO: 805417 - RNA, 16 nt, Mycobacterium avium subsp. paratuberculosis
gugccggcgcaccgcg

SEQ ID NO: 805418 - RNA, 17 nt, Mycobacterium avium subsp. paratuberculosis
gugccggcgcaccgcgu

SEQ ID NO: 805419 - RNA, 13 nt, Mycobacterium avium subsp. paratuberculosis
gugccggcgaacc

SEQ ID NO: 805420 - RNA, 13 nt, Mycobacterium avium subsp. paratuberculosis
gugccggcggcgc

SEQ ID NO: 805421 - RNA, 14 nt, Mycobacterium avium subsp. paratuberculosis
gugccggcggcgcg

SEQ ID NO: 805422 - RNA, 14 nt, Mycobacterium avium subsp. paratuberculosis
gugccggcggcgga

SEQ ID NO: 805423 - RNA, 14 nt, Mycobacterium avium subsp. paratuberculosis
gugccggcggguca

SEQ ID NO: 805424 - RNA, 15 nt, Mycobacterium avium subsp. paratuberculosis
gugcgcagcgcgucg

SEQ ID NO: 805425 - RNA, 19 nt, Mycobacterium avium subsp. paratuberculosis
gugcgcagcgcgucgucgg

SEQ ID NO: 805426 - RNA, 20 nt, Mycobacterium avium subsp. paratuberculosis
gugcgcagcgcgucgucggu

SEQ ID NO: 805427 - RNA, 19 nt, Mycobacterium avium subsp. paratuberculosis
gugcgcagucgcuggucga

SEQ ID NO: 805428 - RNA, 13 nt, Mycobacterium avium subsp. paratuberculosis
gugcgcaggcggc

SEQ ID NO: 805429 - RNA, 13 nt, Mycobacterium avium subsp. paratuberculosis
gugcgcaucggcg

SEQ ID NO: 805430 - RNA, 13 nt, Mycobacterium avium subsp. paratuberculosis
gugcgcauggcgu

SEQ ID NO: 805431 - RNA, 17 nt, Mycobacterium avium subsp. paratuberculosis
gugcgcauucggcgacg

SEQ ID NO: 805432 - RNA, 21 nt, Mycobacterium avium subsp. paratuberculosis
gugcgccgcggcggcucggcg

SEQ ID NO: 805433 - RNA, 14 nt, Mycobacterium avium subsp. paratuberculosis
gugcgcgcgcaccu

SEQ ID NO: 805434 - RNA, 17 nt, Mycobacterium avium subsp. paratuberculosis
gugcgcgccgaccgcga

SEQ ID NO: 805435 - RNA, 12 nt, Mycobacterium avium subsp. paratuberculosis
gugcgcgccgca

SEQ ID NO: 805436 - RNA, 24 nt, Mycobacterium avium subsp. paratuberculosis
gugcgcgacgaauugcagauccag

SEQ ID NO: 805437 - RNA, 20 nt, Mycobacterium avium subsp. paratuberculosis
gugcgcgagauggcgaucag

SEQ ID NO: 805438 - RNA, 13 nt, Mycobacterium avium subsp. paratuberculosis
gugcgcgauggcg

SEQ ID NO: 805439 - RNA, 17 nt, Mycobacterium avium subsp. paratuberculosis
gugcgcgcaccaggccg

SEQ ID NO: 805440 - RNA, 20 nt, Mycobacterium avium subsp. paratuberculosis
gugcgccuugccgucgagca

SEQ ID NO: 805441 - RNA, 21 nt, Mycobacterium avium subsp. paratuberculosis
gugcgccgugcagcacgccgc

SEQ ID NO: 805442 - RNA, 11 nt, Mycobacterium avium subsp. paratuberculosis
gugcgccggca

SEQ ID NO: 805443 - RNA, 13 nt, Mycobacterium avium subsp. paratuberculosis
gugcgccggcagc

SEQ ID NO: 805444 - RNA, 19 nt, Mycobacterium avium subsp. paratuberculosis
gugcgccggcagcggccgc

SEQ ID NO: 805445 - RNA, 20 nt, Mycobacterium avium subsp. paratuberculosis
gugcggggccucgucgccgc

SEQ ID NO: 805446 - RNA, 15 nt, Mycobacterium avium subsp. paratuberculosis
gugcgcuugucggcg

SEQ ID NO: 805447 - RNA, 16 nt, Mycobacterium avium subsp. paratuberculosis
gugcgcuugucggcgu

SEQ ID NO: 805448 - RNA, 20 nt, Mycobacterium avium subsp. paratuberculosis
gugcgcucgugaccggcggu

SEQ ID NO: 805449 - RNA, 16 nt, Mycobacterium avium subsp. paratuberculosis
gugcgcuguggugacg

SEQ ID NO: 805450 - RNA, 19 nt, Mycobacterium avium subsp. paratuberculosis
gugcgcuguggugacggcc

SEQ ID NO: 805451 - RNA, 20 nt, Mycobacterium avium subsp. paratuberculosis
gugcgcuugggucgccgggu

SEQ ID NO: 805452 - RNA, 23 nt, Mycobacterium avium subsp. paratuberculosis
gugcgcguggggcgucgccgccc

SEQ ID NO: 805453 - RNA, 13 nt, Mycobacterium avium subsp. paratuberculosis
gugcgcgucgaca

SEQ ID NO: 805454 - RNA, 13 nt, Mycobacterium avium subsp. paratuberculosis
gugcgcgucgcgg

SEQ ID NO: 805455 - RNA, 14 nt, Mycobacterium avium subsp. paratuberculosis
gugcgcgucgcggu

SEQ ID NO: 805456 - RNA, 16 nt, Mycobacterium avium subsp. paratuberculosis
gugcgcgucgcggugg

SEQ ID NO: 805457 - RNA, 13 nt, Mycobacterium avium subsp. paratuberculosis
gugcgcucaccgc

SEQ ID NO: 805458 - RNA, 14 nt, Mycobacterium avium subsp. paratuberculosis
gugcgcucaccgca

SEQ ID NO: 805459 - RNA, 12 nt, Mycobacterium avium subsp. paratuberculosis
gugcgcucgacc

SEQ ID NO: 805460 - RNA, 19 nt, Mycobacterium avium subsp. paratuberculosis
gugcgcucgaccucggcgg

SEQ ID NO: 805461 - RNA, 20 nt, Mycobacterium avium subsp. paratuberculosis
gugcgcucgaccucggcggc

SEQ ID NO: 805462 - RNA, 22 nt, Mycobacterium avium subsp. paratuberculosis
gugcgcucgaccucggcggcca

SEQ ID NO: 805463 - RNA, 15 nt, Mycobacterium avium subsp. paratuberculosis
gugcgcgggguggcg

SEQ ID NO: 805464 - RNA, 20 nt, Mycobacterium avium subsp. paratuberculosis
gugcgcgggguggcgccggc

SEQ ID NO: 805465 - RNA, 16 nt, Mycobacterium avium subsp. paratuberculosis
gugcgcggucagcgcg

SEQ ID NO: 805466 - RNA, 14 nt, Mycobacterium avium subsp. paratuberculosis
gugcgcggcgagcg

SEQ ID NO: 805467 - RNA, 13 nt, Mycobacterium avium subsp. paratuberculosis
gugcgcgggaacg

SEQ ID NO: 805468 - RNA, 17 nt, Mycobacterium avium subsp. paratuberculosis
gugcgcgucagccgucg

SEQ ID NO: 805469 - RNA, 21 nt, Mycobacterium avium subsp. paratuberculosis
gugcgcgucagccgucgucgu

SEQ ID NO: 805470 - RNA, 21 nt, Mycobacterium avium subsp. paratuberculosis
gugcgcggcuggccgucgucg

SEQ ID NO: 805471 - RNA, 12 nt, Mycobacterium avium subsp. paratuberculosis
gugcgcggcgcg

SEQ ID NO: 805472 - RNA, 13 nt, Mycobacterium avium subsp. paratuberculosis
gugcgcgcgcgcu

SEQ ID NO: 805473 - RNA, 14 nt, Mycobacterium avium subsp. paratuberculosis
gugcgcgcgcgcuc

SEQ ID NO: 805474 - RNA, 19 nt, Mycobacterium avium subsp. paratuberculosis
gugcguuuucggucguagu

SEQ ID NO: 805475 - RNA, 14 nt, Mycobacterium avium subsp. paratuberculosis
gugcguucgcguuc

SEQ ID NO: 805476 - RNA, 17 nt, Mycobacterium avium subsp. paratuberculosis
gugcguucgcguucggg

SEQ ID NO: 805477 - RNA, 16 nt, Mycobacterium avium subsp. paratuberculosis
gugcgugguggggccg

SEQ ID NO: 805478 - RNA, 20 nt, Mycobacterium avium subsp. paratuberculosis
gugcgugucacuacccgcga

SEQ ID NO: 805479 - RNA, 16 nt, Mycobacterium avium subsp. paratuberculosis
gugcggugcaccgcgg

SEQ ID NO: 805480 - RNA, 17 nt, Mycobacterium avium subsp. paratuberculosis
gugcggugcaccgcggc

SEQ ID NO: 805481 - RNA, 21 nt, Mycobacterium avium subsp. paratuberculosis
gugcggugcaccgcggcgcgc

SEQ ID NO: 805482 - RNA, 17 nt, Mycobacterium avium subsp. paratuberculosis
gugcggugcagccgcgg

SEQ ID NO: 805483 - RNA, 16 nt, Mycobacterium avium subsp. paratuberculosis
gugcggugcgccgcau

SEQ ID NO: 805484 - RNA, 16 nt, Mycobacterium avium subsp. paratuberculosis
gugcggugcggccgcg

SEQ ID NO: 805485 - RNA, 16 nt, Mycobacterium avium subsp. paratuberculosis
gugcgugaccugcugg

SEQ ID NO: 805486 - RNA, 21 nt, Mycobacterium avium subsp. paratuberculosis
gugcgugccagcagcucgugg

SEQ ID NO: 805487 - RNA, 14 nt, Mycobacterium avium subsp. paratuberculosis
gugcgugcgcucga

SEQ ID NO: 805488 - RNA, 21 nt, Mycobacterium avium subsp. paratuberculosis
gugcgguaggugccggccgcg

SEQ ID NO: 805489 - RNA, 17 nt, Mycobacterium avium subsp. paratuberculosis
gugcggguguccgagcg

SEQ ID NO: 805490 - RNA, 14 nt, Mycobacterium avium subsp. paratuberculosis
gugcggguuggcgc

SEQ ID NO: 805491 - RNA, 18 nt, Mycobacterium avium subsp. paratuberculosis
gugcggguuggcgccggu

SEQ ID NO: 805492 - RNA, 15 nt, Mycobacterium avium subsp. paratuberculosis
gugcgggucgcgcgg

SEQ ID NO: 805493 - RNA, 22 nt, Mycobacterium avium subsp. paratuberculosis
gugcgggucgguggugaucgcg

SEQ ID NO: 805494 - RNA, 13 nt, Mycobacterium avium subsp. paratuberculosis
gugcgggucucga

SEQ ID NO: 805495 - RNA, 16 nt, Mycobacterium avium subsp. paratuberculosis
gugcgggugccgaaca

SEQ ID NO: 805496 - RNA, 15 nt, Mycobacterium avium subsp. paratuberculosis
gugcggucccggucg

SEQ ID NO: 805497 - RNA, 13 nt, Mycobacterium avium subsp. paratuberculosis
gugcggucgauga

SEQ ID NO: 805498 - RNA, 21 nt, Mycobacterium avium subsp. paratuberculosis
gugcggucgaugacgccgcgc

SEQ ID NO: 805499 - RNA, 12 nt, Mycobacterium avium subsp. paratuberculosis
gugcggucgcgc

SEQ ID NO: 805500 - RNA, 13 nt, Mycobacterium avium subsp. paratuberculosis
gugcggucgcgca

SEQ ID NO: 805501 - RNA, 16 nt, Mycobacterium avium subsp. paratuberculosis
gugcggucgcgcagcc

SEQ ID NO: 805502 - RNA, 17 nt, Mycobacterium avium subsp. paratuberculosis
gugcggucgcgcagccg

SEQ ID NO: 805503 - RNA, 15 nt, Mycobacterium avium subsp. paratuberculosis
gugcggucgcgggac

SEQ ID NO: 805504 - RNA, 13 nt, Mycobacterium avium subsp. paratuberculosis
gugcggucggcga

SEQ ID NO: 805505 - RNA, 13 nt, Mycobacterium avium subsp. paratuberculosis
gugcggucggcgu

SEQ ID NO: 805506 - RNA, 15 nt, Mycobacterium avium subsp. paratuberculosis
gugcggucggcgucg

SEQ ID NO: 805507 - RNA, 19 nt, Mycobacterium avium subsp. paratuberculosis
gugcucaucuacgucgucg

SEQ ID NO: 805508 - RNA, 20 nt, Mycobacterium avium subsp. paratuberculosis
gugcucaucuacgucgucgc

SEQ ID NO: 805509 - RNA, 16 nt, Mycobacterium avium subsp. paratuberculosis
gugcucagccgcacgg

SEQ ID NO: 805510 - RNA, 16 nt, Mycobacterium avium subsp. paratuberculosis
gugcuacugccgacgc

SEQ ID NO: 805511 - RNA, 15 nt, Mycobacterium avium subsp. paratuberculosis
gugcuagcgagcggg

SEQ ID NO: 805512 - RNA, 16 nt, Mycobacterium avium subsp. paratuberculosis
gugcuagcgagcgggc

SEQ ID NO: 805513 - RNA, 14 nt, Mycobacterium avium subsp. paratuberculosis
gugcucccagcuca

SEQ ID NO: 805514 - RNA, 15 nt, Mycobacterium avium subsp. paratuberculosis
gugcucuugacggcc

SEQ ID NO: 805515 - RNA, 23 nt, Mycobacterium avium subsp. paratuberculosis
gugcucuugacggccgcggcggu

SEQ ID NO: 805516 - RNA, 14 nt, Mycobacterium avium subsp. paratuberculosis
gugcucuccgcugu

SEQ ID NO: 805517 - RNA, 15 nt, Mycobacterium avium subsp. paratuberculosis
gugcucucgucgucg

SEQ ID NO: 805518 - RNA, 17 nt, Mycobacterium avium subsp. paratuberculosis
gugcugaacgccugccg

SEQ ID NO: 805519 - RNA, 21 nt, Mycobacterium avium subsp. paratuberculosis
gugcugaacgccugccggcgc

SEQ ID NO: 805520 - RNA, 19 nt, Mycobacterium avium subsp. paratuberculosis
gugcugcccuugugguugc

SEQ ID NO: 805521 - RNA, 13 nt, Mycobacterium avium subsp. paratuberculosis
gugcucaucagcg

SEQ ID NO: 805522 - RNA, 13 nt, Mycobacterium avium subsp. paratuberculosis
gugcugcccggcg

SEQ ID NO: 805523 - RNA, 15 nt, Mycobacterium avium subsp. paratuberculosis
gugcugcccggcgcg

SEQ ID NO: 805524 - RNA, 21 nt, Mycobacterium avium subsp. paratuberculosis
gugcugcagauccgcucgccg

SEQ ID NO: 805525 - RNA, 14 nt, Mycobacterium avium subsp. paratuberculosis
gugcugcagcgcga

SEQ ID NO: 805526 - RNA, 23 nt, Mycobacterium avium subsp. paratuberculosis
gugcugcagguugauccggaucc

SEQ ID NO: 805527 - RNA, 15 nt, Mycobacterium avium subsp. paratuberculosis
gugcugacgucgucg

SEQ ID NO: 805528 - RNA, 16 nt, Mycobacterium avium subsp. paratuberculosis
gugcugacgucgucgc

SEQ ID NO: 805529 - RNA, 14 nt, Mycobacterium avium subsp. paratuberculosis
gugcugagcguggu

SEQ ID NO: 805530 - RNA, 16 nt, Mycobacterium avium subsp. paratuberculosis
gugcugacccagcgcg

SEQ ID NO: 805531 - RNA, 18 nt, Mycobacterium avium subsp. paratuberculosis
gugcugacccagcgcggg

SEQ ID NO: 805532 - RNA, 18 nt, Mycobacterium avium subsp. paratuberculosis
gugcugauccacgcccgg

SEQ ID NO: 805533 - RNA, 22 nt, Mycobacterium avium subsp. paratuberculosis
gugcugauccacgcccggaccc

SEQ ID NO: 805534 - RNA, 13 nt, Mycobacterium avium subsp. paratuberculosis
gugccccacgcca

SEQ ID NO: 805535 - RNA, 22 nt, Mycobacterium avium subsp. paratuberculosis
gugccccgcuggaucccgguga

SEQ ID NO: 805536 - RNA, 12 nt, Mycobacterium avium subsp. paratuberculosis
gugcccagcgcg

SEQ ID NO: 805537 - RNA, 16 nt, Mycobacterium avium subsp. paratuberculosis
gugcccagcgcgaggu

SEQ ID NO: 805538 - RNA, 14 nt, Mycobacterium avium subsp. paratuberculosis
gugccagccggccg

SEQ ID NO: 805539 - RNA, 15 nt, Mycobacterium avium subsp. paratuberculosis
gugccagccggccgc

SEQ ID NO: 805540 - RNA, 22 nt, Mycobacterium avium subsp. paratuberculosis
gugcccagccaggccgccgggc

SEQ ID NO: 805541 - RNA, 14 nt, Mycobacterium avium subsp. paratuberculosis
gugccagcaacaca

SEQ ID NO: 805542 - RNA, 14 nt, Mycobacterium avium subsp. paratuberculosis
gugccagccgaagu

SEQ ID NO: 805543 - RNA, 23 nt, Mycobacterium avium subsp. paratuberculosis
gugccacggccgcggcccggcca

SEQ ID NO: 805544 - RNA, 17 nt, Mycobacterium avium subsp. paratuberculosis
gugccacggucaggcgc

SEQ ID NO: 805545 - RNA, 20 nt, Mycobacterium avium subsp. paratuberculosis
gugccacggucaggcgcagc

SEQ ID NO: 805546 - RNA, 13 nt, Mycobacterium avium subsp. paratuberculosis
gugccacuggcgc

SEQ ID NO: 805547 - RNA, 17 nt, Mycobacterium avium subsp. paratuberculosis
gugccacuggcgccacc

SEQ ID NO: 805548 - RNA, 19 nt, Mycobacterium avium subsp. paratuberculosis
gugccacuggcgccaccuc

SEQ ID NO: 805549 - RNA, 19 nt, Mycobacterium avium subsp. paratuberculosis
gugccacuucgacggcagc

SEQ ID NO: 805550 - RNA, 20 nt, Mycobacterium avium subsp. paratuberculosis
gugccacuucgacggcagcg

SEQ ID NO: 805551 - RNA, 20 nt, Mycobacterium avium subsp. paratuberculosis
gugccaccgccgauggcgac

SEQ ID NO: 805552 - RNA, 22 nt, Mycobacterium avium subsp. paratuberculosis
gugccaccgcugggcggcgcgg

SEQ ID NO: 805553 - RNA, 18 nt, Mycobacterium avium subsp. paratuberculosis
gugccaccaccacggcca

SEQ ID NO: 805554 - RNA, 17 nt, Mycobacterium avium subsp. paratuberculosis
gugcauccagucggcgc

SEQ ID NO: 805555 - RNA, 18 nt, Mycobacterium avium subsp. paratuberculosis
gugcaggguguuggacga

SEQ ID NO: 805556 - RNA, 15 nt, Mycobacterium avium subsp. paratuberculosis
gugcaguucgaugcc

SEQ ID NO: 805557 - RNA, 19 nt, Mycobacterium avium subsp. paratuberculosis
gugcagggggcgcagccga

SEQ ID NO: 805558 - RNA, 20 nt, Mycobacterium avium subsp. paratuberculosis
gugcaggugcccgucggccu

SEQ ID NO: 805559 - RNA, 18 nt, Mycobacterium avium subsp. paratuberculosis
gugcagguuccggaucaa

SEQ ID NO: 805560 - RNA, 19 nt, Mycobacterium avium subsp. paratuberculosis
gugcaguacgcaucggcgc

SEQ ID NO: 805561 - RNA, 20 nt, Mycobacterium avium subsp. paratuberculosis
gugcagugcgaucgccguga

SEQ ID NO: 805562 - RNA, 20 nt, Mycobacterium avium subsp. paratuberculosis
gugcacgugcaggugcggca

SEQ ID NO: 805563 - RNA, 16 nt, Mycobacterium avium subsp. paratuberculosis
gugcagaacagcacga

SEQ ID NO: 805564 - RNA, 14 nt, Mycobacterium avium subsp. paratuberculosis
gugcacucggcgau

SEQ ID NO: 805565 - RNA, 19 nt, Mycobacterium avium subsp. paratuberculosis
gugcacucggcgaugcgcc

SEQ ID NO: 805566 - RNA, 22 nt, Mycobacterium avium subsp. paratuberculosis
gugcagaucguccaucgcgucg

SEQ ID NO: 805567 - RNA, 15 nt, Mycobacterium avium subsp. paratuberculosis
gugcagaccccggcg

SEQ ID NO: 805568 - RNA, 17 nt, Mycobacterium avium subsp. paratuberculosis
gugcagaccccggcguc

SEQ ID NO: 805569 - RNA, 18 nt, Mycobacterium avium subsp. paratuberculosis
gugcagaccccggcgucc

SEQ ID NO: 805570 - RNA, 15 nt, Mycobacterium avium subsp. paratuberculosis
gugcagacgugacgu

SEQ ID NO: 805571 - RNA, 16 nt, Mycobacterium avium subsp. paratuberculosis
gugcagcagcgccgcg

SEQ ID NO: 805572 - RNA, 17 nt, Mycobacterium avium subsp. paratuberculosis
gugcagcagcgccgcga

SEQ ID NO: 805573 - RNA, 13 nt, Mycobacterium avium subsp. paratuberculosis
gugcagcagcucg

SEQ ID NO: 805574 - RNA, 22 nt, Mycobacterium avium subsp. paratuberculosis
gugcagcaguuccggagcgcgg

SEQ ID NO: 805575 - RNA, 20 nt, Mycobacterium avium subsp. paratuberculosis
gugcagccacccgucgguga

SEQ ID NO: 805576 - RNA, 14 nt, Mycobacterium avium subsp. paratuberculosis
gugcagcaccgcca

SEQ ID NO: 805577 - RNA, 16 nt, Mycobacterium avium subsp. paratuberculosis
gugcagcaccgccagc

SEQ ID NO: 805578 - RNA, 17 nt, Mycobacterium avium subsp. paratuberculosis
gugcagcaccgccagca

SEQ ID NO: 805579 - RNA, 15 nt, Mycobacterium avium subsp. paratuberculosis
gugcagcacgccgcg

SEQ ID NO: 805580 - RNA, 21 nt, Mycobacterium avium subsp. paratuberculosis
gugcagcaccacgaacgcugc

SEQ ID NO: 805581 - RNA, 14 nt, Mycobacterium avium subsp. paratuberculosis
gugcagcacgggga

SEQ ID NO: 805582 - RNA, 15 nt, Mycobacterium avium subsp. paratuberculosis
gugcagcagcagcca

SEQ ID NO: 805583 - RNA, 17 nt, Mycobacterium avium subsp. paratuberculosis
gugcagcagcagccacg

SEQ ID NO: 805584 - RNA, 23 nt, Mycobacterium avium subsp. paratuberculosis
gugcagcagcagccacgccagcc

SEQ ID NO: 805585 - RNA, 15 nt, Mycobacterium avium subsp. paratuberculosis
gugcaagcucgccag

SEQ ID NO: 805586 - RNA, 14 nt, Mycobacterium avium subsp. paratuberculosis
gugcaaggcgaugc

SEQ ID NO: 805587 - RNA, 15 nt, Mycobacterium avium subsp. paratuberculosis
gugcaaggcgaugcc

SEQ ID NO: 805588 - RNA, 23 nt, Mycobacterium avium subsp. paratuberculosis
gugcaacgugaugccguggucgg

SEQ ID NO: 805589 - RNA, 15 nt, Mycobacterium avium subsp. paratuberculosis
gugcaacuaccgacg

SEQ ID NO: 805590 - RNA, 22 nt, Mycobacterium avium subsp. paratuberculosis
gugcaacucccgcgccgcggcc

SEQ ID NO: 805591 - RNA, 16 nt, Mycobacterium avium subsp. paratuberculosis
gugcaacuggcaacgc

SEQ ID NO: 805592 - RNA, 19 nt, Mycobacterium avium subsp. paratuberculosis
gugcaaaccggaccgccgc

SEQ ID NO: 805593 - RNA, 17 nt, Mycobacterium avium subsp. paratuberculosis
gugcaaaagcauccggc

SEQ ID NO: 805594 - RNA, 13 nt, Mycobacterium avium subsp. paratuberculosis
gugcaacaccgaa

SEQ ID NO: 805595 - RNA, 22 nt, Mycobacterium avium subsp. paratuberculosis
gugcacgaucgcggugacgcgc

SEQ ID NO: 805596 - RNA, 20 nt, Mycobacterium avium subsp. paratuberculosis
gugcacgccgagcagcaccg

SEQ ID NO: 805597 - RNA, 22 nt, Mycobacterium avium subsp. paratuberculosis
gugcacgccgagcagcaccggc

SEQ ID NO: 805598 - RNA, 20 nt, Mycobacterium avium subsp. paratuberculosis
gugcacgccgaggcgugccg

SEQ ID NO: 805599 - RNA, 20 nt, Mycobacterium avium subsp. paratuberculosis
gugcacgccguggcggcggg

SEQ ID NO: 805600 - RNA, 18 nt, Mycobacterium avium subsp. paratuberculosis
gugcacgccgucgugcuc

SEQ ID NO: 805601 - RNA, 14 nt, Mycobacterium avium subsp. paratuberculosis
gugcacgcucggcg

SEQ ID NO: 805602 - RNA, 15 nt, Mycobacterium avium subsp. paratuberculosis
gugcacgcucggcgc

SEQ ID NO: 805603 - RNA, 17 nt, Mycobacterium avium subsp. paratuberculosis
gugcacgcucggcgcga

SEQ ID NO: 805604 - RNA, 16 nt, Mycobacterium avium subsp. paratuberculosis
gugcacggacagcuca

SEQ ID NO: 805605 - RNA, 18 nt, Mycobacterium avium subsp. paratuberculosis
gugcacggacagcucacc

SEQ ID NO: 805606 - RNA, 23 nt, Mycobacterium avium subsp. paratuberculosis
gugcacggccaacugcaucgcca

SEQ ID NO: 805607 - RNA, 23 nt, Mycobacterium avium subsp. paratuberculosis
gugcacggcgccgugccgcgcgg

SEQ ID NO: 805608 - RNA, 17 nt, Mycobacterium avium subsp. paratuberculosis
gugcacggucagcucgc

SEQ ID NO: 805609 - RNA, 18 nt, Mycobacterium avium subsp. paratuberculosis
gugcacggucagcucgcg

SEQ ID NO: 805610 - RNA, 23 nt, Mycobacterium avium subsp. paratuberculosis
gugcacggucagcucgcgcccgg

SEQ ID NO: 805611 - RNA, 20 nt, Mycobacterium avium subsp. paratuberculosis
gugaucggcggccaccagcc

SEQ ID NO: 805612 - RNA, 22 nt, Mycobacterium avium subsp. paratuberculosis
gugaucggcggccaccagccgg

SEQ ID NO: 805613 - RNA, 17 nt, Mycobacterium avium subsp. paratuberculosis
gugaucucaccggcggc

SEQ ID NO: 805614 - RNA, 21 nt, Mycobacterium avium subsp. paratuberculosis
gugaucucaccggcggcggcc

SEQ ID NO: 805615 - RNA, 22 nt, Mycobacterium avium subsp. paratuberculosis
gugaucucaccggcggcggccu

SEQ ID NO: 805616 - RNA, 21 nt, Mycobacterium avium subsp. paratuberculosis
gugaucucccgugcgguccac

SEQ ID NO: 805617 - RNA, 21 nt, Mycobacterium avium subsp. paratuberculosis
gugaucucgccgagcacaccg

SEQ ID NO: 805618 - RNA, 15 nt, Mycobacterium avium subsp. paratuberculosis
gugaucucgccgcgg

SEQ ID NO: 805619 - RNA, 18 nt, Mycobacterium avium subsp. paratuberculosis
gugaucucgccgcggugg

SEQ ID NO: 805620 - RNA, 17 nt, Mycobacterium avium subsp. paratuberculosis
gugaucucgugccgcac

SEQ ID NO: 805621 - RNA, 23 nt, Mycobacterium avium subsp. paratuberculosis
gugaugaaaaccgggcccucguc

SEQ ID NO: 805622 - RNA, 22 nt, Mycobacterium avium subsp. paratuberculosis
gugaucuuguuguuggugccgc

SEQ ID NO: 805623 - RNA, 15 nt, Mycobacterium avium subsp. paratuberculosis
gugaucuugcccagc

SEQ ID NO: 805624 - RNA, 15 nt, Mycobacterium avium subsp. paratuberculosis
gugaucuggucggcc

SEQ ID NO: 805625 - RNA, 18 nt, Mycobacterium avium subsp. paratuberculosis
gugaucuggucggccagc

SEQ ID NO: 805626 - RNA, 18 nt, Mycobacterium avium subsp. paratuberculosis
gugaucuguucggcggcg

SEQ ID NO: 805627 - RNA, 15 nt, Mycobacterium avium subsp. paratuberculosis
gugaugaccagggcc

SEQ ID NO: 805628 - RNA, 21 nt, Mycobacterium avium subsp. paratuberculosis
gugaugcagcagguugcggug

SEQ ID NO: 805629 - RNA, 14 nt, Mycobacterium avium subsp. paratuberculosis
gugaugaacgcgcc

SEQ ID NO: 805630 - RNA, 15 nt, Mycobacterium avium subsp. paratuberculosis
gugaugacggcggcg

SEQ ID NO: 805631 - RNA, 14 nt, Mycobacterium avium subsp. paratuberculosis
gugaugacguuggu

SEQ ID NO: 805632 - RNA, 18 nt, Mycobacterium avium subsp. paratuberculosis
gugaugaggucgcgaccg

SEQ ID NO: 805633 - RNA, 22 nt, Mycobacterium avium subsp. paratuberculosis
gugaugaggucgcgaccgccgg

SEQ ID NO: 805634 - RNA, 13 nt, Mycobacterium avium subsp. paratuberculosis
gugaugaucgccg

SEQ ID NO: 805635 - RNA, 17 nt, Mycobacterium avium subsp. paratuberculosis
gugaugccgagcgccgc

SEQ ID NO: 805636 - RNA, 20 nt, Mycobacterium avium subsp. paratuberculosis
gugaugccgaguuccugcga

SEQ ID NO: 805637 - RNA, 17 nt, Mycobacterium avium subsp. paratuberculosis
gugaugccguggucggc

SEQ ID NO: 805638 - RNA, 19 nt, Mycobacterium avium subsp. paratuberculosis
gugaugccguggucggcga

SEQ ID NO: 805639 - RNA, 22 nt, Mycobacterium avium subsp. paratuberculosis
gugaugccggacuugaugcugc

SEQ ID NO: 805640 - RNA, 19 nt, Mycobacterium avium subsp. paratuberculosis
gugaugccggcauccucgg

SEQ ID NO: 805641 - RNA, 15 nt, Mycobacterium avium subsp. paratuberculosis
gugaugccggccagc

SEQ ID NO: 805642 - RNA, 15 nt, Mycobacterium avium subsp. paratuberculosis
gugaugccggcggua

SEQ ID NO: 805643 - RNA, 23 nt, Mycobacterium avium subsp. paratuberculosis
gugaugccguccagcaacgccga

SEQ ID NO: 805644 - RNA, 16 nt, Mycobacterium avium subsp. paratuberculosis
gugaugcggucggcgc

SEQ ID NO: 805645 - RNA, 14 nt, Mycobacterium avium subsp. paratuberculosis
gugauggccgccgc

SEQ ID NO: 805646 - RNA, 21 nt, Mycobacterium avium subsp. paratuberculosis
gugauggcgaaccagcgcccg

SEQ ID NO: 805647 - RNA, 15 nt, Mycobacterium avium subsp. paratuberculosis
gugaugggcagcgcc

SEQ ID NO: 805648 - RNA, 18 nt, Mycobacterium avium subsp. paratuberculosis
gugaugggcagcgccccg

SEQ ID NO: 805649 - RNA, 13 nt, Mycobacterium avium subsp. paratuberculosis
gugauggccaucu

SEQ ID NO: 805650 - RNA, 20 nt, Mycobacterium avium subsp. paratuberculosis
gugaugcggaugcccgccgg

SEQ ID NO: 805651 - RNA, 19 nt, Mycobacterium avium subsp. paratuberculosis
gugauggucaccgugucgg

SEQ ID NO: 805652 - RNA, 19 nt, Mycobacterium avium subsp. paratuberculosis
gugaugucgacgucgucga

SEQ ID NO: 805653 - RNA, 13 nt, Mycobacterium avium subsp. paratuberculosis
gugaugucgccga

SEQ ID NO: 805654 - RNA, 17 nt, Mycobacterium avium subsp. paratuberculosis
gugaugucgccggcggc

SEQ ID NO: 805655 - RNA, 19 nt, Mycobacterium avium subsp. paratuberculosis
gugaugucgcugccgccgc

SEQ ID NO: 805656 - RNA, 22 nt, Mycobacterium avium subsp. paratuberculosis
gugauggucucccgggcggucg

SEQ ID NO: 805657 - RNA, 13 nt, Mycobacterium avium subsp. paratuberculosis
gugauucgaagaa

SEQ ID NO: 805658 - RNA, 13 nt, Mycobacterium avium subsp. paratuberculosis
gugauucgcgcgg

SEQ ID NO: 805659 - RNA, 20 nt, Mycobacterium avium subsp. paratuberculosis
gugaugucacccucgaggcc

SEQ ID NO: 805660 - RNA, 18 nt, Mycobacterium avium subsp. paratuberculosis
gugauccggaaugcggug

SEQ ID NO: 805661 - RNA, 22 nt, Mycobacterium avium subsp. paratuberculosis
gugauccggaaugcggugcugc

SEQ ID NO: 805662 - RNA, 17 nt, Mycobacterium avium subsp. paratuberculosis
gugauccggugccacgc

SEQ ID NO: 805663 - RNA, 19 nt, Mycobacterium avium subsp. paratuberculosis
gugauccggugccacgcgg

SEQ ID NO: 805664 - RNA, 20 nt, Mycobacterium avium subsp. paratuberculosis
gugauccucgucuccggcgg

SEQ ID NO: 805665 - RNA, 21 nt, Mycobacterium avium subsp. paratuberculosis
gugauccucgucuccggcggc

SEQ ID NO: 805666 - RNA, 23 nt, Mycobacterium avium subsp. paratuberculosis
gugauccagcccugcucggccag

SEQ ID NO: 805667 - RNA, 15 nt, Mycobacterium avium subsp. paratuberculosis
gugauccacgcggug

SEQ ID NO: 805668 - RNA, 18 nt, Mycobacterium avium subsp. paratuberculosis
gugaucccaggaacgcgc

SEQ ID NO: 805669 - RNA, 23 nt, Mycobacterium avium subsp. paratuberculosis
gugaucacgauguugggccaugc

SEQ ID NO: 805670 - RNA, 13 nt, Mycobacterium avium subsp. paratuberculosis
gugaucagcagca

SEQ ID NO: 805671 - RNA, 15 nt, Mycobacterium avium subsp. paratuberculosis
gugaucagcagcagg

SEQ ID NO: 805672 - RNA, 20 nt, Mycobacterium avium subsp. paratuberculosis
gugaucaggcccucgucggc

SEQ ID NO: 805673 - RNA, 20 nt, Mycobacterium avium subsp. paratuberculosis
gugaucgcgaacgcgccggu

SEQ ID NO: 805674 - RNA, 20 nt, Mycobacterium avium subsp. paratuberculosis
gugaucgccggaucgccgag

SEQ ID NO: 805675 - RNA, 15 nt, Mycobacterium avium subsp. paratuberculosis
gugaucgcggcccac

SEQ ID NO: 805676 - RNA, 16 nt, Mycobacterium avium subsp. paratuberculosis
gugaucgcggcccacc

SEQ ID NO: 805677 - RNA, 20 nt, Mycobacterium avium subsp. paratuberculosis
gugaucgcggcccgcggggc

SEQ ID NO: 805678 - RNA, 22 nt, Mycobacterium avium subsp. paratuberculosis
gugaucgcggcgcugccgccgg

SEQ ID NO: 805679 - RNA, 15 nt, Mycobacterium avium subsp. paratuberculosis
gugaucgcgguggcu

SEQ ID NO: 805680 - RNA, 22 nt, Mycobacterium avium subsp. paratuberculosis
gugaucgcgucaaccaccggca

SEQ ID NO: 805681 - RNA, 15 nt, Mycobacterium avium subsp. paratuberculosis
gugaucgcugacgcc

SEQ ID NO: 805682 - RNA, 15 nt, Mycobacterium avium subsp. paratuberculosis
gugaucggccaggcg

SEQ ID NO: 805683 - RNA, 16 nt, Mycobacterium avium subsp. paratuberculosis
gugaucggccaggcgc

SEQ ID NO: 805684 - RNA, 21 nt, Mycobacterium avium subsp. paratuberculosis
gugaucggccaggcgcccagc

SEQ ID NO: 805685 - RNA, 16 nt, Mycobacterium avium subsp. paratuberculosis
gugaucgccgcggacc

SEQ ID NO: 805686 - RNA, 19 nt, Mycobacterium avium subsp. paratuberculosis
gugaucgccaccaccagcg

SEQ ID NO: 805687 - RNA, 15 nt, Mycobacterium avium subsp. paratuberculosis
gugaucgccacggcg

SEQ ID NO: 805688 - RNA, 19 nt, Mycobacterium avium subsp. paratuberculosis
gugaucgaaacgccgcgcu

SEQ ID NO: 805689 - RNA, 15 nt, Mycobacterium avium subsp. paratuberculosis
gugaucgagcaccag

SEQ ID NO: 805690 - RNA, 17 nt, Mycobacterium avium subsp. paratuberculosis
gugaucgagcaccagcg

SEQ ID NO: 805691 - RNA, 16 nt, Mycobacterium avium subsp. paratuberculosis
gugaucaaagccggug

SEQ ID NO: 805692 - RNA, 21 nt, Mycobacterium avium subsp. paratuberculosis
gugaucaaagccgguggcagc

SEQ ID NO: 805693 - RNA, 21 nt, Mycobacterium avium subsp. paratuberculosis
gugaucaacgcggacacggcc

SEQ ID NO: 805694 - RNA, 13 nt, Mycobacterium avium subsp. paratuberculosis
gucggcguggccg

SEQ ID NO: 805695 - RNA, 16 nt, Mycobacterium avium subsp. paratuberculosis
gucggcguggccgucc

SEQ ID NO: 805696 - RNA, 17 nt, Mycobacterium avium subsp. paratuberculosis
gucggcgucgggccggg

SEQ ID NO: 805697 - RNA, 20 nt, Mycobacterium avium subsp. paratuberculosis
gucggcgucgggccgggggc

SEQ ID NO: 805698 - RNA, 20 nt, Mycobacterium avium subsp. paratuberculosis
gucggcgucgggcggggugu

SEQ ID NO: 805699 - RNA, 20 nt, Mycobacterium avium subsp. paratuberculosis
gucggcgucguacagcagcc

SEQ ID NO: 805700 - RNA, 24 nt, Mycobacterium avium subsp. paratuberculosis
gucggcgucuucggggauguagcc

SEQ ID NO: 805701 - RNA, 15 nt, Mycobacterium avium subsp. paratuberculosis
gucggcgugcagcac

SEQ ID NO: 805702 - RNA, 17 nt, Mycobacterium avium subsp. paratuberculosis
gucggcgugcccgccga

SEQ ID NO: 805703 - RNA, 18 nt, Mycobacterium avium subsp. paratuberculosis
gucggcgugcccgccgac

SEQ ID NO: 805704 - RNA, 20 nt, Mycobacterium avium subsp. paratuberculosis
gucggcgugcucgucgcgga

SEQ ID NO: 805705 - RNA, 20 nt, Mycobacterium avium subsp. paratuberculosis
gucggcguagggcagcccga

SEQ ID NO: 805706 - RNA, 20 nt, Mycobacterium avium subsp. paratuberculosis
gucggcgucaccccaccgag

SEQ ID NO: 805707 - RNA, 13 nt, Mycobacterium avium subsp. paratuberculosis
gucggcguccagc

SEQ ID NO: 805708 - RNA, 17 nt, Mycobacterium avium subsp. paratuberculosis
gucggcguccagcgcgg

SEQ ID NO: 805709 - RNA, 18 nt, Mycobacterium avium subsp. paratuberculosis
gucggcguccagcgcggu

SEQ ID NO: 805710 - RNA, 14 nt, Mycobacterium avium subsp. paratuberculosis
gucggcggccgacc

SEQ ID NO: 805711 - RNA, 23 nt, Mycobacterium avium subsp. paratuberculosis
gucggcggacuggcugagcagca

SEQ ID NO: 805712 - RNA, 20 nt, Mycobacterium avium subsp. paratuberculosis
gucggcggagaugacgugga

SEQ ID NO: 805713 - RNA, 16 nt, Mycobacterium avium subsp. paratuberculosis
gucggcgucgaacggc

SEQ ID NO: 805714 - RNA, 22 nt, Mycobacterium avium subsp. paratuberculosis
gucggcgucgaacggcgucugg

SEQ ID NO: 805715 - RNA, 14 nt, Mycobacterium avium subsp. paratuberculosis
gucggcgucgaagg

SEQ ID NO: 805716 - RNA, 14 nt, Mycobacterium avium subsp. paratuberculosis
gucggcgucgaucg

SEQ ID NO: 805717 - RNA, 22 nt, Mycobacterium avium subsp. paratuberculosis
gucggcgucgaugucgucgucg

SEQ ID NO: 805718 - RNA, 15 nt, Mycobacterium avium subsp. paratuberculosis
gucggcgucgccgag

SEQ ID NO: 805719 - RNA, 19 nt, Mycobacterium avium subsp. paratuberculosis
gucggcgucgccgagccgc

SEQ ID NO: 805720 - RNA, 21 nt, Mycobacterium avium subsp. paratuberculosis
gucggcgucgccgagccgcgc

SEQ ID NO: 805721 - RNA, 14 nt, Mycobacterium avium subsp. paratuberculosis
gucggcgucgcggc

SEQ ID NO: 805722 - RNA, 18 nt, Mycobacterium avium subsp. paratuberculosis
gucggcgucgcggcgcac

SEQ ID NO: 805723 - RNA, 19 nt, Mycobacterium avium subsp. paratuberculosis
gucggcgucggaggcggcg

SEQ ID NO: 805724 - RNA, 15 nt, Mycobacterium avium subsp. paratuberculosis
gucggcgucggccac

SEQ ID NO: 805725 - RNA, 16 nt, Mycobacterium avium subsp. paratuberculosis
gucggcgucggccacc

SEQ ID NO: 805726 - RNA, 17 nt, Mycobacterium avium subsp. paratuberculosis
gucggcgucggccaccg

SEQ ID NO: 805727 - RNA, 21 nt, Mycobacterium avium subsp. paratuberculosis
uaaaggaugucgccgcagauc

SEQ ID NO: 805728 - RNA, 14 nt, Mycobacterium avium subsp. paratuberculosis
guuuccccagcccg

SEQ ID NO: 805729 - RNA, 21 nt, Mycobacterium avium subsp. paratuberculosis
guuuccacgugcacggcgccg

SEQ ID NO: 805730 - RNA, 15 nt, Mycobacterium avium subsp. paratuberculosis
guuuccagcgccggc

SEQ ID NO: 805731 - RNA, 14 nt, Mycobacterium avium subsp. paratuberculosis
guuucaccgccguc

SEQ ID NO: 805732 - RNA, 14 nt, Mycobacterium avium subsp. paratuberculosis
guuucaccgugcgc

SEQ ID NO: 805733 - RNA, 19 nt, Mycobacterium avium subsp. paratuberculosis
guuucaccgugcgcgcgca

SEQ ID NO: 805734 - RNA, 17 nt, Mycobacterium avium subsp. paratuberculosis
guuucacguucgcgguc

SEQ ID NO: 805735 - RNA, 20 nt, Mycobacterium avium subsp. paratuberculosis
uaaccucggcggcggcgcgc

SEQ ID NO: 805736 - RNA, 22 nt, Mycobacterium avium subsp. paratuberculosis
uaacgaguaggcggcuccgauc

SEQ ID NO: 805737 - RNA, 13 nt, Mycobacterium avium subsp. paratuberculosis
uaaucggcggugg

SEQ ID NO: 805738 - RNA, 20 nt, Mycobacterium avium subsp. paratuberculosis
guuguugaccgcggacacgc

SEQ ID NO: 805739 - RNA, 23 nt, Mycobacterium avium subsp. paratuberculosis
guuguugcgcgggaagccgccgc

SEQ ID NO: 805740 - RNA, 17 nt, Mycobacterium avium subsp. paratuberculosis
guuguucuccagcggcc

SEQ ID NO: 805741 - RNA, 13 nt, Mycobacterium avium subsp. paratuberculosis
guuguggcggcca

SEQ ID NO: 805742 - RNA, 14 nt, Mycobacterium avium subsp. paratuberculosis
guuguggcggccag

SEQ ID NO: 805743 - RNA, 13 nt, Mycobacterium avium subsp. paratuberculosis
guuguucaccggc

SEQ ID NO: 805744 - RNA, 16 nt, Mycobacterium avium subsp. paratuberculosis
guuggcgcgcaccagc

SEQ ID NO: 805745 - RNA, 13 nt, Mycobacterium avium subsp. paratuberculosis
guuggccgcgacg

SEQ ID NO: 805746 - RNA, 16 nt, Mycobacterium avium subsp. paratuberculosis
guuggccgcgacgccg

SEQ ID NO: 805747 - RNA, 19 nt, Mycobacterium avium subsp. paratuberculosis
guuggccgcgacgccgccg

SEQ ID NO: 805748 - RNA, 20 nt, Mycobacterium avium subsp. paratuberculosis
guuggccgcgacgccgccgc

SEQ ID NO: 805749 - RNA, 19 nt, Mycobacterium avium subsp. paratuberculosis
guuggccggaaucgcggga

SEQ ID NO: 805750 - RNA, 18 nt, Mycobacterium avium subsp. paratuberculosis
guuggcggcggcccgcgc

SEQ ID NO: 805751 - RNA, 15 nt, Mycobacterium avium subsp. paratuberculosis
guuggcggcgguggg

SEQ ID NO: 805752 - RNA, 20 nt, Mycobacterium avium subsp. paratuberculosis
guuggcggcgucgucgccgu

SEQ ID NO: 805753 - RNA, 21 nt, Mycobacterium avium subsp. paratuberculosis
guuggcguagugggucggcgg

SEQ ID NO: 805754 - RNA, 14 nt, Mycobacterium avium subsp. paratuberculosis
guuggcgucgggca

SEQ ID NO: 805755 - RNA, 14 nt, Mycobacterium avium subsp. paratuberculosis
guuggcgucgucgg

SEQ ID NO: 805756 - RNA, 16 nt, Mycobacterium avium subsp. paratuberculosis
guuggcgucgucggcg

SEQ ID NO: 805757 - RNA, 17 nt, Mycobacterium avium subsp. paratuberculosis
guuggcgucgucggcgg

SEQ ID NO: 805758 - RNA, 20 nt, Mycobacterium avium subsp. paratuberculosis
guuggcguggauggccggcc

SEQ ID NO: 805759 - RNA, 22 nt, Mycobacterium avium subsp. paratuberculosis
guuggcgugucggugauggccg

SEQ ID NO: 805760 - RNA, 16 nt, Mycobacterium avium subsp. paratuberculosis
guuguccagcagcgcc

SEQ ID NO: 805761 - RNA, 22 nt, Mycobacterium avium subsp. paratuberculosis
guuguccagccggugcaccacg

SEQ ID NO: 805762 - RNA, 17 nt, Mycobacterium avium subsp. paratuberculosis
guugucgaacagccggu

SEQ ID NO: 805763 - RNA, 19 nt, Mycobacterium avium subsp. paratuberculosis
guugucccgggcgaacguc

SEQ ID NO: 805764 - RNA, 16 nt, Mycobacterium avium subsp. paratuberculosis
guugucgagcaccgcg

SEQ ID NO: 805765 - RNA, 20 nt, Mycobacterium avium subsp. paratuberculosis
guugucgagcaccgcgauca

SEQ ID NO: 805766 - RNA, 23 nt, Mycobacterium avium subsp. paratuberculosis
guugucgaggucggugaggcugg

SEQ ID NO: 805767 - RNA, 20 nt, Mycobacterium avium subsp. paratuberculosis
guugucgaugaugucguugg

SEQ ID NO: 805768 - RNA, 19 nt, Mycobacterium avium subsp. paratuberculosis
guugucgccgcgccagccg

SEQ ID NO: 805769 - RNA, 21 nt, Mycobacterium avium subsp. paratuberculosis
guugucgccgcgccagccgcc

SEQ ID NO: 805770 - RNA, 14 nt, Mycobacterium avium subsp. paratuberculosis
guugugcaccggca

SEQ ID NO: 805771 - RNA, 13 nt, Mycobacterium avium subsp. paratuberculosis
guugugccaccgc

SEQ ID NO: 805772 - RNA, 15 nt, Mycobacterium avium subsp. paratuberculosis
guugugccaccgccg

SEQ ID NO: 805773 - RNA, 21 nt, Mycobacterium avium subsp. paratuberculosis
guugugccaccgccgauggcg

SEQ ID NO: 805774 - RNA, 17 nt, Mycobacterium avium subsp. paratuberculosis
guugugcccgacggcgc

SEQ ID NO: 805775 - RNA, 14 nt, Mycobacterium avium subsp. paratuberculosis
guugugcucgucga

SEQ ID NO: 805776 - RNA, 15 nt, Mycobacterium avium subsp. paratuberculosis
guugucggcgacggc

SEQ ID NO: 805777 - RNA, 21 nt, Mycobacterium avium subsp. paratuberculosis
guugucgucgggcaccacggc

SEQ ID NO: 805778 - RNA, 22 nt, Mycobacterium avium subsp. paratuberculosis
guugucgucgggcaccacggcg

SEQ ID NO: 805779 - RNA, 19 nt, Mycobacterium avium subsp. paratuberculosis
guugucguucuccccgcgg

SEQ ID NO: 805780 - RNA, 15 nt, Mycobacterium avium subsp. paratuberculosis
guugucucggcgccg

SEQ ID NO: 805781 - RNA, 23 nt, Mycobacterium avium subsp. paratuberculosis
guugugaauccagccgugcggcu

SEQ ID NO: 805782 - RNA, 16 nt, Mycobacterium avium subsp. paratuberculosis
guugugacccgcucgg

SEQ ID NO: 805783 - RNA, 15 nt, Mycobacterium avium subsp. paratuberculosis
guuggagccguccgg

SEQ ID NO: 805784 - RNA, 15 nt, Mycobacterium avium subsp. paratuberculosis
guuggcaucccgcgc

SEQ ID NO: 805785 - RNA, 16 nt, Mycobacterium avium subsp. paratuberculosis
guuggcaucccgcgcc

SEQ ID NO: 805786 - RNA, 23 nt, Mycobacterium avium subsp. paratuberculosis
guuggcaucccgcgccugccugg

SEQ ID NO: 805787 - RNA, 16 nt, Mycobacterium avium subsp. paratuberculosis
guuggccagaugcccg

SEQ ID NO: 805788 - RNA, 14 nt, Mycobacterium avium subsp. paratuberculosis
guuggccagcucgg

SEQ ID NO: 805789 - RNA, 20 nt, Mycobacterium avium subsp. paratuberculosis
guuggccagcucggccaucc

SEQ ID NO: 805790 - RNA, 14 nt, Mycobacterium avium subsp. paratuberculosis
guuggccagguggc

SEQ ID NO: 805791 - RNA, 16 nt, Mycobacterium avium subsp. paratuberculosis
guuggccagguggccg

SEQ ID NO: 805792 - RNA, 16 nt, Mycobacterium avium subsp. paratuberculosis
guuggcccgcaccacc

SEQ ID NO: 805793 - RNA, 17 nt, Mycobacterium avium subsp. paratuberculosis
guuggcccgcaccaccc

SEQ ID NO: 805794 - RNA, 15 nt, Mycobacterium avium subsp. paratuberculosis
guuggcccgccgcgg

SEQ ID NO: 805795 - RNA, 14 nt, Mycobacterium avium subsp. paratuberculosis
guuggcccgcggcg

SEQ ID NO: 805796 - RNA, 17 nt, Mycobacterium avium subsp. paratuberculosis
guuggcccgcggcgccc

SEQ ID NO: 805797 - RNA, 18 nt, Mycobacterium avium subsp. paratuberculosis
guuggcccgcggcgcccg

SEQ ID NO: 805798 - RNA, 21 nt, Mycobacterium avium subsp. paratuberculosis
guuggccgagcagccgggcca

SEQ ID NO: 805799 - RNA, 19 nt, Mycobacterium avium subsp. paratuberculosis
guuggcccugcucuucgcg

SEQ ID NO: 805800 - RNA, 16 nt, Mycobacterium avium subsp. paratuberculosis
guuggcccuucgaccu

SEQ ID NO: 805801 - RNA, 14 nt, Mycobacterium avium subsp. paratuberculosis
guuggaaccggcca

SEQ ID NO: 805802 - RNA, 13 nt, Mycobacterium avium subsp. paratuberculosis
guugcgcgccgau

SEQ ID NO: 805803 - RNA, 23 nt, Mycobacterium avium subsp. paratuberculosis
guugcgccgccagggcgcggcgc

SEQ ID NO: 805804 - RNA, 18 nt, Mycobacterium avium subsp. paratuberculosis
guugcgccguccggccac

SEQ ID NO: 805805 - RNA, 17 nt, Mycobacterium avium subsp. paratuberculosis
guugcgccgcaacggcg

SEQ ID NO: 805806 - RNA, 20 nt, Mycobacterium avium subsp. paratuberculosis
guugcgccgaggucaccgcg

SEQ ID NO: 805807 - RNA, 19 nt, Mycobacterium avium subsp. paratuberculosis
guugcgccgcgagcgcagc

SEQ ID NO: 805808 - RNA, 20 nt, Mycobacterium avium subsp. paratuberculosis
guugcgccgcgagcgcagca

SEQ ID NO: 805809 - RNA, 14 nt, Mycobacterium avium subsp. paratuberculosis
guugcgcaugacgg

SEQ ID NO: 805810 - RNA, 16 nt, Mycobacterium avium subsp. paratuberculosis
guugcgccagcaccga

SEQ ID NO: 805811 - RNA, 23 nt, Mycobacterium avium subsp. paratuberculosis
guugcgagucaucgccacccgca

SEQ ID NO: 805812 - RNA, 17 nt, Mycobacterium avium subsp. paratuberculosis
guugcgcacccgcgggu

SEQ ID NO: 805813 - RNA, 13 nt, Mycobacterium avium subsp. paratuberculosis
guugccggcccgc

SEQ ID NO: 805814 - RNA, 14 nt, Mycobacterium avium subsp. paratuberculosis
guugccggcccgca

SEQ ID NO: 805815 - RNA, 14 nt, Mycobacterium avium subsp. paratuberculosis
guugccggcggcca

SEQ ID NO: 805816 - RNA, 20 nt, Mycobacterium avium subsp. paratuberculosis
guugccggcggccagcaucg

SEQ ID NO: 805817 - RNA, 15 nt, Mycobacterium avium subsp. paratuberculosis
guugccggguaucga

SEQ ID NO: 805818 - RNA, 18 nt, Mycobacterium avium subsp. paratuberculosis
guugccgcgcgcccgcgg

SEQ ID NO: 805819 - RNA, 20 nt, Mycobacterium avium subsp. paratuberculosis
guugccggacaccuggaguc

SEQ ID NO: 805820 - RNA, 19 nt, Mycobacterium avium subsp. paratuberculosis
guugccgugcugggacagc

SEQ ID NO: 805821 - RNA, 22 nt, Mycobacterium avium subsp. paratuberculosis
guugccgugggggucgacccgc

SEQ ID NO: 805822 - RNA, 17 nt, Mycobacterium avium subsp. paratuberculosis
guugcgaccccgccguc

SEQ ID NO: 805823 - RNA, 20 nt, Mycobacterium avium subsp. paratuberculosis
guugcgaccccgccgucgac

SEQ ID NO: 805824 - RNA, 20 nt, Mycobacterium avium subsp. paratuberculosis
guugcgaaagcccaggcccg

SEQ ID NO: 805825 - RNA, 22 nt, Mycobacterium avium subsp. paratuberculosis
guugagcagcagaccgccggug

SEQ ID NO: 805826 - RNA, 22 nt, Mycobacterium avium subsp. paratuberculosis
guugagcacaaagccggucacg

SEQ ID NO: 805827 - RNA, 23 nt, Mycobacterium avium subsp. paratuberculosis
guugagcacacacaggucgcccg

SEQ ID NO: 805828 - RNA, 14 nt, Mycobacterium avium subsp. paratuberculosis
guugagcaccacga

SEQ ID NO: 805829 - RNA, 23 nt, Mycobacterium avium subsp. paratuberculosis
guugagcacccggaugucguaga

SEQ ID NO: 805830 - RNA, 17 nt, Mycobacterium avium subsp. paratuberculosis
guugagcccggaccggc

SEQ ID NO: 805831 - RNA, 17 nt, Mycobacterium avium subsp. paratuberculosis
guugagccggcgcaccg

SEQ ID NO: 805832 - RNA, 19 nt, Mycobacterium avium subsp. paratuberculosis
guugagcguggacaccgca

SEQ ID NO: 805833 - RNA, 21 nt, Mycobacterium avium subsp. paratuberculosis
guugagcguggcagcggucgg

SEQ ID NO: 805834 - RNA, 23 nt, Mycobacterium avium subsp. paratuberculosis
guugagcguggcagcggucggcg

SEQ ID NO: 805835 - RNA, 15 nt, Mycobacterium avium subsp. paratuberculosis
guugccgccgcgcgc

SEQ ID NO: 805836 - RNA, 17 nt, Mycobacterium avium subsp. paratuberculosis
guugccgccgcgcgcgg

SEQ ID NO: 805837 - RNA, 20 nt, Mycobacterium avium subsp. paratuberculosis
guugccgccgcgcgcggcca

SEQ ID NO: 805838 - RNA, 15 nt, Mycobacterium avium subsp. paratuberculosis
guugccgccggcgcc

SEQ ID NO: 805839 - RNA, 16 nt, Mycobacterium avium subsp. paratuberculosis
guugccgccggcgccc

SEQ ID NO: 805840 - RNA, 13 nt, Mycobacterium avium subsp. paratuberculosis
guugccgccggcg

SEQ ID NO: 805841 - RNA, 15 nt, Mycobacterium avium subsp. paratuberculosis
guucguugcgccgcc

SEQ ID NO: 805842 - RNA, 20 nt, Mycobacterium avium subsp. paratuberculosis
guucuccauccgggcggcca

SEQ ID NO: 805843 - RNA, 13 nt, Mycobacterium avium subsp. paratuberculosis
guucuccccgccg

SEQ ID NO: 805844 - RNA, 18 nt, Mycobacterium avium subsp. paratuberculosis
guucgugagcgguggcca

SEQ ID NO: 805845 - RNA, 16 nt, Mycobacterium avium subsp. paratuberculosis
guucgucggucacgga

SEQ ID NO: 805846 - RNA, 17 nt, Mycobacterium avium subsp. paratuberculosis
guucgucgucgcgcagg

SEQ ID NO: 805847 - RNA, 21 nt, Mycobacterium avium subsp. paratuberculosis
guucgucgucgcgcaggucgg

SEQ ID NO: 805848 - RNA, 21 nt, Mycobacterium avium subsp. paratuberculosis
guucguagggacugcgccggg

SEQ ID NO: 805849 - RNA, 20 nt, Mycobacterium avium subsp. paratuberculosis
guucgucaacgccccggucg

SEQ ID NO: 805850 - RNA, 13 nt, Mycobacterium avium subsp. paratuberculosis
guucgucccgcgc

SEQ ID NO: 805851 - RNA, 15 nt, Mycobacterium avium subsp. paratuberculosis
guucgucccgcgcgg

SEQ ID NO: 805852 - RNA, 16 nt, Mycobacterium avium subsp. paratuberculosis
guucguccgugcugcc

SEQ ID NO: 805853 - RNA, 14 nt, Mycobacterium avium subsp. paratuberculosis
guucgucgccggug

SEQ ID NO: 805854 - RNA, 15 nt, Mycobacterium avium subsp. paratuberculosis
guucgucgccgguga

SEQ ID NO: 805855 - RNA, 22 nt, Mycobacterium avium subsp. paratuberculosis
guucgucggccgucggcgccgc

SEQ ID NO: 805856 - RNA, 15 nt, Mycobacterium avium subsp. paratuberculosis
guucgguggccaccg

SEQ ID NO: 805857 - RNA, 19 nt, Mycobacterium avium subsp. paratuberculosis
guucgguggccaccgcgac

SEQ ID NO: 805858 - RNA, 16 nt, Mycobacterium avium subsp. paratuberculosis
guucggugcacggcgc

SEQ ID NO: 805859 - RNA, 19 nt, Mycobacterium avium subsp. paratuberculosis
guucggugcacggcgccac

SEQ ID NO: 805860 - RNA, 15 nt, Mycobacterium avium subsp. paratuberculosis
guucggugcccgggg

SEQ ID NO: 805861 - RNA, 16 nt, Mycobacterium avium subsp. paratuberculosis
guucgguggggccgcc

SEQ ID NO: 805862 - RNA, 18 nt, Mycobacterium avium subsp. paratuberculosis
guucgguggggccgccgu

SEQ ID NO: 805863 - RNA, 17 nt, Mycobacterium avium subsp. paratuberculosis
guucggucagcacgaca

SEQ ID NO: 805864 - RNA, 21 nt, Mycobacterium avium subsp. paratuberculosis
guucgggcccacacuguucgg

SEQ ID NO: 805865 - RNA, 17 nt, Mycobacterium avium subsp. paratuberculosis
guucgggaaccuggccg

SEQ ID NO: 805866 - RNA, 18 nt, Mycobacterium avium subsp. paratuberculosis
guucgggauccucgccgc

SEQ ID NO: 805867 - RNA, 15 nt, Mycobacterium avium subsp. paratuberculosis
guucgggaucgucgc

SEQ ID NO: 805868 - RNA, 16 nt, Mycobacterium avium subsp. paratuberculosis
guucggcgucgaaauc

SEQ ID NO: 805869 - RNA, 16 nt, Mycobacterium avium subsp. paratuberculosis
guucggcggcgcggcc

SEQ ID NO: 805870 - RNA, 16 nt, Mycobacterium avium subsp. paratuberculosis
guucggcgggcaggcc

SEQ ID NO: 805871 - RNA, 22 nt, Mycobacterium avium subsp. paratuberculosis
guucggcgcggaucgucaccga

SEQ ID NO: 805872 - RNA, 12 nt, Mycobacterium avium subsp. paratuberculosis
guucggcggccc

SEQ ID NO: 805873 - RNA, 20 nt, Mycobacterium avium subsp. paratuberculosis
guucggcggcgauccggccg

SEQ ID NO: 805874 - RNA, 13 nt, Mycobacterium avium subsp. paratuberculosis
guucggcgccagc

SEQ ID NO: 805875 - RNA, 16 nt, Mycobacterium avium subsp. paratuberculosis
guucggcgccagccgc

SEQ ID NO: 805876 - RNA, 22 nt, Mycobacterium avium subsp. paratuberculosis
guucggcgccagccgcaccgcg

SEQ ID NO: 805877 - RNA, 17 nt, Mycobacterium avium subsp. paratuberculosis
guucggcgacgcuggug

SEQ ID NO: 805878 - RNA, 21 nt, Mycobacterium avium subsp. paratuberculosis
guucggcgacgcugguggccu

SEQ ID NO: 805879 - RNA, 19 nt, Mycobacterium avium subsp. paratuberculosis
guucugggcgggcucgagc

SEQ ID NO: 805880 - RNA, 20 nt, Mycobacterium avium subsp. paratuberculosis
guucugcgugcggguggccg

SEQ ID NO: 805881 - RNA, 13 nt, Mycobacterium avium subsp. paratuberculosis
guucugcucgaag

SEQ ID NO: 805882 - RNA, 19 nt, Mycobacterium avium subsp. paratuberculosis
guucucggcgaacagcggg

SEQ ID NO: 805883 - RNA, 14 nt, Mycobacterium avium subsp. paratuberculosis
guucugcaccagcu

SEQ ID NO: 805884 - RNA, 13 nt, Mycobacterium avium subsp. paratuberculosis
guucugcacgugg

SEQ ID NO: 805885 - RNA, 23 nt, Mycobacterium avium subsp. paratuberculosis
guucucggaguaguuccggcggu

SEQ ID NO: 805886 - RNA, 14 nt, Mycobacterium avium subsp. paratuberculosis
guucuccucgucgc

SEQ ID NO: 805887 - RNA, 12 nt, Mycobacterium avium subsp. paratuberculosis
guucuccggccc

SEQ ID NO: 805888 - RNA, 14 nt, Mycobacterium avium subsp. paratuberculosis
guucuccggcccgc

SEQ ID NO: 805889 - RNA, 16 nt, Mycobacterium avium subsp. paratuberculosis
guucuccagcacccgc

SEQ ID NO: 805890 - RNA, 15 nt, Mycobacterium avium subsp. paratuberculosis
guucuggccgugguc

SEQ ID NO: 805891 - RNA, 13 nt, Mycobacterium avium subsp. paratuberculosis
guugaagcuggcc

SEQ ID NO: 805892 - RNA, 16 nt, Mycobacterium avium subsp. paratuberculosis
guugaagcuggccacc

SEQ ID NO: 805893 - RNA, 16 nt, Mycobacterium avium subsp. paratuberculosis
guugaaguccggcggu

SEQ ID NO: 805894 - RNA, 14 nt, Mycobacterium avium subsp. paratuberculosis
guugaagucgauca

SEQ ID NO: 805895 - RNA, 14 nt, Mycobacterium avium subsp. paratuberculosis
guugaaguuggcca

SEQ ID NO: 805896 - RNA, 15 nt, Mycobacterium avium subsp. paratuberculosis
guugacaccaccgag

SEQ ID NO: 805897 - RNA, 15 nt, Mycobacterium avium subsp. paratuberculosis
guugacgucggugua

SEQ ID NO: 805898 - RNA, 17 nt, Mycobacterium avium subsp. paratuberculosis
guugacgugcaccggcg

SEQ ID NO: 805899 - RNA, 18 nt, Mycobacterium avium subsp. paratuberculosis
guugacgugcaccggcga

SEQ ID NO: 805900 - RNA, 16 nt, Mycobacterium avium subsp. paratuberculosis
guugaccaggugggcg

SEQ ID NO: 805901 - RNA, 21 nt, Mycobacterium avium subsp. paratuberculosis
guugacguugaucgcgccgau

SEQ ID NO: 805902 - RNA, 17 nt, Mycobacterium avium subsp. paratuberculosis
guugaccccgacggcgc

SEQ ID NO: 805903 - RNA, 22 nt, Mycobacterium avium subsp. paratuberculosis
guugaccccgacggcgccgcgg

SEQ ID NO: 805904 - RNA, 15 nt, Mycobacterium avium subsp. paratuberculosis
guucgccggccagca

SEQ ID NO: 805905 - RNA, 20 nt, Mycobacterium avium subsp. paratuberculosis
guucgccggcgacggccagc

SEQ ID NO: 805906 - RNA, 13 nt, Mycobacterium avium subsp. paratuberculosis
guucgccggcgua

SEQ ID NO: 805907 - RNA, 19 nt, Mycobacterium avium subsp. paratuberculosis
guucgccgguaccgccggc

SEQ ID NO: 805908 - RNA, 19 nt, Mycobacterium avium subsp. paratuberculosis
guucgccggugaccgcgcc

SEQ ID NO: 805909 - RNA, 21 nt, Mycobacterium avium subsp. paratuberculosis
guucgccggugaccugcagcg

SEQ ID NO: 805910 - RNA, 21 nt, Mycobacterium avium subsp. paratuberculosis
guucgcgccgguaggcggcca

SEQ ID NO: 805911 - RNA, 23 nt, Mycobacterium avium subsp. paratuberculosis
guucgcgccgguaggcggccagc

SEQ ID NO: 805912 - RNA, 20 nt, Mycobacterium avium subsp. paratuberculosis
guucgcgcacgcuggccggc

SEQ ID NO: 805913 - RNA, 19 nt, Mycobacterium avium subsp. paratuberculosis
guucgcgcagccaccgccc

SEQ ID NO: 805914 - RNA, 12 nt, Mycobacterium avium subsp. paratuberculosis
guucgcgcagcu

SEQ ID NO: 805915 - RNA, 15 nt, Mycobacterium avium subsp. paratuberculosis
guucgcggcgcagca

SEQ ID NO: 805916 - RNA, 18 nt, Mycobacterium avium subsp. paratuberculosis
guucgcggcgcagcacgg

SEQ ID NO: 805917 - RNA, 14 nt, Mycobacterium avium subsp. paratuberculosis
guucgcggcgcagc

SEQ ID NO: 805918 - RNA, 15 nt, Mycobacterium avium subsp. paratuberculosis
guucgcggcuggccg

SEQ ID NO: 805919 - RNA, 16 nt, Mycobacterium avium subsp. paratuberculosis
guucgcggcuggccgc

SEQ ID NO: 805920 - RNA, 20 nt, Mycobacterium avium subsp. paratuberculosis
guucgcggcuggccgcggcg

SEQ ID NO: 805921 - RNA, 18 nt, Mycobacterium avium subsp. paratuberculosis
guucggaguccaccggcg

SEQ ID NO: 805922 - RNA, 22 nt, Mycobacterium avium subsp. paratuberculosis
guucggccaauuccucagcccg

SEQ ID NO: 805923 - RNA, 14 nt, Mycobacterium avium subsp. paratuberculosis
guucggccaccgcg

SEQ ID NO: 805924 - RNA, 15 nt, Mycobacterium avium subsp. paratuberculosis
guucggccaccgcgc

SEQ ID NO: 805925 - RNA, 17 nt, Mycobacterium avium subsp. paratuberculosis
guucggccaccgcgcgg

SEQ ID NO: 805926 - RNA, 17 nt, Mycobacterium avium subsp. paratuberculosis
guucggccaccgcgucc

SEQ ID NO: 805927 - RNA, 19 nt, Mycobacterium avium subsp. paratuberculosis
guucggccaccgcguccgc

SEQ ID NO: 805928 - RNA, 19 nt, Mycobacterium avium subsp. paratuberculosis
guucggccaguucgggucc

SEQ ID NO: 805929 - RNA, 17 nt, Mycobacterium avium subsp. paratuberculosis
guucggccagcgcggug

SEQ ID NO: 805930 - RNA, 18 nt, Mycobacterium avium subsp. paratuberculosis
guucggccagcgccgcca

SEQ ID NO: 805931 - RNA, 14 nt, Mycobacterium avium subsp. paratuberculosis
guucggccagcgcg

SEQ ID NO: 805932 - RNA, 22 nt, Mycobacterium avium subsp. paratuberculosis
guucgcguugagcgucgccacc

SEQ ID NO: 805933 - RNA, 19 nt, Mycobacterium avium subsp. paratuberculosis
guucgcugcccucggucgc

SEQ ID NO: 805934 - RNA, 21 nt, Mycobacterium avium subsp. paratuberculosis
guucgcugcccucggucgccg

SEQ ID NO: 805935 - RNA, 22 nt, Mycobacterium avium subsp. paratuberculosis
guucgcugcccucggucgccga

SEQ ID NO: 805936 - RNA, 17 nt, Mycobacterium avium subsp. paratuberculosis
guucggacaccucggcc

SEQ ID NO: 805937 - RNA, 19 nt, Mycobacterium avium subsp. paratuberculosis
guucggacacggcgccgug

SEQ ID NO: 805938 - RNA, 16 nt, Mycobacterium avium subsp. paratuberculosis
guucgcuuucgccggg

SEQ ID NO: 805939 - RNA, 19 nt, Mycobacterium avium subsp. paratuberculosis
guucgcuuucgccgggcgu

SEQ ID NO: 805940 - RNA, 13 nt, Mycobacterium avium subsp. paratuberculosis
guucgcuggcggc

SEQ ID NO: 805941 - RNA, 14 nt, Mycobacterium avium subsp. paratuberculosis
guucgcuggcggcc

SEQ ID NO: 805942 - RNA, 17 nt, Mycobacterium avium subsp. paratuberculosis
guucgcuggcggccagc

SEQ ID NO: 805943 - RNA, 17 nt, Mycobacterium avium subsp. paratuberculosis
guucgcuggcggggcgu

SEQ ID NO: 805944 - RNA, 15 nt, Mycobacterium avium subsp. paratuberculosis
guucaagccggcgug

SEQ ID NO: 805945 - RNA, 17 nt, Mycobacterium avium subsp. paratuberculosis
guucgaccuccacccgc

SEQ ID NO: 805946 - RNA, 18 nt, Mycobacterium avium subsp. paratuberculosis
guucgaccuccacccgcu

SEQ ID NO: 805947 - RNA, 14 nt, Mycobacterium avium subsp. paratuberculosis
guucgaccucggug

SEQ ID NO: 805948 - RNA, 14 nt, Mycobacterium avium subsp. paratuberculosis
guucgacgccggug

SEQ ID NO: 805949 - RNA, 17 nt, Mycobacterium avium subsp. paratuberculosis
guucgacgccucggugc

SEQ ID NO: 805950 - RNA, 23 nt, Mycobacterium avium subsp. paratuberculosis
guucgaguccugguaccccagca

SEQ ID NO: 805951 - RNA, 19 nt, Mycobacterium avium subsp. paratuberculosis
guucgaguaggcgaccaca

SEQ ID NO: 805952 - RNA, 18 nt, Mycobacterium avium subsp. paratuberculosis
guucgagggcgcggcgua

SEQ ID NO: 805953 - RNA, 19 nt, Mycobacterium avium subsp. paratuberculosis
guucgauaccguccgcgcc

SEQ ID NO: 805954 - RNA, 22 nt, Mycobacterium avium subsp. paratuberculosis
guucgauaccguccgcgcccac

SEQ ID NO: 805955 - RNA, 14 nt, Mycobacterium avium subsp. paratuberculosis
guucgagcgccgcg

SEQ ID NO: 805956 - RNA, 23 nt, Mycobacterium avium subsp. paratuberculosis
guucgagaguuugcccucgucga

SEQ ID NO: 805957 - RNA, 17 nt, Mycobacterium avium subsp. paratuberculosis
guucgagaugcguucgg

SEQ ID NO: 805958 - RNA, 18 nt, Mycobacterium avium subsp. paratuberculosis
guucgacguagcccgccg

SEQ ID NO: 805959 - RNA, 19 nt, Mycobacterium avium subsp. paratuberculosis
guucgacguagcccgccga

SEQ ID NO: 805960 - RNA, 18 nt, Mycobacterium avium subsp. paratuberculosis
guucgacgucacgacggu

SEQ ID NO: 805961 - RNA, 19 nt, Mycobacterium avium subsp. paratuberculosis
guucgacgugaucuggucg

SEQ ID NO: 805962 - RNA, 12 nt, Mycobacterium avium subsp. paratuberculosis
guucgccgaugu

SEQ ID NO: 805963 - RNA, 23 nt, Mycobacterium avium subsp. paratuberculosis
guucgccgauguccccgcgggug

SEQ ID NO: 805964 - RNA, 19 nt, Mycobacterium avium subsp. paratuberculosis
guucgccgccagcacguga

SEQ ID NO: 805965 - RNA, 14 nt, Mycobacterium avium subsp. paratuberculosis
guucgcccuccccg

SEQ ID NO: 805966 - RNA, 17 nt, Mycobacterium avium subsp. paratuberculosis
guucgcccuccccggcc

SEQ ID NO: 805967 - RNA, 15 nt, Mycobacterium avium subsp. paratuberculosis
guucgccagcaugcg

SEQ ID NO: 805968 - RNA, 14 nt, Mycobacterium avium subsp. paratuberculosis
guucgcccuggccg

SEQ ID NO: 805969 - RNA, 16 nt, Mycobacterium avium subsp. paratuberculosis
guucgccgacaccgca

SEQ ID NO: 805970 - RNA, 14 nt, Mycobacterium avium subsp. paratuberculosis
guucgccgacagca

SEQ ID NO: 805971 - RNA, 19 nt, Mycobacterium avium subsp. paratuberculosis
guucgccgacagcagcuca

SEQ ID NO: 805972 - RNA, 19 nt, Mycobacterium avium subsp. paratuberculosis
guucgccgaggaaccggca

SEQ ID NO: 805973 - RNA, 21 nt, Mycobacterium avium subsp. paratuberculosis
guucgcccgcagcacgcccgu

SEQ ID NO: 805974 - RNA, 20 nt, Mycobacterium avium subsp. paratuberculosis
guucgcaccccaccgacagc

SEQ ID NO: 805975 - RNA, 16 nt, Mycobacterium avium subsp. paratuberculosis
guucgaugucggccag

SEQ ID NO: 805976 - RNA, 19 nt, Mycobacterium avium subsp. paratuberculosis
guucgauccgccggugccg

SEQ ID NO: 805977 - RNA, 17 nt, Mycobacterium avium subsp. paratuberculosis
guucgaucuccucggcg

SEQ ID NO: 805978 - RNA, 15 nt, Mycobacterium avium subsp. paratuberculosis
guucgaucucgucgg

SEQ ID NO: 805979 - RNA, 17 nt, Mycobacterium avium subsp. paratuberculosis
guucgaugacgucgcgc

SEQ ID NO: 805980 - RNA, 18 nt, Mycobacterium avium subsp. paratuberculosis
guucgaugacgucgcgcu

SEQ ID NO: 805981 - RNA, 23 nt, Mycobacterium avium subsp. paratuberculosis
agcgguuuggauggcccgccaga

SEQ ID NO: 805982 - RNA, 20 nt, Mycobacterium avium subsp. paratuberculosis
agcgguuccagaccggcggc

SEQ ID NO: 805983 - RNA, 23 nt, Mycobacterium avium subsp. paratuberculosis
agcgguuccagaccggcggcgau

SEQ ID NO: 805984 - RNA, 17 nt, Mycobacterium avium subsp. paratuberculosis
agcgguucgaucucguc

SEQ ID NO: 805985 - RNA, 21 nt, Mycobacterium avium subsp. paratuberculosis
agcgguucgaucucgucgggu

SEQ ID NO: 805986 - RNA, 23 nt, Mycobacterium avium subsp. paratuberculosis
agcguagaacauccacggcaugg

SEQ ID NO: 805987 - RNA, 20 nt, Mycobacterium avium subsp. paratuberculosis
agcguacccaggucggcgug

SEQ ID NO: 805988 - RNA, 15 nt, Mycobacterium avium subsp. paratuberculosis
agcguauccggccag

SEQ ID NO: 805989 - RNA, 21 nt, Mycobacterium avium subsp. paratuberculosis
agcguauccggccagccgggg

SEQ ID NO: 805990 - RNA, 17 nt, Mycobacterium avium subsp. paratuberculosis
agcguaugccgguggcg

SEQ ID NO: 805991 - RNA, 14 nt, Mycobacterium avium subsp. paratuberculosis
agcgucacgccagc

SEQ ID NO: 805992 - RNA, 17 nt, Mycobacterium avium subsp. paratuberculosis
agcgucacgccagcgug

SEQ ID NO: 805993 - RNA, 18 nt, Mycobacterium avium subsp. paratuberculosis
agcgucacgccagcguga

SEQ ID NO: 805994 - RNA, 21 nt, Mycobacterium avium subsp. paratuberculosis
agcgucacgccagcgugacgc

SEQ ID NO: 805995 - RNA, 22 nt, Mycobacterium avium subsp. paratuberculosis
agcgucacgccaguguggccgc

SEQ ID NO: 805996 - RNA, 13 nt, Mycobacterium avium subsp. paratuberculosis
agcgucacgccgc

SEQ ID NO: 805997 - RNA, 15 nt, Mycobacterium avium subsp. paratuberculosis
agcgucacgccgcgc

SEQ ID NO: 805998 - RNA, 18 nt, Mycobacterium avium subsp. paratuberculosis
agcgucacgccgcgcccg

SEQ ID NO: 805999 - RNA, 19 nt, Mycobacterium avium subsp. paratuberculosis
agcgucacgccgcgcccgu

SEQ ID NO: 806000 - RNA, 18 nt, Mycobacterium avium subsp. paratuberculosis
agcgucacgcuagcguga

SEQ ID NO: 806001 - RNA, 20 nt, Mycobacterium avium subsp. paratuberculosis
agcgucacgcuagcgugaca

SEQ ID NO: 806002 - RNA, 21 nt, Mycobacterium avium subsp. paratuberculosis
agcgucacgcuagcgugacag

SEQ ID NO: 806003 - RNA, 15 nt, Mycobacterium avium subsp. paratuberculosis
agcgucacgcuggcg

SEQ ID NO: 806004 - RNA, 16 nt, Mycobacterium avium subsp. paratuberculosis
agcgucacgcuggcgu

SEQ ID NO: 806005 - RNA, 17 nt, Mycobacterium avium subsp. paratuberculosis
agcgucacgcuggcgug

SEQ ID NO: 806006 - RNA, 18 nt, Mycobacterium avium subsp. paratuberculosis
agcgucacgcuggcguga

SEQ ID NO: 806007 - RNA, 20 nt, Mycobacterium avium subsp. paratuberculosis
agcgucacgcuggcgugacg

SEQ ID NO: 806008 - RNA, 19 nt, Mycobacterium avium subsp. paratuberculosis
agcgucaccaaugcgccgg

SEQ ID NO: 806009 - RNA, 20 nt, Mycobacterium avium subsp. paratuberculosis
agcgucaccaaugcgccggc

SEQ ID NO: 806010 - RNA, 14 nt, Mycobacterium avium subsp. paratuberculosis
agcgucagcaccgc

SEQ ID NO: 806011 - RNA, 16 nt, Mycobacterium avium subsp. paratuberculosis
agcgucagcaccgcga

SEQ ID NO: 806012 - RNA, 21 nt, Mycobacterium avium subsp. paratuberculosis
agcgucagcaccgcgacggug

SEQ ID NO: 806013 - RNA, 14 nt, Mycobacterium avium subsp. paratuberculosis
agcgucaacucguc

SEQ ID NO: 806014 - RNA, 22 nt, Mycobacterium avium subsp. paratuberculosis
agcgucagggcgacuccggcgc

SEQ ID NO: 806015 - RNA, 14 nt, Mycobacterium avium subsp. paratuberculosis
agcgucauuccgcc

SEQ ID NO: 806016 - RNA, 16 nt, Mycobacterium avium subsp. paratuberculosis
agcgucauuccgccgc

SEQ ID NO: 806017 - RNA, 18 nt, Mycobacterium avium subsp. paratuberculosis
agcgucauuccgccgcgc

SEQ ID NO: 806018 - RNA, 19 nt, Mycobacterium avium subsp. paratuberculosis
agcgucauuccgccgcgcc

SEQ ID NO: 806019 - RNA, 21 nt, Mycobacterium avium subsp. paratuberculosis
agcgucauuccgccgcgcccg

SEQ ID NO: 806020 - RNA, 13 nt, Mycobacterium avium subsp. paratuberculosis
agcggggugugcu

SEQ ID NO: 806021 - RNA, 20 nt, Mycobacterium avium subsp. paratuberculosis
agcggggugugcucggcggc

SEQ ID NO: 806022 - RNA, 20 nt, Mycobacterium avium subsp. paratuberculosis
agcgggguguucaccgcgcc

SEQ ID NO: 806023 - RNA, 23 nt, Mycobacterium avium subsp. paratuberculosis
agcgggguguucaccgcgccggg

SEQ ID NO: 806024 - RNA, 22 nt, Mycobacterium avium subsp. paratuberculosis
agcggggaggcccagcccgccg

SEQ ID NO: 806025 - RNA, 23 nt, Mycobacterium avium subsp. paratuberculosis
agcggggaggcccagcccgccgc

SEQ ID NO: 806026 - RNA, 17 nt, Mycobacterium avium subsp. paratuberculosis
agcggggcaagcagcgg

SEQ ID NO: 806027 - RNA, 16 nt, Mycobacterium avium subsp. paratuberculosis
agcggggcgcgcaggc

SEQ ID NO: 806028 - RNA, 20 nt, Mycobacterium avium subsp. paratuberculosis
agcggucauugaugccccgg

SEQ ID NO: 806029 - RNA, 14 nt, Mycobacterium avium subsp. paratuberculosis
agcgguccaacggg

SEQ ID NO: 806030 - RNA, 18 nt, Mycobacterium avium subsp. paratuberculosis
agcgguccagcgugaacg

SEQ ID NO: 806031 - RNA, 18 nt, Mycobacterium avium subsp. paratuberculosis
agcgguccauccagcgcc

SEQ ID NO: 806032 - RNA, 20 nt, Mycobacterium avium subsp. paratuberculosis
agcgguccauccagcgccgc

SEQ ID NO: 806033 - RNA, 19 nt, Mycobacterium avium subsp. paratuberculosis
agcggcggccaguugacgu

SEQ ID NO: 806034 - RNA, 16 nt, Mycobacterium avium subsp. paratuberculosis
agcggcgggcccagca

SEQ ID NO: 806035 - RNA, 15 nt, Mycobacterium avium subsp. paratuberculosis
agcggcguaccgcgg

SEQ ID NO: 806036 - RNA, 16 nt, Mycobacterium avium subsp. paratuberculosis
agcggcguaccgcggc

SEQ ID NO: 806037 - RNA, 13 nt, Mycobacterium avium subsp. paratuberculosis
agcggcggucggc

SEQ ID NO: 806038 - RNA, 16 nt, Mycobacterium avium subsp. paratuberculosis
agcggcggucggcgcc

SEQ ID NO: 806039 - RNA, 17 nt, Mycobacterium avium subsp. paratuberculosis
agcggcggucggcgccg

SEQ ID NO: 806040 - RNA, 17 nt, Mycobacterium avium subsp. paratuberculosis
agcgggcuaggcucggc

SEQ ID NO: 806041 - RNA, 16 nt, Mycobacterium avium subsp. paratuberculosis
agcgggcugucggcgc

SEQ ID NO: 806042 - RNA, 14 nt, Mycobacterium avium subsp. paratuberculosis
agcgggcgcgcagc

SEQ ID NO: 806043 - RNA, 16 nt, Mycobacterium avium subsp. paratuberculosis
agcgggcgcgcagcca

SEQ ID NO: 806044 - RNA, 17 nt, Mycobacterium avium subsp. paratuberculosis
agcgggcggccagccgc

SEQ ID NO: 806045 - RNA, 20 nt, Mycobacterium avium subsp. paratuberculosis
agcgggcggcgaacaccagc

SEQ ID NO: 806046 - RNA, 21 nt, Mycobacterium avium subsp. paratuberculosis
agcgggcggcgaacaccagca

SEQ ID NO: 806047 - RNA, 17 nt, Mycobacterium avium subsp. paratuberculosis
agcgggcgaacgaccgg

SEQ ID NO: 806048 - RNA, 11 nt, Mycobacterium avium subsp. paratuberculosis
agcgggcgacg

SEQ ID NO: 806049 - RNA, 14 nt, Mycobacterium avium subsp. paratuberculosis
agcggcggcacggu

SEQ ID NO: 806050 - RNA, 19 nt, Mycobacterium avium subsp. paratuberculosis
agcggcgacuccagcagcg

SEQ ID NO: 806051 - RNA, 22 nt, Mycobacterium avium subsp. paratuberculosis
agcggcgacuccagcagcgcca

SEQ ID NO: 806052 - RNA, 21 nt, Mycobacterium avium subsp. paratuberculosis
agcggcgcgcgccgcagcgcg

SEQ ID NO: 806053 - RNA, 13 nt, Mycobacterium avium subsp. paratuberculosis
agcggcgcugcag

SEQ ID NO: 806054 - RNA, 21 nt, Mycobacterium avium subsp. paratuberculosis
agcggcgcugcagcagcccga

SEQ ID NO: 806055 - RNA, 16 nt, Mycobacterium avium subsp. paratuberculosis
agcggcgcgggucgcg

SEQ ID NO: 806056 - RNA, 22 nt, Mycobacterium avium subsp. paratuberculosis
agcggcgcgggucgcgguucgc

SEQ ID NO: 806057 - RNA, 23 nt, Mycobacterium avium subsp. paratuberculosis
agcggcgcgguuucggcgucgcc

SEQ ID NO: 806058 - RNA, 23 nt, Mycobacterium avium subsp. paratuberculosis
agcggcgcguccauggucgagcc

SEQ ID NO: 806059 - RNA, 15 nt, Mycobacterium avium subsp. paratuberculosis
agcggccggcgcagc

SEQ ID NO: 806060 - RNA, 17 nt, Mycobacterium avium subsp. paratuberculosis
agcggccggcgcagccg

SEQ ID NO: 806061 - RNA, 21 nt, Mycobacterium avium subsp. paratuberculosis
agcggccggcgcagccggcca

SEQ ID NO: 806062 - RNA, 20 nt, Mycobacterium avium subsp. paratuberculosis
agcggccgacugauccacca

SEQ ID NO: 806063 - RNA, 15 nt, Mycobacterium avium subsp. paratuberculosis
agcggccgucgccgg

SEQ ID NO: 806064 - RNA, 17 nt, Mycobacterium avium subsp. paratuberculosis
agcggccgucgccgggc

SEQ ID NO: 806065 - RNA, 19 nt, Mycobacterium avium subsp. paratuberculosis
agcggccuaggacgccgcc

SEQ ID NO: 806066 - RNA, 18 nt, Mycobacterium avium subsp. paratuberculosis
agcggccuaugcgcccgg

SEQ ID NO: 806067 - RNA, 20 nt, Mycobacterium avium subsp. paratuberculosis
agcggccuaugcgcccggga

SEQ ID NO: 806068 - RNA, 15 nt, Mycobacterium avium subsp. paratuberculosis
agcggcccaccgcga

SEQ ID NO: 806069 - RNA, 16 nt, Mycobacterium avium subsp. paratuberculosis
agcggcccaccgcgac

SEQ ID NO: 806070 - RNA, 17 nt, Mycobacterium avium subsp. paratuberculosis
agcggcccaccgcgacc

SEQ ID NO: 806071 - RNA, 22 nt, Mycobacterium avium subsp. paratuberculosis
agcggcccagguucuccggccc

SEQ ID NO: 806072 - RNA, 23 nt, Mycobacterium avium subsp. paratuberculosis
agcggcccagguucuccggcccg

SEQ ID NO: 806073 - RNA, 13 nt, Mycobacterium avium subsp. paratuberculosis
agcggccccacgu

SEQ ID NO: 806074 - RNA, 15 nt, Mycobacterium avium subsp. paratuberculosis
agcggccccccgcac

SEQ ID NO: 806075 - RNA, 21 nt, Mycobacterium avium subsp. paratuberculosis
agcggccccccgcacaccggc

SEQ ID NO: 806076 - RNA, 22 nt, Mycobacterium avium subsp. paratuberculosis
agcggccccccgcacaccggcc

SEQ ID NO: 806077 - RNA, 12 nt, Mycobacterium avium subsp. paratuberculosis
agcggccccggc

SEQ ID NO: 806078 - RNA, 21 nt, Mycobacterium avium subsp. paratuberculosis
agcggcccgaaaacgcccggg

SEQ ID NO: 806079 - RNA, 19 nt, Mycobacterium avium subsp. paratuberculosis
agcggcccgaucaccaggc

SEQ ID NO: 806080 - RNA, 16 nt, Mycobacterium avium subsp. paratuberculosis
agcggcccgaucaccg

SEQ ID NO: 806081 - RNA, 17 nt, Mycobacterium avium subsp. paratuberculosis
agcggcccgaucaccgc

SEQ ID NO: 806082 - RNA, 18 nt, Mycobacterium avium subsp. paratuberculosis
agcggcccgaucaccgcc

SEQ ID NO: 806083 - RNA, 14 nt, Mycobacterium avium subsp. paratuberculosis
agcggcccgucgcc

SEQ ID NO: 806084 - RNA, 16 nt, Mycobacterium avium subsp. paratuberculosis
agcggcccgucgccga

SEQ ID NO: 806085 - RNA, 21 nt, Mycobacterium avium subsp. paratuberculosis
agcggcccgucgccgaucagc

SEQ ID NO: 806086 - RNA, 14 nt, Mycobacterium avium subsp. paratuberculosis
agcggcccugcgcg

SEQ ID NO: 806087 - RNA, 19 nt, Mycobacterium avium subsp. paratuberculosis
agcggccgaucauggucgg

SEQ ID NO: 806088 - RNA, 19 nt, Mycobacterium avium subsp. paratuberculosis
agcggccgcaaucggcgcc

SEQ ID NO: 806089 - RNA, 22 nt, Mycobacterium avium subsp. paratuberculosis
agcggccgcaaucggcgccggc

SEQ ID NO: 806090 - RNA, 23 nt, Mycobacterium avium subsp. paratuberculosis
agcggccgcaaucggcgccggcu

SEQ ID NO: 806091 - RNA, 15 nt, Mycobacterium avium subsp. paratuberculosis
agcggccgcagcgca

SEQ ID NO: 806092 - RNA, 20 nt, Mycobacterium avium subsp. paratuberculosis
agcggccgcagcgcaucgcc

SEQ ID NO: 806093 - RNA, 23 nt, Mycobacterium avium subsp. paratuberculosis
agcggccgcagcgcaucgccggc

SEQ ID NO: 806094 - RNA, 15 nt, Mycobacterium avium subsp. paratuberculosis
agcggccgcagcgcg

SEQ ID NO: 806095 - RNA, 16 nt, Mycobacterium avium subsp. paratuberculosis
agcggccgcagcgcga

SEQ ID NO: 806096 - RNA, 17 nt, Mycobacterium avium subsp. paratuberculosis
agcggccgcagcgcgac

SEQ ID NO: 806097 - RNA, 18 nt, Mycobacterium avium subsp. paratuberculosis
agcggccgcagcgcgacg

SEQ ID NO: 806098 - RNA, 13 nt, Mycobacterium avium subsp. paratuberculosis
agcggcagguccc

SEQ ID NO: 806099 - RNA, 13 nt, Mycobacterium avium subsp. paratuberculosis
agcggccacaccg

SEQ ID NO: 806100 - RNA, 19 nt, Mycobacterium avium subsp. paratuberculosis
agcggccacaccggggcca

SEQ ID NO: 806101 - RNA, 12 nt, Mycobacterium avium subsp. paratuberculosis
agcggcaguagc

SEQ ID NO: 806102 - RNA, 14 nt, Mycobacterium avium subsp. paratuberculosis
agcggcaucgagga

SEQ ID NO: 806103 - RNA, 18 nt, Mycobacterium avium subsp. paratuberculosis
agcggcaugcccccgaug

SEQ ID NO: 806104 - RNA, 13 nt, Mycobacterium avium subsp. paratuberculosis
agcggcagcagca

SEQ ID NO: 806105 - RNA, 17 nt, Mycobacterium avium subsp. paratuberculosis
agcggcagcagcaccag

SEQ ID NO: 806106 - RNA, 20 nt, Mycobacterium avium subsp. paratuberculosis
agcggcagcagcaccagcgu

SEQ ID NO: 806107 - RNA, 21 nt, Mycobacterium avium subsp. paratuberculosis
agcggcagcagcaccagcgug

SEQ ID NO: 806108 - RNA, 14 nt, Mycobacterium avium subsp. paratuberculosis
agcggcagcgucgc

SEQ ID NO: 806109 - RNA, 15 nt, Mycobacterium avium subsp. paratuberculosis
agcggcagcgucgcc

SEQ ID NO: 806110 - RNA, 17 nt, Mycobacterium avium subsp. paratuberculosis
agcggcagcgucgggcu

SEQ ID NO: 806111 - RNA, 22 nt, Mycobacterium avium subsp. paratuberculosis
agcggaucaggucggucaccga

SEQ ID NO: 806112 - RNA, 14 nt, Mycobacterium avium subsp. paratuberculosis
agcggcaccgccau

SEQ ID NO: 806113 - RNA, 12 nt, Mycobacterium avium subsp. paratuberculosis
agcggcaccguc

SEQ ID NO: 806114 - RNA, 22 nt, Mycobacterium avium subsp. paratuberculosis
agcggcaccuuggugagcaccg

SEQ ID NO: 806115 - RNA, 23 nt, Mycobacterium avium subsp. paratuberculosis
agcggcaccuuggugagcaccgc

SEQ ID NO: 806116 - RNA, 22 nt, Mycobacterium avium subsp. paratuberculosis
agcggcacgaucggcagcgcca

SEQ ID NO: 806117 - RNA, 17 nt, Mycobacterium avium subsp. paratuberculosis
agcggagugaccgccag

SEQ ID NO: 806118 - RNA, 15 nt, Mycobacterium avium subsp. paratuberculosis
agcggacgacggcca

SEQ ID NO: 806119 - RNA, 17 nt, Mycobacterium avium subsp. paratuberculosis
agcggacgacggccagc

SEQ ID NO: 806120 - RNA, 22 nt, Mycobacterium avium subsp. paratuberculosis
agcgcugguaguacaccgggcu

SEQ ID NO: 806121 - RNA, 21 nt, Mycobacterium avium subsp. paratuberculosis
agcgcugguugucgacgcugc

SEQ ID NO: 806122 - RNA, 21 nt, Mycobacterium avium subsp. paratuberculosis
agcgcugggugaacaccccgc

SEQ ID NO: 806123 - RNA, 16 nt, Mycobacterium avium subsp. paratuberculosis
agcgcuggccggccac

SEQ ID NO: 806124 - RNA, 17 nt, Mycobacterium avium subsp. paratuberculosis
agcgcuggccggccacc

SEQ ID NO: 806125 - RNA, 16 nt, Mycobacterium avium subsp. paratuberculosis
agcggacccggucggc

SEQ ID NO: 806126 - RNA, 19 nt, Mycobacterium avium subsp. paratuberculosis
agcggacccggucggccgc

SEQ ID NO: 806127 - RNA, 22 nt, Mycobacterium avium subsp. paratuberculosis
agcggacccggucggccgcgug

SEQ ID NO: 806128 - RNA, 14 nt, Mycobacterium avium subsp. paratuberculosis
agcgauugcggccg

SEQ ID NO: 806129 - RNA, 15 nt, Mycobacterium avium subsp. paratuberculosis
agcgauugcggccgc

SEQ ID NO: 806130 - RNA, 17 nt, Mycobacterium avium subsp. paratuberculosis
agcgcaacggcgucgac

SEQ ID NO: 806131 - RNA, 13 nt, Mycobacterium avium subsp. paratuberculosis
agcgcaacaccga

SEQ ID NO: 806132 - RNA, 16 nt, Mycobacterium avium subsp. paratuberculosis
agcgcaaccgcggcgg

SEQ ID NO: 806133 - RNA, 17 nt, Mycobacterium avium subsp. paratuberculosis
agcgcaaccgcggcggc

SEQ ID NO: 806134 - RNA, 21 nt, Mycobacterium avium subsp. paratuberculosis
agcgcaagggccgacaucguc

SEQ ID NO: 806135 - RNA, 22 nt, Mycobacterium avium subsp. paratuberculosis
agcgccaggacgaaaaccagga

SEQ ID NO: 806136 - RNA, 19 nt, Mycobacterium avium subsp. paratuberculosis
agcgccagcguggccagca

SEQ ID NO: 806137 - RNA, 15 nt, Mycobacterium avium subsp. paratuberculosis
agcgccagucgcggc

SEQ ID NO: 806138 - RNA, 17 nt, Mycobacterium avium subsp. paratuberculosis
agcgccagucgcggcga

SEQ ID NO: 806139 - RNA, 18 nt, Mycobacterium avium subsp. paratuberculosis
agcgccagggugccccgc

SEQ ID NO: 806140 - RNA, 21 nt, Mycobacterium avium subsp. paratuberculosis
agcgccaggugggugaacgcc

SEQ ID NO: 806141 - RNA, 23 nt, Mycobacterium avium subsp. paratuberculosis
agcgccaggcagaagcuccacgc

SEQ ID NO: 806142 - RNA, 15 nt, Mycobacterium avium subsp. paratuberculosis
agcgccaugccgccg

SEQ ID NO: 806143 - RNA, 17 nt, Mycobacterium avium subsp. paratuberculosis
agcgccaugccgccgac

SEQ ID NO: 806144 - RNA, 18 nt, Mycobacterium avium subsp. paratuberculosis
agcgcccggucgaggucg

SEQ ID NO: 806145 - RNA, 18 nt, Mycobacterium avium subsp. paratuberculosis
agcgccgaggccagcacg

SEQ ID NO: 806146 - RNA, 18 nt, Mycobacterium avium subsp. paratuberculosis
agcgccgagaucgcggug

SEQ ID NO: 806147 - RNA, 21 nt, Mycobacterium avium subsp. paratuberculosis
agcgccgagaucgcgguggcg

SEQ ID NO: 806148 - RNA, 16 nt, Mycobacterium avium subsp. paratuberculosis
agcgccgagcacggcu

SEQ ID NO: 806149 - RNA, 15 nt, Mycobacterium avium subsp. paratuberculosis
agcgccugggcguac

SEQ ID NO: 806150 - RNA, 20 nt, Mycobacterium avium subsp. paratuberculosis
agcgccuucggcgccagccc

SEQ ID NO: 806151 - RNA, 22 nt, Mycobacterium avium subsp. paratuberculosis
agcgccucccggaccaccagga

SEQ ID NO: 806152 - RNA, 14 nt, Mycobacterium avium subsp. paratuberculosis
agcgccuccagccg

SEQ ID NO: 806153 - RNA, 16 nt, Mycobacterium avium subsp. paratuberculosis
agcgccuccagccgcu

SEQ ID NO: 806154 - RNA, 19 nt, Mycobacterium avium subsp. paratuberculosis
agcgccgucaucaccgccg

SEQ ID NO: 806155 - RNA, 18 nt, Mycobacterium avium subsp. paratuberculosis
agcgccguccgcaccgcg

SEQ ID NO: 806156 - RNA, 19 nt, Mycobacterium avium subsp. paratuberculosis
agcgccggguugcaggcgc

SEQ ID NO: 806157 - RNA, 20 nt, Mycobacterium avium subsp. paratuberculosis
agcgccggguugcaggcgcc

SEQ ID NO: 806158 - RNA, 20 nt, Mycobacterium avium subsp. paratuberculosis
agcgccgguaggccgcgccg

SEQ ID NO: 806159 - RNA, 21 nt, Mycobacterium avium subsp. paratuberculosis
agcgccgguaggccgcgccga

SEQ ID NO: 806160 - RNA, 14 nt, Mycobacterium avium subsp. paratuberculosis
agcgccgcccgcac

SEQ ID NO: 806161 - RNA, 19 nt, Mycobacterium avium subsp. paratuberculosis
agcgccgcccgcaccugcg

SEQ ID NO: 806162 - RNA, 21 nt, Mycobacterium avium subsp. paratuberculosis
agcgccgcccgggcggcccgg

SEQ ID NO: 806163 - RNA, 14 nt, Mycobacterium avium subsp. paratuberculosis
agcgccgccagccg

SEQ ID NO: 806164 - RNA, 15 nt, Mycobacterium avium subsp. paratuberculosis
agcgccgccagccgc

SEQ ID NO: 806165 - RNA, 16 nt, Mycobacterium avium subsp. paratuberculosis
agcgccgccagccgca

SEQ ID NO: 806166 - RNA, 17 nt, Mycobacterium avium subsp. paratuberculosis
agcgccgccagccgcag

SEQ ID NO: 806167 - RNA, 22 nt, Mycobacterium avium subsp. paratuberculosis
agcgccgcaugcccuugucgcu

SEQ ID NO: 806168 - RNA, 14 nt, Mycobacterium avium subsp. paratuberculosis
agcgccgccaccgg

SEQ ID NO: 806169 - RNA, 17 nt, Mycobacterium avium subsp. paratuberculosis
agcgccgccaccggccg

SEQ ID NO: 806170 - RNA, 19 nt, Mycobacterium avium subsp. paratuberculosis
agcgccgccaccggccggu

SEQ ID NO: 806171 - RNA, 19 nt, Mycobacterium avium subsp. paratuberculosis
agcgccgccacggccaccg

SEQ ID NO: 806172 - RNA, 20 nt, Mycobacterium avium subsp. paratuberculosis
agcgccgccacggccaccgc

SEQ ID NO: 806173 - RNA, 11 nt, Mycobacterium avium subsp. paratuberculosis
agcgccgccag

SEQ ID NO: 806174 - RNA, 20 nt, Mycobacterium avium subsp. paratuberculosis
agcgccgcgacgaacugccg

SEQ ID NO: 806175 - RNA, 20 nt, Mycobacterium avium subsp. paratuberculosis
agcgccgccaaccaggucgc

SEQ ID NO: 806176 - RNA, 14 nt, Mycobacterium avium subsp. paratuberculosis
agcgcugcccgugc

SEQ ID NO: 806177 - RNA, 20 nt, Mycobacterium avium subsp. paratuberculosis
agcgcugcccgugccgcacc

SEQ ID NO: 806178 - RNA, 23 nt, Mycobacterium avium subsp. paratuberculosis
agcgcugcauagucggcccgauc

SEQ ID NO: 806179 - RNA, 18 nt, Mycobacterium avium subsp. paratuberculosis
agcgcgugaccccggcga

SEQ ID NO: 806180 - RNA, 20 nt, Mycobacterium avium subsp. paratuberculosis
agcgcgugcuggggguggcg

SEQ ID NO: 806181 - RNA, 19 nt, Mycobacterium avium subsp. paratuberculosis
agcgcguucuccaccgcgc

SEQ ID NO: 806182 - RNA, 21 nt, Mycobacterium avium subsp. paratuberculosis
agcgcguucuccaccgcgcgc

SEQ ID NO: 806183 - RNA, 18 nt, Mycobacterium avium subsp. paratuberculosis
agcgcguugaagcugacg

SEQ ID NO: 806184 - RNA, 19 nt, Mycobacterium avium subsp. paratuberculosis
agcgcguugcggccgucca

SEQ ID NO: 806185 - RNA, 15 nt, Mycobacterium avium subsp. paratuberculosis
agcgcgucggcgacc

SEQ ID NO: 806186 - RNA, 20 nt, Mycobacterium avium subsp. paratuberculosis
agcgcgucggugaugucggu

SEQ ID NO: 806187 - RNA, 16 nt, Mycobacterium avium subsp. paratuberculosis
agcgcgucgucgccga

SEQ ID NO: 806188 - RNA, 17 nt, Mycobacterium avium subsp. paratuberculosis
agcgcgucgucggucag

SEQ ID NO: 806189 - RNA, 18 nt, Mycobacterium avium subsp. paratuberculosis
agcgcgucgucggucagg

SEQ ID NO: 806190 - RNA, 14 nt, Mycobacterium avium subsp. paratuberculosis
agcgcgucgugcaa

SEQ ID NO: 806191 - RNA, 17 nt, Mycobacterium avium subsp. paratuberculosis
agcgcgucgugcaacuc

SEQ ID NO: 806192 - RNA, 17 nt, Mycobacterium avium subsp. paratuberculosis
agcgcggggucggccag

SEQ ID NO: 806193 - RNA, 11 nt, Mycobacterium avium subsp. paratuberculosis
agcgcggucaa

SEQ ID NO: 806194 - RNA, 16 nt, Mycobacterium avium subsp. paratuberculosis
agcgcggucagcccgc

SEQ ID NO: 806195 - RNA, 14 nt, Mycobacterium avium subsp. paratuberculosis
agcgcgggccagca

SEQ ID NO: 806196 - RNA, 23 nt, Mycobacterium avium subsp. paratuberculosis
agcgcgggccagcaguucgucca

SEQ ID NO: 806197 - RNA, 16 nt, Mycobacterium avium subsp. paratuberculosis
agcgcgggcaccgucg

SEQ ID NO: 806198 - RNA, 20 nt, Mycobacterium avium subsp. paratuberculosis
agcgcgggcaccgucgucgc

SEQ ID NO: 806199 - RNA, 14 nt, Mycobacterium avium subsp. paratuberculosis
agcgcgggcagccc

SEQ ID NO: 806200 - RNA, 13 nt, Mycobacterium avium subsp. paratuberculosis
agcgcggccagca

SEQ ID NO: 806201 - RNA, 20 nt, Mycobacterium avium subsp. paratuberculosis
agcgcggcguucagcagcgc

SEQ ID NO: 806202 - RNA, 22 nt, Mycobacterium avium subsp. paratuberculosis
agcgcggcguucagcagcgcgg

SEQ ID NO: 806203 - RNA, 22 nt, Mycobacterium avium subsp. paratuberculosis
agcgcgucgggcucggccgccg

SEQ ID NO: 806204 - RNA, 23 nt, Mycobacterium avium subsp. paratuberculosis
agcgcgucgggcucggccgccga

SEQ ID NO: 806205 - RNA, 18 nt, Mycobacterium avium subsp. paratuberculosis
agcgcgucggccagcgcg

SEQ ID NO: 806206 - RNA, 18 nt, Mycobacterium avium subsp. paratuberculosis
agcgcggugccggugauc

SEQ ID NO: 806207 - RNA, 14 nt, Mycobacterium avium subsp. paratuberculosis
agcgcgucggccag

SEQ ID NO: 806208 - RNA, 22 nt, Mycobacterium avium subsp. paratuberculosis
agcgcgucggccagcaccacca

SEQ ID NO: 806209 - RNA, 15 nt, Mycobacterium avium subsp. paratuberculosis
agcgcgucgcugccg

SEQ ID NO: 806210 - RNA, 14 nt, Mycobacterium avium subsp. paratuberculosis
agcgcgguggccag

SEQ ID NO: 806211 - RNA, 15 nt, Mycobacterium avium subsp. paratuberculosis
agcgcgguggccagc

SEQ ID NO: 806212 - RNA, 16 nt, Mycobacterium avium subsp. paratuberculosis
agcgcgguggccagca

SEQ ID NO: 806213 - RNA, 20 nt, Mycobacterium avium subsp. paratuberculosis
agcgcgguggccagcagggu

SEQ ID NO: 806214 - RNA, 16 nt, Mycobacterium avium subsp. paratuberculosis
agcgcggucaucguca

SEQ ID NO: 806215 - RNA, 16 nt, Mycobacterium avium subsp. paratuberculosis
agcgcggucgccacca

SEQ ID NO: 806216 - RNA, 22 nt, Mycobacterium avium subsp. paratuberculosis
agcgcggucucgaucugcacca

SEQ ID NO: 806217 - RNA, 23 nt, Mycobacterium avium subsp. paratuberculosis
agcgcggugaagucggugcccag

SEQ ID NO: 806218 - RNA, 16 nt, Mycobacterium avium subsp. paratuberculosis
agcgcggugagcagca

SEQ ID NO: 806219 - RNA, 13 nt, Mycobacterium avium subsp. paratuberculosis
agcgcggugaugu

SEQ ID NO: 806220 - RNA, 18 nt, Mycobacterium avium subsp. paratuberculosis
agcgcggugcccagccag

SEQ ID NO: 806221 - RNA, 23 nt, Mycobacterium avium subsp. paratuberculosis
agcgcggugcccagccaggccgc

SEQ ID NO: 806222 - RNA, 14 nt, Mycobacterium avium subsp. paratuberculosis
agcgcggugccgac

SEQ ID NO: 806223 - RNA, 15 nt, Mycobacterium avium subsp. paratuberculosis
agcgcggccagcacg

SEQ ID NO: 806224 - RNA, 11 nt, Mycobacterium avium subsp. paratuberculosis
agcgcggcccg

SEQ ID NO: 806225 - RNA, 15 nt, Mycobacterium avium subsp. paratuberculosis
agcgcggcccgccga

SEQ ID NO: 806226 - RNA, 16 nt, Mycobacterium avium subsp. paratuberculosis
agcgcggcccgccgaa

SEQ ID NO: 806227 - RNA, 17 nt, Mycobacterium avium subsp. paratuberculosis
agcgcggcccgcggcgu

SEQ ID NO: 806228 - RNA, 18 nt, Mycobacterium avium subsp. paratuberculosis
agcgcggauuccagcgcg

SEQ ID NO: 806229 - RNA, 19 nt, Mycobacterium avium subsp. paratuberculosis
agcgcggauuccagcgcga

SEQ ID NO: 806230 - RNA, 16 nt, Mycobacterium avium subsp. paratuberculosis
agcgcggccaccacca

SEQ ID NO: 806231 - RNA, 14 nt, Mycobacterium avium subsp. paratuberculosis
agcgcggccaccuc

SEQ ID NO: 806232 - RNA, 21 nt, Mycobacterium avium subsp. paratuberculosis
agcgcggccaccuccagcccg

SEQ ID NO: 806233 - RNA, 17 nt, Mycobacterium avium subsp. paratuberculosis
agcgcgccgcccagcgg

SEQ ID NO: 806234 - RNA, 20 nt, Mycobacterium avium subsp. paratuberculosis
agcgcgccgcccagcgguga

SEQ ID NO: 806235 - RNA, 15 nt, Mycobacterium avium subsp. paratuberculosis
agcgcgcugaucgcc

SEQ ID NO: 806236 - RNA, 19 nt, Mycobacterium avium subsp. paratuberculosis
agcgcgcuguaggucgcgu

SEQ ID NO: 806237 - RNA, 20 nt, Mycobacterium avium subsp. paratuberculosis
agcgcgcuuaauacagcgcg

SEQ ID NO: 806238 - RNA, 23 nt, Mycobacterium avium subsp. paratuberculosis
agcgcgcuuaauacagcgcguug

SEQ ID NO: 806239 - RNA, 13 nt, Mycobacterium avium subsp. paratuberculosis
agcgcgccgaucg

SEQ ID NO: 806240 - RNA, 21 nt, Mycobacterium avium subsp. paratuberculosis
agcgcgccgcacagccggcgg

SEQ ID NO: 806241 - RNA, 20 nt, Mycobacterium avium subsp. paratuberculosis
agcgccucgagcaacggccg

SEQ ID NO: 806242 - RNA, 16 nt, Mycobacterium avium subsp. paratuberculosis
agcgcgaaaaccagca

SEQ ID NO: 806243 - RNA, 18 nt, Mycobacterium avium subsp. paratuberculosis
agcgcgaaaaccagcacc

SEQ ID NO: 806244 - RNA, 19 nt, Mycobacterium avium subsp. paratuberculosis
agcgcgaaaaccagcaccg

SEQ ID NO: 806245 - RNA, 21 nt, Mycobacterium avium subsp. paratuberculosis
agcgcgaaaaccagcaccggc

SEQ ID NO: 806246 - RNA, 17 nt, Mycobacterium avium subsp. paratuberculosis
agcgcgaacaaucgcug

SEQ ID NO: 806247 - RNA, 18 nt, Mycobacterium avium subsp. paratuberculosis
agcgcgaacaaucgcugc

SEQ ID NO: 806248 - RNA, 17 nt, Mycobacterium avium subsp. paratuberculosis
agcgcgaacagcgcggc

SEQ ID NO: 806249 - RNA, 12 nt, Mycobacterium avium subsp. paratuberculosis
agcgcgacaccg

SEQ ID NO: 806250 - RNA, 15 nt, Mycobacterium avium subsp. paratuberculosis
agcgcgacaccggac

SEQ ID NO: 806251 - RNA, 14 nt, Mycobacterium avium subsp. paratuberculosis
agcgcgacaucgcc

SEQ ID NO: 806252 - RNA, 18 nt, Mycobacterium avium subsp. paratuberculosis
agcgcgacaucgccggcg

SEQ ID NO: 806253 - RNA, 14 nt, Mycobacterium avium subsp. paratuberculosis
agcgcgaccagccc

SEQ ID NO: 806254 - RNA, 15 nt, Mycobacterium avium subsp. paratuberculosis
agcgcgaccagcccg

SEQ ID NO: 806255 - RNA, 17 nt, Mycobacterium avium subsp. paratuberculosis
agcgcgaccagcccggc

SEQ ID NO: 806256 - RNA, 19 nt, Mycobacterium avium subsp. paratuberculosis
agcgcgaccagcccggccg

SEQ ID NO: 806257 - RNA, 12 nt, Mycobacterium avium subsp. paratuberculosis
agcgcgcccagg

SEQ ID NO: 806258 - RNA, 15 nt, Mycobacterium avium subsp. paratuberculosis
agcgcgcccaggccc

SEQ ID NO: 806259 - RNA, 17 nt, Mycobacterium avium subsp. paratuberculosis
agcgcgcccaggcccga

SEQ ID NO: 806260 - RNA, 12 nt, Mycobacterium avium subsp. paratuberculosis
agcgcgcaucgc

SEQ ID NO: 806261 - RNA, 23 nt, Mycobacterium avium subsp. paratuberculosis
agcgcgcaucgcgggccaccggc

SEQ ID NO: 806262 - RNA, 23 nt, Mycobacterium avium subsp. paratuberculosis
agcgcgaaauacgacgagccgac

SEQ ID NO: 806263 - RNA, 13 nt, Mycobacterium avium subsp. paratuberculosis
agcgcgcccgacg

SEQ ID NO: 806264 - RNA, 15 nt, Mycobacterium avium subsp. paratuberculosis
agcgcgccgaccacg

SEQ ID NO: 806265 - RNA, 17 nt, Mycobacterium avium subsp. paratuberculosis
agcgcgccgagcagcug

SEQ ID NO: 806266 - RNA, 15 nt, Mycobacterium avium subsp. paratuberculosis
agcgcgcccugaggc

SEQ ID NO: 806267 - RNA, 23 nt, Mycobacterium avium subsp. paratuberculosis
agccgcucaaguccucgguggcc

SEQ ID NO: 806268 - RNA, 17 nt, Mycobacterium avium subsp. paratuberculosis
agccgcuccggcccgag

SEQ ID NO: 806269 - RNA, 20 nt, Mycobacterium avium subsp. paratuberculosis
agccgcgggugaaauccgac

SEQ ID NO: 806270 - RNA, 17 nt, Mycobacterium avium subsp. paratuberculosis
agccgcuccaccgcguc

SEQ ID NO: 806271 - RNA, 22 nt, Mycobacterium avium subsp. paratuberculosis
agccgcuccaccgcguccugca

SEQ ID NO: 806272 - RNA, 13 nt, Mycobacterium avium subsp. paratuberculosis
agccgcucccggc

SEQ ID NO: 806273 - RNA, 20 nt, Mycobacterium avium subsp. paratuberculosis
agccgcuccgcggcgggcgu

SEQ ID NO: 806274 - RNA, 17 nt, Mycobacterium avium subsp. paratuberculosis
agccgcucgcccagcgc

SEQ ID NO: 806275 - RNA, 18 nt, Mycobacterium avium subsp. paratuberculosis
agccgcucgcccagcgcg

SEQ ID NO: 806276 - RNA, 19 nt, Mycobacterium avium subsp. paratuberculosis
agccgcucgcccagcgcgg

SEQ ID NO: 806277 - RNA, 21 nt, Mycobacterium avium subsp. paratuberculosis
agccgcucgcccagcgcggcg

SEQ ID NO: 806278 - RNA, 18 nt, Mycobacterium avium subsp. paratuberculosis
agccgcucgcgcaccggg

SEQ ID NO: 806279 - RNA, 13 nt, Mycobacterium avium subsp. paratuberculosis
agccgcugcgaca

SEQ ID NO: 806280 - RNA, 18 nt, Mycobacterium avium subsp. paratuberculosis
agccgcugcgacaggucg

SEQ ID NO: 806281 - RNA, 11 nt, Mycobacterium avium subsp. paratuberculosis
agccgcugcag

SEQ ID NO: 806282 - RNA, 19 nt, Mycobacterium avium subsp. paratuberculosis
agccgcugcugggugccgc

SEQ ID NO: 806283 - RNA, 20 nt, Mycobacterium avium subsp. paratuberculosis
agccgcugcugggugccgcg

SEQ ID NO: 806284 - RNA, 23 nt, Mycobacterium avium subsp. paratuberculosis
agccgcugcagcgccgcccgcac

SEQ ID NO: 806285 - RNA, 17 nt, Mycobacterium avium subsp. paratuberculosis
agccgcucggggauccc

SEQ ID NO: 806286 - RNA, 20 nt, Mycobacterium avium subsp. paratuberculosis
agccgcucguaguuggggcc

SEQ ID NO: 806287 - RNA, 23 nt, Mycobacterium avium subsp. paratuberculosis
agccgcucguaguuggggccggc

SEQ ID NO: 806288 - RNA, 22 nt, Mycobacterium avium subsp. paratuberculosis
agccgcugacgauggcgaccgc

SEQ ID NO: 806289 - RNA, 21 nt, Mycobacterium avium subsp. paratuberculosis
agccgcucggauucccgcucg

SEQ ID NO: 806290 - RNA, 15 nt, Mycobacterium avium subsp. paratuberculosis
agccggagccggccu

SEQ ID NO: 806291 - RNA, 23 nt, Mycobacterium avium subsp. paratuberculosis
agccgcuggccgcgccacagcgu

SEQ ID NO: 806292 - RNA, 23 nt, Mycobacterium avium subsp. paratuberculosis
agccggaaggccaaggccagcaa

SEQ ID NO: 806293 - RNA, 18 nt, Mycobacterium avium subsp. paratuberculosis
agccgcuuggcgcgccgc

SEQ ID NO: 806294 - RNA, 16 nt, Mycobacterium avium subsp. paratuberculosis
agccgcuugguggcgc

SEQ ID NO: 806295 - RNA, 16 nt, Mycobacterium avium subsp. paratuberculosis
agccggaugcggccga

SEQ ID NO: 806296 - RNA, 13 nt, Mycobacterium avium subsp. paratuberculosis
agccggaucagcg

SEQ ID NO: 806297 - RNA, 14 nt, Mycobacterium avium subsp. paratuberculosis
agccggaucucguc

SEQ ID NO: 806298 - RNA, 19 nt, Mycobacterium avium subsp. paratuberculosis
agccggaucucgucgggca

SEQ ID NO: 806299 - RNA, 21 nt, Mycobacterium avium subsp. paratuberculosis
agccggaucucgucgggcacc

SEQ ID NO: 806300 - RNA, 14 nt, Mycobacterium avium subsp. paratuberculosis
agccggcacgcgcg

SEQ ID NO: 806301 - RNA, 19 nt, Mycobacterium avium subsp. paratuberculosis
agccggcacgcgcgccgga

SEQ ID NO: 806302 - RNA, 14 nt, Mycobacterium avium subsp. paratuberculosis
agccggcacggccg

SEQ ID NO: 806303 - RNA, 18 nt, Mycobacterium avium subsp. paratuberculosis
agccggcacggccggccg

SEQ ID NO: 806304 - RNA, 21 nt, Mycobacterium avium subsp. paratuberculosis
agccggauguccuacggcggg

SEQ ID NO: 806305 - RNA, 22 nt, Mycobacterium avium subsp. paratuberculosis
agccggauguccuacggcgggu

SEQ ID NO: 806306 - RNA, 19 nt, Mycobacterium avium subsp. paratuberculosis
agccgccacagcgccucgc

SEQ ID NO: 806307 - RNA, 18 nt, Mycobacterium avium subsp. paratuberculosis
agccgcauggugcgggug

SEQ ID NO: 806308 - RNA, 18 nt, Mycobacterium avium subsp. paratuberculosis
agccgcauucggugagcc

SEQ ID NO: 806309 - RNA, 22 nt, Mycobacterium avium subsp. paratuberculosis
agccgccacggggcccgcgacc

SEQ ID NO: 806310 - RNA, 15 nt, Mycobacterium avium subsp. paratuberculosis
agccgccgccggcgu

SEQ ID NO: 806311 - RNA, 19 nt, Mycobacterium avium subsp. paratuberculosis
agccgccgcgacacccgcg

SEQ ID NO: 806312 - RNA, 18 nt, Mycobacterium avium subsp. paratuberculosis
agccgccggcucagcggc

SEQ ID NO: 806313 - RNA, 19 nt, Mycobacterium avium subsp. paratuberculosis
agccgccggcucagcggca

SEQ ID NO: 806314 - RNA, 13 nt, Mycobacterium avium subsp. paratuberculosis
agccgccggggcg

SEQ ID NO: 806315 - RNA, 18 nt, Mycobacterium avium subsp. paratuberculosis
agccgccggggcgccgcc

SEQ ID NO: 806316 - RNA, 21 nt, Mycobacterium avium subsp. paratuberculosis
agccgccggggcgccgccgaa

SEQ ID NO: 806317 - RNA, 15 nt, Mycobacterium avium subsp. paratuberculosis
agccgccgcggcacc

SEQ ID NO: 806318 - RNA, 16 nt, Mycobacterium avium subsp. paratuberculosis
agccgccgcggcaccu

SEQ ID NO: 806319 - RNA, 14 nt, Mycobacterium avium subsp. paratuberculosis
agccgccgcggguc

SEQ ID NO: 806320 - RNA, 19 nt, Mycobacterium avium subsp. paratuberculosis
agccgccgcgggucggcga

SEQ ID NO: 806321 - RNA, 14 nt, Mycobacterium avium subsp. paratuberculosis
agccgccggccacc

SEQ ID NO: 806322 - RNA, 20 nt, Mycobacterium avium subsp. paratuberculosis
agccgcaggugcucgccggc

SEQ ID NO: 806323 - RNA, 21 nt, Mycobacterium avium subsp. paratuberculosis
agccgcaggugcucgccggcg

SEQ ID NO: 806324 - RNA, 15 nt, Mycobacterium avium subsp. paratuberculosis
agccgcagucgauca

SEQ ID NO: 806325 - RNA, 17 nt, Mycobacterium avium subsp. paratuberculosis
agccgcagucgaucacc

SEQ ID NO: 806326 - RNA, 18 nt, Mycobacterium avium subsp. paratuberculosis
agccgcagucgaucaccg

SEQ ID NO: 806327 - RNA, 16 nt, Mycobacterium avium subsp. paratuberculosis
agccgcagcggcggcu

SEQ ID NO: 806328 - RNA, 14 nt, Mycobacterium avium subsp. paratuberculosis
agccgcagccgggu

SEQ ID NO: 806329 - RNA, 16 nt, Mycobacterium avium subsp. paratuberculosis
agccgcagcgcgcgac

SEQ ID NO: 806330 - RNA, 19 nt, Mycobacterium avium subsp. paratuberculosis
agccgcagcgcgcgaccgc

SEQ ID NO: 806331 - RNA, 14 nt, Mycobacterium avium subsp. paratuberculosis
agccgcacuuggcc

SEQ ID NO: 806332 - RNA, 20 nt, Mycobacterium avium subsp. paratuberculosis
agccgcacuuggccucgggc

SEQ ID NO: 806333 - RNA, 12 nt, Mycobacterium avium subsp. paratuberculosis
agccgcagcagc

SEQ ID NO: 806334 - RNA, 14 nt, Mycobacterium avium subsp. paratuberculosis
agccgcagcaggug

SEQ ID NO: 806335 - RNA, 16 nt, Mycobacterium avium subsp. paratuberculosis
agccgcagcaggugcg

SEQ ID NO: 806336 - RNA, 13 nt, Mycobacterium avium subsp. paratuberculosis
agccgcgguggcg

SEQ ID NO: 806337 - RNA, 15 nt, Mycobacterium avium subsp. paratuberculosis
agccgcgguggcggu

SEQ ID NO: 806338 - RNA, 16 nt, Mycobacterium avium subsp. paratuberculosis
agccgcgguggcggug

SEQ ID NO: 806339 - RNA, 20 nt, Mycobacterium avium subsp. paratuberculosis
agccgcgguucuuguccucg

SEQ ID NO: 806340 - RNA, 17 nt, Mycobacterium avium subsp. paratuberculosis
agccgcgucacgucggc

SEQ ID NO: 806341 - RNA, 13 nt, Mycobacterium avium subsp. paratuberculosis
agccgcggcccgc

SEQ ID NO: 806342 - RNA, 14 nt, Mycobacterium avium subsp. paratuberculosis
agccgcgcggccgc

SEQ ID NO: 806343 - RNA, 16 nt, Mycobacterium avium subsp. paratuberculosis
agccgcggacggccag

SEQ ID NO: 806344 - RNA, 19 nt, Mycobacterium avium subsp. paratuberculosis
agccgcggacggccagccc

SEQ ID NO: 806345 - RNA, 17 nt, Mycobacterium avium subsp. paratuberculosis
agccgcggauggccucg

SEQ ID NO: 806346 - RNA, 15 nt, Mycobacterium avium subsp. paratuberculosis
agccgcgcggcgucg

SEQ ID NO: 806347 - RNA, 17 nt, Mycobacterium avium subsp. paratuberculosis
agccgcgcggcgucggc

SEQ ID NO: 806348 - RNA, 18 nt, Mycobacterium avium subsp. paratuberculosis
agccgcgcggcgucggcc

SEQ ID NO: 806349 - RNA, 14 nt, Mycobacterium avium subsp. paratuberculosis
agccgcgcgccgag

SEQ ID NO: 806350 - RNA, 19 nt, Mycobacterium avium subsp. paratuberculosis
agccgccguagccggcggu

SEQ ID NO: 806351 - RNA, 22 nt, Mycobacterium avium subsp. paratuberculosis
agccgccguagccggcgguggc

SEQ ID NO: 806352 - RNA, 17 nt, Mycobacterium avium subsp. paratuberculosis
agccgccguucucgcgc

SEQ ID NO: 806353 - RNA, 12 nt, Mycobacterium avium subsp. paratuberculosis
agccgccgucgc

SEQ ID NO: 806354 - RNA, 12 nt, Mycobacterium avium subsp. paratuberculosis
agccgccggugg

SEQ ID NO: 806355 - RNA, 14 nt, Mycobacterium avium subsp. paratuberculosis
agccgccgguggcg

SEQ ID NO: 806356 - RNA, 15 nt, Mycobacterium avium subsp. paratuberculosis
agccgccgguggcgu

SEQ ID NO: 806357 - RNA, 16 nt, Mycobacterium avium subsp. paratuberculosis
agccgccgguugauca

SEQ ID NO: 806358 - RNA, 14 nt, Mycobacterium avium subsp. paratuberculosis
agccgccgguccag

SEQ ID NO: 806359 - RNA, 23 nt, Mycobacterium avium subsp. paratuberculosis
agccgccgguccagugccggcga

SEQ ID NO: 806360 - RNA, 19 nt, Mycobacterium avium subsp. paratuberculosis
agcccggcugcgcagcgca

SEQ ID NO: 806361 - RNA, 12 nt, Mycobacterium avium subsp. paratuberculosis
agcccggcgacg

SEQ ID NO: 806362 - RNA, 13 nt, Mycobacterium avium subsp. paratuberculosis
agcccggcgacga

SEQ ID NO: 806363 - RNA, 18 nt, Mycobacterium avium subsp. paratuberculosis
agcccggcgacgucgucg

SEQ ID NO: 806364 - RNA, 17 nt, Mycobacterium avium subsp. paratuberculosis
agcccggcgcucaccgc

SEQ ID NO: 806365 - RNA, 19 nt, Mycobacterium avium subsp. paratuberculosis
agcccggcgcucaccgcga

SEQ ID NO: 806366 - RNA, 22 nt, Mycobacterium avium subsp. paratuberculosis
agcccggcgcucaccgcgauga

SEQ ID NO: 806367 - RNA, 14 nt, Mycobacterium avium subsp. paratuberculosis
agcccggcgcugcg

SEQ ID NO: 806368 - RNA, 20 nt, Mycobacterium avium subsp. paratuberculosis
agcccggcgcugcgcccggu

SEQ ID NO: 806369 - RNA, 23 nt, Mycobacterium avium subsp. paratuberculosis
agccaccucgaucagcggcaucg

SEQ ID NO: 806370 - RNA, 22 nt, Mycobacterium avium subsp. paratuberculosis
agccacgacaccagcgucgcga

SEQ ID NO: 806371 - RNA, 14 nt, Mycobacterium avium subsp. paratuberculosis
agccacccgcgccu

SEQ ID NO: 806372 - RNA, 12 nt, Mycobacterium avium subsp. paratuberculosis
agccacccgucg

SEQ ID NO: 806373 - RNA, 15 nt, Mycobacterium avium subsp. paratuberculosis
agcccgucccggccc

SEQ ID NO: 806374 - RNA, 22 nt, Mycobacterium avium subsp. paratuberculosis
agcccgugccgaugccggccug

SEQ ID NO: 806375 - RNA, 21 nt, Mycobacterium avium subsp. paratuberculosis
agcccgugcggcggggccucg

SEQ ID NO: 806376 - RNA, 22 nt, Mycobacterium avium subsp. paratuberculosis
agcccgugcggcggggccucga

SEQ ID NO: 806377 - RNA, 18 nt, Mycobacterium avium subsp. paratuberculosis
agcccguggccagcgcca

SEQ ID NO: 806378 - RNA, 20 nt, Mycobacterium avium subsp. paratuberculosis
agcccguugcugcguucggc

SEQ ID NO: 806379 - RNA, 22 nt, Mycobacterium avium subsp. paratuberculosis
agcccguugcugcguucggcga

SEQ ID NO: 806380 - RNA, 12 nt, Mycobacterium avium subsp. paratuberculosis
agcccggucagu

SEQ ID NO: 806381 - RNA, 23 nt, Mycobacterium avium subsp. paratuberculosis
agcccgguuuccaguccggcgcc

SEQ ID NO: 806382 - RNA, 18 nt, Mycobacterium avium subsp. paratuberculosis
agcccguacuugcuggcg

SEQ ID NO: 806383 - RNA, 13 nt, Mycobacterium avium subsp. paratuberculosis
agcccgggcaggc

SEQ ID NO: 806384 - RNA, 18 nt, Mycobacterium avium subsp. paratuberculosis
agcccgggcaggcggcgc

SEQ ID NO: 806385 - RNA, 19 nt, Mycobacterium avium subsp. paratuberculosis
agcccgggcaggcggcgcg

SEQ ID NO: 806386 - RNA, 20 nt, Mycobacterium avium subsp. paratuberculosis
agcccgggcugcagcagcga

SEQ ID NO: 806387 - RNA, 22 nt, Mycobacterium avium subsp. paratuberculosis
agcccggguccuggcccccgcc

SEQ ID NO: 806388 - RNA, 13 nt, Mycobacterium avium subsp. paratuberculosis
agcccgggugcga

SEQ ID NO: 806389 - RNA, 16 nt, Mycobacterium avium subsp. paratuberculosis
agccgagccgacccgg

SEQ ID NO: 806390 - RNA, 15 nt, Mycobacterium avium subsp. paratuberculosis
agccgagccgggcca

SEQ ID NO: 806391 - RNA, 13 nt, Mycobacterium avium subsp. paratuberculosis
agccgagccgggu

SEQ ID NO: 806392 - RNA, 20 nt, Mycobacterium avium subsp. paratuberculosis
agccgagccgguccgaccag

SEQ ID NO: 806393 - RNA, 23 nt, Mycobacterium avium subsp. paratuberculosis
agccgaugaugaaaccggccagc

SEQ ID NO: 806394 - RNA, 17 nt, Mycobacterium avium subsp. paratuberculosis
agccgaugcccagcagc

SEQ ID NO: 806395 - RNA, 17 nt, Mycobacterium avium subsp. paratuberculosis
agccgaugcgcccgcgc

SEQ ID NO: 806396 - RNA, 19 nt, Mycobacterium avium subsp. paratuberculosis
agccgaugcgcccgcgcca

SEQ ID NO: 806397 - RNA, 20 nt, Mycobacterium avium subsp. paratuberculosis
agccgaugcgcccgcgccac

SEQ ID NO: 806398 - RNA, 13 nt, Mycobacterium avium subsp. paratuberculosis
agccgagcggcgc

SEQ ID NO: 806399 - RNA, 14 nt, Mycobacterium avium subsp. paratuberculosis
agccgagcggcgcc

SEQ ID NO: 806400 - RNA, 16 nt, Mycobacterium avium subsp. paratuberculosis
agccgaucgcggcgau

SEQ ID NO: 806401 - RNA, 18 nt, Mycobacterium avium subsp. paratuberculosis
agccgaucgcggcgauca

SEQ ID NO: 806402 - RNA, 14 nt, Mycobacterium avium subsp. paratuberculosis
agccgaucgcggug

SEQ ID NO: 806403 - RNA, 16 nt, Mycobacterium avium subsp. paratuberculosis
agccgaucgcggugcu

SEQ ID NO: 806404 - RNA, 14 nt, Mycobacterium avium subsp. paratuberculosis
agccgaugucgucg

SEQ ID NO: 806405 - RNA, 15 nt, Mycobacterium avium subsp. paratuberculosis
agccgaugucgucga

SEQ ID NO: 806406 - RNA, 19 nt, Mycobacterium avium subsp. paratuberculosis
agccgcaacacggccucga

SEQ ID NO: 806407 - RNA, 15 nt, Mycobacterium avium subsp. paratuberculosis
agccgcacaccgcgg

SEQ ID NO: 806408 - RNA, 16 nt, Mycobacterium avium subsp. paratuberculosis
agccgcacaccgcggc

SEQ ID NO: 806409 - RNA, 15 nt, Mycobacterium avium subsp. paratuberculosis
agccgcaccagaucg

SEQ ID NO: 806410 - RNA, 14 nt, Mycobacterium avium subsp. paratuberculosis
agccgcaccgccuc

SEQ ID NO: 806411 - RNA, 17 nt, Mycobacterium avium subsp. paratuberculosis
agccgcaccggcgccgc

SEQ ID NO: 806412 - RNA, 18 nt, Mycobacterium avium subsp. paratuberculosis
agccgcaccucggggcgu

SEQ ID NO: 806413 - RNA, 15 nt, Mycobacterium avium subsp. paratuberculosis
agccgcacgaaccgc

SEQ ID NO: 806414 - RNA, 18 nt, Mycobacterium avium subsp. paratuberculosis
agcccuugcagcacaccg

SEQ ID NO: 806415 - RNA, 21 nt, Mycobacterium avium subsp. paratuberculosis
agcccuugcagcacaccggca

SEQ ID NO: 806416 - RNA, 17 nt, Mycobacterium avium subsp. paratuberculosis
agccgaagccgccgucc

SEQ ID NO: 806417 - RNA, 23 nt, Mycobacterium avium subsp. paratuberculosis
agccgaagccgccguccccgcgc

SEQ ID NO: 806418 - RNA, 13 nt, Mycobacterium avium subsp. paratuberculosis
agccgaagccggc

SEQ ID NO: 806419 - RNA, 17 nt, Mycobacterium avium subsp. paratuberculosis
agccgaagccggcgcag

SEQ ID NO: 806420 - RNA, 22 nt, Mycobacterium avium subsp. paratuberculosis
agccgaaguuggcgucgggcac

SEQ ID NO: 806421 - RNA, 17 nt, Mycobacterium avium subsp. paratuberculosis
agccgacugccccgcuc

SEQ ID NO: 806422 - RNA, 19 nt, Mycobacterium avium subsp. paratuberculosis
agccgagaucgacccgcuc

SEQ ID NO: 806423 - RNA, 23 nt, Mycobacterium avium subsp. paratuberculosis
agccgagaucgacccgcuccgac

SEQ ID NO: 806424 - RNA, 16 nt, Mycobacterium avium subsp. paratuberculosis
agccgagcaccaggcg

SEQ ID NO: 806425 - RNA, 18 nt, Mycobacterium avium subsp. paratuberculosis
agccgagcaccaggcgca

SEQ ID NO: 806426 - RNA, 22 nt, Mycobacterium avium subsp. paratuberculosis
agccgagcaccaggcgcaccag

SEQ ID NO: 806427 - RNA, 17 nt, Mycobacterium avium subsp. paratuberculosis
agccgagcaccggcagc

SEQ ID NO: 806428 - RNA, 20 nt, Mycobacterium avium subsp. paratuberculosis
agccgagcaccggcagcacc

SEQ ID NO: 806429 - RNA, 22 nt, Mycobacterium avium subsp. paratuberculosis
agccgagcacgcagccgcgccc

SEQ ID NO: 806430 - RNA, 21 nt, Mycobacterium avium subsp. paratuberculosis
agcgaagcgggacugcagcgc

SEQ ID NO: 806431 - RNA, 17 nt, Mycobacterium avium subsp. paratuberculosis
agcgaacugccggcaua

SEQ ID NO: 806432 - RNA, 16 nt, Mycobacterium avium subsp. paratuberculosis
agcgaccagucggcgu

SEQ ID NO: 806433 - RNA, 20 nt, Mycobacterium avium subsp. paratuberculosis
agcgaccgcaggucgauggc

SEQ ID NO: 806434 - RNA, 23 nt, Mycobacterium avium subsp. paratuberculosis
agcgaccugguccaccgcggcgg

SEQ ID NO: 806435 - RNA, 20 nt, Mycobacterium avium subsp. paratuberculosis
agcgacggaucggccgcguc

SEQ ID NO: 806436 - RNA, 14 nt, Mycobacterium avium subsp. paratuberculosis
agcgacggccgggu

SEQ ID NO: 806437 - RNA, 16 nt, Mycobacterium avium subsp. paratuberculosis
agcgacgggccgggca

SEQ ID NO: 806438 - RNA, 16 nt, Mycobacterium avium subsp. paratuberculosis
agcgacggcccgccgg

SEQ ID NO: 806439 - RNA, 22 nt, Mycobacterium avium subsp. paratuberculosis
agcgacggcccgccggagccga

SEQ ID NO: 806440 - RNA, 18 nt, Mycobacterium avium subsp. paratuberculosis
agcgacgucaggucgacc

SEQ ID NO: 806441 - RNA, 22 nt, Mycobacterium avium subsp. paratuberculosis
agcgacgucaggucgaccggcu

SEQ ID NO: 806442 - RNA, 13 nt, Mycobacterium avium subsp. paratuberculosis
agcgacgcgacgc

SEQ ID NO: 806443 - RNA, 17 nt, Mycobacterium avium subsp. paratuberculosis
agcgacgaggugaugcc

SEQ ID NO: 806444 - RNA, 22 nt, Mycobacterium avium subsp. paratuberculosis
agcgacgaggugaugccgucca

SEQ ID NO: 806445 - RNA, 20 nt, Mycobacterium avium subsp. paratuberculosis
agcgacgccacggggcugcg

SEQ ID NO: 806446 - RNA, 12 nt, Mycobacterium avium subsp. paratuberculosis
agcgacgccagc

SEQ ID NO: 806447 - RNA, 21 nt, Mycobacterium avium subsp. paratuberculosis
agcgacgccagcggcagcgcc

SEQ ID NO: 806448 - RNA, 13 nt, Mycobacterium avium subsp. paratuberculosis
agcgacgcccaga

SEQ ID NO: 806449 - RNA, 15 nt, Mycobacterium avium subsp. paratuberculosis
agcgagaaccggcgc

SEQ ID NO: 806450 - RNA, 16 nt, Mycobacterium avium subsp. paratuberculosis
agcgacuugaccagca

SEQ ID NO: 806451 - RNA, 17 nt, Mycobacterium avium subsp. paratuberculosis
agcgagacgaccaggau

SEQ ID NO: 806452 - RNA, 18 nt, Mycobacterium avium subsp. paratuberculosis
agcgagaagucgcucagc

SEQ ID NO: 806453 - RNA, 20 nt, Mycobacterium avium subsp. paratuberculosis
agcgagaagucgcucagcgu

SEQ ID NO: 806454 - RNA, 16 nt, Mycobacterium avium subsp. paratuberculosis
agcgagaccggcacgg

SEQ ID NO: 806455 - RNA, 18 nt, Mycobacterium avium subsp. paratuberculosis
agcgagaccucccggcgc

SEQ ID NO: 806456 - RNA, 23 nt, Mycobacterium avium subsp. paratuberculosis
agcgacgucugcggcucggcgcu

SEQ ID NO: 806457 - RNA, 15 nt, Mycobacterium avium subsp. paratuberculosis
agcgacucgaccccg

SEQ ID NO: 806458 - RNA, 19 nt, Mycobacterium avium subsp. paratuberculosis
agcgacucgaccccgccca

SEQ ID NO: 806459 - RNA, 14 nt, Mycobacterium avium subsp. paratuberculosis
agcgacucggccag

SEQ ID NO: 806460 - RNA, 14 nt, Mycobacterium avium subsp. paratuberculosis
agcgacucgggcag

SEQ ID NO: 806461 - RNA, 16 nt, Mycobacterium avium subsp. paratuberculosis
agccugaccgcgggug

SEQ ID NO: 806462 - RNA, 14 nt, Mycobacterium avium subsp. paratuberculosis
agccuccgcgauca

SEQ ID NO: 806463 - RNA, 13 nt, Mycobacterium avium subsp. paratuberculosis
agccucagcgcgc

SEQ ID NO: 806464 - RNA, 15 nt, Mycobacterium avium subsp. paratuberculosis
agccucagcgcgcaa

SEQ ID NO: 806465 - RNA, 17 nt, Mycobacterium avium subsp. paratuberculosis
agccucagggcgcgcug

SEQ ID NO: 806466 - RNA, 14 nt, Mycobacterium avium subsp. paratuberculosis
agccgguucguccc

SEQ ID NO: 806467 - RNA, 19 nt, Mycobacterium avium subsp. paratuberculosis
agccgguucgucccgcgcg

SEQ ID NO: 806468 - RNA, 17 nt, Mycobacterium avium subsp. paratuberculosis
agccgguugcgguggcc

SEQ ID NO: 806469 - RNA, 13 nt, Mycobacterium avium subsp. paratuberculosis
agccguacacggc

SEQ ID NO: 806470 - RNA, 15 nt, Mycobacterium avium subsp. paratuberculosis
agccguacacggcgg

SEQ ID NO: 806471 - RNA, 17 nt, Mycobacterium avium subsp. paratuberculosis
agccguacacggcggcg

SEQ ID NO: 806472 - RNA, 18 nt, Mycobacterium avium subsp. paratuberculosis
agccguacacggcggcga

SEQ ID NO: 806473 - RNA, 15 nt, Mycobacterium avium subsp. paratuberculosis
agccguaccgcaaca

SEQ ID NO: 806474 - RNA, 21 nt, Mycobacterium avium subsp. paratuberculosis
agccguagcgcaacaccgaaa

SEQ ID NO: 806475 - RNA, 13 nt, Mycobacterium avium subsp. paratuberculosis
agccguccaggcc

SEQ ID NO: 806476 - RNA, 14 nt, Mycobacterium avium subsp. paratuberculosis
agccgucccgccgu

SEQ ID NO: 806477 - RNA, 15 nt, Mycobacterium avium subsp. paratuberculosis
agccuggcggcgacc

SEQ ID NO: 806478 - RNA, 12 nt, Mycobacterium avium subsp. paratuberculosis
agccuggcgcgc

SEQ ID NO: 806479 - RNA, 22 nt, Mycobacterium avium subsp. paratuberculosis
agccuggcacgacgccgccgag

SEQ ID NO: 806480 - RNA, 18 nt, Mycobacterium avium subsp. paratuberculosis
agccugaucuugcugguc

SEQ ID NO: 806481 - RNA, 15 nt, Mycobacterium avium subsp. paratuberculosis
agccugaugccgguc

SEQ ID NO: 806482 - RNA, 19 nt, Mycobacterium avium subsp. paratuberculosis
agccugcagugucggaauc

SEQ ID NO: 806483 - RNA, 13 nt, Mycobacterium avium subsp. paratuberculosis
agccugcggccug

SEQ ID NO: 806484 - RNA, 14 nt, Mycobacterium avium subsp. paratuberculosis
agccugcggccugc

SEQ ID NO: 806485 - RNA, 15 nt, Mycobacterium avium subsp. paratuberculosis
agccugcggccugca

SEQ ID NO: 806486 - RNA, 17 nt, Mycobacterium avium subsp. paratuberculosis
agccugcggugaugcgc

SEQ ID NO: 806487 - RNA, 22 nt, Mycobacterium avium subsp. paratuberculosis
agccgguagaucagcgccuggu

SEQ ID NO: 806488 - RNA, 17 nt, Mycobacterium avium subsp. paratuberculosis
agccgguaugcgaucgc

SEQ ID NO: 806489 - RNA, 23 nt, Mycobacterium avium subsp. paratuberculosis
agccgguaugcgaucgcgucgaa

SEQ ID NO: 806490 - RNA, 17 nt, Mycobacterium avium subsp. paratuberculosis
agccgguacggaucgcc

SEQ ID NO: 806491 - RNA, 23 nt, Mycobacterium avium subsp. paratuberculosis
agccgguacggaucgccggacag

SEQ ID NO: 806492 - RNA, 14 nt, Mycobacterium avium subsp. paratuberculosis
agccgguacggcuc

SEQ ID NO: 806493 - RNA, 20 nt, Mycobacterium avium subsp. paratuberculosis
agccgggucaguucgcggcg

SEQ ID NO: 806494 - RNA, 22 nt, Mycobacterium avium subsp. paratuberculosis
agccgggucaguucgcggcgca

SEQ ID NO: 806495 - RNA, 23 nt, Mycobacterium avium subsp. paratuberculosis
agccgggucaguucgcggcgcac

SEQ ID NO: 806496 - RNA, 14 nt, Mycobacterium avium subsp. paratuberculosis
agccgggugcggug

SEQ ID NO: 806497 - RNA, 20 nt, Mycobacterium avium subsp. paratuberculosis
agccggguggcccgcgcgcu

SEQ ID NO: 806498 - RNA, 15 nt, Mycobacterium avium subsp. paratuberculosis
agccgggugcccauc

SEQ ID NO: 806499 - RNA, 17 nt, Mycobacterium avium subsp. paratuberculosis
agccggggacggugcag

SEQ ID NO: 806500 - RNA, 17 nt, Mycobacterium avium subsp. paratuberculosis
agccgggcggcgccgaa

SEQ ID NO: 806501 - RNA, 14 nt, Mycobacterium avium subsp. paratuberculosis
agccgggcggcggc

SEQ ID NO: 806502 - RNA, 15 nt, Mycobacterium avium subsp. paratuberculosis
agccgggcggcggcc

SEQ ID NO: 806503 - RNA, 18 nt, Mycobacterium avium subsp. paratuberculosis
agccgggcggcggccucc

SEQ ID NO: 806504 - RNA, 16 nt, Mycobacterium avium subsp. paratuberculosis
agccgggcggugaugg

SEQ ID NO: 806505 - RNA, 23 nt, Mycobacterium avium subsp. paratuberculosis
agccgggcggugauggucaccgu

SEQ ID NO: 806506 - RNA, 13 nt, Mycobacterium avium subsp. paratuberculosis
agccgggcgcggg

SEQ ID NO: 806507 - RNA, 17 nt, Mycobacterium avium subsp. paratuberculosis
agccgggcggcagcagc

SEQ ID NO: 806508 - RNA, 18 nt, Mycobacterium avium subsp. paratuberculosis
agccgggcggcagcagcu

SEQ ID NO: 806509 - RNA, 19 nt, Mycobacterium avium subsp. paratuberculosis
agccgggcggcagcagcug

SEQ ID NO: 806510 - RNA, 14 nt, Mycobacterium avium subsp. paratuberculosis
agccgggcggccag

SEQ ID NO: 806511 - RNA, 14 nt, Mycobacterium avium subsp. paratuberculosis
agccgggcggccuc

SEQ ID NO: 806512 - RNA, 15 nt, Mycobacterium avium subsp. paratuberculosis
agccgggcggccucg

SEQ ID NO: 806513 - RNA, 12 nt, Mycobacterium avium subsp. paratuberculosis
agccgggcucga

SEQ ID NO: 806514 - RNA, 13 nt, Mycobacterium avium subsp. paratuberculosis
agccgggcucgag

SEQ ID NO: 806515 - RNA, 16 nt, Mycobacterium avium subsp. paratuberculosis
agccgggccugcggcg

SEQ ID NO: 806516 - RNA, 18 nt, Mycobacterium avium subsp. paratuberculosis
agccgggccugcggcgcg

SEQ ID NO: 806517 - RNA, 20 nt, Mycobacterium avium subsp. paratuberculosis
agccgggccugcggcgcggc

SEQ ID NO: 806518 - RNA, 20 nt, Mycobacterium avium subsp. paratuberculosis
agccgggggaucaccucauc

SEQ ID NO: 806519 - RNA, 22 nt, Mycobacterium avium subsp. paratuberculosis
agccgggggaucaccucaucgc

SEQ ID NO: 806520 - RNA, 14 nt, Mycobacterium avium subsp. paratuberculosis
agccgggggcggug

SEQ ID NO: 806521 - RNA, 17 nt, Mycobacterium avium subsp. paratuberculosis
agccgggggcggugcag

SEQ ID NO: 806522 - RNA, 23 nt, Mycobacterium avium subsp. paratuberculosis
agccgggggcggugcagccgggu

SEQ ID NO: 806523 - RNA, 19 nt, Mycobacterium avium subsp. paratuberculosis
agccgggguagggcggcgg

SEQ ID NO: 806524 - RNA, 14 nt, Mycobacterium avium subsp. paratuberculosis
agccggugcaccac

SEQ ID NO: 806525 - RNA, 13 nt, Mycobacterium avium subsp. paratuberculosis
agccgggugggcg

SEQ ID NO: 806526 - RNA, 14 nt, Mycobacterium avium subsp. paratuberculosis
agccggugaucgcg

SEQ ID NO: 806527 - RNA, 19 nt, Mycobacterium avium subsp. paratuberculosis
agccggugaugacgucgcc

SEQ ID NO: 806528 - RNA, 20 nt, Mycobacterium avium subsp. paratuberculosis
agccggugcggucggcgucg

SEQ ID NO: 806529 - RNA, 23 nt, Mycobacterium avium subsp. paratuberculosis
agccggugcggucggcgucguac

SEQ ID NO: 806530 - RNA, 18 nt, Mycobacterium avium subsp. paratuberculosis
agccggugcugacccggu

SEQ ID NO: 806531 - RNA, 21 nt, Mycobacterium avium subsp. paratuberculosis
agccgguggaauucuggccga

SEQ ID NO: 806532 - RNA, 13 nt, Mycobacterium avium subsp. paratuberculosis
agccgguggcagc

SEQ ID NO: 806533 - RNA, 16 nt, Mycobacterium avium subsp. paratuberculosis
agccgguggcagcccg

SEQ ID NO: 806534 - RNA, 14 nt, Mycobacterium avium subsp. paratuberculosis
agccgguggcggcc

SEQ ID NO: 806535 - RNA, 16 nt, Mycobacterium avium subsp. paratuberculosis
agccgguggcggccac

SEQ ID NO: 806536 - RNA, 21 nt, Mycobacterium avium subsp. paratuberculosis
agccggugguuuugcggcccu

SEQ ID NO: 806537 - RNA, 15 nt, Mycobacterium avium subsp. paratuberculosis
agccggucugggcga

SEQ ID NO: 806538 - RNA, 18 nt, Mycobacterium avium subsp. paratuberculosis
agccggucugggcgacca

SEQ ID NO: 806539 - RNA, 21 nt, Mycobacterium avium subsp. paratuberculosis
agccggucuuggacagcagca

SEQ ID NO: 806540 - RNA, 21 nt, Mycobacterium avium subsp. paratuberculosis
agccggucuugggcucggcgc

SEQ ID NO: 806541 - RNA, 16 nt, Mycobacterium avium subsp. paratuberculosis
agccgguaggccugcg

SEQ ID NO: 806542 - RNA, 16 nt, Mycobacterium avium subsp. paratuberculosis
agccggucggcccgcu

SEQ ID NO: 806543 - RNA, 17 nt, Mycobacterium avium subsp. paratuberculosis
agccggucggcccgcuc

SEQ ID NO: 806544 - RNA, 16 nt, Mycobacterium avium subsp. paratuberculosis
agccggucgggaucga

SEQ ID NO: 806545 - RNA, 22 nt, Mycobacterium avium subsp. paratuberculosis
agccggucgucggggcaucgca

SEQ ID NO: 806546 - RNA, 14 nt, Mycobacterium avium subsp. paratuberculosis
agccgguccgacca

SEQ ID NO: 806547 - RNA, 17 nt, Mycobacterium avium subsp. paratuberculosis
agccgguccgaccagcg

SEQ ID NO: 806548 - RNA, 19 nt, Mycobacterium avium subsp. paratuberculosis
agccgguccgaccagcggc

SEQ ID NO: 806549 - RNA, 15 nt, Mycobacterium avium subsp. paratuberculosis
agccgguccgaccgc

SEQ ID NO: 806550 - RNA, 18 nt, Mycobacterium avium subsp. paratuberculosis
agccgguccgaccgccac

SEQ ID NO: 806551 - RNA, 19 nt, Mycobacterium avium subsp. paratuberculosis
agccgguccgaccgccacc

SEQ ID NO: 806552 - RNA, 23 nt, Mycobacterium avium subsp. paratuberculosis
agccgguccgaccgccaccaccc

SEQ ID NO: 806553 - RNA, 17 nt, Mycobacterium avium subsp. paratuberculosis
agccgguccgacggcug

SEQ ID NO: 806554 - RNA, 19 nt, Mycobacterium avium subsp. paratuberculosis
agccgguccgacggcugcg

SEQ ID NO: 806555 - RNA, 16 nt, Mycobacterium avium subsp. paratuberculosis
agccgguccggcggca

SEQ ID NO: 806556 - RNA, 19 nt, Mycobacterium avium subsp. paratuberculosis
agccgguccugggccuccg

SEQ ID NO: 806557 - RNA, 23 nt, Mycobacterium avium subsp. paratuberculosis
agccgguccugggccuccggcgg

SEQ ID NO: 806558 - RNA, 22 nt, Mycobacterium avium subsp. paratuberculosis
agccgguccuuggccugcuugg

SEQ ID NO: 806559 - RNA, 18 nt, Mycobacterium avium subsp. paratuberculosis
agccggucgaacgccagc

SEQ ID NO: 806560 - RNA, 19 nt, Mycobacterium avium subsp. paratuberculosis
agccggucgaggucgccga

SEQ ID NO: 806561 - RNA, 20 nt, Mycobacterium avium subsp. paratuberculosis
agccggucgaggucgccgac

SEQ ID NO: 806562 - RNA, 15 nt, Mycobacterium avium subsp. paratuberculosis
agccggucgccgggc

SEQ ID NO: 806563 - RNA, 18 nt, Mycobacterium avium subsp. paratuberculosis
agccggucgccgggccgg

SEQ ID NO: 806564 - RNA, 19 nt, Mycobacterium avium subsp. paratuberculosis
agccggucgccgggccggc

SEQ ID NO: 806565 - RNA, 15 nt, Mycobacterium avium subsp. paratuberculosis
agccggucgcgcauc

SEQ ID NO: 806566 - RNA, 23 nt, Mycobacterium avium subsp. paratuberculosis
agccggucgcgcaucgccucggc

SEQ ID NO: 806567 - RNA, 14 nt, Mycobacterium avium subsp. paratuberculosis
agccgggccgcccg

SEQ ID NO: 806568 - RNA, 16 nt, Mycobacterium avium subsp. paratuberculosis
agccgggccgcccgcg

SEQ ID NO: 806569 - RNA, 18 nt, Mycobacterium avium subsp. paratuberculosis
agccgggccgcccgcgcg

SEQ ID NO: 806570 - RNA, 23 nt, Mycobacterium avium subsp. paratuberculosis
agccgggccggguccacgccgag

SEQ ID NO: 806571 - RNA, 23 nt, Mycobacterium avium subsp. paratuberculosis
agccgggccaauuacgcugcggc

SEQ ID NO: 806572 - RNA, 20 nt, Mycobacterium avium subsp. paratuberculosis
agccgggccaggucccaggc

SEQ ID NO: 806573 - RNA, 21 nt, Mycobacterium avium subsp. paratuberculosis
agccgggccaggucccaggcg

SEQ ID NO: 806574 - RNA, 23 nt, Mycobacterium avium subsp. paratuberculosis
agccggcggcgccuugccggucu

SEQ ID NO: 806575 - RNA, 14 nt, Mycobacterium avium subsp. paratuberculosis
agccggcgcgcggu

SEQ ID NO: 806576 - RNA, 15 nt, Mycobacterium avium subsp. paratuberculosis
agccggcgcgcggug

SEQ ID NO: 806577 - RNA, 12 nt, Mycobacterium avium subsp. paratuberculosis
agccggcggcgg

SEQ ID NO: 806578 - RNA, 16 nt, Mycobacterium avium subsp. paratuberculosis
agccggcggcggcggu

SEQ ID NO: 806579 - RNA, 20 nt, Mycobacterium avium subsp. paratuberculosis
agccggcggcggcggucggc

SEQ ID NO: 806580 - RNA, 23 nt, Mycobacterium avium subsp. paratuberculosis
agccggcggcggcggucggcaua

SEQ ID NO: 806581 - RNA, 14 nt, Mycobacterium avium subsp. paratuberculosis
agccggcggcggug

SEQ ID NO: 806582 - RNA, 14 nt, Mycobacterium avium subsp. paratuberculosis
agccggcgguggcc

SEQ ID NO: 806583 - RNA, 22 nt, Mycobacterium avium subsp. paratuberculosis
agccggcgguggccaugcgcga

SEQ ID NO: 806584 - RNA, 22 nt, Mycobacterium avium subsp. paratuberculosis
agccggcgucgaugaugccggc

SEQ ID NO: 806585 - RNA, 13 nt, Mycobacterium avium subsp. paratuberculosis
agccggcgucgcc

SEQ ID NO: 806586 - RNA, 19 nt, Mycobacterium avium subsp. paratuberculosis
agccggcucagggugcgcu

SEQ ID NO: 806587 - RNA, 22 nt, Mycobacterium avium subsp. paratuberculosis
agccggcucagggugcgcuggc

SEQ ID NO: 806588 - RNA, 13 nt, Mycobacterium avium subsp. paratuberculosis
agccggcgcacca

SEQ ID NO: 806589 - RNA, 22 nt, Mycobacterium avium subsp. paratuberculosis
agccggcgcaccagggugucgu

SEQ ID NO: 806590 - RNA, 20 nt, Mycobacterium avium subsp. paratuberculosis
agccggcgcaccgcgucgau

SEQ ID NO: 806591 - RNA, 19 nt, Mycobacterium avium subsp. paratuberculosis
agccggcgcacucccgcgu

SEQ ID NO: 806592 - RNA, 20 nt, Mycobacterium avium subsp. paratuberculosis
agccggcgcacucccgcgua

SEQ ID NO: 806593 - RNA, 14 nt, Mycobacterium avium subsp. paratuberculosis
agccggcgcaggug

SEQ ID NO: 806594 - RNA, 15 nt, Mycobacterium avium subsp. paratuberculosis
agccggccagcagcg

SEQ ID NO: 806595 - RNA, 17 nt, Mycobacterium avium subsp. paratuberculosis
agccggcgacgaccgca

SEQ ID NO: 806596 - RNA, 22 nt, Mycobacterium avium subsp. paratuberculosis
agccggcgacgaccgcaccgac

SEQ ID NO: 806597 - RNA, 14 nt, Mycobacterium avium subsp. paratuberculosis
agccggcgagcgcg

SEQ ID NO: 806598 - RNA, 13 nt, Mycobacterium avium subsp. paratuberculosis
agccggcgaucgu

SEQ ID NO: 806599 - RNA, 15 nt, Mycobacterium avium subsp. paratuberculosis
agccggcgaucgucg

SEQ ID NO: 806600 - RNA, 17 nt, Mycobacterium avium subsp. paratuberculosis
agccggcgaucgucgcc

SEQ ID NO: 806601 - RNA, 21 nt, Mycobacterium avium subsp. paratuberculosis
agccggcgaucgucgccguca

SEQ ID NO: 806602 - RNA, 14 nt, Mycobacterium avium subsp. paratuberculosis
agccggccgccgaa

SEQ ID NO: 806603 - RNA, 16 nt, Mycobacterium avium subsp. paratuberculosis
agccggccucgccggc

SEQ ID NO: 806604 - RNA, 19 nt, Mycobacterium avium subsp. paratuberculosis
agccggccucgccggcgcc

SEQ ID NO: 806605 - RNA, 16 nt, Mycobacterium avium subsp. paratuberculosis
agccggccggacaccg

SEQ ID NO: 806606 - RNA, 17 nt, Mycobacterium avium subsp. paratuberculosis
agccggccggacaccga

SEQ ID NO: 806607 - RNA, 12 nt, Mycobacterium avium subsp. paratuberculosis
agccggccggca

SEQ ID NO: 806608 - RNA, 13 nt, Mycobacterium avium subsp. paratuberculosis
agccggccggccg

SEQ ID NO: 806609 - RNA, 16 nt, Mycobacterium avium subsp. paratuberculosis
agccggccggccgaca

SEQ ID NO: 806610 - RNA, 16 nt, Mycobacterium avium subsp. paratuberculosis
agccggccggcggacg

SEQ ID NO: 806611 - RNA, 23 nt, Mycobacterium avium subsp. paratuberculosis
agccggccguagcggacgacggc

SEQ ID NO: 806612 - RNA, 12 nt, Mycobacterium avium subsp. paratuberculosis
agccggccguca

SEQ ID NO: 806613 - RNA, 17 nt, Mycobacterium avium subsp. paratuberculosis
agccggccguccacggc

SEQ ID NO: 806614 - RNA, 21 nt, Mycobacterium avium subsp. paratuberculosis
agccggccguccacggcggug

SEQ ID NO: 806615 - RNA, 21 nt, Mycobacterium avium subsp. paratuberculosis
agccggccagguugaccacca

SEQ ID NO: 806616 - RNA, 20 nt, Mycobacterium avium subsp. paratuberculosis
agccggccgaagaccgccga

SEQ ID NO: 806617 - RNA, 20 nt, Mycobacterium avium subsp. paratuberculosis
agccggccgacgcggccucg

SEQ ID NO: 806618 - RNA, 22 nt, Mycobacterium avium subsp. paratuberculosis
agccggcccgagcccugcgcca

SEQ ID NO: 806619 - RNA, 19 nt, Mycobacterium avium subsp. paratuberculosis
agccggcccgcagccagcg

SEQ ID NO: 806620 - RNA, 21 nt, Mycobacterium avium subsp. paratuberculosis
agccggcccgcagccagcgca

SEQ ID NO: 806621 - RNA, 15 nt, Mycobacterium avium subsp. paratuberculosis
agccggcccgcaucg

SEQ ID NO: 806622 - RNA, 16 nt, Mycobacterium avium subsp. paratuberculosis
agccggccagcgucgc

SEQ ID NO: 806623 - RNA, 13 nt, Mycobacterium avium subsp. paratuberculosis
agccggccagcuc

SEQ ID NO: 806624 - RNA, 14 nt, Mycobacterium avium subsp. paratuberculosis
agccggccagcucg

SEQ ID NO: 806625 - RNA, 17 nt, Mycobacterium avium subsp. paratuberculosis
agccggccaacagcagc

SEQ ID NO: 806626 - RNA, 13 nt, Mycobacterium avium subsp. paratuberculosis
agccggccaccgc

SEQ ID NO: 806627 - RNA, 14 nt, Mycobacterium avium subsp. paratuberculosis
agccggccaccgcc

SEQ ID NO: 806628 - RNA, 17 nt, Mycobacterium avium subsp. paratuberculosis
agccggccaccgcccca

SEQ ID NO: 806629 - RNA, 21 nt, Mycobacterium avium subsp. paratuberculosis
agccggccaccgccccagccg

SEQ ID NO: 806630 - RNA, 17 nt, Mycobacterium avium subsp. paratuberculosis
agaaguauucgccgucg

SEQ ID NO: 806631 - RNA, 15 nt, Mycobacterium avium subsp. paratuberculosis
agaaguggucgaucu

SEQ ID NO: 806632 - RNA, 11 nt, Mycobacterium avium subsp. paratuberculosis
agaaggccgcc

SEQ ID NO: 806633 - RNA, 15 nt, Mycobacterium avium subsp. paratuberculosis
agaaggcggcgucga

SEQ ID NO: 806634 - RNA, 20 nt, Mycobacterium avium subsp. paratuberculosis
agacaaccggugugccuggc

SEQ ID NO: 806635 - RNA, 18 nt, Mycobacterium avium subsp. paratuberculosis
agacacgaauacccuucg

SEQ ID NO: 806636 - RNA, 22 nt, Mycobacterium avium subsp. paratuberculosis
agacacgaauacccuucggccg

SEQ ID NO: 806637 - RNA, 15 nt, Mycobacterium avium subsp. paratuberculosis
agacacgcgccggcg

SEQ ID NO: 806638 - RNA, 14 nt, Mycobacterium avium subsp. paratuberculosis
agacacgcucacgc

SEQ ID NO: 806639 - RNA, 14 nt, Mycobacterium avium subsp. paratuberculosis
agacaggccggccg

SEQ ID NO: 806640 - RNA, 23 nt, Mycobacterium avium subsp. paratuberculosis
acugcuugggcgccucgccgacc

SEQ ID NO: 806641 - RNA, 15 nt, Mycobacterium avium subsp. paratuberculosis
acugcucgaccagcc

SEQ ID NO: 806642 - RNA, 15 nt, Mycobacterium avium subsp. paratuberculosis
acugcugcccgcgac

SEQ ID NO: 806643 - RNA, 11 nt, Mycobacterium avium subsp. paratuberculosis
acugcuucggg

SEQ ID NO: 806644 - RNA, 19 nt, Mycobacterium avium subsp. paratuberculosis
acugcuucgggucgccggu

SEQ ID NO: 806645 - RNA, 14 nt, Mycobacterium avium subsp. paratuberculosis
acugcuugccgccg

SEQ ID NO: 806646 - RNA, 17 nt, Mycobacterium avium subsp. paratuberculosis
acugcuugccgccgggc

SEQ ID NO: 806647 - RNA, 18 nt, Mycobacterium avium subsp. paratuberculosis
acugcuugccgucgacgc

SEQ ID NO: 806648 - RNA, 22 nt, Mycobacterium avium subsp. paratuberculosis
agaacaccgaauuguccagcag

SEQ ID NO: 806649 - RNA, 17 nt, Mycobacterium avium subsp. paratuberculosis
agaacacgccccggcgg

SEQ ID NO: 806650 - RNA, 21 nt, Mycobacterium avium subsp. paratuberculosis
agaacaggugcggcaacccga

SEQ ID NO: 806651 - RNA, 23 nt, Mycobacterium avium subsp. paratuberculosis
agaacaucagccccuuguagguc

SEQ ID NO: 806652 - RNA, 17 nt, Mycobacterium avium subsp. paratuberculosis
agaacaggccgagcgcg

SEQ ID NO: 806653 - RNA, 23 nt, Mycobacterium avium subsp. paratuberculosis
agaacgacgccaguucgucggcc

SEQ ID NO: 806654 - RNA, 17 nt, Mycobacterium avium subsp. paratuberculosis
agaacgacuggcggcgg

SEQ ID NO: 806655 - RNA, 17 nt, Mycobacterium avium subsp. paratuberculosis
agaacgcaaucgcccag

SEQ ID NO: 806656 - RNA, 13 nt, Mycobacterium avium subsp. paratuberculosis
agaacgacgccac

SEQ ID NO: 806657 - RNA, 18 nt, Mycobacterium avium subsp. paratuberculosis
agaaccagcaccgccgcg

SEQ ID NO: 806658 - RNA, 21 nt, Mycobacterium avium subsp. paratuberculosis
agaaccagcaccgccgcggcc

SEQ ID NO: 806659 - RNA, 15 nt, Mycobacterium avium subsp. paratuberculosis
agaaccagcccggcc

SEQ ID NO: 806660 - RNA, 17 nt, Mycobacterium avium subsp. paratuberculosis
agaaccagcccggcccg

SEQ ID NO: 806661 - RNA, 18 nt, Mycobacterium avium subsp. paratuberculosis
agaaccagcccggcccgu

SEQ ID NO: 806662 - RNA, 20 nt, Mycobacterium avium subsp. paratuberculosis
agaaccgcucggcggcgccg

SEQ ID NO: 806663 - RNA, 21 nt, Mycobacterium avium subsp. paratuberculosis
agaaccgcucggcggcgccgu

SEQ ID NO: 806664 - RNA, 21 nt, Mycobacterium avium subsp. paratuberculosis
agaacgggcugaacucgacgu

SEQ ID NO: 806665 - RNA, 20 nt, Mycobacterium avium subsp. paratuberculosis
agaacucgaucugcagccgg

SEQ ID NO: 806666 - RNA, 12 nt, Mycobacterium avium subsp. paratuberculosis
agaagcgggcca

SEQ ID NO: 806667 - RNA, 18 nt, Mycobacterium avium subsp. paratuberculosis
agaacuucgccagcgggc

SEQ ID NO: 806668 - RNA, 18 nt, Mycobacterium avium subsp. paratuberculosis
agaacuucuccgccggca

SEQ ID NO: 806669 - RNA, 19 nt, Mycobacterium avium subsp. paratuberculosis
agaacuucuccgccggcag

SEQ ID NO: 806670 - RNA, 13 nt, Mycobacterium avium subsp. paratuberculosis
agacgcugccgcu

SEQ ID NO: 806671 - RNA, 23 nt, Mycobacterium avium subsp. paratuberculosis
agacggcguggcugaggccgccc

SEQ ID NO: 806672 - RNA, 13 nt, Mycobacterium avium subsp. paratuberculosis
agacggacacccg

SEQ ID NO: 806673 - RNA, 17 nt, Mycobacterium avium subsp. paratuberculosis
agacggacacccgcgcg

SEQ ID NO: 806674 - RNA, 14 nt, Mycobacterium avium subsp. paratuberculosis
agacguccagcgcc

SEQ ID NO: 806675 - RNA, 17 nt, Mycobacterium avium subsp. paratuberculosis
agacguccagcgccgcc

SEQ ID NO: 806676 - RNA, 20 nt, Mycobacterium avium subsp. paratuberculosis
agacguccagcgccgccauc

SEQ ID NO: 806677 - RNA, 14 nt, Mycobacterium avium subsp. paratuberculosis
agacguccgagguc

SEQ ID NO: 806678 - RNA, 16 nt, Mycobacterium avium subsp. paratuberculosis
agacggugcuggcgau

SEQ ID NO: 806679 - RNA, 18 nt, Mycobacterium avium subsp. paratuberculosis
agacgguggggcuggccg

SEQ ID NO: 806680 - RNA, 16 nt, Mycobacterium avium subsp. paratuberculosis
agacggucuuggcguu

SEQ ID NO: 806681 - RNA, 13 nt, Mycobacterium avium subsp. paratuberculosis
agacguccgcguc

SEQ ID NO: 806682 - RNA, 19 nt, Mycobacterium avium subsp. paratuberculosis
agacguccgcgucggcgcc

SEQ ID NO: 806683 - RNA, 23 nt, Mycobacterium avium subsp. paratuberculosis
agacguccgcgucggcgccggcc

SEQ ID NO: 806684 - RNA, 13 nt, Mycobacterium avium subsp. paratuberculosis
agacugaugcccu

SEQ ID NO: 806685 - RNA, 19 nt, Mycobacterium avium subsp. paratuberculosis
agacugaugaagccgccga

SEQ ID NO: 806686 - RNA, 15 nt, Mycobacterium avium subsp. paratuberculosis
agacugcgcaccgcc

SEQ ID NO: 806687 - RNA, 17 nt, Mycobacterium avium subsp. paratuberculosis
agacugcgcaccgccag

SEQ ID NO: 806688 - RNA, 19 nt, Mycobacterium avium subsp. paratuberculosis
agagccgcugcacgcguug

SEQ ID NO: 806689 - RNA, 20 nt, Mycobacterium avium subsp. paratuberculosis
agagccgguagaucagcgcc

SEQ ID NO: 806690 - RNA, 22 nt, Mycobacterium avium subsp. paratuberculosis
agagcgggaucccgcagccgcg

SEQ ID NO: 806691 - RNA, 20 nt, Mycobacterium avium subsp. paratuberculosis
agagcgcgucgacgcggucg

SEQ ID NO: 806692 - RNA, 20 nt, Mycobacterium avium subsp. paratuberculosis
agagcgggccgaccgucagc

SEQ ID NO: 806693 - RNA, 15 nt, Mycobacterium avium subsp. paratuberculosis
agagcgguuugcggg

SEQ ID NO: 806694 - RNA, 20 nt, Mycobacterium avium subsp. paratuberculosis
agagccguuuggcgccgccc

SEQ ID NO: 806695 - RNA, 21 nt, Mycobacterium avium subsp. paratuberculosis
agagccguuuggcgccgccca

SEQ ID NO: 806696 - RNA, 19 nt, Mycobacterium avium subsp. paratuberculosis
agauagcccagccagccgg

SEQ ID NO: 806697 - RNA, 21 nt, Mycobacterium avium subsp. paratuberculosis
agauaggcggcgacggcgucg

SEQ ID NO: 806698 - RNA, 18 nt, Mycobacterium avium subsp. paratuberculosis
agauacggucgcaccgcg

SEQ ID NO: 806699 - RNA, 14 nt, Mycobacterium avium subsp. paratuberculosis
agauaccggccggc

SEQ ID NO: 806700 - RNA, 15 nt, Mycobacterium avium subsp. paratuberculosis
agaccaugccgccga

SEQ ID NO: 806701 - RNA, 15 nt, Mycobacterium avium subsp. paratuberculosis
agaccauggcgcggc

SEQ ID NO: 806702 - RNA, 13 nt, Mycobacterium avium subsp. paratuberculosis
agacccgccgcgg

SEQ ID NO: 806703 - RNA, 13 nt, Mycobacterium avium subsp. paratuberculosis
agacccgcgucga

SEQ ID NO: 806704 - RNA, 22 nt, Mycobacterium avium subsp. paratuberculosis
agacccuggaugaucucgaugc

SEQ ID NO: 806705 - RNA, 20 nt, Mycobacterium avium subsp. paratuberculosis
agaccgaagaucaccgcgac

SEQ ID NO: 806706 - RNA, 19 nt, Mycobacterium avium subsp. paratuberculosis
agacccacagcugccggcc

SEQ ID NO: 806707 - RNA, 15 nt, Mycobacterium avium subsp. paratuberculosis
agacccccagcagcg

SEQ ID NO: 806708 - RNA, 22 nt, Mycobacterium avium subsp. paratuberculosis
agaccggccggggcgggcacgu

SEQ ID NO: 806709 - RNA, 12 nt, Mycobacterium avium subsp. paratuberculosis
agaccgggccga

SEQ ID NO: 806710 - RNA, 13 nt, Mycobacterium avium subsp. paratuberculosis
agaccgggucgua

SEQ ID NO: 806711 - RNA, 18 nt, Mycobacterium avium subsp. paratuberculosis
agaccggugagcaccggg

SEQ ID NO: 806712 - RNA, 18 nt, Mycobacterium avium subsp. paratuberculosis
agaccgugugccagcccg

SEQ ID NO: 806713 - RNA, 12 nt, Mycobacterium avium subsp. paratuberculosis
agaccucccggc

SEQ ID NO: 806714 - RNA, 23 nt, Mycobacterium avium subsp. paratuberculosis
agaccucccggcgccacgccgcg

SEQ ID NO: 806715 - RNA, 13 nt, Mycobacterium avium subsp. paratuberculosis
agaccucgccgac

SEQ ID NO: 806716 - RNA, 17 nt, Mycobacterium avium subsp. paratuberculosis
agaccucgccgacggug

SEQ ID NO: 806717 - RNA, 20 nt, Mycobacterium avium subsp. paratuberculosis
agaccguccgguucggcggc

SEQ ID NO: 806718 - RNA, 20 nt, Mycobacterium avium subsp. paratuberculosis
agacgcaaaagccccgcgac

SEQ ID NO: 806719 - RNA, 15 nt, Mycobacterium avium subsp. paratuberculosis
agacgaugcccagcc

SEQ ID NO: 806720 - RNA, 14 nt, Mycobacterium avium subsp. paratuberculosis
agacgaugucgucg

SEQ ID NO: 806721 - RNA, 15 nt, Mycobacterium avium subsp. paratuberculosis
agacgaugucgucgc

SEQ ID NO: 806722 - RNA, 23 nt, Mycobacterium avium subsp. paratuberculosis
agacgaugucgucgccgguggcc

SEQ ID NO: 806723 - RNA, 21 nt, Mycobacterium avium subsp. paratuberculosis
agacgaucaccggcuugccga

SEQ ID NO: 806724 - RNA, 16 nt, Mycobacterium avium subsp. paratuberculosis
agacgaucucgccguc

SEQ ID NO: 806725 - RNA, 17 nt, Mycobacterium avium subsp. paratuberculosis
agacgaucucgccgucc

SEQ ID NO: 806726 - RNA, 18 nt, Mycobacterium avium subsp. paratuberculosis
agacgaucucgccguccu

SEQ ID NO: 806727 - RNA, 22 nt, Mycobacterium avium subsp. paratuberculosis
agacgaugaaaccccagccggc

SEQ ID NO: 806728 - RNA, 14 nt, Mycobacterium avium subsp. paratuberculosis
agacgaacgcggcc

SEQ ID NO: 806729 - RNA, 23 nt, Mycobacterium avium subsp. paratuberculosis
agacgaccagguccaccccgcca

SEQ ID NO: 806730 - RNA, 20 nt, Mycobacterium avium subsp. paratuberculosis
agacgacgacgaacgcggug

SEQ ID NO: 806731 - RNA, 14 nt, Mycobacterium avium subsp. paratuberculosis
agacgacgccacca

SEQ ID NO: 806732 - RNA, 12 nt, Mycobacterium avium subsp. paratuberculosis
agacgacgucga

SEQ ID NO: 806733 - RNA, 14 nt, Mycobacterium avium subsp. paratuberculosis
agacgagccgccgc

SEQ ID NO: 806734 - RNA, 17 nt, Mycobacterium avium subsp. paratuberculosis
agacgagccgccgcggg

SEQ ID NO: 806735 - RNA, 15 nt, Mycobacterium avium subsp. paratuberculosis
agacgagcucaccgc

SEQ ID NO: 806736 - RNA, 20 nt, Mycobacterium avium subsp. paratuberculosis
agaccugguugccgcccucg

SEQ ID NO: 806737 - RNA, 17 nt, Mycobacterium avium subsp. paratuberculosis
agaccuugaccaccgag

SEQ ID NO: 806738 - RNA, 17 nt, Mycobacterium avium subsp. paratuberculosis
agacgcgaaagcagcgu

SEQ ID NO: 806739 - RNA, 19 nt, Mycobacterium avium subsp. paratuberculosis
agacgcgaaagucccccaa

SEQ ID NO: 806740 - RNA, 15 nt, Mycobacterium avium subsp. paratuberculosis
agacgcgcaccaggg

SEQ ID NO: 806741 - RNA, 19 nt, Mycobacterium avium subsp. paratuberculosis
agacgcgcaccgccaccgc

SEQ ID NO: 806742 - RNA, 21 nt, Mycobacterium avium subsp. paratuberculosis
agacgcgcaccgccaccgccc

SEQ ID NO: 806743 - RNA, 13 nt, Mycobacterium avium subsp. paratuberculosis
agcaucucggcga

SEQ ID NO: 806744 - RNA, 14 nt, Mycobacterium avium subsp. paratuberculosis
agcaucucggugcc

SEQ ID NO: 806745 - RNA, 17 nt, Mycobacterium avium subsp. paratuberculosis
agcaucgggacgccugc

SEQ ID NO: 806746 - RNA, 12 nt, Mycobacterium avium subsp. paratuberculosis
agcaucgggcgc

SEQ ID NO: 806747 - RNA, 13 nt, Mycobacterium avium subsp. paratuberculosis
agcaucgccgucg

SEQ ID NO: 806748 - RNA, 21 nt, Mycobacterium avium subsp. paratuberculosis
agcaucgccgucgucagccgg

SEQ ID NO: 806749 - RNA, 14 nt, Mycobacterium avium subsp. paratuberculosis
agcaucggaugccg

SEQ ID NO: 806750 - RNA, 14 nt, Mycobacterium avium subsp. paratuberculosis
agcaucgccgcgac

SEQ ID NO: 806751 - RNA, 15 nt, Mycobacterium avium subsp. paratuberculosis
agcaucgccgcggug

SEQ ID NO: 806752 - RNA, 19 nt, Mycobacterium avium subsp. paratuberculosis
agcaucgccgcggugcgcg

SEQ ID NO: 806753 - RNA, 20 nt, Mycobacterium avium subsp. paratuberculosis
agcaucgccgcggugcgcga

SEQ ID NO: 806754 - RNA, 13 nt, Mycobacterium avium subsp. paratuberculosis
agccacagcucgg

SEQ ID NO: 806755 - RNA, 13 nt, Mycobacterium avium subsp. paratuberculosis
agccacagccgca

SEQ ID NO: 806756 - RNA, 16 nt, Mycobacterium avium subsp. paratuberculosis
agcauuucgcgcggca

SEQ ID NO: 806757 - RNA, 16 nt, Mycobacterium avium subsp. paratuberculosis
agccacaccgccgcgg

SEQ ID NO: 806758 - RNA, 16 nt, Mycobacterium avium subsp. paratuberculosis
agccacaccgccggcg

SEQ ID NO: 806759 - RNA, 21 nt, Mycobacterium avium subsp. paratuberculosis
agcauucgccggggucgcgcg

SEQ ID NO: 806760 - RNA, 17 nt, Mycobacterium avium subsp. paratuberculosis
agcauuggaaaguccuu

SEQ ID NO: 806761 - RNA, 14 nt, Mycobacterium avium subsp. paratuberculosis
agcauuggcgaugg

SEQ ID NO: 806762 - RNA, 14 nt, Mycobacterium avium subsp. paratuberculosis
agcauguugaacgc

SEQ ID NO: 806763 - RNA, 19 nt, Mycobacterium avium subsp. paratuberculosis
agcauguugaacgccgcgu

SEQ ID NO: 806764 - RNA, 19 nt, Mycobacterium avium subsp. paratuberculosis
agcaguuuguccugcucgg

SEQ ID NO: 806765 - RNA, 23 nt, Mycobacterium avium subsp. paratuberculosis
agcaguuuguccugcucggcgac

SEQ ID NO: 806766 - RNA, 15 nt, Mycobacterium avium subsp. paratuberculosis
agcaguuccgacauc

SEQ ID NO: 806767 - RNA, 20 nt, Mycobacterium avium subsp. paratuberculosis
agcaguucgaugcgcucggc

SEQ ID NO: 806768 - RNA, 20 nt, Mycobacterium avium subsp. paratuberculosis
agcaguucguccacgcuggc

SEQ ID NO: 806769 - RNA, 18 nt, Mycobacterium avium subsp. paratuberculosis
agcagugccccguccggc

SEQ ID NO: 806770 - RNA, 21 nt, Mycobacterium avium subsp. paratuberculosis
agcagguccauggccuugacg

SEQ ID NO: 806771 - RNA, 15 nt, Mycobacterium avium subsp. paratuberculosis
agcagguccgccggu

SEQ ID NO: 806772 - RNA, 18 nt, Mycobacterium avium subsp. paratuberculosis
agcagguccgccggugcc

SEQ ID NO: 806773 - RNA, 14 nt, Mycobacterium avium subsp. paratuberculosis
agcaggucggccag

SEQ ID NO: 806774 - RNA, 15 nt, Mycobacterium avium subsp. paratuberculosis
agcaggucggccagc

SEQ ID NO: 806775 - RNA, 13 nt, Mycobacterium avium subsp. paratuberculosis
agcaggucggcgu

SEQ ID NO: 806776 - RNA, 18 nt, Mycobacterium avium subsp. paratuberculosis
agcaggucggcgugcucg

SEQ ID NO: 806777 - RNA, 15 nt, Mycobacterium avium subsp. paratuberculosis
agcaggucgucgacg

SEQ ID NO: 806778 - RNA, 21 nt, Mycobacterium avium subsp. paratuberculosis
agcaggucgucgacguccucg

SEQ ID NO: 806779 - RNA, 16 nt, Mycobacterium avium subsp. paratuberculosis
agcaggucgucgauca

SEQ ID NO: 806780 - RNA, 16 nt, Mycobacterium avium subsp. paratuberculosis
agcagugccaccacca

SEQ ID NO: 806781 - RNA, 20 nt, Mycobacterium avium subsp. paratuberculosis
agcaggucgaaggcggccgc

SEQ ID NO: 806782 - RNA, 17 nt, Mycobacterium avium subsp. paratuberculosis
agcagguagaucgccag

SEQ ID NO: 806783 - RNA, 12 nt, Mycobacterium avium subsp. paratuberculosis
agcagguagcgg

SEQ ID NO: 806784 - RNA, 19 nt, Mycobacterium avium subsp. paratuberculosis
agcagguagcggcugaccg

SEQ ID NO: 806785 - RNA, 19 nt, Mycobacterium avium subsp. paratuberculosis
agcagguaaaccagcagcg

SEQ ID NO: 806786 - RNA, 14 nt, Mycobacterium avium subsp. paratuberculosis
agcagggcggcgau

SEQ ID NO: 806787 - RNA, 13 nt, Mycobacterium avium subsp. paratuberculosis
agcaggcgccgca

SEQ ID NO: 806788 - RNA, 15 nt, Mycobacterium avium subsp. paratuberculosis
agcaggcgccgcagc

SEQ ID NO: 806789 - RNA, 14 nt, Mycobacterium avium subsp. paratuberculosis
agcaggcccaggcc

SEQ ID NO: 806790 - RNA, 17 nt, Mycobacterium avium subsp. paratuberculosis
agcaggcccaggccgau

SEQ ID NO: 806791 - RNA, 17 nt, Mycobacterium avium subsp. paratuberculosis
agcaggcccucggccag

SEQ ID NO: 806792 - RNA, 18 nt, Mycobacterium avium subsp. paratuberculosis
agcaggcccucggccagc

SEQ ID NO: 806793 - RNA, 13 nt, Mycobacterium avium subsp. paratuberculosis
agcagaucggguc

SEQ ID NO: 806794 - RNA, 17 nt, Mycobacterium avium subsp. paratuberculosis
agcagcaccacccgcac

SEQ ID NO: 806795 - RNA, 18 nt, Mycobacterium avium subsp. paratuberculosis
agcagcaccacccgcacc

SEQ ID NO: 806796 - RNA, 13 nt, Mycobacterium avium subsp. paratuberculosis
agcagcaccagau

SEQ ID NO: 806797 - RNA, 12 nt, Mycobacterium avium subsp. paratuberculosis
agcagcacccgg

SEQ ID NO: 806798 - RNA, 15 nt, Mycobacterium avium subsp. paratuberculosis
agcagccgaucuggc

SEQ ID NO: 806799 - RNA, 14 nt, Mycobacterium avium subsp. paratuberculosis
agcagccgcaacca

SEQ ID NO: 806800 - RNA, 16 nt, Mycobacterium avium subsp. paratuberculosis
agcagccgcagcgcgc

SEQ ID NO: 806801 - RNA, 17 nt, Mycobacterium avium subsp. paratuberculosis
agcagccgcagcggcgg

SEQ ID NO: 806802 - RNA, 15 nt, Mycobacterium avium subsp. paratuberculosis
agcagcaccagcgcc

SEQ ID NO: 806803 - RNA, 18 nt, Mycobacterium avium subsp. paratuberculosis
agcagcaccagcgccgcg

SEQ ID NO: 806804 - RNA, 13 nt, Mycobacterium avium subsp. paratuberculosis
agcagcaccaggc

SEQ ID NO: 806805 - RNA, 22 nt, Mycobacterium avium subsp. paratuberculosis
agcagcaccaggcugaccagcg

SEQ ID NO: 806806 - RNA, 22 nt, Mycobacterium avium subsp. paratuberculosis
agcagcaccccgaucgcgauca

SEQ ID NO: 806807 - RNA, 16 nt, Mycobacterium avium subsp. paratuberculosis
agcagaugccgcccag

SEQ ID NO: 806808 - RNA, 15 nt, Mycobacterium avium subsp. paratuberculosis
agcagaugcgccucg

SEQ ID NO: 806809 - RNA, 20 nt, Mycobacterium avium subsp. paratuberculosis
agcagaugcgcgucgcggcg

SEQ ID NO: 806810 - RNA, 20 nt, Mycobacterium avium subsp. paratuberculosis
agcagaugcgugcggugguc

SEQ ID NO: 806811 - RNA, 20 nt, Mycobacterium avium subsp. paratuberculosis
agcagacacaaaagcaccca

SEQ ID NO: 806812 - RNA, 15 nt, Mycobacterium avium subsp. paratuberculosis
agcagcgcccaccgc

SEQ ID NO: 806813 - RNA, 21 nt, Mycobacterium avium subsp. paratuberculosis
agcagcgcccaccgcucgucg

SEQ ID NO: 806814 - RNA, 10 nt, Mycobacterium avium subsp. paratuberculosis
agcagcgccg

SEQ ID NO: 806815 - RNA, 14 nt, Mycobacterium avium subsp. paratuberculosis
agcagcgccgccac

SEQ ID NO: 806816 - RNA, 15 nt, Mycobacterium avium subsp. paratuberculosis
agcagcgccgccacc

SEQ ID NO: 806817 - RNA, 16 nt, Mycobacterium avium subsp. paratuberculosis
agcagcgccgccaccg

SEQ ID NO: 806818 - RNA, 17 nt, Mycobacterium avium subsp. paratuberculosis
agcagcgccgccaccgg

SEQ ID NO: 806819 - RNA, 12 nt, Mycobacterium avium subsp. paratuberculosis
agcagcgccgcg

SEQ ID NO: 806820 - RNA, 22 nt, Mycobacterium avium subsp. paratuberculosis
agcagcgcgaugccggccaggc

SEQ ID NO: 806821 - RNA, 13 nt, Mycobacterium avium subsp. paratuberculosis
agcagcgcgccgc

SEQ ID NO: 806822 - RNA, 14 nt, Mycobacterium avium subsp. paratuberculosis
agcagcgcgccgcg

SEQ ID NO: 806823 - RNA, 22 nt, Mycobacterium avium subsp. paratuberculosis
agcagcgcgccgcgcuggccga

SEQ ID NO: 806824 - RNA, 14 nt, Mycobacterium avium subsp. paratuberculosis
agcagcgccggcag

SEQ ID NO: 806825 - RNA, 12 nt, Mycobacterium avium subsp. paratuberculosis
agcagcgccucg

SEQ ID NO: 806826 - RNA, 23 nt, Mycobacterium avium subsp. paratuberculosis
agcagcgccucgcuaaucgccgc

SEQ ID NO: 806827 - RNA, 20 nt, Mycobacterium avium subsp. paratuberculosis
agcagcgccucggcgaucgg

SEQ ID NO: 806828 - RNA, 19 nt, Mycobacterium avium subsp. paratuberculosis
agcagcgaggccucgccgc

SEQ ID NO: 806829 - RNA, 22 nt, Mycobacterium avium subsp. paratuberculosis
agcagcgaggcguccagcgcgu

SEQ ID NO: 806830 - RNA, 18 nt, Mycobacterium avium subsp. paratuberculosis
agcagcgagaaccggcgc

SEQ ID NO: 806831 - RNA, 19 nt, Mycobacterium avium subsp. paratuberculosis
agcagcgagaaccggcgca

SEQ ID NO: 806832 - RNA, 20 nt, Mycobacterium avium subsp. paratuberculosis
agcagcgagaaccggcgcag

SEQ ID NO: 806833 - RNA, 17 nt, Mycobacterium avium subsp. paratuberculosis
agcagcgagaccggcac

SEQ ID NO: 806834 - RNA, 19 nt, Mycobacterium avium subsp. paratuberculosis
agcagcgacaugaccaccg

SEQ ID NO: 806835 - RNA, 20 nt, Mycobacterium avium subsp. paratuberculosis
agcagcgacaugaccaccgc

SEQ ID NO: 806836 - RNA, 21 nt, Mycobacterium avium subsp. paratuberculosis
agcagcgacaugaccaccgcg

SEQ ID NO: 806837 - RNA, 23 nt, Mycobacterium avium subsp. paratuberculosis
agcagcgacaugaccaccgcguc

SEQ ID NO: 806838 - RNA, 15 nt, Mycobacterium avium subsp. paratuberculosis
agcagccgcgccgac

SEQ ID NO: 806839 - RNA, 14 nt, Mycobacterium avium subsp. paratuberculosis
agcagccgcgcgag

SEQ ID NO: 806840 - RNA, 15 nt, Mycobacterium avium subsp. paratuberculosis
agcagccgcgcgagc

SEQ ID NO: 806841 - RNA, 13 nt, Mycobacterium avium subsp. paratuberculosis
agcagccgcucgu

SEQ ID NO: 806842 - RNA, 18 nt, Mycobacterium avium subsp. paratuberculosis
agcagccgggccugcggc

SEQ ID NO: 806843 - RNA, 16 nt, Mycobacterium avium subsp. paratuberculosis
agcagccgggugccca

SEQ ID NO: 806844 - RNA, 19 nt, Mycobacterium avium subsp. paratuberculosis
agcagccgguacagcgucu

SEQ ID NO: 806845 - RNA, 14 nt, Mycobacterium avium subsp. paratuberculosis
agcagccgcgacac

SEQ ID NO: 806846 - RNA, 15 nt, Mycobacterium avium subsp. paratuberculosis
agcagcgaacccgcc

SEQ ID NO: 806847 - RNA, 17 nt, Mycobacterium avium subsp. paratuberculosis
agcagcgaacccgccag

SEQ ID NO: 806848 - RNA, 16 nt, Mycobacterium avium subsp. paratuberculosis
agcagcuccggucggc

SEQ ID NO: 806849 - RNA, 19 nt, Mycobacterium avium subsp. paratuberculosis
agcagcucauacagcggcg

SEQ ID NO: 806850 - RNA, 12 nt, Mycobacterium avium subsp. paratuberculosis
agcagcggcagc

SEQ ID NO: 806851 - RNA, 18 nt, Mycobacterium avium subsp. paratuberculosis
agcagcguuccgucggcg

SEQ ID NO: 806852 - RNA, 16 nt, Mycobacterium avium subsp. paratuberculosis
agcagcguucggucag

SEQ ID NO: 806853 - RNA, 17 nt, Mycobacterium avium subsp. paratuberculosis
agcagcguucggucagc

SEQ ID NO: 806854 - RNA, 21 nt, Mycobacterium avium subsp. paratuberculosis
agcagcguucggucagcacga

SEQ ID NO: 806855 - RNA, 20 nt, Mycobacterium avium subsp. paratuberculosis
agcagcggcuugagcgccag

SEQ ID NO: 806856 - RNA, 17 nt, Mycobacterium avium subsp. paratuberculosis
agcagcgucacgucgac

SEQ ID NO: 806857 - RNA, 12 nt, Mycobacterium avium subsp. paratuberculosis
agcagcgucguc

SEQ ID NO: 806858 - RNA, 13 nt, Mycobacterium avium subsp. paratuberculosis
agcagcgucguca

SEQ ID NO: 806859 - RNA, 18 nt, Mycobacterium avium subsp. paratuberculosis
agcagcgucgucaggccg

SEQ ID NO: 806860 - RNA, 17 nt, Mycobacterium avium subsp. paratuberculosis
agcagcgucugcgccag

SEQ ID NO: 806861 - RNA, 18 nt, Mycobacterium avium subsp. paratuberculosis
agcagcgucugcgccagc

SEQ ID NO: 806862 - RNA, 19 nt, Mycobacterium avium subsp. paratuberculosis
agcagcgucugcgccccgg

SEQ ID NO: 806863 - RNA, 14 nt, Mycobacterium avium subsp. paratuberculosis
agcagcggcaugcc

SEQ ID NO: 806864 - RNA, 23 nt, Mycobacterium avium subsp. paratuberculosis
agcagcggccggcgcagccggcc

SEQ ID NO: 806865 - RNA, 14 nt, Mycobacterium avium subsp. paratuberculosis
agcagcgcgcgguu

SEQ ID NO: 806866 - RNA, 15 nt, Mycobacterium avium subsp. paratuberculosis
agcagcgccugcugc

SEQ ID NO: 806867 - RNA, 21 nt, Mycobacterium avium subsp. paratuberculosis
agcagcgggcccgggcugccc

SEQ ID NO: 806868 - RNA, 23 nt, Mycobacterium avium subsp. paratuberculosis
agcagcggggugagcaccgcgac

SEQ ID NO: 806869 - RNA, 21 nt, Mycobacterium avium subsp. paratuberculosis
agcagcgggucgucgggccgg

SEQ ID NO: 806870 - RNA, 12 nt, Mycobacterium avium subsp. paratuberculosis
agcagcgccggc

SEQ ID NO: 806871 - RNA, 12 nt, Mycobacterium avium subsp. paratuberculosis
agcagcgcgcgc

SEQ ID NO: 806872 - RNA, 23 nt, Mycobacterium avium subsp. paratuberculosis
agcagcgcgcgcuugcgcucggu

SEQ ID NO: 806873 - RNA, 22 nt, Mycobacterium avium subsp. paratuberculosis
agcagcgcggucaacaccggga

SEQ ID NO: 806874 - RNA, 20 nt, Mycobacterium avium subsp. paratuberculosis
agcagcgcguaggugcgguc

SEQ ID NO: 806875 - RNA, 19 nt, Mycobacterium avium subsp. paratuberculosis
agcaggaugaugaccgaca

SEQ ID NO: 806876 - RNA, 13 nt, Mycobacterium avium subsp. paratuberculosis
agcaggacggugg

SEQ ID NO: 806877 - RNA, 13 nt, Mycobacterium avium subsp. paratuberculosis
agcaggcaucgcg

SEQ ID NO: 806878 - RNA, 19 nt, Mycobacterium avium subsp. paratuberculosis
agcaggaucuccggccggu

SEQ ID NO: 806879 - RNA, 17 nt, Mycobacterium avium subsp. paratuberculosis
agcaggaucuggugcgc

SEQ ID NO: 806880 - RNA, 21 nt, Mycobacterium avium subsp. paratuberculosis
agcaggaucuggugcgcgcgc

SEQ ID NO: 806881 - RNA, 23 nt, Mycobacterium avium subsp. paratuberculosis
agcagcugggacagcgucaccaa

SEQ ID NO: 806882 - RNA, 21 nt, Mycobacterium avium subsp. paratuberculosis
agcagcuugacgucggucagc

SEQ ID NO: 806883 - RNA, 21 nt, Mycobacterium avium subsp. paratuberculosis
agcagcuugaucgccggggcg

SEQ ID NO: 806884 - RNA, 19 nt, Mycobacterium avium subsp. paratuberculosis
agcaggacgcgcccggcga

SEQ ID NO: 806885 - RNA, 17 nt, Mycobacterium avium subsp. paratuberculosis
agcagcucggcggccug

SEQ ID NO: 806886 - RNA, 21 nt, Mycobacterium avium subsp. paratuberculosis
agcagcucgcggauccgcagc

SEQ ID NO: 806887 - RNA, 15 nt, Mycobacterium avium subsp. paratuberculosis
agcagcucgcguagc

SEQ ID NO: 806888 - RNA, 15 nt, Mycobacterium avium subsp. paratuberculosis
agcagcucggucacc

SEQ ID NO: 806889 - RNA, 14 nt, Mycobacterium avium subsp. paratuberculosis
agcagcucgguggc

SEQ ID NO: 806890 - RNA, 15 nt, Mycobacterium avium subsp. paratuberculosis
agcagcucgguggcg

SEQ ID NO: 806891 - RNA, 23 nt, Mycobacterium avium subsp. paratuberculosis
agcagcucgguggcgucggcggc

SEQ ID NO: 806892 - RNA, 22 nt, Mycobacterium avium subsp. paratuberculosis
agcagcugcgucggcaccagcg

SEQ ID NO: 806893 - RNA, 16 nt, Mycobacterium avium subsp. paratuberculosis
agcagcugcuggcgug

SEQ ID NO: 806894 - RNA, 22 nt, Mycobacterium avium subsp. paratuberculosis
agcagcuggaaauaggccgggc

SEQ ID NO: 806895 - RNA, 20 nt, Mycobacterium avium subsp. paratuberculosis
agcagcuggaacaccacggc

SEQ ID NO: 806896 - RNA, 13 nt, Mycobacterium avium subsp. paratuberculosis
agaucccgccggc

SEQ ID NO: 806897 - RNA, 20 nt, Mycobacterium avium subsp. paratuberculosis
agaucccgccggcggccacg

SEQ ID NO: 806898 - RNA, 14 nt, Mycobacterium avium subsp. paratuberculosis
agaucagcgcgucg

SEQ ID NO: 806899 - RNA, 13 nt, Mycobacterium avium subsp. paratuberculosis
agaucaucccggc

SEQ ID NO: 806900 - RNA, 14 nt, Mycobacterium avium subsp. paratuberculosis
agaucaucccggcc

SEQ ID NO: 806901 - RNA, 16 nt, Mycobacterium avium subsp. paratuberculosis
agaucaucccggccac

SEQ ID NO: 806902 - RNA, 13 nt, Mycobacterium avium subsp. paratuberculosis
agauccaccgcgc

SEQ ID NO: 806903 - RNA, 14 nt, Mycobacterium avium subsp. paratuberculosis
agauccaccgcgcg

SEQ ID NO: 806904 - RNA, 17 nt, Mycobacterium avium subsp. paratuberculosis
agauccaccgcgcggcc

SEQ ID NO: 806905 - RNA, 14 nt, Mycobacterium avium subsp. paratuberculosis
agcaaaaccccgcc

SEQ ID NO: 806906 - RNA, 13 nt, Mycobacterium avium subsp. paratuberculosis
agauugcggcccu

SEQ ID NO: 806907 - RNA, 21 nt, Mycobacterium avium subsp. paratuberculosis
agcaagcaguccccgccuucg

SEQ ID NO: 806908 - RNA, 20 nt, Mycobacterium avium subsp. paratuberculosis
agcaaagguaguccagcaca

SEQ ID NO: 806909 - RNA, 21 nt, Mycobacterium avium subsp. paratuberculosis
agcacaccgucgcccgcccag

SEQ ID NO: 806910 - RNA, 17 nt, Mycobacterium avium subsp. paratuberculosis
agcacaccguucccacc

SEQ ID NO: 806911 - RNA, 18 nt, Mycobacterium avium subsp. paratuberculosis
agcacaccggaucggcug

SEQ ID NO: 806912 - RNA, 14 nt, Mycobacterium avium subsp. paratuberculosis
agcacacccagcga

SEQ ID NO: 806913 - RNA, 22 nt, Mycobacterium avium subsp. paratuberculosis
agcacacccucaccccgcccag

SEQ ID NO: 806914 - RNA, 23 nt, Mycobacterium avium subsp. paratuberculosis
agcacacccucaccccgcccagc

SEQ ID NO: 806915 - RNA, 18 nt, Mycobacterium avium subsp. paratuberculosis
agcacagcacggcaucga

SEQ ID NO: 806916 - RNA, 15 nt, Mycobacterium avium subsp. paratuberculosis
agcacauagcgcagc

SEQ ID NO: 806917 - RNA, 17 nt, Mycobacterium avium subsp. paratuberculosis
agcacagccgucgcacu

SEQ ID NO: 806918 - RNA, 18 nt, Mycobacterium avium subsp. paratuberculosis
agcacagcgaggcgacgu

SEQ ID NO: 806919 - RNA, 13 nt, Mycobacterium avium subsp. paratuberculosis
agcacaucggcgu

SEQ ID NO: 806920 - RNA, 16 nt, Mycobacterium avium subsp. paratuberculosis
agcagaacgccaucac

SEQ ID NO: 806921 - RNA, 13 nt, Mycobacterium avium subsp. paratuberculosis
agcacuuucgcgg

SEQ ID NO: 806922 - RNA, 22 nt, Mycobacterium avium subsp. paratuberculosis
agcacuucauggucgucgucga

SEQ ID NO: 806923 - RNA, 15 nt, Mycobacterium avium subsp. paratuberculosis
agcacggcacgcccg

SEQ ID NO: 806924 - RNA, 13 nt, Mycobacterium avium subsp. paratuberculosis
agcacgccggccg

SEQ ID NO: 806925 - RNA, 15 nt, Mycobacterium avium subsp. paratuberculosis
agcacgccggccggc

SEQ ID NO: 806926 - RNA, 15 nt, Mycobacterium avium subsp. paratuberculosis
agcacgccguugacc

SEQ ID NO: 806927 - RNA, 19 nt, Mycobacterium avium subsp. paratuberculosis
agcacgcugaagcccaccg

SEQ ID NO: 806928 - RNA, 18 nt, Mycobacterium avium subsp. paratuberculosis
agcacgcugaucaccacg

SEQ ID NO: 806929 - RNA, 20 nt, Mycobacterium avium subsp. paratuberculosis
agcacgcugaucaccacggu

SEQ ID NO: 806930 - RNA, 19 nt, Mycobacterium avium subsp. paratuberculosis
agcacgcccagaugcaggc

SEQ ID NO: 806931 - RNA, 13 nt, Mycobacterium avium subsp. paratuberculosis
agcacgcagccgc

SEQ ID NO: 806932 - RNA, 14 nt, Mycobacterium avium subsp. paratuberculosis
agcacgcagccgcg

SEQ ID NO: 806933 - RNA, 20 nt, Mycobacterium avium subsp. paratuberculosis
agcacgcagccgcgcccgau

SEQ ID NO: 806934 - RNA, 23 nt, Mycobacterium avium subsp. paratuberculosis
agcacgcccagcccgcgggcggc

SEQ ID NO: 806935 - RNA, 22 nt, Mycobacterium avium subsp. paratuberculosis
agcacgcccgcgaucggcgcca

SEQ ID NO: 806936 - RNA, 13 nt, Mycobacterium avium subsp. paratuberculosis
agcacgccgccgg

SEQ ID NO: 806937 - RNA, 18 nt, Mycobacterium avium subsp. paratuberculosis
agcacgaccccgcccacg

SEQ ID NO: 806938 - RNA, 19 nt, Mycobacterium avium subsp. paratuberculosis
agcacgaccccgcccacga

SEQ ID NO: 806939 - RNA, 14 nt, Mycobacterium avium subsp. paratuberculosis
agcacgaccgccag

SEQ ID NO: 806940 - RNA, 16 nt, Mycobacterium avium subsp. paratuberculosis
agcacgaucccgccgc

SEQ ID NO: 806941 - RNA, 17 nt, Mycobacterium avium subsp. paratuberculosis
agcacgaucccgccgcc

SEQ ID NO: 806942 - RNA, 13 nt, Mycobacterium avium subsp. paratuberculosis
agcaccuggccgu

SEQ ID NO: 806943 - RNA, 19 nt, Mycobacterium avium subsp. paratuberculosis
agcaccuggccguucaggu

SEQ ID NO: 806944 - RNA, 21 nt, Mycobacterium avium subsp. paratuberculosis
agcaccuggccguucaggucg

SEQ ID NO: 806945 - RNA, 19 nt, Mycobacterium avium subsp. paratuberculosis
agcaccuggcgcaccgccg

SEQ ID NO: 806946 - RNA, 20 nt, Mycobacterium avium subsp. paratuberculosis
agcaccuggcgcaccgccgc

SEQ ID NO: 806947 - RNA, 21 nt, Mycobacterium avium subsp. paratuberculosis
agcaccuggcgcaccgccgcg

SEQ ID NO: 806948 - RNA, 17 nt, Mycobacterium avium subsp. paratuberculosis
agcacgaacgcggccgc

SEQ ID NO: 806949 - RNA, 19 nt, Mycobacterium avium subsp. paratuberculosis
agcacgaacgcggccgcca

SEQ ID NO: 806950 - RNA, 20 nt, Mycobacterium avium subsp. paratuberculosis
agcacgaacgcggccgccau

SEQ ID NO: 806951 - RNA, 22 nt, Mycobacterium avium subsp. paratuberculosis
agcacgaacgcggccgccaucg

SEQ ID NO: 806952 - RNA, 23 nt, Mycobacterium avium subsp. paratuberculosis
agcacgaagaaggcuccgccgau

SEQ ID NO: 806953 - RNA, 21 nt, Mycobacterium avium subsp. paratuberculosis
agcaccuugcccaggugcaga

SEQ ID NO: 806954 - RNA, 15 nt, Mycobacterium avium subsp. paratuberculosis
agcaccuugccgguc

SEQ ID NO: 806955 - RNA, 16 nt, Mycobacterium avium subsp. paratuberculosis
agcaccuucgggccga

SEQ ID NO: 806956 - RNA, 15 nt, Mycobacterium avium subsp. paratuberculosis
agcaccacccgcacc

SEQ ID NO: 806957 - RNA, 14 nt, Mycobacterium avium subsp. paratuberculosis
agcaccaccagguc

SEQ ID NO: 806958 - RNA, 14 nt, Mycobacterium avium subsp. paratuberculosis
agcaccacccgcac

SEQ ID NO: 806959 - RNA, 19 nt, Mycobacterium avium subsp. paratuberculosis
agcaccaacagcggcccga

SEQ ID NO: 806960 - RNA, 18 nt, Mycobacterium avium subsp. paratuberculosis
agcaccacguccgcggug

SEQ ID NO: 806961 - RNA, 14 nt, Mycobacterium avium subsp. paratuberculosis
agcaccacggcccg

SEQ ID NO: 806962 - RNA, 15 nt, Mycobacterium avium subsp. paratuberculosis
agcaccacggcccgc

SEQ ID NO: 806963 - RNA, 23 nt, Mycobacterium avium subsp. paratuberculosis
agcaccacggcccgcgccccggc

SEQ ID NO: 806964 - RNA, 10 nt, Mycobacterium avium subsp. paratuberculosis
agcaccaccg

SEQ ID NO: 806965 - RNA, 14 nt, Mycobacterium avium subsp. paratuberculosis
agcaccaccgcgag

SEQ ID NO: 806966 - RNA, 21 nt, Mycobacterium avium subsp. paratuberculosis
agcaccaccucgcgcggggcg

SEQ ID NO: 806967 - RNA, 18 nt, Mycobacterium avium subsp. paratuberculosis
agcaccggcagcaccgcc

SEQ ID NO: 806968 - RNA, 21 nt, Mycobacterium avium subsp. paratuberculosis
agcaccggcagcaccgccgag

SEQ ID NO: 806969 - RNA, 14 nt, Mycobacterium avium subsp. paratuberculosis
agcaccggcagccg

SEQ ID NO: 806970 - RNA, 14 nt, Mycobacterium avium subsp. paratuberculosis
agcaccggcgccau

SEQ ID NO: 806971 - RNA, 21 nt, Mycobacterium avium subsp. paratuberculosis
agcaccggcgccaugaacucc

SEQ ID NO: 806972 - RNA, 20 nt, Mycobacterium avium subsp. paratuberculosis
agcaccggcgccccgggcag

SEQ ID NO: 806973 - RNA, 13 nt, Mycobacterium avium subsp. paratuberculosis
agcaccggcggca

SEQ ID NO: 806974 - RNA, 22 nt, Mycobacterium avium subsp. paratuberculosis
agcaccgcgacccaggccgccg

SEQ ID NO: 806975 - RNA, 17 nt, Mycobacterium avium subsp. paratuberculosis
agcaccgcgaccacgcc

SEQ ID NO: 806976 - RNA, 16 nt, Mycobacterium avium subsp. paratuberculosis
agcaccgccggcgccg

SEQ ID NO: 806977 - RNA, 17 nt, Mycobacterium avium subsp. paratuberculosis
agcaccgccggcgccgu

SEQ ID NO: 806978 - RNA, 14 nt, Mycobacterium avium subsp. paratuberculosis
agcaccgccucggc

SEQ ID NO: 806979 - RNA, 14 nt, Mycobacterium avium subsp. paratuberculosis
agcaccgcgacgau

SEQ ID NO: 806980 - RNA, 15 nt, Mycobacterium avium subsp. paratuberculosis
agcaccgcgacgauc

SEQ ID NO: 806981 - RNA, 21 nt, Mycobacterium avium subsp. paratuberculosis
agcaccgcgaucaccgagaug

SEQ ID NO: 806982 - RNA, 17 nt, Mycobacterium avium subsp. paratuberculosis
agcaccgcgaucgccga

SEQ ID NO: 806983 - RNA, 22 nt, Mycobacterium avium subsp. paratuberculosis
agcaccgcgcggcggugcucgc

SEQ ID NO: 806984 - RNA, 18 nt, Mycobacterium avium subsp. paratuberculosis
agcaccgcgcucaccgcg

SEQ ID NO: 806985 - RNA, 23 nt, Mycobacterium avium subsp. paratuberculosis
agcaccgcggccgucgcggcgau

SEQ ID NO: 806986 - RNA, 14 nt, Mycobacterium avium subsp. paratuberculosis
agcaccgcggcgau

SEQ ID NO: 806987 - RNA, 23 nt, Mycobacterium avium subsp. paratuberculosis
agcaccgcggcguagcgccaguc

SEQ ID NO: 806988 - RNA, 13 nt, Mycobacterium avium subsp. paratuberculosis
agcaccucggcga

SEQ ID NO: 806989 - RNA, 21 nt, Mycobacterium avium subsp. paratuberculosis
agcaccucgcccugcagcgcg

SEQ ID NO: 806990 - RNA, 22 nt, Mycobacterium avium subsp. paratuberculosis
agcaccucgcccugcagcgcga

SEQ ID NO: 806991 - RNA, 21 nt, Mycobacterium avium subsp. paratuberculosis
agcaccucgcgcagcaccgau

SEQ ID NO: 806992 - RNA, 15 nt, Mycobacterium avium subsp. paratuberculosis
agcaccuccgacauc

SEQ ID NO: 806993 - RNA, 16 nt, Mycobacterium avium subsp. paratuberculosis
agcaccucgaacgccg

SEQ ID NO: 806994 - RNA, 16 nt, Mycobacterium avium subsp. paratuberculosis
agcaccucgaagccga

SEQ ID NO: 806995 - RNA, 19 nt, Mycobacterium avium subsp. paratuberculosis
agcaccucgaagccgacgu

SEQ ID NO: 806996 - RNA, 17 nt, Mycobacterium avium subsp. paratuberculosis
agcaccuggagcggguc

SEQ ID NO: 806997 - RNA, 23 nt, Mycobacterium avium subsp. paratuberculosis
agcaccucuucgaaagccacccg

SEQ ID NO: 806998 - RNA, 16 nt, Mycobacterium avium subsp. paratuberculosis
agcaccugcucgaugc

SEQ ID NO: 806999 - RNA, 13 nt, Mycobacterium avium subsp. paratuberculosis
agcaccugcgcga

SEQ ID NO: 807000 - RNA, 15 nt, Mycobacterium avium subsp. paratuberculosis
agcaccugcgcgacg

SEQ ID NO: 807001 - RNA, 14 nt, Mycobacterium avium subsp. paratuberculosis
agcaccgugccguc

SEQ ID NO: 807002 - RNA, 23 nt, Mycobacterium avium subsp. paratuberculosis
agcaccgugccgucggcgucgac

SEQ ID NO: 807003 - RNA, 21 nt, Mycobacterium avium subsp. paratuberculosis
agcaccgugcugauccacgcc

SEQ ID NO: 807004 - RNA, 14 nt, Mycobacterium avium subsp. paratuberculosis
agcaccgucaccgc

SEQ ID NO: 807005 - RNA, 16 nt, Mycobacterium avium subsp. paratuberculosis
agcaccgucaccgccu

SEQ ID NO: 807006 - RNA, 23 nt, Mycobacterium avium subsp. paratuberculosis
agcaccgucaccuucacccccac

SEQ ID NO: 807007 - RNA, 15 nt, Mycobacterium avium subsp. paratuberculosis
agcaccgugggcccg

SEQ ID NO: 807008 - RNA, 12 nt, Mycobacterium avium subsp. paratuberculosis
agcaccggcguc

SEQ ID NO: 807009 - RNA, 15 nt, Mycobacterium avium subsp. paratuberculosis
agcaccggcgucgac

SEQ ID NO: 807010 - RNA, 16 nt, Mycobacterium avium subsp. paratuberculosis
agcaccggcuggccga

SEQ ID NO: 807011 - RNA, 23 nt, Mycobacterium avium subsp. paratuberculosis
agcaccggcuggugcagcagcug

SEQ ID NO: 807012 - RNA, 22 nt, Mycobacterium avium subsp. paratuberculosis
agcaccgggaacagccaggcga

SEQ ID NO: 807013 - RNA, 23 nt, Mycobacterium avium subsp. paratuberculosis
agcaccgggccgaaggcggcgcc

SEQ ID NO: 807014 - RNA, 15 nt, Mycobacterium avium subsp. paratuberculosis
agcaccgggcugucg

SEQ ID NO: 807015 - RNA, 20 nt, Mycobacterium avium subsp. paratuberculosis
agcaccgggcugucgggcag

SEQ ID NO: 807016 - RNA, 17 nt, Mycobacterium avium subsp. paratuberculosis
agcaccggggccaacuc

SEQ ID NO: 807017 - RNA, 18 nt, Mycobacterium avium subsp. paratuberculosis
agcaccgggugauaccgg

SEQ ID NO: 807018 - RNA, 12 nt, Mycobacterium avium subsp. paratuberculosis
auauucgcgaug

SEQ ID NO: 807019 - RNA, 13 nt, Mycobacterium avium subsp. paratuberculosis
auaggccagcgcg

SEQ ID NO: 807020 - RNA, 11 nt, Mycobacterium avium subsp. paratuberculosis
auaggccgcgu

SEQ ID NO: 807021 - RNA, 22 nt, Mycobacterium avium subsp. paratuberculosis
auaggccgggcagugcgcggcg

SEQ ID NO: 807022 - RNA, 16 nt, Mycobacterium avium subsp. paratuberculosis
auagcgccgcucggcc

SEQ ID NO: 807023 - RNA, 18 nt, Mycobacterium avium subsp. paratuberculosis
auagcggcguaccgcggc

SEQ ID NO: 807024 - RNA, 19 nt, Mycobacterium avium subsp. paratuberculosis
auagcgggcuaggcucggc

SEQ ID NO: 807025 - RNA, 20 nt, Mycobacterium avium subsp. paratuberculosis
auagcgggcuaggcucggca

SEQ ID NO: 807026 - RNA, 15 nt, Mycobacterium avium subsp. paratuberculosis
auagcuggcgccgaa

SEQ ID NO: 807027 - RNA, 19 nt, Mycobacterium avium subsp. paratuberculosis
auacggugcccgccgcgac

SEQ ID NO: 807028 - RNA, 18 nt, Mycobacterium avium subsp. paratuberculosis
aguuugcccucgucgacc

SEQ ID NO: 807029 - RNA, 15 nt, Mycobacterium avium subsp. paratuberculosis
aguuugccgucggga

SEQ ID NO: 807030 - RNA, 19 nt, Mycobacterium avium subsp. paratuberculosis
auaaccgcgcggcgccccc

SEQ ID NO: 807031 - RNA, 13 nt, Mycobacterium avium subsp. paratuberculosis
auaacgccggccc

SEQ ID NO: 807032 - RNA, 14 nt, Mycobacterium avium subsp. paratuberculosis
auaccagggcgagg

SEQ ID NO: 807033 - RNA, 18 nt, Mycobacterium avium subsp. paratuberculosis
auaccggcagcaggugca

SEQ ID NO: 807034 - RNA, 15 nt, Mycobacterium avium subsp. paratuberculosis
auaccagccgcggac

SEQ ID NO: 807035 - RNA, 22 nt, Mycobacterium avium subsp. paratuberculosis
auacaccguccagcucagcgcg

SEQ ID NO: 807036 - RNA, 16 nt, Mycobacterium avium subsp. paratuberculosis
auaccuugucggcguc

SEQ ID NO: 807037 - RNA, 15 nt, Mycobacterium avium subsp. paratuberculosis
auacgacguccgggc

SEQ ID NO: 807038 - RNA, 15 nt, Mycobacterium avium subsp. paratuberculosis
auaccggccggcgcg

SEQ ID NO: 807039 - RNA, 10 nt, Mycobacterium avium subsp. paratuberculosis
auacgcggcg

SEQ ID NO: 807040 - RNA, 20 nt, Mycobacterium avium subsp. paratuberculosis
auacgccucaccccagcgcg

SEQ ID NO: 807041 - RNA, 22 nt, Mycobacterium avium subsp. paratuberculosis
aguuggucaccaccaacgccac

SEQ ID NO: 807042 - RNA, 20 nt, Mycobacterium avium subsp. paratuberculosis
aguuggucgaugucggugcg

SEQ ID NO: 807043 - RNA, 17 nt, Mycobacterium avium subsp. paratuberculosis
aguugggggccagcgcc

SEQ ID NO: 807044 - RNA, 20 nt, Mycobacterium avium subsp. paratuberculosis
aguugggggccagcgccgag

SEQ ID NO: 807045 - RNA, 14 nt, Mycobacterium avium subsp. paratuberculosis
aguuggcggcggug

SEQ ID NO: 807046 - RNA, 15 nt, Mycobacterium avium subsp. paratuberculosis
aguuggcgucgggca

SEQ ID NO: 807047 - RNA, 21 nt, Mycobacterium avium subsp. paratuberculosis
aguugcgcgccgaugccgcgc

SEQ ID NO: 807048 - RNA, 20 nt, Mycobacterium avium subsp. paratuberculosis
aguucggcaucucggccgga

SEQ ID NO: 807049 - RNA, 15 nt, Mycobacterium avium subsp. paratuberculosis
aguucggccagcgcg

SEQ ID NO: 807050 - RNA, 13 nt, Mycobacterium avium subsp. paratuberculosis
aguugccggccau

SEQ ID NO: 807051 - RNA, 14 nt, Mycobacterium avium subsp. paratuberculosis
aguugccggucagg

SEQ ID NO: 807052 - RNA, 12 nt, Mycobacterium avium subsp. paratuberculosis
aguuggccuccc

SEQ ID NO: 807053 - RNA, 20 nt, Mycobacterium avium subsp. paratuberculosis
aguucgaccggcaccagcag

SEQ ID NO: 807054 - RNA, 15 nt, Mycobacterium avium subsp. paratuberculosis
aguucagcgucgaug

SEQ ID NO: 807055 - RNA, 19 nt, Mycobacterium avium subsp. paratuberculosis
aguucgaugcgcucggcga

SEQ ID NO: 807056 - RNA, 16 nt, Mycobacterium avium subsp. paratuberculosis
aguucgaccucgguga

SEQ ID NO: 807057 - RNA, 14 nt, Mycobacterium avium subsp. paratuberculosis
aguucgaucagcag

SEQ ID NO: 807058 - RNA, 18 nt, Mycobacterium avium subsp. paratuberculosis
aguucaccaccgcgcugc

SEQ ID NO: 807059 - RNA, 15 nt, Mycobacterium avium subsp. paratuberculosis
aguucagaagucgcc

SEQ ID NO: 807060 - RNA, 14 nt, Mycobacterium avium subsp. paratuberculosis
aguucgccgucgac

SEQ ID NO: 807061 - RNA, 21 nt, Mycobacterium avium subsp. paratuberculosis
aguucgccgucgacggugauc

SEQ ID NO: 807062 - RNA, 14 nt, Mycobacterium avium subsp. paratuberculosis
aguucgccgccgcc

SEQ ID NO: 807063 - RNA, 16 nt, Mycobacterium avium subsp. paratuberculosis
aguucgccgccgccag

SEQ ID NO: 807064 - RNA, 13 nt, Mycobacterium avium subsp. paratuberculosis
aguucgcggcgca

SEQ ID NO: 807065 - RNA, 17 nt, Mycobacterium avium subsp. paratuberculosis
aguucgcggcgcagcac

SEQ ID NO: 807066 - RNA, 20 nt, Mycobacterium avium subsp. paratuberculosis
agugguagggcuccgcgcug

SEQ ID NO: 807067 - RNA, 14 nt, Mycobacterium avium subsp. paratuberculosis
agugcggcgcggug

SEQ ID NO: 807068 - RNA, 20 nt, Mycobacterium avium subsp. paratuberculosis
agugcgagaaaaucgcccgc

SEQ ID NO: 807069 - RNA, 18 nt, Mycobacterium avium subsp. paratuberculosis
agugcgcaggcggcgcgc

SEQ ID NO: 807070 - RNA, 14 nt, Mycobacterium avium subsp. paratuberculosis
agugcgcgauggcg

SEQ ID NO: 807071 - RNA, 22 nt, Mycobacterium avium subsp. paratuberculosis
agugcgcgauggcgugccggcg

SEQ ID NO: 807072 - RNA, 18 nt, Mycobacterium avium subsp. paratuberculosis
agugcgcggcguccucga

SEQ ID NO: 807073 - RNA, 19 nt, Mycobacterium avium subsp. paratuberculosis
agugccguugagcguggac

SEQ ID NO: 807074 - RNA, 17 nt, Mycobacterium avium subsp. paratuberculosis
agugccccguccggcgc

SEQ ID NO: 807075 - RNA, 18 nt, Mycobacterium avium subsp. paratuberculosis
agugccgguccagccgcc

SEQ ID NO: 807076 - RNA, 18 nt, Mycobacterium avium subsp. paratuberculosis
agugccggccagcucgcc

SEQ ID NO: 807077 - RNA, 21 nt, Mycobacterium avium subsp. paratuberculosis
agugccggccagcucgccgcc

SEQ ID NO: 807078 - RNA, 14 nt, Mycobacterium avium subsp. paratuberculosis
agugcgaucgccgu

SEQ ID NO: 807079 - RNA, 16 nt, Mycobacterium avium subsp. paratuberculosis
agugcucgauggccag

SEQ ID NO: 807080 - RNA, 21 nt, Mycobacterium avium subsp. paratuberculosis
agugcucgauggccagcgcgu

SEQ ID NO: 807081 - RNA, 19 nt, Mycobacterium avium subsp. paratuberculosis
agugcucggcgucccgcgc

SEQ ID NO: 807082 - RNA, 19 nt, Mycobacterium avium subsp. paratuberculosis
agugcggucgguucaucca

SEQ ID NO: 807083 - RNA, 21 nt, Mycobacterium avium subsp. paratuberculosis
agugcggucgguucauccacu

SEQ ID NO: 807084 - RNA, 21 nt, Mycobacterium avium subsp. paratuberculosis
aguggaagucagcgcgugacc

SEQ ID NO: 807085 - RNA, 21 nt, Mycobacterium avium subsp. paratuberculosis
agugcuugcccugguacgcgc

SEQ ID NO: 807086 - RNA, 21 nt, Mycobacterium avium subsp. paratuberculosis
agugcuugggcacguacgcgc

SEQ ID NO: 807087 - RNA, 16 nt, Mycobacterium avium subsp. paratuberculosis
agugcuggacggcccg

SEQ ID NO: 807088 - RNA, 14 nt, Mycobacterium avium subsp. paratuberculosis
aguggaucagccag

SEQ ID NO: 807089 - RNA, 17 nt, Mycobacterium avium subsp. paratuberculosis
agugaggccgaggcgag

SEQ ID NO: 807090 - RNA, 16 nt, Mycobacterium avium subsp. paratuberculosis
agugcaccucgacgaa

SEQ ID NO: 807091 - RNA, 20 nt, Mycobacterium avium subsp. paratuberculosis
agugcaccuugaucucgucg

SEQ ID NO: 807092 - RNA, 14 nt, Mycobacterium avium subsp. paratuberculosis
agugcacgcucggc

SEQ ID NO: 807093 - RNA, 23 nt, Mycobacterium avium subsp. paratuberculosis
agugaggccagcacccggucggu

SEQ ID NO: 807094 - RNA, 15 nt, Mycobacterium avium subsp. paratuberculosis
agugacgccugcggc

SEQ ID NO: 807095 - RNA, 22 nt, Mycobacterium avium subsp. paratuberculosis
agugcaacuaccgacggcaccu

SEQ ID NO: 807096 - RNA, 16 nt, Mycobacterium avium subsp. paratuberculosis
agugcacgcucggcgg

SEQ ID NO: 807097 - RNA, 14 nt, Mycobacterium avium subsp. paratuberculosis
agugcacucggcga

SEQ ID NO: 807098 - RNA, 22 nt, Mycobacterium avium subsp. paratuberculosis
agugcacugccgacccggcgua

SEQ ID NO: 807099 - RNA, 24 nt, Mycobacterium avium subsp. paratuberculosis
agugcaucggcaguccgcgccggu

SEQ ID NO: 807100 - RNA, 14 nt, Mycobacterium avium subsp. paratuberculosis
agugcaugccggcc

SEQ ID NO: 807101 - RNA, 13 nt, Mycobacterium avium subsp. paratuberculosis
agugccaccacca

SEQ ID NO: 807102 - RNA, 14 nt, Mycobacterium avium subsp. paratuberculosis
agugccaccaccac

SEQ ID NO: 807103 - RNA, 16 nt, Mycobacterium avium subsp. paratuberculosis
agugccaccaccacgg

SEQ ID NO: 807104 - RNA, 20 nt, Mycobacterium avium subsp. paratuberculosis
agugccaccaccacggccag

SEQ ID NO: 807105 - RNA, 19 nt, Mycobacterium avium subsp. paratuberculosis
agugccaguaccagcggcc

SEQ ID NO: 807106 - RNA, 13 nt, Mycobacterium avium subsp. paratuberculosis
agugccccacaag

SEQ ID NO: 807107 - RNA, 23 nt, Mycobacterium avium subsp. paratuberculosis
agugcccgcccagcugcacccac

SEQ ID NO: 807108 - RNA, 21 nt, Mycobacterium avium subsp. paratuberculosis
agucguucuccagcccucgug

SEQ ID NO: 807109 - RNA, 18 nt, Mycobacterium avium subsp. paratuberculosis
agucguuggugcgcacca

SEQ ID NO: 807110 - RNA, 17 nt, Mycobacterium avium subsp. paratuberculosis
agucguugucggcgguc

SEQ ID NO: 807111 - RNA, 13 nt, Mycobacterium avium subsp. paratuberculosis
agucuucggccau

SEQ ID NO: 807112 - RNA, 16 nt, Mycobacterium avium subsp. paratuberculosis
agucgggauagggcgc

SEQ ID NO: 807113 - RNA, 20 nt, Mycobacterium avium subsp. paratuberculosis
agucgggauagggcgcgucg

SEQ ID NO: 807114 - RNA, 20 nt, Mycobacterium avium subsp. paratuberculosis
agucggcgaaggcgcgcagg

SEQ ID NO: 807115 - RNA, 24 nt, Mycobacterium avium subsp. paratuberculosis
agucggcguccgugccguccggcc

SEQ ID NO: 807116 - RNA, 22 nt, Mycobacterium avium subsp. paratuberculosis
agucggcgucggagaugcgggc

SEQ ID NO: 807117 - RNA, 14 nt, Mycobacterium avium subsp. paratuberculosis
agucggcgucggcc

SEQ ID NO: 807118 - RNA, 15 nt, Mycobacterium avium subsp. paratuberculosis
agucggcgucggcca

SEQ ID NO: 807119 - RNA, 19 nt, Mycobacterium avium subsp. paratuberculosis
agucggcgucggccaccgc

SEQ ID NO: 807120 - RNA, 20 nt, Mycobacterium avium subsp. paratuberculosis
agucggcgucggccaccgcg

SEQ ID NO: 807121 - RNA, 15 nt, Mycobacterium avium subsp. paratuberculosis
agucggcgucuucgg

SEQ ID NO: 807122 - RNA, 16 nt, Mycobacterium avium subsp. paratuberculosis
agucggucagcgucgc

SEQ ID NO: 807123 - RNA, 19 nt, Mycobacterium avium subsp. paratuberculosis
agucggucagcgucgccgc

SEQ ID NO: 807124 - RNA, 20 nt, Mycobacterium avium subsp. paratuberculosis
agucggucagcgucgccgcc

SEQ ID NO: 807125 - RNA, 15 nt, Mycobacterium avium subsp. paratuberculosis
agucggugagcaccg

SEQ ID NO: 807126 - RNA, 23 nt, Mycobacterium avium subsp. paratuberculosis
agucggugcccagcgcgaggucg

SEQ ID NO: 807127 - RNA, 18 nt, Mycobacterium avium subsp. paratuberculosis
agucgucgaccgccacca

SEQ ID NO: 807128 - RNA, 14 nt, Mycobacterium avium subsp. paratuberculosis
agucgucgaucucg

SEQ ID NO: 807129 - RNA, 20 nt, Mycobacterium avium subsp. paratuberculosis
agucgucgaucucggugagc

SEQ ID NO: 807130 - RNA, 22 nt, Mycobacterium avium subsp. paratuberculosis
agucguacucccaggccgcggc

SEQ ID NO: 807131 - RNA, 22 nt, Mycobacterium avium subsp. paratuberculosis
agucgguuucgaccugcgggug

SEQ ID NO: 807132 - RNA, 22 nt, Mycobacterium avium subsp. paratuberculosis
agucguagucgaugcccgcguc

SEQ ID NO: 807133 - RNA, 16 nt, Mycobacterium avium subsp. paratuberculosis
agucgugacgcggcgu

SEQ ID NO: 807134 - RNA, 16 nt, Mycobacterium avium subsp. paratuberculosis
agucguccagcgucga

SEQ ID NO: 807135 - RNA, 16 nt, Mycobacterium avium subsp. paratuberculosis
agucgucggcgcgguu

SEQ ID NO: 807136 - RNA, 22 nt, Mycobacterium avium subsp. paratuberculosis
agucgucggugggccgccgcgg

SEQ ID NO: 807137 - RNA, 15 nt, Mycobacterium avium subsp. paratuberculosis
agucgcggaucauga

SEQ ID NO: 807138 - RNA, 22 nt, Mycobacterium avium subsp. paratuberculosis
agucgcggaugcgggcgcugcc

SEQ ID NO: 807139 - RNA, 14 nt, Mycobacterium avium subsp. paratuberculosis
agucgcgccgccag

SEQ ID NO: 807140 - RNA, 13 nt, Mycobacterium avium subsp. paratuberculosis
agucgcgccgcgu

SEQ ID NO: 807141 - RNA, 22 nt, Mycobacterium avium subsp. paratuberculosis
agucgcgccgcgucgcgccgcc

SEQ ID NO: 807142 - RNA, 14 nt, Mycobacterium avium subsp. paratuberculosis
agucgcucggcggc

SEQ ID NO: 807143 - RNA, 15 nt, Mycobacterium avium subsp. paratuberculosis
agucgcucggcggcg

SEQ ID NO: 807144 - RNA, 16 nt, Mycobacterium avium subsp. paratuberculosis
agucgcucggcggcga

SEQ ID NO: 807145 - RNA, 23 nt, Mycobacterium avium subsp. paratuberculosis
agucgcucggcggcgacgguguc

SEQ ID NO: 807146 - RNA, 21 nt, Mycobacterium avium subsp. paratuberculosis
agucgcuggucgaaccgcgag

SEQ ID NO: 807147 - RNA, 18 nt, Mycobacterium avium subsp. paratuberculosis
agucgcuguuggcgacgg

SEQ ID NO: 807148 - RNA, 17 nt, Mycobacterium avium subsp. paratuberculosis
agucgcugcagcauuuc

SEQ ID NO: 807149 - RNA, 13 nt, Mycobacterium avium subsp. paratuberculosis
agucggccaccgc

SEQ ID NO: 807150 - RNA, 14 nt, Mycobacterium avium subsp. paratuberculosis
agucggccaccgcg

SEQ ID NO: 807151 - RNA, 15 nt, Mycobacterium avium subsp. paratuberculosis
agucggccacguugc

SEQ ID NO: 807152 - RNA, 19 nt, Mycobacterium avium subsp. paratuberculosis
agucggccaucagcaccga

SEQ ID NO: 807153 - RNA, 12 nt, Mycobacterium avium subsp. paratuberculosis
agucggcccagg

SEQ ID NO: 807154 - RNA, 18 nt, Mycobacterium avium subsp. paratuberculosis
agucggcccaggccaaca

SEQ ID NO: 807155 - RNA, 16 nt, Mycobacterium avium subsp. paratuberculosis
agucggcccgaucgcg

SEQ ID NO: 807156 - RNA, 15 nt, Mycobacterium avium subsp. paratuberculosis
agucggcccgccggg

SEQ ID NO: 807157 - RNA, 16 nt, Mycobacterium avium subsp. paratuberculosis
agucggcccgccgggc

SEQ ID NO: 807158 - RNA, 12 nt, Mycobacterium avium subsp. paratuberculosis
agucggccuccu

SEQ ID NO: 807159 - RNA, 21 nt, Mycobacterium avium subsp. paratuberculosis
agucgcccgcguugcggcgca

SEQ ID NO: 807160 - RNA, 16 nt, Mycobacterium avium subsp. paratuberculosis
aguccugcagcucgcc

SEQ ID NO: 807161 - RNA, 17 nt, Mycobacterium avium subsp. paratuberculosis
agucgcgcaccauccgc

SEQ ID NO: 807162 - RNA, 18 nt, Mycobacterium avium subsp. paratuberculosis
agucgccgauggagaccu

SEQ ID NO: 807163 - RNA, 22 nt, Mycobacterium avium subsp. paratuberculosis
agucgccgccgcgcaccgcgcg

SEQ ID NO: 807164 - RNA, 22 nt, Mycobacterium avium subsp. paratuberculosis
aguccguugggggcgccgcggc

SEQ ID NO: 807165 - RNA, 14 nt, Mycobacterium avium subsp. paratuberculosis
aguccgggccgccg

SEQ ID NO: 807166 - RNA, 15 nt, Mycobacterium avium subsp. paratuberculosis
aguccgggccgccgg

SEQ ID NO: 807167 - RNA, 18 nt, Mycobacterium avium subsp. paratuberculosis
aguccgggccgccggccg

SEQ ID NO: 807168 - RNA, 19 nt, Mycobacterium avium subsp. paratuberculosis
aguccggguugggcgccug

SEQ ID NO: 807169 - RNA, 15 nt, Mycobacterium avium subsp. paratuberculosis
aguccggcggucagc

SEQ ID NO: 807170 - RNA, 20 nt, Mycobacterium avium subsp. paratuberculosis
aguccggcggucagcaccgu

SEQ ID NO: 807171 - RNA, 15 nt, Mycobacterium avium subsp. paratuberculosis
aguccggcgcccggc

SEQ ID NO: 807172 - RNA, 17 nt, Mycobacterium avium subsp. paratuberculosis
aguccggacacggccag

SEQ ID NO: 807173 - RNA, 14 nt, Mycobacterium avium subsp. paratuberculosis
aguccggcagcagc

SEQ ID NO: 807174 - RNA, 16 nt, Mycobacterium avium subsp. paratuberculosis
aguccggcagcagcga

SEQ ID NO: 807175 - RNA, 22 nt, Mycobacterium avium subsp. paratuberculosis
agucccaguuguuuccccagcc

SEQ ID NO: 807176 - RNA, 17 nt, Mycobacterium avium subsp. paratuberculosis
aguccccgguucaccag

SEQ ID NO: 807177 - RNA, 21 nt, Mycobacterium avium subsp. paratuberculosis
agucccagaucguagggcucg

SEQ ID NO: 807178 - RNA, 14 nt, Mycobacterium avium subsp. paratuberculosis
aguccaugaacggc

SEQ ID NO: 807179 - RNA, 22 nt, Mycobacterium avium subsp. paratuberculosis
aguccaugaacggcagcucguc

SEQ ID NO: 807180 - RNA, 17 nt, Mycobacterium avium subsp. paratuberculosis
aguccagccagccgcgc

SEQ ID NO: 807181 - RNA, 23 nt, Mycobacterium avium subsp. paratuberculosis
aguccagccagccgcgccgcgcc

SEQ ID NO: 807182 - RNA, 20 nt, Mycobacterium avium subsp. paratuberculosis
aguccagcgaaucgaccggg

SEQ ID NO: 807183 - RNA, 17 nt, Mycobacterium avium subsp. paratuberculosis
aguccagggugucgucg

SEQ ID NO: 807184 - RNA, 20 nt, Mycobacterium avium subsp. paratuberculosis
aguccagggugucgucgucg

SEQ ID NO: 807185 - RNA, 15 nt, Mycobacterium avium subsp. paratuberculosis
aguccaggucgaucu

SEQ ID NO: 807186 - RNA, 22 nt, Mycobacterium avium subsp. paratuberculosis
aguccaggucgaucucggccag

SEQ ID NO: 807187 - RNA, 22 nt, Mycobacterium avium subsp. paratuberculosis
aguccagcaccugaccgucggc

SEQ ID NO: 807188 - RNA, 19 nt, Mycobacterium avium subsp. paratuberculosis
aguaguccagggugucguc

SEQ ID NO: 807189 - RNA, 16 nt, Mycobacterium avium subsp. paratuberculosis
aguagugcaucggcag

SEQ ID NO: 807190 - RNA, 19 nt, Mycobacterium avium subsp. paratuberculosis
aguagugguccaccgccgc

SEQ ID NO: 807191 - RNA, 13 nt, Mycobacterium avium subsp. paratuberculosis
aguaguuccggcg

SEQ ID NO: 807192 - RNA, 12 nt, Mycobacterium avium subsp. paratuberculosis
agucacccggcc

SEQ ID NO: 807193 - RNA, 18 nt, Mycobacterium avium subsp. paratuberculosis
agucacccggcccccgag

SEQ ID NO: 807194 - RNA, 22 nt, Mycobacterium avium subsp. paratuberculosis
aguacucgguguagagcaccuc

SEQ ID NO: 807195 - RNA, 14 nt, Mycobacterium avium subsp. paratuberculosis
aguagacucagcgu

SEQ ID NO: 807196 - RNA, 16 nt, Mycobacterium avium subsp. paratuberculosis
aguagacgagcucacc

SEQ ID NO: 807197 - RNA, 14 nt, Mycobacterium avium subsp. paratuberculosis
aguacgcgccggcc

SEQ ID NO: 807198 - RNA, 15 nt, Mycobacterium avium subsp. paratuberculosis
aguagccggccagcu

SEQ ID NO: 807199 - RNA, 14 nt, Mycobacterium avium subsp. paratuberculosis
aguagccggcgauc

SEQ ID NO: 807200 - RNA, 14 nt, Mycobacterium avium subsp. paratuberculosis
aguagcgcaccggu

SEQ ID NO: 807201 - RNA, 22 nt, Mycobacterium avium subsp. paratuberculosis
aguaggccagcaucucggcgaa

SEQ ID NO: 807202 - RNA, 21 nt, Mycobacterium avium subsp. paratuberculosis
aguaggcgaccacaccgccgg

SEQ ID NO: 807203 - RNA, 15 nt, Mycobacterium avium subsp. paratuberculosis
aguagggccgcagcg

SEQ ID NO: 807204 - RNA, 12 nt, Mycobacterium avium subsp. paratuberculosis
aggucggcgaug

SEQ ID NO: 807205 - RNA, 21 nt, Mycobacterium avium subsp. paratuberculosis
aggucggccagcaggucgucg

SEQ ID NO: 807206 - RNA, 17 nt, Mycobacterium avium subsp. paratuberculosis
aggucggccagcgccgc

SEQ ID NO: 807207 - RNA, 13 nt, Mycobacterium avium subsp. paratuberculosis
aggucggccgcgg

SEQ ID NO: 807208 - RNA, 23 nt, Mycobacterium avium subsp. paratuberculosis
aggucggacgccucccccacccg

SEQ ID NO: 807209 - RNA, 16 nt, Mycobacterium avium subsp. paratuberculosis
aggucgcugcccggcg

SEQ ID NO: 807210 - RNA, 18 nt, Mycobacterium avium subsp. paratuberculosis
aggucgcugcccggcgug

SEQ ID NO: 807211 - RNA, 18 nt, Mycobacterium avium subsp. paratuberculosis
aggucgcugcgcucgccg

SEQ ID NO: 807212 - RNA, 21 nt, Mycobacterium avium subsp. paratuberculosis
aggucgcggugggcgcgggcc

SEQ ID NO: 807213 - RNA, 23 nt, Mycobacterium avium subsp. paratuberculosis
aggucgcggacuggugggcgucg

SEQ ID NO: 807214 - RNA, 22 nt, Mycobacterium avium subsp. paratuberculosis
aggucgcggauacgcccggcca

SEQ ID NO: 807215 - RNA, 17 nt, Mycobacterium avium subsp. paratuberculosis
aggucgcggcgcugcgc

SEQ ID NO: 807216 - RNA, 15 nt, Mycobacterium avium subsp. paratuberculosis
aggucgcgguagucg

SEQ ID NO: 807217 - RNA, 17 nt, Mycobacterium avium subsp. paratuberculosis
aggucgccuccagguga

SEQ ID NO: 807218 - RNA, 13 nt, Mycobacterium avium subsp. paratuberculosis
aggucgcgaccgc

SEQ ID NO: 807219 - RNA, 16 nt, Mycobacterium avium subsp. paratuberculosis
aggucgcgaccgccgg

SEQ ID NO: 807220 - RNA, 14 nt, Mycobacterium avium subsp. paratuberculosis
agguccuugcgcgc

SEQ ID NO: 807221 - RNA, 15 nt, Mycobacterium avium subsp. paratuberculosis
agguccuugcgcgcc

SEQ ID NO: 807222 - RNA, 20 nt, Mycobacterium avium subsp. paratuberculosis
aggucgaacagcucgaccag

SEQ ID NO: 807223 - RNA, 20 nt, Mycobacterium avium subsp. paratuberculosis
aggucgaaccacgcggcggc

SEQ ID NO: 807224 - RNA, 18 nt, Mycobacterium avium subsp. paratuberculosis
aggucgccgauccagccg

SEQ ID NO: 807225 - RNA, 16 nt, Mycobacterium avium subsp. paratuberculosis
aggcugaacgucguca

SEQ ID NO: 807226 - RNA, 18 nt, Mycobacterium avium subsp. paratuberculosis
aggcugaacgucgucagc

SEQ ID NO: 807227 - RNA, 18 nt, Mycobacterium avium subsp. paratuberculosis
aggcucgcucccgcgcgg

SEQ ID NO: 807228 - RNA, 13 nt, Mycobacterium avium subsp. paratuberculosis
aggcuccgccgau

SEQ ID NO: 807229 - RNA, 11 nt, Mycobacterium avium subsp. paratuberculosis
aggcugaccag

SEQ ID NO: 807230 - RNA, 12 nt, Mycobacterium avium subsp. paratuberculosis
aggcuggcggcg

SEQ ID NO: 807231 - RNA, 20 nt, Mycobacterium avium subsp. paratuberculosis
aggcgucgcggucggcgucg

SEQ ID NO: 807232 - RNA, 14 nt, Mycobacterium avium subsp. paratuberculosis
aggcgucggucagc

SEQ ID NO: 807233 - RNA, 20 nt, Mycobacterium avium subsp. paratuberculosis
aggcgucggucagcaggcgc

SEQ ID NO: 807234 - RNA, 12 nt, Mycobacterium avium subsp. paratuberculosis
aggcgucggcgg

SEQ ID NO: 807235 - RNA, 17 nt, Mycobacterium avium subsp. paratuberculosis
aggcgucgcgcagcagc

SEQ ID NO: 807236 - RNA, 21 nt, Mycobacterium avium subsp. paratuberculosis
aggcgucaucguggacaggag

SEQ ID NO: 807237 - RNA, 19 nt, Mycobacterium avium subsp. paratuberculosis
aggcguccgcaagcaccuc

SEQ ID NO: 807238 - RNA, 23 nt, Mycobacterium avium subsp. paratuberculosis
aggcguccuccucguccgcggcg

SEQ ID NO: 807239 - RNA, 18 nt, Mycobacterium avium subsp. paratuberculosis
aggcgucgaacgggccgg

SEQ ID NO: 807240 - RNA, 20 nt, Mycobacterium avium subsp. paratuberculosis
aggcgucgaacgggccgggc

SEQ ID NO: 807241 - RNA, 21 nt, Mycobacterium avium subsp. paratuberculosis
aggcgucgaacgggccgggca

SEQ ID NO: 807242 - RNA, 11 nt, Mycobacterium avium subsp. paratuberculosis
aggcgucgacg

SEQ ID NO: 807243 - RNA, 13 nt, Mycobacterium avium subsp. paratuberculosis
aggcgucgacgcg

SEQ ID NO: 807244 - RNA, 16 nt, Mycobacterium avium subsp. paratuberculosis
aggcguagcugcaggc

SEQ ID NO: 807245 - RNA, 15 nt, Mycobacterium avium subsp. paratuberculosis
aggcguacaccaggg

SEQ ID NO: 807246 - RNA, 14 nt, Mycobacterium avium subsp. paratuberculosis
aggcguccagcgcg

SEQ ID NO: 807247 - RNA, 18 nt, Mycobacterium avium subsp. paratuberculosis
aggcguccagggccaccg

SEQ ID NO: 807248 - RNA, 19 nt, Mycobacterium avium subsp. paratuberculosis
aggcguccagggccaccgc

SEQ ID NO: 807249 - RNA, 14 nt, Mycobacterium avium subsp. paratuberculosis
aggcggcgucgaug

SEQ ID NO: 807250 - RNA, 14 nt, Mycobacterium avium subsp. paratuberculosis
aggcggcgcagcca

SEQ ID NO: 807251 - RNA, 21 nt, Mycobacterium avium subsp. paratuberculosis
aggcggcgcagccagcgccgc

SEQ ID NO: 807252 - RNA, 21 nt, Mycobacterium avium subsp. paratuberculosis
aggcggcguagucggcgcagc

SEQ ID NO: 807253 - RNA, 15 nt, Mycobacterium avium subsp. paratuberculosis
aggcggcgucgagca

SEQ ID NO: 807254 - RNA, 23 nt, Mycobacterium avium subsp. paratuberculosis
aggcggcgacgaacgccggcauc

SEQ ID NO: 807255 - RNA, 16 nt, Mycobacterium avium subsp. paratuberculosis
aggcggcgaccgcgac

SEQ ID NO: 807256 - RNA, 11 nt, Mycobacterium avium subsp. paratuberculosis
aggcggcgacg

SEQ ID NO: 807257 - RNA, 13 nt, Mycobacterium avium subsp. paratuberculosis
aggcggcgacggc

SEQ ID NO: 807258 - RNA, 19 nt, Mycobacterium avium subsp. paratuberculosis
aggcggcgacggccguccg

SEQ ID NO: 807259 - RNA, 19 nt, Mycobacterium avium subsp. paratuberculosis
aggcggcgacggcgucggc

SEQ ID NO: 807260 - RNA, 13 nt, Mycobacterium avium subsp. paratuberculosis
aggcggcgccggc

SEQ ID NO: 807261 - RNA, 14 nt, Mycobacterium avium subsp. paratuberculosis
aggcggcgccggcc

SEQ ID NO: 807262 - RNA, 19 nt, Mycobacterium avium subsp. paratuberculosis
aggcggcgccggccgggcu

SEQ ID NO: 807263 - RNA, 13 nt, Mycobacterium avium subsp. paratuberculosis
aggcggcgccguc

SEQ ID NO: 807264 - RNA, 14 nt, Mycobacterium avium subsp. paratuberculosis
aggcggcgccgucg

SEQ ID NO: 807265 - RNA, 15 nt, Mycobacterium avium subsp. paratuberculosis
aggcggcgccgucga

SEQ ID NO: 807266 - RNA, 18 nt, Mycobacterium avium subsp. paratuberculosis
aggcggcgccgucgacca

SEQ ID NO: 807267 - RNA, 17 nt, Mycobacterium avium subsp. paratuberculosis
aggcggcgcgcagccgg

SEQ ID NO: 807268 - RNA, 12 nt, Mycobacterium avium subsp. paratuberculosis
aggcggccggcc

SEQ ID NO: 807269 - RNA, 14 nt, Mycobacterium avium subsp. paratuberculosis
aggcggccggcccg

SEQ ID NO: 807270 - RNA, 12 nt, Mycobacterium avium subsp. paratuberculosis
aggcggccggga

SEQ ID NO: 807271 - RNA, 17 nt, Mycobacterium avium subsp. paratuberculosis
aggcggccacacuggcc

SEQ ID NO: 807272 - RNA, 20 nt, Mycobacterium avium subsp. paratuberculosis
aggcggcccgcucgaugucg

SEQ ID NO: 807273 - RNA, 13 nt, Mycobacterium avium subsp. paratuberculosis
aggcggccgcgag

SEQ ID NO: 807274 - RNA, 15 nt, Mycobacterium avium subsp. paratuberculosis
aggcgcgcagggcga

SEQ ID NO: 807275 - RNA, 21 nt, Mycobacterium avium subsp. paratuberculosis
aggcgcgcagguagccgccgu

SEQ ID NO: 807276 - RNA, 21 nt, Mycobacterium avium subsp. paratuberculosis
aggcgcgcagcaggcgccggu

SEQ ID NO: 807277 - RNA, 13 nt, Mycobacterium avium subsp. paratuberculosis
aggcgcgcgcugg

SEQ ID NO: 807278 - RNA, 21 nt, Mycobacterium avium subsp. paratuberculosis
aggcgcgcgcuggugcgggcc

SEQ ID NO: 807279 - RNA, 12 nt, Mycobacterium avium subsp. paratuberculosis
aggcgcgcggcc

SEQ ID NO: 807280 - RNA, 21 nt, Mycobacterium avium subsp. paratuberculosis
aggcggaucuucucgcugcuc

SEQ ID NO: 807281 - RNA, 14 nt, Mycobacterium avium subsp. paratuberculosis
aggcggccaccgcg

SEQ ID NO: 807282 - RNA, 15 nt, Mycobacterium avium subsp. paratuberculosis
aggcggccagcacca

SEQ ID NO: 807283 - RNA, 15 nt, Mycobacterium avium subsp. paratuberculosis
aggcggccagcgccc

SEQ ID NO: 807284 - RNA, 17 nt, Mycobacterium avium subsp. paratuberculosis
aggcggccagcgcccgc

SEQ ID NO: 807285 - RNA, 22 nt, Mycobacterium avium subsp. paratuberculosis
aggcggccagcgcccgcgggug

SEQ ID NO: 807286 - RNA, 14 nt, Mycobacterium avium subsp. paratuberculosis
aggcgcaccgccac

SEQ ID NO: 807287 - RNA, 15 nt, Mycobacterium avium subsp. paratuberculosis
aggcgcaccgccacc

SEQ ID NO: 807288 - RNA, 17 nt, Mycobacterium avium subsp. paratuberculosis
aggcgcaccgccaccgc

SEQ ID NO: 807289 - RNA, 15 nt, Mycobacterium avium subsp. paratuberculosis
aggcgcaacaccgga

SEQ ID NO: 807290 - RNA, 20 nt, Mycobacterium avium subsp. paratuberculosis
aggcgcaacagcaccucguc

SEQ ID NO: 807291 - RNA, 17 nt, Mycobacterium avium subsp. paratuberculosis
aggcgcacaacgaggcc

SEQ ID NO: 807292 - RNA, 13 nt, Mycobacterium avium subsp. paratuberculosis
aggcgcaccacca

SEQ ID NO: 807293 - RNA, 20 nt, Mycobacterium avium subsp. paratuberculosis
aggcgcaccaccagcucguc

SEQ ID NO: 807294 - RNA, 22 nt, Mycobacterium avium subsp. paratuberculosis
aggcgcagaagcuaacgccagc

SEQ ID NO: 807295 - RNA, 18 nt, Mycobacterium avium subsp. paratuberculosis
aggcgcaguagccgacgu

SEQ ID NO: 807296 - RNA, 19 nt, Mycobacterium avium subsp. paratuberculosis
aggcgcaguagccgacgug

SEQ ID NO: 807297 - RNA, 21 nt, Mycobacterium avium subsp. paratuberculosis
aggcgccguauuggcaggcga

SEQ ID NO: 807298 - RNA, 12 nt, Mycobacterium avium subsp. paratuberculosis
aggcgccgucgg

SEQ ID NO: 807299 - RNA, 15 nt, Mycobacterium avium subsp. paratuberculosis
aggcgccggcgcggg

SEQ ID NO: 807300 - RNA, 14 nt, Mycobacterium avium subsp. paratuberculosis
aggcgccggccagc

SEQ ID NO: 807301 - RNA, 17 nt, Mycobacterium avium subsp. paratuberculosis
aggcgaaggucagaucg

SEQ ID NO: 807302 - RNA, 19 nt, Mycobacterium avium subsp. paratuberculosis
aggcgaagguggcgucggc

SEQ ID NO: 807303 - RNA, 14 nt, Mycobacterium avium subsp. paratuberculosis
aggcgaaucggcgc

SEQ ID NO: 807304 - RNA, 13 nt, Mycobacterium avium subsp. paratuberculosis
aggcgaaugcggc

SEQ ID NO: 807305 - RNA, 19 nt, Mycobacterium avium subsp. paratuberculosis
aggcgaccacaccgccggc

SEQ ID NO: 807306 - RNA, 19 nt, Mycobacterium avium subsp. paratuberculosis
aggcgaacauggcggccag

SEQ ID NO: 807307 - RNA, 16 nt, Mycobacterium avium subsp. paratuberculosis
aggcgaccaugcccag

SEQ ID NO: 807308 - RNA, 20 nt, Mycobacterium avium subsp. paratuberculosis
aggcgaccaugcccagcagu

SEQ ID NO: 807309 - RNA, 23 nt, Mycobacterium avium subsp. paratuberculosis
aggcgaccaugcccagcaguccg

SEQ ID NO: 807310 - RNA, 13 nt, Mycobacterium avium subsp. paratuberculosis
aggcgacccccgg

SEQ ID NO: 807311 - RNA, 16 nt, Mycobacterium avium subsp. paratuberculosis
aggcgacccccggugu

SEQ ID NO: 807312 - RNA, 13 nt, Mycobacterium avium subsp. paratuberculosis
aggcgaccggccc

SEQ ID NO: 807313 - RNA, 15 nt, Mycobacterium avium subsp. paratuberculosis
aggcgaccggcccca

SEQ ID NO: 807314 - RNA, 17 nt, Mycobacterium avium subsp. paratuberculosis
aggcgaccggccccaac

SEQ ID NO: 807315 - RNA, 13 nt, Mycobacterium avium subsp. paratuberculosis
aggcgaccucgua

SEQ ID NO: 807316 - RNA, 19 nt, Mycobacterium avium subsp. paratuberculosis
aggcgacuguccaggccga

SEQ ID NO: 807317 - RNA, 13 nt, Mycobacterium avium subsp. paratuberculosis
aggcgagcacccg

SEQ ID NO: 807318 - RNA, 17 nt, Mycobacterium avium subsp. paratuberculosis
aggcgagcacggcacgc

SEQ ID NO: 807319 - RNA, 18 nt, Mycobacterium avium subsp. paratuberculosis
aggcgagcacggcacgcc

SEQ ID NO: 807320 - RNA, 22 nt, Mycobacterium avium subsp. paratuberculosis
aggcgaguaaggccgaggcgag

SEQ ID NO: 807321 - RNA, 17 nt, Mycobacterium avium subsp. paratuberculosis
aggcgaguuaugccguc

SEQ ID NO: 807322 - RNA, 18 nt, Mycobacterium avium subsp. paratuberculosis
aggcgacgaaaaugccca

SEQ ID NO: 807323 - RNA, 22 nt, Mycobacterium avium subsp. paratuberculosis
aggcgacgaaaaugcccagugu

SEQ ID NO: 807324 - RNA, 20 nt, Mycobacterium avium subsp. paratuberculosis
aggcgaacaccagcccggcc

SEQ ID NO: 807325 - RNA, 22 nt, Mycobacterium avium subsp. paratuberculosis
aggcgaacaccucggugaucuc

SEQ ID NO: 807326 - RNA, 13 nt, Mycobacterium avium subsp. paratuberculosis
aggccuuggugau

SEQ ID NO: 807327 - RNA, 21 nt, Mycobacterium avium subsp. paratuberculosis
aggccuuggugugagggcgug

SEQ ID NO: 807328 - RNA, 20 nt, Mycobacterium avium subsp. paratuberculosis
aggccugcgccuuggccucg

SEQ ID NO: 807329 - RNA, 22 nt, Mycobacterium avium subsp. paratuberculosis
aggccugcgccuuggccucggu

SEQ ID NO: 807330 - RNA, 15 nt, Mycobacterium avium subsp. paratuberculosis
aggccugcgcggccg

SEQ ID NO: 807331 - RNA, 18 nt, Mycobacterium avium subsp. paratuberculosis
aggccugcgcggccgcgu

SEQ ID NO: 807332 - RNA, 19 nt, Mycobacterium avium subsp. paratuberculosis
aggccugcgcggccgcguc

SEQ ID NO: 807333 - RNA, 22 nt, Mycobacterium avium subsp. paratuberculosis
aggccugcgcggccgcgucggc

SEQ ID NO: 807334 - RNA, 21 nt, Mycobacterium avium subsp. paratuberculosis
aggccucguggaacaccgcgc

SEQ ID NO: 807335 - RNA, 15 nt, Mycobacterium avium subsp. paratuberculosis
aggccuggaaccggg

SEQ ID NO: 807336 - RNA, 18 nt, Mycobacterium avium subsp. paratuberculosis
aggcccucaucgucgacc

SEQ ID NO: 807337 - RNA, 20 nt, Mycobacterium avium subsp. paratuberculosis
aggccgaggcugucggaggc

SEQ ID NO: 807338 - RNA, 16 nt, Mycobacterium avium subsp. paratuberculosis
aggccgaggcugacga

SEQ ID NO: 807339 - RNA, 13 nt, Mycobacterium avium subsp. paratuberculosis
aggccgagcgcaa

SEQ ID NO: 807340 - RNA, 24 nt, Mycobacterium avium subsp. paratuberculosis
aggccgagcgcaagggccgacauc

SEQ ID NO: 807341 - RNA, 16 nt, Mycobacterium avium subsp. paratuberculosis
aggccucccacagcgg

SEQ ID NO: 807342 - RNA, 21 nt, Mycobacterium avium subsp. paratuberculosis
aggccgauggcgcccagcguc

SEQ ID NO: 807343 - RNA, 20 nt, Mycobacterium avium subsp. paratuberculosis
aggccgaugaugaugccgcc

SEQ ID NO: 807344 - RNA, 16 nt, Mycobacterium avium subsp. paratuberculosis
agggcgaccaccacgg

SEQ ID NO: 807345 - RNA, 13 nt, Mycobacterium avium subsp. paratuberculosis
agggcgaccgccg

SEQ ID NO: 807346 - RNA, 15 nt, Mycobacterium avium subsp. paratuberculosis
agggcgacgccgcgg

SEQ ID NO: 807347 - RNA, 13 nt, Mycobacterium avium subsp. paratuberculosis
agggcgacggcgg

SEQ ID NO: 807348 - RNA, 15 nt, Mycobacterium avium subsp. paratuberculosis
agggcgacggcggcg

SEQ ID NO: 807349 - RNA, 17 nt, Mycobacterium avium subsp. paratuberculosis
agggcgacggcggcgac

SEQ ID NO: 807350 - RNA, 21 nt, Mycobacterium avium subsp. paratuberculosis
agggcgacuccggcgccgguc

SEQ ID NO: 807351 - RNA, 15 nt, Mycobacterium avium subsp. paratuberculosis
agggccucggcgacc

SEQ ID NO: 807352 - RNA, 16 nt, Mycobacterium avium subsp. paratuberculosis
agggccucgucgucgu

SEQ ID NO: 807353 - RNA, 14 nt, Mycobacterium avium subsp. paratuberculosis
agggccgcagcgca

SEQ ID NO: 807354 - RNA, 17 nt, Mycobacterium avium subsp. paratuberculosis
agggccgggcgcuggcc

SEQ ID NO: 807355 - RNA, 19 nt, Mycobacterium avium subsp. paratuberculosis
agggccgggcgcuggccgu

SEQ ID NO: 807356 - RNA, 21 nt, Mycobacterium avium subsp. paratuberculosis
agggccggguuuucgggccgg

SEQ ID NO: 807357 - RNA, 15 nt, Mycobacterium avium subsp. paratuberculosis
agggccuccaccacc

SEQ ID NO: 807358 - RNA, 16 nt, Mycobacterium avium subsp. paratuberculosis
agggccuccaccacca

SEQ ID NO: 807359 - RNA, 18 nt, Mycobacterium avium subsp. paratuberculosis
agggcccacgcucgacgc

SEQ ID NO: 807360 - RNA, 17 nt, Mycobacterium avium subsp. paratuberculosis
agggccccggcaucgac

SEQ ID NO: 807361 - RNA, 20 nt, Mycobacterium avium subsp. paratuberculosis
agggccccguuggugcggug

SEQ ID NO: 807362 - RNA, 22 nt, Mycobacterium avium subsp. paratuberculosis
agggccgaaaaaccugcggugc

SEQ ID NO: 807363 - RNA, 19 nt, Mycobacterium avium subsp. paratuberculosis
agggccgccuugaucuugg

SEQ ID NO: 807364 - RNA, 13 nt, Mycobacterium avium subsp. paratuberculosis
agggccgcgcggg

SEQ ID NO: 807365 - RNA, 16 nt, Mycobacterium avium subsp. paratuberculosis
agggccgcggccgccg

SEQ ID NO: 807366 - RNA, 17 nt, Mycobacterium avium subsp. paratuberculosis
agggccgcggccgccgc

SEQ ID NO: 807367 - RNA, 19 nt, Mycobacterium avium subsp. paratuberculosis
agggccgcggccgccgcga

SEQ ID NO: 807368 - RNA, 20 nt, Mycobacterium avium subsp. paratuberculosis
agggccgcggccgccgcgac

SEQ ID NO: 807369 - RNA, 14 nt, Mycobacterium avium subsp. paratuberculosis
agggcccaugccgc

SEQ ID NO: 807370 - RNA, 16 nt, Mycobacterium avium subsp. paratuberculosis
agggcccaugccgcca

SEQ ID NO: 807371 - RNA, 22 nt, Mycobacterium avium subsp. paratuberculosis
agggccagguucaggcccgcgc

SEQ ID NO: 807372 - RNA, 14 nt, Mycobacterium avium subsp. paratuberculosis
agggccauccggcc

SEQ ID NO: 807373 - RNA, 20 nt, Mycobacterium avium subsp. paratuberculosis
agggccauccggccggcgag

SEQ ID NO: 807374 - RNA, 18 nt, Mycobacterium avium subsp. paratuberculosis
agggcgugacgccgcugc

SEQ ID NO: 807375 - RNA, 23 nt, Mycobacterium avium subsp. paratuberculosis
agggcgugaucuguucggcggcg

SEQ ID NO: 807376 - RNA, 19 nt, Mycobacterium avium subsp. paratuberculosis
agggcguucgacguccacc

SEQ ID NO: 807377 - RNA, 16 nt, Mycobacterium avium subsp. paratuberculosis
agggcguucgcggugg

SEQ ID NO: 807378 - RNA, 21 nt, Mycobacterium avium subsp. paratuberculosis
agggcguuugccacugagcgc

SEQ ID NO: 807379 - RNA, 18 nt, Mycobacterium avium subsp. paratuberculosis
agggcuccccggacagcc

SEQ ID NO: 807380 - RNA, 20 nt, Mycobacterium avium subsp. paratuberculosis
agggcgucacgagcuccagc

SEQ ID NO: 807381 - RNA, 13 nt, Mycobacterium avium subsp. paratuberculosis
agggcgucaggcg

SEQ ID NO: 807382 - RNA, 14 nt, Mycobacterium avium subsp. paratuberculosis
agggcgggucgucg

SEQ ID NO: 807383 - RNA, 14 nt, Mycobacterium avium subsp. paratuberculosis
agggcggcgccggc

SEQ ID NO: 807384 - RNA, 15 nt, Mycobacterium avium subsp. paratuberculosis
agggcggcgccggca

SEQ ID NO: 807385 - RNA, 22 nt, Mycobacterium avium subsp. paratuberculosis
agggcggcgccggcacugcugc

SEQ ID NO: 807386 - RNA, 20 nt, Mycobacterium avium subsp. paratuberculosis
agggcgucggacaugccggc

SEQ ID NO: 807387 - RNA, 18 nt, Mycobacterium avium subsp. paratuberculosis
agggcgaacuugcuggcc

SEQ ID NO: 807388 - RNA, 21 nt, Mycobacterium avium subsp. paratuberculosis
agggcgauaaccucggcggcg

SEQ ID NO: 807389 - RNA, 18 nt, Mycobacterium avium subsp. paratuberculosis
agggcgaggaacccgacc

SEQ ID NO: 807390 - RNA, 20 nt, Mycobacterium avium subsp. paratuberculosis
agggcgaggaacccgaccgc

SEQ ID NO: 807391 - RNA, 20 nt, Mycobacterium avium subsp. paratuberculosis
agggcggaaucgcgguagcg

SEQ ID NO: 807392 - RNA, 13 nt, Mycobacterium avium subsp. paratuberculosis
agggcgcggcgca

SEQ ID NO: 807393 - RNA, 22 nt, Mycobacterium avium subsp. paratuberculosis
agggcgcucaucaggcggccgg

SEQ ID NO: 807394 - RNA, 22 nt, Mycobacterium avium subsp. paratuberculosis
agggcgccgucggcgggggauc

SEQ ID NO: 807395 - RNA, 17 nt, Mycobacterium avium subsp. paratuberculosis
agggcgcgcugucgacg

SEQ ID NO: 807396 - RNA, 16 nt, Mycobacterium avium subsp. paratuberculosis
agggcgccagcaccuc

SEQ ID NO: 807397 - RNA, 14 nt, Mycobacterium avium subsp. paratuberculosis
agguaaaccagcag

SEQ ID NO: 807398 - RNA, 21 nt, Mycobacterium avium subsp. paratuberculosis
aggguuuugcggaucggggcg

SEQ ID NO: 807399 - RNA, 20 nt, Mycobacterium avium subsp. paratuberculosis
aggguucgguggccccgggc

SEQ ID NO: 807400 - RNA, 15 nt, Mycobacterium avium subsp. paratuberculosis
aggguucucgcggcg

SEQ ID NO: 807401 - RNA, 13 nt, Mycobacterium avium subsp. paratuberculosis
aggguugccgcac

SEQ ID NO: 807402 - RNA, 15 nt, Mycobacterium avium subsp. paratuberculosis
aggguuuucacgucg

SEQ ID NO: 807403 - RNA, 20 nt, Mycobacterium avium subsp. paratuberculosis
aggguuugggcgugcggccg

SEQ ID NO: 807404 - RNA, 14 nt, Mycobacterium avium subsp. paratuberculosis
agguaggcggcgcc

SEQ ID NO: 807405 - RNA, 14 nt, Mycobacterium avium subsp. paratuberculosis
agguaggcgucgaa

SEQ ID NO: 807406 - RNA, 15 nt, Mycobacterium avium subsp. paratuberculosis
agguaguagcgcgcc

SEQ ID NO: 807407 - RNA, 20 nt, Mycobacterium avium subsp. paratuberculosis
agguagucccgcgccuggcg

SEQ ID NO: 807408 - RNA, 14 nt, Mycobacterium avium subsp. paratuberculosis
agguagucggccca

SEQ ID NO: 807409 - RNA, 16 nt, Mycobacterium avium subsp. paratuberculosis
agguagugcgcgaugg

SEQ ID NO: 807410 - RNA, 23 nt, Mycobacterium avium subsp. paratuberculosis
agguagugcgcgauggcgugccg

SEQ ID NO: 807411 - RNA, 22 nt, Mycobacterium avium subsp. paratuberculosis
agguccguggugaucgccgcgg

SEQ ID NO: 807412 - RNA, 23 nt, Mycobacterium avium subsp. paratuberculosis
agguccguggugaucgccgcgga

SEQ ID NO: 807413 - RNA, 14 nt, Mycobacterium avium subsp. paratuberculosis
agguccgguaggcg

SEQ ID NO: 807414 - RNA, 23 nt, Mycobacterium avium subsp. paratuberculosis
agguccucgaccucuucggcgcc

SEQ ID NO: 807415 - RNA, 22 nt, Mycobacterium avium subsp. paratuberculosis
agguccucgcuggcgaucaccu

SEQ ID NO: 807416 - RNA, 19 nt, Mycobacterium avium subsp. paratuberculosis
agguccagcguccgggcgu

SEQ ID NO: 807417 - RNA, 21 nt, Mycobacterium avium subsp. paratuberculosis
agguccagcguccgggcguag

SEQ ID NO: 807418 - RNA, 14 nt, Mycobacterium avium subsp. paratuberculosis
aggucccaggcgug

SEQ ID NO: 807419 - RNA, 22 nt, Mycobacterium avium subsp. paratuberculosis
aggucccaggcguggucggcgc

SEQ ID NO: 807420 - RNA, 13 nt, Mycobacterium avium subsp. paratuberculosis
aggggagcggcgg

SEQ ID NO: 807421 - RNA, 22 nt, Mycobacterium avium subsp. paratuberculosis
aggggagcagcacgaucgagcc

SEQ ID NO: 807422 - RNA, 16 nt, Mycobacterium avium subsp. paratuberculosis
aggggauccagcggcg

SEQ ID NO: 807423 - RNA, 12 nt, Mycobacterium avium subsp. paratuberculosis
aggggccgggcu

SEQ ID NO: 807424 - RNA, 16 nt, Mycobacterium avium subsp. paratuberculosis
aggggcgcgcgccggg

SEQ ID NO: 807425 - RNA, 12 nt, Mycobacterium avium subsp. paratuberculosis
aggggcgcggca

SEQ ID NO: 807426 - RNA, 23 nt, Mycobacterium avium subsp. paratuberculosis
aggggccggacggugacgccgga

SEQ ID NO: 807427 - RNA, 15 nt, Mycobacterium avium subsp. paratuberculosis
aggggcagcagcgcc

SEQ ID NO: 807428 - RNA, 16 nt, Mycobacterium avium subsp. paratuberculosis
aggggcagcagcgccc

SEQ ID NO: 807429 - RNA, 18 nt, Mycobacterium avium subsp. paratuberculosis
aggggcagcagcgcccac

SEQ ID NO: 807430 - RNA, 16 nt, Mycobacterium avium subsp. paratuberculosis
aggggcgacgggccga

SEQ ID NO: 807431 - RNA, 19 nt, Mycobacterium avium subsp. paratuberculosis
aggggcgacgggccgauca

SEQ ID NO: 807432 - RNA, 22 nt, Mycobacterium avium subsp. paratuberculosis
agggugaugacguuggugaucg

SEQ ID NO: 807433 - RNA, 15 nt, Mycobacterium avium subsp. paratuberculosis
agggucuggcccggu

SEQ ID NO: 807434 - RNA, 20 nt, Mycobacterium avium subsp. paratuberculosis
agggucucgggcagcagcac

SEQ ID NO: 807435 - RNA, 17 nt, Mycobacterium avium subsp. paratuberculosis
agggugaugucgcugcc

SEQ ID NO: 807436 - RNA, 12 nt, Mycobacterium avium subsp. paratuberculosis
agggucccgguc

SEQ ID NO: 807437 - RNA, 14 nt, Mycobacterium avium subsp. paratuberculosis
agggucccggucag

SEQ ID NO: 807438 - RNA, 14 nt, Mycobacterium avium subsp. paratuberculosis
aggguccgccgucg

SEQ ID NO: 807439 - RNA, 20 nt, Mycobacterium avium subsp. paratuberculosis
agggucagcgcuuccagcgc

SEQ ID NO: 807440 - RNA, 16 nt, Mycobacterium avium subsp. paratuberculosis
agggucaucgcgccgg

SEQ ID NO: 807441 - RNA, 14 nt, Mycobacterium avium subsp. paratuberculosis
agggucgccaggcc

SEQ ID NO: 807442 - RNA, 19 nt, Mycobacterium avium subsp. paratuberculosis
agggucgcggagcggguca

SEQ ID NO: 807443 - RNA, 14 nt, Mycobacterium avium subsp. paratuberculosis
aggagaucggcgcg

SEQ ID NO: 807444 - RNA, 21 nt, Mycobacterium avium subsp. paratuberculosis
aggacuggcccacgcagccgu

SEQ ID NO: 807445 - RNA, 13 nt, Mycobacterium avium subsp. paratuberculosis
aggagaaggccgc

SEQ ID NO: 807446 - RNA, 12 nt, Mycobacterium avium subsp. paratuberculosis
aggacgggcgug

SEQ ID NO: 807447 - RNA, 15 nt, Mycobacterium avium subsp. paratuberculosis
aggacgggcgugaca

SEQ ID NO: 807448 - RNA, 20 nt, Mycobacterium avium subsp. paratuberculosis
aggacgucaggccggucagc

SEQ ID NO: 807449 - RNA, 13 nt, Mycobacterium avium subsp. paratuberculosis
aggacgucgucga

SEQ ID NO: 807450 - RNA, 17 nt, Mycobacterium avium subsp. paratuberculosis
aggacgucgucgacguc

SEQ ID NO: 807451 - RNA, 19 nt, Mycobacterium avium subsp. paratuberculosis
aggacgucgucgacgucca

SEQ ID NO: 807452 - RNA, 12 nt, Mycobacterium avium subsp. paratuberculosis
aggacgguggcc

SEQ ID NO: 807453 - RNA, 21 nt, Mycobacterium avium subsp. paratuberculosis
aggacgguggccgucucgucg

SEQ ID NO: 807454 - RNA, 20 nt, Mycobacterium avium subsp. paratuberculosis
aggacgguuucugccggccg

SEQ ID NO: 807455 - RNA, 14 nt, Mycobacterium avium subsp. paratuberculosis
aggacggcgcggug

SEQ ID NO: 807456 - RNA, 17 nt, Mycobacterium avium subsp. paratuberculosis
aggacggcgcgguggcg

SEQ ID NO: 807457 - RNA, 12 nt, Mycobacterium avium subsp. paratuberculosis
aggaccgcgcgc

SEQ ID NO: 807458 - RNA, 16 nt, Mycobacterium avium subsp. paratuberculosis
aggaccgcgcgccggc

SEQ ID NO: 807459 - RNA, 16 nt, Mycobacterium avium subsp. paratuberculosis
aggaccccggcugcug

SEQ ID NO: 807460 - RNA, 18 nt, Mycobacterium avium subsp. paratuberculosis
aggaccgagccgcgcgcc

SEQ ID NO: 807461 - RNA, 15 nt, Mycobacterium avium subsp. paratuberculosis
aggacgcccggcgag

SEQ ID NO: 807462 - RNA, 17 nt, Mycobacterium avium subsp. paratuberculosis
aggacgccucgcgcagc

SEQ ID NO: 807463 - RNA, 20 nt, Mycobacterium avium subsp. paratuberculosis
aggacgccucgcgcagcgcg

SEQ ID NO: 807464 - RNA, 23 nt, Mycobacterium avium subsp. paratuberculosis
aggacgcgcccggcgacgcggcg

SEQ ID NO: 807465 - RNA, 14 nt, Mycobacterium avium subsp. paratuberculosis
aggacgaugcgcgc

SEQ ID NO: 807466 - RNA, 20 nt, Mycobacterium avium subsp. paratuberculosis
aggacgaacgcuggcggcgu

SEQ ID NO: 807467 - RNA, 22 nt, Mycobacterium avium subsp. paratuberculosis
aggacgaggcgaguaaggccga

SEQ ID NO: 807468 - RNA, 22 nt, Mycobacterium avium subsp. paratuberculosis
aggagucgggaaaucggaccca

SEQ ID NO: 807469 - RNA, 14 nt, Mycobacterium avium subsp. paratuberculosis
aggaggccgcggcg

SEQ ID NO: 807470 - RNA, 19 nt, Mycobacterium avium subsp. paratuberculosis
aggagcaccugcgcgacgc

SEQ ID NO: 807471 - RNA, 20 nt, Mycobacterium avium subsp. paratuberculosis
aggaucaccgggacgggggu

SEQ ID NO: 807472 - RNA, 24 nt, Mycobacterium avium subsp. paratuberculosis
aggauccgcucgacgaguuccucg

SEQ ID NO: 807473 - RNA, 19 nt, Mycobacterium avium subsp. paratuberculosis
aggaucugcacgucggcgg

SEQ ID NO: 807474 - RNA, 20 nt, Mycobacterium avium subsp. paratuberculosis
aggaucugcacgucggcggc

SEQ ID NO: 807475 - RNA, 14 nt, Mycobacterium avium subsp. paratuberculosis
aggaucugcagcac

SEQ ID NO: 807476 - RNA, 17 nt, Mycobacterium avium subsp. paratuberculosis
aggaucuggugcgcgcg

SEQ ID NO: 807477 - RNA, 18 nt, Mycobacterium avium subsp. paratuberculosis
aggaucuugucggcggcc

SEQ ID NO: 807478 - RNA, 18 nt, Mycobacterium avium subsp. paratuberculosis
aggaugaccgcccaggac

SEQ ID NO: 807479 - RNA, 15 nt, Mycobacterium avium subsp. paratuberculosis
aggaugaccgcggcg

SEQ ID NO: 807480 - RNA, 22 nt, Mycobacterium avium subsp. paratuberculosis
aggaugaccgcgucggcgccgu

SEQ ID NO: 807481 - RNA, 12 nt, Mycobacterium avium subsp. paratuberculosis
aggaucgcggcc

SEQ ID NO: 807482 - RNA, 15 nt, Mycobacterium avium subsp. paratuberculosis
aggaucgcggccacg

SEQ ID NO: 807483 - RNA, 15 nt, Mycobacterium avium subsp. paratuberculosis
aggaucgcggugacc

SEQ ID NO: 807484 - RNA, 17 nt, Mycobacterium avium subsp. paratuberculosis
aggcacccgcugcacca

SEQ ID NO: 807485 - RNA, 18 nt, Mycobacterium avium subsp. paratuberculosis
aggcacccgcugcaccag

SEQ ID NO: 807486 - RNA, 22 nt, Mycobacterium avium subsp. paratuberculosis
aggcacccgcugcaccagcccg

SEQ ID NO: 807487 - RNA, 14 nt, Mycobacterium avium subsp. paratuberculosis
aggcacacgaacac

SEQ ID NO: 807488 - RNA, 20 nt, Mycobacterium avium subsp. paratuberculosis
aggcacacgaacaccggcgg

SEQ ID NO: 807489 - RNA, 13 nt, Mycobacterium avium subsp. paratuberculosis
aggcaagucgucg

SEQ ID NO: 807490 - RNA, 15 nt, Mycobacterium avium subsp. paratuberculosis
aggcaagucgucggu

SEQ ID NO: 807491 - RNA, 13 nt, Mycobacterium avium subsp. paratuberculosis
aggcaacucgcga

SEQ ID NO: 807492 - RNA, 14 nt, Mycobacterium avium subsp. paratuberculosis
aggcaagggcgauc

SEQ ID NO: 807493 - RNA, 20 nt, Mycobacterium avium subsp. paratuberculosis
aggaugcccaacagcucgcg

SEQ ID NO: 807494 - RNA, 17 nt, Mycobacterium avium subsp. paratuberculosis
aggaugcccagcaccac

SEQ ID NO: 807495 - RNA, 22 nt, Mycobacterium avium subsp. paratuberculosis
aggcacuccugguuucgggggu

SEQ ID NO: 807496 - RNA, 23 nt, Mycobacterium avium subsp. paratuberculosis
aggcacuccugguuucgggggua

SEQ ID NO: 807497 - RNA, 20 nt, Mycobacterium avium subsp. paratuberculosis
aggcagacccccagcagcgg

SEQ ID NO: 807498 - RNA, 15 nt, Mycobacterium avium subsp. paratuberculosis
aggcagaagcuccac

SEQ ID NO: 807499 - RNA, 22 nt, Mycobacterium avium subsp. paratuberculosis
aggcagaagcuccacgccgccg

SEQ ID NO: 807500 - RNA, 15 nt, Mycobacterium avium subsp. paratuberculosis
aggcacuggcgcugc

SEQ ID NO: 807501 - RNA, 20 nt, Mycobacterium avium subsp. paratuberculosis
aggcagcgcggauuccagcg

SEQ ID NO: 807502 - RNA, 22 nt, Mycobacterium avium subsp. paratuberculosis
aggcagcgcggauuccagcgcg

SEQ ID NO: 807503 - RNA, 19 nt, Mycobacterium avium subsp. paratuberculosis
aggcagcgaaucggggucg

SEQ ID NO: 807504 - RNA, 14 nt, Mycobacterium avium subsp. paratuberculosis
aggcagcccggcug

SEQ ID NO: 807505 - RNA, 16 nt, Mycobacterium avium subsp. paratuberculosis
aggcagcccggcugcg

SEQ ID NO: 807506 - RNA, 21 nt, Mycobacterium avium subsp. paratuberculosis
aggcaggcggccagggcggcg

SEQ ID NO: 807507 - RNA, 18 nt, Mycobacterium avium subsp. paratuberculosis
aggcaggccggcagccgg

SEQ ID NO: 807508 - RNA, 20 nt, Mycobacterium avium subsp. paratuberculosis
aggcaguuccaugucgacga

SEQ ID NO: 807509 - RNA, 14 nt, Mycobacterium avium subsp. paratuberculosis
aggccacgcccacg

SEQ ID NO: 807510 - RNA, 16 nt, Mycobacterium avium subsp. paratuberculosis
aggccacgcccacgcc

SEQ ID NO: 807511 - RNA, 13 nt, Mycobacterium avium subsp. paratuberculosis
aggccaccgcgcc

SEQ ID NO: 807512 - RNA, 14 nt, Mycobacterium avium subsp. paratuberculosis
aggccaccgcgccg

SEQ ID NO: 807513 - RNA, 16 nt, Mycobacterium avium subsp. paratuberculosis
aggccacccgggcgcc

SEQ ID NO: 807514 - RNA, 17 nt, Mycobacterium avium subsp. paratuberculosis
aggccacccgggcgccg

SEQ ID NO: 807515 - RNA, 19 nt, Mycobacterium avium subsp. paratuberculosis
aggccacccgggcgccggc

SEQ ID NO: 807516 - RNA, 23 nt, Mycobacterium avium subsp. paratuberculosis
aggccacccgggcgccggcgaug

SEQ ID NO: 807517 - RNA, 23 nt, Mycobacterium avium subsp. paratuberculosis
aggccacaugggccacggcgcga

SEQ ID NO: 807518 - RNA, 15 nt, Mycobacterium avium subsp. paratuberculosis
aggcccggcaccggu

SEQ ID NO: 807519 - RNA, 14 nt, Mycobacterium avium subsp. paratuberculosis
aggcccgcgccgac

SEQ ID NO: 807520 - RNA, 13 nt, Mycobacterium avium subsp. paratuberculosis
aggcccucgacgu

SEQ ID NO: 807521 - RNA, 23 nt, Mycobacterium avium subsp. paratuberculosis
aggcccucgacguaguccggcca

SEQ ID NO: 807522 - RNA, 15 nt, Mycobacterium avium subsp. paratuberculosis
aggcccucgccgcgg

SEQ ID NO: 807523 - RNA, 17 nt, Mycobacterium avium subsp. paratuberculosis
aggcccucgccgcgguc

SEQ ID NO: 807524 - RNA, 14 nt, Mycobacterium avium subsp. paratuberculosis
aggcccucggccag

SEQ ID NO: 807525 - RNA, 15 nt, Mycobacterium avium subsp. paratuberculosis
aggcccucggccagc

SEQ ID NO: 807526 - RNA, 12 nt, Mycobacterium avium subsp. paratuberculosis
aggcccgggcgg

SEQ ID NO: 807527 - RNA, 23 nt, Mycobacterium avium subsp. paratuberculosis
aggcccggcgugggccgcagcgc

SEQ ID NO: 807528 - RNA, 18 nt, Mycobacterium avium subsp. paratuberculosis
aggcccgggaucgggcgu

SEQ ID NO: 807529 - RNA, 23 nt, Mycobacterium avium subsp. paratuberculosis
aggccccguucgguggccaccgc

SEQ ID NO: 807530 - RNA, 22 nt, Mycobacterium avium subsp. paratuberculosis
aggcccgagcccgacggcagca

SEQ ID NO: 807531 - RNA, 14 nt, Mycobacterium avium subsp. paratuberculosis
aggccccggcgcgc

SEQ ID NO: 807532 - RNA, 15 nt, Mycobacterium avium subsp. paratuberculosis
aggccccgcgugacg

SEQ ID NO: 807533 - RNA, 12 nt, Mycobacterium avium subsp. paratuberculosis
aggccagcgcga

SEQ ID NO: 807534 - RNA, 13 nt, Mycobacterium avium subsp. paratuberculosis
aggccagcagcgc

SEQ ID NO: 807535 - RNA, 18 nt, Mycobacterium avium subsp. paratuberculosis
aggccagcagcgcggcga

SEQ ID NO: 807536 - RNA, 21 nt, Mycobacterium avium subsp. paratuberculosis
aggccagcaccuucagcgggc

SEQ ID NO: 807537 - RNA, 15 nt, Mycobacterium avium subsp. paratuberculosis
aggccagcacgccgg

SEQ ID NO: 807538 - RNA, 13 nt, Mycobacterium avium subsp. paratuberculosis
aggccagcaaccg

SEQ ID NO: 807539 - RNA, 19 nt, Mycobacterium avium subsp. paratuberculosis
agcuugucguagcggcgcc

SEQ ID NO: 807540 - RNA, 17 nt, Mycobacterium avium subsp. paratuberculosis
agcuugggggccgacgc

SEQ ID NO: 807541 - RNA, 22 nt, Mycobacterium avium subsp. paratuberculosis
agcuugcucuucaggaacccga

SEQ ID NO: 807542 - RNA, 23 nt, Mycobacterium avium subsp. paratuberculosis
agcuugcucuucaggaacccgaa

SEQ ID NO: 807543 - RNA, 14 nt, Mycobacterium avium subsp. paratuberculosis
agcuugagccccgc

SEQ ID NO: 807544 - RNA, 17 nt, Mycobacterium avium subsp. paratuberculosis
agcuugacgucggucag

SEQ ID NO: 807545 - RNA, 19 nt, Mycobacterium avium subsp. paratuberculosis
agcuucuugcugccgucgg

SEQ ID NO: 807546 - RNA, 15 nt, Mycobacterium avium subsp. paratuberculosis
agcuucggcgccgag

SEQ ID NO: 807547 - RNA, 22 nt, Mycobacterium avium subsp. paratuberculosis
agcuucucggugaucacccgcc

SEQ ID NO: 807548 - RNA, 18 nt, Mycobacterium avium subsp. paratuberculosis
aggaauucgccgacgcgc

SEQ ID NO: 807549 - RNA, 20 nt, Mycobacterium avium subsp. paratuberculosis
aggacagcaccgccaucgcg

SEQ ID NO: 807550 - RNA, 13 nt, Mycobacterium avium subsp. paratuberculosis
aggacaccacggu

SEQ ID NO: 807551 - RNA, 21 nt, Mycobacterium avium subsp. paratuberculosis
aggacaccacgguggcgucca

SEQ ID NO: 807552 - RNA, 15 nt, Mycobacterium avium subsp. paratuberculosis
aggacaccccggcga

SEQ ID NO: 807553 - RNA, 17 nt, Mycobacterium avium subsp. paratuberculosis
aggacaccccggcgaug

SEQ ID NO: 807554 - RNA, 22 nt, Mycobacterium avium subsp. paratuberculosis
aggacaccccggcgaugaccgg

SEQ ID NO: 807555 - RNA, 23 nt, Mycobacterium avium subsp. paratuberculosis
aggacaccccggcgaugaccggg

SEQ ID NO: 807556 - RNA, 19 nt, Mycobacterium avium subsp. paratuberculosis
aggaaggccaguucgacga

SEQ ID NO: 807557 - RNA, 18 nt, Mycobacterium avium subsp. paratuberculosis
aggaacccgaccgcgaug

SEQ ID NO: 807558 - RNA, 20 nt, Mycobacterium avium subsp. paratuberculosis
aggaagacgucgaacccgaa

SEQ ID NO: 807559 - RNA, 22 nt, Mycobacterium avium subsp. paratuberculosis
aggaacuggucgaacagcgcgc

SEQ ID NO: 807560 - RNA, 17 nt, Mycobacterium avium subsp. paratuberculosis
aggaagccagccguccc

SEQ ID NO: 807561 - RNA, 18 nt, Mycobacterium avium subsp. paratuberculosis
aggaacgccuuggugccg

SEQ ID NO: 807562 - RNA, 17 nt, Mycobacterium avium subsp. paratuberculosis
aggaacggcacccgcag

SEQ ID NO: 807563 - RNA, 14 nt, Mycobacterium avium subsp. paratuberculosis
aggaacggcgccau

SEQ ID NO: 807564 - RNA, 14 nt, Mycobacterium avium subsp. paratuberculosis
aggaacacgggaua

SEQ ID NO: 807565 - RNA, 19 nt, Mycobacterium avium subsp. paratuberculosis
agcguccaguccggcgugc

SEQ ID NO: 807566 - RNA, 20 nt, Mycobacterium avium subsp. paratuberculosis
agcgucggguacaccgagcc

SEQ ID NO: 807567 - RNA, 18 nt, Mycobacterium avium subsp. paratuberculosis
agcgucguccaugcccgc

SEQ ID NO: 807568 - RNA, 21 nt, Mycobacterium avium subsp. paratuberculosis
agcgucucccgggugcgcguc

SEQ ID NO: 807569 - RNA, 15 nt, Mycobacterium avium subsp. paratuberculosis
agcgucuccggcggg

SEQ ID NO: 807570 - RNA, 15 nt, Mycobacterium avium subsp. paratuberculosis
agcgucuccucgacc

SEQ ID NO: 807571 - RNA, 20 nt, Mycobacterium avium subsp. paratuberculosis
agcgucucgaccgcgguggc

SEQ ID NO: 807572 - RNA, 20 nt, Mycobacterium avium subsp. paratuberculosis
agcgucucgacggcgccgac

SEQ ID NO: 807573 - RNA, 15 nt, Mycobacterium avium subsp. paratuberculosis
agcgucgugcgggcu

SEQ ID NO: 807574 - RNA, 18 nt, Mycobacterium avium subsp. paratuberculosis
agcgucgugcgggcuccg

SEQ ID NO: 807575 - RNA, 18 nt, Mycobacterium avium subsp. paratuberculosis
agcgucucgaucgacgac

SEQ ID NO: 807576 - RNA, 13 nt, Mycobacterium avium subsp. paratuberculosis
agcgucucggcga

SEQ ID NO: 807577 - RNA, 22 nt, Mycobacterium avium subsp. paratuberculosis
agcgucucggcgaucagcugcc

SEQ ID NO: 807578 - RNA, 21 nt, Mycobacterium avium subsp. paratuberculosis
agcgucucggcggccgagcgc

SEQ ID NO: 807579 - RNA, 15 nt, Mycobacterium avium subsp. paratuberculosis
agcgucugcgccagc

SEQ ID NO: 807580 - RNA, 16 nt, Mycobacterium avium subsp. paratuberculosis
agcgucugcgccagcu

SEQ ID NO: 807581 - RNA, 13 nt, Mycobacterium avium subsp. paratuberculosis
agcgucugcgccc

SEQ ID NO: 807582 - RNA, 15 nt, Mycobacterium avium subsp. paratuberculosis
agcgucugcgccccg

SEQ ID NO: 807583 - RNA, 19 nt, Mycobacterium avium subsp. paratuberculosis
agcgucugcgccccggcgu

SEQ ID NO: 807584 - RNA, 20 nt, Mycobacterium avium subsp. paratuberculosis
agcgucugcgccccggcguc

SEQ ID NO: 807585 - RNA, 21 nt, Mycobacterium avium subsp. paratuberculosis
agcgucuggcagccggccggc

SEQ ID NO: 807586 - RNA, 22 nt, Mycobacterium avium subsp. paratuberculosis
agcugcuccgggggcaccgcca

SEQ ID NO: 807587 - RNA, 21 nt, Mycobacterium avium subsp. paratuberculosis
agcgucuucuucucgccgucc

SEQ ID NO: 807588 - RNA, 15 nt, Mycobacterium avium subsp. paratuberculosis
agcgucuugcccagc

SEQ ID NO: 807589 - RNA, 18 nt, Mycobacterium avium subsp. paratuberculosis
agcugcggguugcgggcc

SEQ ID NO: 807590 - RNA, 14 nt, Mycobacterium avium subsp. paratuberculosis
agcuggccaccgca

SEQ ID NO: 807591 - RNA, 18 nt, Mycobacterium avium subsp. paratuberculosis
agcuggccaccgcaucgc

SEQ ID NO: 807592 - RNA, 19 nt, Mycobacterium avium subsp. paratuberculosis
agcuggccaccgcaucgcc

SEQ ID NO: 807593 - RNA, 19 nt, Mycobacterium avium subsp. paratuberculosis
agcuggauucgucgcuggc

SEQ ID NO: 807594 - RNA, 20 nt, Mycobacterium avium subsp. paratuberculosis
agcuggauucgucgcuggcc

SEQ ID NO: 807595 - RNA, 12 nt, Mycobacterium avium subsp. paratuberculosis
agcuggcgccga

SEQ ID NO: 807596 - RNA, 14 nt, Mycobacterium avium subsp. paratuberculosis
agcuggccgcccac

SEQ ID NO: 807597 - RNA, 15 nt, Mycobacterium avium subsp. paratuberculosis
agcuggccgcccacc

SEQ ID NO: 807598 - RNA, 16 nt, Mycobacterium avium subsp. paratuberculosis
agcuggccgcccacca

SEQ ID NO: 807599 - RNA, 14 nt, Mycobacterium avium subsp. paratuberculosis
agcuggccgcgcag

SEQ ID NO: 807600 - RNA, 15 nt, Mycobacterium avium subsp. paratuberculosis
agcugcuucgucgcc

SEQ ID NO: 807601 - RNA, 19 nt, Mycobacterium avium subsp. paratuberculosis
agcugcuucgucgccgggc

SEQ ID NO: 807602 - RNA, 20 nt, Mycobacterium avium subsp. paratuberculosis
agcugcuucgucgccgggcu

SEQ ID NO: 807603 - RNA, 14 nt, Mycobacterium avium subsp. paratuberculosis
agcugcucggccac

SEQ ID NO: 807604 - RNA, 23 nt, Mycobacterium avium subsp. paratuberculosis
agcugcucguccuggcgcuggug

SEQ ID NO: 807605 - RNA, 22 nt, Mycobacterium avium subsp. paratuberculosis
agcugcgucggcaccagcggca

SEQ ID NO: 807606 - RNA, 22 nt, Mycobacterium avium subsp. paratuberculosis
agcugcugcgcggcggcggcgc

SEQ ID NO: 807607 - RNA, 14 nt, Mycobacterium avium subsp. paratuberculosis
agcugcugaugcgg

SEQ ID NO: 807608 - RNA, 15 nt, Mycobacterium avium subsp. paratuberculosis
agcuucacgcucggc

SEQ ID NO: 807609 - RNA, 20 nt, Mycobacterium avium subsp. paratuberculosis
agcuucacguucggcgagug

SEQ ID NO: 807610 - RNA, 14 nt, Mycobacterium avium subsp. paratuberculosis
agcugugccgcggu

SEQ ID NO: 807611 - RNA, 15 nt, Mycobacterium avium subsp. paratuberculosis
agcugugccgcggug

SEQ ID NO: 807612 - RNA, 16 nt, Mycobacterium avium subsp. paratuberculosis
agcugugccgcggugc

SEQ ID NO: 807613 - RNA, 23 nt, Mycobacterium avium subsp. paratuberculosis
agcugucgccgagguccucgacc

SEQ ID NO: 807614 - RNA, 19 nt, Mycobacterium avium subsp. paratuberculosis
agcugcuggcuucgcggau

SEQ ID NO: 807615 - RNA, 14 nt, Mycobacterium avium subsp. paratuberculosis
agcuggccgugcac

SEQ ID NO: 807616 - RNA, 21 nt, Mycobacterium avium subsp. paratuberculosis
agcuggccgugcaccgucgcc

SEQ ID NO: 807617 - RNA, 21 nt, Mycobacterium avium subsp. paratuberculosis
agcuggcggucgcugaccccg

SEQ ID NO: 807618 - RNA, 19 nt, Mycobacterium avium subsp. paratuberculosis
agcugggacagcgucacca

SEQ ID NO: 807619 - RNA, 18 nt, Mycobacterium avium subsp. paratuberculosis
agcugggccagcgcggug

SEQ ID NO: 807620 - RNA, 21 nt, Mycobacterium avium subsp. paratuberculosis
agcugggccccuccagccgcc

SEQ ID NO: 807621 - RNA, 18 nt, Mycobacterium avium subsp. paratuberculosis
agcugggcggcgcgcugc

SEQ ID NO: 807622 - RNA, 21 nt, Mycobacterium avium subsp. paratuberculosis
agcugggcggcgcgcugcggc

SEQ ID NO: 807623 - RNA, 17 nt, Mycobacterium avium subsp. paratuberculosis
agcugguagaugguggc

SEQ ID NO: 807624 - RNA, 23 nt, Mycobacterium avium subsp. paratuberculosis
agcugguagaugguggccgucgg

SEQ ID NO: 807625 - RNA, 16 nt, Mycobacterium avium subsp. paratuberculosis
agcuggugcgcagccc

SEQ ID NO: 807626 - RNA, 20 nt, Mycobacterium avium subsp. paratuberculosis
agcuggugcgcagcccgccg

SEQ ID NO: 807627 - RNA, 14 nt, Mycobacterium avium subsp. paratuberculosis
agcugguccggccg

SEQ ID NO: 807628 - RNA, 16 nt, Mycobacterium avium subsp. paratuberculosis
agcugguccggccggc

SEQ ID NO: 807629 - RNA, 17 nt, Mycobacterium avium subsp. paratuberculosis
agcugguccggccggcc

SEQ ID NO: 807630 - RNA, 18 nt, Mycobacterium avium subsp. paratuberculosis
agcugguccggccggccg

SEQ ID NO: 807631 - RNA, 22 nt, Mycobacterium avium subsp. paratuberculosis
agcuggguggucaccagcgcgg

SEQ ID NO: 807632 - RNA, 19 nt, Mycobacterium avium subsp. paratuberculosis
agcuggugaagcugccgac

SEQ ID NO: 807633 - RNA, 14 nt, Mycobacterium avium subsp. paratuberculosis
caauucuucggcgu

SEQ ID NO: 807634 - RNA, 14 nt, Mycobacterium avium subsp. paratuberculosis
caauucugcugccc

SEQ ID NO: 807635 - RNA, 13 nt, Mycobacterium avium subsp. paratuberculosis
caauucgcgcugc

SEQ ID NO: 807636 - RNA, 21 nt, Mycobacterium avium subsp. paratuberculosis
caauggauccgaucagcagca

SEQ ID NO: 807637 - RNA, 13 nt, Mycobacterium avium subsp. paratuberculosis
caaggggccgggc

SEQ ID NO: 807638 - RNA, 22 nt, Mycobacterium avium subsp. paratuberculosis
caaggcccccgccucgccgguc

SEQ ID NO: 807639 - RNA, 21 nt, Mycobacterium avium subsp. paratuberculosis
caagggcggguaggcgccgau

SEQ ID NO: 807640 - RNA, 21 nt, Mycobacterium avium subsp. paratuberculosis
caaggccgacagguagcaggc

SEQ ID NO: 807641 - RNA, 17 nt, Mycobacterium avium subsp. paratuberculosis
caagguggacgagcagc

SEQ ID NO: 807642 - RNA, 15 nt, Mycobacterium avium subsp. paratuberculosis
caaggucgucgcggc

SEQ ID NO: 807643 - RNA, 17 nt, Mycobacterium avium subsp. paratuberculosis
caaugaugucggcgggc

SEQ ID NO: 807644 - RNA, 19 nt, Mycobacterium avium subsp. paratuberculosis
caaugcgucgcggcggcgc

SEQ ID NO: 807645 - RNA, 15 nt, Mycobacterium avium subsp. paratuberculosis
caaugcgccggcggc

SEQ ID NO: 807646 - RNA, 17 nt, Mycobacterium avium subsp. paratuberculosis
caaugcgccggcggccg

SEQ ID NO: 807647 - RNA, 12 nt, Mycobacterium avium subsp. paratuberculosis
cacaaaggccga

SEQ ID NO: 807648 - RNA, 20 nt, Mycobacterium avium subsp. paratuberculosis
cacaacagguucgacagcga

SEQ ID NO: 807649 - RNA, 17 nt, Mycobacterium avium subsp. paratuberculosis
cacacagccgcuuggcg

SEQ ID NO: 807650 - RNA, 13 nt, Mycobacterium avium subsp. paratuberculosis
cacacaggucgcc

SEQ ID NO: 807651 - RNA, 20 nt, Mycobacterium avium subsp. paratuberculosis
cacacaggucgcccggcucg

SEQ ID NO: 807652 - RNA, 21 nt, Mycobacterium avium subsp. paratuberculosis
cacacaggucgcccggcucgc

SEQ ID NO: 807653 - RNA, 16 nt, Mycobacterium avium subsp. paratuberculosis
cacacgaacaccggcg

SEQ ID NO: 807654 - RNA, 19 nt, Mycobacterium avium subsp. paratuberculosis
cacaccuuccaccaccgcg

SEQ ID NO: 807655 - RNA, 23 nt, Mycobacterium avium subsp. paratuberculosis
cacaccucgcuacgcgagcugcu

SEQ ID NO: 807656 - RNA, 14 nt, Mycobacterium avium subsp. paratuberculosis
cacaccucggcgac

SEQ ID NO: 807657 - RNA, 13 nt, Mycobacterium avium subsp. paratuberculosis
cacaccgucggcg

SEQ ID NO: 807658 - RNA, 14 nt, Mycobacterium avium subsp. paratuberculosis
cacaccgucggcga

SEQ ID NO: 807659 - RNA, 15 nt, Mycobacterium avium subsp. paratuberculosis
cacaccgucggcgau

SEQ ID NO: 807660 - RNA, 14 nt, Mycobacterium avium subsp. paratuberculosis
cacaccaccacgcg

SEQ ID NO: 807661 - RNA, 15 nt, Mycobacterium avium subsp. paratuberculosis
cacaccaccacgcga

SEQ ID NO: 807662 - RNA, 11 nt, Mycobacterium avium subsp. paratuberculosis
cacaccaccau

SEQ ID NO: 807663 - RNA, 13 nt, Mycobacterium avium subsp. paratuberculosis
cacacccagcgcc

SEQ ID NO: 807664 - RNA, 14 nt, Mycobacterium avium subsp. paratuberculosis
cacaccagcguucg

SEQ ID NO: 807665 - RNA, 13 nt, Mycobacterium avium subsp. paratuberculosis
cacaccagcacgg

SEQ ID NO: 807666 - RNA, 22 nt, Mycobacterium avium subsp. paratuberculosis
cacaccagcacggcggcgcuga

SEQ ID NO: 807667 - RNA, 13 nt, Mycobacterium avium subsp. paratuberculosis
cacaccagcgguc

SEQ ID NO: 807668 - RNA, 23 nt, Mycobacterium avium subsp. paratuberculosis
cacacgaucucguagguggccag

SEQ ID NO: 807669 - RNA, 21 nt, Mycobacterium avium subsp. paratuberculosis
cacagcaugaagaucagcacc

SEQ ID NO: 807670 - RNA, 22 nt, Mycobacterium avium subsp. paratuberculosis
cacagcaugaagaucagcaccg

SEQ ID NO: 807671 - RNA, 23 nt, Mycobacterium avium subsp. paratuberculosis
cacagcaugaagaucagcaccgu

SEQ ID NO: 807672 - RNA, 20 nt, Mycobacterium avium subsp. paratuberculosis
cacagcauguccucggggug

SEQ ID NO: 807673 - RNA, 15 nt, Mycobacterium avium subsp. paratuberculosis
cacagcagggcaccg

SEQ ID NO: 807674 - RNA, 15 nt, Mycobacterium avium subsp. paratuberculosis
cacagcaccggcguc

SEQ ID NO: 807675 - RNA, 13 nt, Mycobacterium avium subsp. paratuberculosis
cacagcagcacgc

SEQ ID NO: 807676 - RNA, 16 nt, Mycobacterium avium subsp. paratuberculosis
cacagcagcagcacca

SEQ ID NO: 807677 - RNA, 14 nt, Mycobacterium avium subsp. paratuberculosis
cacagcgccacacc

SEQ ID NO: 807678 - RNA, 19 nt, Mycobacterium avium subsp. paratuberculosis
cacagcgccucgucgagcc

SEQ ID NO: 807679 - RNA, 15 nt, Mycobacterium avium subsp. paratuberculosis
cacagcgcggcggug

SEQ ID NO: 807680 - RNA, 14 nt, Mycobacterium avium subsp. paratuberculosis
cacagcgccagcac

SEQ ID NO: 807681 - RNA, 22 nt, Mycobacterium avium subsp. paratuberculosis
cacagcgccagcacggccacca

SEQ ID NO: 807682 - RNA, 19 nt, Mycobacterium avium subsp. paratuberculosis
cacagcgcccuugagcacg

SEQ ID NO: 807683 - RNA, 15 nt, Mycobacterium avium subsp. paratuberculosis
cacagcgaggcgacg

SEQ ID NO: 807684 - RNA, 16 nt, Mycobacterium avium subsp. paratuberculosis
cacagcgaggcgacgu

SEQ ID NO: 807685 - RNA, 19 nt, Mycobacterium avium subsp. paratuberculosis
cacagcgaggcgacgucga

SEQ ID NO: 807686 - RNA, 14 nt, Mycobacterium avium subsp. paratuberculosis
cacagccggucaua

SEQ ID NO: 807687 - RNA, 22 nt, Mycobacterium avium subsp. paratuberculosis
cacagccggucauaggccgcgc

SEQ ID NO: 807688 - RNA, 20 nt, Mycobacterium avium subsp. paratuberculosis
cacagcgaaagcgcuuggcg

SEQ ID NO: 807689 - RNA, 13 nt, Mycobacterium avium subsp. paratuberculosis
cacagcgacaacg

SEQ ID NO: 807690 - RNA, 20 nt, Mycobacterium avium subsp. paratuberculosis
cacagcgacaacgggccgcc

SEQ ID NO: 807691 - RNA, 12 nt, Mycobacterium avium subsp. paratuberculosis
cacagcgacagg

SEQ ID NO: 807692 - RNA, 19 nt, Mycobacterium avium subsp. paratuberculosis
cacagcgacagggugccga

SEQ ID NO: 807693 - RNA, 23 nt, Mycobacterium avium subsp. paratuberculosis
cacagccaaagccuacggcgccg

SEQ ID NO: 807694 - RNA, 18 nt, Mycobacterium avium subsp. paratuberculosis
cacagccagcgcccggcg

SEQ ID NO: 807695 - RNA, 14 nt, Mycobacterium avium subsp. paratuberculosis
cacagcccguugcu

SEQ ID NO: 807696 - RNA, 17 nt, Mycobacterium avium subsp. paratuberculosis
cacagccgcagcagccg

SEQ ID NO: 807697 - RNA, 20 nt, Mycobacterium avium subsp. paratuberculosis
cacagcccccacgcucggcg

SEQ ID NO: 807698 - RNA, 15 nt, Mycobacterium avium subsp. paratuberculosis
cacagccgcuuggcg

SEQ ID NO: 807699 - RNA, 22 nt, Mycobacterium avium subsp. paratuberculosis
cacagccgcuuggcgcgccgca

SEQ ID NO: 807700 - RNA, 13 nt, Mycobacterium avium subsp. paratuberculosis
cacagccggcgcg

SEQ ID NO: 807701 - RNA, 15 nt, Mycobacterium avium subsp. paratuberculosis
cacagccggcgcgcg

SEQ ID NO: 807702 - RNA, 13 nt, Mycobacterium avium subsp. paratuberculosis
cacagccggcggc

SEQ ID NO: 807703 - RNA, 14 nt, Mycobacterium avium subsp. paratuberculosis
cacagccggcggcg

SEQ ID NO: 807704 - RNA, 23 nt, Mycobacterium avium subsp. paratuberculosis
cacagccggcggcggcggucggc

SEQ ID NO: 807705 - RNA, 20 nt, Mycobacterium avium subsp. paratuberculosis
cacagccggggaucgcgcag

SEQ ID NO: 807706 - RNA, 13 nt, Mycobacterium avium subsp. paratuberculosis
cacauuggcgacc

SEQ ID NO: 807707 - RNA, 18 nt, Mycobacterium avium subsp. paratuberculosis
caccaaauagccgucggc

SEQ ID NO: 807708 - RNA, 19 nt, Mycobacterium avium subsp. paratuberculosis
caccaaauagccgucggcg

SEQ ID NO: 807709 - RNA, 21 nt, Mycobacterium avium subsp. paratuberculosis
caccaaauagccgucggcggc

SEQ ID NO: 807710 - RNA, 17 nt, Mycobacterium avium subsp. paratuberculosis
caccaaacgaagugaug

SEQ ID NO: 807711 - RNA, 16 nt, Mycobacterium avium subsp. paratuberculosis
cacaugguccugcacc

SEQ ID NO: 807712 - RNA, 17 nt, Mycobacterium avium subsp. paratuberculosis
cacaugggccacggcgc

SEQ ID NO: 807713 - RNA, 18 nt, Mycobacterium avium subsp. paratuberculosis
cacaugggccacggcgcg

SEQ ID NO: 807714 - RNA, 19 nt, Mycobacterium avium subsp. paratuberculosis
cacaugggccacggcgcga

SEQ ID NO: 807715 - RNA, 13 nt, Mycobacterium avium subsp. paratuberculosis
caccaacgccacg

SEQ ID NO: 807716 - RNA, 13 nt, Mycobacterium avium subsp. paratuberculosis
caccaacggcagc

SEQ ID NO: 807717 - RNA, 14 nt, Mycobacterium avium subsp. paratuberculosis
caccaacggcagca

SEQ ID NO: 807718 - RNA, 15 nt, Mycobacterium avium subsp. paratuberculosis
caccaacaucgacgu

SEQ ID NO: 807719 - RNA, 20 nt, Mycobacterium avium subsp. paratuberculosis
caccaacaucgacgugccgu

SEQ ID NO: 807720 - RNA, 17 nt, Mycobacterium avium subsp. paratuberculosis
caccaacgacagcgacg

SEQ ID NO: 807721 - RNA, 22 nt, Mycobacterium avium subsp. paratuberculosis
caccaacagcggcccgaucacc

SEQ ID NO: 807722 - RNA, 13 nt, Mycobacterium avium subsp. paratuberculosis
caccaacaggucg

SEQ ID NO: 807723 - RNA, 23 nt, Mycobacterium avium subsp. paratuberculosis
caccaacaggucggcgugcagca

SEQ ID NO: 807724 - RNA, 12 nt, Mycobacterium avium subsp. paratuberculosis
caccaaccgcuc

SEQ ID NO: 807725 - RNA, 17 nt, Mycobacterium avium subsp. paratuberculosis
caccaaccgcucggcga

SEQ ID NO: 807726 - RNA, 18 nt, Mycobacterium avium subsp. paratuberculosis
caccaaccgcucggcgau

SEQ ID NO: 807727 - RNA, 19 nt, Mycobacterium avium subsp. paratuberculosis
caccaaccgcucggcgauc

SEQ ID NO: 807728 - RNA, 20 nt, Mycobacterium avium subsp. paratuberculosis
caccaaccggccccgagcgu

SEQ ID NO: 807729 - RNA, 18 nt, Mycobacterium avium subsp. paratuberculosis
caccaaggucuccgggcu

SEQ ID NO: 807730 - RNA, 23 nt, Mycobacterium avium subsp. paratuberculosis
caccaacggcucgccgcgcauca

SEQ ID NO: 807731 - RNA, 17 nt, Mycobacterium avium subsp. paratuberculosis
caccacacccagcgcca

SEQ ID NO: 807732 - RNA, 18 nt, Mycobacterium avium subsp. paratuberculosis
caccacacccgcggccgc

SEQ ID NO: 807733 - RNA, 16 nt, Mycobacterium avium subsp. paratuberculosis
caccaccgagccggcg

SEQ ID NO: 807734 - RNA, 17 nt, Mycobacterium avium subsp. paratuberculosis
caccaccgagccggcgu

SEQ ID NO: 807735 - RNA, 19 nt, Mycobacterium avium subsp. paratuberculosis
caccaccgagccggcgucg

SEQ ID NO: 807736 - RNA, 15 nt, Mycobacterium avium subsp. paratuberculosis
caccaaugcgccggc

SEQ ID NO: 807737 - RNA, 19 nt, Mycobacterium avium subsp. paratuberculosis
caccaaugcgccggcggcc

SEQ ID NO: 807738 - RNA, 22 nt, Mycobacterium avium subsp. paratuberculosis
caccaaugcgccggcggccgcg

SEQ ID NO: 807739 - RNA, 23 nt, Mycobacterium avium subsp. paratuberculosis
caccaaugcgccggcggccgcga

SEQ ID NO: 807740 - RNA, 14 nt, Mycobacterium avium subsp. paratuberculosis
caccaauggcggcc

SEQ ID NO: 807741 - RNA, 13 nt, Mycobacterium avium subsp. paratuberculosis
caccaccgccgcc

SEQ ID NO: 807742 - RNA, 16 nt, Mycobacterium avium subsp. paratuberculosis
caccaccgccaccagc

SEQ ID NO: 807743 - RNA, 12 nt, Mycobacterium avium subsp. paratuberculosis
caccaccgccag

SEQ ID NO: 807744 - RNA, 13 nt, Mycobacterium avium subsp. paratuberculosis
caccaccgccagg

SEQ ID NO: 807745 - RNA, 13 nt, Mycobacterium avium subsp. paratuberculosis
caccaccgcccac

SEQ ID NO: 807746 - RNA, 14 nt, Mycobacterium avium subsp. paratuberculosis
caccaccgcccaca

SEQ ID NO: 807747 - RNA, 23 nt, Mycobacterium avium subsp. paratuberculosis
caccaccgcccacagcaacgaca

SEQ ID NO: 807748 - RNA, 14 nt, Mycobacterium avium subsp. paratuberculosis
caccaccgccgccg

SEQ ID NO: 807749 - RNA, 17 nt, Mycobacterium avium subsp. paratuberculosis
caccaccgccgccgacu

SEQ ID NO: 807750 - RNA, 13 nt, Mycobacterium avium subsp. paratuberculosis
caccaccgccggc

SEQ ID NO: 807751 - RNA, 16 nt, Mycobacterium avium subsp. paratuberculosis
caccaccgccucgacg

SEQ ID NO: 807752 - RNA, 22 nt, Mycobacterium avium subsp. paratuberculosis
caccaccgccucgacggugacc

SEQ ID NO: 807753 - RNA, 17 nt, Mycobacterium avium subsp. paratuberculosis
caccaccgcgccgucgu

SEQ ID NO: 807754 - RNA, 14 nt, Mycobacterium avium subsp. paratuberculosis
caccacgcuggccc

SEQ ID NO: 807755 - RNA, 19 nt, Mycobacterium avium subsp. paratuberculosis
caccacgguguagcggcgg

SEQ ID NO: 807756 - RNA, 20 nt, Mycobacterium avium subsp. paratuberculosis
caccacgguguagcggcggc

SEQ ID NO: 807757 - RNA, 22 nt, Mycobacterium avium subsp. paratuberculosis
caccacgguguagcggcggcug

SEQ ID NO: 807758 - RNA, 15 nt, Mycobacterium avium subsp. paratuberculosis
caccacgccgacgug

SEQ ID NO: 807759 - RNA, 19 nt, Mycobacterium avium subsp. paratuberculosis
caccacgccgagcaccugg

SEQ ID NO: 807760 - RNA, 22 nt, Mycobacterium avium subsp. paratuberculosis
caccacgccgagcaccuggccg

SEQ ID NO: 807761 - RNA, 21 nt, Mycobacterium avium subsp. paratuberculosis
caccacgauccaaccgagucg

SEQ ID NO: 807762 - RNA, 17 nt, Mycobacterium avium subsp. paratuberculosis
caccaccgcggcgauga

SEQ ID NO: 807763 - RNA, 14 nt, Mycobacterium avium subsp. paratuberculosis
caccaccgcggcgc

SEQ ID NO: 807764 - RNA, 16 nt, Mycobacterium avium subsp. paratuberculosis
caccaccgcggugggc

SEQ ID NO: 807765 - RNA, 23 nt, Mycobacterium avium subsp. paratuberculosis
caccaccgcguugaucagcgcca

SEQ ID NO: 807766 - RNA, 17 nt, Mycobacterium avium subsp. paratuberculosis
caccacgaaccaggcgc

SEQ ID NO: 807767 - RNA, 19 nt, Mycobacterium avium subsp. paratuberculosis
caccacgaaccaggcgccg

SEQ ID NO: 807768 - RNA, 21 nt, Mycobacterium avium subsp. paratuberculosis
caccacgaaccaggcgccggc

SEQ ID NO: 807769 - RNA, 18 nt, Mycobacterium avium subsp. paratuberculosis
caccacgaacgcgccgcc

SEQ ID NO: 807770 - RNA, 23 nt, Mycobacterium avium subsp. paratuberculosis
caccacgaacgcgccgccgagca

SEQ ID NO: 807771 - RNA, 17 nt, Mycobacterium avium subsp. paratuberculosis
caccacgaacgcugcca

SEQ ID NO: 807772 - RNA, 11 nt, Mycobacterium avium subsp. paratuberculosis
caccaccgcgg

SEQ ID NO: 807773 - RNA, 13 nt, Mycobacterium avium subsp. paratuberculosis
caccaccgcggcg

SEQ ID NO: 807774 - RNA, 15 nt, Mycobacterium avium subsp. paratuberculosis
caccacgaagcgggc

SEQ ID NO: 807775 - RNA, 18 nt, Mycobacterium avium subsp. paratuberculosis
caccacgaagcgggcggc

SEQ ID NO: 807776 - RNA, 21 nt, Mycobacterium avium subsp. paratuberculosis
caccacgaccagugcccggcc

SEQ ID NO: 807777 - RNA, 13 nt, Mycobacterium avium subsp. paratuberculosis
caccacgacgccg

SEQ ID NO: 807778 - RNA, 17 nt, Mycobacterium avium subsp. paratuberculosis
caccacgacgccgggcg

SEQ ID NO: 807779 - RNA, 18 nt, Mycobacterium avium subsp. paratuberculosis
caccacgacgccgggcgc

SEQ ID NO: 807780 - RNA, 16 nt, Mycobacterium avium subsp. paratuberculosis
caccacgagcagccga

SEQ ID NO: 807781 - RNA, 18 nt, Mycobacterium avium subsp. paratuberculosis
caccacgaggaccagcau

SEQ ID NO: 807782 - RNA, 17 nt, Mycobacterium avium subsp. paratuberculosis
cacauagcccaucagca

SEQ ID NO: 807783 - RNA, 17 nt, Mycobacterium avium subsp. paratuberculosis
cacauacgcggcggccu

SEQ ID NO: 807784 - RNA, 19 nt, Mycobacterium avium subsp. paratuberculosis
cacauacgcggcggccugc

SEQ ID NO: 807785 - RNA, 16 nt, Mycobacterium avium subsp. paratuberculosis
cacaucagcucggcgg

SEQ ID NO: 807786 - RNA, 22 nt, Mycobacterium avium subsp. paratuberculosis
cacaucagcucggcggccucgc

SEQ ID NO: 807787 - RNA, 19 nt, Mycobacterium avium subsp. paratuberculosis
cacaucaggaucgacgucg

SEQ ID NO: 807788 - RNA, 17 nt, Mycobacterium avium subsp. paratuberculosis
cacaucacgguggccgc

SEQ ID NO: 807789 - RNA, 20 nt, Mycobacterium avium subsp. paratuberculosis
cacauccgguugcaccgcga

SEQ ID NO: 807790 - RNA, 15 nt, Mycobacterium avium subsp. paratuberculosis
cacauccgucacgcc

SEQ ID NO: 807791 - RNA, 22 nt, Mycobacterium avium subsp. paratuberculosis
cacaucccgcaauugcgccagc

SEQ ID NO: 807792 - RNA, 19 nt, Mycobacterium avium subsp. paratuberculosis
cacaucggacaucggcagc

SEQ ID NO: 807793 - RNA, 20 nt, Mycobacterium avium subsp. paratuberculosis
cacaucggagagcuugccgc

SEQ ID NO: 807794 - RNA, 21 nt, Mycobacterium avium subsp. paratuberculosis
cacaucggauucgucggucac

SEQ ID NO: 807795 - RNA, 22 nt, Mycobacterium avium subsp. paratuberculosis
cacaucggauucgucggucacc

SEQ ID NO: 807796 - RNA, 16 nt, Mycobacterium avium subsp. paratuberculosis
cacaucugccggcaga

SEQ ID NO: 807797 - RNA, 13 nt, Mycobacterium avium subsp. paratuberculosis
cacaucguggcga

SEQ ID NO: 807798 - RNA, 15 nt, Mycobacterium avium subsp. paratuberculosis
cacaucguggcgacg

SEQ ID NO: 807799 - RNA, 19 nt, Mycobacterium avium subsp. paratuberculosis
cacaucguggcgacgacgc

SEQ ID NO: 807800 - RNA, 22 nt, Mycobacterium avium subsp. paratuberculosis
cacaucguggcgacgacgccga

SEQ ID NO: 807801 - RNA, 21 nt, Mycobacterium avium subsp. paratuberculosis
cacaucgggauuggcggccaa

SEQ ID NO: 807802 - RNA, 20 nt, Mycobacterium avium subsp. paratuberculosis
cacaucggucucgacaccgg

SEQ ID NO: 807803 - RNA, 18 nt, Mycobacterium avium subsp. paratuberculosis
cacaucgguugcuccggc

SEQ ID NO: 807804 - RNA, 22 nt, Mycobacterium avium subsp. paratuberculosis
cacaucgguugcuccggcgucg

SEQ ID NO: 807805 - RNA, 23 nt, Mycobacterium avium subsp. paratuberculosis
cacaucgguugcuccggcgucga

SEQ ID NO: 807806 - RNA, 13 nt, Mycobacterium avium subsp. paratuberculosis
cacagggcggcga

SEQ ID NO: 807807 - RNA, 21 nt, Mycobacterium avium subsp. paratuberculosis
cacagggcggcgacacgccga

SEQ ID NO: 807808 - RNA, 23 nt, Mycobacterium avium subsp. paratuberculosis
cacagggcggcgacacgccgacg

SEQ ID NO: 807809 - RNA, 13 nt, Mycobacterium avium subsp. paratuberculosis
cacaggggcgcgu

SEQ ID NO: 807810 - RNA, 14 nt, Mycobacterium avium subsp. paratuberculosis
cacaggucgcccgg

SEQ ID NO: 807811 - RNA, 15 nt, Mycobacterium avium subsp. paratuberculosis
cacaggugacgacgc

SEQ ID NO: 807812 - RNA, 16 nt, Mycobacterium avium subsp. paratuberculosis
cacaggugacgacgcu

SEQ ID NO: 807813 - RNA, 20 nt, Mycobacterium avium subsp. paratuberculosis
cacagguccagcguccgggc

SEQ ID NO: 807814 - RNA, 20 nt, Mycobacterium avium subsp. paratuberculosis
cacaguaggcggcugucgac

SEQ ID NO: 807815 - RNA, 15 nt, Mycobacterium avium subsp. paratuberculosis
cacagucgcugggug

SEQ ID NO: 807816 - RNA, 21 nt, Mycobacterium avium subsp. paratuberculosis
cacagugcgucgcccaucacc

SEQ ID NO: 807817 - RNA, 14 nt, Mycobacterium avium subsp. paratuberculosis
cacaguggccgcca

SEQ ID NO: 807818 - RNA, 17 nt, Mycobacterium avium subsp. paratuberculosis
cacagcuuucgggcggc

SEQ ID NO: 807819 - RNA, 15 nt, Mycobacterium avium subsp. paratuberculosis
cacagcugccggccg

SEQ ID NO: 807820 - RNA, 16 nt, Mycobacterium avium subsp. paratuberculosis
cacagcuugccggagc

SEQ ID NO: 807821 - RNA, 16 nt, Mycobacterium avium subsp. paratuberculosis
cacaggaacgcgacgg

SEQ ID NO: 807822 - RNA, 19 nt, Mycobacterium avium subsp. paratuberculosis
cacaggaacgcgacggugg

SEQ ID NO: 807823 - RNA, 18 nt, Mycobacterium avium subsp. paratuberculosis
cacaggaacgcgucgacc

SEQ ID NO: 807824 - RNA, 21 nt, Mycobacterium avium subsp. paratuberculosis
cacaggaacgcgucgaccgcc

SEQ ID NO: 807825 - RNA, 22 nt, Mycobacterium avium subsp. paratuberculosis
cacaggaacgcgucgaccgccg

SEQ ID NO: 807826 - RNA, 20 nt, Mycobacterium avium subsp. paratuberculosis
cacaggcgaaucggcgcaca

SEQ ID NO: 807827 - RNA, 19 nt, Mycobacterium avium subsp. paratuberculosis
cacaggccgaacagcagcg

SEQ ID NO: 807828 - RNA, 12 nt, Mycobacterium avium subsp. paratuberculosis
cacaggccgccg

SEQ ID NO: 807829 - RNA, 12 nt, Mycobacterium avium subsp. paratuberculosis
cacaggccgccu

SEQ ID NO: 807830 - RNA, 21 nt, Mycobacterium avium subsp. paratuberculosis
cacagcuaggucguggcgccg

SEQ ID NO: 807831 - RNA, 14 nt, Mycobacterium avium subsp. paratuberculosis
cacagcucaccugc

SEQ ID NO: 807832 - RNA, 21 nt, Mycobacterium avium subsp. paratuberculosis
cacagcgucucgaccgcggug

SEQ ID NO: 807833 - RNA, 16 nt, Mycobacterium avium subsp. paratuberculosis
cacagcgugacccugc

SEQ ID NO: 807834 - RNA, 19 nt, Mycobacterium avium subsp. paratuberculosis
cacagcggcggaugggugc

SEQ ID NO: 807835 - RNA, 12 nt, Mycobacterium avium subsp. paratuberculosis
cacagcgggguc

SEQ ID NO: 807836 - RNA, 19 nt, Mycobacterium avium subsp. paratuberculosis
cacagcgguaucccguugg

SEQ ID NO: 807837 - RNA, 16 nt, Mycobacterium avium subsp. paratuberculosis
cacagcuucggcgccg

SEQ ID NO: 807838 - RNA, 17 nt, Mycobacterium avium subsp. paratuberculosis
cacagcuucggcgccga

SEQ ID NO: 807839 - RNA, 22 nt, Mycobacterium avium subsp. paratuberculosis
cacagcguuauccaccagguug

SEQ ID NO: 807840 - RNA, 14 nt, Mycobacterium avium subsp. paratuberculosis
cacagcucgggcag

SEQ ID NO: 807841 - RNA, 17 nt, Mycobacterium avium subsp. paratuberculosis
cacagcucgggcagcgu

SEQ ID NO: 807842 - RNA, 24 nt, Mycobacterium avium subsp. paratuberculosis
cacagcucgggcagcgugucccgg

SEQ ID NO: 807843 - RNA, 14 nt, Mycobacterium avium subsp. paratuberculosis
cacagcugacgggc

SEQ ID NO: 807844 - RNA, 21 nt, Mycobacterium avium subsp. paratuberculosis
cacagcugacgggccggcggg

SEQ ID NO: 807845 - RNA, 23 nt, Mycobacterium avium subsp. paratuberculosis
cacagcugacgggccggcggggu

SEQ ID NO: 807846 - RNA, 23 nt, Mycobacterium avium subsp. paratuberculosis
caccaggcgccacagcagcacca

SEQ ID NO: 807847 - RNA, 14 nt, Mycobacterium avium subsp. paratuberculosis
caccaggcgcgggc

SEQ ID NO: 807848 - RNA, 17 nt, Mycobacterium avium subsp. paratuberculosis
caccaggcugaccagcg

SEQ ID NO: 807849 - RNA, 17 nt, Mycobacterium avium subsp. paratuberculosis
caccaggcgcaccagcu

SEQ ID NO: 807850 - RNA, 18 nt, Mycobacterium avium subsp. paratuberculosis
caccaggcgcaccagcug

SEQ ID NO: 807851 - RNA, 17 nt, Mycobacterium avium subsp. paratuberculosis
caccaggcgccgucgau

SEQ ID NO: 807852 - RNA, 22 nt, Mycobacterium avium subsp. paratuberculosis
caccaggcgccgucgauggcgc

SEQ ID NO: 807853 - RNA, 19 nt, Mycobacterium avium subsp. paratuberculosis
caccacguacuccugcgcg

SEQ ID NO: 807854 - RNA, 13 nt, Mycobacterium avium subsp. paratuberculosis
caccacguccgcg

SEQ ID NO: 807855 - RNA, 16 nt, Mycobacterium avium subsp. paratuberculosis
caccacgucggguucg

SEQ ID NO: 807856 - RNA, 21 nt, Mycobacterium avium subsp. paratuberculosis
caccacgucggguucgccggu

SEQ ID NO: 807857 - RNA, 13 nt, Mycobacterium avium subsp. paratuberculosis
caccacgucggug

SEQ ID NO: 807858 - RNA, 15 nt, Mycobacterium avium subsp. paratuberculosis
caccacgucggugcc

SEQ ID NO: 807859 - RNA, 17 nt, Mycobacterium avium subsp. paratuberculosis
caccacgucggugccgc

SEQ ID NO: 807860 - RNA, 20 nt, Mycobacterium avium subsp. paratuberculosis
caccacgucggugccgcguu

SEQ ID NO: 807861 - RNA, 17 nt, Mycobacterium avium subsp. paratuberculosis
caccacgucgucggccu

SEQ ID NO: 807862 - RNA, 16 nt, Mycobacterium avium subsp. paratuberculosis
caccacgugccacugg

SEQ ID NO: 807863 - RNA, 15 nt, Mycobacterium avium subsp. paratuberculosis
caccacgugcgcguu

SEQ ID NO: 807864 - RNA, 17 nt, Mycobacterium avium subsp. paratuberculosis
caccacguugcacggca

SEQ ID NO: 807865 - RNA, 19 nt, Mycobacterium avium subsp. paratuberculosis
caccacguugcgcccggcc

SEQ ID NO: 807866 - RNA, 21 nt, Mycobacterium avium subsp. paratuberculosis
caccacguugcgcggccgcau

SEQ ID NO: 807867 - RNA, 16 nt, Mycobacterium avium subsp. paratuberculosis
caccacugcgccguca

SEQ ID NO: 807868 - RNA, 17 nt, Mycobacterium avium subsp. paratuberculosis
caccacugcgccgucau

SEQ ID NO: 807869 - RNA, 19 nt, Mycobacterium avium subsp. paratuberculosis
caccagucgcgcagcguca

SEQ ID NO: 807870 - RNA, 22 nt, Mycobacterium avium subsp. paratuberculosis
caccagucggccaucagcaccg

SEQ ID NO: 807871 - RNA, 14 nt, Mycobacterium avium subsp. paratuberculosis
caccagucggcgcg

SEQ ID NO: 807872 - RNA, 17 nt, Mycobacterium avium subsp. paratuberculosis
caccagguugcggauca

SEQ ID NO: 807873 - RNA, 19 nt, Mycobacterium avium subsp. paratuberculosis
caccagguugucgccgcgc

SEQ ID NO: 807874 - RNA, 18 nt, Mycobacterium avium subsp. paratuberculosis
caccagguucacgucggg

SEQ ID NO: 807875 - RNA, 16 nt, Mycobacterium avium subsp. paratuberculosis
caccagguucgcgcag

SEQ ID NO: 807876 - RNA, 20 nt, Mycobacterium avium subsp. paratuberculosis
caccagggacaugccgagca

SEQ ID NO: 807877 - RNA, 15 nt, Mycobacterium avium subsp. paratuberculosis
caccagggccgcgag

SEQ ID NO: 807878 - RNA, 17 nt, Mycobacterium avium subsp. paratuberculosis
caccaggcugcucggcg

SEQ ID NO: 807879 - RNA, 20 nt, Mycobacterium avium subsp. paratuberculosis
caccaggcugcucggcgggc

SEQ ID NO: 807880 - RNA, 22 nt, Mycobacterium avium subsp. paratuberculosis
caccaggcugcucggcgggcuc

SEQ ID NO: 807881 - RNA, 20 nt, Mycobacterium avium subsp. paratuberculosis
caccagggccugcagcacca

SEQ ID NO: 807882 - RNA, 14 nt, Mycobacterium avium subsp. paratuberculosis
caccaggucguugc

SEQ ID NO: 807883 - RNA, 19 nt, Mycobacterium avium subsp. paratuberculosis
caccaggucuccgucggcg

SEQ ID NO: 807884 - RNA, 16 nt, Mycobacterium avium subsp. paratuberculosis
caccaggugaccggcc

SEQ ID NO: 807885 - RNA, 17 nt, Mycobacterium avium subsp. paratuberculosis
caccaggugaccggccu

SEQ ID NO: 807886 - RNA, 18 nt, Mycobacterium avium subsp. paratuberculosis
caccaggugaccggccug

SEQ ID NO: 807887 - RNA, 15 nt, Mycobacterium avium subsp. paratuberculosis
caccagguggcccga

SEQ ID NO: 807888 - RNA, 16 nt, Mycobacterium avium subsp. paratuberculosis
caccaguucgcguacc

SEQ ID NO: 807889 - RNA, 22 nt, Mycobacterium avium subsp. paratuberculosis
caccaguucgcguacccgcgcg

SEQ ID NO: 807890 - RNA, 17 nt, Mycobacterium avium subsp. paratuberculosis
caccaguugcaccggca

SEQ ID NO: 807891 - RNA, 19 nt, Mycobacterium avium subsp. paratuberculosis
caccaguugcaccggcacc

SEQ ID NO: 807892 - RNA, 19 nt, Mycobacterium avium subsp. paratuberculosis
caccaguuccaccaguguc

SEQ ID NO: 807893 - RNA, 23 nt, Mycobacterium avium subsp. paratuberculosis
caccaguuccugcaugccgggca

SEQ ID NO: 807894 - RNA, 20 nt, Mycobacterium avium subsp. paratuberculosis
caccaguguccgggcgccca

SEQ ID NO: 807895 - RNA, 23 nt, Mycobacterium avium subsp. paratuberculosis
caccaguguccgggcgcccagaa

SEQ ID NO: 807896 - RNA, 14 nt, Mycobacterium avium subsp. paratuberculosis
caccaucccgccgc

SEQ ID NO: 807897 - RNA, 15 nt, Mycobacterium avium subsp. paratuberculosis
caccaucccgccgcc

SEQ ID NO: 807898 - RNA, 17 nt, Mycobacterium avium subsp. paratuberculosis
caccaucccgccgccga

SEQ ID NO: 807899 - RNA, 18 nt, Mycobacterium avium subsp. paratuberculosis
caccaucccgccgccgaa

SEQ ID NO: 807900 - RNA, 14 nt, Mycobacterium avium subsp. paratuberculosis
caccaucagcaccg

SEQ ID NO: 807901 - RNA, 16 nt, Mycobacterium avium subsp. paratuberculosis
caccaucacgucgcgc

SEQ ID NO: 807902 - RNA, 14 nt, Mycobacterium avium subsp. paratuberculosis
caccauccgcgacg

SEQ ID NO: 807903 - RNA, 15 nt, Mycobacterium avium subsp. paratuberculosis
caccauccgcgacgc

SEQ ID NO: 807904 - RNA, 12 nt, Mycobacterium avium subsp. paratuberculosis
caccauccgcgc

SEQ ID NO: 807905 - RNA, 13 nt, Mycobacterium avium subsp. paratuberculosis
caccaucggggug

SEQ ID NO: 807906 - RNA, 20 nt, Mycobacterium avium subsp. paratuberculosis
caccaucgcuuuccggucag

SEQ ID NO: 807907 - RNA, 23 nt, Mycobacterium avium subsp. paratuberculosis
caccaugaucaggccccacccgc

SEQ ID NO: 807908 - RNA, 19 nt, Mycobacterium avium subsp. paratuberculosis
caccaugauguagcggcgg

SEQ ID NO: 807909 - RNA, 14 nt, Mycobacterium avium subsp. paratuberculosis
caccaugucggcgu

SEQ ID NO: 807910 - RNA, 15 nt, Mycobacterium avium subsp. paratuberculosis
caccaugucggcguc

SEQ ID NO: 807911 - RNA, 16 nt, Mycobacterium avium subsp. paratuberculosis
caccaugucggcgucg

SEQ ID NO: 807912 - RNA, 23 nt, Mycobacterium avium subsp. paratuberculosis
caccaugucggcgucgccgagcc

SEQ ID NO: 807913 - RNA, 15 nt, Mycobacterium avium subsp. paratuberculosis
cacccggccacgccg

SEQ ID NO: 807914 - RNA, 16 nt, Mycobacterium avium subsp. paratuberculosis
cacccggccacgccgg

SEQ ID NO: 807915 - RNA, 17 nt, Mycobacterium avium subsp. paratuberculosis
cacccggccacgccggg

SEQ ID NO: 807916 - RNA, 14 nt, Mycobacterium avium subsp. paratuberculosis
cacccggcccacca

SEQ ID NO: 807917 - RNA, 21 nt, Mycobacterium avium subsp. paratuberculosis
cacccggcccaccaccgccuc

SEQ ID NO: 807918 - RNA, 14 nt, Mycobacterium avium subsp. paratuberculosis
cacccggcccaccg

SEQ ID NO: 807919 - RNA, 19 nt, Mycobacterium avium subsp. paratuberculosis
cacccggcccaccggcccg

SEQ ID NO: 807920 - RNA, 19 nt, Mycobacterium avium subsp. paratuberculosis
cacccggcccacgccgucg

SEQ ID NO: 807921 - RNA, 13 nt, Mycobacterium avium subsp. paratuberculosis
cacccgcagcucc

SEQ ID NO: 807922 - RNA, 16 nt, Mycobacterium avium subsp. paratuberculosis
cacccgcagcucgccg

SEQ ID NO: 807923 - RNA, 15 nt, Mycobacterium avium subsp. paratuberculosis
cacccgcagggcgcc

SEQ ID NO: 807924 - RNA, 23 nt, Mycobacterium avium subsp. paratuberculosis
cacccggauggucugcagcgacg

SEQ ID NO: 807925 - RNA, 22 nt, Mycobacterium avium subsp. paratuberculosis
cacccggaugucgugcggucgc

SEQ ID NO: 807926 - RNA, 22 nt, Mycobacterium avium subsp. paratuberculosis
cacccggacgugaucgcggugg

SEQ ID NO: 807927 - RNA, 13 nt, Mycobacterium avium subsp. paratuberculosis
cacccggccggcg

SEQ ID NO: 807928 - RNA, 15 nt, Mycobacterium avium subsp. paratuberculosis
cacccggccggcgaa

SEQ ID NO: 807929 - RNA, 16 nt, Mycobacterium avium subsp. paratuberculosis
cacccggcgcggccgc

SEQ ID NO: 807930 - RNA, 18 nt, Mycobacterium avium subsp. paratuberculosis
cacccggcgcggccgccc

SEQ ID NO: 807931 - RNA, 14 nt, Mycobacterium avium subsp. paratuberculosis
cacccggcggcacc

SEQ ID NO: 807932 - RNA, 20 nt, Mycobacterium avium subsp. paratuberculosis
cacccggcggcaccgcggcu

SEQ ID NO: 807933 - RNA, 22 nt, Mycobacterium avium subsp. paratuberculosis
cacccggcgauuaggucggugg

SEQ ID NO: 807934 - RNA, 12 nt, Mycobacterium avium subsp. paratuberculosis
cacccggcgggg

SEQ ID NO: 807935 - RNA, 22 nt, Mycobacterium avium subsp. paratuberculosis
cacccggcuucgcugcgccggc

SEQ ID NO: 807936 - RNA, 20 nt, Mycobacterium avium subsp. paratuberculosis
cacccgaugaccggcccggc

SEQ ID NO: 807937 - RNA, 22 nt, Mycobacterium avium subsp. paratuberculosis
cacccgaugaccggcccggcgg

SEQ ID NO: 807938 - RNA, 17 nt, Mycobacterium avium subsp. paratuberculosis
cacccgcaacaccacgu

SEQ ID NO: 807939 - RNA, 12 nt, Mycobacterium avium subsp. paratuberculosis
cacccgcaacgc

SEQ ID NO: 807940 - RNA, 18 nt, Mycobacterium avium subsp. paratuberculosis
cacccgcaacgcgcgcga

SEQ ID NO: 807941 - RNA, 20 nt, Mycobacterium avium subsp. paratuberculosis
cacccgcaacgcgcgcgacg

SEQ ID NO: 807942 - RNA, 18 nt, Mycobacterium avium subsp. paratuberculosis
cacccgcaacgcugaccg

SEQ ID NO: 807943 - RNA, 21 nt, Mycobacterium avium subsp. paratuberculosis
cacccgcaacgcugaccgcag

SEQ ID NO: 807944 - RNA, 22 nt, Mycobacterium avium subsp. paratuberculosis
cacccgaggccguucagguaau

SEQ ID NO: 807945 - RNA, 17 nt, Mycobacterium avium subsp. paratuberculosis
cacccgauccacggcga

SEQ ID NO: 807946 - RNA, 18 nt, Mycobacterium avium subsp. paratuberculosis
cacccgauccacggcgac

SEQ ID NO: 807947 - RNA, 15 nt, Mycobacterium avium subsp. paratuberculosis
cacccgacgaagccg

SEQ ID NO: 807948 - RNA, 22 nt, Mycobacterium avium subsp. paratuberculosis
cacccgacgucgacgcgggcga

SEQ ID NO: 807949 - RNA, 23 nt, Mycobacterium avium subsp. paratuberculosis
cacccgacuucggcucggcgaca

SEQ ID NO: 807950 - RNA, 24 nt, Mycobacterium avium subsp. paratuberculosis
cacccgacuucggcucggcgacaa

SEQ ID NO: 807951 - RNA, 19 nt, Mycobacterium avium subsp. paratuberculosis
cacccgcacgcugucgggg

SEQ ID NO: 807952 - RNA, 16 nt, Mycobacterium avium subsp. paratuberculosis
cacccgcaccucgcug

SEQ ID NO: 807953 - RNA, 23 nt, Mycobacterium avium subsp. paratuberculosis
cacccgcaccucgcuggcggcgc

SEQ ID NO: 807954 - RNA, 14 nt, Mycobacterium avium subsp. paratuberculosis
cacccgcacgcccg

SEQ ID NO: 807955 - RNA, 15 nt, Mycobacterium avium subsp. paratuberculosis
cacccgcacgcccgg

SEQ ID NO: 807956 - RNA, 21 nt, Mycobacterium avium subsp. paratuberculosis
cacccgcacgcccgggcaugc

SEQ ID NO: 807957 - RNA, 15 nt, Mycobacterium avium subsp. paratuberculosis
cacccgcaccgugua

SEQ ID NO: 807958 - RNA, 23 nt, Mycobacterium avium subsp. paratuberculosis
cacccgcaccguguagccgaccg

SEQ ID NO: 807959 - RNA, 15 nt, Mycobacterium avium subsp. paratuberculosis
cacccgcacggucgc

SEQ ID NO: 807960 - RNA, 16 nt, Mycobacterium avium subsp. paratuberculosis
cacccgcacggucgcg

SEQ ID NO: 807961 - RNA, 17 nt, Mycobacterium avium subsp. paratuberculosis
cacccgcacggucgcgg

SEQ ID NO: 807962 - RNA, 23 nt, Mycobacterium avium subsp. paratuberculosis
cacccgcacggucgcggugucgg

SEQ ID NO: 807963 - RNA, 19 nt, Mycobacterium avium subsp. paratuberculosis
cacccgcacgugcgcgccg

SEQ ID NO: 807964 - RNA, 13 nt, Mycobacterium avium subsp. paratuberculosis
cacccgcagcccg

SEQ ID NO: 807965 - RNA, 14 nt, Mycobacterium avium subsp. paratuberculosis
cacccgcagcccga

SEQ ID NO: 807966 - RNA, 19 nt, Mycobacterium avium subsp. paratuberculosis
cacccgcagccgcgagucg

SEQ ID NO: 807967 - RNA, 16 nt, Mycobacterium avium subsp. paratuberculosis
cacccgcagcgcggcg

SEQ ID NO: 807968 - RNA, 17 nt, Mycobacterium avium subsp. paratuberculosis
cacccgcagcgcggcgg

SEQ ID NO: 807969 - RNA, 20 nt, Mycobacterium avium subsp. paratuberculosis
cacccaaaaaggcgcgggug

SEQ ID NO: 807970 - RNA, 20 nt, Mycobacterium avium subsp. paratuberculosis
cacccaaaacaucggcgugu

SEQ ID NO: 807971 - RNA, 22 nt, Mycobacterium avium subsp. paratuberculosis
caccauguuccagaaccggcag

SEQ ID NO: 807972 - RNA, 23 nt, Mycobacterium avium subsp. paratuberculosis
cacccaugauggugggcaccgcg

SEQ ID NO: 807973 - RNA, 13 nt, Mycobacterium avium subsp. paratuberculosis
caccccacccgcg

SEQ ID NO: 807974 - RNA, 16 nt, Mycobacterium avium subsp. paratuberculosis
caccccacccgcgcga

SEQ ID NO: 807975 - RNA, 13 nt, Mycobacterium avium subsp. paratuberculosis
caccccaccgaca

SEQ ID NO: 807976 - RNA, 20 nt, Mycobacterium avium subsp. paratuberculosis
caccccaccgagcagcugca

SEQ ID NO: 807977 - RNA, 13 nt, Mycobacterium avium subsp. paratuberculosis
caccccagcgcga

SEQ ID NO: 807978 - RNA, 15 nt, Mycobacterium avium subsp. paratuberculosis
caccccagcgcgacc

SEQ ID NO: 807979 - RNA, 15 nt, Mycobacterium avium subsp. paratuberculosis
caccccacaccgucc

SEQ ID NO: 807980 - RNA, 16 nt, Mycobacterium avium subsp. paratuberculosis
caccccguaggugcac

SEQ ID NO: 807981 - RNA, 18 nt, Mycobacterium avium subsp. paratuberculosis
caccccgucgagcagccg

SEQ ID NO: 807982 - RNA, 18 nt, Mycobacterium avium subsp. paratuberculosis
cacccgaauuccgcuggg

SEQ ID NO: 807983 - RNA, 14 nt, Mycobacterium avium subsp. paratuberculosis
cacccgacacgccg

SEQ ID NO: 807984 - RNA, 18 nt, Mycobacterium avium subsp. paratuberculosis
cacccgacacgccgaucg

SEQ ID NO: 807985 - RNA, 16 nt, Mycobacterium avium subsp. paratuberculosis
caccccgggaacgacg

SEQ ID NO: 807986 - RNA, 22 nt, Mycobacterium avium subsp. paratuberculosis
caccccgcgggaguccacgccg

SEQ ID NO: 807987 - RNA, 17 nt, Mycobacterium avium subsp. paratuberculosis
caccccgcggucggcgg

SEQ ID NO: 807988 - RNA, 15 nt, Mycobacterium avium subsp. paratuberculosis
caccccggagauccg

SEQ ID NO: 807989 - RNA, 13 nt, Mycobacterium avium subsp. paratuberculosis
caccccaggcgau

SEQ ID NO: 807990 - RNA, 20 nt, Mycobacterium avium subsp. paratuberculosis
caccccaggcgaugccgccg

SEQ ID NO: 807991 - RNA, 16 nt, Mycobacterium avium subsp. paratuberculosis
caccccgcccagcgca

SEQ ID NO: 807992 - RNA, 13 nt, Mycobacterium avium subsp. paratuberculosis
caccccggcgacg

SEQ ID NO: 807993 - RNA, 16 nt, Mycobacterium avium subsp. paratuberculosis
caccccggcgacggcg

SEQ ID NO: 807994 - RNA, 17 nt, Mycobacterium avium subsp. paratuberculosis
caccccggcgacggcgg

SEQ ID NO: 807995 - RNA, 14 nt, Mycobacterium avium subsp. paratuberculosis
caccccggcgauga

SEQ ID NO: 807996 - RNA, 20 nt, Mycobacterium avium subsp. paratuberculosis
caccccggcgaugaccggga

SEQ ID NO: 807997 - RNA, 13 nt, Mycobacterium avium subsp. paratuberculosis
caccccggcgcgg

SEQ ID NO: 807998 - RNA, 13 nt, Mycobacterium avium subsp. paratuberculosis
caccccggcggcc

SEQ ID NO: 807999 - RNA, 14 nt, Mycobacterium avium subsp. paratuberculosis
caccccggcggccg

SEQ ID NO: 808000 - RNA, 15 nt, Mycobacterium avium subsp. paratuberculosis
caccccggcggccgc

SEQ ID NO: 808001 - RNA, 19 nt, Mycobacterium avium subsp. paratuberculosis
caccccggcggccgcgucg

SEQ ID NO: 808002 - RNA, 23 nt, Mycobacterium avium subsp. paratuberculosis
caccccggcggccgcgucggcgg

SEQ ID NO: 808003 - RNA, 13 nt, Mycobacterium avium subsp. paratuberculosis
caccccggcgucc

SEQ ID NO: 808004 - RNA, 14 nt, Mycobacterium avium subsp. paratuberculosis
caccccggcgucca

SEQ ID NO: 808005 - RNA, 17 nt, Mycobacterium avium subsp. paratuberculosis
caccccgcgagucaccg

SEQ ID NO: 808006 - RNA, 23 nt, Mycobacterium avium subsp. paratuberculosis
caccccgcgagucaccggcucgc

SEQ ID NO: 808007 - RNA, 14 nt, Mycobacterium avium subsp. paratuberculosis
caccccggccacca

SEQ ID NO: 808008 - RNA, 20 nt, Mycobacterium avium subsp. paratuberculosis
caccccggccagggugccga

SEQ ID NO: 808009 - RNA, 16 nt, Mycobacterium avium subsp. paratuberculosis
caccgcacggcccauc

SEQ ID NO: 808010 - RNA, 17 nt, Mycobacterium avium subsp. paratuberculosis
caccgcacggcccauca

SEQ ID NO: 808011 - RNA, 22 nt, Mycobacterium avium subsp. paratuberculosis
caccgcacggcccaucaccagc

SEQ ID NO: 808012 - RNA, 13 nt, Mycobacterium avium subsp. paratuberculosis
caccgcacccaga

SEQ ID NO: 808013 - RNA, 18 nt, Mycobacterium avium subsp. paratuberculosis
caccgauggguuggccgu

SEQ ID NO: 808014 - RNA, 20 nt, Mycobacterium avium subsp. paratuberculosis
caccgauggguuggccgucg

SEQ ID NO: 808015 - RNA, 15 nt, Mycobacterium avium subsp. paratuberculosis
caccgcaucgccgag

SEQ ID NO: 808016 - RNA, 16 nt, Mycobacterium avium subsp. paratuberculosis
caccgcaucgccgagg

SEQ ID NO: 808017 - RNA, 22 nt, Mycobacterium avium subsp. paratuberculosis
caccgcaucgccgagggcgacg

SEQ ID NO: 808018 - RNA, 23 nt, Mycobacterium avium subsp. paratuberculosis
caccgcaucgccgagggcgacga

SEQ ID NO: 808019 - RNA, 14 nt, Mycobacterium avium subsp. paratuberculosis
caccgccaccagcg

SEQ ID NO: 808020 - RNA, 18 nt, Mycobacterium avium subsp. paratuberculosis
caccgccaccagcgcaca

SEQ ID NO: 808021 - RNA, 20 nt, Mycobacterium avium subsp. paratuberculosis
caccgcauuugccgacaugc

SEQ ID NO: 808022 - RNA, 14 nt, Mycobacterium avium subsp. paratuberculosis
caccgccaccagca

SEQ ID NO: 808023 - RNA, 15 nt, Mycobacterium avium subsp. paratuberculosis
caccgccaccagcag

SEQ ID NO: 808024 - RNA, 22 nt, Mycobacterium avium subsp. paratuberculosis
caccgccaccagcaggcccaac

SEQ ID NO: 808025 - RNA, 14 nt, Mycobacterium avium subsp. paratuberculosis
caccgccagcagcg

SEQ ID NO: 808026 - RNA, 17 nt, Mycobacterium avium subsp. paratuberculosis
caccgccagcagcgccg

SEQ ID NO: 808027 - RNA, 15 nt, Mycobacterium avium subsp. paratuberculosis
caccgccagcgccgg

SEQ ID NO: 808028 - RNA, 17 nt, Mycobacterium avium subsp. paratuberculosis
caccgccagcgccggca

SEQ ID NO: 808029 - RNA, 13 nt, Mycobacterium avium subsp. paratuberculosis
caccgccagcgcg

SEQ ID NO: 808030 - RNA, 14 nt, Mycobacterium avium subsp. paratuberculosis
caccgccagcgcgc

SEQ ID NO: 808031 - RNA, 17 nt, Mycobacterium avium subsp. paratuberculosis
caccgccagcgcgccga

SEQ ID NO: 808032 - RNA, 20 nt, Mycobacterium avium subsp. paratuberculosis
caccgccagcgcgccgaucg

SEQ ID NO: 808033 - RNA, 20 nt, Mycobacterium avium subsp. paratuberculosis
caccgccagcgcggcggcgc

SEQ ID NO: 808034 - RNA, 13 nt, Mycobacterium avium subsp. paratuberculosis
caccgccagcacc

SEQ ID NO: 808035 - RNA, 17 nt, Mycobacterium avium subsp. paratuberculosis
caccgccagcaccgacg

SEQ ID NO: 808036 - RNA, 19 nt, Mycobacterium avium subsp. paratuberculosis
caccgccagcaccgacgcg

SEQ ID NO: 808037 - RNA, 20 nt, Mycobacterium avium subsp. paratuberculosis
caccgccagcaccgacgcgc

SEQ ID NO: 808038 - RNA, 13 nt, Mycobacterium avium subsp. paratuberculosis
caccgccacgucg

SEQ ID NO: 808039 - RNA, 14 nt, Mycobacterium avium subsp. paratuberculosis
caccgccacgucga

SEQ ID NO: 808040 - RNA, 11 nt, Mycobacterium avium subsp. paratuberculosis
caccgccaccg

SEQ ID NO: 808041 - RNA, 16 nt, Mycobacterium avium subsp. paratuberculosis
caccgccaccgcccgc

SEQ ID NO: 808042 - RNA, 14 nt, Mycobacterium avium subsp. paratuberculosis
caccgccaccggcc

SEQ ID NO: 808043 - RNA, 16 nt, Mycobacterium avium subsp. paratuberculosis
caccgccaccggcccg

SEQ ID NO: 808044 - RNA, 15 nt, Mycobacterium avium subsp. paratuberculosis
caccgagcggccguc

SEQ ID NO: 808045 - RNA, 17 nt, Mycobacterium avium subsp. paratuberculosis
caccgagcggccgucca

SEQ ID NO: 808046 - RNA, 23 nt, Mycobacterium avium subsp. paratuberculosis
caccgagcgggguguggcugucg

SEQ ID NO: 808047 - RNA, 13 nt, Mycobacterium avium subsp. paratuberculosis
caccgagcugggc

SEQ ID NO: 808048 - RNA, 19 nt, Mycobacterium avium subsp. paratuberculosis
caccgagcugggccggcgc

SEQ ID NO: 808049 - RNA, 20 nt, Mycobacterium avium subsp. paratuberculosis
caccgagcugggccggcgcc

SEQ ID NO: 808050 - RNA, 22 nt, Mycobacterium avium subsp. paratuberculosis
caccgagcugggccggcgccga

SEQ ID NO: 808051 - RNA, 18 nt, Mycobacterium avium subsp. paratuberculosis
caccgagcgagcgcacca

SEQ ID NO: 808052 - RNA, 18 nt, Mycobacterium avium subsp. paratuberculosis
caccgaggugacgaggcc

SEQ ID NO: 808053 - RNA, 18 nt, Mycobacterium avium subsp. paratuberculosis
caccgaggucaccgcgac

SEQ ID NO: 808054 - RNA, 21 nt, Mycobacterium avium subsp. paratuberculosis
caccgagaucaugccggcgaa

SEQ ID NO: 808055 - RNA, 17 nt, Mycobacterium avium subsp. paratuberculosis
caccgagaucucgucga

SEQ ID NO: 808056 - RNA, 16 nt, Mycobacterium avium subsp. paratuberculosis
caccgagccggcggcg

SEQ ID NO: 808057 - RNA, 17 nt, Mycobacterium avium subsp. paratuberculosis
caccgagccggcggcgu

SEQ ID NO: 808058 - RNA, 18 nt, Mycobacterium avium subsp. paratuberculosis
caccgagccggcggcguu

SEQ ID NO: 808059 - RNA, 15 nt, Mycobacterium avium subsp. paratuberculosis
caccgagccggcguc

SEQ ID NO: 808060 - RNA, 22 nt, Mycobacterium avium subsp. paratuberculosis
caccgagccggcgucgccgcug

SEQ ID NO: 808061 - RNA, 22 nt, Mycobacterium avium subsp. paratuberculosis
caccgagccgggcagcgcgaca

SEQ ID NO: 808062 - RNA, 15 nt, Mycobacterium avium subsp. paratuberculosis
caccgagccggggcu

SEQ ID NO: 808063 - RNA, 19 nt, Mycobacterium avium subsp. paratuberculosis
caccgagccggggcugggc

SEQ ID NO: 808064 - RNA, 17 nt, Mycobacterium avium subsp. paratuberculosis
caccgagccggugccgc

SEQ ID NO: 808065 - RNA, 15 nt, Mycobacterium avium subsp. paratuberculosis
cacccuucaucagca

SEQ ID NO: 808066 - RNA, 16 nt, Mycobacterium avium subsp. paratuberculosis
cacccuucaucagcac

SEQ ID NO: 808067 - RNA, 21 nt, Mycobacterium avium subsp. paratuberculosis
cacccuucaucagcaccgcga

SEQ ID NO: 808068 - RNA, 19 nt, Mycobacterium avium subsp. paratuberculosis
cacccugccgaccugcgcg

SEQ ID NO: 808069 - RNA, 18 nt, Mycobacterium avium subsp. paratuberculosis
cacccugcgcaccgcgga

SEQ ID NO: 808070 - RNA, 18 nt, Mycobacterium avium subsp. paratuberculosis
cacccucgcgcaggaaca

SEQ ID NO: 808071 - RNA, 14 nt, Mycobacterium avium subsp. paratuberculosis
cacccucggcgucc

SEQ ID NO: 808072 - RNA, 22 nt, Mycobacterium avium subsp. paratuberculosis
cacccucgggguagccggcccg

SEQ ID NO: 808073 - RNA, 15 nt, Mycobacterium avium subsp. paratuberculosis
cacccucggucgggc

SEQ ID NO: 808074 - RNA, 13 nt, Mycobacterium avium subsp. paratuberculosis
cacccgggccugc

SEQ ID NO: 808075 - RNA, 16 nt, Mycobacterium avium subsp. paratuberculosis
cacccgggccugcggc

SEQ ID NO: 808076 - RNA, 18 nt, Mycobacterium avium subsp. paratuberculosis
cacccgggccugcggcgg

SEQ ID NO: 808077 - RNA, 19 nt, Mycobacterium avium subsp. paratuberculosis
cacccgggccugcggcggc

SEQ ID NO: 808078 - RNA, 21 nt, Mycobacterium avium subsp. paratuberculosis
cacccgggccugcggcggccg

SEQ ID NO: 808079 - RNA, 22 nt, Mycobacterium avium subsp. paratuberculosis
cacccgggccuuguugcggcgc

SEQ ID NO: 808080 - RNA, 19 nt, Mycobacterium avium subsp. paratuberculosis
cacccgggcgacaugcccg

SEQ ID NO: 808081 - RNA, 20 nt, Mycobacterium avium subsp. paratuberculosis
cacccgggcgacaugcccgc

SEQ ID NO: 808082 - RNA, 19 nt, Mycobacterium avium subsp. paratuberculosis
cacccgggcgccggcgaug

SEQ ID NO: 808083 - RNA, 20 nt, Mycobacterium avium subsp. paratuberculosis
cacccgggcgccggcgauga

SEQ ID NO: 808084 - RNA, 12 nt, Mycobacterium avium subsp. paratuberculosis
cacccgggcgcg

SEQ ID NO: 808085 - RNA, 19 nt, Mycobacterium avium subsp. paratuberculosis
cacccgggcccggucgucg

SEQ ID NO: 808086 - RNA, 16 nt, Mycobacterium avium subsp. paratuberculosis
cacccgggucaggucg

SEQ ID NO: 808087 - RNA, 15 nt, Mycobacterium avium subsp. paratuberculosis
cacccgggugcccgg

SEQ ID NO: 808088 - RNA, 23 nt, Mycobacterium avium subsp. paratuberculosis
cacccgggugcccggcugggcgc

SEQ ID NO: 808089 - RNA, 17 nt, Mycobacterium avium subsp. paratuberculosis
cacccggguggacaccg

SEQ ID NO: 808090 - RNA, 18 nt, Mycobacterium avium subsp. paratuberculosis
cacccggguggacaccgc

SEQ ID NO: 808091 - RNA, 19 nt, Mycobacterium avium subsp. paratuberculosis
cacccggguggacaccgcg

SEQ ID NO: 808092 - RNA, 23 nt, Mycobacterium avium subsp. paratuberculosis
cacccggguggacaccgcgauca

SEQ ID NO: 808093 - RNA, 23 nt, Mycobacterium avium subsp. paratuberculosis
cacccggguguuggagccguccg

SEQ ID NO: 808094 - RNA, 23 nt, Mycobacterium avium subsp. paratuberculosis
cacccggguugcgugcagccgca

SEQ ID NO: 808095 - RNA, 17 nt, Mycobacterium avium subsp. paratuberculosis
caccgcgaaagcgucgg

SEQ ID NO: 808096 - RNA, 17 nt, Mycobacterium avium subsp. paratuberculosis
caccgcgaacagcacgu

SEQ ID NO: 808097 - RNA, 16 nt, Mycobacterium avium subsp. paratuberculosis
caccgcgaagaacggu

SEQ ID NO: 808098 - RNA, 20 nt, Mycobacterium avium subsp. paratuberculosis
caccgcgaagaacgguguca

SEQ ID NO: 808099 - RNA, 22 nt, Mycobacterium avium subsp. paratuberculosis
caccgcgaaacgcaacagcgag

SEQ ID NO: 808100 - RNA, 16 nt, Mycobacterium avium subsp. paratuberculosis
caccgccugugcgacg

SEQ ID NO: 808101 - RNA, 20 nt, Mycobacterium avium subsp. paratuberculosis
caccgccugugcgacggcgu

SEQ ID NO: 808102 - RNA, 15 nt, Mycobacterium avium subsp. paratuberculosis
caccgccuucgacgg

SEQ ID NO: 808103 - RNA, 16 nt, Mycobacterium avium subsp. paratuberculosis
caccgccuucgacggc

SEQ ID NO: 808104 - RNA, 18 nt, Mycobacterium avium subsp. paratuberculosis
caccgccuugcccggcuc

SEQ ID NO: 808105 - RNA, 17 nt, Mycobacterium avium subsp. paratuberculosis
caccgcgaccaugcccg

SEQ ID NO: 808106 - RNA, 20 nt, Mycobacterium avium subsp. paratuberculosis
caccgcgaccaugcccggcg

SEQ ID NO: 808107 - RNA, 21 nt, Mycobacterium avium subsp. paratuberculosis
caccgcgaccaugcccggcgc

SEQ ID NO: 808108 - RNA, 13 nt, Mycobacterium avium subsp. paratuberculosis
caccgcgacccag

SEQ ID NO: 808109 - RNA, 18 nt, Mycobacterium avium subsp. paratuberculosis
caccgcgacccaggccgc

SEQ ID NO: 808110 - RNA, 20 nt, Mycobacterium avium subsp. paratuberculosis
caccgcgacccaggccgccg

SEQ ID NO: 808111 - RNA, 23 nt, Mycobacterium avium subsp. paratuberculosis
caccgcgacccaggccgccgcca

SEQ ID NO: 808112 - RNA, 13 nt, Mycobacterium avium subsp. paratuberculosis
caccgcgacccgg

SEQ ID NO: 808113 - RNA, 14 nt, Mycobacterium avium subsp. paratuberculosis
caccgcgacccggc

SEQ ID NO: 808114 - RNA, 15 nt, Mycobacterium avium subsp. paratuberculosis
caccgcgacccggcc

SEQ ID NO: 808115 - RNA, 17 nt, Mycobacterium avium subsp. paratuberculosis
caccgcgacccggccga

SEQ ID NO: 808116 - RNA, 19 nt, Mycobacterium avium subsp. paratuberculosis
caccgcgacccggccgagc

SEQ ID NO: 808117 - RNA, 11 nt, Mycobacterium avium subsp. paratuberculosis
caccgcgaccg

SEQ ID NO: 808118 - RNA, 18 nt, Mycobacterium avium subsp. paratuberculosis
caccgcgacacgucgaca

SEQ ID NO: 808119 - RNA, 19 nt, Mycobacterium avium subsp. paratuberculosis
caccgcgacacgucgacac

SEQ ID NO: 808120 - RNA, 16 nt, Mycobacterium avium subsp. paratuberculosis
caccgcgaccacgccg

SEQ ID NO: 808121 - RNA, 22 nt, Mycobacterium avium subsp. paratuberculosis
caccgcgaccacgccgcggucg

SEQ ID NO: 808122 - RNA, 16 nt, Mycobacterium avium subsp. paratuberculosis
caccgcgaccagcucg

SEQ ID NO: 808123 - RNA, 19 nt, Mycobacterium avium subsp. paratuberculosis
caccgcgaccagcucgggc

SEQ ID NO: 808124 - RNA, 13 nt, Mycobacterium avium subsp. paratuberculosis
caccgccggccac

SEQ ID NO: 808125 - RNA, 14 nt, Mycobacterium avium subsp. paratuberculosis
caccgccggccacg

SEQ ID NO: 808126 - RNA, 18 nt, Mycobacterium avium subsp. paratuberculosis
caccgccugcgcgaucgc

SEQ ID NO: 808127 - RNA, 19 nt, Mycobacterium avium subsp. paratuberculosis
caccgccugcgcgaucgcc

SEQ ID NO: 808128 - RNA, 21 nt, Mycobacterium avium subsp. paratuberculosis
caccgccugcgcgaucgccgg

SEQ ID NO: 808129 - RNA, 16 nt, Mycobacterium avium subsp. paratuberculosis
caccgccgcggcggug

SEQ ID NO: 808130 - RNA, 15 nt, Mycobacterium avium subsp. paratuberculosis
caccgccgcgggcuc

SEQ ID NO: 808131 - RNA, 19 nt, Mycobacterium avium subsp. paratuberculosis
caccgccgcgguggguccg

SEQ ID NO: 808132 - RNA, 15 nt, Mycobacterium avium subsp. paratuberculosis
caccgccgcggcgac

SEQ ID NO: 808133 - RNA, 16 nt, Mycobacterium avium subsp. paratuberculosis
caccgccgcggcgacc

SEQ ID NO: 808134 - RNA, 20 nt, Mycobacterium avium subsp. paratuberculosis
caccgccgcggcgaccacga

SEQ ID NO: 808135 - RNA, 21 nt, Mycobacterium avium subsp. paratuberculosis
caccgccgcggcgaccacgaa

SEQ ID NO: 808136 - RNA, 17 nt, Mycobacterium avium subsp. paratuberculosis
caccgcgcugcgcgcgu

SEQ ID NO: 808137 - RNA, 12 nt, Mycobacterium avium subsp. paratuberculosis
caccgcgcucgg

SEQ ID NO: 808138 - RNA, 15 nt, Mycobacterium avium subsp. paratuberculosis
caccgcgcucggcga

SEQ ID NO: 808139 - RNA, 17 nt, Mycobacterium avium subsp. paratuberculosis
caccgcggaccaccgcg

SEQ ID NO: 808140 - RNA, 20 nt, Mycobacterium avium subsp. paratuberculosis
caccgcggaccaccgcgugc

SEQ ID NO: 808141 - RNA, 22 nt, Mycobacterium avium subsp. paratuberculosis
caccgcggaggaauucgccgac

SEQ ID NO: 808142 - RNA, 23 nt, Mycobacterium avium subsp. paratuberculosis
caccgcggaggaauucgccgacg

SEQ ID NO: 808143 - RNA, 13 nt, Mycobacterium avium subsp. paratuberculosis
caccgcgcggugc

SEQ ID NO: 808144 - RNA, 14 nt, Mycobacterium avium subsp. paratuberculosis
caccgcgcggugca

SEQ ID NO: 808145 - RNA, 15 nt, Mycobacterium avium subsp. paratuberculosis
caccgcgcgcgggua

SEQ ID NO: 808146 - RNA, 13 nt, Mycobacterium avium subsp. paratuberculosis
caccgcgcgcugc

SEQ ID NO: 808147 - RNA, 15 nt, Mycobacterium avium subsp. paratuberculosis
caccgcgcgcugcag

SEQ ID NO: 808148 - RNA, 16 nt, Mycobacterium avium subsp. paratuberculosis
caccgcgcggccagcg

SEQ ID NO: 808149 - RNA, 17 nt, Mycobacterium avium subsp. paratuberculosis
caccgcgcggccagcgg

SEQ ID NO: 808150 - RNA, 23 nt, Mycobacterium avium subsp. paratuberculosis
caccgcgcggccagcggcgccga

SEQ ID NO: 808151 - RNA, 19 nt, Mycobacterium avium subsp. paratuberculosis
caccgcgcggcgcaguucg

SEQ ID NO: 808152 - RNA, 13 nt, Mycobacterium avium subsp. paratuberculosis
caccgcgcggcgg

SEQ ID NO: 808153 - RNA, 22 nt, Mycobacterium avium subsp. paratuberculosis
caccgcgcggcgguccagcgag

SEQ ID NO: 808154 - RNA, 15 nt, Mycobacterium avium subsp. paratuberculosis
caccgcgcggcggug

SEQ ID NO: 808155 - RNA, 16 nt, Mycobacterium avium subsp. paratuberculosis
caccgcgcggcggugc

SEQ ID NO: 808156 - RNA, 15 nt, Mycobacterium avium subsp. paratuberculosis
caccgcgcagaaccg

SEQ ID NO: 808157 - RNA, 20 nt, Mycobacterium avium subsp. paratuberculosis
caccgcgcagaaccgcaccc

SEQ ID NO: 808158 - RNA, 22 nt, Mycobacterium avium subsp. paratuberculosis
caccgcgcagaaccgcaccccg

SEQ ID NO: 808159 - RNA, 15 nt, Mycobacterium avium subsp. paratuberculosis
caccgcgaucaccac

SEQ ID NO: 808160 - RNA, 17 nt, Mycobacterium avium subsp. paratuberculosis
caccgcgaucaccaccc

SEQ ID NO: 808161 - RNA, 20 nt, Mycobacterium avium subsp. paratuberculosis
caccgcgaucaccaccccgg

SEQ ID NO: 808162 - RNA, 20 nt, Mycobacterium avium subsp. paratuberculosis
caccgcgcaaccgggccgca

SEQ ID NO: 808163 - RNA, 16 nt, Mycobacterium avium subsp. paratuberculosis
caccgcgacgagaucg

SEQ ID NO: 808164 - RNA, 18 nt, Mycobacterium avium subsp. paratuberculosis
caccgcgacgaucgcgac

SEQ ID NO: 808165 - RNA, 19 nt, Mycobacterium avium subsp. paratuberculosis
caccgcgacgaucgcgacg

SEQ ID NO: 808166 - RNA, 22 nt, Mycobacterium avium subsp. paratuberculosis
caccgcgacgaucgcgacggcc

SEQ ID NO: 808167 - RNA, 16 nt, Mycobacterium avium subsp. paratuberculosis
caccgcgacgcccagg

SEQ ID NO: 808168 - RNA, 14 nt, Mycobacterium avium subsp. paratuberculosis
caccgcgacgguga

SEQ ID NO: 808169 - RNA, 14 nt, Mycobacterium avium subsp. paratuberculosis
caccgcgagcaccg

SEQ ID NO: 808170 - RNA, 20 nt, Mycobacterium avium subsp. paratuberculosis
caccgcgaguucgcgcacgc

SEQ ID NO: 808171 - RNA, 13 nt, Mycobacterium avium subsp. paratuberculosis
caccgcgaucacc

SEQ ID NO: 808172 - RNA, 16 nt, Mycobacterium avium subsp. paratuberculosis
caccgcgaucgccgac

SEQ ID NO: 808173 - RNA, 20 nt, Mycobacterium avium subsp. paratuberculosis
caccgcgaucgccgacgucg

SEQ ID NO: 808174 - RNA, 16 nt, Mycobacterium avium subsp. paratuberculosis
caccgcgaucuugccc

SEQ ID NO: 808175 - RNA, 23 nt, Mycobacterium avium subsp. paratuberculosis
caccgcgaucuugcccucguaga

SEQ ID NO: 808176 - RNA, 16 nt, Mycobacterium avium subsp. paratuberculosis
caccgcgaugauggcg

SEQ ID NO: 808177 - RNA, 19 nt, Mycobacterium avium subsp. paratuberculosis
caccgcgaugauggcgucg

SEQ ID NO: 808178 - RNA, 16 nt, Mycobacterium avium subsp. paratuberculosis
caccgcgauggcccgc

SEQ ID NO: 808179 - RNA, 21 nt, Mycobacterium avium subsp. paratuberculosis
caccgccgaugaugguggcgg

SEQ ID NO: 808180 - RNA, 14 nt, Mycobacterium avium subsp. paratuberculosis
caccgcccggguug

SEQ ID NO: 808181 - RNA, 17 nt, Mycobacterium avium subsp. paratuberculosis
caccgccgauggcgacg

SEQ ID NO: 808182 - RNA, 18 nt, Mycobacterium avium subsp. paratuberculosis
caccgccgauggcgacgg

SEQ ID NO: 808183 - RNA, 13 nt, Mycobacterium avium subsp. paratuberculosis
caccgccgagggc

SEQ ID NO: 808184 - RNA, 14 nt, Mycobacterium avium subsp. paratuberculosis
caccgccgagggcc

SEQ ID NO: 808185 - RNA, 17 nt, Mycobacterium avium subsp. paratuberculosis
caccgccgagggcccgg

SEQ ID NO: 808186 - RNA, 19 nt, Mycobacterium avium subsp. paratuberculosis
caccgccgagggcccgggc

SEQ ID NO: 808187 - RNA, 14 nt, Mycobacterium avium subsp. paratuberculosis
caccgccgacaucg

SEQ ID NO: 808188 - RNA, 14 nt, Mycobacterium avium subsp. paratuberculosis
caccgccgcgcggc

SEQ ID NO: 808189 - RNA, 20 nt, Mycobacterium avium subsp. paratuberculosis
caccgccgcgcggccgggcu

SEQ ID NO: 808190 - RNA, 13 nt, Mycobacterium avium subsp. paratuberculosis
caccgccgcggcc

SEQ ID NO: 808191 - RNA, 15 nt, Mycobacterium avium subsp. paratuberculosis
caccgccgcggccgc

SEQ ID NO: 808192 - RNA, 17 nt, Mycobacterium avium subsp. paratuberculosis
caccgccgcggccgcga

SEQ ID NO: 808193 - RNA, 14 nt, Mycobacterium avium subsp. paratuberculosis
caccgccgcgccga

SEQ ID NO: 808194 - RNA, 16 nt, Mycobacterium avium subsp. paratuberculosis
caccgccgcgccgagg

SEQ ID NO: 808195 - RNA, 12 nt, Mycobacterium avium subsp. paratuberculosis
caccgccgccga

SEQ ID NO: 808196 - RNA, 21 nt, Mycobacterium avium subsp. paratuberculosis
caccgccgccgacuccccgcc

SEQ ID NO: 808197 - RNA, 20 nt, Mycobacterium avium subsp. paratuberculosis
caccgcccacagcaacgaca

SEQ ID NO: 808198 - RNA, 18 nt, Mycobacterium avium subsp. paratuberculosis
caccgccaucgcggcguu

SEQ ID NO: 808199 - RNA, 15 nt, Mycobacterium avium subsp. paratuberculosis
caccgccccagccga

SEQ ID NO: 808200 - RNA, 21 nt, Mycobacterium avium subsp. paratuberculosis
caccgccccagccgaccaguu

SEQ ID NO: 808201 - RNA, 15 nt, Mycobacterium avium subsp. paratuberculosis
caccgcccccgcggc

SEQ ID NO: 808202 - RNA, 18 nt, Mycobacterium avium subsp. paratuberculosis
caccgcccccgcggcggc

SEQ ID NO: 808203 - RNA, 20 nt, Mycobacterium avium subsp. paratuberculosis
caccgccagccaccacaucg

SEQ ID NO: 808204 - RNA, 12 nt, Mycobacterium avium subsp. paratuberculosis
caccgcccgcgc

SEQ ID NO: 808205 - RNA, 16 nt, Mycobacterium avium subsp. paratuberculosis
caccgcccgcgcgaug

SEQ ID NO: 808206 - RNA, 19 nt, Mycobacterium avium subsp. paratuberculosis
caccgcccgcugaccgccg

SEQ ID NO: 808207 - RNA, 14 nt, Mycobacterium avium subsp. paratuberculosis
caccgcccggaugc

SEQ ID NO: 808208 - RNA, 23 nt, Mycobacterium avium subsp. paratuberculosis
caccgcccggaugccggcgccca

SEQ ID NO: 808209 - RNA, 12 nt, Mycobacterium avium subsp. paratuberculosis
caccgccccgcc

SEQ ID NO: 808210 - RNA, 14 nt, Mycobacterium avium subsp. paratuberculosis
caccgccccgccgc

SEQ ID NO: 808211 - RNA, 15 nt, Mycobacterium avium subsp. paratuberculosis
caccgccccgccgcg

SEQ ID NO: 808212 - RNA, 16 nt, Mycobacterium avium subsp. paratuberculosis
caccgccccgccgcgc

SEQ ID NO: 808213 - RNA, 19 nt, Mycobacterium avium subsp. paratuberculosis
caccgccccggucaccccg

SEQ ID NO: 808214 - RNA, 20 nt, Mycobacterium avium subsp. paratuberculosis
caccgccccggucaccccgg

SEQ ID NO: 808215 - RNA, 21 nt, Mycobacterium avium subsp. paratuberculosis
caccgccccggucaccccggc

SEQ ID NO: 808216 - RNA, 20 nt, Mycobacterium avium subsp. paratuberculosis
caagcagcggcagccacggc

SEQ ID NO: 808217 - RNA, 16 nt, Mycobacterium avium subsp. paratuberculosis
caagcaguaugcccgc

SEQ ID NO: 808218 - RNA, 22 nt, Mycobacterium avium subsp. paratuberculosis
caagcaguaugcccgccgcuga

SEQ ID NO: 808219 - RNA, 18 nt, Mycobacterium avium subsp. paratuberculosis
caagccauuucagcagcg

SEQ ID NO: 808220 - RNA, 19 nt, Mycobacterium avium subsp. paratuberculosis
caagauaggagacagccga

SEQ ID NO: 808221 - RNA, 14 nt, Mycobacterium avium subsp. paratuberculosis
caagauaccggccg

SEQ ID NO: 808222 - RNA, 15 nt, Mycobacterium avium subsp. paratuberculosis
caagcagagcagcga

SEQ ID NO: 808223 - RNA, 22 nt, Mycobacterium avium subsp. paratuberculosis
caagcagauucgaggucaucga

SEQ ID NO: 808224 - RNA, 17 nt, Mycobacterium avium subsp. paratuberculosis
caagcgcuuucgccgaa

SEQ ID NO: 808225 - RNA, 21 nt, Mycobacterium avium subsp. paratuberculosis
caagcgcuuugaucagcucgc

SEQ ID NO: 808226 - RNA, 19 nt, Mycobacterium avium subsp. paratuberculosis
caagccggccagcagcggc

SEQ ID NO: 808227 - RNA, 16 nt, Mycobacterium avium subsp. paratuberculosis
caagccggcgucgaug

SEQ ID NO: 808228 - RNA, 18 nt, Mycobacterium avium subsp. paratuberculosis
caagcgguuccagaccgg

SEQ ID NO: 808229 - RNA, 14 nt, Mycobacterium avium subsp. paratuberculosis
caagccgccgaucu

SEQ ID NO: 808230 - RNA, 17 nt, Mycobacterium avium subsp. paratuberculosis
caaggcaaucaggcggu

SEQ ID NO: 808231 - RNA, 16 nt, Mycobacterium avium subsp. paratuberculosis
caaggccagcaaccgc

SEQ ID NO: 808232 - RNA, 20 nt, Mycobacterium avium subsp. paratuberculosis
caaggccagcaaccgccgug

SEQ ID NO: 808233 - RNA, 17 nt, Mycobacterium avium subsp. paratuberculosis
caaggccagcaaccgga

SEQ ID NO: 808234 - RNA, 22 nt, Mycobacterium avium subsp. paratuberculosis
caagcguauccggccagccggg

SEQ ID NO: 808235 - RNA, 16 nt, Mycobacterium avium subsp. paratuberculosis
caaggcaacucagucc

SEQ ID NO: 808236 - RNA, 22 nt, Mycobacterium avium subsp. paratuberculosis
caacucggguguggacggcgag

SEQ ID NO: 808237 - RNA, 19 nt, Mycobacterium avium subsp. paratuberculosis
caacucguccagcgucgcg

SEQ ID NO: 808238 - RNA, 15 nt, Mycobacterium avium subsp. paratuberculosis
caacggugguggcga

SEQ ID NO: 808239 - RNA, 18 nt, Mycobacterium avium subsp. paratuberculosis
caacgguucggccgcucg

SEQ ID NO: 808240 - RNA, 20 nt, Mycobacterium avium subsp. paratuberculosis
caacgguucggccgcucggg

SEQ ID NO: 808241 - RNA, 15 nt, Mycobacterium avium subsp. paratuberculosis
caacugcaccagcgg

SEQ ID NO: 808242 - RNA, 22 nt, Mycobacterium avium subsp. paratuberculosis
caacugaauuccuggccggugc

SEQ ID NO: 808243 - RNA, 15 nt, Mycobacterium avium subsp. paratuberculosis
caacugagcgcggcg

SEQ ID NO: 808244 - RNA, 19 nt, Mycobacterium avium subsp. paratuberculosis
caacugcucgaccagcccc

SEQ ID NO: 808245 - RNA, 21 nt, Mycobacterium avium subsp. paratuberculosis
caacugcucgaccagcccccg

SEQ ID NO: 808246 - RNA, 21 nt, Mycobacterium avium subsp. paratuberculosis
caacugcauuucggacggcga

SEQ ID NO: 808247 - RNA, 15 nt, Mycobacterium avium subsp. paratuberculosis
caacugccgacgguc

SEQ ID NO: 808248 - RNA, 17 nt, Mycobacterium avium subsp. paratuberculosis
caacggccaugaagccg

SEQ ID NO: 808249 - RNA, 12 nt, Mycobacterium avium subsp. paratuberculosis
caacggccccca

SEQ ID NO: 808250 - RNA, 15 nt, Mycobacterium avium subsp. paratuberculosis
caacggcccccacga

SEQ ID NO: 808251 - RNA, 13 nt, Mycobacterium avium subsp. paratuberculosis
caacggccgcacg

SEQ ID NO: 808252 - RNA, 19 nt, Mycobacterium avium subsp. paratuberculosis
caacggccgcagcgacucc

SEQ ID NO: 808253 - RNA, 14 nt, Mycobacterium avium subsp. paratuberculosis
caacggccggcgcc

SEQ ID NO: 808254 - RNA, 15 nt, Mycobacterium avium subsp. paratuberculosis
caacggccggcgccg

SEQ ID NO: 808255 - RNA, 18 nt, Mycobacterium avium subsp. paratuberculosis
caacggccggcgccgccg

SEQ ID NO: 808256 - RNA, 22 nt, Mycobacterium avium subsp. paratuberculosis
caacgggcggcggaucagcacc

SEQ ID NO: 808257 - RNA, 23 nt, Mycobacterium avium subsp. paratuberculosis
caacgggcggcggaucagcaccg

SEQ ID NO: 808258 - RNA, 17 nt, Mycobacterium avium subsp. paratuberculosis
caacgggcucagcacca

SEQ ID NO: 808259 - RNA, 22 nt, Mycobacterium avium subsp. paratuberculosis
caacggucgggaucugcgguga

SEQ ID NO: 808260 - RNA, 15 nt, Mycobacterium avium subsp. paratuberculosis
caacggugaucgaca

SEQ ID NO: 808261 - RNA, 17 nt, Mycobacterium avium subsp. paratuberculosis
caacgguacgugcgccg

SEQ ID NO: 808262 - RNA, 20 nt, Mycobacterium avium subsp. paratuberculosis
caacgguacgugcgccggcg

SEQ ID NO: 808263 - RNA, 18 nt, Mycobacterium avium subsp. paratuberculosis
caacgggccgcagccgcg

SEQ ID NO: 808264 - RNA, 22 nt, Mycobacterium avium subsp. paratuberculosis
caagacaauucgcugccccggc

SEQ ID NO: 808265 - RNA, 17 nt, Mycobacterium avium subsp. paratuberculosis
caagacggugggcccgc

SEQ ID NO: 808266 - RNA, 15 nt, Mycobacterium avium subsp. paratuberculosis
caagacguccgcguc

SEQ ID NO: 808267 - RNA, 16 nt, Mycobacterium avium subsp. paratuberculosis
caagacguccgcgucg

SEQ ID NO: 808268 - RNA, 16 nt, Mycobacterium avium subsp. paratuberculosis
caacuggucgugcagc

SEQ ID NO: 808269 - RNA, 20 nt, Mycobacterium avium subsp. paratuberculosis
caacuggucgugcagcaccg

SEQ ID NO: 808270 - RNA, 21 nt, Mycobacterium avium subsp. paratuberculosis
caacuggucgugcagcaccgc

SEQ ID NO: 808271 - RNA, 20 nt, Mycobacterium avium subsp. paratuberculosis
caacuggucgugcucgucgg

SEQ ID NO: 808272 - RNA, 21 nt, Mycobacterium avium subsp. paratuberculosis
caacuggucgugcucgucggc

SEQ ID NO: 808273 - RNA, 15 nt, Mycobacterium avium subsp. paratuberculosis
caacuggcaacgcgu

SEQ ID NO: 808274 - RNA, 18 nt, Mycobacterium avium subsp. paratuberculosis
caacuguucgcggcuggc

SEQ ID NO: 808275 - RNA, 21 nt, Mycobacterium avium subsp. paratuberculosis
caacuguucgcggcuggccgc

SEQ ID NO: 808276 - RNA, 14 nt, Mycobacterium avium subsp. paratuberculosis
caacuugcgcgacg

SEQ ID NO: 808277 - RNA, 15 nt, Mycobacterium avium subsp. paratuberculosis
caacagcaccagcac

SEQ ID NO: 808278 - RNA, 20 nt, Mycobacterium avium subsp. paratuberculosis
caacagcagcgaggcgucca

SEQ ID NO: 808279 - RNA, 14 nt, Mycobacterium avium subsp. paratuberculosis
caacagcagcgccg

SEQ ID NO: 808280 - RNA, 20 nt, Mycobacterium avium subsp. paratuberculosis
caacagcagcgccgcggccg

SEQ ID NO: 808281 - RNA, 14 nt, Mycobacterium avium subsp. paratuberculosis
caacagcagcggca

SEQ ID NO: 808282 - RNA, 14 nt, Mycobacterium avium subsp. paratuberculosis
caacagcgccgaga

SEQ ID NO: 808283 - RNA, 14 nt, Mycobacterium avium subsp. paratuberculosis
caacagcggcccga

SEQ ID NO: 808284 - RNA, 19 nt, Mycobacterium avium subsp. paratuberculosis
caacagcggcccgaucacc

SEQ ID NO: 808285 - RNA, 16 nt, Mycobacterium avium subsp. paratuberculosis
caacagcgcgccggcc

SEQ ID NO: 808286 - RNA, 12 nt, Mycobacterium avium subsp. paratuberculosis
caacagccggcc

SEQ ID NO: 808287 - RNA, 14 nt, Mycobacterium avium subsp. paratuberculosis
caacagccggcccg

SEQ ID NO: 808288 - RNA, 15 nt, Mycobacterium avium subsp. paratuberculosis
caacacucgagcgcg

SEQ ID NO: 808289 - RNA, 16 nt, Mycobacterium avium subsp. paratuberculosis
caacacgucguccggc

SEQ ID NO: 808290 - RNA, 20 nt, Mycobacterium avium subsp. paratuberculosis
caacacgucguccggcgcgc

SEQ ID NO: 808291 - RNA, 21 nt, Mycobacterium avium subsp. paratuberculosis
caacacgucguccggcgcgca

SEQ ID NO: 808292 - RNA, 18 nt, Mycobacterium avium subsp. paratuberculosis
caacacgucgucgugcgc

SEQ ID NO: 808293 - RNA, 23 nt, Mycobacterium avium subsp. paratuberculosis
caacacguugagucccucggcga

SEQ ID NO: 808294 - RNA, 20 nt, Mycobacterium avium subsp. paratuberculosis
caacauccgcgacgacacca

SEQ ID NO: 808295 - RNA, 19 nt, Mycobacterium avium subsp. paratuberculosis
caacagguuucgcucgucg

SEQ ID NO: 808296 - RNA, 20 nt, Mycobacterium avium subsp. paratuberculosis
caacagguuucgcucgucgg

SEQ ID NO: 808297 - RNA, 22 nt, Mycobacterium avium subsp. paratuberculosis
caacagguuucgcucgucggcg

SEQ ID NO: 808298 - RNA, 23 nt, Mycobacterium avium subsp. paratuberculosis
caacagguuucgcucgucggcgc

SEQ ID NO: 808299 - RNA, 15 nt, Mycobacterium avium subsp. paratuberculosis
caacagggccgcgcg

SEQ ID NO: 808300 - RNA, 19 nt, Mycobacterium avium subsp. paratuberculosis
caacagggccgcgcgggcg

SEQ ID NO: 808301 - RNA, 22 nt, Mycobacterium avium subsp. paratuberculosis
caacaggcccagcagcgcaccg

SEQ ID NO: 808302 - RNA, 16 nt, Mycobacterium avium subsp. paratuberculosis
caaccacuugaagccg

SEQ ID NO: 808303 - RNA, 20 nt, Mycobacterium avium subsp. paratuberculosis
caaccacuugaagccgguga

SEQ ID NO: 808304 - RNA, 22 nt, Mycobacterium avium subsp. paratuberculosis
caaccacuuucgcgagcgcgcu

SEQ ID NO: 808305 - RNA, 14 nt, Mycobacterium avium subsp. paratuberculosis
caaccaggucgcgg

SEQ ID NO: 808306 - RNA, 16 nt, Mycobacterium avium subsp. paratuberculosis
caaccaggucgcggcg

SEQ ID NO: 808307 - RNA, 21 nt, Mycobacterium avium subsp. paratuberculosis
caaccagugcacgcucggcgg

SEQ ID NO: 808308 - RNA, 22 nt, Mycobacterium avium subsp. paratuberculosis
caaccagugcacgcucggcggg

SEQ ID NO: 808309 - RNA, 13 nt, Mycobacterium avium subsp. paratuberculosis
caacccgggcgcc

SEQ ID NO: 808310 - RNA, 19 nt, Mycobacterium avium subsp. paratuberculosis
caaccaggccuuccgcaac

SEQ ID NO: 808311 - RNA, 20 nt, Mycobacterium avium subsp. paratuberculosis
caaccaggcgcucgucgaug

SEQ ID NO: 808312 - RNA, 21 nt, Mycobacterium avium subsp. paratuberculosis
caaccuguuuggcugucgcgc

SEQ ID NO: 808313 - RNA, 17 nt, Mycobacterium avium subsp. paratuberculosis
caacccgucgcggguca

SEQ ID NO: 808314 - RNA, 16 nt, Mycobacterium avium subsp. paratuberculosis
caacgcaaugcgucgc

SEQ ID NO: 808315 - RNA, 19 nt, Mycobacterium avium subsp. paratuberculosis
caacgcaaugcgucgcggc

SEQ ID NO: 808316 - RNA, 15 nt, Mycobacterium avium subsp. paratuberculosis
caacgcacgggcggc

SEQ ID NO: 808317 - RNA, 17 nt, Mycobacterium avium subsp. paratuberculosis
caacgcacgggcggcgg

SEQ ID NO: 808318 - RNA, 14 nt, Mycobacterium avium subsp. paratuberculosis
caacgacgucggcg

SEQ ID NO: 808319 - RNA, 19 nt, Mycobacterium avium subsp. paratuberculosis
caacgacagcgacgggccg

SEQ ID NO: 808320 - RNA, 23 nt, Mycobacterium avium subsp. paratuberculosis
caacgacauccagaugcccagca

SEQ ID NO: 808321 - RNA, 13 nt, Mycobacterium avium subsp. paratuberculosis
caacgacccggcc

SEQ ID NO: 808322 - RNA, 21 nt, Mycobacterium avium subsp. paratuberculosis
caacgacccggccaccgccgc

SEQ ID NO: 808323 - RNA, 13 nt, Mycobacterium avium subsp. paratuberculosis
caacgacccgucg

SEQ ID NO: 808324 - RNA, 16 nt, Mycobacterium avium subsp. paratuberculosis
caacgacccgucgggg

SEQ ID NO: 808325 - RNA, 13 nt, Mycobacterium avium subsp. paratuberculosis
caacgccagcgcg

SEQ ID NO: 808326 - RNA, 23 nt, Mycobacterium avium subsp. paratuberculosis
caacgcgccgaacaacggcggac

SEQ ID NO: 808327 - RNA, 22 nt, Mycobacterium avium subsp. paratuberculosis
caacgcgauucucgcugcggcg

SEQ ID NO: 808328 - RNA, 22 nt, Mycobacterium avium subsp. paratuberculosis
caacgcgcacaucacgguggcc

SEQ ID NO: 808329 - RNA, 12 nt, Mycobacterium avium subsp. paratuberculosis
caacgcgcagcc

SEQ ID NO: 808330 - RNA, 18 nt, Mycobacterium avium subsp. paratuberculosis
caacgcggacacggccgg

SEQ ID NO: 808331 - RNA, 12 nt, Mycobacterium avium subsp. paratuberculosis
caacgcgccggc

SEQ ID NO: 808332 - RNA, 13 nt, Mycobacterium avium subsp. paratuberculosis
caacgcgccggcg

SEQ ID NO: 808333 - RNA, 15 nt, Mycobacterium avium subsp. paratuberculosis
caacgcgccggcggu

SEQ ID NO: 808334 - RNA, 16 nt, Mycobacterium avium subsp. paratuberculosis
caacgcgccggcgguc

SEQ ID NO: 808335 - RNA, 18 nt, Mycobacterium avium subsp. paratuberculosis
caacgcgccggcggucga

SEQ ID NO: 808336 - RNA, 15 nt, Mycobacterium avium subsp. paratuberculosis
caacgcgcgcgacgg

SEQ ID NO: 808337 - RNA, 20 nt, Mycobacterium avium subsp. paratuberculosis
caacgcgcgcgacggcgcgu

SEQ ID NO: 808338 - RNA, 16 nt, Mycobacterium avium subsp. paratuberculosis
caacgcggcggugacg

SEQ ID NO: 808339 - RNA, 20 nt, Mycobacterium avium subsp. paratuberculosis
caacgcggcggugacgaacc

SEQ ID NO: 808340 - RNA, 22 nt, Mycobacterium avium subsp. paratuberculosis
caacgcuuucgggucgacgagc

SEQ ID NO: 808341 - RNA, 16 nt, Mycobacterium avium subsp. paratuberculosis
caacggauagcguccg

SEQ ID NO: 808342 - RNA, 20 nt, Mycobacterium avium subsp. paratuberculosis
caacggcaccaccacggugg

SEQ ID NO: 808343 - RNA, 23 nt, Mycobacterium avium subsp. paratuberculosis
caacgcgacgaagccggugccca

SEQ ID NO: 808344 - RNA, 19 nt, Mycobacterium avium subsp. paratuberculosis
caacgccgcgcgcagcaca

SEQ ID NO: 808345 - RNA, 22 nt, Mycobacterium avium subsp. paratuberculosis
caacgccucgucgaccgcggcc

SEQ ID NO: 808346 - RNA, 13 nt, Mycobacterium avium subsp. paratuberculosis
caacgccggcgug

SEQ ID NO: 808347 - RNA, 21 nt, Mycobacterium avium subsp. paratuberculosis
caacgccggcgugcacaggcc

SEQ ID NO: 808348 - RNA, 19 nt, Mycobacterium avium subsp. paratuberculosis
caacgccgggucgacgccg

SEQ ID NO: 808349 - RNA, 20 nt, Mycobacterium avium subsp. paratuberculosis
caacgccgggucgacgccga

SEQ ID NO: 808350 - RNA, 17 nt, Mycobacterium avium subsp. paratuberculosis
caacgccgccgacagca

SEQ ID NO: 808351 - RNA, 20 nt, Mycobacterium avium subsp. paratuberculosis
caacgccgccgacagcaccu

SEQ ID NO: 808352 - RNA, 15 nt, Mycobacterium avium subsp. paratuberculosis
caaaauagcugcgac

SEQ ID NO: 808353 - RNA, 16 nt, Mycobacterium avium subsp. paratuberculosis
caaacagcgcggccgg

SEQ ID NO: 808354 - RNA, 22 nt, Mycobacterium avium subsp. paratuberculosis
caaaagggcccaugccgccauc

SEQ ID NO: 808355 - RNA, 22 nt, Mycobacterium avium subsp. paratuberculosis
caaaaguguuuccgcugaggcg

SEQ ID NO: 808356 - RNA, 20 nt, Mycobacterium avium subsp. paratuberculosis
caaaagccccgcgacacgcc

SEQ ID NO: 808357 - RNA, 23 nt, Mycobacterium avium subsp. paratuberculosis
caaaagcauccggccgucgucgg

SEQ ID NO: 808358 - RNA, 13 nt, Mycobacterium avium subsp. paratuberculosis
caaaacaacgcgc

SEQ ID NO: 808359 - RNA, 18 nt, Mycobacterium avium subsp. paratuberculosis
caaagccuacggcgccgg

SEQ ID NO: 808360 - RNA, 21 nt, Mycobacterium avium subsp. paratuberculosis
caaagguaguccagcacagca

SEQ ID NO: 808361 - RNA, 13 nt, Mycobacterium avium subsp. paratuberculosis
auuuccuggccga

SEQ ID NO: 808362 - RNA, 15 nt, Mycobacterium avium subsp. paratuberculosis
auuucggucggcagg

SEQ ID NO: 808363 - RNA, 17 nt, Mycobacterium avium subsp. paratuberculosis
auuucggacggcgacgg

SEQ ID NO: 808364 - RNA, 14 nt, Mycobacterium avium subsp. paratuberculosis
auucccgaccccgc

SEQ ID NO: 808365 - RNA, 20 nt, Mycobacterium avium subsp. paratuberculosis
auuccccguagucacccggc

SEQ ID NO: 808366 - RNA, 23 nt, Mycobacterium avium subsp. paratuberculosis
auuuccguugugccaccgccgau

SEQ ID NO: 808367 - RNA, 21 nt, Mycobacterium avium subsp. paratuberculosis
auuacucgccggcggcgccgg

SEQ ID NO: 808368 - RNA, 12 nt, Mycobacterium avium subsp. paratuberculosis
auuccagcgcca

SEQ ID NO: 808369 - RNA, 22 nt, Mycobacterium avium subsp. paratuberculosis
auuccagcgcgaccgcccgggc

SEQ ID NO: 808370 - RNA, 17 nt, Mycobacterium avium subsp. paratuberculosis
auuaaccggcaggccgu

SEQ ID NO: 808371 - RNA, 19 nt, Mycobacterium avium subsp. paratuberculosis
auguugugcaggcagccgu

SEQ ID NO: 808372 - RNA, 15 nt, Mycobacterium avium subsp. paratuberculosis
auguugugcccgacg

SEQ ID NO: 808373 - RNA, 18 nt, Mycobacterium avium subsp. paratuberculosis
auguugugcccgacggcg

SEQ ID NO: 808374 - RNA, 18 nt, Mycobacterium avium subsp. paratuberculosis
augucggacucgcgccgg

SEQ ID NO: 808375 - RNA, 22 nt, Mycobacterium avium subsp. paratuberculosis
augucgcgcagcauccgcacca

SEQ ID NO: 808376 - RNA, 13 nt, Mycobacterium avium subsp. paratuberculosis
augucgcggcgca

SEQ ID NO: 808377 - RNA, 20 nt, Mycobacterium avium subsp. paratuberculosis
augcucagcgggaagccgag

SEQ ID NO: 808378 - RNA, 16 nt, Mycobacterium avium subsp. paratuberculosis
augcucgucggucagg

SEQ ID NO: 808379 - RNA, 22 nt, Mycobacterium avium subsp. paratuberculosis
augcucgaugcgcaccugcggc

SEQ ID NO: 808380 - RNA, 16 nt, Mycobacterium avium subsp. paratuberculosis
augcucuugcgggcgg

SEQ ID NO: 808381 - RNA, 19 nt, Mycobacterium avium subsp. paratuberculosis
auggcccgggccacacccg

SEQ ID NO: 808382 - RNA, 12 nt, Mycobacterium avium subsp. paratuberculosis
auggccgcgccg

SEQ ID NO: 808383 - RNA, 15 nt, Mycobacterium avium subsp. paratuberculosis
auggccgcgccgccg

SEQ ID NO: 808384 - RNA, 16 nt, Mycobacterium avium subsp. paratuberculosis
auggccgcgccgccgc

SEQ ID NO: 808385 - RNA, 21 nt, Mycobacterium avium subsp. paratuberculosis
auggccgcgccguagcggccc

SEQ ID NO: 808386 - RNA, 13 nt, Mycobacterium avium subsp. paratuberculosis
auggccggccggg

SEQ ID NO: 808387 - RNA, 14 nt, Mycobacterium avium subsp. paratuberculosis
auggccggcuaccg

SEQ ID NO: 808388 - RNA, 13 nt, Mycobacterium avium subsp. paratuberculosis
auggccgggcagg

SEQ ID NO: 808389 - RNA, 17 nt, Mycobacterium avium subsp. paratuberculosis
auggccgggcaggccgg

SEQ ID NO: 808390 - RNA, 22 nt, Mycobacterium avium subsp. paratuberculosis
auggcgcccggcagccgcuccg

SEQ ID NO: 808391 - RNA, 20 nt, Mycobacterium avium subsp. paratuberculosis
auggcgccgaucgcgcgcag

SEQ ID NO: 808392 - RNA, 19 nt, Mycobacterium avium subsp. paratuberculosis
auggcgcccagcccgagca

SEQ ID NO: 808393 - RNA, 23 nt, Mycobacterium avium subsp. paratuberculosis
auggcgcccagcgucucggcggc

SEQ ID NO: 808394 - RNA, 19 nt, Mycobacterium avium subsp. paratuberculosis
auggccgucgggucggcga

SEQ ID NO: 808395 - RNA, 15 nt, Mycobacterium avium subsp. paratuberculosis
auggcgcaccgcggc

SEQ ID NO: 808396 - RNA, 17 nt, Mycobacterium avium subsp. paratuberculosis
auggcgcaccgcggccu

SEQ ID NO: 808397 - RNA, 15 nt, Mycobacterium avium subsp. paratuberculosis
auggcgcggcccagu

SEQ ID NO: 808398 - RNA, 18 nt, Mycobacterium avium subsp. paratuberculosis
auggcgcggccggccgac

SEQ ID NO: 808399 - RNA, 12 nt, Mycobacterium avium subsp. paratuberculosis
auggcgcggcgc

SEQ ID NO: 808400 - RNA, 13 nt, Mycobacterium avium subsp. paratuberculosis
auggcgcggcgca

SEQ ID NO: 808401 - RNA, 21 nt, Mycobacterium avium subsp. paratuberculosis
auggcggcggcccgccgcgcc

SEQ ID NO: 808402 - RNA, 12 nt, Mycobacterium avium subsp. paratuberculosis
auggcggcggcu

SEQ ID NO: 808403 - RNA, 13 nt, Mycobacterium avium subsp. paratuberculosis
auggcggcggcug

SEQ ID NO: 808404 - RNA, 15 nt, Mycobacterium avium subsp. paratuberculosis
auggcggcggcugcc

SEQ ID NO: 808405 - RNA, 14 nt, Mycobacterium avium subsp. paratuberculosis
auggcggcgucgag

SEQ ID NO: 808406 - RNA, 13 nt, Mycobacterium avium subsp. paratuberculosis
auggcggccgccg

SEQ ID NO: 808407 - RNA, 14 nt, Mycobacterium avium subsp. paratuberculosis
auggcggccgccgc

SEQ ID NO: 808408 - RNA, 12 nt, Mycobacterium avium subsp. paratuberculosis
auggcggcccgc

SEQ ID NO: 808409 - RNA, 18 nt, Mycobacterium avium subsp. paratuberculosis
auggcggcccgcgccggc

SEQ ID NO: 808410 - RNA, 17 nt, Mycobacterium avium subsp. paratuberculosis
auggcggucgcgccaga

SEQ ID NO: 808411 - RNA, 12 nt, Mycobacterium avium subsp. paratuberculosis
auggcgggccgc

SEQ ID NO: 808412 - RNA, 23 nt, Mycobacterium avium subsp. paratuberculosis
auggcgguccaccaccacacccg

SEQ ID NO: 808413 - RNA, 17 nt, Mycobacterium avium subsp. paratuberculosis
auggcgugccggcgcug

SEQ ID NO: 808414 - RNA, 22 nt, Mycobacterium avium subsp. paratuberculosis
auggcgugccggcgcugcccgu

SEQ ID NO: 808415 - RNA, 12 nt, Mycobacterium avium subsp. paratuberculosis
auggcgucgacg

SEQ ID NO: 808416 - RNA, 21 nt, Mycobacterium avium subsp. paratuberculosis
auggcgucgacgugcgcggcg

SEQ ID NO: 808417 - RNA, 15 nt, Mycobacterium avium subsp. paratuberculosis
auggcguccaccgac

SEQ ID NO: 808418 - RNA, 16 nt, Mycobacterium avium subsp. paratuberculosis
auggugaccagcgccc

SEQ ID NO: 808419 - RNA, 14 nt, Mycobacterium avium subsp. paratuberculosis
auggugacggccgu

SEQ ID NO: 808420 - RNA, 20 nt, Mycobacterium avium subsp. paratuberculosis
auggugaucucgccgcggug

SEQ ID NO: 808421 - RNA, 18 nt, Mycobacterium avium subsp. paratuberculosis
auggugaugugcggcgcg

SEQ ID NO: 808422 - RNA, 19 nt, Mycobacterium avium subsp. paratuberculosis
augguggcgcugccgagca

SEQ ID NO: 808423 - RNA, 13 nt, Mycobacterium avium subsp. paratuberculosis
augguggcggcca

SEQ ID NO: 808424 - RNA, 18 nt, Mycobacterium avium subsp. paratuberculosis
augguggcggcgccggau

SEQ ID NO: 808425 - RNA, 17 nt, Mycobacterium avium subsp. paratuberculosis
auggucgagccgcaguc

SEQ ID NO: 808426 - RNA, 16 nt, Mycobacterium avium subsp. paratuberculosis
auggucggcgacgccg

SEQ ID NO: 808427 - RNA, 16 nt, Mycobacterium avium subsp. paratuberculosis
auggucgcggccgugu

SEQ ID NO: 808428 - RNA, 17 nt, Mycobacterium avium subsp. paratuberculosis
auggucgcgccgcggcg

SEQ ID NO: 808429 - RNA, 22 nt, Mycobacterium avium subsp. paratuberculosis
auggucgccgacgguggcgaag

SEQ ID NO: 808430 - RNA, 19 nt, Mycobacterium avium subsp. paratuberculosis
auggugaaaucguccaucg

SEQ ID NO: 808431 - RNA, 20 nt, Mycobacterium avium subsp. paratuberculosis
auggugaagcccagcgcguu

SEQ ID NO: 808432 - RNA, 15 nt, Mycobacterium avium subsp. paratuberculosis
auggucuugccgcug

SEQ ID NO: 808433 - RNA, 17 nt, Mycobacterium avium subsp. paratuberculosis
auggucucccgggcggu

SEQ ID NO: 808434 - RNA, 22 nt, Mycobacterium avium subsp. paratuberculosis
auggucucgcugaucucgacgg

SEQ ID NO: 808435 - RNA, 19 nt, Mycobacterium avium subsp. paratuberculosis
auggcuuccgccgagacgg

SEQ ID NO: 808436 - RNA, 13 nt, Mycobacterium avium subsp. paratuberculosis
auggcucgcgggg

SEQ ID NO: 808437 - RNA, 18 nt, Mycobacterium avium subsp. paratuberculosis
auggcucagcgcaccgcc

SEQ ID NO: 808438 - RNA, 19 nt, Mycobacterium avium subsp. paratuberculosis
auggucagcugccgcaccg

SEQ ID NO: 808439 - RNA, 14 nt, Mycobacterium avium subsp. paratuberculosis
auggucagccgcac

SEQ ID NO: 808440 - RNA, 19 nt, Mycobacterium avium subsp. paratuberculosis
auggucaccggggugccgc

SEQ ID NO: 808441 - RNA, 22 nt, Mycobacterium avium subsp. paratuberculosis
auguccccgcgggugacgcuga

SEQ ID NO: 808442 - RNA, 21 nt, Mycobacterium avium subsp. paratuberculosis
auguccggcaggcucagcagc

SEQ ID NO: 808443 - RNA, 22 nt, Mycobacterium avium subsp. paratuberculosis
auguccggcaggcucagcagca

SEQ ID NO: 808444 - RNA, 17 nt, Mycobacterium avium subsp. paratuberculosis
auguccggggugagcag

SEQ ID NO: 808445 - RNA, 15 nt, Mycobacterium avium subsp. paratuberculosis
auguccuacggcggg

SEQ ID NO: 808446 - RNA, 14 nt, Mycobacterium avium subsp. paratuberculosis
augucgaccaccgg

SEQ ID NO: 808447 - RNA, 14 nt, Mycobacterium avium subsp. paratuberculosis
augucgaccucggc

SEQ ID NO: 808448 - RNA, 21 nt, Mycobacterium avium subsp. paratuberculosis
augucgacgacguugcgggcc

SEQ ID NO: 808449 - RNA, 15 nt, Mycobacterium avium subsp. paratuberculosis
augucgaaccccacg

SEQ ID NO: 808450 - RNA, 14 nt, Mycobacterium avium subsp. paratuberculosis
augucgccgaacgc

SEQ ID NO: 808451 - RNA, 15 nt, Mycobacterium avium subsp. paratuberculosis
augucgccggcggcg

SEQ ID NO: 808452 - RNA, 17 nt, Mycobacterium avium subsp. paratuberculosis
augucgccggcggcgau

SEQ ID NO: 808453 - RNA, 21 nt, Mycobacterium avium subsp. paratuberculosis
augucgccguacaucauggcg

SEQ ID NO: 808454 - RNA, 13 nt, Mycobacterium avium subsp. paratuberculosis
augucgcaacggu

SEQ ID NO: 808455 - RNA, 18 nt, Mycobacterium avium subsp. paratuberculosis
augucgcaacggucggga

SEQ ID NO: 808456 - RNA, 13 nt, Mycobacterium avium subsp. paratuberculosis
augucgacgcuga

SEQ ID NO: 808457 - RNA, 18 nt, Mycobacterium avium subsp. paratuberculosis
augucgacgucgucgacc

SEQ ID NO: 808458 - RNA, 16 nt, Mycobacterium avium subsp. paratuberculosis
augucgaugacggcgg

SEQ ID NO: 808459 - RNA, 17 nt, Mycobacterium avium subsp. paratuberculosis
augucgaugacggcggc

SEQ ID NO: 808460 - RNA, 18 nt, Mycobacterium avium subsp. paratuberculosis
augucgaugacggcggcg

SEQ ID NO: 808461 - RNA, 13 nt, Mycobacterium avium subsp. paratuberculosis
auguccgaccggu

SEQ ID NO: 808462 - RNA, 13 nt, Mycobacterium avium subsp. paratuberculosis
auguagcagcgcg

SEQ ID NO: 808463 - RNA, 15 nt, Mycobacterium avium subsp. paratuberculosis
auguagcagcgcggc

SEQ ID NO: 808464 - RNA, 16 nt, Mycobacterium avium subsp. paratuberculosis
augcgaccacgaccgg

SEQ ID NO: 808465 - RNA, 19 nt, Mycobacterium avium subsp. paratuberculosis
augcgaucauuccgccgaa

SEQ ID NO: 808466 - RNA, 13 nt, Mycobacterium avium subsp. paratuberculosis
augcgcgccacca

SEQ ID NO: 808467 - RNA, 20 nt, Mycobacterium avium subsp. paratuberculosis
augcgcgccaccaggcgguc

SEQ ID NO: 808468 - RNA, 17 nt, Mycobacterium avium subsp. paratuberculosis
augcgcgccuccgacga

SEQ ID NO: 808469 - RNA, 17 nt, Mycobacterium avium subsp. paratuberculosis
augccuuccucggcgcu

SEQ ID NO: 808470 - RNA, 12 nt, Mycobacterium avium subsp. paratuberculosis
augccuuggcgg

SEQ ID NO: 808471 - RNA, 16 nt, Mycobacterium avium subsp. paratuberculosis
augccuuucagcucga

SEQ ID NO: 808472 - RNA, 18 nt, Mycobacterium avium subsp. paratuberculosis
augccuaggggagcagca

SEQ ID NO: 808473 - RNA, 17 nt, Mycobacterium avium subsp. paratuberculosis
augccguugccaggccg

SEQ ID NO: 808474 - RNA, 20 nt, Mycobacterium avium subsp. paratuberculosis
augccucuucggcgcgccgg

SEQ ID NO: 808475 - RNA, 14 nt, Mycobacterium avium subsp. paratuberculosis
augcggaccgggga

SEQ ID NO: 808476 - RNA, 17 nt, Mycobacterium avium subsp. paratuberculosis
augcggaucucggugcc

SEQ ID NO: 808477 - RNA, 19 nt, Mycobacterium avium subsp. paratuberculosis
augcggaucucggugccgg

SEQ ID NO: 808478 - RNA, 15 nt, Mycobacterium avium subsp. paratuberculosis
augcggcaccagccc

SEQ ID NO: 808479 - RNA, 18 nt, Mycobacterium avium subsp. paratuberculosis
augcgcgugacgcgcgug

SEQ ID NO: 808480 - RNA, 13 nt, Mycobacterium avium subsp. paratuberculosis
augcgcggcccgu

SEQ ID NO: 808481 - RNA, 11 nt, Mycobacterium avium subsp. paratuberculosis
augcgcucggc

SEQ ID NO: 808482 - RNA, 17 nt, Mycobacterium avium subsp. paratuberculosis
augcgcucggcgaccug

SEQ ID NO: 808483 - RNA, 18 nt, Mycobacterium avium subsp. paratuberculosis
augccgcccaccaccggc

SEQ ID NO: 808484 - RNA, 19 nt, Mycobacterium avium subsp. paratuberculosis
augccgcccaccaccggcu

SEQ ID NO: 808485 - RNA, 16 nt, Mycobacterium avium subsp. paratuberculosis
augccgcccaggugca

SEQ ID NO: 808486 - RNA, 18 nt, Mycobacterium avium subsp. paratuberculosis
augccgccgaagcccgac

SEQ ID NO: 808487 - RNA, 19 nt, Mycobacterium avium subsp. paratuberculosis
augccgccgaagcccgaca

SEQ ID NO: 808488 - RNA, 17 nt, Mycobacterium avium subsp. paratuberculosis
augccgcccaucagcag

SEQ ID NO: 808489 - RNA, 13 nt, Mycobacterium avium subsp. paratuberculosis
augccgccgacga

SEQ ID NO: 808490 - RNA, 15 nt, Mycobacterium avium subsp. paratuberculosis
augccgccgacgaug

SEQ ID NO: 808491 - RNA, 13 nt, Mycobacterium avium subsp. paratuberculosis
augccgccgccag

SEQ ID NO: 808492 - RNA, 21 nt, Mycobacterium avium subsp. paratuberculosis
augccgcccuugcucgcggcg

SEQ ID NO: 808493 - RNA, 15 nt, Mycobacterium avium subsp. paratuberculosis
augccgcucggcgcu

SEQ ID NO: 808494 - RNA, 22 nt, Mycobacterium avium subsp. paratuberculosis
augccgcgggccagcagccggg

SEQ ID NO: 808495 - RNA, 16 nt, Mycobacterium avium subsp. paratuberculosis
augccgcguuccacgc

SEQ ID NO: 808496 - RNA, 14 nt, Mycobacterium avium subsp. paratuberculosis
augccgcgcaggcc

SEQ ID NO: 808497 - RNA, 20 nt, Mycobacterium avium subsp. paratuberculosis
augccgcgcaggccguccag

SEQ ID NO: 808498 - RNA, 14 nt, Mycobacterium avium subsp. paratuberculosis
augccgcgcggcgc

SEQ ID NO: 808499 - RNA, 15 nt, Mycobacterium avium subsp. paratuberculosis
augccgcgcggcgcc

SEQ ID NO: 808500 - RNA, 15 nt, Mycobacterium avium subsp. paratuberculosis
augccgcgcucgaac

SEQ ID NO: 808501 - RNA, 13 nt, Mycobacterium avium subsp. paratuberculosis
augccgcgcucgu

SEQ ID NO: 808502 - RNA, 12 nt, Mycobacterium avium subsp. paratuberculosis
augccgcagccg

SEQ ID NO: 808503 - RNA, 14 nt, Mycobacterium avium subsp. paratuberculosis
augccgcagccgau

SEQ ID NO: 808504 - RNA, 15 nt, Mycobacterium avium subsp. paratuberculosis
augccgcagccgauc

SEQ ID NO: 808505 - RNA, 19 nt, Mycobacterium avium subsp. paratuberculosis
augccgagcgccgcguuca

SEQ ID NO: 808506 - RNA, 19 nt, Mycobacterium avium subsp. paratuberculosis
augccgaggcacagcagca

SEQ ID NO: 808507 - RNA, 15 nt, Mycobacterium avium subsp. paratuberculosis
augccgaugcccauc

SEQ ID NO: 808508 - RNA, 15 nt, Mycobacterium avium subsp. paratuberculosis
augccgaucggggcg

SEQ ID NO: 808509 - RNA, 17 nt, Mycobacterium avium subsp. paratuberculosis
augccgacccgcugcag

SEQ ID NO: 808510 - RNA, 13 nt, Mycobacterium avium subsp. paratuberculosis
augccgaccgaca

SEQ ID NO: 808511 - RNA, 13 nt, Mycobacterium avium subsp. paratuberculosis
augccgagcagca

SEQ ID NO: 808512 - RNA, 21 nt, Mycobacterium avium subsp. paratuberculosis
augccgagcagcaccgcgacc

SEQ ID NO: 808513 - RNA, 19 nt, Mycobacterium avium subsp. paratuberculosis
augccgagcagcucggcgg

SEQ ID NO: 808514 - RNA, 21 nt, Mycobacterium avium subsp. paratuberculosis
augccgagcccuuugcgcugc

SEQ ID NO: 808515 - RNA, 22 nt, Mycobacterium avium subsp. paratuberculosis
augccgaaccgcuccccgagca

SEQ ID NO: 808516 - RNA, 19 nt, Mycobacterium avium subsp. paratuberculosis
augccgaacgucaccaaca

SEQ ID NO: 808517 - RNA, 15 nt, Mycobacterium avium subsp. paratuberculosis
augcccgugaucgcc

SEQ ID NO: 808518 - RNA, 23 nt, Mycobacterium avium subsp. paratuberculosis
augcccuuggcggccacgacggc

SEQ ID NO: 808519 - RNA, 16 nt, Mycobacterium avium subsp. paratuberculosis
augccgacaccccaca

SEQ ID NO: 808520 - RNA, 19 nt, Mycobacterium avium subsp. paratuberculosis
augccgacaccccacaccg

SEQ ID NO: 808521 - RNA, 14 nt, Mycobacterium avium subsp. paratuberculosis
augccgguguucaa

SEQ ID NO: 808522 - RNA, 16 nt, Mycobacterium avium subsp. paratuberculosis
augccguagaccagca

SEQ ID NO: 808523 - RNA, 21 nt, Mycobacterium avium subsp. paratuberculosis
augccguaaguggcgccgcgg

SEQ ID NO: 808524 - RNA, 13 nt, Mycobacterium avium subsp. paratuberculosis
augccgucgacga

SEQ ID NO: 808525 - RNA, 17 nt, Mycobacterium avium subsp. paratuberculosis
augccgugccagccggc

SEQ ID NO: 808526 - RNA, 13 nt, Mycobacterium avium subsp. paratuberculosis
augccgugccggu

SEQ ID NO: 808527 - RNA, 21 nt, Mycobacterium avium subsp. paratuberculosis
augccguuccagggugucgac

SEQ ID NO: 808528 - RNA, 16 nt, Mycobacterium avium subsp. paratuberculosis
augccguucgcgccgu

SEQ ID NO: 808529 - RNA, 18 nt, Mycobacterium avium subsp. paratuberculosis
augccgucggcgcccggc

SEQ ID NO: 808530 - RNA, 21 nt, Mycobacterium avium subsp. paratuberculosis
augccggcauccucggcgcgu

SEQ ID NO: 808531 - RNA, 16 nt, Mycobacterium avium subsp. paratuberculosis
augccggccaggcaca

SEQ ID NO: 808532 - RNA, 12 nt, Mycobacterium avium subsp. paratuberculosis
augccggccggc

SEQ ID NO: 808533 - RNA, 14 nt, Mycobacterium avium subsp. paratuberculosis
augccggccagccg

SEQ ID NO: 808534 - RNA, 14 nt, Mycobacterium avium subsp. paratuberculosis
augccggccagcgg

SEQ ID NO: 808535 - RNA, 20 nt, Mycobacterium avium subsp. paratuberculosis
augccggcaaccgcugcggu

SEQ ID NO: 808536 - RNA, 12 nt, Mycobacterium avium subsp. paratuberculosis
augccggagaug

SEQ ID NO: 808537 - RNA, 11 nt, Mycobacterium avium subsp. paratuberculosis
augccggaucg

SEQ ID NO: 808538 - RNA, 20 nt, Mycobacterium avium subsp. paratuberculosis
augccggaucgggaccggga

SEQ ID NO: 808539 - RNA, 20 nt, Mycobacterium avium subsp. paratuberculosis
augccgcuuuccaaccaggc

SEQ ID NO: 808540 - RNA, 20 nt, Mycobacterium avium subsp. paratuberculosis
augccggguuucggcccggc

SEQ ID NO: 808541 - RNA, 15 nt, Mycobacterium avium subsp. paratuberculosis
augccgguacggccg

SEQ ID NO: 808542 - RNA, 21 nt, Mycobacterium avium subsp. paratuberculosis
augccgggcuccgcguucgac

SEQ ID NO: 808543 - RNA, 22 nt, Mycobacterium avium subsp. paratuberculosis
augccgggcaaccacagcggcg

SEQ ID NO: 808544 - RNA, 22 nt, Mycobacterium avium subsp. paratuberculosis
augccgggugggcagccccagc

SEQ ID NO: 808545 - RNA, 18 nt, Mycobacterium avium subsp. paratuberculosis
augccggggcagcacccg

SEQ ID NO: 808546 - RNA, 20 nt, Mycobacterium avium subsp. paratuberculosis
augccggggcagcacccgca

SEQ ID NO: 808547 - RNA, 22 nt, Mycobacterium avium subsp. paratuberculosis
augccggggcagcacccgcacc

SEQ ID NO: 808548 - RNA, 21 nt, Mycobacterium avium subsp. paratuberculosis
augccggccuucucgcgcacc

SEQ ID NO: 808549 - RNA, 20 nt, Mycobacterium avium subsp. paratuberculosis
augccggcgaacucgcggcg

SEQ ID NO: 808550 - RNA, 18 nt, Mycobacterium avium subsp. paratuberculosis
augccggcgauccgcgcg

SEQ ID NO: 808551 - RNA, 20 nt, Mycobacterium avium subsp. paratuberculosis
augccggcgauccgcgcggc

SEQ ID NO: 808552 - RNA, 23 nt, Mycobacterium avium subsp. paratuberculosis
augccggcgauccgcgcggcgac

SEQ ID NO: 808553 - RNA, 17 nt, Mycobacterium avium subsp. paratuberculosis
augccggcgcccagcgg

SEQ ID NO: 808554 - RNA, 14 nt, Mycobacterium avium subsp. paratuberculosis
augccggccgggac

SEQ ID NO: 808555 - RNA, 16 nt, Mycobacterium avium subsp. paratuberculosis
augccggccggcacga

SEQ ID NO: 808556 - RNA, 19 nt, Mycobacterium avium subsp. paratuberculosis
augccggcgguaccgccga

SEQ ID NO: 808557 - RNA, 14 nt, Mycobacterium avium subsp. paratuberculosis
augccggcgguguc

SEQ ID NO: 808558 - RNA, 16 nt, Mycobacterium avium subsp. paratuberculosis
augaugaugccgccca

SEQ ID NO: 808559 - RNA, 19 nt, Mycobacterium avium subsp. paratuberculosis
augaugcccuuggcggcca

SEQ ID NO: 808560 - RNA, 18 nt, Mycobacterium avium subsp. paratuberculosis
augaucucguugcggcgc

SEQ ID NO: 808561 - RNA, 17 nt, Mycobacterium avium subsp. paratuberculosis
augaucgucucggccgc

SEQ ID NO: 808562 - RNA, 19 nt, Mycobacterium avium subsp. paratuberculosis
augagcgaggacgucgagc

SEQ ID NO: 808563 - RNA, 23 nt, Mycobacterium avium subsp. paratuberculosis
augagccuaugaggcgacccccg

SEQ ID NO: 808564 - RNA, 15 nt, Mycobacterium avium subsp. paratuberculosis
augagcccuccagcu

SEQ ID NO: 808565 - RNA, 17 nt, Mycobacterium avium subsp. paratuberculosis
augagcugggcggcgcg

SEQ ID NO: 808566 - RNA, 17 nt, Mycobacterium avium subsp. paratuberculosis
augagcuggugcagcga

SEQ ID NO: 808567 - RNA, 15 nt, Mycobacterium avium subsp. paratuberculosis
aucugaccgagcagc

SEQ ID NO: 808568 - RNA, 22 nt, Mycobacterium avium subsp. paratuberculosis
aucugcaggccgaggcugucgg

SEQ ID NO: 808569 - RNA, 23 nt, Mycobacterium avium subsp. paratuberculosis
aucugcagcacgcccagaucgac

SEQ ID NO: 808570 - RNA, 17 nt, Mycobacterium avium subsp. paratuberculosis
aucugccgggcggcgac

SEQ ID NO: 808571 - RNA, 19 nt, Mycobacterium avium subsp. paratuberculosis
aucugccggugccgccggc

SEQ ID NO: 808572 - RNA, 22 nt, Mycobacterium avium subsp. paratuberculosis
augacggccguacgcgguucgu

SEQ ID NO: 808573 - RNA, 22 nt, Mycobacterium avium subsp. paratuberculosis
augacguggcaacgugccacag

SEQ ID NO: 808574 - RNA, 14 nt, Mycobacterium avium subsp. paratuberculosis
augacguugcgcgc

SEQ ID NO: 808575 - RNA, 19 nt, Mycobacterium avium subsp. paratuberculosis
augacguccuugacccggc

SEQ ID NO: 808576 - RNA, 14 nt, Mycobacterium avium subsp. paratuberculosis
augacgucgcgcug

SEQ ID NO: 808577 - RNA, 21 nt, Mycobacterium avium subsp. paratuberculosis
augacggcggcggugccgcag

SEQ ID NO: 808578 - RNA, 16 nt, Mycobacterium avium subsp. paratuberculosis
augacggccugcacca

SEQ ID NO: 808579 - RNA, 22 nt, Mycobacterium avium subsp. paratuberculosis
augacggucugcaccgggauga

SEQ ID NO: 808580 - RNA, 17 nt, Mycobacterium avium subsp. paratuberculosis
augcacggucggccccg

SEQ ID NO: 808581 - RNA, 19 nt, Mycobacterium avium subsp. paratuberculosis
augcacccggacgugaucg

SEQ ID NO: 808582 - RNA, 15 nt, Mycobacterium avium subsp. paratuberculosis
augccagucaagcgc

SEQ ID NO: 808583 - RNA, 19 nt, Mycobacterium avium subsp. paratuberculosis
augccagcagguccgccgg

SEQ ID NO: 808584 - RNA, 15 nt, Mycobacterium avium subsp. paratuberculosis
augccagacgcgcac

SEQ ID NO: 808585 - RNA, 16 nt, Mycobacterium avium subsp. paratuberculosis
augccagacgcgcacc

SEQ ID NO: 808586 - RNA, 21 nt, Mycobacterium avium subsp. paratuberculosis
augccagacgcgcaccgccac

SEQ ID NO: 808587 - RNA, 15 nt, Mycobacterium avium subsp. paratuberculosis
augcccaccaucccg

SEQ ID NO: 808588 - RNA, 20 nt, Mycobacterium avium subsp. paratuberculosis
augcccaccaucccgccgcc

SEQ ID NO: 808589 - RNA, 14 nt, Mycobacterium avium subsp. paratuberculosis
augcccacccgcuc

SEQ ID NO: 808590 - RNA, 20 nt, Mycobacterium avium subsp. paratuberculosis
augccccguauugccgucgg

SEQ ID NO: 808591 - RNA, 13 nt, Mycobacterium avium subsp. paratuberculosis
augccccaggcga

SEQ ID NO: 808592 - RNA, 21 nt, Mycobacterium avium subsp. paratuberculosis
augccccaggugacgccgcac

SEQ ID NO: 808593 - RNA, 23 nt, Mycobacterium avium subsp. paratuberculosis
augcccccgaaaugcaucagcgu

SEQ ID NO: 808594 - RNA, 16 nt, Mycobacterium avium subsp. paratuberculosis
augcccgacaccgccc

SEQ ID NO: 808595 - RNA, 12 nt, Mycobacterium avium subsp. paratuberculosis
augcccaggccg

SEQ ID NO: 808596 - RNA, 19 nt, Mycobacterium avium subsp. paratuberculosis
augcccaggcccaccagcu

SEQ ID NO: 808597 - RNA, 16 nt, Mycobacterium avium subsp. paratuberculosis
augcccacgccgucga

SEQ ID NO: 808598 - RNA, 14 nt, Mycobacterium avium subsp. paratuberculosis
augcccagcagcgg

SEQ ID NO: 808599 - RNA, 23 nt, Mycobacterium avium subsp. paratuberculosis
augcccagcaguccggcggucag

SEQ ID NO: 808600 - RNA, 17 nt, Mycobacterium avium subsp. paratuberculosis
augcccgccacggccag

SEQ ID NO: 808601 - RNA, 22 nt, Mycobacterium avium subsp. paratuberculosis
augcccgccacggccagcaccg

SEQ ID NO: 808602 - RNA, 22 nt, Mycobacterium avium subsp. paratuberculosis
augcccgcccacgggucgccga

SEQ ID NO: 808603 - RNA, 18 nt, Mycobacterium avium subsp. paratuberculosis
augcccgccccgcccggc

SEQ ID NO: 808604 - RNA, 22 nt, Mycobacterium avium subsp. paratuberculosis
augcccgccccgcccggcggcc

SEQ ID NO: 808605 - RNA, 14 nt, Mycobacterium avium subsp. paratuberculosis
augcccgccccgga

SEQ ID NO: 808606 - RNA, 13 nt, Mycobacterium avium subsp. paratuberculosis
augcccgccgcgu

SEQ ID NO: 808607 - RNA, 17 nt, Mycobacterium avium subsp. paratuberculosis
augcccgccgcgucagc

SEQ ID NO: 808608 - RNA, 22 nt, Mycobacterium avium subsp. paratuberculosis
augcccgccgcgucagcggcgg

SEQ ID NO: 808609 - RNA, 21 nt, Mycobacterium avium subsp. paratuberculosis
augcccgccgcugacgcggcg

SEQ ID NO: 808610 - RNA, 18 nt, Mycobacterium avium subsp. paratuberculosis
augcccgcgaacgccucg

SEQ ID NO: 808611 - RNA, 13 nt, Mycobacterium avium subsp. paratuberculosis
augcccgcgccga

SEQ ID NO: 808612 - RNA, 14 nt, Mycobacterium avium subsp. paratuberculosis
augcccgcgccgac

SEQ ID NO: 808613 - RNA, 21 nt, Mycobacterium avium subsp. paratuberculosis
augcccgcguccugcagcgcc

SEQ ID NO: 808614 - RNA, 17 nt, Mycobacterium avium subsp. paratuberculosis
augcccguagaugccgg

SEQ ID NO: 808615 - RNA, 17 nt, Mycobacterium avium subsp. paratuberculosis
augcccgucacggccgu

SEQ ID NO: 808616 - RNA, 18 nt, Mycobacterium avium subsp. paratuberculosis
augcccgucacggccguc

SEQ ID NO: 808617 - RNA, 16 nt, Mycobacterium avium subsp. paratuberculosis
augcccggcgacggcg

SEQ ID NO: 808618 - RNA, 18 nt, Mycobacterium avium subsp. paratuberculosis
augcccggcgacggcgcc

SEQ ID NO: 808619 - RNA, 22 nt, Mycobacterium avium subsp. paratuberculosis
augcccgggccgucaucgccga

SEQ ID NO: 808620 - RNA, 21 nt, Mycobacterium avium subsp. paratuberculosis
augcccgggccguccgggugc

SEQ ID NO: 808621 - RNA, 18 nt, Mycobacterium avium subsp. paratuberculosis
augcccgggcgacuucgu

SEQ ID NO: 808622 - RNA, 15 nt, Mycobacterium avium subsp. paratuberculosis
aucgcggcggucagg

SEQ ID NO: 808623 - RNA, 13 nt, Mycobacterium avium subsp. paratuberculosis
aucgcggcggcgu

SEQ ID NO: 808624 - RNA, 20 nt, Mycobacterium avium subsp. paratuberculosis
aucgcgggaucggccggcga

SEQ ID NO: 808625 - RNA, 19 nt, Mycobacterium avium subsp. paratuberculosis
aucgcgggccaccggcgcc

SEQ ID NO: 808626 - RNA, 14 nt, Mycobacterium avium subsp. paratuberculosis
aucgcgggcgaccc

SEQ ID NO: 808627 - RNA, 14 nt, Mycobacterium avium subsp. paratuberculosis
aucgcggcgcugcc

SEQ ID NO: 808628 - RNA, 16 nt, Mycobacterium avium subsp. paratuberculosis
aucgcggugacgcgcc

SEQ ID NO: 808629 - RNA, 14 nt, Mycobacterium avium subsp. paratuberculosis
aucgcgguggcgcc

SEQ ID NO: 808630 - RNA, 17 nt, Mycobacterium avium subsp. paratuberculosis
aucgcgguggcgcccgc

SEQ ID NO: 808631 - RNA, 19 nt, Mycobacterium avium subsp. paratuberculosis
aucgcggcggacagcacgu

SEQ ID NO: 808632 - RNA, 12 nt, Mycobacterium avium subsp. paratuberculosis
aucgcggcggcg

SEQ ID NO: 808633 - RNA, 14 nt, Mycobacterium avium subsp. paratuberculosis
aucgcggccggcga

SEQ ID NO: 808634 - RNA, 22 nt, Mycobacterium avium subsp. paratuberculosis
aucgcggccggcgagucgcgga

SEQ ID NO: 808635 - RNA, 20 nt, Mycobacterium avium subsp. paratuberculosis
aucgcggcgaacaacgccac

SEQ ID NO: 808636 - RNA, 22 nt, Mycobacterium avium subsp. paratuberculosis
aucgcgagggccguugcggcca

SEQ ID NO: 808637 - RNA, 16 nt, Mycobacterium avium subsp. paratuberculosis
aucgcggcgacccgcu

SEQ ID NO: 808638 - RNA, 13 nt, Mycobacterium avium subsp. paratuberculosis
aucgcggcgagca

SEQ ID NO: 808639 - RNA, 15 nt, Mycobacterium avium subsp. paratuberculosis
aucgcggcgagcagc

SEQ ID NO: 808640 - RNA, 20 nt, Mycobacterium avium subsp. paratuberculosis
aucgcggcgagcagcgcgau

SEQ ID NO: 808641 - RNA, 12 nt, Mycobacterium avium subsp. paratuberculosis
aucgcggcgauc

SEQ ID NO: 808642 - RNA, 18 nt, Mycobacterium avium subsp. paratuberculosis
aucgcggcgaucagcccg

SEQ ID NO: 808643 - RNA, 23 nt, Mycobacterium avium subsp. paratuberculosis
aucgcuugcgccgcagcggugau

SEQ ID NO: 808644 - RNA, 16 nt, Mycobacterium avium subsp. paratuberculosis
aucgcgugcgucacgc

SEQ ID NO: 808645 - RNA, 13 nt, Mycobacterium avium subsp. paratuberculosis
aucgcgugccgac

SEQ ID NO: 808646 - RNA, 16 nt, Mycobacterium avium subsp. paratuberculosis
aucgcgugccgaccag

SEQ ID NO: 808647 - RNA, 17 nt, Mycobacterium avium subsp. paratuberculosis
aucgcgucgaugccggc

SEQ ID NO: 808648 - RNA, 19 nt, Mycobacterium avium subsp. paratuberculosis
aucgcgucgaugccggcga

SEQ ID NO: 808649 - RNA, 20 nt, Mycobacterium avium subsp. paratuberculosis
aucgcgucgacggcgccgga

SEQ ID NO: 808650 - RNA, 18 nt, Mycobacterium avium subsp. paratuberculosis
aucgcgucaaccaccggc

SEQ ID NO: 808651 - RNA, 17 nt, Mycobacterium avium subsp. paratuberculosis
aucgcggugaccgccgc

SEQ ID NO: 808652 - RNA, 21 nt, Mycobacterium avium subsp. paratuberculosis
aucgcggugaccgccgccauc

SEQ ID NO: 808653 - RNA, 16 nt, Mycobacterium avium subsp. paratuberculosis
aucgcguagcgccggu

SEQ ID NO: 808654 - RNA, 15 nt, Mycobacterium avium subsp. paratuberculosis
aucgcgaccaccggc

SEQ ID NO: 808655 - RNA, 16 nt, Mycobacterium avium subsp. paratuberculosis
aucgcgaccaccggcc

SEQ ID NO: 808656 - RNA, 15 nt, Mycobacterium avium subsp. paratuberculosis
aucgcgagcagggcg

SEQ ID NO: 808657 - RNA, 21 nt, Mycobacterium avium subsp. paratuberculosis
aucgcgagcagggcgggcagg

SEQ ID NO: 808658 - RNA, 22 nt, Mycobacterium avium subsp. paratuberculosis
aucgcgagcagggcgggcaggc

SEQ ID NO: 808659 - RNA, 18 nt, Mycobacterium avium subsp. paratuberculosis
aucgcgacggccggggcc

SEQ ID NO: 808660 - RNA, 15 nt, Mycobacterium avium subsp. paratuberculosis
aucgccuuggcucgg

SEQ ID NO: 808661 - RNA, 19 nt, Mycobacterium avium subsp. paratuberculosis
aucgccuuggcucgggcca

SEQ ID NO: 808662 - RNA, 17 nt, Mycobacterium avium subsp. paratuberculosis
aucgcgaacgcgccggu

SEQ ID NO: 808663 - RNA, 19 nt, Mycobacterium avium subsp. paratuberculosis
aucgcgaagaccagcgugu

SEQ ID NO: 808664 - RNA, 16 nt, Mycobacterium avium subsp. paratuberculosis
aucgccucggucgcgu

SEQ ID NO: 808665 - RNA, 19 nt, Mycobacterium avium subsp. paratuberculosis
aucgccucggucgcgugac

SEQ ID NO: 808666 - RNA, 23 nt, Mycobacterium avium subsp. paratuberculosis
aucgccgaaccgggcgcgcagau

SEQ ID NO: 808667 - RNA, 17 nt, Mycobacterium avium subsp. paratuberculosis
aucgccgaacgccucga

SEQ ID NO: 808668 - RNA, 16 nt, Mycobacterium avium subsp. paratuberculosis
aucgccgacggugagc

SEQ ID NO: 808669 - RNA, 23 nt, Mycobacterium avium subsp. paratuberculosis
aucgccgacgacgaagacguacg

SEQ ID NO: 808670 - RNA, 16 nt, Mycobacterium avium subsp. paratuberculosis
aucgccgacgccagca

SEQ ID NO: 808671 - RNA, 15 nt, Mycobacterium avium subsp. paratuberculosis
aucgccgagcgcauc

SEQ ID NO: 808672 - RNA, 14 nt, Mycobacterium avium subsp. paratuberculosis
aucgccgagcucga

SEQ ID NO: 808673 - RNA, 17 nt, Mycobacterium avium subsp. paratuberculosis
aucgccgauccggcgcc

SEQ ID NO: 808674 - RNA, 19 nt, Mycobacterium avium subsp. paratuberculosis
aucgccgauccggcgccgc

SEQ ID NO: 808675 - RNA, 23 nt, Mycobacterium avium subsp. paratuberculosis
aucgccgauccggcgccgcgggc

SEQ ID NO: 808676 - RNA, 18 nt, Mycobacterium avium subsp. paratuberculosis
aucgccgagggcgacgau

SEQ ID NO: 808677 - RNA, 20 nt, Mycobacterium avium subsp. paratuberculosis
aucgccgagguagccgcgca

SEQ ID NO: 808678 - RNA, 15 nt, Mycobacterium avium subsp. paratuberculosis
aucgccuccgucagc

SEQ ID NO: 808679 - RNA, 21 nt, Mycobacterium avium subsp. paratuberculosis
aucgccuccgucagcgccgcc

SEQ ID NO: 808680 - RNA, 19 nt, Mycobacterium avium subsp. paratuberculosis
aucgccucgaccagcaccg

SEQ ID NO: 808681 - RNA, 14 nt, Mycobacterium avium subsp. paratuberculosis
aucgccucggccgc

SEQ ID NO: 808682 - RNA, 16 nt, Mycobacterium avium subsp. paratuberculosis
aucgccucggccgcgg

SEQ ID NO: 808683 - RNA, 16 nt, Mycobacterium avium subsp. paratuberculosis
aucgccucggcggccg

SEQ ID NO: 808684 - RNA, 17 nt, Mycobacterium avium subsp. paratuberculosis
aucgccucggcggccgc

SEQ ID NO: 808685 - RNA, 20 nt, Mycobacterium avium subsp. paratuberculosis
aucgccucggcggccgcccg

SEQ ID NO: 808686 - RNA, 20 nt, Mycobacterium avium subsp. paratuberculosis
aucgauaacgcgcgcgccgu

SEQ ID NO: 808687 - RNA, 23 nt, Mycobacterium avium subsp. paratuberculosis
aucgaggugauguuggccgcgac

SEQ ID NO: 808688 - RNA, 17 nt, Mycobacterium avium subsp. paratuberculosis
aucgagucccgcgcggc

SEQ ID NO: 808689 - RNA, 18 nt, Mycobacterium avium subsp. paratuberculosis
aucgagucccgcgcggcg

SEQ ID NO: 808690 - RNA, 22 nt, Mycobacterium avium subsp. paratuberculosis
aucgaggaucucccggguggcc

SEQ ID NO: 808691 - RNA, 21 nt, Mycobacterium avium subsp. paratuberculosis
auccguccuuggugauuucgc

SEQ ID NO: 808692 - RNA, 17 nt, Mycobacterium avium subsp. paratuberculosis
auccgucgccccgcacc

SEQ ID NO: 808693 - RNA, 19 nt, Mycobacterium avium subsp. paratuberculosis
auccgucugcucccaggac

SEQ ID NO: 808694 - RNA, 15 nt, Mycobacterium avium subsp. paratuberculosis
aucgagggcgcgcag

SEQ ID NO: 808695 - RNA, 16 nt, Mycobacterium avium subsp. paratuberculosis
aucgagggcgcgcagc

SEQ ID NO: 808696 - RNA, 18 nt, Mycobacterium avium subsp. paratuberculosis
aucgagguagcgugcgcc

SEQ ID NO: 808697 - RNA, 17 nt, Mycobacterium avium subsp. paratuberculosis
aucgaggucgaaccacg

SEQ ID NO: 808698 - RNA, 22 nt, Mycobacterium avium subsp. paratuberculosis
aucgaggucgaaccacgcggcg

SEQ ID NO: 808699 - RNA, 19 nt, Mycobacterium avium subsp. paratuberculosis
aucgaguaguccgggauga

SEQ ID NO: 808700 - RNA, 21 nt, Mycobacterium avium subsp. paratuberculosis
aucgauggcgggcgcgccggc

SEQ ID NO: 808701 - RNA, 14 nt, Mycobacterium avium subsp. paratuberculosis
aucgauggcggugu

SEQ ID NO: 808702 - RNA, 13 nt, Mycobacterium avium subsp. paratuberculosis
aucgcaaaccgcg

SEQ ID NO: 808703 - RNA, 16 nt, Mycobacterium avium subsp. paratuberculosis
aucgaugcccagcgcg

SEQ ID NO: 808704 - RNA, 12 nt, Mycobacterium avium subsp. paratuberculosis
aucgaugccggc

SEQ ID NO: 808705 - RNA, 18 nt, Mycobacterium avium subsp. paratuberculosis
aucgaugccggcaaccgc

SEQ ID NO: 808706 - RNA, 15 nt, Mycobacterium avium subsp. paratuberculosis
aucgaucaucgccuc

SEQ ID NO: 808707 - RNA, 21 nt, Mycobacterium avium subsp. paratuberculosis
aucgaucccuuggcggcggcc

SEQ ID NO: 808708 - RNA, 23 nt, Mycobacterium avium subsp. paratuberculosis
aucgaucccuuggcggcggccag

SEQ ID NO: 808709 - RNA, 16 nt, Mycobacterium avium subsp. paratuberculosis
aucgaucagccgcgac

SEQ ID NO: 808710 - RNA, 17 nt, Mycobacterium avium subsp. paratuberculosis
aucgaucagccgcgaca

SEQ ID NO: 808711 - RNA, 16 nt, Mycobacterium avium subsp. paratuberculosis
aucgcacccaucccca

SEQ ID NO: 808712 - RNA, 12 nt, Mycobacterium avium subsp. paratuberculosis
aucgcaccggcg

SEQ ID NO: 808713 - RNA, 14 nt, Mycobacterium avium subsp. paratuberculosis
aucgcaccggcgcc

SEQ ID NO: 808714 - RNA, 17 nt, Mycobacterium avium subsp. paratuberculosis
aucgcagcgcgcggcgc

SEQ ID NO: 808715 - RNA, 21 nt, Mycobacterium avium subsp. paratuberculosis
aucgcagcgcgcggcgcagau

SEQ ID NO: 808716 - RNA, 22 nt, Mycobacterium avium subsp. paratuberculosis
aucgcaucgggcgacaucucgg

SEQ ID NO: 808717 - RNA, 18 nt, Mycobacterium avium subsp. paratuberculosis
aucgccaucagcagcgcc

SEQ ID NO: 808718 - RNA, 22 nt, Mycobacterium avium subsp. paratuberculosis
aucgcccggugcgccagcguga

SEQ ID NO: 808719 - RNA, 17 nt, Mycobacterium avium subsp. paratuberculosis
aucgccaguccggcgcc

SEQ ID NO: 808720 - RNA, 20 nt, Mycobacterium avium subsp. paratuberculosis
aucgccaggcguugcaccgc

SEQ ID NO: 808721 - RNA, 23 nt, Mycobacterium avium subsp. paratuberculosis
aucgccagcgcccccagcggggc

SEQ ID NO: 808722 - RNA, 13 nt, Mycobacterium avium subsp. paratuberculosis
aucgccagcgcgc

SEQ ID NO: 808723 - RNA, 22 nt, Mycobacterium avium subsp. paratuberculosis
aucgccagcgcggugucgacgu

SEQ ID NO: 808724 - RNA, 16 nt, Mycobacterium avium subsp. paratuberculosis
aucgccacgccgacca

SEQ ID NO: 808725 - RNA, 13 nt, Mycobacterium avium subsp. paratuberculosis
aucgccaccacca

SEQ ID NO: 808726 - RNA, 21 nt, Mycobacterium avium subsp. paratuberculosis
aucgccagcccggcguacagc

SEQ ID NO: 808727 - RNA, 22 nt, Mycobacterium avium subsp. paratuberculosis
aucgccagcaacgacccggcca

SEQ ID NO: 808728 - RNA, 19 nt, Mycobacterium avium subsp. paratuberculosis
aucgccagcaccggcgcgc

SEQ ID NO: 808729 - RNA, 20 nt, Mycobacterium avium subsp. paratuberculosis
aucgccagcaccggcgcgcc

SEQ ID NO: 808730 - RNA, 13 nt, Mycobacterium avium subsp. paratuberculosis
aucgccacccgca

SEQ ID NO: 808731 - RNA, 23 nt, Mycobacterium avium subsp. paratuberculosis
aucgccaccgagaucaugccggc

SEQ ID NO: 808732 - RNA, 18 nt, Mycobacterium avium subsp. paratuberculosis
aucgggugagacggccag

SEQ ID NO: 808733 - RNA, 20 nt, Mycobacterium avium subsp. paratuberculosis
aucgggugagacggccagca

SEQ ID NO: 808734 - RNA, 21 nt, Mycobacterium avium subsp. paratuberculosis
aucgggugagacggccagcag

SEQ ID NO: 808735 - RNA, 23 nt, Mycobacterium avium subsp. paratuberculosis
aucgguccggcgaauccgaccgg

SEQ ID NO: 808736 - RNA, 22 nt, Mycobacterium avium subsp. paratuberculosis
aucgggcgcagaaaaaggccgc

SEQ ID NO: 808737 - RNA, 22 nt, Mycobacterium avium subsp. paratuberculosis
aucgggcgcagguccacccgcc

SEQ ID NO: 808738 - RNA, 21 nt, Mycobacterium avium subsp. paratuberculosis
aucgggcguugcgccgcgagc

SEQ ID NO: 808739 - RNA, 18 nt, Mycobacterium avium subsp. paratuberculosis
aucgggcuggguccgauu

SEQ ID NO: 808740 - RNA, 20 nt, Mycobacterium avium subsp. paratuberculosis
aucggggaauccuggccgau

SEQ ID NO: 808741 - RNA, 18 nt, Mycobacterium avium subsp. paratuberculosis
aucggggauguaugcggu

SEQ ID NO: 808742 - RNA, 17 nt, Mycobacterium avium subsp. paratuberculosis
aucggggcgcagcccgg

SEQ ID NO: 808743 - RNA, 18 nt, Mycobacterium avium subsp. paratuberculosis
aucggggugccgccgggg

SEQ ID NO: 808744 - RNA, 21 nt, Mycobacterium avium subsp. paratuberculosis
aucgggguuccaccguucggg

SEQ ID NO: 808745 - RNA, 16 nt, Mycobacterium avium subsp. paratuberculosis
aucgggucaccggccg

SEQ ID NO: 808746 - RNA, 19 nt, Mycobacterium avium subsp. paratuberculosis
aucgggucaccggccgagc

SEQ ID NO: 808747 - RNA, 17 nt, Mycobacterium avium subsp. paratuberculosis
aucggguccagcgccga

SEQ ID NO: 808748 - RNA, 14 nt, Mycobacterium avium subsp. paratuberculosis
aucgggucccagau

SEQ ID NO: 808749 - RNA, 20 nt, Mycobacterium avium subsp. paratuberculosis
aucgggucguagagcgcgaa

SEQ ID NO: 808750 - RNA, 14 nt, Mycobacterium avium subsp. paratuberculosis
aucggugaacccgc

SEQ ID NO: 808751 - RNA, 15 nt, Mycobacterium avium subsp. paratuberculosis
aucggugaacccgcc

SEQ ID NO: 808752 - RNA, 14 nt, Mycobacterium avium subsp. paratuberculosis
aucggugaagccga

SEQ ID NO: 808753 - RNA, 17 nt, Mycobacterium avium subsp. paratuberculosis
aucggugaagcggcgcg

SEQ ID NO: 808754 - RNA, 18 nt, Mycobacterium avium subsp. paratuberculosis
aucggugaccgucgccga

SEQ ID NO: 808755 - RNA, 21 nt, Mycobacterium avium subsp. paratuberculosis
aucggugaccgucgccgacca

SEQ ID NO: 808756 - RNA, 20 nt, Mycobacterium avium subsp. paratuberculosis
aucgguggcaccccgcgccg

SEQ ID NO: 808757 - RNA, 22 nt, Mycobacterium avium subsp. paratuberculosis
aucgguggcaccccgcgccggg

SEQ ID NO: 808758 - RNA, 14 nt, Mycobacterium avium subsp. paratuberculosis
aucggugccgacgg

SEQ ID NO: 808759 - RNA, 18 nt, Mycobacterium avium subsp. paratuberculosis
aucggugccgacggugcg

SEQ ID NO: 808760 - RNA, 14 nt, Mycobacterium avium subsp. paratuberculosis
aucggugaucacga

SEQ ID NO: 808761 - RNA, 18 nt, Mycobacterium avium subsp. paratuberculosis
aucggugcaggccgcgac

SEQ ID NO: 808762 - RNA, 19 nt, Mycobacterium avium subsp. paratuberculosis
aucggcagcccggaggcga

SEQ ID NO: 808763 - RNA, 14 nt, Mycobacterium avium subsp. paratuberculosis
aucggcagcgcgcc

SEQ ID NO: 808764 - RNA, 16 nt, Mycobacterium avium subsp. paratuberculosis
aucggcagcgcgcccu

SEQ ID NO: 808765 - RNA, 13 nt, Mycobacterium avium subsp. paratuberculosis
aucggacccagcc

SEQ ID NO: 808766 - RNA, 15 nt, Mycobacterium avium subsp. paratuberculosis
aucggacccagcccg

SEQ ID NO: 808767 - RNA, 16 nt, Mycobacterium avium subsp. paratuberculosis
aucggacccagcccga

SEQ ID NO: 808768 - RNA, 16 nt, Mycobacterium avium subsp. paratuberculosis
aucggacccagcccgg

SEQ ID NO: 808769 - RNA, 18 nt, Mycobacterium avium subsp. paratuberculosis
aucggacccagcccggcg

SEQ ID NO: 808770 - RNA, 17 nt, Mycobacterium avium subsp. paratuberculosis
aucggcaguccgcgccg

SEQ ID NO: 808771 - RNA, 12 nt, Mycobacterium avium subsp. paratuberculosis
aucggcaggucg

SEQ ID NO: 808772 - RNA, 22 nt, Mycobacterium avium subsp. paratuberculosis
aucggcaggauccggucgauca

SEQ ID NO: 808773 - RNA, 18 nt, Mycobacterium avium subsp. paratuberculosis
aucggcaucgcgcgcggc

SEQ ID NO: 808774 - RNA, 20 nt, Mycobacterium avium subsp. paratuberculosis
aucggcaucgcgcgcggcga

SEQ ID NO: 808775 - RNA, 21 nt, Mycobacterium avium subsp. paratuberculosis
aucggcaucgcgcgcggcgac

SEQ ID NO: 808776 - RNA, 22 nt, Mycobacterium avium subsp. paratuberculosis
aucgggaugucgugggcgugcc

SEQ ID NO: 808777 - RNA, 17 nt, Mycobacterium avium subsp. paratuberculosis
aucgggauuggcggcca

SEQ ID NO: 808778 - RNA, 18 nt, Mycobacterium avium subsp. paratuberculosis
aucgggcgcucggccagc

SEQ ID NO: 808779 - RNA, 15 nt, Mycobacterium avium subsp. paratuberculosis
aucggccagccacgc

SEQ ID NO: 808780 - RNA, 20 nt, Mycobacterium avium subsp. paratuberculosis
aucggccagccacgccgaca

SEQ ID NO: 808781 - RNA, 20 nt, Mycobacterium avium subsp. paratuberculosis
aucggccagcgcggccgggc

SEQ ID NO: 808782 - RNA, 15 nt, Mycobacterium avium subsp. paratuberculosis
aucggcuggucggcg

SEQ ID NO: 808783 - RNA, 17 nt, Mycobacterium avium subsp. paratuberculosis
aucggcuggucggcggc

SEQ ID NO: 808784 - RNA, 23 nt, Mycobacterium avium subsp. paratuberculosis
aucggcuuggggaagccggccag

SEQ ID NO: 808785 - RNA, 18 nt, Mycobacterium avium subsp. paratuberculosis
aucggcuuggugggcgcc

SEQ ID NO: 808786 - RNA, 21 nt, Mycobacterium avium subsp. paratuberculosis
aucggcuuggugggcgccggc

SEQ ID NO: 808787 - RNA, 22 nt, Mycobacterium avium subsp. paratuberculosis
aucggcuuggugggcgccggcg

SEQ ID NO: 808788 - RNA, 16 nt, Mycobacterium avium subsp. paratuberculosis
aucgggaacagcccgc

SEQ ID NO: 808789 - RNA, 21 nt, Mycobacterium avium subsp. paratuberculosis
aucuccaccgagugcggcgcg

SEQ ID NO: 808790 - RNA, 14 nt, Mycobacterium avium subsp. paratuberculosis
aucucaccggcggc

SEQ ID NO: 808791 - RNA, 16 nt, Mycobacterium avium subsp. paratuberculosis
aucucaccggcggcgg

SEQ ID NO: 808792 - RNA, 17 nt, Mycobacterium avium subsp. paratuberculosis
aucucaccggcggcggc

SEQ ID NO: 808793 - RNA, 17 nt, Mycobacterium avium subsp. paratuberculosis
aucguucccugcgcggc

SEQ ID NO: 808794 - RNA, 18 nt, Mycobacterium avium subsp. paratuberculosis
aucucgugccgcacccga

SEQ ID NO: 808795 - RNA, 15 nt, Mycobacterium avium subsp. paratuberculosis
aucucuucgccggac

SEQ ID NO: 808796 - RNA, 19 nt, Mycobacterium avium subsp. paratuberculosis
aucucguagguggccagca

SEQ ID NO: 808797 - RNA, 17 nt, Mycobacterium avium subsp. paratuberculosis
aucucggugguggccau

SEQ ID NO: 808798 - RNA, 13 nt, Mycobacterium avium subsp. paratuberculosis
aucuccagcagcu

SEQ ID NO: 808799 - RNA, 15 nt, Mycobacterium avium subsp. paratuberculosis
aucuccagccggcga

SEQ ID NO: 808800 - RNA, 14 nt, Mycobacterium avium subsp. paratuberculosis
aucucguugcggcg

SEQ ID NO: 808801 - RNA, 16 nt, Mycobacterium avium subsp. paratuberculosis
aucucguugcggcgca

SEQ ID NO: 808802 - RNA, 22 nt, Mycobacterium avium subsp. paratuberculosis
aucucgucgcacaaccgggcca

SEQ ID NO: 808803 - RNA, 15 nt, Mycobacterium avium subsp. paratuberculosis
aucucgucgcgcagc

SEQ ID NO: 808804 - RNA, 16 nt, Mycobacterium avium subsp. paratuberculosis
aucucgucgcgcagcu

SEQ ID NO: 808805 - RNA, 18 nt, Mycobacterium avium subsp. paratuberculosis
aucucgucgcggcugccg

SEQ ID NO: 808806 - RNA, 13 nt, Mycobacterium avium subsp. paratuberculosis
aucucgucggcgg

SEQ ID NO: 808807 - RNA, 16 nt, Mycobacterium avium subsp. paratuberculosis
aucucgucggcggcgg

SEQ ID NO: 808808 - RNA, 15 nt, Mycobacterium avium subsp. paratuberculosis
aucucgucggggcgc

SEQ ID NO: 808809 - RNA, 18 nt, Mycobacterium avium subsp. paratuberculosis
aucguccacaccgggaag

SEQ ID NO: 808810 - RNA, 18 nt, Mycobacterium avium subsp. paratuberculosis
aucgucaugccuuggccg

SEQ ID NO: 808811 - RNA, 19 nt, Mycobacterium avium subsp. paratuberculosis
aucgucgaacucgggcccg

SEQ ID NO: 808812 - RNA, 22 nt, Mycobacterium avium subsp. paratuberculosis
aucgucaaagccguucgcgccg

SEQ ID NO: 808813 - RNA, 23 nt, Mycobacterium avium subsp. paratuberculosis
aucgucaccgaccccucggcggc

SEQ ID NO: 808814 - RNA, 21 nt, Mycobacterium avium subsp. paratuberculosis
aucgucaccucgagcacucgc

SEQ ID NO: 808815 - RNA, 19 nt, Mycobacterium avium subsp. paratuberculosis
aucgucaggucuucggucg

SEQ ID NO: 808816 - RNA, 21 nt, Mycobacterium avium subsp. paratuberculosis
aucgucaggucuucggucgcg

SEQ ID NO: 808817 - RNA, 23 nt, Mycobacterium avium subsp. paratuberculosis
aucguguggccgcccucgcugcc

SEQ ID NO: 808818 - RNA, 19 nt, Mycobacterium avium subsp. paratuberculosis
aucguguccgcgccggcgc

SEQ ID NO: 808819 - RNA, 20 nt, Mycobacterium avium subsp. paratuberculosis
aucguguccgcgccggcgca

SEQ ID NO: 808820 - RNA, 20 nt, Mycobacterium avium subsp. paratuberculosis
aucguggcuuucggcgccaa

SEQ ID NO: 808821 - RNA, 14 nt, Mycobacterium avium subsp. paratuberculosis
aucguggccgcgua

SEQ ID NO: 808822 - RNA, 20 nt, Mycobacterium avium subsp. paratuberculosis
aucgucggcacugcccgcau

SEQ ID NO: 808823 - RNA, 16 nt, Mycobacterium avium subsp. paratuberculosis
aucgucggcagcgacg

SEQ ID NO: 808824 - RNA, 17 nt, Mycobacterium avium subsp. paratuberculosis
aucgucggcagcgacgc

SEQ ID NO: 808825 - RNA, 16 nt, Mycobacterium avium subsp. paratuberculosis
aucgucggccacgcuc

SEQ ID NO: 808826 - RNA, 16 nt, Mycobacterium avium subsp. paratuberculosis
aucgucgggcaccagc

SEQ ID NO: 808827 - RNA, 16 nt, Mycobacterium avium subsp. paratuberculosis
aucgucgggccggauc

SEQ ID NO: 808828 - RNA, 19 nt, Mycobacterium avium subsp. paratuberculosis
aucgucgucccgucggcgc

SEQ ID NO: 808829 - RNA, 11 nt, Mycobacterium avium subsp. paratuberculosis
aucgucgccgg

SEQ ID NO: 808830 - RNA, 14 nt, Mycobacterium avium subsp. paratuberculosis
aucgucgcggcggu

SEQ ID NO: 808831 - RNA, 15 nt, Mycobacterium avium subsp. paratuberculosis
auccacccaccggca

SEQ ID NO: 808832 - RNA, 23 nt, Mycobacterium avium subsp. paratuberculosis
auccacagcgguucggcgacgcu

SEQ ID NO: 808833 - RNA, 17 nt, Mycobacterium avium subsp. paratuberculosis
auccacgaugccgggca

SEQ ID NO: 808834 - RNA, 23 nt, Mycobacterium avium subsp. paratuberculosis
auccaaggagaaggccgcgcgca

SEQ ID NO: 808835 - RNA, 20 nt, Mycobacterium avium subsp. paratuberculosis
aucaugcgcgucauggccgu

SEQ ID NO: 808836 - RNA, 23 nt, Mycobacterium avium subsp. paratuberculosis
aucauggugaaggcgaacaccag

SEQ ID NO: 808837 - RNA, 22 nt, Mycobacterium avium subsp. paratuberculosis
aucaugucgaugccgagccggc

SEQ ID NO: 808838 - RNA, 12 nt, Mycobacterium avium subsp. paratuberculosis
aucaugucgucc

SEQ ID NO: 808839 - RNA, 18 nt, Mycobacterium avium subsp. paratuberculosis
aucaucgccccggagaug

SEQ ID NO: 808840 - RNA, 22 nt, Mycobacterium avium subsp. paratuberculosis
aucaucuggcuggugauggcca

SEQ ID NO: 808841 - RNA, 20 nt, Mycobacterium avium subsp. paratuberculosis
aucaugcguuugccgucgag

SEQ ID NO: 808842 - RNA, 13 nt, Mycobacterium avium subsp. paratuberculosis
aucauccggcggg

SEQ ID NO: 808843 - RNA, 14 nt, Mycobacterium avium subsp. paratuberculosis
aucauccggcgggg

SEQ ID NO: 808844 - RNA, 23 nt, Mycobacterium avium subsp. paratuberculosis
aucauccaggugaacagcagcca

SEQ ID NO: 808845 - RNA, 13 nt, Mycobacterium avium subsp. paratuberculosis
aucaucccggcca

SEQ ID NO: 808846 - RNA, 21 nt, Mycobacterium avium subsp. paratuberculosis
aucaucgcuacaccccaccgg

SEQ ID NO: 808847 - RNA, 21 nt, Mycobacterium avium subsp. paratuberculosis
aucaucaccaccgccgccgac

SEQ ID NO: 808848 - RNA, 19 nt, Mycobacterium avium subsp. paratuberculosis
aucaguuccuugauccggc

SEQ ID NO: 808849 - RNA, 14 nt, Mycobacterium avium subsp. paratuberculosis
aucagugaccgcac

SEQ ID NO: 808850 - RNA, 21 nt, Mycobacterium avium subsp. paratuberculosis
aucaggcgcagcccgagcggc

SEQ ID NO: 808851 - RNA, 18 nt, Mycobacterium avium subsp. paratuberculosis
aucagggccgcggccgcc

SEQ ID NO: 808852 - RNA, 14 nt, Mycobacterium avium subsp. paratuberculosis
aucagggcggcgcc

SEQ ID NO: 808853 - RNA, 14 nt, Mycobacterium avium subsp. paratuberculosis
aucagggcggcgcg

SEQ ID NO: 808854 - RNA, 19 nt, Mycobacterium avium subsp. paratuberculosis
aucagggcggcgcgcgcca

SEQ ID NO: 808855 - RNA, 23 nt, Mycobacterium avium subsp. paratuberculosis
aucagucgaagaugucgcggcgc

SEQ ID NO: 808856 - RNA, 14 nt, Mycobacterium avium subsp. paratuberculosis
aucaggucggugcc

SEQ ID NO: 808857 - RNA, 21 nt, Mycobacterium avium subsp. paratuberculosis
aucaggucggugccgcggcgc

SEQ ID NO: 808858 - RNA, 17 nt, Mycobacterium avium subsp. paratuberculosis
aucaggucgccgaucca

SEQ ID NO: 808859 - RNA, 24 nt, Mycobacterium avium subsp. paratuberculosis
aucaggucgccgauccagccgucg

SEQ ID NO: 808860 - RNA, 23 nt, Mycobacterium avium subsp. paratuberculosis
aucagcucgcggauccgggccgg

SEQ ID NO: 808861 - RNA, 14 nt, Mycobacterium avium subsp. paratuberculosis
aucagcucgccgau

SEQ ID NO: 808862 - RNA, 16 nt, Mycobacterium avium subsp. paratuberculosis
aucagcucggcggccu

SEQ ID NO: 808863 - RNA, 23 nt, Mycobacterium avium subsp. paratuberculosis
aucagcucgucagcgcgggccag

SEQ ID NO: 808864 - RNA, 17 nt, Mycobacterium avium subsp. paratuberculosis
aucagcugcucggccac

SEQ ID NO: 808865 - RNA, 22 nt, Mycobacterium avium subsp. paratuberculosis
aucagcugcucggccaccgcgc

SEQ ID NO: 808866 - RNA, 19 nt, Mycobacterium avium subsp. paratuberculosis
aucaggcugccgcugcgcc

SEQ ID NO: 808867 - RNA, 22 nt, Mycobacterium avium subsp. paratuberculosis
aucaggcugccgcugcgccggc

SEQ ID NO: 808868 - RNA, 23 nt, Mycobacterium avium subsp. paratuberculosis
aucaggcugccgcugcgccggcg

SEQ ID NO: 808869 - RNA, 16 nt, Mycobacterium avium subsp. paratuberculosis
aucaggcggccggccc

SEQ ID NO: 808870 - RNA, 23 nt, Mycobacterium avium subsp. paratuberculosis
aucaggcggucgaacgcggcgcc

SEQ ID NO: 808871 - RNA, 19 nt, Mycobacterium avium subsp. paratuberculosis
aucaggaucgacgucgacu

SEQ ID NO: 808872 - RNA, 19 nt, Mycobacterium avium subsp. paratuberculosis
aucaggaugacgccgcggu

SEQ ID NO: 808873 - RNA, 15 nt, Mycobacterium avium subsp. paratuberculosis
aucaggccccacccg

SEQ ID NO: 808874 - RNA, 22 nt, Mycobacterium avium subsp. paratuberculosis
auccgccguugaccggugcgcc

SEQ ID NO: 808875 - RNA, 14 nt, Mycobacterium avium subsp. paratuberculosis
auccgccgggcggc

SEQ ID NO: 808876 - RNA, 16 nt, Mycobacterium avium subsp. paratuberculosis
auccgccgggcggcgu

SEQ ID NO: 808877 - RNA, 22 nt, Mycobacterium avium subsp. paratuberculosis
auccgccggcgaagcucgacga

SEQ ID NO: 808878 - RNA, 16 nt, Mycobacterium avium subsp. paratuberculosis
auccgcgagccgagcc

SEQ ID NO: 808879 - RNA, 20 nt, Mycobacterium avium subsp. paratuberculosis
auccgcgacgacaccaccgu

SEQ ID NO: 808880 - RNA, 14 nt, Mycobacterium avium subsp. paratuberculosis
auccgcgacgccag

SEQ ID NO: 808881 - RNA, 15 nt, Mycobacterium avium subsp. paratuberculosis
auccgccugcgcggg

SEQ ID NO: 808882 - RNA, 14 nt, Mycobacterium avium subsp. paratuberculosis
auccgcgccgcgau

SEQ ID NO: 808883 - RNA, 17 nt, Mycobacterium avium subsp. paratuberculosis
auccgcgcgagcgcgcu

SEQ ID NO: 808884 - RNA, 21 nt, Mycobacterium avium subsp. paratuberculosis
auccgcgcggccaccagcgcg

SEQ ID NO: 808885 - RNA, 14 nt, Mycobacterium avium subsp. paratuberculosis
auccgcgcggcgac

SEQ ID NO: 808886 - RNA, 20 nt, Mycobacterium avium subsp. paratuberculosis
auccgcgcgucgggcucgcg

SEQ ID NO: 808887 - RNA, 15 nt, Mycobacterium avium subsp. paratuberculosis
auccggccgcuggug

SEQ ID NO: 808888 - RNA, 14 nt, Mycobacterium avium subsp. paratuberculosis
auccggccggcggc

SEQ ID NO: 808889 - RNA, 15 nt, Mycobacterium avium subsp. paratuberculosis
auccggccggcggcg

SEQ ID NO: 808890 - RNA, 16 nt, Mycobacterium avium subsp. paratuberculosis
auccggccggcggcgg

SEQ ID NO: 808891 - RNA, 17 nt, Mycobacterium avium subsp. paratuberculosis
auccggccggcggcggu

SEQ ID NO: 808892 - RNA, 22 nt, Mycobacterium avium subsp. paratuberculosis
auccggcacugaaggcgcgggc

SEQ ID NO: 808893 - RNA, 13 nt, Mycobacterium avium subsp. paratuberculosis
auccggcgccgcg

SEQ ID NO: 808894 - RNA, 17 nt, Mycobacterium avium subsp. paratuberculosis
auccggcgcgccgcgau

SEQ ID NO: 808895 - RNA, 20 nt, Mycobacterium avium subsp. paratuberculosis
auccggcgcguuccaucagc

SEQ ID NO: 808896 - RNA, 15 nt, Mycobacterium avium subsp. paratuberculosis
auccggcgcacggcg

SEQ ID NO: 808897 - RNA, 13 nt, Mycobacterium avium subsp. paratuberculosis
auccggcggcgcu

SEQ ID NO: 808898 - RNA, 20 nt, Mycobacterium avium subsp. paratuberculosis
auccggucauccucgccgcg

SEQ ID NO: 808899 - RNA, 21 nt, Mycobacterium avium subsp. paratuberculosis
auccggucauccucgccgcgc

SEQ ID NO: 808900 - RNA, 22 nt, Mycobacterium avium subsp. paratuberculosis
auccggucauccucgccgcgcc

SEQ ID NO: 808901 - RNA, 23 nt, Mycobacterium avium subsp. paratuberculosis
auccggucauccucgccgcgcca

SEQ ID NO: 808902 - RNA, 19 nt, Mycobacterium avium subsp. paratuberculosis
auccgguccagaucggcgc

SEQ ID NO: 808903 - RNA, 18 nt, Mycobacterium avium subsp. paratuberculosis
auccgguccagcccggug

SEQ ID NO: 808904 - RNA, 20 nt, Mycobacterium avium subsp. paratuberculosis
auccggucgaucaccucguc

SEQ ID NO: 808905 - RNA, 22 nt, Mycobacterium avium subsp. paratuberculosis
auccgguugcaccgcgauggcc

SEQ ID NO: 808906 - RNA, 15 nt, Mycobacterium avium subsp. paratuberculosis
auccggugccgagcg

SEQ ID NO: 808907 - RNA, 12 nt, Mycobacterium avium subsp. paratuberculosis
auccggugaccg

SEQ ID NO: 808908 - RNA, 19 nt, Mycobacterium avium subsp. paratuberculosis
auccggugaccgcgacgcu

SEQ ID NO: 808909 - RNA, 18 nt, Mycobacterium avium subsp. paratuberculosis
aucccuccggcaggccgc

SEQ ID NO: 808910 - RNA, 17 nt, Mycobacterium avium subsp. paratuberculosis
aucccguacucgaugcc

SEQ ID NO: 808911 - RNA, 17 nt, Mycobacterium avium subsp. paratuberculosis
aucccggugaugccggc

SEQ ID NO: 808912 - RNA, 20 nt, Mycobacterium avium subsp. paratuberculosis
aucccggugaugccggcauc

SEQ ID NO: 808913 - RNA, 21 nt, Mycobacterium avium subsp. paratuberculosis
aucccgguggacgcgauggcg

SEQ ID NO: 808914 - RNA, 14 nt, Mycobacterium avium subsp. paratuberculosis
aucccgucggccau

SEQ ID NO: 808915 - RNA, 23 nt, Mycobacterium avium subsp. paratuberculosis
aucccgucggccaucagccgccg

SEQ ID NO: 808916 - RNA, 22 nt, Mycobacterium avium subsp. paratuberculosis
aucccguugcgcaugacggccu

SEQ ID NO: 808917 - RNA, 22 nt, Mycobacterium avium subsp. paratuberculosis
aucccguugcgccgcaacggcg

SEQ ID NO: 808918 - RNA, 15 nt, Mycobacterium avium subsp. paratuberculosis
aucccggggcgcgcu

SEQ ID NO: 808919 - RNA, 23 nt, Mycobacterium avium subsp. paratuberculosis
aucccgcgggucgcggcccaccg

SEQ ID NO: 808920 - RNA, 14 nt, Mycobacterium avium subsp. paratuberculosis
aucccggagccguc

SEQ ID NO: 808921 - RNA, 17 nt, Mycobacterium avium subsp. paratuberculosis
aucccggccaccccgca

SEQ ID NO: 808922 - RNA, 19 nt, Mycobacterium avium subsp. paratuberculosis
aucccggccagcacccgcu

SEQ ID NO: 808923 - RNA, 19 nt, Mycobacterium avium subsp. paratuberculosis
aucccgccucggcggaguc

SEQ ID NO: 808924 - RNA, 21 nt, Mycobacterium avium subsp. paratuberculosis
aucccgccucggugagcagcu

SEQ ID NO: 808925 - RNA, 17 nt, Mycobacterium avium subsp. paratuberculosis
aucccgccgaacccgcc

SEQ ID NO: 808926 - RNA, 11 nt, Mycobacterium avium subsp. paratuberculosis
aucccgccgac

SEQ ID NO: 808927 - RNA, 22 nt, Mycobacterium avium subsp. paratuberculosis
aucccgauccgcgccgccgcca

SEQ ID NO: 808928 - RNA, 22 nt, Mycobacterium avium subsp. paratuberculosis
aucccgaucgacgucagcuccc

SEQ ID NO: 808929 - RNA, 14 nt, Mycobacterium avium subsp. paratuberculosis
aucccgaugccgcg

SEQ ID NO: 808930 - RNA, 14 nt, Mycobacterium avium subsp. paratuberculosis
aucccgaacugccg

SEQ ID NO: 808931 - RNA, 18 nt, Mycobacterium avium subsp. paratuberculosis
aucccgaacugccgcgca

SEQ ID NO: 808932 - RNA, 20 nt, Mycobacterium avium subsp. paratuberculosis
aucccgcaauugcgccagca

SEQ ID NO: 808933 - RNA, 14 nt, Mycobacterium avium subsp. paratuberculosis
aucccgcaccgccc

SEQ ID NO: 808934 - RNA, 18 nt, Mycobacterium avium subsp. paratuberculosis
aucccgcaccgccccgca

SEQ ID NO: 808935 - RNA, 16 nt, Mycobacterium avium subsp. paratuberculosis
aucccgcagccgcgac

SEQ ID NO: 808936 - RNA, 13 nt, Mycobacterium avium subsp. paratuberculosis
aucccgcagcucg

SEQ ID NO: 808937 - RNA, 15 nt, Mycobacterium avium subsp. paratuberculosis
aucccgaaaccgucg

SEQ ID NO: 808938 - RNA, 16 nt, Mycobacterium avium subsp. paratuberculosis
aucccgaaaccgucga

SEQ ID NO: 808939 - RNA, 17 nt, Mycobacterium avium subsp. paratuberculosis
aucccgaaaccgucgac

SEQ ID NO: 808940 - RNA, 18 nt, Mycobacterium avium subsp. paratuberculosis
aucccgaaaccgucgacc

SEQ ID NO: 808941 - RNA, 20 nt, Mycobacterium avium subsp. paratuberculosis
auccccucacuccagcggcg

SEQ ID NO: 808942 - RNA, 17 nt, Mycobacterium avium subsp. paratuberculosis
auccccgcuucggcucg

SEQ ID NO: 808943 - RNA, 15 nt, Mycobacterium avium subsp. paratuberculosis
aucccccgacccgcc

SEQ ID NO: 808944 - RNA, 14 nt, Mycobacterium avium subsp. paratuberculosis
auccacuccagcac

SEQ ID NO: 808945 - RNA, 17 nt, Mycobacterium avium subsp. paratuberculosis
auccacuccgaggucag

SEQ ID NO: 808946 - RNA, 22 nt, Mycobacterium avium subsp. paratuberculosis
auccacuccgaggucagcgcgu

SEQ ID NO: 808947 - RNA, 24 nt, Mycobacterium avium subsp. paratuberculosis
auccacuccgaggucagcgcguac

SEQ ID NO: 808948 - RNA, 13 nt, Mycobacterium avium subsp. paratuberculosis
auccacggccggu

SEQ ID NO: 808949 - RNA, 14 nt, Mycobacterium avium subsp. paratuberculosis
auccacggcgaccc

SEQ ID NO: 808950 - RNA, 13 nt, Mycobacterium avium subsp. paratuberculosis
auccagcaccgcc

SEQ ID NO: 808951 - RNA, 16 nt, Mycobacterium avium subsp. paratuberculosis
auccagaugcccagca

SEQ ID NO: 808952 - RNA, 14 nt, Mycobacterium avium subsp. paratuberculosis
auccagaugccggg

SEQ ID NO: 808953 - RNA, 15 nt, Mycobacterium avium subsp. paratuberculosis
auccagaugccgggu

SEQ ID NO: 808954 - RNA, 17 nt, Mycobacterium avium subsp. paratuberculosis
auccagcccugcucggc

SEQ ID NO: 808955 - RNA, 20 nt, Mycobacterium avium subsp. paratuberculosis
auccagcccugcucggccag

SEQ ID NO: 808956 - RNA, 14 nt, Mycobacterium avium subsp. paratuberculosis
auccagcgcgccgc

SEQ ID NO: 808957 - RNA, 15 nt, Mycobacterium avium subsp. paratuberculosis
auccagcgcgccgcu

SEQ ID NO: 808958 - RNA, 15 nt, Mycobacterium avium subsp. paratuberculosis
auccagcgccgcagc

SEQ ID NO: 808959 - RNA, 13 nt, Mycobacterium avium subsp. paratuberculosis
auccagcgccgcc

SEQ ID NO: 808960 - RNA, 13 nt, Mycobacterium avium subsp. paratuberculosis
auccagcgcuggc

SEQ ID NO: 808961 - RNA, 12 nt, Mycobacterium avium subsp. paratuberculosis
auccagcggcgc

SEQ ID NO: 808962 - RNA, 13 nt, Mycobacterium avium subsp. paratuberculosis
auccagcggcgca

SEQ ID NO: 808963 - RNA, 22 nt, Mycobacterium avium subsp. paratuberculosis
auccaggccagcaccuggcgca

SEQ ID NO: 808964 - RNA, 16 nt, Mycobacterium avium subsp. paratuberculosis
auccaggaccgcgcgc

SEQ ID NO: 808965 - RNA, 17 nt, Mycobacterium avium subsp. paratuberculosis
auccaggaccgcgcgcc

SEQ ID NO: 808966 - RNA, 22 nt, Mycobacterium avium subsp. paratuberculosis
auccaggaccgcgcgccggcca

SEQ ID NO: 808967 - RNA, 16 nt, Mycobacterium avium subsp. paratuberculosis
auccagugcaguucga

SEQ ID NO: 808968 - RNA, 23 nt, Mycobacterium avium subsp. paratuberculosis
auccagugcaguucgaugccgau

SEQ ID NO: 808969 - RNA, 14 nt, Mycobacterium avium subsp. paratuberculosis
auccagucggcgcc

SEQ ID NO: 808970 - RNA, 15 nt, Mycobacterium avium subsp. paratuberculosis
auccagucggcgccg

SEQ ID NO: 808971 - RNA, 17 nt, Mycobacterium avium subsp. paratuberculosis
auccagucggcgccgau

SEQ ID NO: 808972 - RNA, 20 nt, Mycobacterium avium subsp. paratuberculosis
auccagucggcgccgaugca

SEQ ID NO: 808973 - RNA, 14 nt, Mycobacterium avium subsp. paratuberculosis
auccagguggcgcc

SEQ ID NO: 808974 - RNA, 21 nt, Mycobacterium avium subsp. paratuberculosis
auccagguggcgccuccgccc

SEQ ID NO: 808975 - RNA, 19 nt, Mycobacterium avium subsp. paratuberculosis
auccauugcgacuugcgcg

SEQ ID NO: 808976 - RNA, 22 nt, Mycobacterium avium subsp. paratuberculosis
aucccaggaacgcgcccggcgg

SEQ ID NO: 808977 - RNA, 23 nt, Mycobacterium avium subsp. paratuberculosis
aucccagccauacugacgccggu

SEQ ID NO: 808978 - RNA, 18 nt, Mycobacterium avium subsp. paratuberculosis
aucccagcgggacagcac

SEQ ID NO: 808979 - RNA, 20 nt, Mycobacterium avium subsp. paratuberculosis
aucccagaauucgccggggc

SEQ ID NO: 808980 - RNA, 22 nt, Mycobacterium avium subsp. paratuberculosis
aucccagacccagcaucgccgc

SEQ ID NO: 808981 - RNA, 12 nt, Mycobacterium avium subsp. paratuberculosis
aucccaccacga

SEQ ID NO: 808982 - RNA, 23 nt, Mycobacterium avium subsp. paratuberculosis
auccccagcacggugaugcgggu

SEQ ID NO: 808983 - RNA, 15 nt, Mycobacterium avium subsp. paratuberculosis
auccccaucucgagc

SEQ ID NO: 808984 - RNA, 20 nt, Mycobacterium avium subsp. paratuberculosis
aucccauguagagcgggauc

SEQ ID NO: 808985 - RNA, 20 nt, Mycobacterium avium subsp. paratuberculosis
aucccaucagugcggcccgc

SEQ ID NO: 808986 - RNA, 15 nt, Mycobacterium avium subsp. paratuberculosis
ccauaaagccgucgu

SEQ ID NO: 808987 - RNA, 15 nt, Mycobacterium avium subsp. paratuberculosis
ccaguuucccgucgg

SEQ ID NO: 808988 - RNA, 22 nt, Mycobacterium avium subsp. paratuberculosis
ccaguuguuuccccagcccgga

SEQ ID NO: 808989 - RNA, 16 nt, Mycobacterium avium subsp. paratuberculosis
ccaucaacccgagcac

SEQ ID NO: 808990 - RNA, 17 nt, Mycobacterium avium subsp. paratuberculosis
ccaucaacccgagcacc

SEQ ID NO: 808991 - RNA, 22 nt, Mycobacterium avium subsp. paratuberculosis
ccagugcgugaccugcugggcg

SEQ ID NO: 808992 - RNA, 20 nt, Mycobacterium avium subsp. paratuberculosis
ccaguucgcguacccgcgcg

SEQ ID NO: 808993 - RNA, 12 nt, Mycobacterium avium subsp. paratuberculosis
ccaguucggcca

SEQ ID NO: 808994 - RNA, 13 nt, Mycobacterium avium subsp. paratuberculosis
ccaguucggccag

SEQ ID NO: 808995 - RNA, 17 nt, Mycobacterium avium subsp. paratuberculosis
ccaguucggccagcgcg

SEQ ID NO: 808996 - RNA, 15 nt, Mycobacterium avium subsp. paratuberculosis
ccaguucgucgcgcg

SEQ ID NO: 808997 - RNA, 16 nt, Mycobacterium avium subsp. paratuberculosis
ccaguucgucggccgu

SEQ ID NO: 808998 - RNA, 14 nt, Mycobacterium avium subsp. paratuberculosis
ccaguucgccggug

SEQ ID NO: 808999 - RNA, 22 nt, Mycobacterium avium subsp. paratuberculosis
ccaguucgagcgccgcggccac

SEQ ID NO: 809000 - RNA, 16 nt, Mycobacterium avium subsp. paratuberculosis
ccaguucccggcgggc

SEQ ID NO: 809001 - RNA, 15 nt, Mycobacterium avium subsp. paratuberculosis
ccagugcccggccaa

SEQ ID NO: 809002 - RNA, 16 nt, Mycobacterium avium subsp. paratuberculosis
ccagugcaugccggcc

SEQ ID NO: 809003 - RNA, 16 nt, Mycobacterium avium subsp. paratuberculosis
ccagugcccgagcacc

SEQ ID NO: 809004 - RNA, 18 nt, Mycobacterium avium subsp. paratuberculosis
ccagugcccgagcaccug

SEQ ID NO: 809005 - RNA, 17 nt, Mycobacterium avium subsp. paratuberculosis
ccaguaguggaucagcc

SEQ ID NO: 809006 - RNA, 18 nt, Mycobacterium avium subsp. paratuberculosis
ccaguaguggaucagcca

SEQ ID NO: 809007 - RNA, 19 nt, Mycobacterium avium subsp. paratuberculosis
ccagugcaguucgaugccg

SEQ ID NO: 809008 - RNA, 22 nt, Mycobacterium avium subsp. paratuberculosis
ccagugcaguucgaugccgaug

SEQ ID NO: 809009 - RNA, 13 nt, Mycobacterium avium subsp. paratuberculosis
ccaguaccgggcc

SEQ ID NO: 809010 - RNA, 15 nt, Mycobacterium avium subsp. paratuberculosis
ccaguaccagcggcc

SEQ ID NO: 809011 - RNA, 13 nt, Mycobacterium avium subsp. paratuberculosis
ccaguacaccgcg

SEQ ID NO: 809012 - RNA, 16 nt, Mycobacterium avium subsp. paratuberculosis
ccaguaggccagcauc

SEQ ID NO: 809013 - RNA, 18 nt, Mycobacterium avium subsp. paratuberculosis
ccaguagccgccgggcgu

SEQ ID NO: 809014 - RNA, 23 nt, Mycobacterium avium subsp. paratuberculosis
ccaggucgcggcgcugcgccguu

SEQ ID NO: 809015 - RNA, 22 nt, Mycobacterium avium subsp. paratuberculosis
ccaggucgcccagauagaucgc

SEQ ID NO: 809016 - RNA, 15 nt, Mycobacterium avium subsp. paratuberculosis
ccaggugugcggcac

SEQ ID NO: 809017 - RNA, 14 nt, Mycobacterium avium subsp. paratuberculosis
ccagguucagcccg

SEQ ID NO: 809018 - RNA, 16 nt, Mycobacterium avium subsp. paratuberculosis
ccagguucagcccggc

SEQ ID NO: 809019 - RNA, 18 nt, Mycobacterium avium subsp. paratuberculosis
ccagguucaggcccgcgc

SEQ ID NO: 809020 - RNA, 23 nt, Mycobacterium avium subsp. paratuberculosis
ccagguuccaguacccgcgcaug

SEQ ID NO: 809021 - RNA, 22 nt, Mycobacterium avium subsp. paratuberculosis
ccagguuccggugucgagccgg

SEQ ID NO: 809022 - RNA, 15 nt, Mycobacterium avium subsp. paratuberculosis
ccagguucgcgcagc

SEQ ID NO: 809023 - RNA, 14 nt, Mycobacterium avium subsp. paratuberculosis
ccagguucgcgccg

SEQ ID NO: 809024 - RNA, 14 nt, Mycobacterium avium subsp. paratuberculosis
ccagguggcccgac

SEQ ID NO: 809025 - RNA, 14 nt, Mycobacterium avium subsp. paratuberculosis
ccagguggcgccuc

SEQ ID NO: 809026 - RNA, 21 nt, Mycobacterium avium subsp. paratuberculosis
ccagguggcgccuccgcccgg

SEQ ID NO: 809027 - RNA, 13 nt, Mycobacterium avium subsp. paratuberculosis
ccagguggugaac

SEQ ID NO: 809028 - RNA, 16 nt, Mycobacterium avium subsp. paratuberculosis
ccagguguaggcgugg

SEQ ID NO: 809029 - RNA, 17 nt, Mycobacterium avium subsp. paratuberculosis
ccagguguccggcccga

SEQ ID NO: 809030 - RNA, 18 nt, Mycobacterium avium subsp. paratuberculosis
ccagguacacguagcggu

SEQ ID NO: 809031 - RNA, 17 nt, Mycobacterium avium subsp. paratuberculosis
ccagguaccggcgggcg

SEQ ID NO: 809032 - RNA, 15 nt, Mycobacterium avium subsp. paratuberculosis
ccagguacgcgacgg

SEQ ID NO: 809033 - RNA, 19 nt, Mycobacterium avium subsp. paratuberculosis
ccagguacugaucaccgcg

SEQ ID NO: 809034 - RNA, 20 nt, Mycobacterium avium subsp. paratuberculosis
ccagguacugaucaccgcgc

SEQ ID NO: 809035 - RNA, 18 nt, Mycobacterium avium subsp. paratuberculosis
ccagggugucccagcgcc

SEQ ID NO: 809036 - RNA, 20 nt, Mycobacterium avium subsp. paratuberculosis
ccaggguuggucggagccgu

SEQ ID NO: 809037 - RNA, 21 nt, Mycobacterium avium subsp. paratuberculosis
ccaggguuucaugcacggcgc

SEQ ID NO: 809038 - RNA, 15 nt, Mycobacterium avium subsp. paratuberculosis
ccagggugucgacga

SEQ ID NO: 809039 - RNA, 12 nt, Mycobacterium avium subsp. paratuberculosis
ccagggugucgu

SEQ ID NO: 809040 - RNA, 16 nt, Mycobacterium avium subsp. paratuberculosis
ccagggugucgucguc

SEQ ID NO: 809041 - RNA, 19 nt, Mycobacterium avium subsp. paratuberculosis
ccagggugucgucgucggu

SEQ ID NO: 809042 - RNA, 18 nt, Mycobacterium avium subsp. paratuberculosis
ccaggguucucgcggcgg

SEQ ID NO: 809043 - RNA, 20 nt, Mycobacterium avium subsp. paratuberculosis
ccaggguucucgcggcggcc

SEQ ID NO: 809044 - RNA, 20 nt, Mycobacterium avium subsp. paratuberculosis
ccagguccucgcuggcgauc

SEQ ID NO: 809045 - RNA, 23 nt, Mycobacterium avium subsp. paratuberculosis
ccagguccucgcuggcgaucacc

SEQ ID NO: 809046 - RNA, 23 nt, Mycobacterium avium subsp. paratuberculosis
ccaggucgaagaggugcucgacg

SEQ ID NO: 809047 - RNA, 21 nt, Mycobacterium avium subsp. paratuberculosis
ccaggucgaagcgcagcaccu

SEQ ID NO: 809048 - RNA, 17 nt, Mycobacterium avium subsp. paratuberculosis
ccagguccuugaucggg

SEQ ID NO: 809049 - RNA, 17 nt, Mycobacterium avium subsp. paratuberculosis
ccagguacugggcgugg

SEQ ID NO: 809050 - RNA, 18 nt, Mycobacterium avium subsp. paratuberculosis
ccaggucgaucucggcca

SEQ ID NO: 809051 - RNA, 19 nt, Mycobacterium avium subsp. paratuberculosis
ccaggucgaucucggccag

SEQ ID NO: 809052 - RNA, 22 nt, Mycobacterium avium subsp. paratuberculosis
ccaggucgaucucggccagcgg

SEQ ID NO: 809053 - RNA, 21 nt, Mycobacterium avium subsp. paratuberculosis
ccaggucgacggggucggaca

SEQ ID NO: 809054 - RNA, 17 nt, Mycobacterium avium subsp. paratuberculosis
ccaggucgccgcgcagc

SEQ ID NO: 809055 - RNA, 18 nt, Mycobacterium avium subsp. paratuberculosis
ccaggucgccgcgcagca

SEQ ID NO: 809056 - RNA, 22 nt, Mycobacterium avium subsp. paratuberculosis
ccaggucgccgcgcagcaccgc

SEQ ID NO: 809057 - RNA, 14 nt, Mycobacterium avium subsp. paratuberculosis
ccaggucgccggcg

SEQ ID NO: 809058 - RNA, 16 nt, Mycobacterium avium subsp. paratuberculosis
ccaggucgccggcggc

SEQ ID NO: 809059 - RNA, 17 nt, Mycobacterium avium subsp. paratuberculosis
ccaggucgccggcggcc

SEQ ID NO: 809060 - RNA, 22 nt, Mycobacterium avium subsp. paratuberculosis
ccaggucgccggcggccgacag

SEQ ID NO: 809061 - RNA, 21 nt, Mycobacterium avium subsp. paratuberculosis
ccaggcuuggcccgccgccgg

SEQ ID NO: 809062 - RNA, 17 nt, Mycobacterium avium subsp. paratuberculosis
ccaggcugcucggcggg

SEQ ID NO: 809063 - RNA, 18 nt, Mycobacterium avium subsp. paratuberculosis
ccaggcugcucggcgggc

SEQ ID NO: 809064 - RNA, 19 nt, Mycobacterium avium subsp. paratuberculosis
ccaggcugcucggcgggcu

SEQ ID NO: 809065 - RNA, 21 nt, Mycobacterium avium subsp. paratuberculosis
ccaggcugcucggcgggcucg

SEQ ID NO: 809066 - RNA, 23 nt, Mycobacterium avium subsp. paratuberculosis
ccaggguggucagcgucucggcg

SEQ ID NO: 809067 - RNA, 17 nt, Mycobacterium avium subsp. paratuberculosis
ccagggcagccagcccg

SEQ ID NO: 809068 - RNA, 14 nt, Mycobacterium avium subsp. paratuberculosis
ccagggcagcgccu

SEQ ID NO: 809069 - RNA, 19 nt, Mycobacterium avium subsp. paratuberculosis
ccagggcagcgccucggcg

SEQ ID NO: 809070 - RNA, 16 nt, Mycobacterium avium subsp. paratuberculosis
ccaggcgugcgcgugg

SEQ ID NO: 809071 - RNA, 16 nt, Mycobacterium avium subsp. paratuberculosis
ccagggacuccgggga

SEQ ID NO: 809072 - RNA, 17 nt, Mycobacterium avium subsp. paratuberculosis
ccaggcguggucggcgc

SEQ ID NO: 809073 - RNA, 18 nt, Mycobacterium avium subsp. paratuberculosis
ccaggcguggucggcgcg

SEQ ID NO: 809074 - RNA, 20 nt, Mycobacterium avium subsp. paratuberculosis
ccaggcguggucggcgcggu

SEQ ID NO: 809075 - RNA, 17 nt, Mycobacterium avium subsp. paratuberculosis
ccaggcgguccgacacc

SEQ ID NO: 809076 - RNA, 16 nt, Mycobacterium avium subsp. paratuberculosis
ccaggcgugcacccgg

SEQ ID NO: 809077 - RNA, 17 nt, Mycobacterium avium subsp. paratuberculosis
ccaggcgugcacccggu

SEQ ID NO: 809078 - RNA, 18 nt, Mycobacterium avium subsp. paratuberculosis
ccaggcgguggccgaacc

SEQ ID NO: 809079 - RNA, 16 nt, Mycobacterium avium subsp. paratuberculosis
ccaggcguuggucacc

SEQ ID NO: 809080 - RNA, 22 nt, Mycobacterium avium subsp. paratuberculosis
ccaggcucaggaucagcagccg

SEQ ID NO: 809081 - RNA, 19 nt, Mycobacterium avium subsp. paratuberculosis
ccaggcugaccagcgccuc

SEQ ID NO: 809082 - RNA, 18 nt, Mycobacterium avium subsp. paratuberculosis
ccaggcucgcgagggcgg

SEQ ID NO: 809083 - RNA, 19 nt, Mycobacterium avium subsp. paratuberculosis
ccaggcucgcucccgcgcg

SEQ ID NO: 809084 - RNA, 23 nt, Mycobacterium avium subsp. paratuberculosis
ccaggcugaacaccaccaggccg

SEQ ID NO: 809085 - RNA, 17 nt, Mycobacterium avium subsp. paratuberculosis
ccaggcugaacgucguc

SEQ ID NO: 809086 - RNA, 21 nt, Mycobacterium avium subsp. paratuberculosis
ccaggcugaacgucgucagca

SEQ ID NO: 809087 - RNA, 12 nt, Mycobacterium avium subsp. paratuberculosis
ccaggcgggcca

SEQ ID NO: 809088 - RNA, 13 nt, Mycobacterium avium subsp. paratuberculosis
ccaggcgggccag

SEQ ID NO: 809089 - RNA, 15 nt, Mycobacterium avium subsp. paratuberculosis
ccaggcgggccagcu

SEQ ID NO: 809090 - RNA, 14 nt, Mycobacterium avium subsp. paratuberculosis
ccaggcggcgacga

SEQ ID NO: 809091 - RNA, 21 nt, Mycobacterium avium subsp. paratuberculosis
ccaggcggcgacgaacgccgg

SEQ ID NO: 809092 - RNA, 24 nt, Mycobacterium avium subsp. paratuberculosis
ccaggcggaaugcaggaucgcggu

SEQ ID NO: 809093 - RNA, 18 nt, Mycobacterium avium subsp. paratuberculosis
ccaggcggaucacaucgg

SEQ ID NO: 809094 - RNA, 15 nt, Mycobacterium avium subsp. paratuberculosis
ccaggcgcgcgcugg

SEQ ID NO: 809095 - RNA, 16 nt, Mycobacterium avium subsp. paratuberculosis
ccaggcgccgucgaug

SEQ ID NO: 809096 - RNA, 18 nt, Mycobacterium avium subsp. paratuberculosis
ccaggcgccgucgauggc

SEQ ID NO: 809097 - RNA, 17 nt, Mycobacterium avium subsp. paratuberculosis
ccaggcgcccagcaccc

SEQ ID NO: 809098 - RNA, 15 nt, Mycobacterium avium subsp. paratuberculosis
ccaggcgccacagca

SEQ ID NO: 809099 - RNA, 17 nt, Mycobacterium avium subsp. paratuberculosis
ccaggcgccacagcagc

SEQ ID NO: 809100 - RNA, 14 nt, Mycobacterium avium subsp. paratuberculosis
ccaggcgcaccagc

SEQ ID NO: 809101 - RNA, 17 nt, Mycobacterium avium subsp. paratuberculosis
ccaggcgaugccgccga

SEQ ID NO: 809102 - RNA, 18 nt, Mycobacterium avium subsp. paratuberculosis
ccaggcgaugccgccgac

SEQ ID NO: 809103 - RNA, 23 nt, Mycobacterium avium subsp. paratuberculosis
ccaggccuuccgcaacaucguca

SEQ ID NO: 809104 - RNA, 15 nt, Mycobacterium avium subsp. paratuberculosis
ccaggccuuguacgc

SEQ ID NO: 809105 - RNA, 22 nt, Mycobacterium avium subsp. paratuberculosis
ccaggccuugucguccucgauc

SEQ ID NO: 809106 - RNA, 21 nt, Mycobacterium avium subsp. paratuberculosis
ccaggcgaacauggcggccag

SEQ ID NO: 809107 - RNA, 22 nt, Mycobacterium avium subsp. paratuberculosis
ccaggcgaacauggcggccagc

SEQ ID NO: 809108 - RNA, 21 nt, Mycobacterium avium subsp. paratuberculosis
ccaggcgaaguuggucaccac

SEQ ID NO: 809109 - RNA, 14 nt, Mycobacterium avium subsp. paratuberculosis
ccaggccgucgagg

SEQ ID NO: 809110 - RNA, 17 nt, Mycobacterium avium subsp. paratuberculosis
ccaggccgucgaggcgc

SEQ ID NO: 809111 - RNA, 17 nt, Mycobacterium avium subsp. paratuberculosis
ccaggccgucggcgcgg

SEQ ID NO: 809112 - RNA, 13 nt, Mycobacterium avium subsp. paratuberculosis
ccaggccgugauc

SEQ ID NO: 809113 - RNA, 21 nt, Mycobacterium avium subsp. paratuberculosis
ccaggccguccaccagaucgc

SEQ ID NO: 809114 - RNA, 14 nt, Mycobacterium avium subsp. paratuberculosis
ccaggccggcgccg

SEQ ID NO: 809115 - RNA, 18 nt, Mycobacterium avium subsp. paratuberculosis
ccaggccggcgccgcggg

SEQ ID NO: 809116 - RNA, 16 nt, Mycobacterium avium subsp. paratuberculosis
ccaggccgcgcuggcg

SEQ ID NO: 809117 - RNA, 14 nt, Mycobacterium avium subsp. paratuberculosis
ccaggccgcggcca

SEQ ID NO: 809118 - RNA, 15 nt, Mycobacterium avium subsp. paratuberculosis
ccaggccggcgacga

SEQ ID NO: 809119 - RNA, 16 nt, Mycobacterium avium subsp. paratuberculosis
ccaggccggcgacgau

SEQ ID NO: 809120 - RNA, 13 nt, Mycobacterium avium subsp. paratuberculosis
ccaggccggcgag

SEQ ID NO: 809121 - RNA, 17 nt, Mycobacterium avium subsp. paratuberculosis
ccaggccggcgagcucg

SEQ ID NO: 809122 - RNA, 22 nt, Mycobacterium avium subsp. paratuberculosis
ccaggccggcgagcucgcggcc

SEQ ID NO: 809123 - RNA, 14 nt, Mycobacterium avium subsp. paratuberculosis
ccaggccagcaccu

SEQ ID NO: 809124 - RNA, 15 nt, Mycobacterium avium subsp. paratuberculosis
ccaggccagcaccug

SEQ ID NO: 809125 - RNA, 13 nt, Mycobacterium avium subsp. paratuberculosis
ccaggccacccgg

SEQ ID NO: 809126 - RNA, 16 nt, Mycobacterium avium subsp. paratuberculosis
ccaggccaccgcacgu

SEQ ID NO: 809127 - RNA, 15 nt, Mycobacterium avium subsp. paratuberculosis
ccaggcccagcagca

SEQ ID NO: 809128 - RNA, 14 nt, Mycobacterium avium subsp. paratuberculosis
ccaggcccagccca

SEQ ID NO: 809129 - RNA, 13 nt, Mycobacterium avium subsp. paratuberculosis
ccaggcccaccac

SEQ ID NO: 809130 - RNA, 14 nt, Mycobacterium avium subsp. paratuberculosis
ccaggcccaggccg

SEQ ID NO: 809131 - RNA, 14 nt, Mycobacterium avium subsp. paratuberculosis
ccaggcccggcacc

SEQ ID NO: 809132 - RNA, 15 nt, Mycobacterium avium subsp. paratuberculosis
ccaggcccggcaccg

SEQ ID NO: 809133 - RNA, 16 nt, Mycobacterium avium subsp. paratuberculosis
ccaggcccggcaccgg

SEQ ID NO: 809134 - RNA, 21 nt, Mycobacterium avium subsp. paratuberculosis
ccaggccccggccgagcgcag

SEQ ID NO: 809135 - RNA, 14 nt, Mycobacterium avium subsp. paratuberculosis
ccaggcccaucgcg

SEQ ID NO: 809136 - RNA, 16 nt, Mycobacterium avium subsp. paratuberculosis
ccaggcccaucgcggu

SEQ ID NO: 809137 - RNA, 13 nt, Mycobacterium avium subsp. paratuberculosis
ccaggccgcgccg

SEQ ID NO: 809138 - RNA, 14 nt, Mycobacterium avium subsp. paratuberculosis
ccaggccgcgccgg

SEQ ID NO: 809139 - RNA, 15 nt, Mycobacterium avium subsp. paratuberculosis
ccaggccgcgccggg

SEQ ID NO: 809140 - RNA, 17 nt, Mycobacterium avium subsp. paratuberculosis
ccaggccgcgccgggcg

SEQ ID NO: 809141 - RNA, 13 nt, Mycobacterium avium subsp. paratuberculosis
ccaggccgccggg

SEQ ID NO: 809142 - RNA, 14 nt, Mycobacterium avium subsp. paratuberculosis
ccaggccgccgggc

SEQ ID NO: 809143 - RNA, 15 nt, Mycobacterium avium subsp. paratuberculosis
ccaggccgccgggcc

SEQ ID NO: 809144 - RNA, 16 nt, Mycobacterium avium subsp. paratuberculosis
ccaggccgccgggccg

SEQ ID NO: 809145 - RNA, 21 nt, Mycobacterium avium subsp. paratuberculosis
ccaggccgccgggccgccgau

SEQ ID NO: 809146 - RNA, 13 nt, Mycobacterium avium subsp. paratuberculosis
ccaggccgccgug

SEQ ID NO: 809147 - RNA, 11 nt, Mycobacterium avium subsp. paratuberculosis
ccaggccgcga

SEQ ID NO: 809148 - RNA, 14 nt, Mycobacterium avium subsp. paratuberculosis
ccaggccgccgcca

SEQ ID NO: 809149 - RNA, 15 nt, Mycobacterium avium subsp. paratuberculosis
ccaggccgccgccac

SEQ ID NO: 809150 - RNA, 18 nt, Mycobacterium avium subsp. paratuberculosis
ccaggccgacgccggcca

SEQ ID NO: 809151 - RNA, 23 nt, Mycobacterium avium subsp. paratuberculosis
ccaggccgacgccggccaccaac

SEQ ID NO: 809152 - RNA, 14 nt, Mycobacterium avium subsp. paratuberculosis
ccaggccgacgcug

SEQ ID NO: 809153 - RNA, 21 nt, Mycobacterium avium subsp. paratuberculosis
ccaggccgaguauccgcgcag

SEQ ID NO: 809154 - RNA, 18 nt, Mycobacterium avium subsp. paratuberculosis
ccaggcccugccagcgcc

SEQ ID NO: 809155 - RNA, 23 nt, Mycobacterium avium subsp. paratuberculosis
ccaggcagaagcuccacgccgcc

SEQ ID NO: 809156 - RNA, 13 nt, Mycobacterium avium subsp. paratuberculosis
ccaggcacagcga

SEQ ID NO: 809157 - RNA, 15 nt, Mycobacterium avium subsp. paratuberculosis
ccaggcacggcccgu

SEQ ID NO: 809158 - RNA, 13 nt, Mycobacterium avium subsp. paratuberculosis
ccaggcagcgcga

SEQ ID NO: 809159 - RNA, 18 nt, Mycobacterium avium subsp. paratuberculosis
ccaggccaacagcagcag

SEQ ID NO: 809160 - RNA, 16 nt, Mycobacterium avium subsp. paratuberculosis
ccagcgugccgcgcac

SEQ ID NO: 809161 - RNA, 18 nt, Mycobacterium avium subsp. paratuberculosis
ccagcgugccgcgcacca

SEQ ID NO: 809162 - RNA, 19 nt, Mycobacterium avium subsp. paratuberculosis
ccagcgugcgcggcuggcc

SEQ ID NO: 809163 - RNA, 19 nt, Mycobacterium avium subsp. paratuberculosis
ccagcgucugcugcgccau

SEQ ID NO: 809164 - RNA, 20 nt, Mycobacterium avium subsp. paratuberculosis
ccagcgucugcugcgccauc

SEQ ID NO: 809165 - RNA, 17 nt, Mycobacterium avium subsp. paratuberculosis
ccagcgugaacaccgcg

SEQ ID NO: 809166 - RNA, 18 nt, Mycobacterium avium subsp. paratuberculosis
ccagcgugaacaccgcgu

SEQ ID NO: 809167 - RNA, 16 nt, Mycobacterium avium subsp. paratuberculosis
ccagcgugaacagcgc

SEQ ID NO: 809168 - RNA, 21 nt, Mycobacterium avium subsp. paratuberculosis
ccagcgugaacagcgcccggc

SEQ ID NO: 809169 - RNA, 13 nt, Mycobacterium avium subsp. paratuberculosis
ccagcguggcgaa

SEQ ID NO: 809170 - RNA, 12 nt, Mycobacterium avium subsp. paratuberculosis
ccagcguggcgc

SEQ ID NO: 809171 - RNA, 21 nt, Mycobacterium avium subsp. paratuberculosis
ccagcguggcgcgccccggcc

SEQ ID NO: 809172 - RNA, 23 nt, Mycobacterium avium subsp. paratuberculosis
ccagcguggcgcgccccggcccg

SEQ ID NO: 809173 - RNA, 14 nt, Mycobacterium avium subsp. paratuberculosis
ccaggaugacgccg

SEQ ID NO: 809174 - RNA, 16 nt, Mycobacterium avium subsp. paratuberculosis
ccagcguggccggcag

SEQ ID NO: 809175 - RNA, 22 nt, Mycobacterium avium subsp. paratuberculosis
ccagcgugcugccggacacccc

SEQ ID NO: 809176 - RNA, 14 nt, Mycobacterium avium subsp. paratuberculosis
ccagcguggccagc

SEQ ID NO: 809177 - RNA, 23 nt, Mycobacterium avium subsp. paratuberculosis
ccaggauguucaccccggcgcgg

SEQ ID NO: 809178 - RNA, 21 nt, Mycobacterium avium subsp. paratuberculosis
ccaggauguacccgcaggcca

SEQ ID NO: 809179 - RNA, 15 nt, Mycobacterium avium subsp. paratuberculosis
ccaggaugucgacga

SEQ ID NO: 809180 - RNA, 17 nt, Mycobacterium avium subsp. paratuberculosis
ccaggaugucgacgaca

SEQ ID NO: 809181 - RNA, 22 nt, Mycobacterium avium subsp. paratuberculosis
ccaggaugucggacucgcgccg

SEQ ID NO: 809182 - RNA, 20 nt, Mycobacterium avium subsp. paratuberculosis
ccaggaugucuccgcgcagc

SEQ ID NO: 809183 - RNA, 22 nt, Mycobacterium avium subsp. paratuberculosis
ccaggaugucuccgcgcagcca

SEQ ID NO: 809184 - RNA, 18 nt, Mycobacterium avium subsp. paratuberculosis
ccaggaugccgaacgcga

SEQ ID NO: 809185 - RNA, 20 nt, Mycobacterium avium subsp. paratuberculosis
ccaggaugccgaacgcgauc

SEQ ID NO: 809186 - RNA, 18 nt, Mycobacterium avium subsp. paratuberculosis
ccagcguggccagcaccg

SEQ ID NO: 809187 - RNA, 14 nt, Mycobacterium avium subsp. paratuberculosis
ccaggauucccgac

SEQ ID NO: 809188 - RNA, 17 nt, Mycobacterium avium subsp. paratuberculosis
ccaggauuccgucggcg

SEQ ID NO: 809189 - RNA, 18 nt, Mycobacterium avium subsp. paratuberculosis
ccaggauuccgucggcgg

SEQ ID NO: 809190 - RNA, 21 nt, Mycobacterium avium subsp. paratuberculosis
ccaggauuccgucggcggccg

SEQ ID NO: 809191 - RNA, 19 nt, Mycobacterium avium subsp. paratuberculosis
cccaauccucgccgagcag

SEQ ID NO: 809192 - RNA, 13 nt, Mycobacterium avium subsp. paratuberculosis
cccacagcaggua

SEQ ID NO: 809193 - RNA, 18 nt, Mycobacterium avium subsp. paratuberculosis
cccacagcggaucggccu

SEQ ID NO: 809194 - RNA, 19 nt, Mycobacterium avium subsp. paratuberculosis
cccacaccgacaccggccg

SEQ ID NO: 809195 - RNA, 18 nt, Mycobacterium avium subsp. paratuberculosis
cccacaccaccaccgagc

SEQ ID NO: 809196 - RNA, 19 nt, Mycobacterium avium subsp. paratuberculosis
cccacaccuucgcggucgg

SEQ ID NO: 809197 - RNA, 13 nt, Mycobacterium avium subsp. paratuberculosis
cccacacgcucgg

SEQ ID NO: 809198 - RNA, 14 nt, Mycobacterium avium subsp. paratuberculosis
cccacacgcucggc

SEQ ID NO: 809199 - RNA, 17 nt, Mycobacterium avium subsp. paratuberculosis
cccacacgcucggcgag

SEQ ID NO: 809200 - RNA, 23 nt, Mycobacterium avium subsp. paratuberculosis
cccaacuggcgaccgguccgcgg

SEQ ID NO: 809201 - RNA, 17 nt, Mycobacterium avium subsp. paratuberculosis
cccaacgguccaacgug

SEQ ID NO: 809202 - RNA, 15 nt, Mycobacterium avium subsp. paratuberculosis
cccaacgacgucggc

SEQ ID NO: 809203 - RNA, 14 nt, Mycobacterium avium subsp. paratuberculosis
cccaacgcagcgca

SEQ ID NO: 809204 - RNA, 19 nt, Mycobacterium avium subsp. paratuberculosis
cccaauaccguuccgcccc

SEQ ID NO: 809205 - RNA, 16 nt, Mycobacterium avium subsp. paratuberculosis
cccaaggcggacaacg

SEQ ID NO: 809206 - RNA, 22 nt, Mycobacterium avium subsp. paratuberculosis
cccaacaacucgacguucggcg

SEQ ID NO: 809207 - RNA, 14 nt, Mycobacterium avium subsp. paratuberculosis
cccaaccguuggug

SEQ ID NO: 809208 - RNA, 22 nt, Mycobacterium avium subsp. paratuberculosis
ccauugcgacuugcgcgccgug

SEQ ID NO: 809209 - RNA, 19 nt, Mycobacterium avium subsp. paratuberculosis
ccauugcgggaagggcccg

SEQ ID NO: 809210 - RNA, 17 nt, Mycobacterium avium subsp. paratuberculosis
ccauguccuuggugaug

SEQ ID NO: 809211 - RNA, 20 nt, Mycobacterium avium subsp. paratuberculosis
ccauguagcagacggacacc

SEQ ID NO: 809212 - RNA, 21 nt, Mycobacterium avium subsp. paratuberculosis
ccauguaguucagcagccggc

SEQ ID NO: 809213 - RNA, 23 nt, Mycobacterium avium subsp. paratuberculosis
ccauguaguucagcagccggcag

SEQ ID NO: 809214 - RNA, 20 nt, Mycobacterium avium subsp. paratuberculosis
ccauggugccgccguugcga

SEQ ID NO: 809215 - RNA, 23 nt, Mycobacterium avium subsp. paratuberculosis
ccaugggguugaccuugaccagc

SEQ ID NO: 809216 - RNA, 21 nt, Mycobacterium avium subsp. paratuberculosis
ccaugggucucggcgaggcgc

SEQ ID NO: 809217 - RNA, 20 nt, Mycobacterium avium subsp. paratuberculosis
ccauguacagaccccacacc

SEQ ID NO: 809218 - RNA, 14 nt, Mycobacterium avium subsp. paratuberculosis
ccaugucgucgagc

SEQ ID NO: 809219 - RNA, 17 nt, Mycobacterium avium subsp. paratuberculosis
ccaugucgucgagcucg

SEQ ID NO: 809220 - RNA, 13 nt, Mycobacterium avium subsp. paratuberculosis
ccaugucgccggu

SEQ ID NO: 809221 - RNA, 23 nt, Mycobacterium avium subsp. paratuberculosis
ccaugucggagcugcgcgccccg

SEQ ID NO: 809222 - RNA, 14 nt, Mycobacterium avium subsp. paratuberculosis
ccaugucggcgucg

SEQ ID NO: 809223 - RNA, 18 nt, Mycobacterium avium subsp. paratuberculosis
ccaucagcgcccgcgcgg

SEQ ID NO: 809224 - RNA, 24 nt, Mycobacterium avium subsp. paratuberculosis
ccaucagcgcccgcgcgggcugca

SEQ ID NO: 809225 - RNA, 17 nt, Mycobacterium avium subsp. paratuberculosis
ccaucagcccggcgucc

SEQ ID NO: 809226 - RNA, 23 nt, Mycobacterium avium subsp. paratuberculosis
ccaucagcccggugacgaacauc

SEQ ID NO: 809227 - RNA, 19 nt, Mycobacterium avium subsp. paratuberculosis
ccaucagccgccgucgcgc

SEQ ID NO: 809228 - RNA, 18 nt, Mycobacterium avium subsp. paratuberculosis
ccaucagcaccgccucgg

SEQ ID NO: 809229 - RNA, 14 nt, Mycobacterium avium subsp. paratuberculosis
ccaucacgucgcgc

SEQ ID NO: 809230 - RNA, 15 nt, Mycobacterium avium subsp. paratuberculosis
ccaucacgucgcgcu

SEQ ID NO: 809231 - RNA, 14 nt, Mycobacterium avium subsp. paratuberculosis
ccaucacgucgggg

SEQ ID NO: 809232 - RNA, 20 nt, Mycobacterium avium subsp. paratuberculosis
ccaucacgcagaacucgucg

SEQ ID NO: 809233 - RNA, 23 nt, Mycobacterium avium subsp. paratuberculosis
ccaucaccggaccggccagcagc

SEQ ID NO: 809234 - RNA, 17 nt, Mycobacterium avium subsp. paratuberculosis
ccaucacggugccgagu

SEQ ID NO: 809235 - RNA, 13 nt, Mycobacterium avium subsp. paratuberculosis
ccaucaccccgaa

SEQ ID NO: 809236 - RNA, 13 nt, Mycobacterium avium subsp. paratuberculosis
ccaucaccgcacc

SEQ ID NO: 809237 - RNA, 19 nt, Mycobacterium avium subsp. paratuberculosis
ccaucagcggcucgcgggu

SEQ ID NO: 809238 - RNA, 20 nt, Mycobacterium avium subsp. paratuberculosis
ccaucaggaugcccgggccg

SEQ ID NO: 809239 - RNA, 12 nt, Mycobacterium avium subsp. paratuberculosis
ccaucggcaucg

SEQ ID NO: 809240 - RNA, 18 nt, Mycobacterium avium subsp. paratuberculosis
ccaucggcagacccagca

SEQ ID NO: 809241 - RNA, 21 nt, Mycobacterium avium subsp. paratuberculosis
ccaucggcagacccagcagcg

SEQ ID NO: 809242 - RNA, 14 nt, Mycobacterium avium subsp. paratuberculosis
ccaucggcagcccg

SEQ ID NO: 809243 - RNA, 13 nt, Mycobacterium avium subsp. paratuberculosis
ccaucguggccgc

SEQ ID NO: 809244 - RNA, 13 nt, Mycobacterium avium subsp. paratuberculosis
ccaucguccucgc

SEQ ID NO: 809245 - RNA, 16 nt, Mycobacterium avium subsp. paratuberculosis
ccaucguccucgcgcc

SEQ ID NO: 809246 - RNA, 17 nt, Mycobacterium avium subsp. paratuberculosis
ccaucguccucgcgccg

SEQ ID NO: 809247 - RNA, 14 nt, Mycobacterium avium subsp. paratuberculosis
ccaucgggaccgcg

SEQ ID NO: 809248 - RNA, 20 nt, Mycobacterium avium subsp. paratuberculosis
ccaucgggucgucggcgucg

SEQ ID NO: 809249 - RNA, 19 nt, Mycobacterium avium subsp. paratuberculosis
ccaugcgaccacgaccggg

SEQ ID NO: 809250 - RNA, 20 nt, Mycobacterium avium subsp. paratuberculosis
ccaugcgcgagucgagcacc

SEQ ID NO: 809251 - RNA, 21 nt, Mycobacterium avium subsp. paratuberculosis
ccaugcgcgagucgagcaccg

SEQ ID NO: 809252 - RNA, 14 nt, Mycobacterium avium subsp. paratuberculosis
ccauggcggcaucc

SEQ ID NO: 809253 - RNA, 14 nt, Mycobacterium avium subsp. paratuberculosis
ccauggcggcccgc

SEQ ID NO: 809254 - RNA, 15 nt, Mycobacterium avium subsp. paratuberculosis
ccauggcggcccgcg

SEQ ID NO: 809255 - RNA, 21 nt, Mycobacterium avium subsp. paratuberculosis
ccauggcggcccgcgccggcg

SEQ ID NO: 809256 - RNA, 20 nt, Mycobacterium avium subsp. paratuberculosis
ccauggcgcggcggccggcc

SEQ ID NO: 809257 - RNA, 22 nt, Mycobacterium avium subsp. paratuberculosis
ccaucugcacagcuucggcgcc

SEQ ID NO: 809258 - RNA, 15 nt, Mycobacterium avium subsp. paratuberculosis
ccaucucgugcccgg

SEQ ID NO: 809259 - RNA, 17 nt, Mycobacterium avium subsp. paratuberculosis
ccaucucgugcccgggc

SEQ ID NO: 809260 - RNA, 15 nt, Mycobacterium avium subsp. paratuberculosis
ccaucugccggcgcu

SEQ ID NO: 809261 - RNA, 12 nt, Mycobacterium avium subsp. paratuberculosis
ccaucuggccgc

SEQ ID NO: 809262 - RNA, 13 nt, Mycobacterium avium subsp. paratuberculosis
ccaucuggccgcg

SEQ ID NO: 809263 - RNA, 23 nt, Mycobacterium avium subsp. paratuberculosis
ccaugccucuucggcgcgccggc

SEQ ID NO: 809264 - RNA, 13 nt, Mycobacterium avium subsp. paratuberculosis
ccaugccggcguc

SEQ ID NO: 809265 - RNA, 19 nt, Mycobacterium avium subsp. paratuberculosis
ccaugccggguuucggccc

SEQ ID NO: 809266 - RNA, 20 nt, Mycobacterium avium subsp. paratuberculosis
ccaugccggguuucggcccg

SEQ ID NO: 809267 - RNA, 13 nt, Mycobacterium avium subsp. paratuberculosis
ccaugccggugga

SEQ ID NO: 809268 - RNA, 21 nt, Mycobacterium avium subsp. paratuberculosis
ccaucucagcguucacgucga

SEQ ID NO: 809269 - RNA, 21 nt, Mycobacterium avium subsp. paratuberculosis
ccaucucgggagugcggccca

SEQ ID NO: 809270 - RNA, 19 nt, Mycobacterium avium subsp. paratuberculosis
ccaucuccuccgggcugac

SEQ ID NO: 809271 - RNA, 15 nt, Mycobacterium avium subsp. paratuberculosis
ccaucuacgaccucg

SEQ ID NO: 809272 - RNA, 14 nt, Mycobacterium avium subsp. paratuberculosis
cccaggcgaugccg

SEQ ID NO: 809273 - RNA, 15 nt, Mycobacterium avium subsp. paratuberculosis
cccaggccggcggug

SEQ ID NO: 809274 - RNA, 16 nt, Mycobacterium avium subsp. paratuberculosis
cccaggaugacgccga

SEQ ID NO: 809275 - RNA, 21 nt, Mycobacterium avium subsp. paratuberculosis
cccaggaugaucuucuccagg

SEQ ID NO: 809276 - RNA, 15 nt, Mycobacterium avium subsp. paratuberculosis
cccaggccgcggucg

SEQ ID NO: 809277 - RNA, 21 nt, Mycobacterium avium subsp. paratuberculosis
cccaggaggcacuggcgcugc

SEQ ID NO: 809278 - RNA, 20 nt, Mycobacterium avium subsp. paratuberculosis
cccaggaaguagccggccag

SEQ ID NO: 809279 - RNA, 22 nt, Mycobacterium avium subsp. paratuberculosis
cccaggaaguagccggccagcg

SEQ ID NO: 809280 - RNA, 15 nt, Mycobacterium avium subsp. paratuberculosis
cccaggcguggucgg

SEQ ID NO: 809281 - RNA, 17 nt, Mycobacterium avium subsp. paratuberculosis
cccaggcguggucggcg

SEQ ID NO: 809282 - RNA, 14 nt, Mycobacterium avium subsp. paratuberculosis
cccagggccucggc

SEQ ID NO: 809283 - RNA, 19 nt, Mycobacterium avium subsp. paratuberculosis
cccagggccucggcgaccg

SEQ ID NO: 809284 - RNA, 21 nt, Mycobacterium avium subsp. paratuberculosis
cccagggccucggcgaccgcc

SEQ ID NO: 809285 - RNA, 14 nt, Mycobacterium avium subsp. paratuberculosis
cccaggcgucgucg

SEQ ID NO: 809286 - RNA, 15 nt, Mycobacterium avium subsp. paratuberculosis
cccaggcgucgucgu

SEQ ID NO: 809287 - RNA, 19 nt, Mycobacterium avium subsp. paratuberculosis
cccaggaaaaccagcgacg

SEQ ID NO: 809288 - RNA, 24 nt, Mycobacterium avium subsp. paratuberculosis
cccaggaaaaccagcgacgccagc

SEQ ID NO: 809289 - RNA, 18 nt, Mycobacterium avium subsp. paratuberculosis
cccaggaacgcgcccggc

SEQ ID NO: 809290 - RNA, 20 nt, Mycobacterium avium subsp. paratuberculosis
cccaggaacgcgcccggcgg

SEQ ID NO: 809291 - RNA, 21 nt, Mycobacterium avium subsp. paratuberculosis
cccaggaacgcgcccggcggg

SEQ ID NO: 809292 - RNA, 15 nt, Mycobacterium avium subsp. paratuberculosis
cccaggaacgcgccg

SEQ ID NO: 809293 - RNA, 13 nt, Mycobacterium avium subsp. paratuberculosis
cccaggacgcggu

SEQ ID NO: 809294 - RNA, 14 nt, Mycobacterium avium subsp. paratuberculosis
cccaggacgcggug

SEQ ID NO: 809295 - RNA, 15 nt, Mycobacterium avium subsp. paratuberculosis
cccaggacgcgguga

SEQ ID NO: 809296 - RNA, 21 nt, Mycobacterium avium subsp. paratuberculosis
cccaggacgcggugacgguga

SEQ ID NO: 809297 - RNA, 13 nt, Mycobacterium avium subsp. paratuberculosis
cccaggacggcgc

SEQ ID NO: 809298 - RNA, 17 nt, Mycobacterium avium subsp. paratuberculosis
cccaggacggcgcggug

SEQ ID NO: 809299 - RNA, 18 nt, Mycobacterium avium subsp. paratuberculosis
cccaggacggcgcggugg

SEQ ID NO: 809300 - RNA, 21 nt, Mycobacterium avium subsp. paratuberculosis
cccaggacgguuucugccggc

SEQ ID NO: 809301 - RNA, 16 nt, Mycobacterium avium subsp. paratuberculosis
cccagcugucgggugg

SEQ ID NO: 809302 - RNA, 21 nt, Mycobacterium avium subsp. paratuberculosis
cccagcuugaccacccggucg

SEQ ID NO: 809303 - RNA, 19 nt, Mycobacterium avium subsp. paratuberculosis
cccagcugggccagcgcgg

SEQ ID NO: 809304 - RNA, 22 nt, Mycobacterium avium subsp. paratuberculosis
cccagcugggccagcgcggugg

SEQ ID NO: 809305 - RNA, 20 nt, Mycobacterium avium subsp. paratuberculosis
cccagcugggccgccagccg

SEQ ID NO: 809306 - RNA, 16 nt, Mycobacterium avium subsp. paratuberculosis
cccagcugcucgagca

SEQ ID NO: 809307 - RNA, 14 nt, Mycobacterium avium subsp. paratuberculosis
cccagcgccgcggc

SEQ ID NO: 809308 - RNA, 14 nt, Mycobacterium avium subsp. paratuberculosis
cccagcgcccgggc

SEQ ID NO: 809309 - RNA, 13 nt, Mycobacterium avium subsp. paratuberculosis
cccagcgccacgg

SEQ ID NO: 809310 - RNA, 12 nt, Mycobacterium avium subsp. paratuberculosis
cccagcgcaacg

SEQ ID NO: 809311 - RNA, 19 nt, Mycobacterium avium subsp. paratuberculosis
cccagcgcaacggcgucga

SEQ ID NO: 809312 - RNA, 20 nt, Mycobacterium avium subsp. paratuberculosis
cccagcgagcugccggcggc

SEQ ID NO: 809313 - RNA, 14 nt, Mycobacterium avium subsp. paratuberculosis
cccagcgaggcggc

SEQ ID NO: 809314 - RNA, 16 nt, Mycobacterium avium subsp. paratuberculosis
cccagguccaccaggu

SEQ ID NO: 809315 - RNA, 19 nt, Mycobacterium avium subsp. paratuberculosis
cccagguccaccaggugac

SEQ ID NO: 809316 - RNA, 23 nt, Mycobacterium avium subsp. paratuberculosis
cccaggucuucucguccgcgcug

SEQ ID NO: 809317 - RNA, 15 nt, Mycobacterium avium subsp. paratuberculosis
cccagggcgcgucca

SEQ ID NO: 809318 - RNA, 19 nt, Mycobacterium avium subsp. paratuberculosis
cccaguugcacgguguaga

SEQ ID NO: 809319 - RNA, 16 nt, Mycobacterium avium subsp. paratuberculosis
cccaguucccggcggg

SEQ ID NO: 809320 - RNA, 21 nt, Mycobacterium avium subsp. paratuberculosis
cccaguucccggcgggcaggu

SEQ ID NO: 809321 - RNA, 23 nt, Mycobacterium avium subsp. paratuberculosis
cccaguucgaucagcagcucggu

SEQ ID NO: 809322 - RNA, 15 nt, Mycobacterium avium subsp. paratuberculosis
cccaggugcagaccg

SEQ ID NO: 809323 - RNA, 19 nt, Mycobacterium avium subsp. paratuberculosis
cccaggugggcgcgcagca

SEQ ID NO: 809324 - RNA, 22 nt, Mycobacterium avium subsp. paratuberculosis
cccaggugggcgcgcagcacca

SEQ ID NO: 809325 - RNA, 18 nt, Mycobacterium avium subsp. paratuberculosis
cccagguuccggugucga

SEQ ID NO: 809326 - RNA, 22 nt, Mycobacterium avium subsp. paratuberculosis
cccagguuccggugucgagccg

SEQ ID NO: 809327 - RNA, 11 nt, Mycobacterium avium subsp. paratuberculosis
cccagguucuc

SEQ ID NO: 809328 - RNA, 15 nt, Mycobacterium avium subsp. paratuberculosis
cccaucgcggccgcc

SEQ ID NO: 809329 - RNA, 14 nt, Mycobacterium avium subsp. paratuberculosis
cccaucgcggucag

SEQ ID NO: 809330 - RNA, 15 nt, Mycobacterium avium subsp. paratuberculosis
cccaucucgagcagg

SEQ ID NO: 809331 - RNA, 18 nt, Mycobacterium avium subsp. paratuberculosis
cccaugaacgcgucgccg

SEQ ID NO: 809332 - RNA, 14 nt, Mycobacterium avium subsp. paratuberculosis
cccaguuggcgucg

SEQ ID NO: 809333 - RNA, 19 nt, Mycobacterium avium subsp. paratuberculosis
cccaguuggcgucgucggc

SEQ ID NO: 809334 - RNA, 11 nt, Mycobacterium avium subsp. paratuberculosis
cccaguuguuu

SEQ ID NO: 809335 - RNA, 21 nt, Mycobacterium avium subsp. paratuberculosis
cccaguuguuuccccagcccg

SEQ ID NO: 809336 - RNA, 14 nt, Mycobacterium avium subsp. paratuberculosis
cccagcaucgccgc

SEQ ID NO: 809337 - RNA, 22 nt, Mycobacterium avium subsp. paratuberculosis
cccagcaucgccgcgacccggu

SEQ ID NO: 809338 - RNA, 18 nt, Mycobacterium avium subsp. paratuberculosis
cccagcaucgccgcggug

SEQ ID NO: 809339 - RNA, 20 nt, Mycobacterium avium subsp. paratuberculosis
cccagcaucgccgcggugcg

SEQ ID NO: 809340 - RNA, 14 nt, Mycobacterium avium subsp. paratuberculosis
cccagccacagccg

SEQ ID NO: 809341 - RNA, 14 nt, Mycobacterium avium subsp. paratuberculosis
cccagccaccgugg

SEQ ID NO: 809342 - RNA, 18 nt, Mycobacterium avium subsp. paratuberculosis
cccagcaguuuguccugc

SEQ ID NO: 809343 - RNA, 17 nt, Mycobacterium avium subsp. paratuberculosis
cccagccagccgguggc

SEQ ID NO: 809344 - RNA, 14 nt, Mycobacterium avium subsp. paratuberculosis
cccagccagcgaca

SEQ ID NO: 809345 - RNA, 13 nt, Mycobacterium avium subsp. paratuberculosis
cccagccaggccg

SEQ ID NO: 809346 - RNA, 18 nt, Mycobacterium avium subsp. paratuberculosis
cccagacaggccggccgc

SEQ ID NO: 809347 - RNA, 14 nt, Mycobacterium avium subsp. paratuberculosis
cccagaauucgccg

SEQ ID NO: 809348 - RNA, 18 nt, Mycobacterium avium subsp. paratuberculosis
cccagaauucgccggggc

SEQ ID NO: 809349 - RNA, 16 nt, Mycobacterium avium subsp. paratuberculosis
cccagacccagcaucg

SEQ ID NO: 809350 - RNA, 17 nt, Mycobacterium avium subsp. paratuberculosis
cccagcaguccggcggu

SEQ ID NO: 809351 - RNA, 17 nt, Mycobacterium avium subsp. paratuberculosis
cccagcagcgggcccgg

SEQ ID NO: 809352 - RNA, 16 nt, Mycobacterium avium subsp. paratuberculosis
cccagcagcggggcga

SEQ ID NO: 809353 - RNA, 19 nt, Mycobacterium avium subsp. paratuberculosis
cccagcagcugcgcgucga

SEQ ID NO: 809354 - RNA, 16 nt, Mycobacterium avium subsp. paratuberculosis
cccagccggucgccgg

SEQ ID NO: 809355 - RNA, 14 nt, Mycobacterium avium subsp. paratuberculosis
cccagccggugcga

SEQ ID NO: 809356 - RNA, 13 nt, Mycobacterium avium subsp. paratuberculosis
cccagccggccga

SEQ ID NO: 809357 - RNA, 14 nt, Mycobacterium avium subsp. paratuberculosis
cccagccggccgac

SEQ ID NO: 809358 - RNA, 13 nt, Mycobacterium avium subsp. paratuberculosis
cccagcgagaccg

SEQ ID NO: 809359 - RNA, 18 nt, Mycobacterium avium subsp. paratuberculosis
cccagcgagaccgcuugc

SEQ ID NO: 809360 - RNA, 20 nt, Mycobacterium avium subsp. paratuberculosis
cccagcgagcaggucaccgg

SEQ ID NO: 809361 - RNA, 12 nt, Mycobacterium avium subsp. paratuberculosis
cccagcgagccg

SEQ ID NO: 809362 - RNA, 19 nt, Mycobacterium avium subsp. paratuberculosis
cccagccgcugacgauggc

SEQ ID NO: 809363 - RNA, 15 nt, Mycobacterium avium subsp. paratuberculosis
cccagccgccagccg

SEQ ID NO: 809364 - RNA, 16 nt, Mycobacterium avium subsp. paratuberculosis
cccagccgccgcgaca

SEQ ID NO: 809365 - RNA, 22 nt, Mycobacterium avium subsp. paratuberculosis
cccagccgcauucggugagcca

SEQ ID NO: 809366 - RNA, 13 nt, Mycobacterium avium subsp. paratuberculosis
cccagccgccagc

SEQ ID NO: 809367 - RNA, 15 nt, Mycobacterium avium subsp. paratuberculosis
cccagcccggccagc

SEQ ID NO: 809368 - RNA, 19 nt, Mycobacterium avium subsp. paratuberculosis
cccagcccggccagcaccc

SEQ ID NO: 809369 - RNA, 15 nt, Mycobacterium avium subsp. paratuberculosis
cccagcccggcgacg

SEQ ID NO: 809370 - RNA, 23 nt, Mycobacterium avium subsp. paratuberculosis
cccagcccucgucgaugacgucc

SEQ ID NO: 809371 - RNA, 19 nt, Mycobacterium avium subsp. paratuberculosis
cccagccccucgccgggcg

SEQ ID NO: 809372 - RNA, 20 nt, Mycobacterium avium subsp. paratuberculosis
cccagccccuuguagcccuc

SEQ ID NO: 809373 - RNA, 14 nt, Mycobacterium avium subsp. paratuberculosis
cccagcccgagcac

SEQ ID NO: 809374 - RNA, 21 nt, Mycobacterium avium subsp. paratuberculosis
cccagcccgagcaccagcgga

SEQ ID NO: 809375 - RNA, 13 nt, Mycobacterium avium subsp. paratuberculosis
cccagcccgccgc

SEQ ID NO: 809376 - RNA, 14 nt, Mycobacterium avium subsp. paratuberculosis
cccagcccgcgccg

SEQ ID NO: 809377 - RNA, 14 nt, Mycobacterium avium subsp. paratuberculosis
cccagcccgcgcga

SEQ ID NO: 809378 - RNA, 16 nt, Mycobacterium avium subsp. paratuberculosis
cccagcccgcgcgagc

SEQ ID NO: 809379 - RNA, 18 nt, Mycobacterium avium subsp. paratuberculosis
cccagcccgcgcgagcgc

SEQ ID NO: 809380 - RNA, 11 nt, Mycobacterium avium subsp. paratuberculosis
cccagcccgga

SEQ ID NO: 809381 - RNA, 22 nt, Mycobacterium avium subsp. paratuberculosis
cccacagcugacgggccggcgg

SEQ ID NO: 809382 - RNA, 17 nt, Mycobacterium avium subsp. paratuberculosis
cccacagcuugccggag

SEQ ID NO: 809383 - RNA, 13 nt, Mycobacterium avium subsp. paratuberculosis
cccacauucggcg

SEQ ID NO: 809384 - RNA, 22 nt, Mycobacterium avium subsp. paratuberculosis
cccaccaccacgaggaccagca

SEQ ID NO: 809385 - RNA, 12 nt, Mycobacterium avium subsp. paratuberculosis
cccaccaccgcc

SEQ ID NO: 809386 - RNA, 15 nt, Mycobacterium avium subsp. paratuberculosis
cccaccaccgccggc

SEQ ID NO: 809387 - RNA, 13 nt, Mycobacterium avium subsp. paratuberculosis
cccaccaccgccu

SEQ ID NO: 809388 - RNA, 20 nt, Mycobacterium avium subsp. paratuberculosis
cccaccaccgccucgacggu

SEQ ID NO: 809389 - RNA, 12 nt, Mycobacterium avium subsp. paratuberculosis
cccaccaccggc

SEQ ID NO: 809390 - RNA, 13 nt, Mycobacterium avium subsp. paratuberculosis
cccacgucgccgu

SEQ ID NO: 809391 - RNA, 22 nt, Mycobacterium avium subsp. paratuberculosis
cccacguggugaucagcauccg

SEQ ID NO: 809392 - RNA, 14 nt, Mycobacterium avium subsp. paratuberculosis
cccacguugagcac

SEQ ID NO: 809393 - RNA, 14 nt, Mycobacterium avium subsp. paratuberculosis
cccaccacaucggu

SEQ ID NO: 809394 - RNA, 21 nt, Mycobacterium avium subsp. paratuberculosis
cccaccacauucccgccgccg

SEQ ID NO: 809395 - RNA, 18 nt, Mycobacterium avium subsp. paratuberculosis
cccaccacgaagcuggcg

SEQ ID NO: 809396 - RNA, 19 nt, Mycobacterium avium subsp. paratuberculosis
cccacugccugacccggcc

SEQ ID NO: 809397 - RNA, 22 nt, Mycobacterium avium subsp. paratuberculosis
cccacugcccguagucggcggc

SEQ ID NO: 809398 - RNA, 19 nt, Mycobacterium avium subsp. paratuberculosis
cccacuggcggccggccgc

SEQ ID NO: 809399 - RNA, 22 nt, Mycobacterium avium subsp. paratuberculosis
cccacuggcggccggccgcgcc

SEQ ID NO: 809400 - RNA, 14 nt, Mycobacterium avium subsp. paratuberculosis
cccacucccagccg

SEQ ID NO: 809401 - RNA, 19 nt, Mycobacterium avium subsp. paratuberculosis
cccacucccagccgccggc

SEQ ID NO: 809402 - RNA, 20 nt, Mycobacterium avium subsp. paratuberculosis
cccacucccagccgccggcc

SEQ ID NO: 809403 - RNA, 14 nt, Mycobacterium avium subsp. paratuberculosis
cccacuucgacggu

SEQ ID NO: 809404 - RNA, 21 nt, Mycobacterium avium subsp. paratuberculosis
cccacuggucguugcacaccc

SEQ ID NO: 809405 - RNA, 18 nt, Mycobacterium avium subsp. paratuberculosis
cccagaacugggccgccg

SEQ ID NO: 809406 - RNA, 19 nt, Mycobacterium avium subsp. paratuberculosis
cccagaacugggccgccgu

SEQ ID NO: 809407 - RNA, 22 nt, Mycobacterium avium subsp. paratuberculosis
cccagaacugggccgccgucgc

SEQ ID NO: 809408 - RNA, 16 nt, Mycobacterium avium subsp. paratuberculosis
cccagaaccgcucggc

SEQ ID NO: 809409 - RNA, 19 nt, Mycobacterium avium subsp. paratuberculosis
cccagaaccgcucggcggc

SEQ ID NO: 809410 - RNA, 22 nt, Mycobacterium avium subsp. paratuberculosis
cccagaacgacgcgcucagccc

SEQ ID NO: 809411 - RNA, 21 nt, Mycobacterium avium subsp. paratuberculosis
cccacuuuucccgcgcgagca

SEQ ID NO: 809412 - RNA, 23 nt, Mycobacterium avium subsp. paratuberculosis
cccgaagcucaucaccggcgcgc

SEQ ID NO: 809413 - RNA, 16 nt, Mycobacterium avium subsp. paratuberculosis
cccgaaggugguggcg

SEQ ID NO: 809414 - RNA, 19 nt, Mycobacterium avium subsp. paratuberculosis
cccgaaugagacgacccga

SEQ ID NO: 809415 - RNA, 22 nt, Mycobacterium avium subsp. paratuberculosis
cccgaauugcgcugcaccgcag

SEQ ID NO: 809416 - RNA, 16 nt, Mycobacterium avium subsp. paratuberculosis
cccgaaaccgucgacc

SEQ ID NO: 809417 - RNA, 21 nt, Mycobacterium avium subsp. paratuberculosis
cccgaacacgggcggcagggc

SEQ ID NO: 809418 - RNA, 22 nt, Mycobacterium avium subsp. paratuberculosis
cccgaacacgggcggcagggcc

SEQ ID NO: 809419 - RNA, 20 nt, Mycobacterium avium subsp. paratuberculosis
cccgaacagccgggcggccg

SEQ ID NO: 809420 - RNA, 23 nt, Mycobacterium avium subsp. paratuberculosis
cccgaacagcuugccgaucuggu

SEQ ID NO: 809421 - RNA, 14 nt, Mycobacterium avium subsp. paratuberculosis
cccgaacagggcga

SEQ ID NO: 809422 - RNA, 20 nt, Mycobacterium avium subsp. paratuberculosis
cccgaacaucgccucggccg

SEQ ID NO: 809423 - RNA, 21 nt, Mycobacterium avium subsp. paratuberculosis
cccgaacaucgccucggccgc

SEQ ID NO: 809424 - RNA, 15 nt, Mycobacterium avium subsp. paratuberculosis
cccgaacccagcgcc

SEQ ID NO: 809425 - RNA, 14 nt, Mycobacterium avium subsp. paratuberculosis
cccgaacccggcca

SEQ ID NO: 809426 - RNA, 15 nt, Mycobacterium avium subsp. paratuberculosis
cccgaaccgcccgcc

SEQ ID NO: 809427 - RNA, 17 nt, Mycobacterium avium subsp. paratuberculosis
cccgaacggaccgggcg

SEQ ID NO: 809428 - RNA, 14 nt, Mycobacterium avium subsp. paratuberculosis
cccgaacugccgcg

SEQ ID NO: 809429 - RNA, 17 nt, Mycobacterium avium subsp. paratuberculosis
cccgaccgacgcccggc

SEQ ID NO: 809430 - RNA, 15 nt, Mycobacterium avium subsp. paratuberculosis
cccgaccgacgcggu

SEQ ID NO: 809431 - RNA, 22 nt, Mycobacterium avium subsp. paratuberculosis
cccgaccgacgcggucaccggc

SEQ ID NO: 809432 - RNA, 12 nt, Mycobacterium avium subsp. paratuberculosis
cccgaccccgcc

SEQ ID NO: 809433 - RNA, 17 nt, Mycobacterium avium subsp. paratuberculosis
cccgaccccgccagcac

SEQ ID NO: 809434 - RNA, 14 nt, Mycobacterium avium subsp. paratuberculosis
cccgaccccggcga

SEQ ID NO: 809435 - RNA, 15 nt, Mycobacterium avium subsp. paratuberculosis
cccgaccccggcgag

SEQ ID NO: 809436 - RNA, 18 nt, Mycobacterium avium subsp. paratuberculosis
cccgaccccggcgagcgc

SEQ ID NO: 809437 - RNA, 19 nt, Mycobacterium avium subsp. paratuberculosis
cccgaccccggcgagcgcg

SEQ ID NO: 809438 - RNA, 12 nt, Mycobacterium avium subsp. paratuberculosis
cccgacccgaag

SEQ ID NO: 809439 - RNA, 13 nt, Mycobacterium avium subsp. paratuberculosis
cccgacccgcacc

SEQ ID NO: 809440 - RNA, 14 nt, Mycobacterium avium subsp. paratuberculosis
cccgacccgcacca

SEQ ID NO: 809441 - RNA, 19 nt, Mycobacterium avium subsp. paratuberculosis
cccgacccgcaccaccgcc

SEQ ID NO: 809442 - RNA, 17 nt, Mycobacterium avium subsp. paratuberculosis
cccgacaucugccgggc

SEQ ID NO: 809443 - RNA, 18 nt, Mycobacterium avium subsp. paratuberculosis
cccgacaucugccgggcg

SEQ ID NO: 809444 - RNA, 20 nt, Mycobacterium avium subsp. paratuberculosis
cccgacaucugccgggcggc

SEQ ID NO: 809445 - RNA, 22 nt, Mycobacterium avium subsp. paratuberculosis
cccgaaggcguuggagccgacc

SEQ ID NO: 809446 - RNA, 20 nt, Mycobacterium avium subsp. paratuberculosis
cccgaccacaccggcgcugc

SEQ ID NO: 809447 - RNA, 14 nt, Mycobacterium avium subsp. paratuberculosis
cccgaccagcaccg

SEQ ID NO: 809448 - RNA, 15 nt, Mycobacterium avium subsp. paratuberculosis
cccgaccagcaccgc

SEQ ID NO: 809449 - RNA, 23 nt, Mycobacterium avium subsp. paratuberculosis
cccgaccaccuccccgcggugcc

SEQ ID NO: 809450 - RNA, 16 nt, Mycobacterium avium subsp. paratuberculosis
cccgaccagcgggccg

SEQ ID NO: 809451 - RNA, 13 nt, Mycobacterium avium subsp. paratuberculosis
cccgacaccgcca

SEQ ID NO: 809452 - RNA, 14 nt, Mycobacterium avium subsp. paratuberculosis
cccgacaccgccag

SEQ ID NO: 809453 - RNA, 16 nt, Mycobacterium avium subsp. paratuberculosis
cccgacaccgccagca

SEQ ID NO: 809454 - RNA, 19 nt, Mycobacterium avium subsp. paratuberculosis
cccgacaccgccagcagcg

SEQ ID NO: 809455 - RNA, 13 nt, Mycobacterium avium subsp. paratuberculosis
cccgacaccgccc

SEQ ID NO: 809456 - RNA, 20 nt, Mycobacterium avium subsp. paratuberculosis
cccgacaccgccccgccgcg

SEQ ID NO: 809457 - RNA, 18 nt, Mycobacterium avium subsp. paratuberculosis
cccgacaccgugguggcg

SEQ ID NO: 809458 - RNA, 19 nt, Mycobacterium avium subsp. paratuberculosis
cccgacaccgugguggcgg

SEQ ID NO: 809459 - RNA, 22 nt, Mycobacterium avium subsp. paratuberculosis
cccgacaccgugguggcggcga

SEQ ID NO: 809460 - RNA, 13 nt, Mycobacterium avium subsp. paratuberculosis
cccgacacgccga

SEQ ID NO: 809461 - RNA, 14 nt, Mycobacterium avium subsp. paratuberculosis
cccgacacgccgau

SEQ ID NO: 809462 - RNA, 15 nt, Mycobacterium avium subsp. paratuberculosis
cccgacacgccgauc

SEQ ID NO: 809463 - RNA, 15 nt, Mycobacterium avium subsp. paratuberculosis
cccgacagcaacgcc

SEQ ID NO: 809464 - RNA, 16 nt, Mycobacterium avium subsp. paratuberculosis
cccgacaggcccaccc

SEQ ID NO: 809465 - RNA, 17 nt, Mycobacterium avium subsp. paratuberculosis
cccgacauccaggaccg

SEQ ID NO: 809466 - RNA, 21 nt, Mycobacterium avium subsp. paratuberculosis
cccgacauccaggaccgcgcg

SEQ ID NO: 809467 - RNA, 23 nt, Mycobacterium avium subsp. paratuberculosis
cccgacauccaggaccgcgcgcc

SEQ ID NO: 809468 - RNA, 22 nt, Mycobacterium avium subsp. paratuberculosis
cccgacaucgccaucagcagcg

SEQ ID NO: 809469 - RNA, 14 nt, Mycobacterium avium subsp. paratuberculosis
cccgaccggagccg

SEQ ID NO: 809470 - RNA, 15 nt, Mycobacterium avium subsp. paratuberculosis
cccgaccucgucgac

SEQ ID NO: 809471 - RNA, 16 nt, Mycobacterium avium subsp. paratuberculosis
cccgaccucgucgacg

SEQ ID NO: 809472 - RNA, 18 nt, Mycobacterium avium subsp. paratuberculosis
cccgaccucgucgacggc

SEQ ID NO: 809473 - RNA, 21 nt, Mycobacterium avium subsp. paratuberculosis
cccgaccucgucgacggcggc

SEQ ID NO: 809474 - RNA, 12 nt, Mycobacterium avium subsp. paratuberculosis
cccgacgacgau

SEQ ID NO: 809475 - RNA, 13 nt, Mycobacterium avium subsp. paratuberculosis
cccgacgacgccg

SEQ ID NO: 809476 - RNA, 16 nt, Mycobacterium avium subsp. paratuberculosis
cccgacgacgccguca

SEQ ID NO: 809477 - RNA, 19 nt, Mycobacterium avium subsp. paratuberculosis
cccgacgaucgcgccggcc

SEQ ID NO: 809478 - RNA, 21 nt, Mycobacterium avium subsp. paratuberculosis
cccgacgccgacaccagcgcg

SEQ ID NO: 809479 - RNA, 15 nt, Mycobacterium avium subsp. paratuberculosis
cccgacgugcagcgc

SEQ ID NO: 809480 - RNA, 20 nt, Mycobacterium avium subsp. paratuberculosis
cccgacgugcagcgccagca

SEQ ID NO: 809481 - RNA, 22 nt, Mycobacterium avium subsp. paratuberculosis
cccgacgugcagcgccagcacc

SEQ ID NO: 809482 - RNA, 18 nt, Mycobacterium avium subsp. paratuberculosis
cccgacguugccgcuggu

SEQ ID NO: 809483 - RNA, 17 nt, Mycobacterium avium subsp. paratuberculosis
cccgacuccucacaccu

SEQ ID NO: 809484 - RNA, 18 nt, Mycobacterium avium subsp. paratuberculosis
cccgacuccucacaccuc

SEQ ID NO: 809485 - RNA, 18 nt, Mycobacterium avium subsp. paratuberculosis
cccgacggcgcgcccgac

SEQ ID NO: 809486 - RNA, 19 nt, Mycobacterium avium subsp. paratuberculosis
cccgacggcgcgcccgacg

SEQ ID NO: 809487 - RNA, 13 nt, Mycobacterium avium subsp. paratuberculosis
cccgacggcgucu

SEQ ID NO: 809488 - RNA, 19 nt, Mycobacterium avium subsp. paratuberculosis
cccgacgggcgugccggcg

SEQ ID NO: 809489 - RNA, 20 nt, Mycobacterium avium subsp. paratuberculosis
cccgacgggcgugccggcgg

SEQ ID NO: 809490 - RNA, 21 nt, Mycobacterium avium subsp. paratuberculosis
cccgacgggcgugccggcggc

SEQ ID NO: 809491 - RNA, 12 nt, Mycobacterium avium subsp. paratuberculosis
cccgacgcggcg

SEQ ID NO: 809492 - RNA, 16 nt, Mycobacterium avium subsp. paratuberculosis
cccgacgcggcgcgac

SEQ ID NO: 809493 - RNA, 18 nt, Mycobacterium avium subsp. paratuberculosis
cccgacggagacgacgac

SEQ ID NO: 809494 - RNA, 15 nt, Mycobacterium avium subsp. paratuberculosis
cccgacggcagcacc

SEQ ID NO: 809495 - RNA, 18 nt, Mycobacterium avium subsp. paratuberculosis
cccgacggcagcaccgcc

SEQ ID NO: 809496 - RNA, 19 nt, Mycobacterium avium subsp. paratuberculosis
cccgacggcagcaccgccg

SEQ ID NO: 809497 - RNA, 21 nt, Mycobacterium avium subsp. paratuberculosis
cccgacggcagcaccgccgac

SEQ ID NO: 809498 - RNA, 23 nt, Mycobacterium avium subsp. paratuberculosis
cccgacggcagcaccgccgacau

SEQ ID NO: 809499 - RNA, 21 nt, Mycobacterium avium subsp. paratuberculosis
cccgaggucauaucgacggcc

SEQ ID NO: 809500 - RNA, 16 nt, Mycobacterium avium subsp. paratuberculosis
cccgagcgucacgcca

SEQ ID NO: 809501 - RNA, 21 nt, Mycobacterium avium subsp. paratuberculosis
cccgagcgucacgccagcgug

SEQ ID NO: 809502 - RNA, 12 nt, Mycobacterium avium subsp. paratuberculosis
cccgagcgucau

SEQ ID NO: 809503 - RNA, 16 nt, Mycobacterium avium subsp. paratuberculosis
cccgagcgugggggcc

SEQ ID NO: 809504 - RNA, 19 nt, Mycobacterium avium subsp. paratuberculosis
cccgagcgugggggccaug

SEQ ID NO: 809505 - RNA, 19 nt, Mycobacterium avium subsp. paratuberculosis
cccgagcugaucgcggccg

SEQ ID NO: 809506 - RNA, 20 nt, Mycobacterium avium subsp. paratuberculosis
cccgagcugaucgcggccgg

SEQ ID NO: 809507 - RNA, 21 nt, Mycobacterium avium subsp. paratuberculosis
cccgagcugaucgcggccggc

SEQ ID NO: 809508 - RNA, 17 nt, Mycobacterium avium subsp. paratuberculosis
cccgaggagacgucggc

SEQ ID NO: 809509 - RNA, 16 nt, Mycobacterium avium subsp. paratuberculosis
cccgaggaugccgccc

SEQ ID NO: 809510 - RNA, 13 nt, Mycobacterium avium subsp. paratuberculosis
cccgagcggcauc

SEQ ID NO: 809511 - RNA, 13 nt, Mycobacterium avium subsp. paratuberculosis
cccgagcggcgac

SEQ ID NO: 809512 - RNA, 16 nt, Mycobacterium avium subsp. paratuberculosis
cccgagcggcgacucc

SEQ ID NO: 809513 - RNA, 13 nt, Mycobacterium avium subsp. paratuberculosis
cccgagccgacga

SEQ ID NO: 809514 - RNA, 19 nt, Mycobacterium avium subsp. paratuberculosis
cccgagcccugcgccagca

SEQ ID NO: 809515 - RNA, 20 nt, Mycobacterium avium subsp. paratuberculosis
cccgagcaccaccaggccca

SEQ ID NO: 809516 - RNA, 21 nt, Mycobacterium avium subsp. paratuberculosis
cccgagcaccccggcggccgc

SEQ ID NO: 809517 - RNA, 14 nt, Mycobacterium avium subsp. paratuberculosis
cccgagcaccgggc

SEQ ID NO: 809518 - RNA, 16 nt, Mycobacterium avium subsp. paratuberculosis
cccgagcaccgggccg

SEQ ID NO: 809519 - RNA, 17 nt, Mycobacterium avium subsp. paratuberculosis
cccgagcaccgggccga

SEQ ID NO: 809520 - RNA, 21 nt, Mycobacterium avium subsp. paratuberculosis
cccgagcaccugaacggccgc

SEQ ID NO: 809521 - RNA, 23 nt, Mycobacterium avium subsp. paratuberculosis
cccgagcaccugaacggccgcgc

SEQ ID NO: 809522 - RNA, 13 nt, Mycobacterium avium subsp. paratuberculosis
cccgagcacgucg

SEQ ID NO: 809523 - RNA, 15 nt, Mycobacterium avium subsp. paratuberculosis
cccgagcagaucggg

SEQ ID NO: 809524 - RNA, 18 nt, Mycobacterium avium subsp. paratuberculosis
cccgagcagaucgggucg

SEQ ID NO: 809525 - RNA, 16 nt, Mycobacterium avium subsp. paratuberculosis
cccgagcagcgggucg

SEQ ID NO: 809526 - RNA, 12 nt, Mycobacterium avium subsp. paratuberculosis
cccgagcaggcg

SEQ ID NO: 809527 - RNA, 18 nt, Mycobacterium avium subsp. paratuberculosis
cccgagcaggcggaucgg

SEQ ID NO: 809528 - RNA, 17 nt, Mycobacterium avium subsp. paratuberculosis
cccgacuucggcucggc

SEQ ID NO: 809529 - RNA, 14 nt, Mycobacterium avium subsp. paratuberculosis
cccgagaucaccgg

SEQ ID NO: 809530 - RNA, 16 nt, Mycobacterium avium subsp. paratuberculosis
cccgagaucccagcgg

SEQ ID NO: 809531 - RNA, 17 nt, Mycobacterium avium subsp. paratuberculosis
cccgagaucgcgggcug

SEQ ID NO: 809532 - RNA, 16 nt, Mycobacterium avium subsp. paratuberculosis
cccgagcaucgccgag

SEQ ID NO: 809533 - RNA, 17 nt, Mycobacterium avium subsp. paratuberculosis
cccgagcaucgccgagc

SEQ ID NO: 809534 - RNA, 18 nt, Mycobacterium avium subsp. paratuberculosis
cccgagcauuucgcgcac

SEQ ID NO: 809535 - RNA, 12 nt, Mycobacterium avium subsp. paratuberculosis
cccaugccgaug

SEQ ID NO: 809536 - RNA, 16 nt, Mycobacterium avium subsp. paratuberculosis
cccaugccccagguga

SEQ ID NO: 809537 - RNA, 14 nt, Mycobacterium avium subsp. paratuberculosis
cccaugucgaucgg

SEQ ID NO: 809538 - RNA, 16 nt, Mycobacterium avium subsp. paratuberculosis
cccaugucgaucggcu

SEQ ID NO: 809539 - RNA, 18 nt, Mycobacterium avium subsp. paratuberculosis
ccccguccagcccagcgc

SEQ ID NO: 809540 - RNA, 19 nt, Mycobacterium avium subsp. paratuberculosis
ccccguccagcccagcgcc

SEQ ID NO: 809541 - RNA, 14 nt, Mycobacterium avium subsp. paratuberculosis
ccccguccggcgcc

SEQ ID NO: 809542 - RNA, 15 nt, Mycobacterium avium subsp. paratuberculosis
ccccggucccggggc

SEQ ID NO: 809543 - RNA, 18 nt, Mycobacterium avium subsp. paratuberculosis
ccccggucccggggcucg

SEQ ID NO: 809544 - RNA, 19 nt, Mycobacterium avium subsp. paratuberculosis
ccccggucgugucaugugc

SEQ ID NO: 809545 - RNA, 21 nt, Mycobacterium avium subsp. paratuberculosis
ccccggugacgauccggucga

SEQ ID NO: 809546 - RNA, 22 nt, Mycobacterium avium subsp. paratuberculosis
ccccggugccgcagugccggcg

SEQ ID NO: 809547 - RNA, 18 nt, Mycobacterium avium subsp. paratuberculosis
ccccgguggaugggcucg

SEQ ID NO: 809548 - RNA, 22 nt, Mycobacterium avium subsp. paratuberculosis
ccccggugucugaccucgcgcc

SEQ ID NO: 809549 - RNA, 18 nt, Mycobacterium avium subsp. paratuberculosis
ccccgggcccagcaccac

SEQ ID NO: 809550 - RNA, 18 nt, Mycobacterium avium subsp. paratuberculosis
ccccgggccgcagggugg

SEQ ID NO: 809551 - RNA, 15 nt, Mycobacterium avium subsp. paratuberculosis
ccccgggcgagcguc

SEQ ID NO: 809552 - RNA, 13 nt, Mycobacterium avium subsp. paratuberculosis
ccccggcugcugc

SEQ ID NO: 809553 - RNA, 21 nt, Mycobacterium avium subsp. paratuberculosis
ccccggcugcugcacgacgac

SEQ ID NO: 809554 - RNA, 16 nt, Mycobacterium avium subsp. paratuberculosis
ccccgggaaaugcugc

SEQ ID NO: 809555 - RNA, 13 nt, Mycobacterium avium subsp. paratuberculosis
ccccgggaaccag

SEQ ID NO: 809556 - RNA, 15 nt, Mycobacterium avium subsp. paratuberculosis
ccccgggaacgacgg

SEQ ID NO: 809557 - RNA, 18 nt, Mycobacterium avium subsp. paratuberculosis
ccccgggaacgacggugc

SEQ ID NO: 809558 - RNA, 19 nt, Mycobacterium avium subsp. paratuberculosis
ccccgggauccgaggcguc

SEQ ID NO: 809559 - RNA, 19 nt, Mycobacterium avium subsp. paratuberculosis
ccccggucaccccggccau

SEQ ID NO: 809560 - RNA, 13 nt, Mycobacterium avium subsp. paratuberculosis
ccccgggcaccag

SEQ ID NO: 809561 - RNA, 19 nt, Mycobacterium avium subsp. paratuberculosis
ccccgguagccagcaccgc

SEQ ID NO: 809562 - RNA, 15 nt, Mycobacterium avium subsp. paratuberculosis
ccccgggcgugccgg

SEQ ID NO: 809563 - RNA, 21 nt, Mycobacterium avium subsp. paratuberculosis
ccccggggccuccagccagcg

SEQ ID NO: 809564 - RNA, 16 nt, Mycobacterium avium subsp. paratuberculosis
ccccuaccgccgagcg

SEQ ID NO: 809565 - RNA, 14 nt, Mycobacterium avium subsp. paratuberculosis
ccccuacgccgugg

SEQ ID NO: 809566 - RNA, 23 nt, Mycobacterium avium subsp. paratuberculosis
ccccuacgggcgcaccgcgcgcc

SEQ ID NO: 809567 - RNA, 14 nt, Mycobacterium avium subsp. paratuberculosis
ccccguuggugcgg

SEQ ID NO: 809568 - RNA, 14 nt, Mycobacterium avium subsp. paratuberculosis
ccccguugccgccg

SEQ ID NO: 809569 - RNA, 23 nt, Mycobacterium avium subsp. paratuberculosis
ccccucgacguccaggccggcgc

SEQ ID NO: 809570 - RNA, 14 nt, Mycobacterium avium subsp. paratuberculosis
ccccucgccgggcg

SEQ ID NO: 809571 - RNA, 14 nt, Mycobacterium avium subsp. paratuberculosis
ccccucggcggccg

SEQ ID NO: 809572 - RNA, 17 nt, Mycobacterium avium subsp. paratuberculosis
ccccucggcggccgucg

SEQ ID NO: 809573 - RNA, 13 nt, Mycobacterium avium subsp. paratuberculosis
ccccgugcggggc

SEQ ID NO: 809574 - RNA, 17 nt, Mycobacterium avium subsp. paratuberculosis
ccccgugcggggccucg

SEQ ID NO: 809575 - RNA, 15 nt, Mycobacterium avium subsp. paratuberculosis
ccccguucgccgaca

SEQ ID NO: 809576 - RNA, 23 nt, Mycobacterium avium subsp. paratuberculosis
ccccguugaucuugaccgucgcg

SEQ ID NO: 809577 - RNA, 13 nt, Mycobacterium avium subsp. paratuberculosis
ccccgugcagccg

SEQ ID NO: 809578 - RNA, 13 nt, Mycobacterium avium subsp. paratuberculosis
ccccgucgggccg

SEQ ID NO: 809579 - RNA, 15 nt, Mycobacterium avium subsp. paratuberculosis
ccccgucgggccguc

SEQ ID NO: 809580 - RNA, 18 nt, Mycobacterium avium subsp. paratuberculosis
ccccgucggucccgacgc

SEQ ID NO: 809581 - RNA, 19 nt, Mycobacterium avium subsp. paratuberculosis
ccccguaugcgccaacgcu

SEQ ID NO: 809582 - RNA, 16 nt, Mycobacterium avium subsp. paratuberculosis
ccccguauugccgucg

SEQ ID NO: 809583 - RNA, 17 nt, Mycobacterium avium subsp. paratuberculosis
ccccguauugccgucgg

SEQ ID NO: 809584 - RNA, 20 nt, Mycobacterium avium subsp. paratuberculosis
ccccguauugccgucggcgu

SEQ ID NO: 809585 - RNA, 21 nt, Mycobacterium avium subsp. paratuberculosis
ccccguauugccgucggcguc

SEQ ID NO: 809586 - RNA, 22 nt, Mycobacterium avium subsp. paratuberculosis
ccccguauugccgucggcgucg

SEQ ID NO: 809587 - RNA, 23 nt, Mycobacterium avium subsp. paratuberculosis
ccccugagggugucggcgaucca

SEQ ID NO: 809588 - RNA, 14 nt, Mycobacterium avium subsp. paratuberculosis
ccccugcggggugu

SEQ ID NO: 809589 - RNA, 15 nt, Mycobacterium avium subsp. paratuberculosis
ccccugcucagcggc

SEQ ID NO: 809590 - RNA, 16 nt, Mycobacterium avium subsp. paratuberculosis
ccccugcucagcggcc

SEQ ID NO: 809591 - RNA, 14 nt, Mycobacterium avium subsp. paratuberculosis
ccccugcucgcugu

SEQ ID NO: 809592 - RNA, 12 nt, Mycobacterium avium subsp. paratuberculosis
ccccugccgcca

SEQ ID NO: 809593 - RNA, 14 nt, Mycobacterium avium subsp. paratuberculosis
ccccugccgccacc

SEQ ID NO: 809594 - RNA, 22 nt, Mycobacterium avium subsp. paratuberculosis
cccgaaaaauaggugaccucga

SEQ ID NO: 809595 - RNA, 19 nt, Mycobacterium avium subsp. paratuberculosis
cccgaaaagcaccaggcuc

SEQ ID NO: 809596 - RNA, 21 nt, Mycobacterium avium subsp. paratuberculosis
cccgaaaagguauucgcgcaa

SEQ ID NO: 809597 - RNA, 15 nt, Mycobacterium avium subsp. paratuberculosis
cccgaguucggccag

SEQ ID NO: 809598 - RNA, 21 nt, Mycobacterium avium subsp. paratuberculosis
cccgaguucggccagaucggc

SEQ ID NO: 809599 - RNA, 17 nt, Mycobacterium avium subsp. paratuberculosis
cccgagucacccggcug

SEQ ID NO: 809600 - RNA, 18 nt, Mycobacterium avium subsp. paratuberculosis
cccgagucacccggcugg

SEQ ID NO: 809601 - RNA, 21 nt, Mycobacterium avium subsp. paratuberculosis
cccgagucacccggcuggccg

SEQ ID NO: 809602 - RNA, 14 nt, Mycobacterium avium subsp. paratuberculosis
cccgaguggcgccg

SEQ ID NO: 809603 - RNA, 16 nt, Mycobacterium avium subsp. paratuberculosis
cccgaguggcgccguc

SEQ ID NO: 809604 - RNA, 17 nt, Mycobacterium avium subsp. paratuberculosis
cccgaguggcgccgucg

SEQ ID NO: 809605 - RNA, 18 nt, Mycobacterium avium subsp. paratuberculosis
cccgaguggcgccgucgg

SEQ ID NO: 809606 - RNA, 19 nt, Mycobacterium avium subsp. paratuberculosis
cccgagugggaccgucggc

SEQ ID NO: 809607 - RNA, 17 nt, Mycobacterium avium subsp. paratuberculosis
cccgaugaccggcccgg

SEQ ID NO: 809608 - RNA, 21 nt, Mycobacterium avium subsp. paratuberculosis
cccgaugaccggcccggcggc

SEQ ID NO: 809609 - RNA, 14 nt, Mycobacterium avium subsp. paratuberculosis
cccgaugccgccga

SEQ ID NO: 809610 - RNA, 12 nt, Mycobacterium avium subsp. paratuberculosis
cccgaugccgcg

SEQ ID NO: 809611 - RNA, 19 nt, Mycobacterium avium subsp. paratuberculosis
cccgaugccgcgcaggccg

SEQ ID NO: 809612 - RNA, 21 nt, Mycobacterium avium subsp. paratuberculosis
cccgaugccgcgcaggccguc

SEQ ID NO: 809613 - RNA, 20 nt, Mycobacterium avium subsp. paratuberculosis
cccgaucugggaucggugcg

SEQ ID NO: 809614 - RNA, 18 nt, Mycobacterium avium subsp. paratuberculosis
cccgauagccccgccagg

SEQ ID NO: 809615 - RNA, 18 nt, Mycobacterium avium subsp. paratuberculosis
cccgaugcggugccgggc

SEQ ID NO: 809616 - RNA, 17 nt, Mycobacterium avium subsp. paratuberculosis
cccgaugcucccggucg

SEQ ID NO: 809617 - RNA, 21 nt, Mycobacterium avium subsp. paratuberculosis
cccgaugccgaacuccgccga

SEQ ID NO: 809618 - RNA, 23 nt, Mycobacterium avium subsp. paratuberculosis
cccgaugccgaacuccgccgaac

SEQ ID NO: 809619 - RNA, 16 nt, Mycobacterium avium subsp. paratuberculosis
cccgaugcgcucaccc

SEQ ID NO: 809620 - RNA, 13 nt, Mycobacterium avium subsp. paratuberculosis
cccgaugcgcucg

SEQ ID NO: 809621 - RNA, 18 nt, Mycobacterium avium subsp. paratuberculosis
cccgauggaggugccgcg

SEQ ID NO: 809622 - RNA, 16 nt, Mycobacterium avium subsp. paratuberculosis
cccgauggcggccugc

SEQ ID NO: 809623 - RNA, 16 nt, Mycobacterium avium subsp. paratuberculosis
cccgauucagccggcg

SEQ ID NO: 809624 - RNA, 20 nt, Mycobacterium avium subsp. paratuberculosis
cccgauucagccggcgggcg

SEQ ID NO: 809625 - RNA, 15 nt, Mycobacterium avium subsp. paratuberculosis
cccgauucgcggcca

SEQ ID NO: 809626 - RNA, 16 nt, Mycobacterium avium subsp. paratuberculosis
cccgcaaaucagccga

SEQ ID NO: 809627 - RNA, 20 nt, Mycobacterium avium subsp. paratuberculosis
cccgcaaaucagccgagccg

SEQ ID NO: 809628 - RNA, 16 nt, Mycobacterium avium subsp. paratuberculosis
cccgaugcggacgcgu

SEQ ID NO: 809629 - RNA, 18 nt, Mycobacterium avium subsp. paratuberculosis
cccgcaacgcgcgcgacg

SEQ ID NO: 809630 - RNA, 18 nt, Mycobacterium avium subsp. paratuberculosis
cccgcaacgcugaccgca

SEQ ID NO: 809631 - RNA, 17 nt, Mycobacterium avium subsp. paratuberculosis
cccgcaucaacugcacc

SEQ ID NO: 809632 - RNA, 21 nt, Mycobacterium avium subsp. paratuberculosis
cccgcaucaacugcaccagcg

SEQ ID NO: 809633 - RNA, 23 nt, Mycobacterium avium subsp. paratuberculosis
cccgcaucaacugcaccagcggc

SEQ ID NO: 809634 - RNA, 12 nt, Mycobacterium avium subsp. paratuberculosis
cccgcagugcgu

SEQ ID NO: 809635 - RNA, 20 nt, Mycobacterium avium subsp. paratuberculosis
cccgcagugcgucagaaccg

SEQ ID NO: 809636 - RNA, 19 nt, Mycobacterium avium subsp. paratuberculosis
cccgcaguucggccgccgu

SEQ ID NO: 809637 - RNA, 19 nt, Mycobacterium avium subsp. paratuberculosis
cccgcaauugcgccagcag

SEQ ID NO: 809638 - RNA, 23 nt, Mycobacterium avium subsp. paratuberculosis
cccgcauggccuugagaacgucg

SEQ ID NO: 809639 - RNA, 23 nt, Mycobacterium avium subsp. paratuberculosis
cccgcauguccggggugagcagg

SEQ ID NO: 809640 - RNA, 23 nt, Mycobacterium avium subsp. paratuberculosis
cccgcauguucucgagcccgauc

SEQ ID NO: 809641 - RNA, 14 nt, Mycobacterium avium subsp. paratuberculosis
cccgcaugcaccgg

SEQ ID NO: 809642 - RNA, 17 nt, Mycobacterium avium subsp. paratuberculosis
cccgcaucgcggcgaug

SEQ ID NO: 809643 - RNA, 15 nt, Mycobacterium avium subsp. paratuberculosis
cccgcaucgccgaac

SEQ ID NO: 809644 - RNA, 19 nt, Mycobacterium avium subsp. paratuberculosis
cccgcaucgccgaaccggg

SEQ ID NO: 809645 - RNA, 12 nt, Mycobacterium avium subsp. paratuberculosis
cccgcaucgcac

SEQ ID NO: 809646 - RNA, 19 nt, Mycobacterium avium subsp. paratuberculosis
cccgccacggccagcaccg

SEQ ID NO: 809647 - RNA, 15 nt, Mycobacterium avium subsp. paratuberculosis
cccgccaaucaccgc

SEQ ID NO: 809648 - RNA, 13 nt, Mycobacterium avium subsp. paratuberculosis
cccgccacgugcg

SEQ ID NO: 809649 - RNA, 15 nt, Mycobacterium avium subsp. paratuberculosis
cccgccacgugcggc

SEQ ID NO: 809650 - RNA, 12 nt, Mycobacterium avium subsp. paratuberculosis
cccgccagcccg

SEQ ID NO: 809651 - RNA, 16 nt, Mycobacterium avium subsp. paratuberculosis
cccgccagcccgcguc

SEQ ID NO: 809652 - RNA, 13 nt, Mycobacterium avium subsp. paratuberculosis
cccgcccacgggu

SEQ ID NO: 809653 - RNA, 20 nt, Mycobacterium avium subsp. paratuberculosis
cccgcccacgggucgccgau

SEQ ID NO: 809654 - RNA, 22 nt, Mycobacterium avium subsp. paratuberculosis
cccgcccaccacgaacgcgccg

SEQ ID NO: 809655 - RNA, 16 nt, Mycobacterium avium subsp. paratuberculosis
cccgccauggcggcau

SEQ ID NO: 809656 - RNA, 21 nt, Mycobacterium avium subsp. paratuberculosis
cccgccauggcggcaucccca

SEQ ID NO: 809657 - RNA, 13 nt, Mycobacterium avium subsp. paratuberculosis
cccgccaucugga

SEQ ID NO: 809658 - RNA, 18 nt, Mycobacterium avium subsp. paratuberculosis
cccgcuucaggcagcgca

SEQ ID NO: 809659 - RNA, 16 nt, Mycobacterium avium subsp. paratuberculosis
cccgcuucuggcgggc

SEQ ID NO: 809660 - RNA, 17 nt, Mycobacterium avium subsp. paratuberculosis
cccgcuucuggcgggcg

SEQ ID NO: 809661 - RNA, 13 nt, Mycobacterium avium subsp. paratuberculosis
cccgcuugccgac

SEQ ID NO: 809662 - RNA, 14 nt, Mycobacterium avium subsp. paratuberculosis
cccgcuugccggau

SEQ ID NO: 809663 - RNA, 19 nt, Mycobacterium avium subsp. paratuberculosis
cccgcuggggcgcaccgcc

SEQ ID NO: 809664 - RNA, 18 nt, Mycobacterium avium subsp. paratuberculosis
cccgcuggcgccggcguc

SEQ ID NO: 809665 - RNA, 20 nt, Mycobacterium avium subsp. paratuberculosis
cccgcugugguccucgucac

SEQ ID NO: 809666 - RNA, 16 nt, Mycobacterium avium subsp. paratuberculosis
cccgcucggcgggucg

SEQ ID NO: 809667 - RNA, 12 nt, Mycobacterium avium subsp. paratuberculosis
cccgcucgccga

SEQ ID NO: 809668 - RNA, 21 nt, Mycobacterium avium subsp. paratuberculosis
cccgcucgccgaugacguugc

SEQ ID NO: 809669 - RNA, 14 nt, Mycobacterium avium subsp. paratuberculosis
cccgcucgcgggcc

SEQ ID NO: 809670 - RNA, 14 nt, Mycobacterium avium subsp. paratuberculosis
cccgcucggcgauc

SEQ ID NO: 809671 - RNA, 15 nt, Mycobacterium avium subsp. paratuberculosis
cccgcucggcgaucu

SEQ ID NO: 809672 - RNA, 17 nt, Mycobacterium avium subsp. paratuberculosis
cccgcucggccagcgcg

SEQ ID NO: 809673 - RNA, 20 nt, Mycobacterium avium subsp. paratuberculosis
cccgcucggccagcgcgccg

SEQ ID NO: 809674 - RNA, 22 nt, Mycobacterium avium subsp. paratuberculosis
cccgcucggccagcgcgccgca

SEQ ID NO: 809675 - RNA, 22 nt, Mycobacterium avium subsp. paratuberculosis
cccgcuccuccucgcgccgcca

SEQ ID NO: 809676 - RNA, 17 nt, Mycobacterium avium subsp. paratuberculosis
cccgcucgaugggugug

SEQ ID NO: 809677 - RNA, 15 nt, Mycobacterium avium subsp. paratuberculosis
cccgcuccgacgcgg

SEQ ID NO: 809678 - RNA, 19 nt, Mycobacterium avium subsp. paratuberculosis
cccgcgugacggccgcggc

SEQ ID NO: 809679 - RNA, 21 nt, Mycobacterium avium subsp. paratuberculosis
cccgcgugacggccgcggcgc

SEQ ID NO: 809680 - RNA, 19 nt, Mycobacterium avium subsp. paratuberculosis
cccgcucgacgcgcacccg

SEQ ID NO: 809681 - RNA, 17 nt, Mycobacterium avium subsp. paratuberculosis
cccgcgucguggcccug

SEQ ID NO: 809682 - RNA, 18 nt, Mycobacterium avium subsp. paratuberculosis
cccgcguccugcagcgcc

SEQ ID NO: 809683 - RNA, 23 nt, Mycobacterium avium subsp. paratuberculosis
cccgcguccugcagcgccguccg

SEQ ID NO: 809684 - RNA, 16 nt, Mycobacterium avium subsp. paratuberculosis
cccgcgucgcgcagca

SEQ ID NO: 809685 - RNA, 20 nt, Mycobacterium avium subsp. paratuberculosis
cccgcggugugcuggccagc

SEQ ID NO: 809686 - RNA, 22 nt, Mycobacterium avium subsp. paratuberculosis
cccgcggugugcuggccagcac

SEQ ID NO: 809687 - RNA, 23 nt, Mycobacterium avium subsp. paratuberculosis
cccgcggugugcuggccagcacc

SEQ ID NO: 809688 - RNA, 16 nt, Mycobacterium avium subsp. paratuberculosis
cccgcguaaccggcgg

SEQ ID NO: 809689 - RNA, 17 nt, Mycobacterium avium subsp. paratuberculosis
cccgcguaaccggcggc

SEQ ID NO: 809690 - RNA, 18 nt, Mycobacterium avium subsp. paratuberculosis
cccgcguaaccggcggcg

SEQ ID NO: 809691 - RNA, 23 nt, Mycobacterium avium subsp. paratuberculosis
cccgcguaaccggcggcggugag

SEQ ID NO: 809692 - RNA, 16 nt, Mycobacterium avium subsp. paratuberculosis
cccgcguacagcgggu

SEQ ID NO: 809693 - RNA, 20 nt, Mycobacterium avium subsp. paratuberculosis
cccgcguauugcacggcggc

SEQ ID NO: 809694 - RNA, 16 nt, Mycobacterium avium subsp. paratuberculosis
cccgcuccgcgggcag

SEQ ID NO: 809695 - RNA, 18 nt, Mycobacterium avium subsp. paratuberculosis
cccgcuccgcgggcagcg

SEQ ID NO: 809696 - RNA, 15 nt, Mycobacterium avium subsp. paratuberculosis
cccgcuccggcggac

SEQ ID NO: 809697 - RNA, 13 nt, Mycobacterium avium subsp. paratuberculosis
cccgcgcgggcug

SEQ ID NO: 809698 - RNA, 14 nt, Mycobacterium avium subsp. paratuberculosis
cccgcgcgggggcc

SEQ ID NO: 809699 - RNA, 13 nt, Mycobacterium avium subsp. paratuberculosis
cccgcgcgggguc

SEQ ID NO: 809700 - RNA, 12 nt, Mycobacterium avium subsp. paratuberculosis
cccgcgcgucgc

SEQ ID NO: 809701 - RNA, 14 nt, Mycobacterium avium subsp. paratuberculosis
cccgcgcgucgcgc

SEQ ID NO: 809702 - RNA, 15 nt, Mycobacterium avium subsp. paratuberculosis
cccgcgcgucgcgca

SEQ ID NO: 809703 - RNA, 18 nt, Mycobacterium avium subsp. paratuberculosis
cccgcgcgucgcgcagcg

SEQ ID NO: 809704 - RNA, 20 nt, Mycobacterium avium subsp. paratuberculosis
cccgcgggucgucgggcggc

SEQ ID NO: 809705 - RNA, 23 nt, Mycobacterium avium subsp. paratuberculosis
cccgcggguggccuucaucaccg

SEQ ID NO: 809706 - RNA, 20 nt, Mycobacterium avium subsp. paratuberculosis
cccgcggguguuucggucgg

SEQ ID NO: 809707 - RNA, 17 nt, Mycobacterium avium subsp. paratuberculosis
cccgcggucaugcgcgg

SEQ ID NO: 809708 - RNA, 20 nt, Mycobacterium avium subsp. paratuberculosis
cccgcggucaugcgcgggca

SEQ ID NO: 809709 - RNA, 16 nt, Mycobacterium avium subsp. paratuberculosis
cccgcggucggcggcg

SEQ ID NO: 809710 - RNA, 18 nt, Mycobacterium avium subsp. paratuberculosis
cccgcggucggcggcgua

SEQ ID NO: 809711 - RNA, 20 nt, Mycobacterium avium subsp. paratuberculosis
cccgcggugcagucggucgg

SEQ ID NO: 809712 - RNA, 20 nt, Mycobacterium avium subsp. paratuberculosis
cccgcggugccgcagcucga

SEQ ID NO: 809713 - RNA, 20 nt, Mycobacterium avium subsp. paratuberculosis
cccgcgguggaacccagcac

SEQ ID NO: 809714 - RNA, 23 nt, Mycobacterium avium subsp. paratuberculosis
cccgcgacccagacuugggcagc

SEQ ID NO: 809715 - RNA, 16 nt, Mycobacterium avium subsp. paratuberculosis
cccgcgaccgcagcag

SEQ ID NO: 809716 - RNA, 12 nt, Mycobacterium avium subsp. paratuberculosis
cccgcgacgucg

SEQ ID NO: 809717 - RNA, 13 nt, Mycobacterium avium subsp. paratuberculosis
cccgcgacugucg

SEQ ID NO: 809718 - RNA, 16 nt, Mycobacterium avium subsp. paratuberculosis
cccgcgacugucggcg

SEQ ID NO: 809719 - RNA, 18 nt, Mycobacterium avium subsp. paratuberculosis
cccgcgacugucggcgcc

SEQ ID NO: 809720 - RNA, 19 nt, Mycobacterium avium subsp. paratuberculosis
cccgcgacugucggcucgc

SEQ ID NO: 809721 - RNA, 14 nt, Mycobacterium avium subsp. paratuberculosis
cccgcgaucggcgc

SEQ ID NO: 809722 - RNA, 16 nt, Mycobacterium avium subsp. paratuberculosis
cccgcgaucggcgcca

SEQ ID NO: 809723 - RNA, 13 nt, Mycobacterium avium subsp. paratuberculosis
cccgcgcggccgc

SEQ ID NO: 809724 - RNA, 14 nt, Mycobacterium avium subsp. paratuberculosis
cccgcgcggccgcc

SEQ ID NO: 809725 - RNA, 13 nt, Mycobacterium avium subsp. paratuberculosis
cccgcgcggcgca

SEQ ID NO: 809726 - RNA, 14 nt, Mycobacterium avium subsp. paratuberculosis
cccgcgcggcggcc

SEQ ID NO: 809727 - RNA, 15 nt, Mycobacterium avium subsp. paratuberculosis
cccgcgcggcggcca

SEQ ID NO: 809728 - RNA, 14 nt, Mycobacterium avium subsp. paratuberculosis
cccgcgcggcggug

SEQ ID NO: 809729 - RNA, 19 nt, Mycobacterium avium subsp. paratuberculosis
cccgcgcggcucacagcgc

SEQ ID NO: 809730 - RNA, 22 nt, Mycobacterium avium subsp. paratuberculosis
cccgcgcggcucacagcgcggc

SEQ ID NO: 809731 - RNA, 19 nt, Mycobacterium avium subsp. paratuberculosis
cccgcgcggcucgcgggcg

SEQ ID NO: 809732 - RNA, 12 nt, Mycobacterium avium subsp. paratuberculosis
cccgcgcgggca

SEQ ID NO: 809733 - RNA, 14 nt, Mycobacterium avium subsp. paratuberculosis
cccgcgcgcgggcc

SEQ ID NO: 809734 - RNA, 15 nt, Mycobacterium avium subsp. paratuberculosis
cccgcgcgcgggcca

SEQ ID NO: 809735 - RNA, 13 nt, Mycobacterium avium subsp. paratuberculosis
cccgcgcgcucgg

SEQ ID NO: 809736 - RNA, 14 nt, Mycobacterium avium subsp. paratuberculosis
cccgcgcgcugacc

SEQ ID NO: 809737 - RNA, 22 nt, Mycobacterium avium subsp. paratuberculosis
cccgcgcaauacccgaccagca

SEQ ID NO: 809738 - RNA, 16 nt, Mycobacterium avium subsp. paratuberculosis
cccgcgcaggccccgg

SEQ ID NO: 809739 - RNA, 17 nt, Mycobacterium avium subsp. paratuberculosis
cccgcgcaggccccggg

SEQ ID NO: 809740 - RNA, 22 nt, Mycobacterium avium subsp. paratuberculosis
cccgcgcaucccgucgaccagg

SEQ ID NO: 809741 - RNA, 23 nt, Mycobacterium avium subsp. paratuberculosis
cccgcgcgacaucaccgcgggcg

SEQ ID NO: 809742 - RNA, 13 nt, Mycobacterium avium subsp. paratuberculosis
cccgcgcgaucgg

SEQ ID NO: 809743 - RNA, 17 nt, Mycobacterium avium subsp. paratuberculosis
cccgcgcgaucggcgag

SEQ ID NO: 809744 - RNA, 15 nt, Mycobacterium avium subsp. paratuberculosis
cccgccgggccggau

SEQ ID NO: 809745 - RNA, 14 nt, Mycobacterium avium subsp. paratuberculosis
cccgccgggcgcca

SEQ ID NO: 809746 - RNA, 15 nt, Mycobacterium avium subsp. paratuberculosis
cccgccgggcgucgc

SEQ ID NO: 809747 - RNA, 19 nt, Mycobacterium avium subsp. paratuberculosis
cccgccgggcugaccgucg

SEQ ID NO: 809748 - RNA, 13 nt, Mycobacterium avium subsp. paratuberculosis
cccgccggggccg

SEQ ID NO: 809749 - RNA, 15 nt, Mycobacterium avium subsp. paratuberculosis
cccgccggggccggc

SEQ ID NO: 809750 - RNA, 16 nt, Mycobacterium avium subsp. paratuberculosis
cccgccgggguccgca

SEQ ID NO: 809751 - RNA, 21 nt, Mycobacterium avium subsp. paratuberculosis
cccgccggguggccgccacgu

SEQ ID NO: 809752 - RNA, 12 nt, Mycobacterium avium subsp. paratuberculosis
cccgccggcggc

SEQ ID NO: 809753 - RNA, 13 nt, Mycobacterium avium subsp. paratuberculosis
cccgccggcggcc

SEQ ID NO: 809754 - RNA, 13 nt, Mycobacterium avium subsp. paratuberculosis
cccgccggcgggu

SEQ ID NO: 809755 - RNA, 22 nt, Mycobacterium avium subsp. paratuberculosis
cccgccggcggguuggccgucg

SEQ ID NO: 809756 - RNA, 13 nt, Mycobacterium avium subsp. paratuberculosis
cccgccggcgucu

SEQ ID NO: 809757 - RNA, 21 nt, Mycobacterium avium subsp. paratuberculosis
cccgccgggaucggcggggcg

SEQ ID NO: 809758 - RNA, 18 nt, Mycobacterium avium subsp. paratuberculosis
cccgccgggaugcgccac

SEQ ID NO: 809759 - RNA, 23 nt, Mycobacterium avium subsp. paratuberculosis
cccgccgggaugcgccaccgaca

SEQ ID NO: 809760 - RNA, 20 nt, Mycobacterium avium subsp. paratuberculosis
cccgccgggcacccgggugg

SEQ ID NO: 809761 - RNA, 17 nt, Mycobacterium avium subsp. paratuberculosis
cccgccgguggccgcga

SEQ ID NO: 809762 - RNA, 17 nt, Mycobacterium avium subsp. paratuberculosis
cccgccgguggccgcgc

SEQ ID NO: 809763 - RNA, 17 nt, Mycobacterium avium subsp. paratuberculosis
cccgccgguggcggcga

SEQ ID NO: 809764 - RNA, 18 nt, Mycobacterium avium subsp. paratuberculosis
cccgccggugucggcgac

SEQ ID NO: 809765 - RNA, 16 nt, Mycobacterium avium subsp. paratuberculosis
cccgccggagaugauc

SEQ ID NO: 809766 - RNA, 13 nt, Mycobacterium avium subsp. paratuberculosis
cccgccggagccg

SEQ ID NO: 809767 - RNA, 13 nt, Mycobacterium avium subsp. paratuberculosis
cccgccggcgauc

SEQ ID NO: 809768 - RNA, 14 nt, Mycobacterium avium subsp. paratuberculosis
cccgccccagcccg

SEQ ID NO: 809769 - RNA, 13 nt, Mycobacterium avium subsp. paratuberculosis
cccgcccagcgca

SEQ ID NO: 809770 - RNA, 16 nt, Mycobacterium avium subsp. paratuberculosis
cccgcccagcgcagca

SEQ ID NO: 809771 - RNA, 14 nt, Mycobacterium avium subsp. paratuberculosis
cccgcccagcgcca

SEQ ID NO: 809772 - RNA, 13 nt, Mycobacterium avium subsp. paratuberculosis
cccgcccaggccg

SEQ ID NO: 809773 - RNA, 13 nt, Mycobacterium avium subsp. paratuberculosis
ccgaauccaccgg

SEQ ID NO: 809774 - RNA, 18 nt, Mycobacterium avium subsp. paratuberculosis
ccgaauccagcgcgccgc

SEQ ID NO: 809775 - RNA, 21 nt, Mycobacterium avium subsp. paratuberculosis
ccgaauccagcgcgccgcuga

SEQ ID NO: 809776 - RNA, 15 nt, Mycobacterium avium subsp. paratuberculosis
ccgaaugacguggca

SEQ ID NO: 809777 - RNA, 18 nt, Mycobacterium avium subsp. paratuberculosis
ccgaaugagacgacccga

SEQ ID NO: 809778 - RNA, 22 nt, Mycobacterium avium subsp. paratuberculosis
ccgaaugagacgacccgagagc

SEQ ID NO: 809779 - RNA, 14 nt, Mycobacterium avium subsp. paratuberculosis
ccgaaucggucgac

SEQ ID NO: 809780 - RNA, 16 nt, Mycobacterium avium subsp. paratuberculosis
ccgaaucggucgacca

SEQ ID NO: 809781 - RNA, 22 nt, Mycobacterium avium subsp. paratuberculosis
ccgaaucggucgaccagcuccu

SEQ ID NO: 809782 - RNA, 15 nt, Mycobacterium avium subsp. paratuberculosis
ccgaauccggccgga

SEQ ID NO: 809783 - RNA, 21 nt, Mycobacterium avium subsp. paratuberculosis
ccgaagcgccacggggcgccg

SEQ ID NO: 809784 - RNA, 19 nt, Mycobacterium avium subsp. paratuberculosis
ccgaagccggcgcaggugu

SEQ ID NO: 809785 - RNA, 14 nt, Mycobacterium avium subsp. paratuberculosis
ccgaagccggcucg

SEQ ID NO: 809786 - RNA, 13 nt, Mycobacterium avium subsp. paratuberculosis
ccgaagccgucga

SEQ ID NO: 809787 - RNA, 16 nt, Mycobacterium avium subsp. paratuberculosis
ccgaaguuggcgucgg

SEQ ID NO: 809788 - RNA, 20 nt, Mycobacterium avium subsp. paratuberculosis
ccgaaguuggcgucgggcac

SEQ ID NO: 809789 - RNA, 16 nt, Mycobacterium avium subsp. paratuberculosis
ccgaaguugucggguu

SEQ ID NO: 809790 - RNA, 17 nt, Mycobacterium avium subsp. paratuberculosis
ccgaaguucgacacggu

SEQ ID NO: 809791 - RNA, 19 nt, Mycobacterium avium subsp. paratuberculosis
ccgaaguucgacacgguga

SEQ ID NO: 809792 - RNA, 19 nt, Mycobacterium avium subsp. paratuberculosis
ccgaagcgcuaacaaaagc

SEQ ID NO: 809793 - RNA, 23 nt, Mycobacterium avium subsp. paratuberculosis
ccgaagcgcuaacaaaagcccga

SEQ ID NO: 809794 - RNA, 22 nt, Mycobacterium avium subsp. paratuberculosis
ccgaagcgcuuucccugcucga

SEQ ID NO: 809795 - RNA, 19 nt, Mycobacterium avium subsp. paratuberculosis
ccgaagcccgagcgucacg

SEQ ID NO: 809796 - RNA, 14 nt, Mycobacterium avium subsp. paratuberculosis
ccgaagcccgcagc

SEQ ID NO: 809797 - RNA, 13 nt, Mycobacterium avium subsp. paratuberculosis
ccgaagccgccgu

SEQ ID NO: 809798 - RNA, 20 nt, Mycobacterium avium subsp. paratuberculosis
ccgaagccgccguccccgcg

SEQ ID NO: 809799 - RNA, 16 nt, Mycobacterium avium subsp. paratuberculosis
ccgaagccgacgucga

SEQ ID NO: 809800 - RNA, 18 nt, Mycobacterium avium subsp. paratuberculosis
ccgaagccgacgucgacc

SEQ ID NO: 809801 - RNA, 19 nt, Mycobacterium avium subsp. paratuberculosis
ccgaagccgacgucgacca

SEQ ID NO: 809802 - RNA, 15 nt, Mycobacterium avium subsp. paratuberculosis
ccgaaccgggcgcgc

SEQ ID NO: 809803 - RNA, 14 nt, Mycobacterium avium subsp. paratuberculosis
ccgaaccggggccg

SEQ ID NO: 809804 - RNA, 17 nt, Mycobacterium avium subsp. paratuberculosis
ccgaacgacgagccguc

SEQ ID NO: 809805 - RNA, 19 nt, Mycobacterium avium subsp. paratuberculosis
ccgaacgacgagccgucga

SEQ ID NO: 809806 - RNA, 17 nt, Mycobacterium avium subsp. paratuberculosis
ccgaagauggccagcgc

SEQ ID NO: 809807 - RNA, 21 nt, Mycobacterium avium subsp. paratuberculosis
ccgaagauggccagcgcggcg

SEQ ID NO: 809808 - RNA, 18 nt, Mycobacterium avium subsp. paratuberculosis
ccgaagauggccaggaac

SEQ ID NO: 809809 - RNA, 16 nt, Mycobacterium avium subsp. paratuberculosis
ccgaacaacagggccg

SEQ ID NO: 809810 - RNA, 15 nt, Mycobacterium avium subsp. paratuberculosis
ccgaacaucagccga

SEQ ID NO: 809811 - RNA, 19 nt, Mycobacterium avium subsp. paratuberculosis
ccgaacaucgccucggccg

SEQ ID NO: 809812 - RNA, 22 nt, Mycobacterium avium subsp. paratuberculosis
ccgaacaucgccucggccgcgg

SEQ ID NO: 809813 - RNA, 21 nt, Mycobacterium avium subsp. paratuberculosis
ccgaaccaguucgccaccacg

SEQ ID NO: 809814 - RNA, 15 nt, Mycobacterium avium subsp. paratuberculosis
ccgaacccaccagcg

SEQ ID NO: 809815 - RNA, 18 nt, Mycobacterium avium subsp. paratuberculosis
ccgaacccagcgccucga

SEQ ID NO: 809816 - RNA, 13 nt, Mycobacterium avium subsp. paratuberculosis
ccgaacccgggcg

SEQ ID NO: 809817 - RNA, 22 nt, Mycobacterium avium subsp. paratuberculosis
ccgaacccgggcgcgcccaccc

SEQ ID NO: 809818 - RNA, 23 nt, Mycobacterium avium subsp. paratuberculosis
ccgaacccgggcgcgcccacccg

SEQ ID NO: 809819 - RNA, 17 nt, Mycobacterium avium subsp. paratuberculosis
ccgaacccguucccgac

SEQ ID NO: 809820 - RNA, 16 nt, Mycobacterium avium subsp. paratuberculosis
ccgaaccgaucaccgg

SEQ ID NO: 809821 - RNA, 17 nt, Mycobacterium avium subsp. paratuberculosis
ccgaaccgaucaccggc

SEQ ID NO: 809822 - RNA, 18 nt, Mycobacterium avium subsp. paratuberculosis
ccgaaccgcagccggauc

SEQ ID NO: 809823 - RNA, 21 nt, Mycobacterium avium subsp. paratuberculosis
ccgaaccgcccgcccggcacg

SEQ ID NO: 809824 - RNA, 19 nt, Mycobacterium avium subsp. paratuberculosis
ccgaacccggaucggccau

SEQ ID NO: 809825 - RNA, 18 nt, Mycobacterium avium subsp. paratuberculosis
ccgaaccgcucgucggga

SEQ ID NO: 809826 - RNA, 16 nt, Mycobacterium avium subsp. paratuberculosis
cccugguacgcgccgu

SEQ ID NO: 809827 - RNA, 17 nt, Mycobacterium avium subsp. paratuberculosis
cccugguugagcaccgc

SEQ ID NO: 809828 - RNA, 15 nt, Mycobacterium avium subsp. paratuberculosis
cccuggucggccagg

SEQ ID NO: 809829 - RNA, 19 nt, Mycobacterium avium subsp. paratuberculosis
cccuggugaccgacgacgu

SEQ ID NO: 809830 - RNA, 20 nt, Mycobacterium avium subsp. paratuberculosis
cccuggugcaacaccgaaag

SEQ ID NO: 809831 - RNA, 14 nt, Mycobacterium avium subsp. paratuberculosis
cccuggcgggcggc

SEQ ID NO: 809832 - RNA, 18 nt, Mycobacterium avium subsp. paratuberculosis
cccuggcggguacagccg

SEQ ID NO: 809833 - RNA, 21 nt, Mycobacterium avium subsp. paratuberculosis
cccuggcggguacagccgcag

SEQ ID NO: 809834 - RNA, 16 nt, Mycobacterium avium subsp. paratuberculosis
cccuggccgccggccg

SEQ ID NO: 809835 - RNA, 17 nt, Mycobacterium avium subsp. paratuberculosis
cccuggccgccggccgc

SEQ ID NO: 809836 - RNA, 21 nt, Mycobacterium avium subsp. paratuberculosis
ccgaaaucaacgcgccgaaca

SEQ ID NO: 809837 - RNA, 21 nt, Mycobacterium avium subsp. paratuberculosis
ccgaaagccuccgcgaucagc

SEQ ID NO: 809838 - RNA, 13 nt, Mycobacterium avium subsp. paratuberculosis
ccgaaacggugcc

SEQ ID NO: 809839 - RNA, 16 nt, Mycobacterium avium subsp. paratuberculosis
ccgaaacggugcccgc

SEQ ID NO: 809840 - RNA, 19 nt, Mycobacterium avium subsp. paratuberculosis
ccgaaacggugcccgcagc

SEQ ID NO: 809841 - RNA, 22 nt, Mycobacterium avium subsp. paratuberculosis
ccgaaacccgcugucaaucccc

SEQ ID NO: 809842 - RNA, 13 nt, Mycobacterium avium subsp. paratuberculosis
ccgaaaccgucga

SEQ ID NO: 809843 - RNA, 17 nt, Mycobacterium avium subsp. paratuberculosis
ccgaaaaacgcgacggc

SEQ ID NO: 809844 - RNA, 17 nt, Mycobacterium avium subsp. paratuberculosis
cccugcccgucgggcgc

SEQ ID NO: 809845 - RNA, 13 nt, Mycobacterium avium subsp. paratuberculosis
cccugcgcgcccu

SEQ ID NO: 809846 - RNA, 15 nt, Mycobacterium avium subsp. paratuberculosis
cccugcgcaccgcgg

SEQ ID NO: 809847 - RNA, 15 nt, Mycobacterium avium subsp. paratuberculosis
cccugcgcggcgaug

SEQ ID NO: 809848 - RNA, 22 nt, Mycobacterium avium subsp. paratuberculosis
cccugcgcggaaguggaccgcg

SEQ ID NO: 809849 - RNA, 21 nt, Mycobacterium avium subsp. paratuberculosis
cccuggaugucacgguccagg

SEQ ID NO: 809850 - RNA, 16 nt, Mycobacterium avium subsp. paratuberculosis
cccugcgcucagcacg

SEQ ID NO: 809851 - RNA, 16 nt, Mycobacterium avium subsp. paratuberculosis
cccuggauauccagcc

SEQ ID NO: 809852 - RNA, 13 nt, Mycobacterium avium subsp. paratuberculosis
cccuggccagcac

SEQ ID NO: 809853 - RNA, 13 nt, Mycobacterium avium subsp. paratuberculosis
cccuggcagguga

SEQ ID NO: 809854 - RNA, 20 nt, Mycobacterium avium subsp. paratuberculosis
cccuggcaggugagccgggu

SEQ ID NO: 809855 - RNA, 19 nt, Mycobacterium avium subsp. paratuberculosis
cccugaagcugggcgccca

SEQ ID NO: 809856 - RNA, 23 nt, Mycobacterium avium subsp. paratuberculosis
cccugacacagcaccggcgucga

SEQ ID NO: 809857 - RNA, 16 nt, Mycobacterium avium subsp. paratuberculosis
cccucugccacggcgg

SEQ ID NO: 809858 - RNA, 13 nt, Mycobacterium avium subsp. paratuberculosis
cccucgucggcga

SEQ ID NO: 809859 - RNA, 20 nt, Mycobacterium avium subsp. paratuberculosis
cccucgucuuccgcggcggc

SEQ ID NO: 809860 - RNA, 16 nt, Mycobacterium avium subsp. paratuberculosis
cccucgugguggacgg

SEQ ID NO: 809861 - RNA, 21 nt, Mycobacterium avium subsp. paratuberculosis
cccucgugguggacggucagc

SEQ ID NO: 809862 - RNA, 17 nt, Mycobacterium avium subsp. paratuberculosis
cccucgucgaucgcggc

SEQ ID NO: 809863 - RNA, 19 nt, Mycobacterium avium subsp. paratuberculosis
cccucgucgaugacgucca

SEQ ID NO: 809864 - RNA, 21 nt, Mycobacterium avium subsp. paratuberculosis
cccucguucgaauuguggcgg

SEQ ID NO: 809865 - RNA, 23 nt, Mycobacterium avium subsp. paratuberculosis
cccucguucgaauuguggcggcc

SEQ ID NO: 809866 - RNA, 14 nt, Mycobacterium avium subsp. paratuberculosis
cccucgguguucgg

SEQ ID NO: 809867 - RNA, 18 nt, Mycobacterium avium subsp. paratuberculosis
cccucguagaaggaccgg

SEQ ID NO: 809868 - RNA, 24 nt, Mycobacterium avium subsp. paratuberculosis
cccucguccaggugcacccgcggc

SEQ ID NO: 809869 - RNA, 15 nt, Mycobacterium avium subsp. paratuberculosis
cccucguccgacagc

SEQ ID NO: 809870 - RNA, 16 nt, Mycobacterium avium subsp. paratuberculosis
cccucggucgggcgau

SEQ ID NO: 809871 - RNA, 13 nt, Mycobacterium avium subsp. paratuberculosis
cccucgacgccgg

SEQ ID NO: 809872 - RNA, 20 nt, Mycobacterium avium subsp. paratuberculosis
cccucgacgccgggcagcgc

SEQ ID NO: 809873 - RNA, 18 nt, Mycobacterium avium subsp. paratuberculosis
cccucgacguccaggccg

SEQ ID NO: 809874 - RNA, 18 nt, Mycobacterium avium subsp. paratuberculosis
cccucgaggccgacgugc

SEQ ID NO: 809875 - RNA, 18 nt, Mycobacterium avium subsp. paratuberculosis
cccucgauaauggcggcc

SEQ ID NO: 809876 - RNA, 22 nt, Mycobacterium avium subsp. paratuberculosis
cccucgaucagccacaccgccg

SEQ ID NO: 809877 - RNA, 14 nt, Mycobacterium avium subsp. paratuberculosis
cccgugaucgccac

SEQ ID NO: 809878 - RNA, 17 nt, Mycobacterium avium subsp. paratuberculosis
cccgugaucgccacggc

SEQ ID NO: 809879 - RNA, 19 nt, Mycobacterium avium subsp. paratuberculosis
cccgugaucgccacggcgg

SEQ ID NO: 809880 - RNA, 14 nt, Mycobacterium avium subsp. paratuberculosis
cccgugcaggaucg

SEQ ID NO: 809881 - RNA, 20 nt, Mycobacterium avium subsp. paratuberculosis
cccgugcaggaucggcuugg

SEQ ID NO: 809882 - RNA, 18 nt, Mycobacterium avium subsp. paratuberculosis
cccgugccgaugccggcc

SEQ ID NO: 809883 - RNA, 21 nt, Mycobacterium avium subsp. paratuberculosis
cccgugccgaugccggccugg

SEQ ID NO: 809884 - RNA, 13 nt, Mycobacterium avium subsp. paratuberculosis
cccgugcgggugg

SEQ ID NO: 809885 - RNA, 13 nt, Mycobacterium avium subsp. paratuberculosis
cccgugggccgac

SEQ ID NO: 809886 - RNA, 17 nt, Mycobacterium avium subsp. paratuberculosis
cccgugggccgaccggc

SEQ ID NO: 809887 - RNA, 19 nt, Mycobacterium avium subsp. paratuberculosis
cccguggauggacgcccag

SEQ ID NO: 809888 - RNA, 16 nt, Mycobacterium avium subsp. paratuberculosis
cccguggcccacggga

SEQ ID NO: 809889 - RNA, 22 nt, Mycobacterium avium subsp. paratuberculosis
cccguggcccacgggaugcggc

SEQ ID NO: 809890 - RNA, 19 nt, Mycobacterium avium subsp. paratuberculosis
cccgugcggggccucgucg

SEQ ID NO: 809891 - RNA, 22 nt, Mycobacterium avium subsp. paratuberculosis
cccgugcggggccucgucgccg

SEQ ID NO: 809892 - RNA, 13 nt, Mycobacterium avium subsp. paratuberculosis
cccgugcgccgcc

SEQ ID NO: 809893 - RNA, 14 nt, Mycobacterium avium subsp. paratuberculosis
cccgugcgccgccc

SEQ ID NO: 809894 - RNA, 20 nt, Mycobacterium avium subsp. paratuberculosis
cccgugcgccgcccacaccg

SEQ ID NO: 809895 - RNA, 17 nt, Mycobacterium avium subsp. paratuberculosis
cccuccuggcggguggc

SEQ ID NO: 809896 - RNA, 13 nt, Mycobacterium avium subsp. paratuberculosis
cccuccgggcggc

SEQ ID NO: 809897 - RNA, 21 nt, Mycobacterium avium subsp. paratuberculosis
cccuccgggcggcaccgcugc

SEQ ID NO: 809898 - RNA, 13 nt, Mycobacterium avium subsp. paratuberculosis
cccucaucgucga

SEQ ID NO: 809899 - RNA, 22 nt, Mycobacterium avium subsp. paratuberculosis
cccucaucgucgacccggccgc

SEQ ID NO: 809900 - RNA, 17 nt, Mycobacterium avium subsp. paratuberculosis
cccuccacggugcgcac

SEQ ID NO: 809901 - RNA, 17 nt, Mycobacterium avium subsp. paratuberculosis
cccuccacgucgucgga

SEQ ID NO: 809902 - RNA, 19 nt, Mycobacterium avium subsp. paratuberculosis
cccuccaggcaugggauca

SEQ ID NO: 809903 - RNA, 17 nt, Mycobacterium avium subsp. paratuberculosis
cccuccccggccagcac

SEQ ID NO: 809904 - RNA, 23 nt, Mycobacterium avium subsp. paratuberculosis
cccgugguagacgccggacgugg

SEQ ID NO: 809905 - RNA, 23 nt, Mycobacterium avium subsp. paratuberculosis
cccguggugggcgaacagcagca

SEQ ID NO: 809906 - RNA, 14 nt, Mycobacterium avium subsp. paratuberculosis
cccguucagugacc

SEQ ID NO: 809907 - RNA, 18 nt, Mycobacterium avium subsp. paratuberculosis
cccguucccgacagcucg

SEQ ID NO: 809908 - RNA, 14 nt, Mycobacterium avium subsp. paratuberculosis
cccguuccggcgag

SEQ ID NO: 809909 - RNA, 14 nt, Mycobacterium avium subsp. paratuberculosis
cccguuccucgacg

SEQ ID NO: 809910 - RNA, 20 nt, Mycobacterium avium subsp. paratuberculosis
cccucagggagcugcccgca

SEQ ID NO: 809911 - RNA, 20 nt, Mycobacterium avium subsp. paratuberculosis
cccucagguggacagaugcc

SEQ ID NO: 809912 - RNA, 20 nt, Mycobacterium avium subsp. paratuberculosis
cccgcuucggcucggggucg

SEQ ID NO: 809913 - RNA, 20 nt, Mycobacterium avium subsp. paratuberculosis
cccgcuucgcccggcugcgc

SEQ ID NO: 809914 - RNA, 22 nt, Mycobacterium avium subsp. paratuberculosis
cccgcuugggugaaucaccaag

SEQ ID NO: 809915 - RNA, 16 nt, Mycobacterium avium subsp. paratuberculosis
cccgcuuuugccgucg

SEQ ID NO: 809916 - RNA, 22 nt, Mycobacterium avium subsp. paratuberculosis
cccgcuuuugccgucggugcgg

SEQ ID NO: 809917 - RNA, 17 nt, Mycobacterium avium subsp. paratuberculosis
cccggaaaaccccaccc

SEQ ID NO: 809918 - RNA, 18 nt, Mycobacterium avium subsp. paratuberculosis
cccggaaagcgcgggcag

SEQ ID NO: 809919 - RNA, 22 nt, Mycobacterium avium subsp. paratuberculosis
cccggaaagcgcgggcagccca

SEQ ID NO: 809920 - RNA, 20 nt, Mycobacterium avium subsp. paratuberculosis
cccggacgaugacccagccc

SEQ ID NO: 809921 - RNA, 15 nt, Mycobacterium avium subsp. paratuberculosis
cccggacgaugccgc

SEQ ID NO: 809922 - RNA, 18 nt, Mycobacterium avium subsp. paratuberculosis
cccggacgaugcgcaccc

SEQ ID NO: 809923 - RNA, 13 nt, Mycobacterium avium subsp. paratuberculosis
cccggacgcugcg

SEQ ID NO: 809924 - RNA, 14 nt, Mycobacterium avium subsp. paratuberculosis
cccggacggagccg

SEQ ID NO: 809925 - RNA, 22 nt, Mycobacterium avium subsp. paratuberculosis
cccggacggccgaaacgcccgg

SEQ ID NO: 809926 - RNA, 14 nt, Mycobacterium avium subsp. paratuberculosis
cccggagagccggu

SEQ ID NO: 809927 - RNA, 17 nt, Mycobacterium avium subsp. paratuberculosis
cccggagauccggccgc

SEQ ID NO: 809928 - RNA, 18 nt, Mycobacterium avium subsp. paratuberculosis
cccggagauccggccgcu

SEQ ID NO: 809929 - RNA, 21 nt, Mycobacterium avium subsp. paratuberculosis
cccggagauccggccgcuggu

SEQ ID NO: 809930 - RNA, 18 nt, Mycobacterium avium subsp. paratuberculosis
cccggagaaaccgucggc

SEQ ID NO: 809931 - RNA, 22 nt, Mycobacterium avium subsp. paratuberculosis
cccggagaaaccgucggcccgc

SEQ ID NO: 809932 - RNA, 14 nt, Mycobacterium avium subsp. paratuberculosis
cccggagcugucgg

SEQ ID NO: 809933 - RNA, 19 nt, Mycobacterium avium subsp. paratuberculosis
cccggagcugucggugacg

SEQ ID NO: 809934 - RNA, 17 nt, Mycobacterium avium subsp. paratuberculosis
cccggagguucgccgga

SEQ ID NO: 809935 - RNA, 23 nt, Mycobacterium avium subsp. paratuberculosis
cccggauaacgcaaaacggugcg

SEQ ID NO: 809936 - RNA, 21 nt, Mycobacterium avium subsp. paratuberculosis
cccggauccgucgccccgcac

SEQ ID NO: 809937 - RNA, 23 nt, Mycobacterium avium subsp. paratuberculosis
cccggauccgucgccccgcaccg

SEQ ID NO: 809938 - RNA, 16 nt, Mycobacterium avium subsp. paratuberculosis
cccggaucgccgaacg

SEQ ID NO: 809939 - RNA, 23 nt, Mycobacterium avium subsp. paratuberculosis
cccggaucuugccgucggccgcc

SEQ ID NO: 809940 - RNA, 23 nt, Mycobacterium avium subsp. paratuberculosis
cccggcgaugcgcacgucggccg

SEQ ID NO: 809941 - RNA, 12 nt, Mycobacterium avium subsp. paratuberculosis
cccggcgcgcgg

SEQ ID NO: 809942 - RNA, 11 nt, Mycobacterium avium subsp. paratuberculosis
cccggcgcgga

SEQ ID NO: 809943 - RNA, 19 nt, Mycobacterium avium subsp. paratuberculosis
cccggcgcggaacgcgccg

SEQ ID NO: 809944 - RNA, 21 nt, Mycobacterium avium subsp. paratuberculosis
cccggcgcggaacgcgccggg

SEQ ID NO: 809945 - RNA, 18 nt, Mycobacterium avium subsp. paratuberculosis
cccggcgcggacagcgcg

SEQ ID NO: 809946 - RNA, 19 nt, Mycobacterium avium subsp. paratuberculosis
cccggcgcggacagcgcgg

SEQ ID NO: 809947 - RNA, 21 nt, Mycobacterium avium subsp. paratuberculosis
cccggcgcggcaucggcgacg

SEQ ID NO: 809948 - RNA, 20 nt, Mycobacterium avium subsp. paratuberculosis
cccggcgcgccacgacguac

SEQ ID NO: 809949 - RNA, 14 nt, Mycobacterium avium subsp. paratuberculosis
cccggcgcgccgca

SEQ ID NO: 809950 - RNA, 17 nt, Mycobacterium avium subsp. paratuberculosis
cccggcgcgccgcagga

SEQ ID NO: 809951 - RNA, 17 nt, Mycobacterium avium subsp. paratuberculosis
cccggcgcgccugcgcg

SEQ ID NO: 809952 - RNA, 18 nt, Mycobacterium avium subsp. paratuberculosis
cccggcgcgccugcgcgg

SEQ ID NO: 809953 - RNA, 19 nt, Mycobacterium avium subsp. paratuberculosis
cccggcgcgccugcgcggc

SEQ ID NO: 809954 - RNA, 15 nt, Mycobacterium avium subsp. paratuberculosis
cccggcgccucggcg

SEQ ID NO: 809955 - RNA, 17 nt, Mycobacterium avium subsp. paratuberculosis
cccggcgccucggcgcc

SEQ ID NO: 809956 - RNA, 13 nt, Mycobacterium avium subsp. paratuberculosis
cccggcgcgacgg

SEQ ID NO: 809957 - RNA, 15 nt, Mycobacterium avium subsp. paratuberculosis
cccggcgcgacggca

SEQ ID NO: 809958 - RNA, 12 nt, Mycobacterium avium subsp. paratuberculosis
cccggcgccgga

SEQ ID NO: 809959 - RNA, 16 nt, Mycobacterium avium subsp. paratuberculosis
cccggcgccggcccgc

SEQ ID NO: 809960 - RNA, 19 nt, Mycobacterium avium subsp. paratuberculosis
cccggcgccggcccgcggc

SEQ ID NO: 809961 - RNA, 14 nt, Mycobacterium avium subsp. paratuberculosis
cccggcgccggccg

SEQ ID NO: 809962 - RNA, 13 nt, Mycobacterium avium subsp. paratuberculosis
cccggcgccggcg

SEQ ID NO: 809963 - RNA, 15 nt, Mycobacterium avium subsp. paratuberculosis
cccggcgccggcggc

SEQ ID NO: 809964 - RNA, 17 nt, Mycobacterium avium subsp. paratuberculosis
cccggcgccggcggcca

SEQ ID NO: 809965 - RNA, 14 nt, Mycobacterium avium subsp. paratuberculosis
cccggcgccggucg

SEQ ID NO: 809966 - RNA, 13 nt, Mycobacterium avium subsp. paratuberculosis
cccggcgcccggc

SEQ ID NO: 809967 - RNA, 12 nt, Mycobacterium avium subsp. paratuberculosis
cccggcgccgau

SEQ ID NO: 809968 - RNA, 19 nt, Mycobacterium avium subsp. paratuberculosis
cccggcgccgccguucgcc

SEQ ID NO: 809969 - RNA, 16 nt, Mycobacterium avium subsp. paratuberculosis
cccggcgcccggccgg

SEQ ID NO: 809970 - RNA, 18 nt, Mycobacterium avium subsp. paratuberculosis
cccggcgcccggccggcc

SEQ ID NO: 809971 - RNA, 17 nt, Mycobacterium avium subsp. paratuberculosis
cccggcgcccggccggu

SEQ ID NO: 809972 - RNA, 17 nt, Mycobacterium avium subsp. paratuberculosis
cccggcgcccugcaccc

SEQ ID NO: 809973 - RNA, 22 nt, Mycobacterium avium subsp. paratuberculosis
cccggcgcccugcacccagccg

SEQ ID NO: 809974 - RNA, 22 nt, Mycobacterium avium subsp. paratuberculosis
cccggcgcccuucggcgcccgc

SEQ ID NO: 809975 - RNA, 12 nt, Mycobacterium avium subsp. paratuberculosis
cccggcgccgac

SEQ ID NO: 809976 - RNA, 13 nt, Mycobacterium avium subsp. paratuberculosis
cccggcgccgacc

SEQ ID NO: 809977 - RNA, 12 nt, Mycobacterium avium subsp. paratuberculosis
cccggcgccacg

SEQ ID NO: 809978 - RNA, 19 nt, Mycobacterium avium subsp. paratuberculosis
cccggcgccacgcacaccg

SEQ ID NO: 809979 - RNA, 15 nt, Mycobacterium avium subsp. paratuberculosis
cccggcgccacgccg

SEQ ID NO: 809980 - RNA, 17 nt, Mycobacterium avium subsp. paratuberculosis
cccggcgccacgccgcg

SEQ ID NO: 809981 - RNA, 16 nt, Mycobacterium avium subsp. paratuberculosis
cccggcgcaccaggcg

SEQ ID NO: 809982 - RNA, 13 nt, Mycobacterium avium subsp. paratuberculosis
cccggagccgucg

SEQ ID NO: 809983 - RNA, 18 nt, Mycobacterium avium subsp. paratuberculosis
cccggcgcagcgccgcgc

SEQ ID NO: 809984 - RNA, 15 nt, Mycobacterium avium subsp. paratuberculosis
cccggggccguccgg

SEQ ID NO: 809985 - RNA, 17 nt, Mycobacterium avium subsp. paratuberculosis
cccggggccuccagcca

SEQ ID NO: 809986 - RNA, 21 nt, Mycobacterium avium subsp. paratuberculosis
cccggggccuccagccagcgc

SEQ ID NO: 809987 - RNA, 16 nt, Mycobacterium avium subsp. paratuberculosis
cccggggcgcgcuggg

SEQ ID NO: 809988 - RNA, 15 nt, Mycobacterium avium subsp. paratuberculosis
cccgggccgcgccca

SEQ ID NO: 809989 - RNA, 16 nt, Mycobacterium avium subsp. paratuberculosis
cccgggcuagacgcgc

SEQ ID NO: 809990 - RNA, 17 nt, Mycobacterium avium subsp. paratuberculosis
cccgggcuaucgcccgg

SEQ ID NO: 809991 - RNA, 14 nt, Mycobacterium avium subsp. paratuberculosis
cccgggccacccgc

SEQ ID NO: 809992 - RNA, 20 nt, Mycobacterium avium subsp. paratuberculosis
cccgggccacccgcgaucgg

SEQ ID NO: 809993 - RNA, 16 nt, Mycobacterium avium subsp. paratuberculosis
cccgggccaggaccgg

SEQ ID NO: 809994 - RNA, 18 nt, Mycobacterium avium subsp. paratuberculosis
cccgggccaggcgcgcgu

SEQ ID NO: 809995 - RNA, 13 nt, Mycobacterium avium subsp. paratuberculosis
cccgggccagguc

SEQ ID NO: 809996 - RNA, 14 nt, Mycobacterium avium subsp. paratuberculosis
cccgggccagguuc

SEQ ID NO: 809997 - RNA, 20 nt, Mycobacterium avium subsp. paratuberculosis
cccgggccagguucgcgccg

SEQ ID NO: 809998 - RNA, 16 nt, Mycobacterium avium subsp. paratuberculosis
cccgggcaucccgccg

SEQ ID NO: 809999 - RNA, 18 nt, Mycobacterium avium subsp. paratuberculosis
cccgggcaucccgccgaa

SEQ ID NO: 810000 - RNA, 18 nt, Mycobacterium avium subsp. paratuberculosis
cccgggcaugcccguaga

SEQ ID NO: 810001 - RNA, 16 nt, Mycobacterium avium subsp. paratuberculosis
cccgggcccgauggcg

SEQ ID NO: 810002 - RNA, 17 nt, Mycobacterium avium subsp. paratuberculosis
cccgggcccgcugcagc

SEQ ID NO: 810003 - RNA, 22 nt, Mycobacterium avium subsp. paratuberculosis
cccgggcccguagcucgcgccg

SEQ ID NO: 810004 - RNA, 23 nt, Mycobacterium avium subsp. paratuberculosis
cccgggcccguagcucgcgccga

SEQ ID NO: 810005 - RNA, 17 nt, Mycobacterium avium subsp. paratuberculosis
cccgggccgcagggugg

SEQ ID NO: 810006 - RNA, 18 nt, Mycobacterium avium subsp. paratuberculosis
cccgggccgccacggcgc

SEQ ID NO: 810007 - RNA, 14 nt, Mycobacterium avium subsp. paratuberculosis
cccggcuucgcugc

SEQ ID NO: 810008 - RNA, 18 nt, Mycobacterium avium subsp. paratuberculosis
cccgggaaaugcugcacc

SEQ ID NO: 810009 - RNA, 14 nt, Mycobacterium avium subsp. paratuberculosis
cccgggacagcccg

SEQ ID NO: 810010 - RNA, 13 nt, Mycobacterium avium subsp. paratuberculosis
cccgggacccgga

SEQ ID NO: 810011 - RNA, 21 nt, Mycobacterium avium subsp. paratuberculosis
cccgggauccgaggcgucagg

SEQ ID NO: 810012 - RNA, 13 nt, Mycobacterium avium subsp. paratuberculosis
cccgggaugccga

SEQ ID NO: 810013 - RNA, 22 nt, Mycobacterium avium subsp. paratuberculosis
cccgggaugccugcccgcgcag

SEQ ID NO: 810014 - RNA, 17 nt, Mycobacterium avium subsp. paratuberculosis
cccgggauggaucgagu

SEQ ID NO: 810015 - RNA, 14 nt, Mycobacterium avium subsp. paratuberculosis
cccgggcacgcgag

SEQ ID NO: 810016 - RNA, 21 nt, Mycobacterium avium subsp. paratuberculosis
cccgggcagcuuccgccucgg

SEQ ID NO: 810017 - RNA, 18 nt, Mycobacterium avium subsp. paratuberculosis
cccgggcaggcggcgcgc

SEQ ID NO: 810018 - RNA, 15 nt, Mycobacterium avium subsp. paratuberculosis
cccggcuucgccgcc

SEQ ID NO: 810019 - RNA, 21 nt, Mycobacterium avium subsp. paratuberculosis
cccggcuucgccgccgcaccg

SEQ ID NO: 810020 - RNA, 17 nt, Mycobacterium avium subsp. paratuberculosis
cccggcuucgccgcgcu

SEQ ID NO: 810021 - RNA, 12 nt, Mycobacterium avium subsp. paratuberculosis
cccggcugcugc

SEQ ID NO: 810022 - RNA, 17 nt, Mycobacterium avium subsp. paratuberculosis
cccggcugcugcacgac

SEQ ID NO: 810023 - RNA, 21 nt, Mycobacterium avium subsp. paratuberculosis
cccggcugcugcacgacgacc

SEQ ID NO: 810024 - RNA, 16 nt, Mycobacterium avium subsp. paratuberculosis
cccggcugggcgcgca

SEQ ID NO: 810025 - RNA, 22 nt, Mycobacterium avium subsp. paratuberculosis
cccggcuggcaggucgcgccgg

SEQ ID NO: 810026 - RNA, 15 nt, Mycobacterium avium subsp. paratuberculosis
cccggcugcgcagcg

SEQ ID NO: 810027 - RNA, 20 nt, Mycobacterium avium subsp. paratuberculosis
cccggcugcgcagcgcagca

SEQ ID NO: 810028 - RNA, 15 nt, Mycobacterium avium subsp. paratuberculosis
cccggcugcgccgcg

SEQ ID NO: 810029 - RNA, 17 nt, Mycobacterium avium subsp. paratuberculosis
cccggcugcgccgcgcu

SEQ ID NO: 810030 - RNA, 13 nt, Mycobacterium avium subsp. paratuberculosis
cccggcggacccg

SEQ ID NO: 810031 - RNA, 13 nt, Mycobacterium avium subsp. paratuberculosis
cccggcggcaccg

SEQ ID NO: 810032 - RNA, 16 nt, Mycobacterium avium subsp. paratuberculosis
cccggcggcaccgcgg

SEQ ID NO: 810033 - RNA, 14 nt, Mycobacterium avium subsp. paratuberculosis
cccggcggccacca

SEQ ID NO: 810034 - RNA, 13 nt, Mycobacterium avium subsp. paratuberculosis
cccggcggccacg

SEQ ID NO: 810035 - RNA, 15 nt, Mycobacterium avium subsp. paratuberculosis
cccggcggccacgca

SEQ ID NO: 810036 - RNA, 13 nt, Mycobacterium avium subsp. paratuberculosis
cccggcgcugcgc

SEQ ID NO: 810037 - RNA, 17 nt, Mycobacterium avium subsp. paratuberculosis
cccggcgcugcgcccgg

SEQ ID NO: 810038 - RNA, 22 nt, Mycobacterium avium subsp. paratuberculosis
cccggcgcggccgcccagcccg

SEQ ID NO: 810039 - RNA, 14 nt, Mycobacterium avium subsp. paratuberculosis
cccggcgcggccgg

SEQ ID NO: 810040 - RNA, 15 nt, Mycobacterium avium subsp. paratuberculosis
cccggcgcggccggu

SEQ ID NO: 810041 - RNA, 14 nt, Mycobacterium avium subsp. paratuberculosis
cccggcgcggcggc

SEQ ID NO: 810042 - RNA, 19 nt, Mycobacterium avium subsp. paratuberculosis
cccggcgcggcggcgccgc

SEQ ID NO: 810043 - RNA, 18 nt, Mycobacterium avium subsp. paratuberculosis
cccggcgcuaaagccgac

SEQ ID NO: 810044 - RNA, 15 nt, Mycobacterium avium subsp. paratuberculosis
cccggggcggcgaug

SEQ ID NO: 810045 - RNA, 21 nt, Mycobacterium avium subsp. paratuberculosis
cccggggcggcgaugcgcggc

SEQ ID NO: 810046 - RNA, 19 nt, Mycobacterium avium subsp. paratuberculosis
cccgggggaagcccagcac

SEQ ID NO: 810047 - RNA, 16 nt, Mycobacterium avium subsp. paratuberculosis
cccgggggaccagcgc

SEQ ID NO: 810048 - RNA, 17 nt, Mycobacterium avium subsp. paratuberculosis
cccgggggaccagcgca

SEQ ID NO: 810049 - RNA, 17 nt, Mycobacterium avium subsp. paratuberculosis
cccggggguagcggugg

SEQ ID NO: 810050 - RNA, 18 nt, Mycobacterium avium subsp. paratuberculosis
cccgggguccaccggccg

SEQ ID NO: 810051 - RNA, 22 nt, Mycobacterium avium subsp. paratuberculosis
cccgggguggauccgucgcuac

SEQ ID NO: 810052 - RNA, 15 nt, Mycobacterium avium subsp. paratuberculosis
cccgggucgagcggc

SEQ ID NO: 810053 - RNA, 19 nt, Mycobacterium avium subsp. paratuberculosis
cccgggucgagcggcccgc

SEQ ID NO: 810054 - RNA, 15 nt, Mycobacterium avium subsp. paratuberculosis
cccggguccuggauc

SEQ ID NO: 810055 - RNA, 22 nt, Mycobacterium avium subsp. paratuberculosis
cccggucugaucgcccagcacc

SEQ ID NO: 810056 - RNA, 23 nt, Mycobacterium avium subsp. paratuberculosis
cccggucugaucgcccagcaccg

SEQ ID NO: 810057 - RNA, 18 nt, Mycobacterium avium subsp. paratuberculosis
cccggucugcggccgcga

SEQ ID NO: 810058 - RNA, 23 nt, Mycobacterium avium subsp. paratuberculosis
cccggucugcggccgcgacugca

SEQ ID NO: 810059 - RNA, 16 nt, Mycobacterium avium subsp. paratuberculosis
cccggucuugccggcu

SEQ ID NO: 810060 - RNA, 22 nt, Mycobacterium avium subsp. paratuberculosis
cccggucuuguugugcugcacc

SEQ ID NO: 810061 - RNA, 22 nt, Mycobacterium avium subsp. paratuberculosis
cccggugacgauccggucgaug

SEQ ID NO: 810062 - RNA, 13 nt, Mycobacterium avium subsp. paratuberculosis
cccggucggccgc

SEQ ID NO: 810063 - RNA, 20 nt, Mycobacterium avium subsp. paratuberculosis
cccggucgcggccguagccg

SEQ ID NO: 810064 - RNA, 13 nt, Mycobacterium avium subsp. paratuberculosis
cccggucggugag

SEQ ID NO: 810065 - RNA, 22 nt, Mycobacterium avium subsp. paratuberculosis
cccggucguagucggcccgccg

SEQ ID NO: 810066 - RNA, 15 nt, Mycobacterium avium subsp. paratuberculosis
cccggucgucgccgg

SEQ ID NO: 810067 - RNA, 19 nt, Mycobacterium avium subsp. paratuberculosis
cccggucgucgccggaugu

SEQ ID NO: 810068 - RNA, 13 nt, Mycobacterium avium subsp. paratuberculosis
cccguaacacgau

SEQ ID NO: 810069 - RNA, 21 nt, Mycobacterium avium subsp. paratuberculosis
cccguaacacgaucaccccga

SEQ ID NO: 810070 - RNA, 17 nt, Mycobacterium avium subsp. paratuberculosis
cccguacggguugccgu

SEQ ID NO: 810071 - RNA, 22 nt, Mycobacterium avium subsp. paratuberculosis
cccguacggguugccgucgacg

SEQ ID NO: 810072 - RNA, 15 nt, Mycobacterium avium subsp. paratuberculosis
cccguagaugccggu

SEQ ID NO: 810073 - RNA, 17 nt, Mycobacterium avium subsp. paratuberculosis
cccguagaugccgguac

SEQ ID NO: 810074 - RNA, 23 nt, Mycobacterium avium subsp. paratuberculosis
cccguagccgcgguucggcgucg

SEQ ID NO: 810075 - RNA, 18 nt, Mycobacterium avium subsp. paratuberculosis
cccguagcucgcgccgac

SEQ ID NO: 810076 - RNA, 22 nt, Mycobacterium avium subsp. paratuberculosis
cccguagcucgcgccgacccgc

SEQ ID NO: 810077 - RNA, 23 nt, Mycobacterium avium subsp. paratuberculosis
cccguagcucgcgccgacccgcc

SEQ ID NO: 810078 - RNA, 13 nt, Mycobacterium avium subsp. paratuberculosis
cccguagcggcgg

SEQ ID NO: 810079 - RNA, 13 nt, Mycobacterium avium subsp. paratuberculosis
cccguagcggugg

SEQ ID NO: 810080 - RNA, 16 nt, Mycobacterium avium subsp. paratuberculosis
cccgguugagcaccgc

SEQ ID NO: 810081 - RNA, 19 nt, Mycobacterium avium subsp. paratuberculosis
cccgguugagugcgccgug

SEQ ID NO: 810082 - RNA, 23 nt, Mycobacterium avium subsp. paratuberculosis
cccgguugagugcgccgugcagc

SEQ ID NO: 810083 - RNA, 17 nt, Mycobacterium avium subsp. paratuberculosis
cccgguugauccggauc

SEQ ID NO: 810084 - RNA, 18 nt, Mycobacterium avium subsp. paratuberculosis
cccgguucugggcgggcu

SEQ ID NO: 810085 - RNA, 20 nt, Mycobacterium avium subsp. paratuberculosis
cccgguugaaggccgcgcug

SEQ ID NO: 810086 - RNA, 21 nt, Mycobacterium avium subsp. paratuberculosis
cccgguugaccccggccccgg

SEQ ID NO: 810087 - RNA, 14 nt, Mycobacterium avium subsp. paratuberculosis
cccggugaucgccg

SEQ ID NO: 810088 - RNA, 12 nt, Mycobacterium avium subsp. paratuberculosis
cccggugaugac

SEQ ID NO: 810089 - RNA, 17 nt, Mycobacterium avium subsp. paratuberculosis
cccggugaugacggggc

SEQ ID NO: 810090 - RNA, 17 nt, Mycobacterium avium subsp. paratuberculosis
cccggugaugccggcau

SEQ ID NO: 810091 - RNA, 17 nt, Mycobacterium avium subsp. paratuberculosis
cccguauugccgucggc

SEQ ID NO: 810092 - RNA, 15 nt, Mycobacterium avium subsp. paratuberculosis
cccguaggucgccuc

SEQ ID NO: 810093 - RNA, 22 nt, Mycobacterium avium subsp. paratuberculosis
cccguagguugccccacacgau

SEQ ID NO: 810094 - RNA, 18 nt, Mycobacterium avium subsp. paratuberculosis
cccguagucggcggcgag

SEQ ID NO: 810095 - RNA, 16 nt, Mycobacterium avium subsp. paratuberculosis
cccgucaggucgcggu

SEQ ID NO: 810096 - RNA, 13 nt, Mycobacterium avium subsp. paratuberculosis
cccgucacgcugg

SEQ ID NO: 810097 - RNA, 19 nt, Mycobacterium avium subsp. paratuberculosis
cccgucacgcuggcgugac

SEQ ID NO: 810098 - RNA, 15 nt, Mycobacterium avium subsp. paratuberculosis
cccgucacggccguc

SEQ ID NO: 810099 - RNA, 14 nt, Mycobacterium avium subsp. paratuberculosis
cccgucacggcugc

SEQ ID NO: 810100 - RNA, 12 nt, Mycobacterium avium subsp. paratuberculosis
cccgucgaaacc

SEQ ID NO: 810101 - RNA, 13 nt, Mycobacterium avium subsp. paratuberculosis
cccguccgggccg

SEQ ID NO: 810102 - RNA, 15 nt, Mycobacterium avium subsp. paratuberculosis
cccguccgggccggc

SEQ ID NO: 810103 - RNA, 12 nt, Mycobacterium avium subsp. paratuberculosis
cccguccgcccc

SEQ ID NO: 810104 - RNA, 16 nt, Mycobacterium avium subsp. paratuberculosis
cccguccgccccgcug

SEQ ID NO: 810105 - RNA, 17 nt, Mycobacterium avium subsp. paratuberculosis
cccguccgccccgcugc

SEQ ID NO: 810106 - RNA, 20 nt, Mycobacterium avium subsp. paratuberculosis
cccguccagaucggccagcg

SEQ ID NO: 810107 - RNA, 23 nt, Mycobacterium avium subsp. paratuberculosis
cccguccagaucggccagcgcgg

SEQ ID NO: 810108 - RNA, 14 nt, Mycobacterium avium subsp. paratuberculosis
cccguccaucgccg

SEQ ID NO: 810109 - RNA, 22 nt, Mycobacterium avium subsp. paratuberculosis
cccguccaucgccgcgcacccg

SEQ ID NO: 810110 - RNA, 18 nt, Mycobacterium avium subsp. paratuberculosis
cccgucgggccguccgcc

SEQ ID NO: 810111 - RNA, 22 nt, Mycobacterium avium subsp. paratuberculosis
cccgucgggccguccgccggcu

SEQ ID NO: 810112 - RNA, 15 nt, Mycobacterium avium subsp. paratuberculosis
cccgucgggcgcggc

SEQ ID NO: 810113 - RNA, 19 nt, Mycobacterium avium subsp. paratuberculosis
cccgucgggcgcggcggca

SEQ ID NO: 810114 - RNA, 23 nt, Mycobacterium avium subsp. paratuberculosis
cccgucggggcccggcccggcga

SEQ ID NO: 810115 - RNA, 13 nt, Mycobacterium avium subsp. paratuberculosis
cccgucgggugug

SEQ ID NO: 810116 - RNA, 14 nt, Mycobacterium avium subsp. paratuberculosis
cccgucggucgggc

SEQ ID NO: 810117 - RNA, 16 nt, Mycobacterium avium subsp. paratuberculosis
cccgucggucgggcag

SEQ ID NO: 810118 - RNA, 23 nt, Mycobacterium avium subsp. paratuberculosis
cccgucggugaaguuggcggcgg

SEQ ID NO: 810119 - RNA, 22 nt, Mycobacterium avium subsp. paratuberculosis
cccgucguccuugagcccccac

SEQ ID NO: 810120 - RNA, 13 nt, Mycobacterium avium subsp. paratuberculosis
cccgucgucgaug

SEQ ID NO: 810121 - RNA, 16 nt, Mycobacterium avium subsp. paratuberculosis
cccgucgucgaugcgc

SEQ ID NO: 810122 - RNA, 21 nt, Mycobacterium avium subsp. paratuberculosis
cccgucgucgaugcgcagcag

SEQ ID NO: 810123 - RNA, 23 nt, Mycobacterium avium subsp. paratuberculosis
cccgucgucgaugcgcagcagcg

SEQ ID NO: 810124 - RNA, 15 nt, Mycobacterium avium subsp. paratuberculosis
cccgucgucgccgau

SEQ ID NO: 810125 - RNA, 18 nt, Mycobacterium avium subsp. paratuberculosis
cccgucggcgugauaggc

SEQ ID NO: 810126 - RNA, 17 nt, Mycobacterium avium subsp. paratuberculosis
cccgucgucggcgccgc

SEQ ID NO: 810127 - RNA, 21 nt, Mycobacterium avium subsp. paratuberculosis
cccgucgucggcgccgcgccg

SEQ ID NO: 810128 - RNA, 17 nt, Mycobacterium avium subsp. paratuberculosis
cccgucggaggacaacg

SEQ ID NO: 810129 - RNA, 13 nt, Mycobacterium avium subsp. paratuberculosis
cccgucggccauc

SEQ ID NO: 810130 - RNA, 18 nt, Mycobacterium avium subsp. paratuberculosis
cccgucggccaucagccg

SEQ ID NO: 810131 - RNA, 15 nt, Mycobacterium avium subsp. paratuberculosis
cccgucgagcgucac

SEQ ID NO: 810132 - RNA, 21 nt, Mycobacterium avium subsp. paratuberculosis
cccgucgagcgucacgccgcg

SEQ ID NO: 810133 - RNA, 22 nt, Mycobacterium avium subsp. paratuberculosis
cccgucgagcgucacgccgcgc

SEQ ID NO: 810134 - RNA, 22 nt, Mycobacterium avium subsp. paratuberculosis
cccgucgacgggccaccagcgc

SEQ ID NO: 810135 - RNA, 13 nt, Mycobacterium avium subsp. paratuberculosis
cccgucgacgucg

SEQ ID NO: 810136 - RNA, 14 nt, Mycobacterium avium subsp. paratuberculosis
cccgucgacgucga

SEQ ID NO: 810137 - RNA, 13 nt, Mycobacterium avium subsp. paratuberculosis
cccgucgacucgg

SEQ ID NO: 810138 - RNA, 17 nt, Mycobacterium avium subsp. paratuberculosis
cccgucgacucggcggu

SEQ ID NO: 810139 - RNA, 22 nt, Mycobacterium avium subsp. paratuberculosis
cccgucgacucggcggugccgu

SEQ ID NO: 810140 - RNA, 17 nt, Mycobacterium avium subsp. paratuberculosis
cccguccugggccuggc

SEQ ID NO: 810141 - RNA, 21 nt, Mycobacterium avium subsp. paratuberculosis
cccgucgaccaggacgucggc

SEQ ID NO: 810142 - RNA, 13 nt, Mycobacterium avium subsp. paratuberculosis
ccaaccccgggcg

SEQ ID NO: 810143 - RNA, 18 nt, Mycobacterium avium subsp. paratuberculosis
ccaaagccuacggcgccg

SEQ ID NO: 810144 - RNA, 19 nt, Mycobacterium avium subsp. paratuberculosis
ccaaagccuacggcgccgg

SEQ ID NO: 810145 - RNA, 23 nt, Mycobacterium avium subsp. paratuberculosis
ccaaagcggcuaagccggcgucg

SEQ ID NO: 810146 - RNA, 15 nt, Mycobacterium avium subsp. paratuberculosis
ccaacccgggcgcca

SEQ ID NO: 810147 - RNA, 16 nt, Mycobacterium avium subsp. paratuberculosis
ccaacccgggcgccau

SEQ ID NO: 810148 - RNA, 15 nt, Mycobacterium avium subsp. paratuberculosis
ccaaccgcauucggc

SEQ ID NO: 810149 - RNA, 19 nt, Mycobacterium avium subsp. paratuberculosis
ccaaccgcauucggccgcc

SEQ ID NO: 810150 - RNA, 17 nt, Mycobacterium avium subsp. paratuberculosis
ccaaccgcccggcgccg

SEQ ID NO: 810151 - RNA, 14 nt, Mycobacterium avium subsp. paratuberculosis
ccaaccgcucggcg

SEQ ID NO: 810152 - RNA, 13 nt, Mycobacterium avium subsp. paratuberculosis
ccaaccggccccg

SEQ ID NO: 810153 - RNA, 15 nt, Mycobacterium avium subsp. paratuberculosis
ccaaccgggcaggca

SEQ ID NO: 810154 - RNA, 18 nt, Mycobacterium avium subsp. paratuberculosis
ccaaccgggcaggcacgg

SEQ ID NO: 810155 - RNA, 12 nt, Mycobacterium avium subsp. paratuberculosis
ccaacgacagcg

SEQ ID NO: 810156 - RNA, 16 nt, Mycobacterium avium subsp. paratuberculosis
ccaacgacagcgacgg

SEQ ID NO: 810157 - RNA, 18 nt, Mycobacterium avium subsp. paratuberculosis
ccaacgacagcgacgggc

SEQ ID NO: 810158 - RNA, 21 nt, Mycobacterium avium subsp. paratuberculosis
ccaacgacagcgacgggccgg

SEQ ID NO: 810159 - RNA, 17 nt, Mycobacterium avium subsp. paratuberculosis
cauugucgccgugcggc

SEQ ID NO: 810160 - RNA, 18 nt, Mycobacterium avium subsp. paratuberculosis
cauugucgccgugcggcg

SEQ ID NO: 810161 - RNA, 21 nt, Mycobacterium avium subsp. paratuberculosis
cauuggugccggccucgucgg

SEQ ID NO: 810162 - RNA, 17 nt, Mycobacterium avium subsp. paratuberculosis
cauugcccaucgccacg

SEQ ID NO: 810163 - RNA, 14 nt, Mycobacterium avium subsp. paratuberculosis
cauuggcaccgucg

SEQ ID NO: 810164 - RNA, 18 nt, Mycobacterium avium subsp. paratuberculosis
cauuggcaccgucgaccu

SEQ ID NO: 810165 - RNA, 15 nt, Mycobacterium avium subsp. paratuberculosis
cauuggcagcucggg

SEQ ID NO: 810166 - RNA, 18 nt, Mycobacterium avium subsp. paratuberculosis
cauugcgauacgacggga

SEQ ID NO: 810167 - RNA, 15 nt, Mycobacterium avium subsp. paratuberculosis
cauuggcgaccgcgg

SEQ ID NO: 810168 - RNA, 18 nt, Mycobacterium avium subsp. paratuberculosis
cauuccgccgcgcccguc

SEQ ID NO: 810169 - RNA, 22 nt, Mycobacterium avium subsp. paratuberculosis
cauucgucggcggucuuggcgg

SEQ ID NO: 810170 - RNA, 20 nt, Mycobacterium avium subsp. paratuberculosis
cauucugaauucggccaccg

SEQ ID NO: 810171 - RNA, 14 nt, Mycobacterium avium subsp. paratuberculosis
cauucccgccgccg

SEQ ID NO: 810172 - RNA, 15 nt, Mycobacterium avium subsp. paratuberculosis
cauucccgccgccgc

SEQ ID NO: 810173 - RNA, 20 nt, Mycobacterium avium subsp. paratuberculosis
caugucgaugucgacgccgu

SEQ ID NO: 810174 - RNA, 13 nt, Mycobacterium avium subsp. paratuberculosis
caugucgcccgcg

SEQ ID NO: 810175 - RNA, 20 nt, Mycobacterium avium subsp. paratuberculosis
caugucgaccucggccacca

SEQ ID NO: 810176 - RNA, 14 nt, Mycobacterium avium subsp. paratuberculosis
caugucgacgcuga

SEQ ID NO: 810177 - RNA, 16 nt, Mycobacterium avium subsp. paratuberculosis
caugucgacgcugagc

SEQ ID NO: 810178 - RNA, 23 nt, Mycobacterium avium subsp. paratuberculosis
caugucgaagaagcggccgacga

SEQ ID NO: 810179 - RNA, 16 nt, Mycobacterium avium subsp. paratuberculosis
caugucgaugccgagc

SEQ ID NO: 810180 - RNA, 17 nt, Mycobacterium avium subsp. paratuberculosis
cauguccggcaggcuca

SEQ ID NO: 810181 - RNA, 17 nt, Mycobacterium avium subsp. paratuberculosis
cauguccucgggguggu

SEQ ID NO: 810182 - RNA, 17 nt, Mycobacterium avium subsp. paratuberculosis
caugucaaugccgcagc

SEQ ID NO: 810183 - RNA, 15 nt, Mycobacterium avium subsp. paratuberculosis
ccaacgguucggccg

SEQ ID NO: 810184 - RNA, 17 nt, Mycobacterium avium subsp. paratuberculosis
ccaacgguuuccaccac

SEQ ID NO: 810185 - RNA, 14 nt, Mycobacterium avium subsp. paratuberculosis
ccaacggcucgccg

SEQ ID NO: 810186 - RNA, 20 nt, Mycobacterium avium subsp. paratuberculosis
ccaacggcucgccgcgcauc

SEQ ID NO: 810187 - RNA, 14 nt, Mycobacterium avium subsp. paratuberculosis
ccaacgggcggcgg

SEQ ID NO: 810188 - RNA, 15 nt, Mycobacterium avium subsp. paratuberculosis
ccaacgggcggcgga

SEQ ID NO: 810189 - RNA, 22 nt, Mycobacterium avium subsp. paratuberculosis
ccaacgggcggcggaucagcac

SEQ ID NO: 810190 - RNA, 23 nt, Mycobacterium avium subsp. paratuberculosis
ccaacgcguucuccucgaacacc

SEQ ID NO: 810191 - RNA, 14 nt, Mycobacterium avium subsp. paratuberculosis
ccaacggcgugcag

SEQ ID NO: 810192 - RNA, 16 nt, Mycobacterium avium subsp. paratuberculosis
ccaacguggguggccc

SEQ ID NO: 810193 - RNA, 16 nt, Mycobacterium avium subsp. paratuberculosis
ccaacuacccgccgac

SEQ ID NO: 810194 - RNA, 17 nt, Mycobacterium avium subsp. paratuberculosis
ccaacuacccgccgacg

SEQ ID NO: 810195 - RNA, 21 nt, Mycobacterium avium subsp. paratuberculosis
ccaacucaugggcccggcccg

SEQ ID NO: 810196 - RNA, 24 nt, Mycobacterium avium subsp. paratuberculosis
ccaacucaugggcccggcccguca

SEQ ID NO: 810197 - RNA, 15 nt, Mycobacterium avium subsp. paratuberculosis
ccaacuccaccgccc

SEQ ID NO: 810198 - RNA, 23 nt, Mycobacterium avium subsp. paratuberculosis
ccaacugcagauaggacccggcg

SEQ ID NO: 810199 - RNA, 17 nt, Mycobacterium avium subsp. paratuberculosis
ccaacugcaucgccagc

SEQ ID NO: 810200 - RNA, 22 nt, Mycobacterium avium subsp. paratuberculosis
ccaaccuggacgguuucaccgc

SEQ ID NO: 810201 - RNA, 23 nt, Mycobacterium avium subsp. paratuberculosis
ccaaccuggacgguuucaccgcc

SEQ ID NO: 810202 - RNA, 15 nt, Mycobacterium avium subsp. paratuberculosis
ccaacgccucgucga

SEQ ID NO: 810203 - RNA, 17 nt, Mycobacterium avium subsp. paratuberculosis
ccaacgccucgucgacc

SEQ ID NO: 810204 - RNA, 18 nt, Mycobacterium avium subsp. paratuberculosis
ccaacggcaccaccacgg

SEQ ID NO: 810205 - RNA, 13 nt, Mycobacterium avium subsp. paratuberculosis
ccaacggccgcac

SEQ ID NO: 810206 - RNA, 14 nt, Mycobacterium avium subsp. paratuberculosis
ccaacggccgcacg

SEQ ID NO: 810207 - RNA, 12 nt, Mycobacterium avium subsp. paratuberculosis
ccaacgcggcca

SEQ ID NO: 810208 - RNA, 13 nt, Mycobacterium avium subsp. paratuberculosis
ccaacgcggcgcc

SEQ ID NO: 810209 - RNA, 15 nt, Mycobacterium avium subsp. paratuberculosis
ccaacgcggcgccgg

SEQ ID NO: 810210 - RNA, 17 nt, Mycobacterium avium subsp. paratuberculosis
ccaagcgguuccagacc

SEQ ID NO: 810211 - RNA, 20 nt, Mycobacterium avium subsp. paratuberculosis
ccaagcgguuccagaccggc

SEQ ID NO: 810212 - RNA, 22 nt, Mycobacterium avium subsp. paratuberculosis
ccaagcgguuccagaccggcgg

SEQ ID NO: 810213 - RNA, 23 nt, Mycobacterium avium subsp. paratuberculosis
ccaagcgguuccagaccggcggc

SEQ ID NO: 810214 - RNA, 22 nt, Mycobacterium avium subsp. paratuberculosis
ccaagaaccaacugagcgcggc

SEQ ID NO: 810215 - RNA, 19 nt, Mycobacterium avium subsp. paratuberculosis
ccaacugcauuucggacgg

SEQ ID NO: 810216 - RNA, 21 nt, Mycobacterium avium subsp. paratuberculosis
ccaacugcauuucggacggcg

SEQ ID NO: 810217 - RNA, 17 nt, Mycobacterium avium subsp. paratuberculosis
ccaagccggccaggccc

SEQ ID NO: 810218 - RNA, 19 nt, Mycobacterium avium subsp. paratuberculosis
ccaagaaguuuccccacca

SEQ ID NO: 810219 - RNA, 19 nt, Mycobacterium avium subsp. paratuberculosis
ccaagacguccgcgucggc

SEQ ID NO: 810220 - RNA, 22 nt, Mycobacterium avium subsp. paratuberculosis
ccaagacguccgcgucggcgcc

SEQ ID NO: 810221 - RNA, 23 nt, Mycobacterium avium subsp. paratuberculosis
ccacauacgcggcggccugcgcg

SEQ ID NO: 810222 - RNA, 15 nt, Mycobacterium avium subsp. paratuberculosis
ccacacgcucggcga

SEQ ID NO: 810223 - RNA, 16 nt, Mycobacterium avium subsp. paratuberculosis
ccacacgcucggcgcg

SEQ ID NO: 810224 - RNA, 13 nt, Mycobacterium avium subsp. paratuberculosis
ccacacgaugcgc

SEQ ID NO: 810225 - RNA, 18 nt, Mycobacterium avium subsp. paratuberculosis
ccacaccggcgcugcccg

SEQ ID NO: 810226 - RNA, 13 nt, Mycobacterium avium subsp. paratuberculosis
ccacaccgggaag

SEQ ID NO: 810227 - RNA, 15 nt, Mycobacterium avium subsp. paratuberculosis
ccacaccgucgacga

SEQ ID NO: 810228 - RNA, 22 nt, Mycobacterium avium subsp. paratuberculosis
ccacaccgccgcggcgguggcc

SEQ ID NO: 810229 - RNA, 12 nt, Mycobacterium avium subsp. paratuberculosis
ccacaccgccgg

SEQ ID NO: 810230 - RNA, 14 nt, Mycobacterium avium subsp. paratuberculosis
ccacaccgccggcc

SEQ ID NO: 810231 - RNA, 16 nt, Mycobacterium avium subsp. paratuberculosis
ccacaccgccggcgcg

SEQ ID NO: 810232 - RNA, 20 nt, Mycobacterium avium subsp. paratuberculosis
ccacaccgccggcgcggacg

SEQ ID NO: 810233 - RNA, 14 nt, Mycobacterium avium subsp. paratuberculosis
ccacacccgcggcc

SEQ ID NO: 810234 - RNA, 14 nt, Mycobacterium avium subsp. paratuberculosis
ccacacccagcgcc

SEQ ID NO: 810235 - RNA, 20 nt, Mycobacterium avium subsp. paratuberculosis
ccacacccagcgccaggacg

SEQ ID NO: 810236 - RNA, 21 nt, Mycobacterium avium subsp. paratuberculosis
ccacaccgacaugucgccggg

SEQ ID NO: 810237 - RNA, 15 nt, Mycobacterium avium subsp. paratuberculosis
ccaauaccguuccgc

SEQ ID NO: 810238 - RNA, 22 nt, Mycobacterium avium subsp. paratuberculosis
ccacaccccggccaccagggcg

SEQ ID NO: 810239 - RNA, 13 nt, Mycobacterium avium subsp. paratuberculosis
ccacaugccguug

SEQ ID NO: 810240 - RNA, 23 nt, Mycobacterium avium subsp. paratuberculosis
ccacaugccguugccaggccgcg

SEQ ID NO: 810241 - RNA, 20 nt, Mycobacterium avium subsp. paratuberculosis
ccacaucgggauuggcggcc

SEQ ID NO: 810242 - RNA, 15 nt, Mycobacterium avium subsp. paratuberculosis
ccacaucggucucga

SEQ ID NO: 810243 - RNA, 17 nt, Mycobacterium avium subsp. paratuberculosis
ccacauucccgccgccg

SEQ ID NO: 810244 - RNA, 20 nt, Mycobacterium avium subsp. paratuberculosis
ccacaugggccacggcgcga

SEQ ID NO: 810245 - RNA, 21 nt, Mycobacterium avium subsp. paratuberculosis
ccacaugggccacggcgcgag

SEQ ID NO: 810246 - RNA, 20 nt, Mycobacterium avium subsp. paratuberculosis
ccacauguucuccucgucgc

SEQ ID NO: 810247 - RNA, 19 nt, Mycobacterium avium subsp. paratuberculosis
ccacaucggauucgucggu

SEQ ID NO: 810248 - RNA, 21 nt, Mycobacterium avium subsp. paratuberculosis
ccaccaggucuccgucggcgc

SEQ ID NO: 810249 - RNA, 15 nt, Mycobacterium avium subsp. paratuberculosis
ccaccaggguggccg

SEQ ID NO: 810250 - RNA, 17 nt, Mycobacterium avium subsp. paratuberculosis
ccaccaggguggccgcc

SEQ ID NO: 810251 - RNA, 18 nt, Mycobacterium avium subsp. paratuberculosis
ccaccaggguggccgcca

SEQ ID NO: 810252 - RNA, 19 nt, Mycobacterium avium subsp. paratuberculosis
ccaccaggguggccgccac

SEQ ID NO: 810253 - RNA, 23 nt, Mycobacterium avium subsp. paratuberculosis
ccaccagguccuugaucgggaac

SEQ ID NO: 810254 - RNA, 18 nt, Mycobacterium avium subsp. paratuberculosis
ccaccagugucagggcag

SEQ ID NO: 810255 - RNA, 15 nt, Mycobacterium avium subsp. paratuberculosis
ccaccagggcgguga

SEQ ID NO: 810256 - RNA, 20 nt, Mycobacterium avium subsp. paratuberculosis
ccaccagggacaugccgagc

SEQ ID NO: 810257 - RNA, 23 nt, Mycobacterium avium subsp. paratuberculosis
ccaccagggacaugccgagcagc

SEQ ID NO: 810258 - RNA, 15 nt, Mycobacterium avium subsp. paratuberculosis
ccaccaggcgcgggc

SEQ ID NO: 810259 - RNA, 15 nt, Mycobacterium avium subsp. paratuberculosis
ccaccaggcgguccg

SEQ ID NO: 810260 - RNA, 19 nt, Mycobacterium avium subsp. paratuberculosis
ccaccaggcgguccgacac

SEQ ID NO: 810261 - RNA, 19 nt, Mycobacterium avium subsp. paratuberculosis
ccaccaggccguagagcac

SEQ ID NO: 810262 - RNA, 16 nt, Mycobacterium avium subsp. paratuberculosis
ccaccagccggccggc

SEQ ID NO: 810263 - RNA, 12 nt, Mycobacterium avium subsp. paratuberculosis
ccaccaggccga

SEQ ID NO: 810264 - RNA, 23 nt, Mycobacterium avium subsp. paratuberculosis
ccaccaaaaguguuuccgcugag

SEQ ID NO: 810265 - RNA, 23 nt, Mycobacterium avium subsp. paratuberculosis
ccacauuggcgaccgcggccgcg

SEQ ID NO: 810266 - RNA, 18 nt, Mycobacterium avium subsp. paratuberculosis
ccaccaacaucgacgugc

SEQ ID NO: 810267 - RNA, 14 nt, Mycobacterium avium subsp. paratuberculosis
ccaccaaggucucc

SEQ ID NO: 810268 - RNA, 19 nt, Mycobacterium avium subsp. paratuberculosis
ccaccaacgccacguagca

SEQ ID NO: 810269 - RNA, 23 nt, Mycobacterium avium subsp. paratuberculosis
ccaccaacgccacguagcagcag

SEQ ID NO: 810270 - RNA, 18 nt, Mycobacterium avium subsp. paratuberculosis
ccaccaacggcucgccgc

SEQ ID NO: 810271 - RNA, 23 nt, Mycobacterium avium subsp. paratuberculosis
ccaccacugcgccgucaucgaca

SEQ ID NO: 810272 - RNA, 18 nt, Mycobacterium avium subsp. paratuberculosis
ccaccacguugcgcggcc

SEQ ID NO: 810273 - RNA, 23 nt, Mycobacterium avium subsp. paratuberculosis
ccaccacguugcgcggccgcaug

SEQ ID NO: 810274 - RNA, 16 nt, Mycobacterium avium subsp. paratuberculosis
ccaccaauucgcgcug

SEQ ID NO: 810275 - RNA, 19 nt, Mycobacterium avium subsp. paratuberculosis
ccaccaauucgcgcugcca

SEQ ID NO: 810276 - RNA, 19 nt, Mycobacterium avium subsp. paratuberculosis
ccaccagaucgccccgcug

SEQ ID NO: 810277 - RNA, 20 nt, Mycobacterium avium subsp. paratuberculosis
ccaccagaucguguccgcgc

SEQ ID NO: 810278 - RNA, 16 nt, Mycobacterium avium subsp. paratuberculosis
ccaccagaugccgggc

SEQ ID NO: 810279 - RNA, 19 nt, Mycobacterium avium subsp. paratuberculosis
ccaccagaugccgggcucc

SEQ ID NO: 810280 - RNA, 14 nt, Mycobacterium avium subsp. paratuberculosis
ccaccagcaccggg

SEQ ID NO: 810281 - RNA, 15 nt, Mycobacterium avium subsp. paratuberculosis
ccaccagcaccggga

SEQ ID NO: 810282 - RNA, 13 nt, Mycobacterium avium subsp. paratuberculosis
ccaccagccggcc

SEQ ID NO: 810283 - RNA, 22 nt, Mycobacterium avium subsp. paratuberculosis
ccaccagccgagaucgacccgc

SEQ ID NO: 810284 - RNA, 23 nt, Mycobacterium avium subsp. paratuberculosis
ccaccagccgcaggugcucgccg

SEQ ID NO: 810285 - RNA, 17 nt, Mycobacterium avium subsp. paratuberculosis
ccaccagcacgccguug

SEQ ID NO: 810286 - RNA, 15 nt, Mycobacterium avium subsp. paratuberculosis
ccaccagcagcgaga

SEQ ID NO: 810287 - RNA, 23 nt, Mycobacterium avium subsp. paratuberculosis
ccaccagcagcgagaccggcacg

SEQ ID NO: 810288 - RNA, 20 nt, Mycobacterium avium subsp. paratuberculosis
ccaccagccacaccgccgcg

SEQ ID NO: 810289 - RNA, 20 nt, Mycobacterium avium subsp. paratuberculosis
cauggagaugcuucagcccu

SEQ ID NO: 810290 - RNA, 17 nt, Mycobacterium avium subsp. paratuberculosis
cauggaaaccggcggga

SEQ ID NO: 810291 - RNA, 14 nt, Mycobacterium avium subsp. paratuberculosis
cauggccagcacca

SEQ ID NO: 810292 - RNA, 21 nt, Mycobacterium avium subsp. paratuberculosis
cauggcaguuguuccaguccc

SEQ ID NO: 810293 - RNA, 22 nt, Mycobacterium avium subsp. paratuberculosis
caugcuguuccagacgucggcg

SEQ ID NO: 810294 - RNA, 15 nt, Mycobacterium avium subsp. paratuberculosis
caugcuggugccgcc

SEQ ID NO: 810295 - RNA, 18 nt, Mycobacterium avium subsp. paratuberculosis
caugcuggugccgccgau

SEQ ID NO: 810296 - RNA, 13 nt, Mycobacterium avium subsp. paratuberculosis
caugcgaccacga

SEQ ID NO: 810297 - RNA, 20 nt, Mycobacterium avium subsp. paratuberculosis
caugcgaccacgaccggguc

SEQ ID NO: 810298 - RNA, 16 nt, Mycobacterium avium subsp. paratuberculosis
caugcgcagcgcccag

SEQ ID NO: 810299 - RNA, 20 nt, Mycobacterium avium subsp. paratuberculosis
caugcgccagagcgcgaaaa

SEQ ID NO: 810300 - RNA, 15 nt, Mycobacterium avium subsp. paratuberculosis
caugcugggcuacca

SEQ ID NO: 810301 - RNA, 19 nt, Mycobacterium avium subsp. paratuberculosis
caugcugggcuaccagccc

SEQ ID NO: 810302 - RNA, 16 nt, Mycobacterium avium subsp. paratuberculosis
caugcgcgagucgagc

SEQ ID NO: 810303 - RNA, 17 nt, Mycobacterium avium subsp. paratuberculosis
caugcgcgagucgagca

SEQ ID NO: 810304 - RNA, 15 nt, Mycobacterium avium subsp. paratuberculosis
cauggcggcccgcgc

SEQ ID NO: 810305 - RNA, 12 nt, Mycobacterium avium subsp. paratuberculosis
cauggucgagcc

SEQ ID NO: 810306 - RNA, 23 nt, Mycobacterium avium subsp. paratuberculosis
cauggugaacugguugacgucgg

SEQ ID NO: 810307 - RNA, 18 nt, Mycobacterium avium subsp. paratuberculosis
cauggugaaggcgaacac

SEQ ID NO: 810308 - RNA, 23 nt, Mycobacterium avium subsp. paratuberculosis
cauggugcgcggguucacccugg

SEQ ID NO: 810309 - RNA, 18 nt, Mycobacterium avium subsp. paratuberculosis
cauggugcggguguccga

SEQ ID NO: 810310 - RNA, 13 nt, Mycobacterium avium subsp. paratuberculosis
cauggucgcggcc

SEQ ID NO: 810311 - RNA, 14 nt, Mycobacterium avium subsp. paratuberculosis
cauggucggcgacg

SEQ ID NO: 810312 - RNA, 12 nt, Mycobacterium avium subsp. paratuberculosis
cauggucgucgu

SEQ ID NO: 810313 - RNA, 16 nt, Mycobacterium avium subsp. paratuberculosis
cauggucgcccacacc

SEQ ID NO: 810314 - RNA, 19 nt, Mycobacterium avium subsp. paratuberculosis
cauggucgcccacaccgga

SEQ ID NO: 810315 - RNA, 13 nt, Mycobacterium avium subsp. paratuberculosis
cauggcggccagc

SEQ ID NO: 810316 - RNA, 14 nt, Mycobacterium avium subsp. paratuberculosis
cauggcgcggcggc

SEQ ID NO: 810317 - RNA, 13 nt, Mycobacterium avium subsp. paratuberculosis
caugcagccgccg

SEQ ID NO: 810318 - RNA, 18 nt, Mycobacterium avium subsp. paratuberculosis
caugccacuugcgcacgu

SEQ ID NO: 810319 - RNA, 14 nt, Mycobacterium avium subsp. paratuberculosis
caugccagaccaca

SEQ ID NO: 810320 - RNA, 13 nt, Mycobacterium avium subsp. paratuberculosis
caugcccuuggcc

SEQ ID NO: 810321 - RNA, 20 nt, Mycobacterium avium subsp. paratuberculosis
caugcccuuggcccgggcgu

SEQ ID NO: 810322 - RNA, 19 nt, Mycobacterium avium subsp. paratuberculosis
caugcccuugucgcuggcg

SEQ ID NO: 810323 - RNA, 17 nt, Mycobacterium avium subsp. paratuberculosis
caugccgaacaacaggg

SEQ ID NO: 810324 - RNA, 19 nt, Mycobacterium avium subsp. paratuberculosis
caugccgaacaacagggcc

SEQ ID NO: 810325 - RNA, 23 nt, Mycobacterium avium subsp. paratuberculosis
caugccgaacaacagggccgcgc

SEQ ID NO: 810326 - RNA, 18 nt, Mycobacterium avium subsp. paratuberculosis
caugccgaggcacagcag

SEQ ID NO: 810327 - RNA, 14 nt, Mycobacterium avium subsp. paratuberculosis
caugccgagcaccu

SEQ ID NO: 810328 - RNA, 15 nt, Mycobacterium avium subsp. paratuberculosis
caugccgagcaccuc

SEQ ID NO: 810329 - RNA, 19 nt, Mycobacterium avium subsp. paratuberculosis
caugccgagcaccuccgac

SEQ ID NO: 810330 - RNA, 17 nt, Mycobacterium avium subsp. paratuberculosis
caugccgagcagcaccg

SEQ ID NO: 810331 - RNA, 19 nt, Mycobacterium avium subsp. paratuberculosis
caugccgagccgcuuggug

SEQ ID NO: 810332 - RNA, 23 nt, Mycobacterium avium subsp. paratuberculosis
caugccggucauccgggccacca

SEQ ID NO: 810333 - RNA, 20 nt, Mycobacterium avium subsp. paratuberculosis
caugccguucagcgcggcca

SEQ ID NO: 810334 - RNA, 22 nt, Mycobacterium avium subsp. paratuberculosis
caugccguucagcgcggccacc

SEQ ID NO: 810335 - RNA, 19 nt, Mycobacterium avium subsp. paratuberculosis
caugccucuucggcgcgcc

SEQ ID NO: 810336 - RNA, 22 nt, Mycobacterium avium subsp. paratuberculosis
caugccucuucggcgcgccggc

SEQ ID NO: 810337 - RNA, 18 nt, Mycobacterium avium subsp. paratuberculosis
caugccguagcggucgcc

SEQ ID NO: 810338 - RNA, 20 nt, Mycobacterium avium subsp. paratuberculosis
caugccguagcggucgcccc

SEQ ID NO: 810339 - RNA, 21 nt, Mycobacterium avium subsp. paratuberculosis
caugccguugccaggccgcga

SEQ ID NO: 810340 - RNA, 19 nt, Mycobacterium avium subsp. paratuberculosis
caugccgucggcgcccggc

SEQ ID NO: 810341 - RNA, 17 nt, Mycobacterium avium subsp. paratuberculosis
caugccgucgacgacgg

SEQ ID NO: 810342 - RNA, 18 nt, Mycobacterium avium subsp. paratuberculosis
caugccgucgacgacggu

SEQ ID NO: 810343 - RNA, 21 nt, Mycobacterium avium subsp. paratuberculosis
caugccguaaguggcgccgcg

SEQ ID NO: 810344 - RNA, 17 nt, Mycobacterium avium subsp. paratuberculosis
caugaccgauccgccgg

SEQ ID NO: 810345 - RNA, 19 nt, Mycobacterium avium subsp. paratuberculosis
caugaccgauccgccggcg

SEQ ID NO: 810346 - RNA, 13 nt, Mycobacterium avium subsp. paratuberculosis
caugacccacggg

SEQ ID NO: 810347 - RNA, 17 nt, Mycobacterium avium subsp. paratuberculosis
caugaucaccgccagcg

SEQ ID NO: 810348 - RNA, 20 nt, Mycobacterium avium subsp. paratuberculosis
caugaucaccgccagcgcgc

SEQ ID NO: 810349 - RNA, 20 nt, Mycobacterium avium subsp. paratuberculosis
caugaucaggccccacccgc

SEQ ID NO: 810350 - RNA, 12 nt, Mycobacterium avium subsp. paratuberculosis
caugaucggcag

SEQ ID NO: 810351 - RNA, 18 nt, Mycobacterium avium subsp. paratuberculosis
caugaucggcaggauccg

SEQ ID NO: 810352 - RNA, 14 nt, Mycobacterium avium subsp. paratuberculosis
caugcagccgccgc

SEQ ID NO: 810353 - RNA, 17 nt, Mycobacterium avium subsp. paratuberculosis
caugcagccgccgcgga

SEQ ID NO: 810354 - RNA, 18 nt, Mycobacterium avium subsp. paratuberculosis
caugaucucguugcggcg

SEQ ID NO: 810355 - RNA, 19 nt, Mycobacterium avium subsp. paratuberculosis
caucucggugccgucgauc

SEQ ID NO: 810356 - RNA, 22 nt, Mycobacterium avium subsp. paratuberculosis
caucucggugguggccaucgcg

SEQ ID NO: 810357 - RNA, 18 nt, Mycobacterium avium subsp. paratuberculosis
caucucgugcccgggccc

SEQ ID NO: 810358 - RNA, 17 nt, Mycobacterium avium subsp. paratuberculosis
caucucguugucgucgg

SEQ ID NO: 810359 - RNA, 16 nt, Mycobacterium avium subsp. paratuberculosis
caucugcacagcuucg

SEQ ID NO: 810360 - RNA, 18 nt, Mycobacterium avium subsp. paratuberculosis
caucugcacagcuucggc

SEQ ID NO: 810361 - RNA, 19 nt, Mycobacterium avium subsp. paratuberculosis
caucugcacagcuucggcg

SEQ ID NO: 810362 - RNA, 22 nt, Mycobacterium avium subsp. paratuberculosis
caucugcacagcuucggcgccg

SEQ ID NO: 810363 - RNA, 23 nt, Mycobacterium avium subsp. paratuberculosis
caucugcuugaugaugucggcgg

SEQ ID NO: 810364 - RNA, 11 nt, Mycobacterium avium subsp. paratuberculosis
caucuggccgc

SEQ ID NO: 810365 - RNA, 13 nt, Mycobacterium avium subsp. paratuberculosis
caucuggccgcgg

SEQ ID NO: 810366 - RNA, 21 nt, Mycobacterium avium subsp. paratuberculosis
caucuggccgcgggugcggcc

SEQ ID NO: 810367 - RNA, 16 nt, Mycobacterium avium subsp. paratuberculosis
caucugccgggcggcg

SEQ ID NO: 810368 - RNA, 17 nt, Mycobacterium avium subsp. paratuberculosis
caucugccgggcggcga

SEQ ID NO: 810369 - RNA, 19 nt, Mycobacterium avium subsp. paratuberculosis
caucugccgggcggcgacg

SEQ ID NO: 810370 - RNA, 16 nt, Mycobacterium avium subsp. paratuberculosis
caucugccggucgaug

SEQ ID NO: 810371 - RNA, 16 nt, Mycobacterium avium subsp. paratuberculosis
caucucaccgacgacc

SEQ ID NO: 810372 - RNA, 19 nt, Mycobacterium avium subsp. paratuberculosis
caucucagcguucacgucg

SEQ ID NO: 810373 - RNA, 16 nt, Mycobacterium avium subsp. paratuberculosis
caucucccgcacccgu

SEQ ID NO: 810374 - RNA, 13 nt, Mycobacterium avium subsp. paratuberculosis
caucucccgcgcg

SEQ ID NO: 810375 - RNA, 17 nt, Mycobacterium avium subsp. paratuberculosis
caucuccgagucggcgu

SEQ ID NO: 810376 - RNA, 16 nt, Mycobacterium avium subsp. paratuberculosis
caucuccagccgcggc

SEQ ID NO: 810377 - RNA, 14 nt, Mycobacterium avium subsp. paratuberculosis
caucuccagcgcgg

SEQ ID NO: 810378 - RNA, 12 nt, Mycobacterium avium subsp. paratuberculosis
caucuccagcuc

SEQ ID NO: 810379 - RNA, 19 nt, Mycobacterium avium subsp. paratuberculosis
caucuccagcuccgcggcc

SEQ ID NO: 810380 - RNA, 21 nt, Mycobacterium avium subsp. paratuberculosis
caucucgaaugcggcugccgg

SEQ ID NO: 810381 - RNA, 21 nt, Mycobacterium avium subsp. paratuberculosis
caucucgacggugaccggcuc

SEQ ID NO: 810382 - RNA, 19 nt, Mycobacterium avium subsp. paratuberculosis
caucuccggcacguugacg

SEQ ID NO: 810383 - RNA, 19 nt, Mycobacterium avium subsp. paratuberculosis
caucuccguggacggcgag

SEQ ID NO: 810384 - RNA, 23 nt, Mycobacterium avium subsp. paratuberculosis
caucuccuuggggcugaccucgc

SEQ ID NO: 810385 - RNA, 18 nt, Mycobacterium avium subsp. paratuberculosis
caucucgggagugcggcc

SEQ ID NO: 810386 - RNA, 21 nt, Mycobacterium avium subsp. paratuberculosis
caucucgggagugcggcccac

SEQ ID NO: 810387 - RNA, 20 nt, Mycobacterium avium subsp. paratuberculosis
caucucgucaaccgcagucg

SEQ ID NO: 810388 - RNA, 16 nt, Mycobacterium avium subsp. paratuberculosis
caugaaggcgacgucg

SEQ ID NO: 810389 - RNA, 13 nt, Mycobacterium avium subsp. paratuberculosis
caugaccaccgcg

SEQ ID NO: 810390 - RNA, 17 nt, Mycobacterium avium subsp. paratuberculosis
caugaccaccgcgucgg

SEQ ID NO: 810391 - RNA, 12 nt, Mycobacterium avium subsp. paratuberculosis
caugaacggcgg

SEQ ID NO: 810392 - RNA, 14 nt, Mycobacterium avium subsp. paratuberculosis
caugaacggcgggg

SEQ ID NO: 810393 - RNA, 23 nt, Mycobacterium avium subsp. paratuberculosis
caugaacuccgacuccagcagcg

SEQ ID NO: 810394 - RNA, 17 nt, Mycobacterium avium subsp. paratuberculosis
caugaagaucagcaccg

SEQ ID NO: 810395 - RNA, 20 nt, Mycobacterium avium subsp. paratuberculosis
caugaagaucagcaccgucc

SEQ ID NO: 810396 - RNA, 12 nt, Mycobacterium avium subsp. paratuberculosis
caugaaccgguc

SEQ ID NO: 810397 - RNA, 14 nt, Mycobacterium avium subsp. paratuberculosis
caugaaccaggccg

SEQ ID NO: 810398 - RNA, 20 nt, Mycobacterium avium subsp. paratuberculosis
caugaacgacccuuccggaa

SEQ ID NO: 810399 - RNA, 20 nt, Mycobacterium avium subsp. paratuberculosis
caucuugaucugggugccgc

SEQ ID NO: 810400 - RNA, 23 nt, Mycobacterium avium subsp. paratuberculosis
caucuugguguugaucagguuca

SEQ ID NO: 810401 - RNA, 17 nt, Mycobacterium avium subsp. paratuberculosis
caucugguucaccucgg

SEQ ID NO: 810402 - RNA, 21 nt, Mycobacterium avium subsp. paratuberculosis
caucugguucaccucgggaua

SEQ ID NO: 810403 - RNA, 20 nt, Mycobacterium avium subsp. paratuberculosis
caucgguugcuccggcgucg

SEQ ID NO: 810404 - RNA, 20 nt, Mycobacterium avium subsp. paratuberculosis
caucgguuugaccacggcgc

SEQ ID NO: 810405 - RNA, 13 nt, Mycobacterium avium subsp. paratuberculosis
caucgucaacaug

SEQ ID NO: 810406 - RNA, 22 nt, Mycobacterium avium subsp. paratuberculosis
caucgucacuucgccgggcugg

SEQ ID NO: 810407 - RNA, 16 nt, Mycobacterium avium subsp. paratuberculosis
caucguccacaccggg

SEQ ID NO: 810408 - RNA, 19 nt, Mycobacterium avium subsp. paratuberculosis
caucguccacaccgggaag

SEQ ID NO: 810409 - RNA, 13 nt, Mycobacterium avium subsp. paratuberculosis
caucgucgacccg

SEQ ID NO: 810410 - RNA, 18 nt, Mycobacterium avium subsp. paratuberculosis
caucguccucgcgccgug

SEQ ID NO: 810411 - RNA, 18 nt, Mycobacterium avium subsp. paratuberculosis
caucgucggggacgaaga

SEQ ID NO: 810412 - RNA, 20 nt, Mycobacterium avium subsp. paratuberculosis
caucgucggggacgaagacc

SEQ ID NO: 810413 - RNA, 16 nt, Mycobacterium avium subsp. paratuberculosis
caucgucgcggcgguc

SEQ ID NO: 810414 - RNA, 17 nt, Mycobacterium avium subsp. paratuberculosis
caucgucgcggcgguca

SEQ ID NO: 810415 - RNA, 21 nt, Mycobacterium avium subsp. paratuberculosis
caucgucggcgccggcgcgca

SEQ ID NO: 810416 - RNA, 23 nt, Mycobacterium avium subsp. paratuberculosis
caucgucggcgccggcgcgcaac

SEQ ID NO: 810417 - RNA, 22 nt, Mycobacterium avium subsp. paratuberculosis
caucguucccugcgcggcgaug

SEQ ID NO: 810418 - RNA, 14 nt, Mycobacterium avium subsp. paratuberculosis
caucguugccggcg

SEQ ID NO: 810419 - RNA, 18 nt, Mycobacterium avium subsp. paratuberculosis
caucguugccggcggcga

SEQ ID NO: 810420 - RNA, 21 nt, Mycobacterium avium subsp. paratuberculosis
caucgugaucgaaacgccgcg

SEQ ID NO: 810421 - RNA, 20 nt, Mycobacterium avium subsp. paratuberculosis
caucgugaucgcccaccugg

SEQ ID NO: 810422 - RNA, 14 nt, Mycobacterium avium subsp. paratuberculosis
caucguggccgcgu

SEQ ID NO: 810423 - RNA, 16 nt, Mycobacterium avium subsp. paratuberculosis
caucguggcgacgacg

SEQ ID NO: 810424 - RNA, 21 nt, Mycobacterium avium subsp. paratuberculosis
caucguggcgacgacgccgau

SEQ ID NO: 810425 - RNA, 13 nt, Mycobacterium avium subsp. paratuberculosis
caucguggcgcga

SEQ ID NO: 810426 - RNA, 14 nt, Mycobacterium avium subsp. paratuberculosis
caucgugggcgccg

SEQ ID NO: 810427 - RNA, 16 nt, Mycobacterium avium subsp. paratuberculosis
cauccggugccgagcg

SEQ ID NO: 810428 - RNA, 12 nt, Mycobacterium avium subsp. paratuberculosis
cauccguucggc

SEQ ID NO: 810429 - RNA, 14 nt, Mycobacterium avium subsp. paratuberculosis
cauccgggccgccg

SEQ ID NO: 810430 - RNA, 18 nt, Mycobacterium avium subsp. paratuberculosis
cauccgggcggcaucgcg

SEQ ID NO: 810431 - RNA, 14 nt, Mycobacterium avium subsp. paratuberculosis
cauccgggcggcca

SEQ ID NO: 810432 - RNA, 18 nt, Mycobacterium avium subsp. paratuberculosis
cauccgggcggccagccg

SEQ ID NO: 810433 - RNA, 19 nt, Mycobacterium avium subsp. paratuberculosis
cauccgguccagaucggcg

SEQ ID NO: 810434 - RNA, 21 nt, Mycobacterium avium subsp. paratuberculosis
cauccgguccagaucggcgcg

SEQ ID NO: 810435 - RNA, 22 nt, Mycobacterium avium subsp. paratuberculosis
cauccgguccagaucggcgcgc

SEQ ID NO: 810436 - RNA, 14 nt, Mycobacterium avium subsp. paratuberculosis
cauccgggccacca

SEQ ID NO: 810437 - RNA, 15 nt, Mycobacterium avium subsp. paratuberculosis
cauccgggccaccac

SEQ ID NO: 810438 - RNA, 18 nt, Mycobacterium avium subsp. paratuberculosis
cauccgggccaccaccac

SEQ ID NO: 810439 - RNA, 20 nt, Mycobacterium avium subsp. paratuberculosis
cauccgggccaccaccacgg

SEQ ID NO: 810440 - RNA, 15 nt, Mycobacterium avium subsp. paratuberculosis
cauccgcagcaccag

SEQ ID NO: 810441 - RNA, 19 nt, Mycobacterium avium subsp. paratuberculosis
cauccgcagcccgucgauc

SEQ ID NO: 810442 - RNA, 17 nt, Mycobacterium avium subsp. paratuberculosis
cauccgccacccgcugc

SEQ ID NO: 810443 - RNA, 14 nt, Mycobacterium avium subsp. paratuberculosis
cauccgccagaucg

SEQ ID NO: 810444 - RNA, 14 nt, Mycobacterium avium subsp. paratuberculosis
cauccgccgacgau

SEQ ID NO: 810445 - RNA, 15 nt, Mycobacterium avium subsp. paratuberculosis
cauccgcgagccgag

SEQ ID NO: 810446 - RNA, 16 nt, Mycobacterium avium subsp. paratuberculosis
cauccgcgagccgagc

SEQ ID NO: 810447 - RNA, 20 nt, Mycobacterium avium subsp. paratuberculosis
caucgggguuccaccguucg

SEQ ID NO: 810448 - RNA, 22 nt, Mycobacterium avium subsp. paratuberculosis
caucgggguuuugaucagcccg

SEQ ID NO: 810449 - RNA, 16 nt, Mycobacterium avium subsp. paratuberculosis
caucggggugaccguc

SEQ ID NO: 810450 - RNA, 23 nt, Mycobacterium avium subsp. paratuberculosis
caucggggugaccgucacccccg

SEQ ID NO: 810451 - RNA, 20 nt, Mycobacterium avium subsp. paratuberculosis
caucgggcccgacgacgauc

SEQ ID NO: 810452 - RNA, 15 nt, Mycobacterium avium subsp. paratuberculosis
caucggucaccagcu

SEQ ID NO: 810453 - RNA, 21 nt, Mycobacterium avium subsp. paratuberculosis
caucgggcgacaucucgguga

SEQ ID NO: 810454 - RNA, 22 nt, Mycobacterium avium subsp. paratuberculosis
caucgggcgacaucucggugag

SEQ ID NO: 810455 - RNA, 16 nt, Mycobacterium avium subsp. paratuberculosis
caucgggcgcucggcc

SEQ ID NO: 810456 - RNA, 16 nt, Mycobacterium avium subsp. paratuberculosis
caucggcuggucggcg

SEQ ID NO: 810457 - RNA, 19 nt, Mycobacterium avium subsp. paratuberculosis
caucggcuggucggcggcc

SEQ ID NO: 810458 - RNA, 16 nt, Mycobacterium avium subsp. paratuberculosis
caucgggaccgcgggc

SEQ ID NO: 810459 - RNA, 21 nt, Mycobacterium avium subsp. paratuberculosis
ccacguugaucaugucgaugc

SEQ ID NO: 810460 - RNA, 16 nt, Mycobacterium avium subsp. paratuberculosis
ccacguugaugccgcc

SEQ ID NO: 810461 - RNA, 19 nt, Mycobacterium avium subsp. paratuberculosis
ccacguugaugccgcccag

SEQ ID NO: 810462 - RNA, 19 nt, Mycobacterium avium subsp. paratuberculosis
ccacguugccggguaucga

SEQ ID NO: 810463 - RNA, 21 nt, Mycobacterium avium subsp. paratuberculosis
ccacguggugaucagcauccg

SEQ ID NO: 810464 - RNA, 14 nt, Mycobacterium avium subsp. paratuberculosis
ccacguugagcacg

SEQ ID NO: 810465 - RNA, 21 nt, Mycobacterium avium subsp. paratuberculosis
ccacuccaggguucucgcggc

SEQ ID NO: 810466 - RNA, 16 nt, Mycobacterium avium subsp. paratuberculosis
ccacucccagccgccg

SEQ ID NO: 810467 - RNA, 19 nt, Mycobacterium avium subsp. paratuberculosis
ccacucccagccgccggcc

SEQ ID NO: 810468 - RNA, 17 nt, Mycobacterium avium subsp. paratuberculosis
ccacugccgccgcccag

SEQ ID NO: 810469 - RNA, 21 nt, Mycobacterium avium subsp. paratuberculosis
ccacuccaauacggcccggcg

SEQ ID NO: 810470 - RNA, 18 nt, Mycobacterium avium subsp. paratuberculosis
ccacuccaccaccggccg

SEQ ID NO: 810471 - RNA, 21 nt, Mycobacterium avium subsp. paratuberculosis
ccacuccaccaccggccgcgc

SEQ ID NO: 810472 - RNA, 16 nt, Mycobacterium avium subsp. paratuberculosis
ccacuccagcaccgga

SEQ ID NO: 810473 - RNA, 22 nt, Mycobacterium avium subsp. paratuberculosis
ccacgucguucaugaucggcag

SEQ ID NO: 810474 - RNA, 15 nt, Mycobacterium avium subsp. paratuberculosis
ccacgucgucggaca

SEQ ID NO: 810475 - RNA, 14 nt, Mycobacterium avium subsp. paratuberculosis
ccacgucgucggcc

SEQ ID NO: 810476 - RNA, 19 nt, Mycobacterium avium subsp. paratuberculosis
ccacgucgucggccugcac

SEQ ID NO: 810477 - RNA, 21 nt, Mycobacterium avium subsp. paratuberculosis
ccacgucgucggccugcacgu

SEQ ID NO: 810478 - RNA, 23 nt, Mycobacterium avium subsp. paratuberculosis
ccacgugcggcugcgcguucggc

SEQ ID NO: 810479 - RNA, 12 nt, Mycobacterium avium subsp. paratuberculosis
ccacgugcacgg

SEQ ID NO: 810480 - RNA, 15 nt, Mycobacterium avium subsp. paratuberculosis
ccacgugcacggcgc

SEQ ID NO: 810481 - RNA, 16 nt, Mycobacterium avium subsp. paratuberculosis
ccacgugcacggcgcc

SEQ ID NO: 810482 - RNA, 17 nt, Mycobacterium avium subsp. paratuberculosis
ccacgugcacggcgccg

SEQ ID NO: 810483 - RNA, 19 nt, Mycobacterium avium subsp. paratuberculosis
ccacgugcacggcgccgug

SEQ ID NO: 810484 - RNA, 15 nt, Mycobacterium avium subsp. paratuberculosis
ccacgugccacuggc

SEQ ID NO: 810485 - RNA, 22 nt, Mycobacterium avium subsp. paratuberculosis
ccacgugccacuggcgccaccu

SEQ ID NO: 810486 - RNA, 14 nt, Mycobacterium avium subsp. paratuberculosis
ccacgucggugccg

SEQ ID NO: 810487 - RNA, 17 nt, Mycobacterium avium subsp. paratuberculosis
ccacgucggugccgcgu

SEQ ID NO: 810488 - RNA, 11 nt, Mycobacterium avium subsp. paratuberculosis
ccacggcggug

SEQ ID NO: 810489 - RNA, 15 nt, Mycobacterium avium subsp. paratuberculosis
ccacgguggcgccgg

SEQ ID NO: 810490 - RNA, 20 nt, Mycobacterium avium subsp. paratuberculosis
ccacgguggugucgucgggc

SEQ ID NO: 810491 - RNA, 17 nt, Mycobacterium avium subsp. paratuberculosis
ccacggucuuugccggc

SEQ ID NO: 810492 - RNA, 18 nt, Mycobacterium avium subsp. paratuberculosis
ccacggucuuugccggcc

SEQ ID NO: 810493 - RNA, 19 nt, Mycobacterium avium subsp. paratuberculosis
ccacggucuuugccggcca

SEQ ID NO: 810494 - RNA, 13 nt, Mycobacterium avium subsp. paratuberculosis
ccacggugaacgg

SEQ ID NO: 810495 - RNA, 18 nt, Mycobacterium avium subsp. paratuberculosis
ccacggugaacgggccgc

SEQ ID NO: 810496 - RNA, 16 nt, Mycobacterium avium subsp. paratuberculosis
ccacggugaggacacc

SEQ ID NO: 810497 - RNA, 15 nt, Mycobacterium avium subsp. paratuberculosis
ccacggugaucucgc

SEQ ID NO: 810498 - RNA, 18 nt, Mycobacterium avium subsp. paratuberculosis
ccacggugaucucgccga

SEQ ID NO: 810499 - RNA, 20 nt, Mycobacterium avium subsp. paratuberculosis
ccacggugaucucgccgagc

SEQ ID NO: 810500 - RNA, 22 nt, Mycobacterium avium subsp. paratuberculosis
ccacggugaucucgccgagcac

SEQ ID NO: 810501 - RNA, 23 nt, Mycobacterium avium subsp. paratuberculosis
ccacggugauuccggcacccgcc

SEQ ID NO: 810502 - RNA, 12 nt, Mycobacterium avium subsp. paratuberculosis
ccacggugcgca

SEQ ID NO: 810503 - RNA, 17 nt, Mycobacterium avium subsp. paratuberculosis
ccacggugcgcucguga

SEQ ID NO: 810504 - RNA, 21 nt, Mycobacterium avium subsp. paratuberculosis
ccacggugcgcucgugaccgg

SEQ ID NO: 810505 - RNA, 20 nt, Mycobacterium avium subsp. paratuberculosis
ccacgcuagcgugacgcucg

SEQ ID NO: 810506 - RNA, 16 nt, Mycobacterium avium subsp. paratuberculosis
ccacggcgccaugcgc

SEQ ID NO: 810507 - RNA, 18 nt, Mycobacterium avium subsp. paratuberculosis
ccacggcgccaugcgccg

SEQ ID NO: 810508 - RNA, 19 nt, Mycobacterium avium subsp. paratuberculosis
ccacggcgccaugcgccgc

SEQ ID NO: 810509 - RNA, 21 nt, Mycobacterium avium subsp. paratuberculosis
ccacggcgccaugcgccgcgc

SEQ ID NO: 810510 - RNA, 16 nt, Mycobacterium avium subsp. paratuberculosis
ccacggcgcgugcugu

SEQ ID NO: 810511 - RNA, 19 nt, Mycobacterium avium subsp. paratuberculosis
ccacggcggaucaguaccg

SEQ ID NO: 810512 - RNA, 13 nt, Mycobacterium avium subsp. paratuberculosis
ccacggcggcaug

SEQ ID NO: 810513 - RNA, 14 nt, Mycobacterium avium subsp. paratuberculosis
ccacggucagcgcg

SEQ ID NO: 810514 - RNA, 15 nt, Mycobacterium avium subsp. paratuberculosis
ccacggucagcgcgu

SEQ ID NO: 810515 - RNA, 16 nt, Mycobacterium avium subsp. paratuberculosis
ccacggucagcgcguc

SEQ ID NO: 810516 - RNA, 17 nt, Mycobacterium avium subsp. paratuberculosis
ccacggucagcgcgucg

SEQ ID NO: 810517 - RNA, 19 nt, Mycobacterium avium subsp. paratuberculosis
ccacggucaggcgcagcca

SEQ ID NO: 810518 - RNA, 16 nt, Mycobacterium avium subsp. paratuberculosis
ccacggucagggccag

SEQ ID NO: 810519 - RNA, 18 nt, Mycobacterium avium subsp. paratuberculosis
ccacggucagggccagca

SEQ ID NO: 810520 - RNA, 19 nt, Mycobacterium avium subsp. paratuberculosis
ccacggucagggccagcaa

SEQ ID NO: 810521 - RNA, 16 nt, Mycobacterium avium subsp. paratuberculosis
ccacggucaccccgag

SEQ ID NO: 810522 - RNA, 22 nt, Mycobacterium avium subsp. paratuberculosis
ccacggucaccccgaguucggc

SEQ ID NO: 810523 - RNA, 19 nt, Mycobacterium avium subsp. paratuberculosis
ccacgguccccgcgcccgc

SEQ ID NO: 810524 - RNA, 14 nt, Mycobacterium avium subsp. paratuberculosis
ccacgcggcggcgg

SEQ ID NO: 810525 - RNA, 15 nt, Mycobacterium avium subsp. paratuberculosis
ccacgcggcggcggu

SEQ ID NO: 810526 - RNA, 16 nt, Mycobacterium avium subsp. paratuberculosis
ccacgcgcucagcgcg

SEQ ID NO: 810527 - RNA, 18 nt, Mycobacterium avium subsp. paratuberculosis
ccacgcgcucagcgcggc

SEQ ID NO: 810528 - RNA, 19 nt, Mycobacterium avium subsp. paratuberculosis
ccacgcgcucagcgcggcc

SEQ ID NO: 810529 - RNA, 22 nt, Mycobacterium avium subsp. paratuberculosis
ccacgcggauagcccagcgugg

SEQ ID NO: 810530 - RNA, 23 nt, Mycobacterium avium subsp. paratuberculosis
ccacgcggauagcccagcguggu

SEQ ID NO: 810531 - RNA, 16 nt, Mycobacterium avium subsp. paratuberculosis
ccacgcggcgcgcauc

SEQ ID NO: 810532 - RNA, 17 nt, Mycobacterium avium subsp. paratuberculosis
ccacgcggcgcgcaucg

SEQ ID NO: 810533 - RNA, 13 nt, Mycobacterium avium subsp. paratuberculosis
ccacgccuccggc

SEQ ID NO: 810534 - RNA, 18 nt, Mycobacterium avium subsp. paratuberculosis
ccacgccguugggcgcau

SEQ ID NO: 810535 - RNA, 23 nt, Mycobacterium avium subsp. paratuberculosis
ccacgccuggcggaaggccgcgc

SEQ ID NO: 810536 - RNA, 23 nt, Mycobacterium avium subsp. paratuberculosis
ccacgcgcagggcgaacggcgga

SEQ ID NO: 810537 - RNA, 13 nt, Mycobacterium avium subsp. paratuberculosis
ccagacgcgggcg

SEQ ID NO: 810538 - RNA, 17 nt, Mycobacterium avium subsp. paratuberculosis
ccagacgcgggcgccca

SEQ ID NO: 810539 - RNA, 13 nt, Mycobacterium avium subsp. paratuberculosis
ccagauacgccgc

SEQ ID NO: 810540 - RNA, 18 nt, Mycobacterium avium subsp. paratuberculosis
ccagauaggccagcgcgu

SEQ ID NO: 810541 - RNA, 22 nt, Mycobacterium avium subsp. paratuberculosis
ccagauaggccagcgcgugauc

SEQ ID NO: 810542 - RNA, 20 nt, Mycobacterium avium subsp. paratuberculosis
ccagaucgacccccaccgcg

SEQ ID NO: 810543 - RNA, 21 nt, Mycobacterium avium subsp. paratuberculosis
ccagaucgacccccaccgcga

SEQ ID NO: 810544 - RNA, 23 nt, Mycobacterium avium subsp. paratuberculosis
ccagaucgacccccaccgcgaca

SEQ ID NO: 810545 - RNA, 14 nt, Mycobacterium avium subsp. paratuberculosis
ccagaucgacgccg

SEQ ID NO: 810546 - RNA, 15 nt, Mycobacterium avium subsp. paratuberculosis
ccagaucgacgccgc

SEQ ID NO: 810547 - RNA, 16 nt, Mycobacterium avium subsp. paratuberculosis
ccagaucgagcugggc

SEQ ID NO: 810548 - RNA, 19 nt, Mycobacterium avium subsp. paratuberculosis
ccagaucgaggccagcgcg

SEQ ID NO: 810549 - RNA, 18 nt, Mycobacterium avium subsp. paratuberculosis
ccagaucgcccgggcggc

SEQ ID NO: 810550 - RNA, 21 nt, Mycobacterium avium subsp. paratuberculosis
ccagaucgcccgggcggcggg

SEQ ID NO: 810551 - RNA, 13 nt, Mycobacterium avium subsp. paratuberculosis
ccagaucgccgac

SEQ ID NO: 810552 - RNA, 12 nt, Mycobacterium avium subsp. paratuberculosis
ccagaucgccgc

SEQ ID NO: 810553 - RNA, 13 nt, Mycobacterium avium subsp. paratuberculosis
ccagaucggcgcg

SEQ ID NO: 810554 - RNA, 16 nt, Mycobacterium avium subsp. paratuberculosis
ccagaucggccagcca

SEQ ID NO: 810555 - RNA, 21 nt, Mycobacterium avium subsp. paratuberculosis
ccagaucggccagccacgccg

SEQ ID NO: 810556 - RNA, 16 nt, Mycobacterium avium subsp. paratuberculosis
ccagaucggccagcgc

SEQ ID NO: 810557 - RNA, 17 nt, Mycobacterium avium subsp. paratuberculosis
ccagaucggccagcgcg

SEQ ID NO: 810558 - RNA, 19 nt, Mycobacterium avium subsp. paratuberculosis
ccagaucggccagcgcggc

SEQ ID NO: 810559 - RNA, 23 nt, Mycobacterium avium subsp. paratuberculosis
ccagaucggccagcgcggccggg

SEQ ID NO: 810560 - RNA, 14 nt, Mycobacterium avium subsp. paratuberculosis
ccagaucgucgggc

SEQ ID NO: 810561 - RNA, 15 nt, Mycobacterium avium subsp. paratuberculosis
ccagaugcaccucgc

SEQ ID NO: 810562 - RNA, 19 nt, Mycobacterium avium subsp. paratuberculosis
ccagaucguguccgcgccg

SEQ ID NO: 810563 - RNA, 20 nt, Mycobacterium avium subsp. paratuberculosis
ccagaucguguccgcgccgg

SEQ ID NO: 810564 - RNA, 21 nt, Mycobacterium avium subsp. paratuberculosis
ccagaugcgcgacggccucgc

SEQ ID NO: 810565 - RNA, 16 nt, Mycobacterium avium subsp. paratuberculosis
ccagaugcccagcggc

SEQ ID NO: 810566 - RNA, 20 nt, Mycobacterium avium subsp. paratuberculosis
ccagaugcccagcggcaugg

SEQ ID NO: 810567 - RNA, 16 nt, Mycobacterium avium subsp. paratuberculosis
ccagaugccgccgcca

SEQ ID NO: 810568 - RNA, 23 nt, Mycobacterium avium subsp. paratuberculosis
ccagaugccgccgccagcgcggg

SEQ ID NO: 810569 - RNA, 16 nt, Mycobacterium avium subsp. paratuberculosis
ccagaugccgcucggc

SEQ ID NO: 810570 - RNA, 13 nt, Mycobacterium avium subsp. paratuberculosis
ccagaugccggcg

SEQ ID NO: 810571 - RNA, 12 nt, Mycobacterium avium subsp. paratuberculosis
ccagaugccggg

SEQ ID NO: 810572 - RNA, 13 nt, Mycobacterium avium subsp. paratuberculosis
ccagaugccgggu

SEQ ID NO: 810573 - RNA, 16 nt, Mycobacterium avium subsp. paratuberculosis
ccacugcggcagaccg

SEQ ID NO: 810574 - RNA, 15 nt, Mycobacterium avium subsp. paratuberculosis
ccacugcgccgucau

SEQ ID NO: 810575 - RNA, 22 nt, Mycobacterium avium subsp. paratuberculosis
ccacugcgccgucaucgacacc

SEQ ID NO: 810576 - RNA, 16 nt, Mycobacterium avium subsp. paratuberculosis
ccacuggcggccggcc

SEQ ID NO: 810577 - RNA, 20 nt, Mycobacterium avium subsp. paratuberculosis
ccacuggcggccggccgcgc

SEQ ID NO: 810578 - RNA, 16 nt, Mycobacterium avium subsp. paratuberculosis
ccacugguaaccgccc

SEQ ID NO: 810579 - RNA, 19 nt, Mycobacterium avium subsp. paratuberculosis
ccacugguaaccgcccgag

SEQ ID NO: 810580 - RNA, 20 nt, Mycobacterium avium subsp. paratuberculosis
ccacuggucguugcacaccc

SEQ ID NO: 810581 - RNA, 15 nt, Mycobacterium avium subsp. paratuberculosis
ccagacaggccggcc

SEQ ID NO: 810582 - RNA, 15 nt, Mycobacterium avium subsp. paratuberculosis
ccagacccagcaucg

SEQ ID NO: 810583 - RNA, 18 nt, Mycobacterium avium subsp. paratuberculosis
ccagacccagcaucgccg

SEQ ID NO: 810584 - RNA, 13 nt, Mycobacterium avium subsp. paratuberculosis
ccagaccggcggc

SEQ ID NO: 810585 - RNA, 13 nt, Mycobacterium avium subsp. paratuberculosis
ccagaccggccgg

SEQ ID NO: 810586 - RNA, 14 nt, Mycobacterium avium subsp. paratuberculosis
ccagaccggccggg

SEQ ID NO: 810587 - RNA, 16 nt, Mycobacterium avium subsp. paratuberculosis
ccagaccggccggggc

SEQ ID NO: 810588 - RNA, 14 nt, Mycobacterium avium subsp. paratuberculosis
ccagaccggcggcg

SEQ ID NO: 810589 - RNA, 15 nt, Mycobacterium avium subsp. paratuberculosis
ccagaccggcggcga

SEQ ID NO: 810590 - RNA, 17 nt, Mycobacterium avium subsp. paratuberculosis
ccagaccggcggcgauc

SEQ ID NO: 810591 - RNA, 20 nt, Mycobacterium avium subsp. paratuberculosis
ccagaccgaagaucaccgcg

SEQ ID NO: 810592 - RNA, 21 nt, Mycobacterium avium subsp. paratuberculosis
ccagaccgaagaucaccgcga

SEQ ID NO: 810593 - RNA, 16 nt, Mycobacterium avium subsp. paratuberculosis
ccagacgaacgcggcc

SEQ ID NO: 810594 - RNA, 17 nt, Mycobacterium avium subsp. paratuberculosis
ccagacgaacgcggccg

SEQ ID NO: 810595 - RNA, 18 nt, Mycobacterium avium subsp. paratuberculosis
ccagacgaacgcggccgc

SEQ ID NO: 810596 - RNA, 20 nt, Mycobacterium avium subsp. paratuberculosis
ccagacgaacgcggccgcca

SEQ ID NO: 810597 - RNA, 23 nt, Mycobacterium avium subsp. paratuberculosis
ccagaccgguugcggcgaacgcg

SEQ ID NO: 810598 - RNA, 19 nt, Mycobacterium avium subsp. paratuberculosis
ccagacgauuugggcgguc

SEQ ID NO: 810599 - RNA, 21 nt, Mycobacterium avium subsp. paratuberculosis
ccagacgauuugggcgguccg

SEQ ID NO: 810600 - RNA, 14 nt, Mycobacterium avium subsp. paratuberculosis
ccagacgcgcaccg

SEQ ID NO: 810601 - RNA, 19 nt, Mycobacterium avium subsp. paratuberculosis
ccagacgcgcaccgccacc

SEQ ID NO: 810602 - RNA, 15 nt, Mycobacterium avium subsp. paratuberculosis
ccacgcagucgucga

SEQ ID NO: 810603 - RNA, 15 nt, Mycobacterium avium subsp. paratuberculosis
ccacgcagccgucga

SEQ ID NO: 810604 - RNA, 20 nt, Mycobacterium avium subsp. paratuberculosis
ccacgcagcggugcagcccc

SEQ ID NO: 810605 - RNA, 21 nt, Mycobacterium avium subsp. paratuberculosis
ccacgcagcggugcagccccg

SEQ ID NO: 810606 - RNA, 12 nt, Mycobacterium avium subsp. paratuberculosis
ccacgccagcca

SEQ ID NO: 810607 - RNA, 17 nt, Mycobacterium avium subsp. paratuberculosis
ccacgccaugugccggc

SEQ ID NO: 810608 - RNA, 20 nt, Mycobacterium avium subsp. paratuberculosis
ccacgccaugugccggcgcu

SEQ ID NO: 810609 - RNA, 13 nt, Mycobacterium avium subsp. paratuberculosis
ccacgccagccgg

SEQ ID NO: 810610 - RNA, 15 nt, Mycobacterium avium subsp. paratuberculosis
ccacgcccagcgccc

SEQ ID NO: 810611 - RNA, 18 nt, Mycobacterium avium subsp. paratuberculosis
ccacgcccaccgguggcc

SEQ ID NO: 810612 - RNA, 24 nt, Mycobacterium avium subsp. paratuberculosis
ccacgcccgacgacgacgucgacg

SEQ ID NO: 810613 - RNA, 22 nt, Mycobacterium avium subsp. paratuberculosis
ccacgccccauugccgcgccgg

SEQ ID NO: 810614 - RNA, 15 nt, Mycobacterium avium subsp. paratuberculosis
ccacgccccggcgcc

SEQ ID NO: 810615 - RNA, 16 nt, Mycobacterium avium subsp. paratuberculosis
ccacgccccggcgccg

SEQ ID NO: 810616 - RNA, 16 nt, Mycobacterium avium subsp. paratuberculosis
ccacgcccuggccgcc

SEQ ID NO: 810617 - RNA, 17 nt, Mycobacterium avium subsp. paratuberculosis
ccacgcccuggccgccg

SEQ ID NO: 810618 - RNA, 20 nt, Mycobacterium avium subsp. paratuberculosis
ccacgcccuggccgccggcc

SEQ ID NO: 810619 - RNA, 18 nt, Mycobacterium avium subsp. paratuberculosis
ccacgcccuagcgggcca

SEQ ID NO: 810620 - RNA, 16 nt, Mycobacterium avium subsp. paratuberculosis
ccacgcccgcagcgca

SEQ ID NO: 810621 - RNA, 18 nt, Mycobacterium avium subsp. paratuberculosis
ccacgcccgcagcgcauc

SEQ ID NO: 810622 - RNA, 12 nt, Mycobacterium avium subsp. paratuberculosis
ccacgcccggac

SEQ ID NO: 810623 - RNA, 19 nt, Mycobacterium avium subsp. paratuberculosis
ccacgccgggcauccgccc

SEQ ID NO: 810624 - RNA, 14 nt, Mycobacterium avium subsp. paratuberculosis
ccacgccggugacc

SEQ ID NO: 810625 - RNA, 13 nt, Mycobacterium avium subsp. paratuberculosis
ccacgccgucgac

SEQ ID NO: 810626 - RNA, 17 nt, Mycobacterium avium subsp. paratuberculosis
ccacgccgucgacgauc

SEQ ID NO: 810627 - RNA, 12 nt, Mycobacterium avium subsp. paratuberculosis
ccacgccggcga

SEQ ID NO: 810628 - RNA, 13 nt, Mycobacterium avium subsp. paratuberculosis
ccacgccggcaca

SEQ ID NO: 810629 - RNA, 18 nt, Mycobacterium avium subsp. paratuberculosis
ccacgccgcgauccgggc

SEQ ID NO: 810630 - RNA, 21 nt, Mycobacterium avium subsp. paratuberculosis
ccacgccgcgcuugacggccg

SEQ ID NO: 810631 - RNA, 13 nt, Mycobacterium avium subsp. paratuberculosis
ccacgccgcggga

SEQ ID NO: 810632 - RNA, 15 nt, Mycobacterium avium subsp. paratuberculosis
ccacgccgcggucgc

SEQ ID NO: 810633 - RNA, 12 nt, Mycobacterium avium subsp. paratuberculosis
ccacgccgccgg

SEQ ID NO: 810634 - RNA, 13 nt, Mycobacterium avium subsp. paratuberculosis
ccacgccgcccag

SEQ ID NO: 810635 - RNA, 20 nt, Mycobacterium avium subsp. paratuberculosis
ccacgccgagggcggcggcu

SEQ ID NO: 810636 - RNA, 18 nt, Mycobacterium avium subsp. paratuberculosis
ccacgccgagggugccgg

SEQ ID NO: 810637 - RNA, 14 nt, Mycobacterium avium subsp. paratuberculosis
ccacgccgaccagg

SEQ ID NO: 810638 - RNA, 17 nt, Mycobacterium avium subsp. paratuberculosis
ccacgccgacuagcgcg

SEQ ID NO: 810639 - RNA, 21 nt, Mycobacterium avium subsp. paratuberculosis
ccacgccgacuagcgcggcgg

SEQ ID NO: 810640 - RNA, 23 nt, Mycobacterium avium subsp. paratuberculosis
ccacgccgacuagcgcggcggcc

SEQ ID NO: 810641 - RNA, 14 nt, Mycobacterium avium subsp. paratuberculosis
ccacgccgagcacc

SEQ ID NO: 810642 - RNA, 15 nt, Mycobacterium avium subsp. paratuberculosis
ccacgaucaccacca

SEQ ID NO: 810643 - RNA, 15 nt, Mycobacterium avium subsp. paratuberculosis
ccacgaucacgucgg

SEQ ID NO: 810644 - RNA, 13 nt, Mycobacterium avium subsp. paratuberculosis
ccacgaucagcgc

SEQ ID NO: 810645 - RNA, 18 nt, Mycobacterium avium subsp. paratuberculosis
ccacgaucagcgcgucga

SEQ ID NO: 810646 - RNA, 20 nt, Mycobacterium avium subsp. paratuberculosis
ccacgaucgcgaucgccgau

SEQ ID NO: 810647 - RNA, 21 nt, Mycobacterium avium subsp. paratuberculosis
ccacgaucgcgaucgccgauc

SEQ ID NO: 810648 - RNA, 20 nt, Mycobacterium avium subsp. paratuberculosis
ccacgaucgcggccagcgug

SEQ ID NO: 810649 - RNA, 18 nt, Mycobacterium avium subsp. paratuberculosis
ccacgauuccucggaccg

SEQ ID NO: 810650 - RNA, 19 nt, Mycobacterium avium subsp. paratuberculosis
ccacgauuccucggaccgg

SEQ ID NO: 810651 - RNA, 18 nt, Mycobacterium avium subsp. paratuberculosis
ccacgaugcggugccggg

SEQ ID NO: 810652 - RNA, 22 nt, Mycobacterium avium subsp. paratuberculosis
ccacgaugcugauacccgcgcg

SEQ ID NO: 810653 - RNA, 21 nt, Mycobacterium avium subsp. paratuberculosis
ccacgaugaagccgugcccgc

SEQ ID NO: 810654 - RNA, 19 nt, Mycobacterium avium subsp. paratuberculosis
ccacgaugacggugguggc

SEQ ID NO: 810655 - RNA, 19 nt, Mycobacterium avium subsp. paratuberculosis
ccacgaugaucgucggcag

SEQ ID NO: 810656 - RNA, 23 nt, Mycobacterium avium subsp. paratuberculosis
ccacgaugaucgucggcagcgac

SEQ ID NO: 810657 - RNA, 13 nt, Mycobacterium avium subsp. paratuberculosis
ccacgcacaccac

SEQ ID NO: 810658 - RNA, 15 nt, Mycobacterium avium subsp. paratuberculosis
ccacgcacaccaccg

SEQ ID NO: 810659 - RNA, 20 nt, Mycobacterium avium subsp. paratuberculosis
ccacgcacaccaccgacgcg

SEQ ID NO: 810660 - RNA, 22 nt, Mycobacterium avium subsp. paratuberculosis
ccacgcacaccaccgacgcguc

SEQ ID NO: 810661 - RNA, 16 nt, Mycobacterium avium subsp. paratuberculosis
ccacgcacaccgcgcg

SEQ ID NO: 810662 - RNA, 23 nt, Mycobacterium avium subsp. paratuberculosis
ccacgcagaucuugugccagccg

SEQ ID NO: 810663 - RNA, 13 nt, Mycobacterium avium subsp. paratuberculosis
ccacgaugcccgu

SEQ ID NO: 810664 - RNA, 17 nt, Mycobacterium avium subsp. paratuberculosis
ccacgaucaccagaccg

SEQ ID NO: 810665 - RNA, 18 nt, Mycobacterium avium subsp. paratuberculosis
ccacgaucaccagaccgg

SEQ ID NO: 810666 - RNA, 13 nt, Mycobacterium avium subsp. paratuberculosis
ccacgauccgcgc

SEQ ID NO: 810667 - RNA, 14 nt, Mycobacterium avium subsp. paratuberculosis
ccacgauccgcgcg

SEQ ID NO: 810668 - RNA, 16 nt, Mycobacterium avium subsp. paratuberculosis
ccacgauccgcgcggc

SEQ ID NO: 810669 - RNA, 17 nt, Mycobacterium avium subsp. paratuberculosis
ccacgauccgcgcggcc

SEQ ID NO: 810670 - RNA, 18 nt, Mycobacterium avium subsp. paratuberculosis
ccacgauccgcgcggcca

SEQ ID NO: 810671 - RNA, 21 nt, Mycobacterium avium subsp. paratuberculosis
ccacgauccgcgcggccacca

SEQ ID NO: 810672 - RNA, 18 nt, Mycobacterium avium subsp. paratuberculosis
ccacgauccggggcagca

SEQ ID NO: 810673 - RNA, 16 nt, Mycobacterium avium subsp. paratuberculosis
ccacgacugcgcggcc

SEQ ID NO: 810674 - RNA, 17 nt, Mycobacterium avium subsp. paratuberculosis
ccacgacugcgcggccg

SEQ ID NO: 810675 - RNA, 18 nt, Mycobacterium avium subsp. paratuberculosis
ccacgacugcgcggccgg

SEQ ID NO: 810676 - RNA, 19 nt, Mycobacterium avium subsp. paratuberculosis
ccacgacugcgcggccggc

SEQ ID NO: 810677 - RNA, 18 nt, Mycobacterium avium subsp. paratuberculosis
ccacgacguccucgacga

SEQ ID NO: 810678 - RNA, 19 nt, Mycobacterium avium subsp. paratuberculosis
ccacgacguccucgacgau

SEQ ID NO: 810679 - RNA, 20 nt, Mycobacterium avium subsp. paratuberculosis
ccacgacgucgagccagcgg

SEQ ID NO: 810680 - RNA, 21 nt, Mycobacterium avium subsp. paratuberculosis
ccacgacgucugggccgccga

SEQ ID NO: 810681 - RNA, 15 nt, Mycobacterium avium subsp. paratuberculosis
ccacgacgccgggcg

SEQ ID NO: 810682 - RNA, 11 nt, Mycobacterium avium subsp. paratuberculosis
ccacgacgcgg

SEQ ID NO: 810683 - RNA, 12 nt, Mycobacterium avium subsp. paratuberculosis
ccacgacgcggc

SEQ ID NO: 810684 - RNA, 14 nt, Mycobacterium avium subsp. paratuberculosis
ccacgacgcggcga

SEQ ID NO: 810685 - RNA, 15 nt, Mycobacterium avium subsp. paratuberculosis
ccacgacgcggcgau

SEQ ID NO: 810686 - RNA, 14 nt, Mycobacterium avium subsp. paratuberculosis
ccacgacgcggcgc

SEQ ID NO: 810687 - RNA, 15 nt, Mycobacterium avium subsp. paratuberculosis
ccacgacgcggcgcg

SEQ ID NO: 810688 - RNA, 16 nt, Mycobacterium avium subsp. paratuberculosis
ccacgacgcggcgcgc

SEQ ID NO: 810689 - RNA, 18 nt, Mycobacterium avium subsp. paratuberculosis
ccacgacgcggcgcgcga

SEQ ID NO: 810690 - RNA, 14 nt, Mycobacterium avium subsp. paratuberculosis
ccacgacggggaac

SEQ ID NO: 810691 - RNA, 17 nt, Mycobacterium avium subsp. paratuberculosis
ccaccaugggcgggacg

SEQ ID NO: 810692 - RNA, 17 nt, Mycobacterium avium subsp. paratuberculosis
ccaccaucuccgcggcg

SEQ ID NO: 810693 - RNA, 17 nt, Mycobacterium avium subsp. paratuberculosis
ccaccaugagcagaccg

SEQ ID NO: 810694 - RNA, 22 nt, Mycobacterium avium subsp. paratuberculosis
ccaccaugauguagcggcgguc

SEQ ID NO: 810695 - RNA, 12 nt, Mycobacterium avium subsp. paratuberculosis
ccaccaucccgc

SEQ ID NO: 810696 - RNA, 14 nt, Mycobacterium avium subsp. paratuberculosis
ccaccaucccgccg

SEQ ID NO: 810697 - RNA, 16 nt, Mycobacterium avium subsp. paratuberculosis
ccaccaucccgccgcc

SEQ ID NO: 810698 - RNA, 19 nt, Mycobacterium avium subsp. paratuberculosis
ccaccaucccgccgccgaa

SEQ ID NO: 810699 - RNA, 17 nt, Mycobacterium avium subsp. paratuberculosis
ccaccgucgucgagcgc

SEQ ID NO: 810700 - RNA, 20 nt, Mycobacterium avium subsp. paratuberculosis
ccaccgucgucgagcgcucg

SEQ ID NO: 810701 - RNA, 15 nt, Mycobacterium avium subsp. paratuberculosis
ccaccgucagcguca

SEQ ID NO: 810702 - RNA, 17 nt, Mycobacterium avium subsp. paratuberculosis
ccaccgucagcgucagc

SEQ ID NO: 810703 - RNA, 15 nt, Mycobacterium avium subsp. paratuberculosis
ccaccgucagggugg

SEQ ID NO: 810704 - RNA, 14 nt, Mycobacterium avium subsp. paratuberculosis
ccaccgucgaugga

SEQ ID NO: 810705 - RNA, 15 nt, Mycobacterium avium subsp. paratuberculosis
ccaccgucgccacga

SEQ ID NO: 810706 - RNA, 16 nt, Mycobacterium avium subsp. paratuberculosis
ccaccgucgccacgau

SEQ ID NO: 810707 - RNA, 17 nt, Mycobacterium avium subsp. paratuberculosis
ccaccgucgccggcuga

SEQ ID NO: 810708 - RNA, 21 nt, Mycobacterium avium subsp. paratuberculosis
ccaccgucuuggucucgccga

SEQ ID NO: 810709 - RNA, 12 nt, Mycobacterium avium subsp. paratuberculosis
ccaccgugacgu

SEQ ID NO: 810710 - RNA, 19 nt, Mycobacterium avium subsp. paratuberculosis
ccaccguguucaccagcgg

SEQ ID NO: 810711 - RNA, 23 nt, Mycobacterium avium subsp. paratuberculosis
ccaccguguucaccagcggggug

SEQ ID NO: 810712 - RNA, 17 nt, Mycobacterium avium subsp. paratuberculosis
ccaccguugucucggcg

SEQ ID NO: 810713 - RNA, 20 nt, Mycobacterium avium subsp. paratuberculosis
ccaccguugucucggcgccg

SEQ ID NO: 810714 - RNA, 21 nt, Mycobacterium avium subsp. paratuberculosis
ccaccguugucucggcgccgu

SEQ ID NO: 810715 - RNA, 22 nt, Mycobacterium avium subsp. paratuberculosis
ccaccguugucucggcgccguc

SEQ ID NO: 810716 - RNA, 23 nt, Mycobacterium avium subsp. paratuberculosis
ccaccguugucucggcgccgucg

SEQ ID NO: 810717 - RNA, 21 nt, Mycobacterium avium subsp. paratuberculosis
ccaccguggucggcagcaccg

SEQ ID NO: 810718 - RNA, 14 nt, Mycobacterium avium subsp. paratuberculosis
ccaccgugccgucg

SEQ ID NO: 810719 - RNA, 15 nt, Mycobacterium avium subsp. paratuberculosis
ccaccgugccgucgc

SEQ ID NO: 810720 - RNA, 20 nt, Mycobacterium avium subsp. paratuberculosis
ccaccgugccgucgcgggcg

SEQ ID NO: 810721 - RNA, 20 nt, Mycobacterium avium subsp. paratuberculosis
ccaccgugccuuacgccggg

SEQ ID NO: 810722 - RNA, 14 nt, Mycobacterium avium subsp. paratuberculosis
ccaccuccagcccg

SEQ ID NO: 810723 - RNA, 23 nt, Mycobacterium avium subsp. paratuberculosis
ccaccuccucgcgggcgaucucc

SEQ ID NO: 810724 - RNA, 17 nt, Mycobacterium avium subsp. paratuberculosis
ccaccucgacggcgugg

SEQ ID NO: 810725 - RNA, 14 nt, Mycobacterium avium subsp. paratuberculosis
ccaccucgagcaac

SEQ ID NO: 810726 - RNA, 22 nt, Mycobacterium avium subsp. paratuberculosis
ccaccucgagcacgcccugcgg

SEQ ID NO: 810727 - RNA, 18 nt, Mycobacterium avium subsp. paratuberculosis
ccaccucgaucagcggca

SEQ ID NO: 810728 - RNA, 13 nt, Mycobacterium avium subsp. paratuberculosis
ccaccucgccgca

SEQ ID NO: 810729 - RNA, 14 nt, Mycobacterium avium subsp. paratuberculosis
ccaccucgccgcag

SEQ ID NO: 810730 - RNA, 13 nt, Mycobacterium avium subsp. paratuberculosis
ccaccucgcgcgg

SEQ ID NO: 810731 - RNA, 14 nt, Mycobacterium avium subsp. paratuberculosis
ccaccucgcgcggg

SEQ ID NO: 810732 - RNA, 21 nt, Mycobacterium avium subsp. paratuberculosis
ccaccucgcgcggggcggccg

SEQ ID NO: 810733 - RNA, 13 nt, Mycobacterium avium subsp. paratuberculosis
ccaccucgcgggc

SEQ ID NO: 810734 - RNA, 17 nt, Mycobacterium avium subsp. paratuberculosis
ccaccucgggccgggcg

SEQ ID NO: 810735 - RNA, 18 nt, Mycobacterium avium subsp. paratuberculosis
ccaccucgggccgggcgg

SEQ ID NO: 810736 - RNA, 19 nt, Mycobacterium avium subsp. paratuberculosis
ccaccucgguggacgccgc

SEQ ID NO: 810737 - RNA, 20 nt, Mycobacterium avium subsp. paratuberculosis
ccaccucgguggacgccgcg

SEQ ID NO: 810738 - RNA, 22 nt, Mycobacterium avium subsp. paratuberculosis
ccaccucgguggacgccgcgca

SEQ ID NO: 810739 - RNA, 12 nt, Mycobacterium avium subsp. paratuberculosis
ccaccucgucgg

SEQ ID NO: 810740 - RNA, 15 nt, Mycobacterium avium subsp. paratuberculosis
ccaccucgucggcgg

SEQ ID NO: 810741 - RNA, 17 nt, Mycobacterium avium subsp. paratuberculosis
ccaccucgucggcgguc

SEQ ID NO: 810742 - RNA, 13 nt, Mycobacterium avium subsp. paratuberculosis
ccaccuggaagcg

SEQ ID NO: 810743 - RNA, 19 nt, Mycobacterium avium subsp. paratuberculosis
ccaccuggaagcgcaucgc

SEQ ID NO: 810744 - RNA, 21 nt, Mycobacterium avium subsp. paratuberculosis
ccaccuggaggccaacgagcg

SEQ ID NO: 810745 - RNA, 23 nt, Mycobacterium avium subsp. paratuberculosis
ccaccuggaggccaacgagcgcg

SEQ ID NO: 810746 - RNA, 15 nt, Mycobacterium avium subsp. paratuberculosis
ccaccugggcggggc

SEQ ID NO: 810747 - RNA, 17 nt, Mycobacterium avium subsp. paratuberculosis
ccaccugggcggggcug

SEQ ID NO: 810748 - RNA, 18 nt, Mycobacterium avium subsp. paratuberculosis
ccaccugggcgucgucgg

SEQ ID NO: 810749 - RNA, 20 nt, Mycobacterium avium subsp. paratuberculosis
ccaccugggcgucgucggcc

SEQ ID NO: 810750 - RNA, 19 nt, Mycobacterium avium subsp. paratuberculosis
ccaccugccgcaacgggcc

SEQ ID NO: 810751 - RNA, 13 nt, Mycobacterium avium subsp. paratuberculosis
ccaccugcggcac

SEQ ID NO: 810752 - RNA, 20 nt, Mycobacterium avium subsp. paratuberculosis
ccaccugcaccugggugauc

SEQ ID NO: 810753 - RNA, 15 nt, Mycobacterium avium subsp. paratuberculosis
ccaccugcacgggga

SEQ ID NO: 810754 - RNA, 20 nt, Mycobacterium avium subsp. paratuberculosis
ccaccugcacggggacgucg

SEQ ID NO: 810755 - RNA, 16 nt, Mycobacterium avium subsp. paratuberculosis
ccaccucuucgcgguc

SEQ ID NO: 810756 - RNA, 13 nt, Mycobacterium avium subsp. paratuberculosis
ccaccugaccgcg

SEQ ID NO: 810757 - RNA, 16 nt, Mycobacterium avium subsp. paratuberculosis
ccaccugaucgcggcg

SEQ ID NO: 810758 - RNA, 18 nt, Mycobacterium avium subsp. paratuberculosis
ccaccugaucgcggcgag

SEQ ID NO: 810759 - RNA, 13 nt, Mycobacterium avium subsp. paratuberculosis
ccaccuggccggc

SEQ ID NO: 810760 - RNA, 20 nt, Mycobacterium avium subsp. paratuberculosis
ccaccugguucucccgucgc

SEQ ID NO: 810761 - RNA, 19 nt, Mycobacterium avium subsp. paratuberculosis
ccaccugguuggcccgcac

SEQ ID NO: 810762 - RNA, 13 nt, Mycobacterium avium subsp. paratuberculosis
ccaccuucaccgc

SEQ ID NO: 810763 - RNA, 15 nt, Mycobacterium avium subsp. paratuberculosis
ccaccuucaccgcgc

SEQ ID NO: 810764 - RNA, 16 nt, Mycobacterium avium subsp. paratuberculosis
ccaccuucaccgcgcc

SEQ ID NO: 810765 - RNA, 19 nt, Mycobacterium avium subsp. paratuberculosis
ccaccuucaccgcgccggu

SEQ ID NO: 810766 - RNA, 22 nt, Mycobacterium avium subsp. paratuberculosis
ccaccuucaccgcgccgguccg

SEQ ID NO: 810767 - RNA, 15 nt, Mycobacterium avium subsp. paratuberculosis
ccaccuucaucgccg

SEQ ID NO: 810768 - RNA, 19 nt, Mycobacterium avium subsp. paratuberculosis
ccaccuucaucgccgucgc

SEQ ID NO: 810769 - RNA, 20 nt, Mycobacterium avium subsp. paratuberculosis
ccaccuucccaaccccgggc

SEQ ID NO: 810770 - RNA, 21 nt, Mycobacterium avium subsp. paratuberculosis
ccaccuucccaaccccgggcg

SEQ ID NO: 810771 - RNA, 17 nt, Mycobacterium avium subsp. paratuberculosis
ccacgaacaccggcgcg

SEQ ID NO: 810772 - RNA, 14 nt, Mycobacterium avium subsp. paratuberculosis
ccacgaaccaggcg

SEQ ID NO: 810773 - RNA, 15 nt, Mycobacterium avium subsp. paratuberculosis
ccacgaaccaggcgc

SEQ ID NO: 810774 - RNA, 16 nt, Mycobacterium avium subsp. paratuberculosis
ccacgaaccaggcgcc

SEQ ID NO: 810775 - RNA, 17 nt, Mycobacterium avium subsp. paratuberculosis
ccacgaacgcgccgccg

SEQ ID NO: 810776 - RNA, 22 nt, Mycobacterium avium subsp. paratuberculosis
ccacgaacggguccuugccggc

SEQ ID NO: 810777 - RNA, 13 nt, Mycobacterium avium subsp. paratuberculosis
ccacgaacgucag

SEQ ID NO: 810778 - RNA, 20 nt, Mycobacterium avium subsp. paratuberculosis
ccacgaacucccccgcccgg

SEQ ID NO: 810779 - RNA, 19 nt, Mycobacterium avium subsp. paratuberculosis
ccacgaagaugaucagcgc

SEQ ID NO: 810780 - RNA, 23 nt, Mycobacterium avium subsp. paratuberculosis
ccacgaagaugaucagcgcgccc

SEQ ID NO: 810781 - RNA, 14 nt, Mycobacterium avium subsp. paratuberculosis
ccaccuugcgcggg

SEQ ID NO: 810782 - RNA, 17 nt, Mycobacterium avium subsp. paratuberculosis
ccaccuugcgcgggucg

SEQ ID NO: 810783 - RNA, 20 nt, Mycobacterium avium subsp. paratuberculosis
ccaccuugcgcgggucgccg

SEQ ID NO: 810784 - RNA, 22 nt, Mycobacterium avium subsp. paratuberculosis
ccaccuuggacaggcccagcgg

SEQ ID NO: 810785 - RNA, 15 nt, Mycobacterium avium subsp. paratuberculosis
ccaccuuggccggug

SEQ ID NO: 810786 - RNA, 23 nt, Mycobacterium avium subsp. paratuberculosis
ccaccuuggcgucgaucagcgcg

SEQ ID NO: 810787 - RNA, 15 nt, Mycobacterium avium subsp. paratuberculosis
ccaccuugguggccg

SEQ ID NO: 810788 - RNA, 17 nt, Mycobacterium avium subsp. paratuberculosis
ccaccuugguggccgcg

SEQ ID NO: 810789 - RNA, 19 nt, Mycobacterium avium subsp. paratuberculosis
ccaccuugguggccgcggc

SEQ ID NO: 810790 - RNA, 21 nt, Mycobacterium avium subsp. paratuberculosis
ccaccuugguggccgcggccg

SEQ ID NO: 810791 - RNA, 16 nt, Mycobacterium avium subsp. paratuberculosis
ccaccuugucggcgcc

SEQ ID NO: 810792 - RNA, 13 nt, Mycobacterium avium subsp. paratuberculosis
ccacgaaacccau

SEQ ID NO: 810793 - RNA, 19 nt, Mycobacterium avium subsp. paratuberculosis
ccacgaagggcgccagcac

SEQ ID NO: 810794 - RNA, 21 nt, Mycobacterium avium subsp. paratuberculosis
ccacgaagggcgccagcaccu

SEQ ID NO: 810795 - RNA, 14 nt, Mycobacterium avium subsp. paratuberculosis
ccacgaagcgggcg

SEQ ID NO: 810796 - RNA, 16 nt, Mycobacterium avium subsp. paratuberculosis
ccacgaagcgggcggc

SEQ ID NO: 810797 - RNA, 21 nt, Mycobacterium avium subsp. paratuberculosis
ccacgaaccgguugcgggccg

SEQ ID NO: 810798 - RNA, 16 nt, Mycobacterium avium subsp. paratuberculosis
ccacgaccuggcgggc

SEQ ID NO: 810799 - RNA, 21 nt, Mycobacterium avium subsp. paratuberculosis
ccacgaccuggcgggccagcu

SEQ ID NO: 810800 - RNA, 16 nt, Mycobacterium avium subsp. paratuberculosis
ccacgaccccggcggc

SEQ ID NO: 810801 - RNA, 20 nt, Mycobacterium avium subsp. paratuberculosis
ccacgaccccggcggcaccg

SEQ ID NO: 810802 - RNA, 18 nt, Mycobacterium avium subsp. paratuberculosis
ccacgaccagcggcagca

SEQ ID NO: 810803 - RNA, 14 nt, Mycobacterium avium subsp. paratuberculosis
ccacgaccagugcc

SEQ ID NO: 810804 - RNA, 13 nt, Mycobacterium avium subsp. paratuberculosis
ccacgacaccagc

SEQ ID NO: 810805 - RNA, 17 nt, Mycobacterium avium subsp. paratuberculosis
ccacgacaccagcgucg

SEQ ID NO: 810806 - RNA, 23 nt, Mycobacterium avium subsp. paratuberculosis
ccaccugcgguucgucgcggcgg

SEQ ID NO: 810807 - RNA, 22 nt, Mycobacterium avium subsp. paratuberculosis
ccagcccccgcgggucgucgac

SEQ ID NO: 810808 - RNA, 15 nt, Mycobacterium avium subsp. paratuberculosis
ccagccccgggaacc

SEQ ID NO: 810809 - RNA, 14 nt, Mycobacterium avium subsp. paratuberculosis
ccagccccagcacg

SEQ ID NO: 810810 - RNA, 15 nt, Mycobacterium avium subsp. paratuberculosis
ccagcccauguccag

SEQ ID NO: 810811 - RNA, 16 nt, Mycobacterium avium subsp. paratuberculosis
ccagccccaccggcca

SEQ ID NO: 810812 - RNA, 18 nt, Mycobacterium avium subsp. paratuberculosis
ccagcccaggucgggacg

SEQ ID NO: 810813 - RNA, 14 nt, Mycobacterium avium subsp. paratuberculosis
ccagcccgagcacc

SEQ ID NO: 810814 - RNA, 19 nt, Mycobacterium avium subsp. paratuberculosis
ccagcccgagcaccagcgg

SEQ ID NO: 810815 - RNA, 22 nt, Mycobacterium avium subsp. paratuberculosis
ccagccccucgccgggcgucac

SEQ ID NO: 810816 - RNA, 19 nt, Mycobacterium avium subsp. paratuberculosis
ccagcccgaaaguccccgg

SEQ ID NO: 810817 - RNA, 13 nt, Mycobacterium avium subsp. paratuberculosis
ccagcccggccag

SEQ ID NO: 810818 - RNA, 14 nt, Mycobacterium avium subsp. paratuberculosis
ccagcccggccagc

SEQ ID NO: 810819 - RNA, 16 nt, Mycobacterium avium subsp. paratuberculosis
ccagcccggccagcgg

SEQ ID NO: 810820 - RNA, 16 nt, Mycobacterium avium subsp. paratuberculosis
ccagcccggccaguug

SEQ ID NO: 810821 - RNA, 17 nt, Mycobacterium avium subsp. paratuberculosis
ccagcccggccaguuga

SEQ ID NO: 810822 - RNA, 12 nt, Mycobacterium avium subsp. paratuberculosis
ccagcccggccc

SEQ ID NO: 810823 - RNA, 21 nt, Mycobacterium avium subsp. paratuberculosis
ccagcccggccccaccgccgc

SEQ ID NO: 810824 - RNA, 13 nt, Mycobacterium avium subsp. paratuberculosis
ccagcccggcccg

SEQ ID NO: 810825 - RNA, 17 nt, Mycobacterium avium subsp. paratuberculosis
ccagcccggcccgucga

SEQ ID NO: 810826 - RNA, 17 nt, Mycobacterium avium subsp. paratuberculosis
ccagcccgcggcagcca

SEQ ID NO: 810827 - RNA, 23 nt, Mycobacterium avium subsp. paratuberculosis
ccagcccgcggcagccagccugg

SEQ ID NO: 810828 - RNA, 13 nt, Mycobacterium avium subsp. paratuberculosis
ccagcccggccgc

SEQ ID NO: 810829 - RNA, 21 nt, Mycobacterium avium subsp. paratuberculosis
ccagcccggaaucgucggcca

SEQ ID NO: 810830 - RNA, 14 nt, Mycobacterium avium subsp. paratuberculosis
ccagcccggccgcc

SEQ ID NO: 810831 - RNA, 19 nt, Mycobacterium avium subsp. paratuberculosis
ccagcccggcgaugaucag

SEQ ID NO: 810832 - RNA, 15 nt, Mycobacterium avium subsp. paratuberculosis
ccagcccggccgccg

SEQ ID NO: 810833 - RNA, 14 nt, Mycobacterium avium subsp. paratuberculosis
ccagcccggcgugc

SEQ ID NO: 810834 - RNA, 19 nt, Mycobacterium avium subsp. paratuberculosis
ccagcccgccgcguccggg

SEQ ID NO: 810835 - RNA, 13 nt, Mycobacterium avium subsp. paratuberculosis
ccagcccggcugg

SEQ ID NO: 810836 - RNA, 21 nt, Mycobacterium avium subsp. paratuberculosis
ccagcccggcuggcaggucgc

SEQ ID NO: 810837 - RNA, 13 nt, Mycobacterium avium subsp. paratuberculosis
ccagcccgggaaa

SEQ ID NO: 810838 - RNA, 13 nt, Mycobacterium avium subsp. paratuberculosis
ccagcccggucac

SEQ ID NO: 810839 - RNA, 21 nt, Mycobacterium avium subsp. paratuberculosis
ccagcccggucaccaucagca

SEQ ID NO: 810840 - RNA, 19 nt, Mycobacterium avium subsp. paratuberculosis
ccagcccggugaucgccgc

SEQ ID NO: 810841 - RNA, 20 nt, Mycobacterium avium subsp. paratuberculosis
ccagcccggugaucgccgcc

SEQ ID NO: 810842 - RNA, 14 nt, Mycobacterium avium subsp. paratuberculosis
ccagccgagccggg

SEQ ID NO: 810843 - RNA, 15 nt, Mycobacterium avium subsp. paratuberculosis
ccagccgagccgggc

SEQ ID NO: 810844 - RNA, 18 nt, Mycobacterium avium subsp. paratuberculosis
ccagcccugcucggccag

SEQ ID NO: 810845 - RNA, 19 nt, Mycobacterium avium subsp. paratuberculosis
ccagcccugcucggccagc

SEQ ID NO: 810846 - RNA, 14 nt, Mycobacterium avium subsp. paratuberculosis
ccagcccgucggcc

SEQ ID NO: 810847 - RNA, 13 nt, Mycobacterium avium subsp. paratuberculosis
ccagcccgucguc

SEQ ID NO: 810848 - RNA, 19 nt, Mycobacterium avium subsp. paratuberculosis
ccagcccguggccagcgcc

SEQ ID NO: 810849 - RNA, 23 nt, Mycobacterium avium subsp. paratuberculosis
ccagcccguggccagcgccagcg

SEQ ID NO: 810850 - RNA, 20 nt, Mycobacterium avium subsp. paratuberculosis
ccagcccguugucgagcacc

SEQ ID NO: 810851 - RNA, 23 nt, Mycobacterium avium subsp. paratuberculosis
ccagcccguugucgagcaccgcg

SEQ ID NO: 810852 - RNA, 19 nt, Mycobacterium avium subsp. paratuberculosis
ccagcccguuguggcggcc

SEQ ID NO: 810853 - RNA, 15 nt, Mycobacterium avium subsp. paratuberculosis
ccagccauacugacg

SEQ ID NO: 810854 - RNA, 21 nt, Mycobacterium avium subsp. paratuberculosis
ccagccauacugacgccgguc

SEQ ID NO: 810855 - RNA, 15 nt, Mycobacterium avium subsp. paratuberculosis
ccagccaguccgccg

SEQ ID NO: 810856 - RNA, 17 nt, Mycobacterium avium subsp. paratuberculosis
ccagccaguccgccgcc

SEQ ID NO: 810857 - RNA, 19 nt, Mycobacterium avium subsp. paratuberculosis
ccagccaguugggggccag

SEQ ID NO: 810858 - RNA, 23 nt, Mycobacterium avium subsp. paratuberculosis
ccagccaguugggggccagcgcc

SEQ ID NO: 810859 - RNA, 12 nt, Mycobacterium avium subsp. paratuberculosis
ccagcccagccg

SEQ ID NO: 810860 - RNA, 15 nt, Mycobacterium avium subsp. paratuberculosis
ccagccaggccgccg

SEQ ID NO: 810861 - RNA, 15 nt, Mycobacterium avium subsp. paratuberculosis
ccagccaggccgucg

SEQ ID NO: 810862 - RNA, 12 nt, Mycobacterium avium subsp. paratuberculosis
ccagccagcgcg

SEQ ID NO: 810863 - RNA, 13 nt, Mycobacterium avium subsp. paratuberculosis
ccagccagccgcc

SEQ ID NO: 810864 - RNA, 14 nt, Mycobacterium avium subsp. paratuberculosis
ccagccagccgcgc

SEQ ID NO: 810865 - RNA, 19 nt, Mycobacterium avium subsp. paratuberculosis
ccagccagccgcgccgcgc

SEQ ID NO: 810866 - RNA, 23 nt, Mycobacterium avium subsp. paratuberculosis
ccagccagccgcgccgcgccgcc

SEQ ID NO: 810867 - RNA, 23 nt, Mycobacterium avium subsp. paratuberculosis
ccagccagaacacgccccggcgg

SEQ ID NO: 810868 - RNA, 21 nt, Mycobacterium avium subsp. paratuberculosis
ccagccacaccgccgcggcgg

SEQ ID NO: 810869 - RNA, 23 nt, Mycobacterium avium subsp. paratuberculosis
ccagccacaccgccgcggcggug

SEQ ID NO: 810870 - RNA, 14 nt, Mycobacterium avium subsp. paratuberculosis
ccagccacagccgc

SEQ ID NO: 810871 - RNA, 15 nt, Mycobacterium avium subsp. paratuberculosis
ccagccacagccgca

SEQ ID NO: 810872 - RNA, 16 nt, Mycobacterium avium subsp. paratuberculosis
ccagccacgccgacac

SEQ ID NO: 810873 - RNA, 18 nt, Mycobacterium avium subsp. paratuberculosis
ccagccacgccgacaccg

SEQ ID NO: 810874 - RNA, 16 nt, Mycobacterium avium subsp. paratuberculosis
ccagcauguguggcuc

SEQ ID NO: 810875 - RNA, 21 nt, Mycobacterium avium subsp. paratuberculosis
ccagcaugugcucccagcuca

SEQ ID NO: 810876 - RNA, 20 nt, Mycobacterium avium subsp. paratuberculosis
ccagcauggcgaucaccccg

SEQ ID NO: 810877 - RNA, 21 nt, Mycobacterium avium subsp. paratuberculosis
ccagcagugccaacacggcgg

SEQ ID NO: 810878 - RNA, 17 nt, Mycobacterium avium subsp. paratuberculosis
ccagcagugccaccacc

SEQ ID NO: 810879 - RNA, 18 nt, Mycobacterium avium subsp. paratuberculosis
ccagcaguguccagucgg

SEQ ID NO: 810880 - RNA, 19 nt, Mycobacterium avium subsp. paratuberculosis
ccagcaguguccagucggc

SEQ ID NO: 810881 - RNA, 17 nt, Mycobacterium avium subsp. paratuberculosis
ccagcagggcggcgauc

SEQ ID NO: 810882 - RNA, 15 nt, Mycobacterium avium subsp. paratuberculosis
ccagcagggcgccga

SEQ ID NO: 810883 - RNA, 18 nt, Mycobacterium avium subsp. paratuberculosis
ccagcagggcgccgacga

SEQ ID NO: 810884 - RNA, 15 nt, Mycobacterium avium subsp. paratuberculosis
ccagcaggcuggcgu

SEQ ID NO: 810885 - RNA, 22 nt, Mycobacterium avium subsp. paratuberculosis
ccagcagggcaucucccgcgcg

SEQ ID NO: 810886 - RNA, 17 nt, Mycobacterium avium subsp. paratuberculosis
ccagcaguuuggucauc

SEQ ID NO: 810887 - RNA, 15 nt, Mycobacterium avium subsp. paratuberculosis
ccagcaggcgcgccg

SEQ ID NO: 810888 - RNA, 16 nt, Mycobacterium avium subsp. paratuberculosis
ccagcaggcgcgccga

SEQ ID NO: 810889 - RNA, 17 nt, Mycobacterium avium subsp. paratuberculosis
ccagcaggcgcgccgag

SEQ ID NO: 810890 - RNA, 18 nt, Mycobacterium avium subsp. paratuberculosis
ccagcaggcccaacguga

SEQ ID NO: 810891 - RNA, 14 nt, Mycobacterium avium subsp. paratuberculosis
ccagcagcggcacc

SEQ ID NO: 810892 - RNA, 22 nt, Mycobacterium avium subsp. paratuberculosis
ccagcagcggcaguagcgcacc

SEQ ID NO: 810893 - RNA, 15 nt, Mycobacterium avium subsp. paratuberculosis
ccagcagcggccggc

SEQ ID NO: 810894 - RNA, 17 nt, Mycobacterium avium subsp. paratuberculosis
ccagcagcgcgccgcgc

SEQ ID NO: 810895 - RNA, 15 nt, Mycobacterium avium subsp. paratuberculosis
ccagcagcgcggcga

SEQ ID NO: 810896 - RNA, 21 nt, Mycobacterium avium subsp. paratuberculosis
ccagcagcgcgucgcgggccc

SEQ ID NO: 810897 - RNA, 12 nt, Mycobacterium avium subsp. paratuberculosis
ccagcagcgccu

SEQ ID NO: 810898 - RNA, 20 nt, Mycobacterium avium subsp. paratuberculosis
ccagcagcgccucggcgauc

SEQ ID NO: 810899 - RNA, 15 nt, Mycobacterium avium subsp. paratuberculosis
ccagcagcgccuugc

SEQ ID NO: 810900 - RNA, 16 nt, Mycobacterium avium subsp. paratuberculosis
ccagcagcgccuugcc

SEQ ID NO: 810901 - RNA, 19 nt, Mycobacterium avium subsp. paratuberculosis
ccagcagcgccuugccgac

SEQ ID NO: 810902 - RNA, 21 nt, Mycobacterium avium subsp. paratuberculosis
ccagcagcgccuugccgacga

SEQ ID NO: 810903 - RNA, 24 nt, Mycobacterium avium subsp. paratuberculosis
ccagcagcgccgcuucgucgccgg

SEQ ID NO: 810904 - RNA, 14 nt, Mycobacterium avium subsp. paratuberculosis
ccagcagcgccggc

SEQ ID NO: 810905 - RNA, 16 nt, Mycobacterium avium subsp. paratuberculosis
ccagcagcgccggcag

SEQ ID NO: 810906 - RNA, 17 nt, Mycobacterium avium subsp. paratuberculosis
ccagcagcgccggcagc

SEQ ID NO: 810907 - RNA, 19 nt, Mycobacterium avium subsp. paratuberculosis
ccagcagcgccggcagcgc

SEQ ID NO: 810908 - RNA, 13 nt, Mycobacterium avium subsp. paratuberculosis
ccagcagcgccgc

SEQ ID NO: 810909 - RNA, 23 nt, Mycobacterium avium subsp. paratuberculosis
ccagcagcgcaccggcgaugcag

SEQ ID NO: 810910 - RNA, 11 nt, Mycobacterium avium subsp. paratuberculosis
ccagcacguug

SEQ ID NO: 810911 - RNA, 22 nt, Mycobacterium avium subsp. paratuberculosis
ccagcacgcccagaucgccgac

SEQ ID NO: 810912 - RNA, 22 nt, Mycobacterium avium subsp. paratuberculosis
ccagcacgcccccgcuggcccg

SEQ ID NO: 810913 - RNA, 21 nt, Mycobacterium avium subsp. paratuberculosis
ccagcacguugugcucgucga

SEQ ID NO: 810914 - RNA, 19 nt, Mycobacterium avium subsp. paratuberculosis
ccagcagauagcccagcca

SEQ ID NO: 810915 - RNA, 18 nt, Mycobacterium avium subsp. paratuberculosis
ccagcagcaacgcggugu

SEQ ID NO: 810916 - RNA, 19 nt, Mycobacterium avium subsp. paratuberculosis
ccagcagcaccagaugcac

SEQ ID NO: 810917 - RNA, 18 nt, Mycobacterium avium subsp. paratuberculosis
ccagcagcaccagggcgu

SEQ ID NO: 810918 - RNA, 13 nt, Mycobacterium avium subsp. paratuberculosis
ccagcagcaccgc

SEQ ID NO: 810919 - RNA, 15 nt, Mycobacterium avium subsp. paratuberculosis
ccagcagcaccgcga

SEQ ID NO: 810920 - RNA, 17 nt, Mycobacterium avium subsp. paratuberculosis
ccagcagcaccgcgacc

SEQ ID NO: 810921 - RNA, 19 nt, Mycobacterium avium subsp. paratuberculosis
ccagcagcaccgcgaccgg

SEQ ID NO: 810922 - RNA, 20 nt, Mycobacterium avium subsp. paratuberculosis
ccagcagcaccgcgaccggu

SEQ ID NO: 810923 - RNA, 15 nt, Mycobacterium avium subsp. paratuberculosis
ccagcagcaccgcgu

SEQ ID NO: 810924 - RNA, 13 nt, Mycobacterium avium subsp. paratuberculosis
ccagcagcgccag

SEQ ID NO: 810925 - RNA, 12 nt, Mycobacterium avium subsp. paratuberculosis
ccagcagcgcca

SEQ ID NO: 810926 - RNA, 20 nt, Mycobacterium avium subsp. paratuberculosis
ccagcagcgagaaccggcgc

SEQ ID NO: 810927 - RNA, 21 nt, Mycobacterium avium subsp. paratuberculosis
ccagcagcgagaaccggcgca

SEQ ID NO: 810928 - RNA, 23 nt, Mycobacterium avium subsp. paratuberculosis
ccagcagcgagaaccggcgcaga

SEQ ID NO: 810929 - RNA, 16 nt, Mycobacterium avium subsp. paratuberculosis
ccagcagcgagaccgg

SEQ ID NO: 810930 - RNA, 15 nt, Mycobacterium avium subsp. paratuberculosis
ccagcaccugcucga

SEQ ID NO: 810931 - RNA, 17 nt, Mycobacterium avium subsp. paratuberculosis
ccagcaccucggcgacc

SEQ ID NO: 810932 - RNA, 20 nt, Mycobacterium avium subsp. paratuberculosis
ccagcaccucggcgaccacg

SEQ ID NO: 810933 - RNA, 21 nt, Mycobacterium avium subsp. paratuberculosis
ccagcaccugaccgucggcca

SEQ ID NO: 810934 - RNA, 17 nt, Mycobacterium avium subsp. paratuberculosis
ccagaugcgucaacccg

SEQ ID NO: 810935 - RNA, 16 nt, Mycobacterium avium subsp. paratuberculosis
ccagcacgccggucag

SEQ ID NO: 810936 - RNA, 19 nt, Mycobacterium avium subsp. paratuberculosis
ccagcacgugcccagcccg

SEQ ID NO: 810937 - RNA, 20 nt, Mycobacterium avium subsp. paratuberculosis
ccagcacgugcccagcccgc

SEQ ID NO: 810938 - RNA, 17 nt, Mycobacterium avium subsp. paratuberculosis
ccagcacguggccgggc

SEQ ID NO: 810939 - RNA, 13 nt, Mycobacterium avium subsp. paratuberculosis
ccagcacgcaggc

SEQ ID NO: 810940 - RNA, 18 nt, Mycobacterium avium subsp. paratuberculosis
ccagcacgaucccgccgc

SEQ ID NO: 810941 - RNA, 16 nt, Mycobacterium avium subsp. paratuberculosis
ccagcacgaugacgac

SEQ ID NO: 810942 - RNA, 13 nt, Mycobacterium avium subsp. paratuberculosis
ccagcacgacacc

SEQ ID NO: 810943 - RNA, 14 nt, Mycobacterium avium subsp. paratuberculosis
ccagcacgacaccg

SEQ ID NO: 810944 - RNA, 16 nt, Mycobacterium avium subsp. paratuberculosis
ccagcacgaccccgcc

SEQ ID NO: 810945 - RNA, 18 nt, Mycobacterium avium subsp. paratuberculosis
ccagcaccuucagcgggc

SEQ ID NO: 810946 - RNA, 17 nt, Mycobacterium avium subsp. paratuberculosis
ccagcacgaaggccgcc

SEQ ID NO: 810947 - RNA, 18 nt, Mycobacterium avium subsp. paratuberculosis
ccagcacgaaggccgccg

SEQ ID NO: 810948 - RNA, 19 nt, Mycobacterium avium subsp. paratuberculosis
ccagcacgaaggccgccgg

SEQ ID NO: 810949 - RNA, 23 nt, Mycobacterium avium subsp. paratuberculosis
ccagcaccuggcgcaccgccgcg

SEQ ID NO: 810950 - RNA, 18 nt, Mycobacterium avium subsp. paratuberculosis
ccagcaccuucgggccga

SEQ ID NO: 810951 - RNA, 15 nt, Mycobacterium avium subsp. paratuberculosis
ccagcgcgcggugcg

SEQ ID NO: 810952 - RNA, 23 nt, Mycobacterium avium subsp. paratuberculosis
ccagcgcgcggugcgccagcgcc

SEQ ID NO: 810953 - RNA, 14 nt, Mycobacterium avium subsp. paratuberculosis
ccagcgcgcgggug

SEQ ID NO: 810954 - RNA, 14 nt, Mycobacterium avium subsp. paratuberculosis
ccagcggcagcagc

SEQ ID NO: 810955 - RNA, 17 nt, Mycobacterium avium subsp. paratuberculosis
ccagcggcagcagcacc

SEQ ID NO: 810956 - RNA, 14 nt, Mycobacterium avium subsp. paratuberculosis
ccagcggcacgggc

SEQ ID NO: 810957 - RNA, 15 nt, Mycobacterium avium subsp. paratuberculosis
ccagcggcacgggca

SEQ ID NO: 810958 - RNA, 22 nt, Mycobacterium avium subsp. paratuberculosis
ccagcggcacgggcaccgacga

SEQ ID NO: 810959 - RNA, 15 nt, Mycobacterium avium subsp. paratuberculosis
ccagcgcgcggcgga

SEQ ID NO: 810960 - RNA, 17 nt, Mycobacterium avium subsp. paratuberculosis
ccagcgcgcgggcgcgc

SEQ ID NO: 810961 - RNA, 20 nt, Mycobacterium avium subsp. paratuberculosis
ccagcgcgcgggcgcgcgcc

SEQ ID NO: 810962 - RNA, 22 nt, Mycobacterium avium subsp. paratuberculosis
ccagcgcgcgggcgcgcgccgc

SEQ ID NO: 810963 - RNA, 18 nt, Mycobacterium avium subsp. paratuberculosis
ccagcgcgcgaucagcgc

SEQ ID NO: 810964 - RNA, 22 nt, Mycobacterium avium subsp. paratuberculosis
ccagcgcgcgaucagcgccguc

SEQ ID NO: 810965 - RNA, 14 nt, Mycobacterium avium subsp. paratuberculosis
ccagcgcgccgccc

SEQ ID NO: 810966 - RNA, 19 nt, Mycobacterium avium subsp. paratuberculosis
ccagcgcgccgcccagcgg

SEQ ID NO: 810967 - RNA, 20 nt, Mycobacterium avium subsp. paratuberculosis
ccagcgcgccgcccagcggc

SEQ ID NO: 810968 - RNA, 21 nt, Mycobacterium avium subsp. paratuberculosis
ccagcgcgccgcccagcggcc

SEQ ID NO: 810969 - RNA, 12 nt, Mycobacterium avium subsp. paratuberculosis
ccagcgcgccgc

SEQ ID NO: 810970 - RNA, 13 nt, Mycobacterium avium subsp. paratuberculosis
ccagcgcgcccgc

SEQ ID NO: 810971 - RNA, 17 nt, Mycobacterium avium subsp. paratuberculosis
ccagcgcgcccgccauc

SEQ ID NO: 810972 - RNA, 22 nt, Mycobacterium avium subsp. paratuberculosis
ccagcgccucggccucgucgac

SEQ ID NO: 810973 - RNA, 19 nt, Mycobacterium avium subsp. paratuberculosis
ccagcgccgucaucaccgc

SEQ ID NO: 810974 - RNA, 23 nt, Mycobacterium avium subsp. paratuberculosis
ccagcgccgucaucaccgccgag

SEQ ID NO: 810975 - RNA, 17 nt, Mycobacterium avium subsp. paratuberculosis
ccagcgccucgagcacc

SEQ ID NO: 810976 - RNA, 23 nt, Mycobacterium avium subsp. paratuberculosis
ccagcgccucgagcaccacggcc

SEQ ID NO: 810977 - RNA, 23 nt, Mycobacterium avium subsp. paratuberculosis
ccagcgggaugaaggcacccagg

SEQ ID NO: 810978 - RNA, 12 nt, Mycobacterium avium subsp. paratuberculosis
ccagcgggccga

SEQ ID NO: 810979 - RNA, 16 nt, Mycobacterium avium subsp. paratuberculosis
ccagcgggccgacagc

SEQ ID NO: 810980 - RNA, 19 nt, Mycobacterium avium subsp. paratuberculosis
ccagcgggccgacagcacg

SEQ ID NO: 810981 - RNA, 21 nt, Mycobacterium avium subsp. paratuberculosis
ccagcgggccgaccuggcggc

SEQ ID NO: 810982 - RNA, 16 nt, Mycobacterium avium subsp. paratuberculosis
ccagcggcuguagcac

SEQ ID NO: 810983 - RNA, 21 nt, Mycobacterium avium subsp. paratuberculosis
ccagcggcuguagcacccggc

SEQ ID NO: 810984 - RNA, 22 nt, Mycobacterium avium subsp. paratuberculosis
ccagcggcuguagcacccggcc

SEQ ID NO: 810985 - RNA, 18 nt, Mycobacterium avium subsp. paratuberculosis
ccagcggcuuggccgugc

SEQ ID NO: 810986 - RNA, 16 nt, Mycobacterium avium subsp. paratuberculosis
ccagcgggacagcacc

SEQ ID NO: 810987 - RNA, 14 nt, Mycobacterium avium subsp. paratuberculosis
ccagcggcucggug

SEQ ID NO: 810988 - RNA, 16 nt, Mycobacterium avium subsp. paratuberculosis
ccagcgcgccggccag

SEQ ID NO: 810989 - RNA, 12 nt, Mycobacterium avium subsp. paratuberculosis
ccagcggcaucc

SEQ ID NO: 810990 - RNA, 16 nt, Mycobacterium avium subsp. paratuberculosis
ccagcggcagcggcgu

SEQ ID NO: 810991 - RNA, 18 nt, Mycobacterium avium subsp. paratuberculosis
ccagcggcagcggcgucg

SEQ ID NO: 810992 - RNA, 22 nt, Mycobacterium avium subsp. paratuberculosis
ccagcggcagcggcgucgucgu

SEQ ID NO: 810993 - RNA, 15 nt, Mycobacterium avium subsp. paratuberculosis
ccagcggcagcgaca

SEQ ID NO: 810994 - RNA, 22 nt, Mycobacterium avium subsp. paratuberculosis
ccagcggcagcgacagcgcguc

SEQ ID NO: 810995 - RNA, 15 nt, Mycobacterium avium subsp. paratuberculosis
ccagcggcagcgucg

SEQ ID NO: 810996 - RNA, 16 nt, Mycobacterium avium subsp. paratuberculosis
ccagcggcaucgccgc

SEQ ID NO: 810997 - RNA, 15 nt, Mycobacterium avium subsp. paratuberculosis
ccagcggcauggcga

SEQ ID NO: 810998 - RNA, 14 nt, Mycobacterium avium subsp. paratuberculosis
ccagcggccacacc

SEQ ID NO: 810999 - RNA, 14 nt, Mycobacterium avium subsp. paratuberculosis
ccagcggccagccc

SEQ ID NO: 811000 - RNA, 15 nt, Mycobacterium avium subsp. paratuberculosis
ccagcggccagcccg

SEQ ID NO: 811001 - RNA, 15 nt, Mycobacterium avium subsp. paratuberculosis
ccagcggcccaccgc

SEQ ID NO: 811002 - RNA, 16 nt, Mycobacterium avium subsp. paratuberculosis
ccagcggcccaccgcg

SEQ ID NO: 811003 - RNA, 17 nt, Mycobacterium avium subsp. paratuberculosis
ccagcggcccaccgcga

SEQ ID NO: 811004 - RNA, 19 nt, Mycobacterium avium subsp. paratuberculosis
ccagcggcccaccgcgacc

SEQ ID NO: 811005 - RNA, 16 nt, Mycobacterium avium subsp. paratuberculosis
ccagcggccccggcuc

SEQ ID NO: 811006 - RNA, 17 nt, Mycobacterium avium subsp. paratuberculosis
ccagcggccccggcucg

SEQ ID NO: 811007 - RNA, 19 nt, Mycobacterium avium subsp. paratuberculosis
ccagcggccccggcucggg

SEQ ID NO: 811008 - RNA, 13 nt, Mycobacterium avium subsp. paratuberculosis
ccagcggcccgcu

SEQ ID NO: 811009 - RNA, 18 nt, Mycobacterium avium subsp. paratuberculosis
ccagcgucucggcggccg

SEQ ID NO: 811010 - RNA, 21 nt, Mycobacterium avium subsp. paratuberculosis
ccagcgucucggcggccgagc

SEQ ID NO: 811011 - RNA, 22 nt, Mycobacterium avium subsp. paratuberculosis
ccagcgucagggcgacuccggc

SEQ ID NO: 811012 - RNA, 15 nt, Mycobacterium avium subsp. paratuberculosis
ccagcgucgcggccg

SEQ ID NO: 811013 - RNA, 14 nt, Mycobacterium avium subsp. paratuberculosis
ccagcgucgcggcc

SEQ ID NO: 811014 - RNA, 14 nt, Mycobacterium avium subsp. paratuberculosis
ccagcgugaccucg

SEQ ID NO: 811015 - RNA, 20 nt, Mycobacterium avium subsp. paratuberculosis
ccagcgugaccucgacggug

SEQ ID NO: 811016 - RNA, 23 nt, Mycobacterium avium subsp. paratuberculosis
ccagcgugaccucgacggugcug

SEQ ID NO: 811017 - RNA, 16 nt, Mycobacterium avium subsp. paratuberculosis
ccagcgugacgcccgg

SEQ ID NO: 811018 - RNA, 17 nt, Mycobacterium avium subsp. paratuberculosis
ccagcgugacgcccggc

SEQ ID NO: 811019 - RNA, 19 nt, Mycobacterium avium subsp. paratuberculosis
ccagcgugacgcccggcgc

SEQ ID NO: 811020 - RNA, 21 nt, Mycobacterium avium subsp. paratuberculosis
ccagcgugacgcccggcgccg

SEQ ID NO: 811021 - RNA, 22 nt, Mycobacterium avium subsp. paratuberculosis
ccagcgugacgcccggcgccgg

SEQ ID NO: 811022 - RNA, 14 nt, Mycobacterium avium subsp. paratuberculosis
ccagcgugacgccg

SEQ ID NO: 811023 - RNA, 15 nt, Mycobacterium avium subsp. paratuberculosis
ccagcgugacgccgg

SEQ ID NO: 811024 - RNA, 17 nt, Mycobacterium avium subsp. paratuberculosis
ccagcgugacgccgggc

SEQ ID NO: 811025 - RNA, 21 nt, Mycobacterium avium subsp. paratuberculosis
ccagcgugacgccgggccgcc

SEQ ID NO: 811026 - RNA, 22 nt, Mycobacterium avium subsp. paratuberculosis
ccagcgugacgccgggccgccg

SEQ ID NO: 811027 - RNA, 15 nt, Mycobacterium avium subsp. paratuberculosis
ccagcgugacgcucg

SEQ ID NO: 811028 - RNA, 17 nt, Mycobacterium avium subsp. paratuberculosis
ccagcgugacgcucggg

SEQ ID NO: 811029 - RNA, 18 nt, Mycobacterium avium subsp. paratuberculosis
ccagcgugacgucgacgu

SEQ ID NO: 811030 - RNA, 20 nt, Mycobacterium avium subsp. paratuberculosis
ccagcgucaccuucaccacg

SEQ ID NO: 811031 - RNA, 22 nt, Mycobacterium avium subsp. paratuberculosis
ccagcguagaacauccacggca

SEQ ID NO: 811032 - RNA, 23 nt, Mycobacterium avium subsp. paratuberculosis
ccagcguagaacauccacggcau

SEQ ID NO: 811033 - RNA, 15 nt, Mycobacterium avium subsp. paratuberculosis
ccagcgucgacgcgg

SEQ ID NO: 811034 - RNA, 17 nt, Mycobacterium avium subsp. paratuberculosis
ccagcgucgacgcggug

SEQ ID NO: 811035 - RNA, 16 nt, Mycobacterium avium subsp. paratuberculosis
ccagcgucgcgaucag

SEQ ID NO: 811036 - RNA, 14 nt, Mycobacterium avium subsp. paratuberculosis
ccagcgucgcgccg

SEQ ID NO: 811037 - RNA, 17 nt, Mycobacterium avium subsp. paratuberculosis
ccagcgucgcgccgcca

SEQ ID NO: 811038 - RNA, 21 nt, Mycobacterium avium subsp. paratuberculosis
ccagcgggucgugcaucggcg

SEQ ID NO: 811039 - RNA, 22 nt, Mycobacterium avium subsp. paratuberculosis
ccagcgggucgugcaucggcgc

SEQ ID NO: 811040 - RNA, 16 nt, Mycobacterium avium subsp. paratuberculosis
ccagcggucggcgguu

SEQ ID NO: 811041 - RNA, 17 nt, Mycobacterium avium subsp. paratuberculosis
ccagcggucggcgguuc

SEQ ID NO: 811042 - RNA, 22 nt, Mycobacterium avium subsp. paratuberculosis
ccagcggucgggugcgcucacc

SEQ ID NO: 811043 - RNA, 20 nt, Mycobacterium avium subsp. paratuberculosis
ccagcgggguguucaccgcg

SEQ ID NO: 811044 - RNA, 16 nt, Mycobacterium avium subsp. paratuberculosis
ccagcggguccagccg

SEQ ID NO: 811045 - RNA, 17 nt, Mycobacterium avium subsp. paratuberculosis
ccagcggguccagccgc

SEQ ID NO: 811046 - RNA, 19 nt, Mycobacterium avium subsp. paratuberculosis
ccagcggguccagccgccg

SEQ ID NO: 811047 - RNA, 21 nt, Mycobacterium avium subsp. paratuberculosis
ccagcggguccagccgccggc

SEQ ID NO: 811048 - RNA, 15 nt, Mycobacterium avium subsp. paratuberculosis
ccagcggguugccgc

SEQ ID NO: 811049 - RNA, 17 nt, Mycobacterium avium subsp. paratuberculosis
ccagcggguugccgcug

SEQ ID NO: 811050 - RNA, 21 nt, Mycobacterium avium subsp. paratuberculosis
ccagcggguugucgucgucgg

SEQ ID NO: 811051 - RNA, 17 nt, Mycobacterium avium subsp. paratuberculosis
ccagcgguaaccacccg

SEQ ID NO: 811052 - RNA, 16 nt, Mycobacterium avium subsp. paratuberculosis
ccagcggggcaagcag

SEQ ID NO: 811053 - RNA, 21 nt, Mycobacterium avium subsp. paratuberculosis
ccagcggggcaagcagcggca

SEQ ID NO: 811054 - RNA, 22 nt, Mycobacterium avium subsp. paratuberculosis
ccagcggggcaagcagcggcag

SEQ ID NO: 811055 - RNA, 16 nt, Mycobacterium avium subsp. paratuberculosis
ccagcgggcggcggug

SEQ ID NO: 811056 - RNA, 19 nt, Mycobacterium avium subsp. paratuberculosis
ccagcgggcggcgguggcc

SEQ ID NO: 811057 - RNA, 18 nt, Mycobacterium avium subsp. paratuberculosis
ccagcgggcugucggcgc

SEQ ID NO: 811058 - RNA, 22 nt, Mycobacterium avium subsp. paratuberculosis
ccagcgggcugugccggcgggu

SEQ ID NO: 811059 - RNA, 20 nt, Mycobacterium avium subsp. paratuberculosis
ccagcgggccgugccgccau

SEQ ID NO: 811060 - RNA, 17 nt, Mycobacterium avium subsp. paratuberculosis
ccagcgggcgacgucgg

SEQ ID NO: 811061 - RNA, 15 nt, Mycobacterium avium subsp. paratuberculosis
ccagcgggcggcccc

SEQ ID NO: 811062 - RNA, 14 nt, Mycobacterium avium subsp. paratuberculosis
ccagccgaucgcgg

SEQ ID NO: 811063 - RNA, 16 nt, Mycobacterium avium subsp. paratuberculosis
ccagccgaucgcggug

SEQ ID NO: 811064 - RNA, 21 nt, Mycobacterium avium subsp. paratuberculosis
ccagccgaucgcggugcugca

SEQ ID NO: 811065 - RNA, 20 nt, Mycobacterium avium subsp. paratuberculosis
ccagccgcaccgcgaccguc

SEQ ID NO: 811066 - RNA, 21 nt, Mycobacterium avium subsp. paratuberculosis
ccagccgcaccgcgaccguca

SEQ ID NO: 811067 - RNA, 20 nt, Mycobacterium avium subsp. paratuberculosis
ccagccgaugcgcccgcgcc

SEQ ID NO: 811068 - RNA, 23 nt, Mycobacterium avium subsp. paratuberculosis
ccagccgaugcgcccgcgccacc

SEQ ID NO: 811069 - RNA, 17 nt, Mycobacterium avium subsp. paratuberculosis
ccagccgaggcgcucgc

SEQ ID NO: 811070 - RNA, 15 nt, Mycobacterium avium subsp. paratuberculosis
ccagccgccgccgac

SEQ ID NO: 811071 - RNA, 17 nt, Mycobacterium avium subsp. paratuberculosis
ccagccgccgcgacacc

SEQ ID NO: 811072 - RNA, 15 nt, Mycobacterium avium subsp. paratuberculosis
ccagccgccgcgugg

SEQ ID NO: 811073 - RNA, 23 nt, Mycobacterium avium subsp. paratuberculosis
ccagccgcagcaggcacuccugg

SEQ ID NO: 811074 - RNA, 23 nt, Mycobacterium avium subsp. paratuberculosis
ccagccgcaggugcucgccggcg

SEQ ID NO: 811075 - RNA, 14 nt, Mycobacterium avium subsp. paratuberculosis
ccagccgcaucacc

SEQ ID NO: 811076 - RNA, 13 nt, Mycobacterium avium subsp. paratuberculosis
ccagccgccggcc

SEQ ID NO: 811077 - RNA, 17 nt, Mycobacterium avium subsp. paratuberculosis
ccagccgccggcucagc

SEQ ID NO: 811078 - RNA, 13 nt, Mycobacterium avium subsp. paratuberculosis
ccagccgccgguc

SEQ ID NO: 811079 - RNA, 16 nt, Mycobacterium avium subsp. paratuberculosis
ccagccgcgccgcgcc

SEQ ID NO: 811080 - RNA, 18 nt, Mycobacterium avium subsp. paratuberculosis
ccagccgcgccgcgccgc

SEQ ID NO: 811081 - RNA, 14 nt, Mycobacterium avium subsp. paratuberculosis
ccagccgcgcgacg

SEQ ID NO: 811082 - RNA, 15 nt, Mycobacterium avium subsp. paratuberculosis
ccagccgcgcggccg

SEQ ID NO: 811083 - RNA, 17 nt, Mycobacterium avium subsp. paratuberculosis
ccagccgcgcggccgcc

SEQ ID NO: 811084 - RNA, 15 nt, Mycobacterium avium subsp. paratuberculosis
ccagccgcgcggcgu

SEQ ID NO: 811085 - RNA, 19 nt, Mycobacterium avium subsp. paratuberculosis
ccagcgagcucaggccggc

SEQ ID NO: 811086 - RNA, 20 nt, Mycobacterium avium subsp. paratuberculosis
ccagcgagcucaggccggcc

SEQ ID NO: 811087 - RNA, 17 nt, Mycobacterium avium subsp. paratuberculosis
ccagcgagcugccggcg

SEQ ID NO: 811088 - RNA, 18 nt, Mycobacterium avium subsp. paratuberculosis
ccagcgagcugccggcgg

SEQ ID NO: 811089 - RNA, 20 nt, Mycobacterium avium subsp. paratuberculosis
ccagcgagcugccggcggcc

SEQ ID NO: 811090 - RNA, 23 nt, Mycobacterium avium subsp. paratuberculosis
ccagcgagcugccggcggccgcc

SEQ ID NO: 811091 - RNA, 22 nt, Mycobacterium avium subsp. paratuberculosis
ccagcgagcccuucgcggugug

SEQ ID NO: 811092 - RNA, 17 nt, Mycobacterium avium subsp. paratuberculosis
ccagcgagcaggucacc

SEQ ID NO: 811093 - RNA, 15 nt, Mycobacterium avium subsp. paratuberculosis
ccagcgagccgauga

SEQ ID NO: 811094 - RNA, 14 nt, Mycobacterium avium subsp. paratuberculosis
ccagcgcaccgagc

SEQ ID NO: 811095 - RNA, 12 nt, Mycobacterium avium subsp. paratuberculosis
ccagcgaggcgg

SEQ ID NO: 811096 - RNA, 15 nt, Mycobacterium avium subsp. paratuberculosis
ccagcgaggcggcca

SEQ ID NO: 811097 - RNA, 21 nt, Mycobacterium avium subsp. paratuberculosis
ccagcgaggucucccggucca

SEQ ID NO: 811098 - RNA, 16 nt, Mycobacterium avium subsp. paratuberculosis
ccagcgaggugguuuc

SEQ ID NO: 811099 - RNA, 16 nt, Mycobacterium avium subsp. paratuberculosis
ccagcgacucggccag

SEQ ID NO: 811100 - RNA, 17 nt, Mycobacterium avium subsp. paratuberculosis
ccagcgacgccagcggc

SEQ ID NO: 811101 - RNA, 19 nt, Mycobacterium avium subsp. paratuberculosis
ccagcgacgccagcggcag

SEQ ID NO: 811102 - RNA, 13 nt, Mycobacterium avium subsp. paratuberculosis
ccagcgacggcag

SEQ ID NO: 811103 - RNA, 17 nt, Mycobacterium avium subsp. paratuberculosis
ccagcgacggcaggucg

SEQ ID NO: 811104 - RNA, 18 nt, Mycobacterium avium subsp. paratuberculosis
ccagcgacggcaggucgg

SEQ ID NO: 811105 - RNA, 13 nt, Mycobacterium avium subsp. paratuberculosis
ccagcgacggccg

SEQ ID NO: 811106 - RNA, 16 nt, Mycobacterium avium subsp. paratuberculosis
ccagcgacggccgggu

SEQ ID NO: 811107 - RNA, 21 nt, Mycobacterium avium subsp. paratuberculosis
ccagccgcggacggccagccc

SEQ ID NO: 811108 - RNA, 11 nt, Mycobacterium avium subsp. paratuberculosis
ccagccgcggu

SEQ ID NO: 811109 - RNA, 23 nt, Mycobacterium avium subsp. paratuberculosis
ccagccgcgguucuuguccucga

SEQ ID NO: 811110 - RNA, 14 nt, Mycobacterium avium subsp. paratuberculosis
ccagccgcgucacg

SEQ ID NO: 811111 - RNA, 20 nt, Mycobacterium avium subsp. paratuberculosis
ccagccgcgucacgucggcc

SEQ ID NO: 811112 - RNA, 17 nt, Mycobacterium avium subsp. paratuberculosis
ccagccgcucccggcgc

SEQ ID NO: 811113 - RNA, 18 nt, Mycobacterium avium subsp. paratuberculosis
ccagccgcuccgcggcgg

SEQ ID NO: 811114 - RNA, 21 nt, Mycobacterium avium subsp. paratuberculosis
ccagccgcuccgcggcgggcg

SEQ ID NO: 811115 - RNA, 16 nt, Mycobacterium avium subsp. paratuberculosis
ccagcgcccgcgggug

SEQ ID NO: 811116 - RNA, 17 nt, Mycobacterium avium subsp. paratuberculosis
ccagcgcccgcgggugc

SEQ ID NO: 811117 - RNA, 17 nt, Mycobacterium avium subsp. paratuberculosis
ccagcgcaucggucacc

SEQ ID NO: 811118 - RNA, 20 nt, Mycobacterium avium subsp. paratuberculosis
ccagcgcaucggucaccagc

SEQ ID NO: 811119 - RNA, 14 nt, Mycobacterium avium subsp. paratuberculosis
ccagcgcccggcga

SEQ ID NO: 811120 - RNA, 15 nt, Mycobacterium avium subsp. paratuberculosis
ccagcgcccggcgac

SEQ ID NO: 811121 - RNA, 16 nt, Mycobacterium avium subsp. paratuberculosis
ccagcgcccggcgacc

SEQ ID NO: 811122 - RNA, 13 nt, Mycobacterium avium subsp. paratuberculosis
ccagcgcccgggc

SEQ ID NO: 811123 - RNA, 15 nt, Mycobacterium avium subsp. paratuberculosis
ccagcgcccgggcgc

SEQ ID NO: 811124 - RNA, 16 nt, Mycobacterium avium subsp. paratuberculosis
ccagcgcccgggcgcg

SEQ ID NO: 811125 - RNA, 16 nt, Mycobacterium avium subsp. paratuberculosis
ccagcgcccguagccg

SEQ ID NO: 811126 - RNA, 19 nt, Mycobacterium avium subsp. paratuberculosis
ccagcgcccgcgcgugggc

SEQ ID NO: 811127 - RNA, 11 nt, Mycobacterium avium subsp. paratuberculosis
ccagcgccgag

SEQ ID NO: 811128 - RNA, 14 nt, Mycobacterium avium subsp. paratuberculosis
ccagcgccgagacc

SEQ ID NO: 811129 - RNA, 19 nt, Mycobacterium avium subsp. paratuberculosis
ccagcgccgagaccagcca

SEQ ID NO: 811130 - RNA, 14 nt, Mycobacterium avium subsp. paratuberculosis
ccagcgcagcaucg

SEQ ID NO: 811131 - RNA, 16 nt, Mycobacterium avium subsp. paratuberculosis
ccagcgcagcaucggc

SEQ ID NO: 811132 - RNA, 20 nt, Mycobacterium avium subsp. paratuberculosis
ccagcgcagcacugagcggc

SEQ ID NO: 811133 - RNA, 22 nt, Mycobacterium avium subsp. paratuberculosis
ccagcgcagcacugagcggcag

SEQ ID NO: 811134 - RNA, 17 nt, Mycobacterium avium subsp. paratuberculosis
ccagcgcagcgccucgg

SEQ ID NO: 811135 - RNA, 20 nt, Mycobacterium avium subsp. paratuberculosis
ccagcgcagcgccucggcgg

SEQ ID NO: 811136 - RNA, 18 nt, Mycobacterium avium subsp. paratuberculosis
ccagcgcagguacgcggc

SEQ ID NO: 811137 - RNA, 20 nt, Mycobacterium avium subsp. paratuberculosis
ccagcgcagguacgcggcgu

SEQ ID NO: 811138 - RNA, 19 nt, Mycobacterium avium subsp. paratuberculosis
ccagcgcauccaccagggc

SEQ ID NO: 811139 - RNA, 15 nt, Mycobacterium avium subsp. paratuberculosis
ccagcgccgaggugc

SEQ ID NO: 811140 - RNA, 12 nt, Mycobacterium avium subsp. paratuberculosis
ccagcgccgcag

SEQ ID NO: 811141 - RNA, 16 nt, Mycobacterium avium subsp. paratuberculosis
ccagcgccgagaucgc

SEQ ID NO: 811142 - RNA, 20 nt, Mycobacterium avium subsp. paratuberculosis
ccagcgccgagaucgcggug

SEQ ID NO: 811143 - RNA, 18 nt, Mycobacterium avium subsp. paratuberculosis
ccagcgccgagcacggcu

SEQ ID NO: 811144 - RNA, 24 nt, Mycobacterium avium subsp. paratuberculosis
ccagcgccgagcacggcucgucca

SEQ ID NO: 811145 - RNA, 15 nt, Mycobacterium avium subsp. paratuberculosis
ccagcgccgagccga

SEQ ID NO: 811146 - RNA, 12 nt, Mycobacterium avium subsp. paratuberculosis
ccagcgccgcca

SEQ ID NO: 811147 - RNA, 20 nt, Mycobacterium avium subsp. paratuberculosis
ccagcgccgccaaccagguc

SEQ ID NO: 811148 - RNA, 15 nt, Mycobacterium avium subsp. paratuberculosis
ccagcgccgccacgg

SEQ ID NO: 811149 - RNA, 23 nt, Mycobacterium avium subsp. paratuberculosis
ccagcgccgccaucgccucgucc

SEQ ID NO: 811150 - RNA, 13 nt, Mycobacterium avium subsp. paratuberculosis
ccagcgccgccau

SEQ ID NO: 811151 - RNA, 14 nt, Mycobacterium avium subsp. paratuberculosis
ccagcgccgccauc

SEQ ID NO: 811152 - RNA, 18 nt, Mycobacterium avium subsp. paratuberculosis
ccagcgccgcccgggcgg

SEQ ID NO: 811153 - RNA, 11 nt, Mycobacterium avium subsp. paratuberculosis
ccagcgccggg

SEQ ID NO: 811154 - RNA, 13 nt, Mycobacterium avium subsp. paratuberculosis
ccagcgccggcag

SEQ ID NO: 811155 - RNA, 15 nt, Mycobacterium avium subsp. paratuberculosis
ccagcgccgcggcga

SEQ ID NO: 811156 - RNA, 15 nt, Mycobacterium avium subsp. paratuberculosis
ccagcgccgcgauga

SEQ ID NO: 811157 - RNA, 14 nt, Mycobacterium avium subsp. paratuberculosis
ccagcgccgcggcg

SEQ ID NO: 811158 - RNA, 19 nt, Mycobacterium avium subsp. paratuberculosis
ccagcgccgcgcgcgcggc

SEQ ID NO: 811159 - RNA, 20 nt, Mycobacterium avium subsp. paratuberculosis
ccagcgccgcgcgcgcggcc

SEQ ID NO: 811160 - RNA, 13 nt, Mycobacterium avium subsp. paratuberculosis
caguucaccgcgc

SEQ ID NO: 811161 - RNA, 22 nt, Mycobacterium avium subsp. paratuberculosis
cagugguggccgaacgggucgg

SEQ ID NO: 811162 - RNA, 14 nt, Mycobacterium avium subsp. paratuberculosis
caguggcugucggg

SEQ ID NO: 811163 - RNA, 22 nt, Mycobacterium avium subsp. paratuberculosis
caguggguggugugcucgguga

SEQ ID NO: 811164 - RNA, 22 nt, Mycobacterium avium subsp. paratuberculosis
caguuccaugucgacgacguug

SEQ ID NO: 811165 - RNA, 11 nt, Mycobacterium avium subsp. paratuberculosis
caguucccggg

SEQ ID NO: 811166 - RNA, 14 nt, Mycobacterium avium subsp. paratuberculosis
caguuccucgccgg

SEQ ID NO: 811167 - RNA, 15 nt, Mycobacterium avium subsp. paratuberculosis
caguuccucggcgau

SEQ ID NO: 811168 - RNA, 17 nt, Mycobacterium avium subsp. paratuberculosis
caguugcaccggcaccg

SEQ ID NO: 811169 - RNA, 17 nt, Mycobacterium avium subsp. paratuberculosis
caguugcggcacgccga

SEQ ID NO: 811170 - RNA, 20 nt, Mycobacterium avium subsp. paratuberculosis
caguugcggcacgccgacca

SEQ ID NO: 811171 - RNA, 17 nt, Mycobacterium avium subsp. paratuberculosis
cagucgccggccaggcc

SEQ ID NO: 811172 - RNA, 20 nt, Mycobacterium avium subsp. paratuberculosis
cagucgccggccaggccggc

SEQ ID NO: 811173 - RNA, 16 nt, Mycobacterium avium subsp. paratuberculosis
cagucgcaggccccgg

SEQ ID NO: 811174 - RNA, 17 nt, Mycobacterium avium subsp. paratuberculosis
cagucgcaggccccgga

SEQ ID NO: 811175 - RNA, 16 nt, Mycobacterium avium subsp. paratuberculosis
caguccggcagcagcg

SEQ ID NO: 811176 - RNA, 13 nt, Mycobacterium avium subsp. paratuberculosis
caguccggccagc

SEQ ID NO: 811177 - RNA, 12 nt, Mycobacterium avium subsp. paratuberculosis
caguccggcagc

SEQ ID NO: 811178 - RNA, 13 nt, Mycobacterium avium subsp. paratuberculosis
caguccggccgug

SEQ ID NO: 811179 - RNA, 13 nt, Mycobacterium avium subsp. paratuberculosis
caguccggcgccc

SEQ ID NO: 811180 - RNA, 18 nt, Mycobacterium avium subsp. paratuberculosis
caguccggcgcccggcuc

SEQ ID NO: 811181 - RNA, 16 nt, Mycobacterium avium subsp. paratuberculosis
caguccggcgccgacc

SEQ ID NO: 811182 - RNA, 17 nt, Mycobacterium avium subsp. paratuberculosis
caguccggcgccgaccc

SEQ ID NO: 811183 - RNA, 14 nt, Mycobacterium avium subsp. paratuberculosis
cagucgcagcagca

SEQ ID NO: 811184 - RNA, 17 nt, Mycobacterium avium subsp. paratuberculosis
cagucgcagcagcagcc

SEQ ID NO: 811185 - RNA, 19 nt, Mycobacterium avium subsp. paratuberculosis
cagucgcagcagcagcccg

SEQ ID NO: 811186 - RNA, 13 nt, Mycobacterium avium subsp. paratuberculosis
cagucgcggcgaa

SEQ ID NO: 811187 - RNA, 23 nt, Mycobacterium avium subsp. paratuberculosis
cagucgcggcgaaccagcaugcg

SEQ ID NO: 811188 - RNA, 15 nt, Mycobacterium avium subsp. paratuberculosis
cagucgccgccgcgc

SEQ ID NO: 811189 - RNA, 22 nt, Mycobacterium avium subsp. paratuberculosis
cagucgccgcgcagaucgaugg

SEQ ID NO: 811190 - RNA, 16 nt, Mycobacterium avium subsp. paratuberculosis
cagucgcgcagcguca

SEQ ID NO: 811191 - RNA, 23 nt, Mycobacterium avium subsp. paratuberculosis
cagucgcgcagcgucaucgcgua

SEQ ID NO: 811192 - RNA, 23 nt, Mycobacterium avium subsp. paratuberculosis
cagucgcgccgagguggccgcca

SEQ ID NO: 811193 - RNA, 13 nt, Mycobacterium avium subsp. paratuberculosis
cagucgcgccgcc

SEQ ID NO: 811194 - RNA, 14 nt, Mycobacterium avium subsp. paratuberculosis
cagucgcgccgcca

SEQ ID NO: 811195 - RNA, 18 nt, Mycobacterium avium subsp. paratuberculosis
cagucgcgggcagccggc

SEQ ID NO: 811196 - RNA, 19 nt, Mycobacterium avium subsp. paratuberculosis
cagucgcgggcagccggcg

SEQ ID NO: 811197 - RNA, 20 nt, Mycobacterium avium subsp. paratuberculosis
cagucgcgggcgagccgaca

SEQ ID NO: 811198 - RNA, 21 nt, Mycobacterium avium subsp. paratuberculosis
cagucgcgggcggggcgccga

SEQ ID NO: 811199 - RNA, 12 nt, Mycobacterium avium subsp. paratuberculosis
cagugccggcga

SEQ ID NO: 811200 - RNA, 13 nt, Mycobacterium avium subsp. paratuberculosis
cagugccggcgag

SEQ ID NO: 811201 - RNA, 21 nt, Mycobacterium avium subsp. paratuberculosis
cagugccgggccagcugcucg

SEQ ID NO: 811202 - RNA, 13 nt, Mycobacterium avium subsp. paratuberculosis
cagugccggugca

SEQ ID NO: 811203 - RNA, 13 nt, Mycobacterium avium subsp. paratuberculosis
cagugcgaucgcc

SEQ ID NO: 811204 - RNA, 15 nt, Mycobacterium avium subsp. paratuberculosis
cagugcgcaggcggc

SEQ ID NO: 811205 - RNA, 16 nt, Mycobacterium avium subsp. paratuberculosis
cagugcgcaggcggcg

SEQ ID NO: 811206 - RNA, 17 nt, Mycobacterium avium subsp. paratuberculosis
cagugcgcaggcggcgc

SEQ ID NO: 811207 - RNA, 15 nt, Mycobacterium avium subsp. paratuberculosis
cagugcgcauucggc

SEQ ID NO: 811208 - RNA, 13 nt, Mycobacterium avium subsp. paratuberculosis
cagugcgagaaaa

SEQ ID NO: 811209 - RNA, 23 nt, Mycobacterium avium subsp. paratuberculosis
cagugcgagaaaaucgcccgcga

SEQ ID NO: 811210 - RNA, 23 nt, Mycobacterium avium subsp. paratuberculosis
cagucgcuggguguaaccggcuu

SEQ ID NO: 811211 - RNA, 21 nt, Mycobacterium avium subsp. paratuberculosis
cagugccgcgcggacgcggcg

SEQ ID NO: 811212 - RNA, 15 nt, Mycobacterium avium subsp. paratuberculosis
caguuucccgucggg

SEQ ID NO: 811213 - RNA, 16 nt, Mycobacterium avium subsp. paratuberculosis
caguuggcgucgucgg

SEQ ID NO: 811214 - RNA, 19 nt, Mycobacterium avium subsp. paratuberculosis
cauacugcuugccgucgac

SEQ ID NO: 811215 - RNA, 21 nt, Mycobacterium avium subsp. paratuberculosis
cauacugcuugccgucgacgc

SEQ ID NO: 811216 - RNA, 22 nt, Mycobacterium avium subsp. paratuberculosis
cauacugcuugccgucgacgcg

SEQ ID NO: 811217 - RNA, 16 nt, Mycobacterium avium subsp. paratuberculosis
cauacggcggcucggg

SEQ ID NO: 811218 - RNA, 14 nt, Mycobacterium avium subsp. paratuberculosis
cauaccgcccgcgc

SEQ ID NO: 811219 - RNA, 15 nt, Mycobacterium avium subsp. paratuberculosis
cauaccagcgcuggu

SEQ ID NO: 811220 - RNA, 20 nt, Mycobacterium avium subsp. paratuberculosis
cauaggcgucgcggucggcg

SEQ ID NO: 811221 - RNA, 18 nt, Mycobacterium avium subsp. paratuberculosis
cauagggcucguccucga

SEQ ID NO: 811222 - RNA, 15 nt, Mycobacterium avium subsp. paratuberculosis
cauaggccgcgagga

SEQ ID NO: 811223 - RNA, 15 nt, Mycobacterium avium subsp. paratuberculosis
cauccaccagggcgg

SEQ ID NO: 811224 - RNA, 21 nt, Mycobacterium avium subsp. paratuberculosis
cauccccgugcggggccucgu

SEQ ID NO: 811225 - RNA, 14 nt, Mycobacterium avium subsp. paratuberculosis
cauccccuuggugc

SEQ ID NO: 811226 - RNA, 14 nt, Mycobacterium avium subsp. paratuberculosis
caucaugucgaaga

SEQ ID NO: 811227 - RNA, 22 nt, Mycobacterium avium subsp. paratuberculosis
caucaugucgaagaagcggccg

SEQ ID NO: 811228 - RNA, 15 nt, Mycobacterium avium subsp. paratuberculosis
caucccuggugaccg

SEQ ID NO: 811229 - RNA, 19 nt, Mycobacterium avium subsp. paratuberculosis
caucccuggugaccgacga

SEQ ID NO: 811230 - RNA, 23 nt, Mycobacterium avium subsp. paratuberculosis
caucccgaaugagacgacccgag

SEQ ID NO: 811231 - RNA, 20 nt, Mycobacterium avium subsp. paratuberculosis
caucccugacacgaccgccu

SEQ ID NO: 811232 - RNA, 21 nt, Mycobacterium avium subsp. paratuberculosis
cauccgcaacgugcgccggcc

SEQ ID NO: 811233 - RNA, 14 nt, Mycobacterium avium subsp. paratuberculosis
caucccggccaccc

SEQ ID NO: 811234 - RNA, 15 nt, Mycobacterium avium subsp. paratuberculosis
caucccggccacccc

SEQ ID NO: 811235 - RNA, 17 nt, Mycobacterium avium subsp. paratuberculosis
caucccggccaccccgc

SEQ ID NO: 811236 - RNA, 16 nt, Mycobacterium avium subsp. paratuberculosis
caucccggagccgucg

SEQ ID NO: 811237 - RNA, 18 nt, Mycobacterium avium subsp. paratuberculosis
caucccggagccgucggc

SEQ ID NO: 811238 - RNA, 15 nt, Mycobacterium avium subsp. paratuberculosis
caucccggugccgcu

SEQ ID NO: 811239 - RNA, 23 nt, Mycobacterium avium subsp. paratuberculosis
caucccgauccgcgccgccgcca

SEQ ID NO: 811240 - RNA, 14 nt, Mycobacterium avium subsp. paratuberculosis
caucccgaucgacg

SEQ ID NO: 811241 - RNA, 19 nt, Mycobacterium avium subsp. paratuberculosis
caucccgaucgacgucagc

SEQ ID NO: 811242 - RNA, 17 nt, Mycobacterium avium subsp. paratuberculosis
caucccgaugucggcga

SEQ ID NO: 811243 - RNA, 21 nt, Mycobacterium avium subsp. paratuberculosis
caucccgcaauugcgccagca

SEQ ID NO: 811244 - RNA, 22 nt, Mycobacterium avium subsp. paratuberculosis
caucccgcaauugcgccagcag

SEQ ID NO: 811245 - RNA, 13 nt, Mycobacterium avium subsp. paratuberculosis
caucccgccgggc

SEQ ID NO: 811246 - RNA, 23 nt, Mycobacterium avium subsp. paratuberculosis
caucccgccgggcaucucguugu

SEQ ID NO: 811247 - RNA, 20 nt, Mycobacterium avium subsp. paratuberculosis
caucccgcugaagccgaacg

SEQ ID NO: 811248 - RNA, 22 nt, Mycobacterium avium subsp. paratuberculosis
caucccgcugaagccgaacgcg

SEQ ID NO: 811249 - RNA, 15 nt, Mycobacterium avium subsp. paratuberculosis
caucccgcuucuggc

SEQ ID NO: 811250 - RNA, 22 nt, Mycobacterium avium subsp. paratuberculosis
caucagguugaccaggugggcg

SEQ ID NO: 811251 - RNA, 14 nt, Mycobacterium avium subsp. paratuberculosis
caucagugaccgca

SEQ ID NO: 811252 - RNA, 16 nt, Mycobacterium avium subsp. paratuberculosis
caucagugcggcccgc

SEQ ID NO: 811253 - RNA, 21 nt, Mycobacterium avium subsp. paratuberculosis
caucagugcggcccgccgggc

SEQ ID NO: 811254 - RNA, 14 nt, Mycobacterium avium subsp. paratuberculosis
caucagugcgggca

SEQ ID NO: 811255 - RNA, 16 nt, Mycobacterium avium subsp. paratuberculosis
caucaucggcacgccg

SEQ ID NO: 811256 - RNA, 19 nt, Mycobacterium avium subsp. paratuberculosis
caucaucucggcgaaguag

SEQ ID NO: 811257 - RNA, 19 nt, Mycobacterium avium subsp. paratuberculosis
caucagggcaaagaucggu

SEQ ID NO: 811258 - RNA, 22 nt, Mycobacterium avium subsp. paratuberculosis
caucaggucggugccgcggcgc

SEQ ID NO: 811259 - RNA, 22 nt, Mycobacterium avium subsp. paratuberculosis
cauaugacgccggccucucguc

SEQ ID NO: 811260 - RNA, 14 nt, Mycobacterium avium subsp. paratuberculosis
caucaccaccgccg

SEQ ID NO: 811261 - RNA, 15 nt, Mycobacterium avium subsp. paratuberculosis
caucaccaccgccgc

SEQ ID NO: 811262 - RNA, 17 nt, Mycobacterium avium subsp. paratuberculosis
caucaccaccgccgccg

SEQ ID NO: 811263 - RNA, 19 nt, Mycobacterium avium subsp. paratuberculosis
caucaccaccgccgccgac

SEQ ID NO: 811264 - RNA, 22 nt, Mycobacterium avium subsp. paratuberculosis
caucaccacgcuguagggccac

SEQ ID NO: 811265 - RNA, 17 nt, Mycobacterium avium subsp. paratuberculosis
caucaccagcagacccg

SEQ ID NO: 811266 - RNA, 13 nt, Mycobacterium avium subsp. paratuberculosis
caucacccggcgc

SEQ ID NO: 811267 - RNA, 14 nt, Mycobacterium avium subsp. paratuberculosis
caucacccggcgcg

SEQ ID NO: 811268 - RNA, 14 nt, Mycobacterium avium subsp. paratuberculosis
caucacccggcggc

SEQ ID NO: 811269 - RNA, 14 nt, Mycobacterium avium subsp. paratuberculosis
caucaccagcgcgu

SEQ ID NO: 811270 - RNA, 15 nt, Mycobacterium avium subsp. paratuberculosis
caucaccagcggcug

SEQ ID NO: 811271 - RNA, 13 nt, Mycobacterium avium subsp. paratuberculosis
caucaccggcgcg

SEQ ID NO: 811272 - RNA, 15 nt, Mycobacterium avium subsp. paratuberculosis
caucacgugcuggcg

SEQ ID NO: 811273 - RNA, 19 nt, Mycobacterium avium subsp. paratuberculosis
caucaccgcgggcgcgccg

SEQ ID NO: 811274 - RNA, 13 nt, Mycobacterium avium subsp. paratuberculosis
caucaccggaccg

SEQ ID NO: 811275 - RNA, 21 nt, Mycobacterium avium subsp. paratuberculosis
caucaccggaccggccagcag

SEQ ID NO: 811276 - RNA, 23 nt, Mycobacterium avium subsp. paratuberculosis
caucaccggaccggccagcagcc

SEQ ID NO: 811277 - RNA, 18 nt, Mycobacterium avium subsp. paratuberculosis
caucaccgaggucaccgc

SEQ ID NO: 811278 - RNA, 15 nt, Mycobacterium avium subsp. paratuberculosis
caucaccgcaccgac

SEQ ID NO: 811279 - RNA, 19 nt, Mycobacterium avium subsp. paratuberculosis
caguagaaguggccgaccg

SEQ ID NO: 811280 - RNA, 14 nt, Mycobacterium avium subsp. paratuberculosis
caguagacgccgcc

SEQ ID NO: 811281 - RNA, 16 nt, Mycobacterium avium subsp. paratuberculosis
caguagacgccgccgu

SEQ ID NO: 811282 - RNA, 14 nt, Mycobacterium avium subsp. paratuberculosis
caguagcagcgucu

SEQ ID NO: 811283 - RNA, 20 nt, Mycobacterium avium subsp. paratuberculosis
caguagcggaaguacaccgg

SEQ ID NO: 811284 - RNA, 16 nt, Mycobacterium avium subsp. paratuberculosis
caguagccgacgugcc

SEQ ID NO: 811285 - RNA, 20 nt, Mycobacterium avium subsp. paratuberculosis
caguagccgaucuccaccga

SEQ ID NO: 811286 - RNA, 13 nt, Mycobacterium avium subsp. paratuberculosis
cagucccagaucg

SEQ ID NO: 811287 - RNA, 13 nt, Mycobacterium avium subsp. paratuberculosis
cagucccagcaca

SEQ ID NO: 811288 - RNA, 13 nt, Mycobacterium avium subsp. paratuberculosis
cagucccaguugu

SEQ ID NO: 811289 - RNA, 20 nt, Mycobacterium avium subsp. paratuberculosis
cagucccagcacagccgucg

SEQ ID NO: 811290 - RNA, 14 nt, Mycobacterium avium subsp. paratuberculosis
cagucccgcguugu

SEQ ID NO: 811291 - RNA, 23 nt, Mycobacterium avium subsp. paratuberculosis
cagucccgcguugugcaccaaca

SEQ ID NO: 811292 - RNA, 14 nt, Mycobacterium avium subsp. paratuberculosis
caguccgacgcgac

SEQ ID NO: 811293 - RNA, 13 nt, Mycobacterium avium subsp. paratuberculosis
caguccgccccga

SEQ ID NO: 811294 - RNA, 12 nt, Mycobacterium avium subsp. paratuberculosis
caguccgccgcc

SEQ ID NO: 811295 - RNA, 22 nt, Mycobacterium avium subsp. paratuberculosis
caguccgccggagaccagcagc

SEQ ID NO: 811296 - RNA, 15 nt, Mycobacterium avium subsp. paratuberculosis
caguccgcgccgguc

SEQ ID NO: 811297 - RNA, 22 nt, Mycobacterium avium subsp. paratuberculosis
caguccgcgccggucccgcggc

SEQ ID NO: 811298 - RNA, 23 nt, Mycobacterium avium subsp. paratuberculosis
caguccgcgccggucccgcggcg

SEQ ID NO: 811299 - RNA, 19 nt, Mycobacterium avium subsp. paratuberculosis
caguccgcgugacaagccg

SEQ ID NO: 811300 - RNA, 20 nt, Mycobacterium avium subsp. paratuberculosis
caguccggacacggccagcg

SEQ ID NO: 811301 - RNA, 22 nt, Mycobacterium avium subsp. paratuberculosis
caguccggacacggccagcgcc

SEQ ID NO: 811302 - RNA, 22 nt, Mycobacterium avium subsp. paratuberculosis
cagguuucgcucgucggcgcgg

SEQ ID NO: 811303 - RNA, 24 nt, Mycobacterium avium subsp. paratuberculosis
cagguuucgcucgucggcgcgggc

SEQ ID NO: 811304 - RNA, 15 nt, Mycobacterium avium subsp. paratuberculosis
cagguuugagcgugc

SEQ ID NO: 811305 - RNA, 20 nt, Mycobacterium avium subsp. paratuberculosis
caguacagcuaggccagcag

SEQ ID NO: 811306 - RNA, 23 nt, Mycobacterium avium subsp. paratuberculosis
caguacagcuaggccagcagcgc

SEQ ID NO: 811307 - RNA, 16 nt, Mycobacterium avium subsp. paratuberculosis
caguacgcaucggcgc

SEQ ID NO: 811308 - RNA, 13 nt, Mycobacterium avium subsp. paratuberculosis
caguaccggcgau

SEQ ID NO: 811309 - RNA, 18 nt, Mycobacterium avium subsp. paratuberculosis
caguaccagcggccgucg

SEQ ID NO: 811310 - RNA, 20 nt, Mycobacterium avium subsp. paratuberculosis
cagguuguccagccggugca

SEQ ID NO: 811311 - RNA, 23 nt, Mycobacterium avium subsp. paratuberculosis
cagguugucgcugaacgccccgu

SEQ ID NO: 811312 - RNA, 17 nt, Mycobacterium avium subsp. paratuberculosis
cagguugucgccgcgcc

SEQ ID NO: 811313 - RNA, 18 nt, Mycobacterium avium subsp. paratuberculosis
cagguugucgccgcgcca

SEQ ID NO: 811314 - RNA, 13 nt, Mycobacterium avium subsp. paratuberculosis
cagguuggcggcg

SEQ ID NO: 811315 - RNA, 17 nt, Mycobacterium avium subsp. paratuberculosis
cagguuggggacggcga

SEQ ID NO: 811316 - RNA, 15 nt, Mycobacterium avium subsp. paratuberculosis
cagguuggggccgau

SEQ ID NO: 811317 - RNA, 14 nt, Mycobacterium avium subsp. paratuberculosis
cagguuggcgccga

SEQ ID NO: 811318 - RNA, 20 nt, Mycobacterium avium subsp. paratuberculosis
cagguuggucagcagcagcg

SEQ ID NO: 811319 - RNA, 21 nt, Mycobacterium avium subsp. paratuberculosis
cagguuggucagcagcagcgc

SEQ ID NO: 811320 - RNA, 16 nt, Mycobacterium avium subsp. paratuberculosis
cagguuguagucggcg

SEQ ID NO: 811321 - RNA, 13 nt, Mycobacterium avium subsp. paratuberculosis
cagguggccgcuu

SEQ ID NO: 811322 - RNA, 13 nt, Mycobacterium avium subsp. paratuberculosis
caggugggcgcgc

SEQ ID NO: 811323 - RNA, 16 nt, Mycobacterium avium subsp. paratuberculosis
caggugggcggccacc

SEQ ID NO: 811324 - RNA, 13 nt, Mycobacterium avium subsp. paratuberculosis
cagguggcgcccg

SEQ ID NO: 811325 - RNA, 18 nt, Mycobacterium avium subsp. paratuberculosis
cagguggggcacgggcgg

SEQ ID NO: 811326 - RNA, 14 nt, Mycobacterium avium subsp. paratuberculosis
cagguggucggcga

SEQ ID NO: 811327 - RNA, 14 nt, Mycobacterium avium subsp. paratuberculosis
cagguggucgguga

SEQ ID NO: 811328 - RNA, 19 nt, Mycobacterium avium subsp. paratuberculosis
caggugggugaacgccugc

SEQ ID NO: 811329 - RNA, 23 nt, Mycobacterium avium subsp. paratuberculosis
caggugggugaacgccugcggga

SEQ ID NO: 811330 - RNA, 18 nt, Mycobacterium avium subsp. paratuberculosis
cagguugcgguguugcgc

SEQ ID NO: 811331 - RNA, 20 nt, Mycobacterium avium subsp. paratuberculosis
caggucgagguagugcgcga

SEQ ID NO: 811332 - RNA, 12 nt, Mycobacterium avium subsp. paratuberculosis
caggucgagguc

SEQ ID NO: 811333 - RNA, 20 nt, Mycobacterium avium subsp. paratuberculosis
caggucgagguccucggcga

SEQ ID NO: 811334 - RNA, 19 nt, Mycobacterium avium subsp. paratuberculosis
caggucgaccaucugccgg

SEQ ID NO: 811335 - RNA, 20 nt, Mycobacterium avium subsp. paratuberculosis
caggucgaccaucugccggc

SEQ ID NO: 811336 - RNA, 21 nt, Mycobacterium avium subsp. paratuberculosis
cagguccgguucgaccggcgu

SEQ ID NO: 811337 - RNA, 16 nt, Mycobacterium avium subsp. paratuberculosis
caggucgaggccggcc

SEQ ID NO: 811338 - RNA, 15 nt, Mycobacterium avium subsp. paratuberculosis
caggucggggcccgu

SEQ ID NO: 811339 - RNA, 21 nt, Mycobacterium avium subsp. paratuberculosis
caggucgggguccaggccgcg

SEQ ID NO: 811340 - RNA, 16 nt, Mycobacterium avium subsp. paratuberculosis
caggucggggugggcg

SEQ ID NO: 811341 - RNA, 15 nt, Mycobacterium avium subsp. paratuberculosis
caggucgaucagcgg

SEQ ID NO: 811342 - RNA, 19 nt, Mycobacterium avium subsp. paratuberculosis
caggucgaucucggccagc

SEQ ID NO: 811343 - RNA, 18 nt, Mycobacterium avium subsp. paratuberculosis
caggucgaucugcggcac

SEQ ID NO: 811344 - RNA, 19 nt, Mycobacterium avium subsp. paratuberculosis
caggucgaucugcggcacg

SEQ ID NO: 811345 - RNA, 18 nt, Mycobacterium avium subsp. paratuberculosis
caggucggcggucgcggu

SEQ ID NO: 811346 - RNA, 13 nt, Mycobacterium avium subsp. paratuberculosis
caggucggcguga

SEQ ID NO: 811347 - RNA, 13 nt, Mycobacterium avium subsp. paratuberculosis
caggucggcgugc

SEQ ID NO: 811348 - RNA, 23 nt, Mycobacterium avium subsp. paratuberculosis
caggucggcgugcagcacgggga

SEQ ID NO: 811349 - RNA, 18 nt, Mycobacterium avium subsp. paratuberculosis
caggucguugccggugcc

SEQ ID NO: 811350 - RNA, 20 nt, Mycobacterium avium subsp. paratuberculosis
caggucguugccggugccga

SEQ ID NO: 811351 - RNA, 14 nt, Mycobacterium avium subsp. paratuberculosis
caggucgucgacgu

SEQ ID NO: 811352 - RNA, 16 nt, Mycobacterium avium subsp. paratuberculosis
caggucgucgacgucg

SEQ ID NO: 811353 - RNA, 12 nt, Mycobacterium avium subsp. paratuberculosis
caggucgucgau

SEQ ID NO: 811354 - RNA, 18 nt, Mycobacterium avium subsp. paratuberculosis
caggucgucgaucagggc

SEQ ID NO: 811355 - RNA, 14 nt, Mycobacterium avium subsp. paratuberculosis
caggucggugccgc

SEQ ID NO: 811356 - RNA, 18 nt, Mycobacterium avium subsp. paratuberculosis
caggucggugccgcggcg

SEQ ID NO: 811357 - RNA, 22 nt, Mycobacterium avium subsp. paratuberculosis
caggucggugcgcgggguggcg

SEQ ID NO: 811358 - RNA, 13 nt, Mycobacterium avium subsp. paratuberculosis
caggucggucacc

SEQ ID NO: 811359 - RNA, 19 nt, Mycobacterium avium subsp. paratuberculosis
caggugcagcagcagccac

SEQ ID NO: 811360 - RNA, 14 nt, Mycobacterium avium subsp. paratuberculosis
caggugcagcgugg

SEQ ID NO: 811361 - RNA, 22 nt, Mycobacterium avium subsp. paratuberculosis
caggugcagcuccuugagccgc

SEQ ID NO: 811362 - RNA, 14 nt, Mycobacterium avium subsp. paratuberculosis
caggugcacgccga

SEQ ID NO: 811363 - RNA, 18 nt, Mycobacterium avium subsp. paratuberculosis
caggugcacgccgagcag

SEQ ID NO: 811364 - RNA, 22 nt, Mycobacterium avium subsp. paratuberculosis
caggugcagaccggacagcugg

SEQ ID NO: 811365 - RNA, 17 nt, Mycobacterium avium subsp. paratuberculosis
caggugcccgucggccu

SEQ ID NO: 811366 - RNA, 17 nt, Mycobacterium avium subsp. paratuberculosis
caggugcauccagucgg

SEQ ID NO: 811367 - RNA, 17 nt, Mycobacterium avium subsp. paratuberculosis
caggugcaucgaccggc

SEQ ID NO: 811368 - RNA, 15 nt, Mycobacterium avium subsp. paratuberculosis
caggugcaucgccac

SEQ ID NO: 811369 - RNA, 20 nt, Mycobacterium avium subsp. paratuberculosis
caggugcaucgccaccgucg

SEQ ID NO: 811370 - RNA, 22 nt, Mycobacterium avium subsp. paratuberculosis
caggugcaucgccaccgucguc

SEQ ID NO: 811371 - RNA, 13 nt, Mycobacterium avium subsp. paratuberculosis
caggugccggcgg

SEQ ID NO: 811372 - RNA, 18 nt, Mycobacterium avium subsp. paratuberculosis
caggugccggcggcgcgg

SEQ ID NO: 811373 - RNA, 13 nt, Mycobacterium avium subsp. paratuberculosis
caggugccgguga

SEQ ID NO: 811374 - RNA, 18 nt, Mycobacterium avium subsp. paratuberculosis
caggugccggugacgguc

SEQ ID NO: 811375 - RNA, 19 nt, Mycobacterium avium subsp. paratuberculosis
cagguggauggucaccggg

SEQ ID NO: 811376 - RNA, 20 nt, Mycobacterium avium subsp. paratuberculosis
cagguggauggucaccgggg

SEQ ID NO: 811377 - RNA, 19 nt, Mycobacterium avium subsp. paratuberculosis
cagguggauugucggccgc

SEQ ID NO: 811378 - RNA, 18 nt, Mycobacterium avium subsp. paratuberculosis
cagguggccgaucagcgg

SEQ ID NO: 811379 - RNA, 19 nt, Mycobacterium avium subsp. paratuberculosis
cagguggccgaucagcggc

SEQ ID NO: 811380 - RNA, 20 nt, Mycobacterium avium subsp. paratuberculosis
cagguggccgaucagcggcg

SEQ ID NO: 811381 - RNA, 22 nt, Mycobacterium avium subsp. paratuberculosis
cagguggccgaucagcggcggg

SEQ ID NO: 811382 - RNA, 19 nt, Mycobacterium avium subsp. paratuberculosis
cagguggcguagucggugc

SEQ ID NO: 811383 - RNA, 16 nt, Mycobacterium avium subsp. paratuberculosis
cagguggcgucggcgu

SEQ ID NO: 811384 - RNA, 21 nt, Mycobacterium avium subsp. paratuberculosis
cagguggcgucggcgucgaac

SEQ ID NO: 811385 - RNA, 22 nt, Mycobacterium avium subsp. paratuberculosis
cagguggcgucggcgucgaacg

SEQ ID NO: 811386 - RNA, 14 nt, Mycobacterium avium subsp. paratuberculosis
cagguccgugguga

SEQ ID NO: 811387 - RNA, 19 nt, Mycobacterium avium subsp. paratuberculosis
cagguccucgcuggcgauc

SEQ ID NO: 811388 - RNA, 18 nt, Mycobacterium avium subsp. paratuberculosis
cagguccucuucauaccg

SEQ ID NO: 811389 - RNA, 24 nt, Mycobacterium avium subsp. paratuberculosis
cagguccgcgaacucgucgacgcc

SEQ ID NO: 811390 - RNA, 16 nt, Mycobacterium avium subsp. paratuberculosis
cagguccgggcacucg

SEQ ID NO: 811391 - RNA, 21 nt, Mycobacterium avium subsp. paratuberculosis
cagguccgggcacucgagcgu

SEQ ID NO: 811392 - RNA, 22 nt, Mycobacterium avium subsp. paratuberculosis
cagguccgccggugccagcaac

SEQ ID NO: 811393 - RNA, 20 nt, Mycobacterium avium subsp. paratuberculosis
caggucaugguggcggcgcc

SEQ ID NO: 811394 - RNA, 16 nt, Mycobacterium avium subsp. paratuberculosis
caggucccaggcgugg

SEQ ID NO: 811395 - RNA, 19 nt, Mycobacterium avium subsp. paratuberculosis
caggucgaagcgcagcacc

SEQ ID NO: 811396 - RNA, 17 nt, Mycobacterium avium subsp. paratuberculosis
caggucgaaggcggccg

SEQ ID NO: 811397 - RNA, 18 nt, Mycobacterium avium subsp. paratuberculosis
caggucgaaggcggccgc

SEQ ID NO: 811398 - RNA, 22 nt, Mycobacterium avium subsp. paratuberculosis
caggucgaaggcggccgcgagc

SEQ ID NO: 811399 - RNA, 17 nt, Mycobacterium avium subsp. paratuberculosis
caggucgaagggcaucg

SEQ ID NO: 811400 - RNA, 19 nt, Mycobacterium avium subsp. paratuberculosis
cagguccuugaggaugcgc

SEQ ID NO: 811401 - RNA, 19 nt, Mycobacterium avium subsp. paratuberculosis
caggucgaagaggugcucg

SEQ ID NO: 811402 - RNA, 23 nt, Mycobacterium avium subsp. paratuberculosis
caggucgaagaggugcucgacgg

SEQ ID NO: 811403 - RNA, 15 nt, Mycobacterium avium subsp. paratuberculosis
cagguccuugcgcgc

SEQ ID NO: 811404 - RNA, 16 nt, Mycobacterium avium subsp. paratuberculosis
cagguccuugcgcgcc

SEQ ID NO: 811405 - RNA, 17 nt, Mycobacterium avium subsp. paratuberculosis
cagguccuugcgcgccg

SEQ ID NO: 811406 - RNA, 18 nt, Mycobacterium avium subsp. paratuberculosis
cagguccuugcgcgccgc

SEQ ID NO: 811407 - RNA, 20 nt, Mycobacterium avium subsp. paratuberculosis
cagguccuugcgcgccgcga

SEQ ID NO: 811408 - RNA, 13 nt, Mycobacterium avium subsp. paratuberculosis
caggucgaccggc

SEQ ID NO: 811409 - RNA, 15 nt, Mycobacterium avium subsp. paratuberculosis
caggucgaccggcuc

SEQ ID NO: 811410 - RNA, 16 nt, Mycobacterium avium subsp. paratuberculosis
caggucgaccggcucg

SEQ ID NO: 811411 - RNA, 20 nt, Mycobacterium avium subsp. paratuberculosis
caggucgaccggcucgccgu

SEQ ID NO: 811412 - RNA, 21 nt, Mycobacterium avium subsp. paratuberculosis
caggucgaccggcucgccguu

SEQ ID NO: 811413 - RNA, 17 nt, Mycobacterium avium subsp. paratuberculosis
caggucgacggggucgg

SEQ ID NO: 811414 - RNA, 15 nt, Mycobacterium avium subsp. paratuberculosis
cagguaggcgccgcu

SEQ ID NO: 811415 - RNA, 15 nt, Mycobacterium avium subsp. paratuberculosis
caggucaaccaggcc

SEQ ID NO: 811416 - RNA, 13 nt, Mycobacterium avium subsp. paratuberculosis
cagguccaccagg

SEQ ID NO: 811417 - RNA, 16 nt, Mycobacterium avium subsp. paratuberculosis
cagguccaccagguga

SEQ ID NO: 811418 - RNA, 21 nt, Mycobacterium avium subsp. paratuberculosis
cagguccacccgccccgccgc

SEQ ID NO: 811419 - RNA, 23 nt, Mycobacterium avium subsp. paratuberculosis
cagguccacccgccccgccgcgg

SEQ ID NO: 811420 - RNA, 14 nt, Mycobacterium avium subsp. paratuberculosis
caggucaccgcgcg

SEQ ID NO: 811421 - RNA, 22 nt, Mycobacterium avium subsp. paratuberculosis
caggucaccggaugcacgugca

SEQ ID NO: 811422 - RNA, 12 nt, Mycobacterium avium subsp. paratuberculosis
cagggcggugcg

SEQ ID NO: 811423 - RNA, 15 nt, Mycobacterium avium subsp. paratuberculosis
cagggggcgcagccg

SEQ ID NO: 811424 - RNA, 19 nt, Mycobacterium avium subsp. paratuberculosis
cagggggcgcagccgaucg

SEQ ID NO: 811425 - RNA, 19 nt, Mycobacterium avium subsp. paratuberculosis
cagggggaguagucggcga

SEQ ID NO: 811426 - RNA, 22 nt, Mycobacterium avium subsp. paratuberculosis
caggggucccaggugggcgcgc

SEQ ID NO: 811427 - RNA, 15 nt, Mycobacterium avium subsp. paratuberculosis
cagggguuggcgcgc

SEQ ID NO: 811428 - RNA, 17 nt, Mycobacterium avium subsp. paratuberculosis
caggguagaggcggcga

SEQ ID NO: 811429 - RNA, 19 nt, Mycobacterium avium subsp. paratuberculosis
caggguagaggcggcgacc

SEQ ID NO: 811430 - RNA, 21 nt, Mycobacterium avium subsp. paratuberculosis
caggguagaggcggcgaccgc

SEQ ID NO: 811431 - RNA, 21 nt, Mycobacterium avium subsp. paratuberculosis
cagggcgcgcaucugcucggc

SEQ ID NO: 811432 - RNA, 19 nt, Mycobacterium avium subsp. paratuberculosis
cagggcgcggcgcaccgag

SEQ ID NO: 811433 - RNA, 22 nt, Mycobacterium avium subsp. paratuberculosis
cagggcgcucaucaggcggccg

SEQ ID NO: 811434 - RNA, 17 nt, Mycobacterium avium subsp. paratuberculosis
cagggcgccgacgaucc

SEQ ID NO: 811435 - RNA, 17 nt, Mycobacterium avium subsp. paratuberculosis
cagggcgcgcaccgguu

SEQ ID NO: 811436 - RNA, 14 nt, Mycobacterium avium subsp. paratuberculosis
cagggcgccgguga

SEQ ID NO: 811437 - RNA, 14 nt, Mycobacterium avium subsp. paratuberculosis
cagggcgccgacga

SEQ ID NO: 811438 - RNA, 17 nt, Mycobacterium avium subsp. paratuberculosis
cagggcgggcaggcccg

SEQ ID NO: 811439 - RNA, 17 nt, Mycobacterium avium subsp. paratuberculosis
cagggcggcgcgcgcca

SEQ ID NO: 811440 - RNA, 22 nt, Mycobacterium avium subsp. paratuberculosis
cagggcggcgcgcgccagcguc

SEQ ID NO: 811441 - RNA, 11 nt, Mycobacterium avium subsp. paratuberculosis
cagggcggcgc

SEQ ID NO: 811442 - RNA, 14 nt, Mycobacterium avium subsp. paratuberculosis
cagggcggcgccgc

SEQ ID NO: 811443 - RNA, 18 nt, Mycobacterium avium subsp. paratuberculosis
cagggcggcgccgcggcc

SEQ ID NO: 811444 - RNA, 19 nt, Mycobacterium avium subsp. paratuberculosis
cagggcggcgccgcggccc

SEQ ID NO: 811445 - RNA, 16 nt, Mycobacterium avium subsp. paratuberculosis
cagggcggcgccggca

SEQ ID NO: 811446 - RNA, 17 nt, Mycobacterium avium subsp. paratuberculosis
cagggcggcgccggcac

SEQ ID NO: 811447 - RNA, 12 nt, Mycobacterium avium subsp. paratuberculosis
cagggcggccgg

SEQ ID NO: 811448 - RNA, 17 nt, Mycobacterium avium subsp. paratuberculosis
cagggcggccggccagu

SEQ ID NO: 811449 - RNA, 14 nt, Mycobacterium avium subsp. paratuberculosis
cagggcggcaccga

SEQ ID NO: 811450 - RNA, 19 nt, Mycobacterium avium subsp. paratuberculosis
cagggcggcaccgaucggc

SEQ ID NO: 811451 - RNA, 24 nt, Mycobacterium avium subsp. paratuberculosis
cagggcggcaccgaucggcacguc

SEQ ID NO: 811452 - RNA, 17 nt, Mycobacterium avium subsp. paratuberculosis
cagggccaagacacgcu

SEQ ID NO: 811453 - RNA, 11 nt, Mycobacterium avium subsp. paratuberculosis
cagggccaccg

SEQ ID NO: 811454 - RNA, 13 nt, Mycobacterium avium subsp. paratuberculosis
cagggccaccgcg

SEQ ID NO: 811455 - RNA, 21 nt, Mycobacterium avium subsp. paratuberculosis
cagggccagcaacaccagcug

SEQ ID NO: 811456 - RNA, 23 nt, Mycobacterium avium subsp. paratuberculosis
cagggccagcaacaccagcugga

SEQ ID NO: 811457 - RNA, 17 nt, Mycobacterium avium subsp. paratuberculosis
cagggccagcaccauga

SEQ ID NO: 811458 - RNA, 17 nt, Mycobacterium avium subsp. paratuberculosis
cagggccagcagcccgg

SEQ ID NO: 811459 - RNA, 19 nt, Mycobacterium avium subsp. paratuberculosis
cagggcauccgggaggcca

SEQ ID NO: 811460 - RNA, 17 nt, Mycobacterium avium subsp. paratuberculosis
cagggccccguuggugc

SEQ ID NO: 811461 - RNA, 20 nt, Mycobacterium avium subsp. paratuberculosis
cagggccccguuggugcggu

SEQ ID NO: 811462 - RNA, 22 nt, Mycobacterium avium subsp. paratuberculosis
cagggccccguuggugcggugc

SEQ ID NO: 811463 - RNA, 20 nt, Mycobacterium avium subsp. paratuberculosis
cagggcccacagcagccgca

SEQ ID NO: 811464 - RNA, 20 nt, Mycobacterium avium subsp. paratuberculosis
cagggccagguucaggcccg

SEQ ID NO: 811465 - RNA, 22 nt, Mycobacterium avium subsp. paratuberculosis
cagggccagguucaggcccgcg

SEQ ID NO: 811466 - RNA, 14 nt, Mycobacterium avium subsp. paratuberculosis
cagggccagcgcca

SEQ ID NO: 811467 - RNA, 15 nt, Mycobacterium avium subsp. paratuberculosis
cagggccagcgccau

SEQ ID NO: 811468 - RNA, 23 nt, Mycobacterium avium subsp. paratuberculosis
cagggccagcgccaugccgccga

SEQ ID NO: 811469 - RNA, 16 nt, Mycobacterium avium subsp. paratuberculosis
cagggccaccgcgucg

SEQ ID NO: 811470 - RNA, 21 nt, Mycobacterium avium subsp. paratuberculosis
cagggccaccgcgucgcugcc

SEQ ID NO: 811471 - RNA, 14 nt, Mycobacterium avium subsp. paratuberculosis
cagggccaccguca

SEQ ID NO: 811472 - RNA, 12 nt, Mycobacterium avium subsp. paratuberculosis
cagggccagcgc

SEQ ID NO: 811473 - RNA, 17 nt, Mycobacterium avium subsp. paratuberculosis
cagggcgauggccaugg

SEQ ID NO: 811474 - RNA, 16 nt, Mycobacterium avium subsp. paratuberculosis
cagggccgggcgugcc

SEQ ID NO: 811475 - RNA, 18 nt, Mycobacterium avium subsp. paratuberculosis
cagggcgacuccggcgcc

SEQ ID NO: 811476 - RNA, 22 nt, Mycobacterium avium subsp. paratuberculosis
cagggcgacuccggcgccgguc

SEQ ID NO: 811477 - RNA, 17 nt, Mycobacterium avium subsp. paratuberculosis
cagggcgaggaacccga

SEQ ID NO: 811478 - RNA, 22 nt, Mycobacterium avium subsp. paratuberculosis
cagggcgaggaacccgaccgcg

SEQ ID NO: 811479 - RNA, 24 nt, Mycobacterium avium subsp. paratuberculosis
cagggcgauaaccucggcggcggc

SEQ ID NO: 811480 - RNA, 15 nt, Mycobacterium avium subsp. paratuberculosis
cagggcgaucaccgc

SEQ ID NO: 811481 - RNA, 18 nt, Mycobacterium avium subsp. paratuberculosis
cagggcgaucaccgcggc

SEQ ID NO: 811482 - RNA, 20 nt, Mycobacterium avium subsp. paratuberculosis
cagggcgaucaccgcggcca

SEQ ID NO: 811483 - RNA, 13 nt, Mycobacterium avium subsp. paratuberculosis
cagggccgcgcgg

SEQ ID NO: 811484 - RNA, 18 nt, Mycobacterium avium subsp. paratuberculosis
cagggccgcgcgggcgac

SEQ ID NO: 811485 - RNA, 21 nt, Mycobacterium avium subsp. paratuberculosis
cagggccgcgcgggcgaccug

SEQ ID NO: 811486 - RNA, 14 nt, Mycobacterium avium subsp. paratuberculosis
cagggccgcggccg

SEQ ID NO: 811487 - RNA, 18 nt, Mycobacterium avium subsp. paratuberculosis
cagggccgcggccgccgc

SEQ ID NO: 811488 - RNA, 19 nt, Mycobacterium avium subsp. paratuberculosis
cagggccgcggccgccgcg

SEQ ID NO: 811489 - RNA, 19 nt, Mycobacterium avium subsp. paratuberculosis
cagggccgcuacgccgagg

SEQ ID NO: 811490 - RNA, 15 nt, Mycobacterium avium subsp. paratuberculosis
cagggcccgcagccg

SEQ ID NO: 811491 - RNA, 16 nt, Mycobacterium avium subsp. paratuberculosis
cagggcccgcagccgc

SEQ ID NO: 811492 - RNA, 13 nt, Mycobacterium avium subsp. paratuberculosis
cagggccgccgca

SEQ ID NO: 811493 - RNA, 22 nt, Mycobacterium avium subsp. paratuberculosis
cagggccgccgcauaccgcccg

SEQ ID NO: 811494 - RNA, 15 nt, Mycobacterium avium subsp. paratuberculosis
cagguagaagccgcg

SEQ ID NO: 811495 - RNA, 16 nt, Mycobacterium avium subsp. paratuberculosis
cagguagaagccgcga

SEQ ID NO: 811496 - RNA, 17 nt, Mycobacterium avium subsp. paratuberculosis
cagguacuccucggugu

SEQ ID NO: 811497 - RNA, 18 nt, Mycobacterium avium subsp. paratuberculosis
cagguacuccucggugug

SEQ ID NO: 811498 - RNA, 18 nt, Mycobacterium avium subsp. paratuberculosis
cagguacugaucaccgcg

SEQ ID NO: 811499 - RNA, 19 nt, Mycobacterium avium subsp. paratuberculosis
cagguacugaucaccgcgc

SEQ ID NO: 811500 - RNA, 22 nt, Mycobacterium avium subsp. paratuberculosis
cagguacugcuugccgccgggc

SEQ ID NO: 811501 - RNA, 22 nt, Mycobacterium avium subsp. paratuberculosis
cagguacugggcguggucgccg

SEQ ID NO: 811502 - RNA, 13 nt, Mycobacterium avium subsp. paratuberculosis
cagguagcaggcg

SEQ ID NO: 811503 - RNA, 19 nt, Mycobacterium avium subsp. paratuberculosis
cagguagacgaugcccagc

SEQ ID NO: 811504 - RNA, 22 nt, Mycobacterium avium subsp. paratuberculosis
cagguagacgaugcccagcccc

SEQ ID NO: 811505 - RNA, 23 nt, Mycobacterium avium subsp. paratuberculosis
cagguagaggcuguccagcagcg

SEQ ID NO: 811506 - RNA, 19 nt, Mycobacterium avium subsp. paratuberculosis
cagguagccgaggucgccg

SEQ ID NO: 811507 - RNA, 22 nt, Mycobacterium avium subsp. paratuberculosis
cagguagccgccguagccggcg

SEQ ID NO: 811508 - RNA, 18 nt, Mycobacterium avium subsp. paratuberculosis
cagguaguagcgcgccgg

SEQ ID NO: 811509 - RNA, 19 nt, Mycobacterium avium subsp. paratuberculosis
cagguaguagcgcgccggg

SEQ ID NO: 811510 - RNA, 14 nt, Mycobacterium avium subsp. paratuberculosis
cagguaggcggcgc

SEQ ID NO: 811511 - RNA, 17 nt, Mycobacterium avium subsp. paratuberculosis
cagguaggcggcgccgu

SEQ ID NO: 811512 - RNA, 20 nt, Mycobacterium avium subsp. paratuberculosis
cagguaggcggcgccgucga

SEQ ID NO: 811513 - RNA, 23 nt, Mycobacterium avium subsp. paratuberculosis
cagguaggcggcgccgucgacca

SEQ ID NO: 811514 - RNA, 17 nt, Mycobacterium avium subsp. paratuberculosis
cagguaggcgguggcgc

SEQ ID NO: 811515 - RNA, 14 nt, Mycobacterium avium subsp. paratuberculosis
cagguaggcgucga

SEQ ID NO: 811516 - RNA, 16 nt, Mycobacterium avium subsp. paratuberculosis
cagguagguggccagc

SEQ ID NO: 811517 - RNA, 18 nt, Mycobacterium avium subsp. paratuberculosis
cagguagguggccagccg

SEQ ID NO: 811518 - RNA, 14 nt, Mycobacterium avium subsp. paratuberculosis
cagguaggcgacca

SEQ ID NO: 811519 - RNA, 20 nt, Mycobacterium avium subsp. paratuberculosis
cagguagcccaugucgccgg

SEQ ID NO: 811520 - RNA, 16 nt, Mycobacterium avium subsp. paratuberculosis
cagguagcgcagcccg

SEQ ID NO: 811521 - RNA, 15 nt, Mycobacterium avium subsp. paratuberculosis
cagguaaaccagcag

SEQ ID NO: 811522 - RNA, 22 nt, Mycobacterium avium subsp. paratuberculosis
cagguaaucgaaggccaggugc

SEQ ID NO: 811523 - RNA, 14 nt, Mycobacterium avium subsp. paratuberculosis
cagguacacguagc

SEQ ID NO: 811524 - RNA, 14 nt, Mycobacterium avium subsp. paratuberculosis
cagguaccggcggg

SEQ ID NO: 811525 - RNA, 15 nt, Mycobacterium avium subsp. paratuberculosis
cagguaccggcgggc

SEQ ID NO: 811526 - RNA, 13 nt, Mycobacterium avium subsp. paratuberculosis
cagguacgcggcg

SEQ ID NO: 811527 - RNA, 17 nt, Mycobacterium avium subsp. paratuberculosis
caggguuuucacgucga

SEQ ID NO: 811528 - RNA, 20 nt, Mycobacterium avium subsp. paratuberculosis
caggguuuucacgucgagcg

SEQ ID NO: 811529 - RNA, 20 nt, Mycobacterium avium subsp. paratuberculosis
caggguucucgcggcggccg

SEQ ID NO: 811530 - RNA, 16 nt, Mycobacterium avium subsp. paratuberculosis
caggguuuccucgagc

SEQ ID NO: 811531 - RNA, 15 nt, Mycobacterium avium subsp. paratuberculosis
caggguuggucggag

SEQ ID NO: 811532 - RNA, 18 nt, Mycobacterium avium subsp. paratuberculosis
caggguuggucggagccg

SEQ ID NO: 811533 - RNA, 19 nt, Mycobacterium avium subsp. paratuberculosis
caggguuucaugcacggcg

SEQ ID NO: 811534 - RNA, 19 nt, Mycobacterium avium subsp. paratuberculosis
caggguguuguccgagccg

SEQ ID NO: 811535 - RNA, 23 nt, Mycobacterium avium subsp. paratuberculosis
caggguguuguccgagccgccca

SEQ ID NO: 811536 - RNA, 14 nt, Mycobacterium avium subsp. paratuberculosis
cagggugucgaaca

SEQ ID NO: 811537 - RNA, 22 nt, Mycobacterium avium subsp. paratuberculosis
cagggugcguuccagguccgcg

SEQ ID NO: 811538 - RNA, 13 nt, Mycobacterium avium subsp. paratuberculosis
caggguggggauc

SEQ ID NO: 811539 - RNA, 22 nt, Mycobacterium avium subsp. paratuberculosis
caggguggggaucacgucggcg

SEQ ID NO: 811540 - RNA, 14 nt, Mycobacterium avium subsp. paratuberculosis
caggguggucagcg

SEQ ID NO: 811541 - RNA, 16 nt, Mycobacterium avium subsp. paratuberculosis
caggguggucagcguc

SEQ ID NO: 811542 - RNA, 20 nt, Mycobacterium avium subsp. paratuberculosis
caggguggugguggugccca

SEQ ID NO: 811543 - RNA, 16 nt, Mycobacterium avium subsp. paratuberculosis
caggguguaggccgcg

SEQ ID NO: 811544 - RNA, 17 nt, Mycobacterium avium subsp. paratuberculosis
caggguguaggccgcgu

SEQ ID NO: 811545 - RNA, 19 nt, Mycobacterium avium subsp. paratuberculosis
caggguggccucgucggcg

SEQ ID NO: 811546 - RNA, 20 nt, Mycobacterium avium subsp. paratuberculosis
caggguggccucgucggcgc

SEQ ID NO: 811547 - RNA, 17 nt, Mycobacterium avium subsp. paratuberculosis
caggguggccagcaccg

SEQ ID NO: 811548 - RNA, 17 nt, Mycobacterium avium subsp. paratuberculosis
caggguggccagcacgc

SEQ ID NO: 811549 - RNA, 18 nt, Mycobacterium avium subsp. paratuberculosis
caggguggccagcacgcu

SEQ ID NO: 811550 - RNA, 18 nt, Mycobacterium avium subsp. paratuberculosis
caggguggccccagcccg

SEQ ID NO: 811551 - RNA, 19 nt, Mycobacterium avium subsp. paratuberculosis
caggguggccgccaccagg

SEQ ID NO: 811552 - RNA, 20 nt, Mycobacterium avium subsp. paratuberculosis
caggguggccgccaccaggc

SEQ ID NO: 811553 - RNA, 14 nt, Mycobacterium avium subsp. paratuberculosis
cagggugcgcagcg

SEQ ID NO: 811554 - RNA, 20 nt, Mycobacterium avium subsp. paratuberculosis
cagggugccgcugcccgccg

SEQ ID NO: 811555 - RNA, 11 nt, Mycobacterium avium subsp. paratuberculosis
cagggugccga

SEQ ID NO: 811556 - RNA, 14 nt, Mycobacterium avium subsp. paratuberculosis
cagggugccgacga

SEQ ID NO: 811557 - RNA, 14 nt, Mycobacterium avium subsp. paratuberculosis
cagggugccgccgg

SEQ ID NO: 811558 - RNA, 24 nt, Mycobacterium avium subsp. paratuberculosis
cagggugccgccgggcaccucggc

SEQ ID NO: 811559 - RNA, 15 nt, Mycobacterium avium subsp. paratuberculosis
cagggugccccgcga

SEQ ID NO: 811560 - RNA, 23 nt, Mycobacterium avium subsp. paratuberculosis
cagggugccccgcgaccgcagca

SEQ ID NO: 811561 - RNA, 16 nt, Mycobacterium avium subsp. paratuberculosis
cagggugccccgcacc

SEQ ID NO: 811562 - RNA, 21 nt, Mycobacterium avium subsp. paratuberculosis
cagggugcaggcccgggcggc

SEQ ID NO: 811563 - RNA, 23 nt, Mycobacterium avium subsp. paratuberculosis
cagggugcaggcccgggcggcga

SEQ ID NO: 811564 - RNA, 19 nt, Mycobacterium avium subsp. paratuberculosis
cagggugccaaggucgccg

SEQ ID NO: 811565 - RNA, 17 nt, Mycobacterium avium subsp. paratuberculosis
cagggugacgucguuga

SEQ ID NO: 811566 - RNA, 15 nt, Mycobacterium avium subsp. paratuberculosis
cagggucucgggcag

SEQ ID NO: 811567 - RNA, 19 nt, Mycobacterium avium subsp. paratuberculosis
cagggucucgcgcagcacg

SEQ ID NO: 811568 - RNA, 20 nt, Mycobacterium avium subsp. paratuberculosis
cagggucucgcgcagcacga

SEQ ID NO: 811569 - RNA, 20 nt, Mycobacterium avium subsp. paratuberculosis
cagggucuggcccggugcga

SEQ ID NO: 811570 - RNA, 16 nt, Mycobacterium avium subsp. paratuberculosis
cagggucuucagcccg

SEQ ID NO: 811571 - RNA, 19 nt, Mycobacterium avium subsp. paratuberculosis
cagggucuucagcccgcgc

SEQ ID NO: 811572 - RNA, 19 nt, Mycobacterium avium subsp. paratuberculosis
cagggugaccgaggccgcc

SEQ ID NO: 811573 - RNA, 17 nt, Mycobacterium avium subsp. paratuberculosis
cagggugacgauccaca

SEQ ID NO: 811574 - RNA, 16 nt, Mycobacterium avium subsp. paratuberculosis
cagggucgcggagcgg

SEQ ID NO: 811575 - RNA, 17 nt, Mycobacterium avium subsp. paratuberculosis
cagggucaucgcgccgg

SEQ ID NO: 811576 - RNA, 22 nt, Mycobacterium avium subsp. paratuberculosis
caggguccagggcgggucgucg

SEQ ID NO: 811577 - RNA, 23 nt, Mycobacterium avium subsp. paratuberculosis
caggguccagggcgggucgucga

SEQ ID NO: 811578 - RNA, 22 nt, Mycobacterium avium subsp. paratuberculosis
cagggucagcgcuuccagcgcg

SEQ ID NO: 811579 - RNA, 14 nt, Mycobacterium avium subsp. paratuberculosis
cagggucagcagca

SEQ ID NO: 811580 - RNA, 19 nt, Mycobacterium avium subsp. paratuberculosis
cagggucagcuuggagccg

SEQ ID NO: 811581 - RNA, 23 nt, Mycobacterium avium subsp. paratuberculosis
cagggucagcuuggagccgagca

SEQ ID NO: 811582 - RNA, 19 nt, Mycobacterium avium subsp. paratuberculosis
cagggucgagaucagcacc

SEQ ID NO: 811583 - RNA, 20 nt, Mycobacterium avium subsp. paratuberculosis
cagggucgagaucagcaccg

SEQ ID NO: 811584 - RNA, 21 nt, Mycobacterium avium subsp. paratuberculosis
cagggucgagaucagcaccgg

SEQ ID NO: 811585 - RNA, 17 nt, Mycobacterium avium subsp. paratuberculosis
caggaugcccgggccgu

SEQ ID NO: 811586 - RNA, 18 nt, Mycobacterium avium subsp. paratuberculosis
caggaugcuggggucggc

SEQ ID NO: 811587 - RNA, 19 nt, Mycobacterium avium subsp. paratuberculosis
caggaugcuggggucggcc

SEQ ID NO: 811588 - RNA, 20 nt, Mycobacterium avium subsp. paratuberculosis
caggaugcuggggucggcca

SEQ ID NO: 811589 - RNA, 17 nt, Mycobacterium avium subsp. paratuberculosis
caggaugcguucggcca

SEQ ID NO: 811590 - RNA, 19 nt, Mycobacterium avium subsp. paratuberculosis
caggaucucgcgggcccgc

SEQ ID NO: 811591 - RNA, 22 nt, Mycobacterium avium subsp. paratuberculosis
caggaucucgcgggcccgcgcg

SEQ ID NO: 811592 - RNA, 18 nt, Mycobacterium avium subsp. paratuberculosis
caggaucugcgcaagaag

SEQ ID NO: 811593 - RNA, 20 nt, Mycobacterium avium subsp. paratuberculosis
caggaucuugucggcggccu

SEQ ID NO: 811594 - RNA, 22 nt, Mycobacterium avium subsp. paratuberculosis
caggaucuuugcauacagcagg

SEQ ID NO: 811595 - RNA, 16 nt, Mycobacterium avium subsp. paratuberculosis
caggaugaccgcgucg

SEQ ID NO: 811596 - RNA, 14 nt, Mycobacterium avium subsp. paratuberculosis
caggaugacgccga

SEQ ID NO: 811597 - RNA, 15 nt, Mycobacterium avium subsp. paratuberculosis
caggaugacgccgcg

SEQ ID NO: 811598 - RNA, 18 nt, Mycobacterium avium subsp. paratuberculosis
caggaucggcgggcgccg

SEQ ID NO: 811599 - RNA, 19 nt, Mycobacterium avium subsp. paratuberculosis
caggaugauuucggcgugg

SEQ ID NO: 811600 - RNA, 16 nt, Mycobacterium avium subsp. paratuberculosis
caggaugcagccggcc

SEQ ID NO: 811601 - RNA, 17 nt, Mycobacterium avium subsp. paratuberculosis
caggaugcagccggcca

SEQ ID NO: 811602 - RNA, 19 nt, Mycobacterium avium subsp. paratuberculosis
caggauccggucgaucacc

SEQ ID NO: 811603 - RNA, 16 nt, Mycobacterium avium subsp. paratuberculosis
caggaucgacaacgcg

SEQ ID NO: 811604 - RNA, 17 nt, Mycobacterium avium subsp. paratuberculosis
caggauccgcaccgggc

SEQ ID NO: 811605 - RNA, 17 nt, Mycobacterium avium subsp. paratuberculosis
caggauccgcccgccgg

SEQ ID NO: 811606 - RNA, 15 nt, Mycobacterium avium subsp. paratuberculosis
caggaucgccggucg

SEQ ID NO: 811607 - RNA, 21 nt, Mycobacterium avium subsp. paratuberculosis
caggaucgccggucguggggc

SEQ ID NO: 811608 - RNA, 23 nt, Mycobacterium avium subsp. paratuberculosis
caggaucgccugauacgacgucc

SEQ ID NO: 811609 - RNA, 18 nt, Mycobacterium avium subsp. paratuberculosis
caggaucgcggugaccgc

SEQ ID NO: 811610 - RNA, 20 nt, Mycobacterium avium subsp. paratuberculosis
caggcacucgaucagcaccg

SEQ ID NO: 811611 - RNA, 13 nt, Mycobacterium avium subsp. paratuberculosis
caggcacucgccc

SEQ ID NO: 811612 - RNA, 15 nt, Mycobacterium avium subsp. paratuberculosis
caggcacggcccgug

SEQ ID NO: 811613 - RNA, 23 nt, Mycobacterium avium subsp. paratuberculosis
caggcagaagcuccacgccgccg

SEQ ID NO: 811614 - RNA, 15 nt, Mycobacterium avium subsp. paratuberculosis
caggcagcagcaccc

SEQ ID NO: 811615 - RNA, 17 nt, Mycobacterium avium subsp. paratuberculosis
caggcagcagcaccccg

SEQ ID NO: 811616 - RNA, 19 nt, Mycobacterium avium subsp. paratuberculosis
caggcagcagcaccccgau

SEQ ID NO: 811617 - RNA, 22 nt, Mycobacterium avium subsp. paratuberculosis
caggcagcccggcugcgcagcg

SEQ ID NO: 811618 - RNA, 15 nt, Mycobacterium avium subsp. paratuberculosis
caggcaggccggcag

SEQ ID NO: 811619 - RNA, 20 nt, Mycobacterium avium subsp. paratuberculosis
caggcaggccggcagccggc

SEQ ID NO: 811620 - RNA, 17 nt, Mycobacterium avium subsp. paratuberculosis
caggagcaccugcgcga

SEQ ID NO: 811621 - RNA, 16 nt, Mycobacterium avium subsp. paratuberculosis
caggagaucggcgcgg

SEQ ID NO: 811622 - RNA, 17 nt, Mycobacterium avium subsp. paratuberculosis
caggagaucggcgcgga

SEQ ID NO: 811623 - RNA, 16 nt, Mycobacterium avium subsp. paratuberculosis
caggacgguggccguc

SEQ ID NO: 811624 - RNA, 18 nt, Mycobacterium avium subsp. paratuberculosis
caggacgguggccgucuc

SEQ ID NO: 811625 - RNA, 23 nt, Mycobacterium avium subsp. paratuberculosis
caggacuccuugggagacugcga

SEQ ID NO: 811626 - RNA, 16 nt, Mycobacterium avium subsp. paratuberculosis
caggacuggaccgugc

SEQ ID NO: 811627 - RNA, 13 nt, Mycobacterium avium subsp. paratuberculosis
caggauccccguc

SEQ ID NO: 811628 - RNA, 15 nt, Mycobacterium avium subsp. paratuberculosis
caggaucacgcggcg

SEQ ID NO: 811629 - RNA, 16 nt, Mycobacterium avium subsp. paratuberculosis
caggaucacgcggcgg

SEQ ID NO: 811630 - RNA, 14 nt, Mycobacterium avium subsp. paratuberculosis
caggaucagcagcc

SEQ ID NO: 811631 - RNA, 16 nt, Mycobacterium avium subsp. paratuberculosis
caggaagaacccggcg

SEQ ID NO: 811632 - RNA, 17 nt, Mycobacterium avium subsp. paratuberculosis
caggaagaacccggcgu

SEQ ID NO: 811633 - RNA, 16 nt, Mycobacterium avium subsp. paratuberculosis
caggaaccuggucggg

SEQ ID NO: 811634 - RNA, 16 nt, Mycobacterium avium subsp. paratuberculosis
caggaacgggccggcg

SEQ ID NO: 811635 - RNA, 17 nt, Mycobacterium avium subsp. paratuberculosis
caggaacuccagcagcu

SEQ ID NO: 811636 - RNA, 19 nt, Mycobacterium avium subsp. paratuberculosis
caggaacuccagcagcugu

SEQ ID NO: 811637 - RNA, 17 nt, Mycobacterium avium subsp. paratuberculosis
caggacgcgaccggcca

SEQ ID NO: 811638 - RNA, 17 nt, Mycobacterium avium subsp. paratuberculosis
caggacgcgcccggcga

SEQ ID NO: 811639 - RNA, 22 nt, Mycobacterium avium subsp. paratuberculosis
caggacgcgcccggcgacgcgg

SEQ ID NO: 811640 - RNA, 23 nt, Mycobacterium avium subsp. paratuberculosis
caggacgcgcccggcgacgcggc

SEQ ID NO: 811641 - RNA, 12 nt, Mycobacterium avium subsp. paratuberculosis
caggacgcggug

SEQ ID NO: 811642 - RNA, 18 nt, Mycobacterium avium subsp. paratuberculosis
caggacggcgcgguggcg

SEQ ID NO: 811643 - RNA, 21 nt, Mycobacterium avium subsp. paratuberculosis
caggacgguuucugccggccg

SEQ ID NO: 811644 - RNA, 22 nt, Mycobacterium avium subsp. paratuberculosis
caggacgguuucugccggccgc

SEQ ID NO: 811645 - RNA, 23 nt, Mycobacterium avium subsp. paratuberculosis
caggacgguuucugccggccgcc

SEQ ID NO: 811646 - RNA, 14 nt, Mycobacterium avium subsp. paratuberculosis
caggacgucggccg

SEQ ID NO: 811647 - RNA, 16 nt, Mycobacterium avium subsp. paratuberculosis
caggacguugaggcgg

SEQ ID NO: 811648 - RNA, 18 nt, Mycobacterium avium subsp. paratuberculosis
caggacguugaggcggcg

SEQ ID NO: 811649 - RNA, 19 nt, Mycobacterium avium subsp. paratuberculosis
caggacguugaggcggcgg

SEQ ID NO: 811650 - RNA, 13 nt, Mycobacterium avium subsp. paratuberculosis
cagcuccgccacc

SEQ ID NO: 811651 - RNA, 14 nt, Mycobacterium avium subsp. paratuberculosis
cagcuccgccgaca

SEQ ID NO: 811652 - RNA, 14 nt, Mycobacterium avium subsp. paratuberculosis
cagcuccgcggcca

SEQ ID NO: 811653 - RNA, 14 nt, Mycobacterium avium subsp. paratuberculosis
cagcuccggcaacg

SEQ ID NO: 811654 - RNA, 16 nt, Mycobacterium avium subsp. paratuberculosis
cagcuccgggucgacc

SEQ ID NO: 811655 - RNA, 16 nt, Mycobacterium avium subsp. paratuberculosis
cagcuccggucggcgc

SEQ ID NO: 811656 - RNA, 17 nt, Mycobacterium avium subsp. paratuberculosis
cagcuccggucggcgcu

SEQ ID NO: 811657 - RNA, 18 nt, Mycobacterium avium subsp. paratuberculosis
cagcuccggucggcgcuc

SEQ ID NO: 811658 - RNA, 19 nt, Mycobacterium avium subsp. paratuberculosis
cagcuccggucggcgcucg

SEQ ID NO: 811659 - RNA, 18 nt, Mycobacterium avium subsp. paratuberculosis
cagcuccguccaccggca

SEQ ID NO: 811660 - RNA, 23 nt, Mycobacterium avium subsp. paratuberculosis
cagcuccuggaagaagucggugu

SEQ ID NO: 811661 - RNA, 19 nt, Mycobacterium avium subsp. paratuberculosis
cagcuccucggccagcacc

SEQ ID NO: 811662 - RNA, 20 nt, Mycobacterium avium subsp. paratuberculosis
cagcuccucggccagcacca

SEQ ID NO: 811663 - RNA, 17 nt, Mycobacterium avium subsp. paratuberculosis
cagcuccucggccccaa

SEQ ID NO: 811664 - RNA, 16 nt, Mycobacterium avium subsp. paratuberculosis
cagcuccucggcggcc

SEQ ID NO: 811665 - RNA, 18 nt, Mycobacterium avium subsp. paratuberculosis
cagcuccucggcggccuc

SEQ ID NO: 811666 - RNA, 16 nt, Mycobacterium avium subsp. paratuberculosis
cagcuccucggggaug

SEQ ID NO: 811667 - RNA, 23 nt, Mycobacterium avium subsp. paratuberculosis
cagcuccucggucagcucggggu

SEQ ID NO: 811668 - RNA, 19 nt, Mycobacterium avium subsp. paratuberculosis
cagcugcgaaucgucggcg

SEQ ID NO: 811669 - RNA, 23 nt, Mycobacterium avium subsp. paratuberculosis
cagcugcgaaucgucggcgaugg

SEQ ID NO: 811670 - RNA, 22 nt, Mycobacterium avium subsp. paratuberculosis
cagcugcgccgcgucgacgccg

SEQ ID NO: 811671 - RNA, 12 nt, Mycobacterium avium subsp. paratuberculosis
cagcugcgcgga

SEQ ID NO: 811672 - RNA, 14 nt, Mycobacterium avium subsp. paratuberculosis
cagcugcgcgggcg

SEQ ID NO: 811673 - RNA, 23 nt, Mycobacterium avium subsp. paratuberculosis
cagcugcgcgccggcggccgccg

SEQ ID NO: 811674 - RNA, 22 nt, Mycobacterium avium subsp. paratuberculosis
cagcugcggaaaugcccgcgcc

SEQ ID NO: 811675 - RNA, 19 nt, Mycobacterium avium subsp. paratuberculosis
cagcuccuugagccgccgc

SEQ ID NO: 811676 - RNA, 15 nt, Mycobacterium avium subsp. paratuberculosis
cagcugccgcaccgc

SEQ ID NO: 811677 - RNA, 17 nt, Mycobacterium avium subsp. paratuberculosis
cagcugccgcgacucgg

SEQ ID NO: 811678 - RNA, 13 nt, Mycobacterium avium subsp. paratuberculosis
cagcugccggccg

SEQ ID NO: 811679 - RNA, 17 nt, Mycobacterium avium subsp. paratuberculosis
cagcugcucggccaccg

SEQ ID NO: 811680 - RNA, 19 nt, Mycobacterium avium subsp. paratuberculosis
cagcugcucggccaccgcg

SEQ ID NO: 811681 - RNA, 20 nt, Mycobacterium avium subsp. paratuberculosis
cagcugcucggccaccgcgc

SEQ ID NO: 811682 - RNA, 14 nt, Mycobacterium avium subsp. paratuberculosis
cagcugcgucggca

SEQ ID NO: 811683 - RNA, 17 nt, Mycobacterium avium subsp. paratuberculosis
cagcugcgucggcacca

SEQ ID NO: 811684 - RNA, 23 nt, Mycobacterium avium subsp. paratuberculosis
cagcugcggaucgggcguggcgu

SEQ ID NO: 811685 - RNA, 19 nt, Mycobacterium avium subsp. paratuberculosis
cagcugggacagcgucacc

SEQ ID NO: 811686 - RNA, 13 nt, Mycobacterium avium subsp. paratuberculosis
cagcuggcugaca

SEQ ID NO: 811687 - RNA, 14 nt, Mycobacterium avium subsp. paratuberculosis
cagcugggccagcg

SEQ ID NO: 811688 - RNA, 15 nt, Mycobacterium avium subsp. paratuberculosis
cagcugggccagcgc

SEQ ID NO: 811689 - RNA, 17 nt, Mycobacterium avium subsp. paratuberculosis
cagcugggccagcgcgg

SEQ ID NO: 811690 - RNA, 14 nt, Mycobacterium avium subsp. paratuberculosis
cagcugggccgcca

SEQ ID NO: 811691 - RNA, 18 nt, Mycobacterium avium subsp. paratuberculosis
cagcugggccgccagccg

SEQ ID NO: 811692 - RNA, 20 nt, Mycobacterium avium subsp. paratuberculosis
cagcugggccgccagccggu

SEQ ID NO: 811693 - RNA, 13 nt, Mycobacterium avium subsp. paratuberculosis
cagcugggcugcc

SEQ ID NO: 811694 - RNA, 17 nt, Mycobacterium avium subsp. paratuberculosis
cagcugggcugccagcg

SEQ ID NO: 811695 - RNA, 20 nt, Mycobacterium avium subsp. paratuberculosis
cagcuggguggucaccagcg

SEQ ID NO: 811696 - RNA, 22 nt, Mycobacterium avium subsp. paratuberculosis
cagcugguagaugguggccguc

SEQ ID NO: 811697 - RNA, 23 nt, Mycobacterium avium subsp. paratuberculosis
cagcugguagaugguggccgucg

SEQ ID NO: 811698 - RNA, 18 nt, Mycobacterium avium subsp. paratuberculosis
cagcuggucccacagcgg

SEQ ID NO: 811699 - RNA, 16 nt, Mycobacterium avium subsp. paratuberculosis
cagcugguccggccgg

SEQ ID NO: 811700 - RNA, 19 nt, Mycobacterium avium subsp. paratuberculosis
cagcugguccggccggccg

SEQ ID NO: 811701 - RNA, 22 nt, Mycobacterium avium subsp. paratuberculosis
caggaacaccgagccggcggcg

SEQ ID NO: 811702 - RNA, 19 nt, Mycobacterium avium subsp. paratuberculosis
caggaacagacacagcacg

SEQ ID NO: 811703 - RNA, 22 nt, Mycobacterium avium subsp. paratuberculosis
caggaacgcgcccggcgggcca

SEQ ID NO: 811704 - RNA, 17 nt, Mycobacterium avium subsp. paratuberculosis
caggaacgcgccggcgc

SEQ ID NO: 811705 - RNA, 14 nt, Mycobacterium avium subsp. paratuberculosis
caggaacgcgucga

SEQ ID NO: 811706 - RNA, 16 nt, Mycobacterium avium subsp. paratuberculosis
caggaacgcgucgacc

SEQ ID NO: 811707 - RNA, 23 nt, Mycobacterium avium subsp. paratuberculosis
caggaacgcgucgaccgccgcga

SEQ ID NO: 811708 - RNA, 21 nt, Mycobacterium avium subsp. paratuberculosis
cagcuugucguagcggcgcca

SEQ ID NO: 811709 - RNA, 14 nt, Mycobacterium avium subsp. paratuberculosis
caggaaaaccagcg

SEQ ID NO: 811710 - RNA, 15 nt, Mycobacterium avium subsp. paratuberculosis
cagcuguucgggcag

SEQ ID NO: 811711 - RNA, 17 nt, Mycobacterium avium subsp. paratuberculosis
cagcuguugacgggccg

SEQ ID NO: 811712 - RNA, 20 nt, Mycobacterium avium subsp. paratuberculosis
cagcuguugacgggccgcgg

SEQ ID NO: 811713 - RNA, 17 nt, Mycobacterium avium subsp. paratuberculosis
cagcuugggggccgacg

SEQ ID NO: 811714 - RNA, 14 nt, Mycobacterium avium subsp. paratuberculosis
cagcuucaccgguc

SEQ ID NO: 811715 - RNA, 18 nt, Mycobacterium avium subsp. paratuberculosis
cagcuucaccggucgggc

SEQ ID NO: 811716 - RNA, 18 nt, Mycobacterium avium subsp. paratuberculosis
cagcuuccgccucggcga

SEQ ID NO: 811717 - RNA, 16 nt, Mycobacterium avium subsp. paratuberculosis
cagcuuggcgcagccg

SEQ ID NO: 811718 - RNA, 19 nt, Mycobacterium avium subsp. paratuberculosis
cagcuuggcgcagccgguc

SEQ ID NO: 811719 - RNA, 19 nt, Mycobacterium avium subsp. paratuberculosis
caggccugguaggccgccu

SEQ ID NO: 811720 - RNA, 16 nt, Mycobacterium avium subsp. paratuberculosis
caggcgaacaccucgg

SEQ ID NO: 811721 - RNA, 15 nt, Mycobacterium avium subsp. paratuberculosis
caggcgaaggucaga

SEQ ID NO: 811722 - RNA, 16 nt, Mycobacterium avium subsp. paratuberculosis
caggcgaacauggcgg

SEQ ID NO: 811723 - RNA, 17 nt, Mycobacterium avium subsp. paratuberculosis
caggcgaacauggcggc

SEQ ID NO: 811724 - RNA, 23 nt, Mycobacterium avium subsp. paratuberculosis
caggcgaacauggcggccagccg

SEQ ID NO: 811725 - RNA, 20 nt, Mycobacterium avium subsp. paratuberculosis
caggccuuguacgccccgga

SEQ ID NO: 811726 - RNA, 19 nt, Mycobacterium avium subsp. paratuberculosis
caggccuugucguccucga

SEQ ID NO: 811727 - RNA, 16 nt, Mycobacterium avium subsp. paratuberculosis
caggccuuccgcaaca

SEQ ID NO: 811728 - RNA, 16 nt, Mycobacterium avium subsp. paratuberculosis
caggcgcagcccgagc

SEQ ID NO: 811729 - RNA, 16 nt, Mycobacterium avium subsp. paratuberculosis
caggcgcaccgccacc

SEQ ID NO: 811730 - RNA, 19 nt, Mycobacterium avium subsp. paratuberculosis
caggcgauggcgucggcca

SEQ ID NO: 811731 - RNA, 19 nt, Mycobacterium avium subsp. paratuberculosis
caggcgauggugccggcca

SEQ ID NO: 811732 - RNA, 21 nt, Mycobacterium avium subsp. paratuberculosis
caggcgauguggguggucagc

SEQ ID NO: 811733 - RNA, 17 nt, Mycobacterium avium subsp. paratuberculosis
caggcgcaacagcaccu

SEQ ID NO: 811734 - RNA, 18 nt, Mycobacterium avium subsp. paratuberculosis
caggcgcaacagcaccuc

SEQ ID NO: 811735 - RNA, 13 nt, Mycobacterium avium subsp. paratuberculosis
caggcgcgcacca

SEQ ID NO: 811736 - RNA, 23 nt, Mycobacterium avium subsp. paratuberculosis
caggcgcgcggccagccccggga

SEQ ID NO: 811737 - RNA, 19 nt, Mycobacterium avium subsp. paratuberculosis
caggccguuguggccaccc

SEQ ID NO: 811738 - RNA, 20 nt, Mycobacterium avium subsp. paratuberculosis
caggccguuguggccacccu

SEQ ID NO: 811739 - RNA, 23 nt, Mycobacterium avium subsp. paratuberculosis
caggccguuguggccacccucgc

SEQ ID NO: 811740 - RNA, 13 nt, Mycobacterium avium subsp. paratuberculosis
caggccgcggccg

SEQ ID NO: 811741 - RNA, 16 nt, Mycobacterium avium subsp. paratuberculosis
caggccgcggccgucg

SEQ ID NO: 811742 - RNA, 11 nt, Mycobacterium avium subsp. paratuberculosis
caggccgcggg

SEQ ID NO: 811743 - RNA, 22 nt, Mycobacterium avium subsp. paratuberculosis
caggccucgaggaucgcggcca

SEQ ID NO: 811744 - RNA, 18 nt, Mycobacterium avium subsp. paratuberculosis
caggccucuacucagccg

SEQ ID NO: 811745 - RNA, 15 nt, Mycobacterium avium subsp. paratuberculosis
caggccgccugcggg

SEQ ID NO: 811746 - RNA, 15 nt, Mycobacterium avium subsp. paratuberculosis
caggccgcgacgggc

SEQ ID NO: 811747 - RNA, 21 nt, Mycobacterium avium subsp. paratuberculosis
caggccgcgagcacgacgucg

SEQ ID NO: 811748 - RNA, 12 nt, Mycobacterium avium subsp. paratuberculosis
caggccgccggg

SEQ ID NO: 811749 - RNA, 13 nt, Mycobacterium avium subsp. paratuberculosis
caggccgccgacg

SEQ ID NO: 811750 - RNA, 14 nt, Mycobacterium avium subsp. paratuberculosis
caggccgccgacga

SEQ ID NO: 811751 - RNA, 16 nt, Mycobacterium avium subsp. paratuberculosis
caggccgccgacgacg

SEQ ID NO: 811752 - RNA, 13 nt, Mycobacterium avium subsp. paratuberculosis
caggccgccgcau

SEQ ID NO: 811753 - RNA, 14 nt, Mycobacterium avium subsp. paratuberculosis
caggccgccgcauu

SEQ ID NO: 811754 - RNA, 22 nt, Mycobacterium avium subsp. paratuberculosis
caggccgccgcauuccucggcc

SEQ ID NO: 811755 - RNA, 23 nt, Mycobacterium avium subsp. paratuberculosis
caggccgccgcauuccucggcca

SEQ ID NO: 811756 - RNA, 19 nt, Mycobacterium avium subsp. paratuberculosis
caggccgccgccaccgucg

SEQ ID NO: 811757 - RNA, 13 nt, Mycobacterium avium subsp. paratuberculosis
caggccgcccggc

SEQ ID NO: 811758 - RNA, 10 nt, Mycobacterium avium subsp. paratuberculosis
caggccgccc

SEQ ID NO: 811759 - RNA, 20 nt, Mycobacterium avium subsp. paratuberculosis
caggccgauggugguaccga

SEQ ID NO: 811760 - RNA, 16 nt, Mycobacterium avium subsp. paratuberculosis
caggccaggugcagcu

SEQ ID NO: 811761 - RNA, 15 nt, Mycobacterium avium subsp. paratuberculosis
caggccaucagcccg

SEQ ID NO: 811762 - RNA, 17 nt, Mycobacterium avium subsp. paratuberculosis
caggccaucagcccggc

SEQ ID NO: 811763 - RNA, 18 nt, Mycobacterium avium subsp. paratuberculosis
caggccaucagcccggcg

SEQ ID NO: 811764 - RNA, 19 nt, Mycobacterium avium subsp. paratuberculosis
caggccaucagcccggcgu

SEQ ID NO: 811765 - RNA, 23 nt, Mycobacterium avium subsp. paratuberculosis
caggccaucagcccggcguccug

SEQ ID NO: 811766 - RNA, 17 nt, Mycobacterium avium subsp. paratuberculosis
caggccauggcgcaccg

SEQ ID NO: 811767 - RNA, 18 nt, Mycobacterium avium subsp. paratuberculosis
caggccauggcgcaccgc

SEQ ID NO: 811768 - RNA, 21 nt, Mycobacterium avium subsp. paratuberculosis
caggccauggcgcaccgcggc

SEQ ID NO: 811769 - RNA, 14 nt, Mycobacterium avium subsp. paratuberculosis
caggcccaccgucg

SEQ ID NO: 811770 - RNA, 13 nt, Mycobacterium avium subsp. paratuberculosis
caggccgaacacc

SEQ ID NO: 811771 - RNA, 19 nt, Mycobacterium avium subsp. paratuberculosis
caggccgaacagcagcgaa

SEQ ID NO: 811772 - RNA, 15 nt, Mycobacterium avium subsp. paratuberculosis
caggcccuugcccca

SEQ ID NO: 811773 - RNA, 13 nt, Mycobacterium avium subsp. paratuberculosis
caggccgaagaac

SEQ ID NO: 811774 - RNA, 17 nt, Mycobacterium avium subsp. paratuberculosis
caggccgaagacgauga

SEQ ID NO: 811775 - RNA, 18 nt, Mycobacterium avium subsp. paratuberculosis
caggcauuuccagguccg

SEQ ID NO: 811776 - RNA, 18 nt, Mycobacterium avium subsp. paratuberculosis
caggcauuccaccgcgcg

SEQ ID NO: 811777 - RNA, 23 nt, Mycobacterium avium subsp. paratuberculosis
caggcauuccaccgcgcggcgca

SEQ ID NO: 811778 - RNA, 20 nt, Mycobacterium avium subsp. paratuberculosis
caggcaucgcgugccgacca

SEQ ID NO: 811779 - RNA, 24 nt, Mycobacterium avium subsp. paratuberculosis
caggcaucgcgugccgaccagccg

SEQ ID NO: 811780 - RNA, 22 nt, Mycobacterium avium subsp. paratuberculosis
caggcaugggaucagcagcacc

SEQ ID NO: 811781 - RNA, 23 nt, Mycobacterium avium subsp. paratuberculosis
caggcaugggaucagcagcaccg

SEQ ID NO: 811782 - RNA, 15 nt, Mycobacterium avium subsp. paratuberculosis
caggccaccgcacgu

SEQ ID NO: 811783 - RNA, 18 nt, Mycobacterium avium subsp. paratuberculosis
caggccacaugggccacg

SEQ ID NO: 811784 - RNA, 23 nt, Mycobacterium avium subsp. paratuberculosis
caggccacaugggccacggcgcg

SEQ ID NO: 811785 - RNA, 15 nt, Mycobacterium avium subsp. paratuberculosis
caggccacccgggcg

SEQ ID NO: 811786 - RNA, 16 nt, Mycobacterium avium subsp. paratuberculosis
caggccacccgggcgc

SEQ ID NO: 811787 - RNA, 17 nt, Mycobacterium avium subsp. paratuberculosis
caggccacccgggcgcc

SEQ ID NO: 811788 - RNA, 21 nt, Mycobacterium avium subsp. paratuberculosis
caggccacccgggcgccggcg

SEQ ID NO: 811789 - RNA, 22 nt, Mycobacterium avium subsp. paratuberculosis
caggccacccgggcgccggcga

SEQ ID NO: 811790 - RNA, 14 nt, Mycobacterium avium subsp. paratuberculosis
caggccaacagcag

SEQ ID NO: 811791 - RNA, 16 nt, Mycobacterium avium subsp. paratuberculosis
caggccaacagcagca

SEQ ID NO: 811792 - RNA, 17 nt, Mycobacterium avium subsp. paratuberculosis
cagcuaggucguggcgc

SEQ ID NO: 811793 - RNA, 13 nt, Mycobacterium avium subsp. paratuberculosis
cagcucaccggcc

SEQ ID NO: 811794 - RNA, 22 nt, Mycobacterium avium subsp. paratuberculosis
cagcucaccgggcucggucacc

SEQ ID NO: 811795 - RNA, 13 nt, Mycobacterium avium subsp. paratuberculosis
cagcucagcgcgc

SEQ ID NO: 811796 - RNA, 19 nt, Mycobacterium avium subsp. paratuberculosis
cagcucaggaacggccgga

SEQ ID NO: 811797 - RNA, 20 nt, Mycobacterium avium subsp. paratuberculosis
cagcucauacagcggcgcgc

SEQ ID NO: 811798 - RNA, 19 nt, Mycobacterium avium subsp. paratuberculosis
cagcucccgggcggcgccg

SEQ ID NO: 811799 - RNA, 15 nt, Mycobacterium avium subsp. paratuberculosis
cagcucccgggcggc

SEQ ID NO: 811800 - RNA, 20 nt, Mycobacterium avium subsp. paratuberculosis
cagcguucacgucgaucacg

SEQ ID NO: 811801 - RNA, 13 nt, Mycobacterium avium subsp. paratuberculosis
cagcguuccagca

SEQ ID NO: 811802 - RNA, 19 nt, Mycobacterium avium subsp. paratuberculosis
cagcguuccagcacccggc

SEQ ID NO: 811803 - RNA, 18 nt, Mycobacterium avium subsp. paratuberculosis
cagcguuccggcggccgg

SEQ ID NO: 811804 - RNA, 17 nt, Mycobacterium avium subsp. paratuberculosis
cagcguuccgucggcga

SEQ ID NO: 811805 - RNA, 18 nt, Mycobacterium avium subsp. paratuberculosis
cagcguuccgucggcgag

SEQ ID NO: 811806 - RNA, 16 nt, Mycobacterium avium subsp. paratuberculosis
cagcuaggccagcagc

SEQ ID NO: 811807 - RNA, 17 nt, Mycobacterium avium subsp. paratuberculosis
cagcuaggccagcagcg

SEQ ID NO: 811808 - RNA, 20 nt, Mycobacterium avium subsp. paratuberculosis
cagcuaggccagcagcgcgg

SEQ ID NO: 811809 - RNA, 20 nt, Mycobacterium avium subsp. paratuberculosis
cagcguguugagcucgcggc

SEQ ID NO: 811810 - RNA, 22 nt, Mycobacterium avium subsp. paratuberculosis
cagcguguugagcucgcggcgc

SEQ ID NO: 811811 - RNA, 15 nt, Mycobacterium avium subsp. paratuberculosis
cagcgugugcguggu

SEQ ID NO: 811812 - RNA, 23 nt, Mycobacterium avium subsp. paratuberculosis
cagcgugugcgugguggggccga

SEQ ID NO: 811813 - RNA, 17 nt, Mycobacterium avium subsp. paratuberculosis
cagcguguagacggugc

SEQ ID NO: 811814 - RNA, 16 nt, Mycobacterium avium subsp. paratuberculosis
cagcgugucccgguac

SEQ ID NO: 811815 - RNA, 19 nt, Mycobacterium avium subsp. paratuberculosis
cagcgugucgccggggcgg

SEQ ID NO: 811816 - RNA, 14 nt, Mycobacterium avium subsp. paratuberculosis
cagcgugucggcga

SEQ ID NO: 811817 - RNA, 15 nt, Mycobacterium avium subsp. paratuberculosis
cagcgugucggcgau

SEQ ID NO: 811818 - RNA, 16 nt, Mycobacterium avium subsp. paratuberculosis
cagcgugucggcgauc

SEQ ID NO: 811819 - RNA, 17 nt, Mycobacterium avium subsp. paratuberculosis
cagcgugucggcgaucg

SEQ ID NO: 811820 - RNA, 19 nt, Mycobacterium avium subsp. paratuberculosis
cagcgugucggcgaucgcg

SEQ ID NO: 811821 - RNA, 18 nt, Mycobacterium avium subsp. paratuberculosis
cagcgugucggggucggc

SEQ ID NO: 811822 - RNA, 22 nt, Mycobacterium avium subsp. paratuberculosis
cagcgugucggggucggcgccg

SEQ ID NO: 811823 - RNA, 15 nt, Mycobacterium avium subsp. paratuberculosis
cagcguggcgucggc

SEQ ID NO: 811824 - RNA, 17 nt, Mycobacterium avium subsp. paratuberculosis
cagcguggcgucggcgc

SEQ ID NO: 811825 - RNA, 19 nt, Mycobacterium avium subsp. paratuberculosis
cagcguggcgucggcgcgc

SEQ ID NO: 811826 - RNA, 13 nt, Mycobacterium avium subsp. paratuberculosis
cagcguggccggc

SEQ ID NO: 811827 - RNA, 15 nt, Mycobacterium avium subsp. paratuberculosis
cagcguggccggcag

SEQ ID NO: 811828 - RNA, 16 nt, Mycobacterium avium subsp. paratuberculosis
cagcguggcgaacgcg

SEQ ID NO: 811829 - RNA, 18 nt, Mycobacterium avium subsp. paratuberculosis
cagcguggcgcgccccgg

SEQ ID NO: 811830 - RNA, 18 nt, Mycobacterium avium subsp. paratuberculosis
cagcgugggcaccggcac

SEQ ID NO: 811831 - RNA, 15 nt, Mycobacterium avium subsp. paratuberculosis
cagcguggucagcgu

SEQ ID NO: 811832 - RNA, 17 nt, Mycobacterium avium subsp. paratuberculosis
cagcgugguccagcacg

SEQ ID NO: 811833 - RNA, 12 nt, Mycobacterium avium subsp. paratuberculosis
cagcguggucgc

SEQ ID NO: 811834 - RNA, 14 nt, Mycobacterium avium subsp. paratuberculosis
cagcguggucgcgc

SEQ ID NO: 811835 - RNA, 18 nt, Mycobacterium avium subsp. paratuberculosis
cagcguggucgcgcagca

SEQ ID NO: 811836 - RNA, 22 nt, Mycobacterium avium subsp. paratuberculosis
cagcguggucuccuggccgccg

SEQ ID NO: 811837 - RNA, 23 nt, Mycobacterium avium subsp. paratuberculosis
cagcguggucuccuggccgccgu

SEQ ID NO: 811838 - RNA, 24 nt, Mycobacterium avium subsp. paratuberculosis
cagcguggucuccuggccgccgug

SEQ ID NO: 811839 - RNA, 18 nt, Mycobacterium avium subsp. paratuberculosis
cagcggguugccgcuggc

SEQ ID NO: 811840 - RNA, 19 nt, Mycobacterium avium subsp. paratuberculosis
cagcggguugccgcuggcg

SEQ ID NO: 811841 - RNA, 22 nt, Mycobacterium avium subsp. paratuberculosis
cagcggguuguucuccagcggc

SEQ ID NO: 811842 - RNA, 16 nt, Mycobacterium avium subsp. paratuberculosis
cagcgucaacucgucg

SEQ ID NO: 811843 - RNA, 19 nt, Mycobacterium avium subsp. paratuberculosis
cagcgucaacucgucggcg

SEQ ID NO: 811844 - RNA, 14 nt, Mycobacterium avium subsp. paratuberculosis
cagcgucaccaaug

SEQ ID NO: 811845 - RNA, 21 nt, Mycobacterium avium subsp. paratuberculosis
cagcgucaccaaugcgccggc

SEQ ID NO: 811846 - RNA, 22 nt, Mycobacterium avium subsp. paratuberculosis
cagcgucaccaaugcgccggcg

SEQ ID NO: 811847 - RNA, 23 nt, Mycobacterium avium subsp. paratuberculosis
cagcgucaccaaugcgccggcgg

SEQ ID NO: 811848 - RNA, 24 nt, Mycobacterium avium subsp. paratuberculosis
cagcgucaccaaugcgccggcggc

SEQ ID NO: 811849 - RNA, 14 nt, Mycobacterium avium subsp. paratuberculosis
cagcgggucgucgg

SEQ ID NO: 811850 - RNA, 21 nt, Mycobacterium avium subsp. paratuberculosis
cagcgggucgucgggccgggg

SEQ ID NO: 811851 - RNA, 14 nt, Mycobacterium avium subsp. paratuberculosis
cagcgggugauggc

SEQ ID NO: 811852 - RNA, 20 nt, Mycobacterium avium subsp. paratuberculosis
cagcgggugauggccgccgc

SEQ ID NO: 811853 - RNA, 21 nt, Mycobacterium avium subsp. paratuberculosis
cagcgggugauggccgccgca

SEQ ID NO: 811854 - RNA, 22 nt, Mycobacterium avium subsp. paratuberculosis
cagcgggugauggccgccgcag

SEQ ID NO: 811855 - RNA, 15 nt, Mycobacterium avium subsp. paratuberculosis
cagcggguccagccg

SEQ ID NO: 811856 - RNA, 19 nt, Mycobacterium avium subsp. paratuberculosis
cagcggguccagccgccgg

SEQ ID NO: 811857 - RNA, 20 nt, Mycobacterium avium subsp. paratuberculosis
cagcggguccagccgccggc

SEQ ID NO: 811858 - RNA, 21 nt, Mycobacterium avium subsp. paratuberculosis
cagcggguccagccgccggcg

SEQ ID NO: 811859 - RNA, 23 nt, Mycobacterium avium subsp. paratuberculosis
cagcgucaggauguagagcggga

SEQ ID NO: 811860 - RNA, 15 nt, Mycobacterium avium subsp. paratuberculosis
cagcgucagggcgac

SEQ ID NO: 811861 - RNA, 14 nt, Mycobacterium avium subsp. paratuberculosis
cagcgucaggucac

SEQ ID NO: 811862 - RNA, 15 nt, Mycobacterium avium subsp. paratuberculosis
cagcguccacgaugc

SEQ ID NO: 811863 - RNA, 16 nt, Mycobacterium avium subsp. paratuberculosis
cagcgucacgucgacg

SEQ ID NO: 811864 - RNA, 18 nt, Mycobacterium avium subsp. paratuberculosis
cagcgucacgucgacggc

SEQ ID NO: 811865 - RNA, 20 nt, Mycobacterium avium subsp. paratuberculosis
cagcgucacgucgacggccg

SEQ ID NO: 811866 - RNA, 15 nt, Mycobacterium avium subsp. paratuberculosis
cagcgucagcaccgc

SEQ ID NO: 811867 - RNA, 23 nt, Mycobacterium avium subsp. paratuberculosis
cagcgucagcaccgcgacgguga

SEQ ID NO: 811868 - RNA, 14 nt, Mycobacterium avium subsp. paratuberculosis
cagcgucagcaucg

SEQ ID NO: 811869 - RNA, 22 nt, Mycobacterium avium subsp. paratuberculosis
cagcgucagcaucgccgucguc

SEQ ID NO: 811870 - RNA, 15 nt, Mycobacterium avium subsp. paratuberculosis
cagcgucagccccga

SEQ ID NO: 811871 - RNA, 19 nt, Mycobacterium avium subsp. paratuberculosis
cagcgucagccccgagucc

SEQ ID NO: 811872 - RNA, 21 nt, Mycobacterium avium subsp. paratuberculosis
cagcgucggcgugcccgccga

SEQ ID NO: 811873 - RNA, 22 nt, Mycobacterium avium subsp. paratuberculosis
cagcgucggcgugcccgccgac

SEQ ID NO: 811874 - RNA, 17 nt, Mycobacterium avium subsp. paratuberculosis
cagcgucucgaucgacg

SEQ ID NO: 811875 - RNA, 19 nt, Mycobacterium avium subsp. paratuberculosis
cagcgucucgaugaccucg

SEQ ID NO: 811876 - RNA, 15 nt, Mycobacterium avium subsp. paratuberculosis
cagcgucucgccggg

SEQ ID NO: 811877 - RNA, 22 nt, Mycobacterium avium subsp. paratuberculosis
cagcgucucgccggggaacacc

SEQ ID NO: 811878 - RNA, 17 nt, Mycobacterium avium subsp. paratuberculosis
cagcgucuccggcgggc

SEQ ID NO: 811879 - RNA, 21 nt, Mycobacterium avium subsp. paratuberculosis
cagcgucuccggcgggcuggu

SEQ ID NO: 811880 - RNA, 18 nt, Mycobacterium avium subsp. paratuberculosis
cagcgucuccucgaccgc

SEQ ID NO: 811881 - RNA, 15 nt, Mycobacterium avium subsp. paratuberculosis
cagcgucucgaccgc

SEQ ID NO: 811882 - RNA, 17 nt, Mycobacterium avium subsp. paratuberculosis
cagcgucucgaccgcgg

SEQ ID NO: 811883 - RNA, 19 nt, Mycobacterium avium subsp. paratuberculosis
cagcgucucgacggcgccg

SEQ ID NO: 811884 - RNA, 16 nt, Mycobacterium avium subsp. paratuberculosis
cagcgucugcgccagc

SEQ ID NO: 811885 - RNA, 14 nt, Mycobacterium avium subsp. paratuberculosis
cagcgucugcgccc

SEQ ID NO: 811886 - RNA, 23 nt, Mycobacterium avium subsp. paratuberculosis
cagcgucugcgccccggcgucga

SEQ ID NO: 811887 - RNA, 22 nt, Mycobacterium avium subsp. paratuberculosis
cagcgucuggcagccggccggc

SEQ ID NO: 811888 - RNA, 14 nt, Mycobacterium avium subsp. paratuberculosis
cagcgucucggcga

SEQ ID NO: 811889 - RNA, 17 nt, Mycobacterium avium subsp. paratuberculosis
cagcguggccagcaccg

SEQ ID NO: 811890 - RNA, 21 nt, Mycobacterium avium subsp. paratuberculosis
cagcgugcugacgucgucgcc

SEQ ID NO: 811891 - RNA, 20 nt, Mycobacterium avium subsp. paratuberculosis
cagcgucuucuucucgccgu

SEQ ID NO: 811892 - RNA, 22 nt, Mycobacterium avium subsp. paratuberculosis
cagcgucuucuucucgccgucc

SEQ ID NO: 811893 - RNA, 17 nt, Mycobacterium avium subsp. paratuberculosis
cagcgugcgcggcuggc

SEQ ID NO: 811894 - RNA, 15 nt, Mycobacterium avium subsp. paratuberculosis
cagcggcgcaccgug

SEQ ID NO: 811895 - RNA, 13 nt, Mycobacterium avium subsp. paratuberculosis
cagcggcgccgaa

SEQ ID NO: 811896 - RNA, 13 nt, Mycobacterium avium subsp. paratuberculosis
cagcggcgacagc

SEQ ID NO: 811897 - RNA, 12 nt, Mycobacterium avium subsp. paratuberculosis
cagcggcgccac

SEQ ID NO: 811898 - RNA, 14 nt, Mycobacterium avium subsp. paratuberculosis
cagcggcgccaccg

SEQ ID NO: 811899 - RNA, 15 nt, Mycobacterium avium subsp. paratuberculosis
cagcggcgccaccgg

SEQ ID NO: 811900 - RNA, 18 nt, Mycobacterium avium subsp. paratuberculosis
cagcggcgccaccgggac

SEQ ID NO: 811901 - RNA, 14 nt, Mycobacterium avium subsp. paratuberculosis
cagcggcgccaggu

SEQ ID NO: 811902 - RNA, 19 nt, Mycobacterium avium subsp. paratuberculosis
cagcggcgccaggucgggg

SEQ ID NO: 811903 - RNA, 14 nt, Mycobacterium avium subsp. paratuberculosis
cagcggccgucgcc

SEQ ID NO: 811904 - RNA, 16 nt, Mycobacterium avium subsp. paratuberculosis
cagcggccgucgccgg

SEQ ID NO: 811905 - RNA, 15 nt, Mycobacterium avium subsp. paratuberculosis
cagcggccgucgcgc

SEQ ID NO: 811906 - RNA, 16 nt, Mycobacterium avium subsp. paratuberculosis
cagcggccggcgcagc

SEQ ID NO: 811907 - RNA, 17 nt, Mycobacterium avium subsp. paratuberculosis
cagcggccggcgcagcc

SEQ ID NO: 811908 - RNA, 12 nt, Mycobacterium avium subsp. paratuberculosis
cagcggccgggc

SEQ ID NO: 811909 - RNA, 13 nt, Mycobacterium avium subsp. paratuberculosis
cagcggccggaac

SEQ ID NO: 811910 - RNA, 13 nt, Mycobacterium avium subsp. paratuberculosis
cagcggccgauca

SEQ ID NO: 811911 - RNA, 23 nt, Mycobacterium avium subsp. paratuberculosis
cagcggccgaucauggucggcga

SEQ ID NO: 811912 - RNA, 13 nt, Mycobacterium avium subsp. paratuberculosis
cagcggccgcagc

SEQ ID NO: 811913 - RNA, 14 nt, Mycobacterium avium subsp. paratuberculosis
cagcggccgcagcg

SEQ ID NO: 811914 - RNA, 17 nt, Mycobacterium avium subsp. paratuberculosis
cagcggccgcagcgcga

SEQ ID NO: 811915 - RNA, 16 nt, Mycobacterium avium subsp. paratuberculosis
cagcggccaucgccgc

SEQ ID NO: 811916 - RNA, 19 nt, Mycobacterium avium subsp. paratuberculosis
cagcggccagcccaucccg

SEQ ID NO: 811917 - RNA, 14 nt, Mycobacterium avium subsp. paratuberculosis
cagcggccagcccg

SEQ ID NO: 811918 - RNA, 16 nt, Mycobacterium avium subsp. paratuberculosis
cagcggcccgaacacc

SEQ ID NO: 811919 - RNA, 12 nt, Mycobacterium avium subsp. paratuberculosis
cagcggcccgau

SEQ ID NO: 811920 - RNA, 14 nt, Mycobacterium avium subsp. paratuberculosis
cagcggcccgauca

SEQ ID NO: 811921 - RNA, 18 nt, Mycobacterium avium subsp. paratuberculosis
cagcggcccgaucaccgc

SEQ ID NO: 811922 - RNA, 19 nt, Mycobacterium avium subsp. paratuberculosis
cagcggccccacguugauc

SEQ ID NO: 811923 - RNA, 21 nt, Mycobacterium avium subsp. paratuberculosis
cagcggccccccgcacaccgg

SEQ ID NO: 811924 - RNA, 16 nt, Mycobacterium avium subsp. paratuberculosis
cagcggcccgcugugg

SEQ ID NO: 811925 - RNA, 14 nt, Mycobacterium avium subsp. paratuberculosis
cagcggccacaccg

SEQ ID NO: 811926 - RNA, 21 nt, Mycobacterium avium subsp. paratuberculosis
cagcggccacaccggggccag

SEQ ID NO: 811927 - RNA, 17 nt, Mycobacterium avium subsp. paratuberculosis
cagcggcaugcccccga

SEQ ID NO: 811928 - RNA, 13 nt, Mycobacterium avium subsp. paratuberculosis
cagcggcaggugc

SEQ ID NO: 811929 - RNA, 23 nt, Mycobacterium avium subsp. paratuberculosis
cagcggcaguagcgcaccgguca

SEQ ID NO: 811930 - RNA, 17 nt, Mycobacterium avium subsp. paratuberculosis
cagcggcaucgaggacc

SEQ ID NO: 811931 - RNA, 20 nt, Mycobacterium avium subsp. paratuberculosis
cagcggcaucgaggaccggc

SEQ ID NO: 811932 - RNA, 17 nt, Mycobacterium avium subsp. paratuberculosis
cagcggcaucgccgcca

SEQ ID NO: 811933 - RNA, 14 nt, Mycobacterium avium subsp. paratuberculosis
cagcggcgucgucg

SEQ ID NO: 811934 - RNA, 16 nt, Mycobacterium avium subsp. paratuberculosis
cagcggcgucgucguc

SEQ ID NO: 811935 - RNA, 13 nt, Mycobacterium avium subsp. paratuberculosis
cagcggcggccau

SEQ ID NO: 811936 - RNA, 13 nt, Mycobacterium avium subsp. paratuberculosis
cagcggcggcacg

SEQ ID NO: 811937 - RNA, 11 nt, Mycobacterium avium subsp. paratuberculosis
cagcggcggcc

SEQ ID NO: 811938 - RNA, 12 nt, Mycobacterium avium subsp. paratuberculosis
cagcggcggcca

SEQ ID NO: 811939 - RNA, 13 nt, Mycobacterium avium subsp. paratuberculosis
cagcggcgcgccg

SEQ ID NO: 811940 - RNA, 15 nt, Mycobacterium avium subsp. paratuberculosis
cagcggcgcgcgccg

SEQ ID NO: 811941 - RNA, 14 nt, Mycobacterium avium subsp. paratuberculosis
cagcggcgcggccg

SEQ ID NO: 811942 - RNA, 12 nt, Mycobacterium avium subsp. paratuberculosis
cagcggcgcggu

SEQ ID NO: 811943 - RNA, 19 nt, Mycobacterium avium subsp. paratuberculosis
cagcggcgccgcagcucgu

SEQ ID NO: 811944 - RNA, 13 nt, Mycobacterium avium subsp. paratuberculosis
cagcggggcgacc

SEQ ID NO: 811945 - RNA, 15 nt, Mycobacterium avium subsp. paratuberculosis
cagcggggcgaccuu

SEQ ID NO: 811946 - RNA, 17 nt, Mycobacterium avium subsp. paratuberculosis
cagcggggcgagcuggc

SEQ ID NO: 811947 - RNA, 14 nt, Mycobacterium avium subsp. paratuberculosis
cagcggggcgcgca

SEQ ID NO: 811948 - RNA, 16 nt, Mycobacterium avium subsp. paratuberculosis
cagcggggcgcgcagg

SEQ ID NO: 811949 - RNA, 14 nt, Mycobacterium avium subsp. paratuberculosis
cagcggggcgucca

SEQ ID NO: 811950 - RNA, 17 nt, Mycobacterium avium subsp. paratuberculosis
cagcgggaacaccacgu

SEQ ID NO: 811951 - RNA, 21 nt, Mycobacterium avium subsp. paratuberculosis
cagcgggaacaccacgucguc

SEQ ID NO: 811952 - RNA, 14 nt, Mycobacterium avium subsp. paratuberculosis
cagcggggcaagca

SEQ ID NO: 811953 - RNA, 17 nt, Mycobacterium avium subsp. paratuberculosis
cagcggggugagcaccg

SEQ ID NO: 811954 - RNA, 20 nt, Mycobacterium avium subsp. paratuberculosis
cagcggggugagcaccgcga

SEQ ID NO: 811955 - RNA, 22 nt, Mycobacterium avium subsp. paratuberculosis
cagcggggugugcucggcggcg

SEQ ID NO: 811956 - RNA, 23 nt, Mycobacterium avium subsp. paratuberculosis
cagcggggugugcucggcggcgc

SEQ ID NO: 811957 - RNA, 18 nt, Mycobacterium avium subsp. paratuberculosis
cagcggcuugaccggcuc

SEQ ID NO: 811958 - RNA, 22 nt, Mycobacterium avium subsp. paratuberculosis
cagcggcuugaccggcucgccg

SEQ ID NO: 811959 - RNA, 21 nt, Mycobacterium avium subsp. paratuberculosis
cagcggcuugagccggaucgg

SEQ ID NO: 811960 - RNA, 15 nt, Mycobacterium avium subsp. paratuberculosis
cagcggcuugagcgc

SEQ ID NO: 811961 - RNA, 17 nt, Mycobacterium avium subsp. paratuberculosis
cagcggcuugagcgcca

SEQ ID NO: 811962 - RNA, 22 nt, Mycobacterium avium subsp. paratuberculosis
cagcggcuugagcgccagcgcg

SEQ ID NO: 811963 - RNA, 24 nt, Mycobacterium avium subsp. paratuberculosis
cagcggcuugagcgccagcgcggu

SEQ ID NO: 811964 - RNA, 22 nt, Mycobacterium avium subsp. paratuberculosis
cagcggcuuggucaccagcucg

SEQ ID NO: 811965 - RNA, 19 nt, Mycobacterium avium subsp. paratuberculosis
cagcgggacagcaccacca

SEQ ID NO: 811966 - RNA, 20 nt, Mycobacterium avium subsp. paratuberculosis
cagcgggacagcaccaccag

SEQ ID NO: 811967 - RNA, 17 nt, Mycobacterium avium subsp. paratuberculosis
cagcgggacgaucugcg

SEQ ID NO: 811968 - RNA, 20 nt, Mycobacterium avium subsp. paratuberculosis
cagcggggaggcccagcccg

SEQ ID NO: 811969 - RNA, 21 nt, Mycobacterium avium subsp. paratuberculosis
cagcggggaggcccagcccgc

SEQ ID NO: 811970 - RNA, 20 nt, Mycobacterium avium subsp. paratuberculosis
cagcggcuguagcacccggc

SEQ ID NO: 811971 - RNA, 21 nt, Mycobacterium avium subsp. paratuberculosis
cagcggcuguagcacccggcc

SEQ ID NO: 811972 - RNA, 23 nt, Mycobacterium avium subsp. paratuberculosis
cagcggcuguagcacccggccgg

SEQ ID NO: 811973 - RNA, 16 nt, Mycobacterium avium subsp. paratuberculosis
cagcggcugcagcaga

SEQ ID NO: 811974 - RNA, 20 nt, Mycobacterium avium subsp. paratuberculosis
cagcggcgugcugcgcagca

SEQ ID NO: 811975 - RNA, 13 nt, Mycobacterium avium subsp. paratuberculosis
cagcggcgucacg

SEQ ID NO: 811976 - RNA, 17 nt, Mycobacterium avium subsp. paratuberculosis
cagcggcucgcgggugc

SEQ ID NO: 811977 - RNA, 18 nt, Mycobacterium avium subsp. paratuberculosis
cagcggcucgcgggugcg

SEQ ID NO: 811978 - RNA, 13 nt, Mycobacterium avium subsp. paratuberculosis
cagcggcucggcc

SEQ ID NO: 811979 - RNA, 14 nt, Mycobacterium avium subsp. paratuberculosis
cagcggcucggccu

SEQ ID NO: 811980 - RNA, 16 nt, Mycobacterium avium subsp. paratuberculosis
cagcgcgcgaccgcga

SEQ ID NO: 811981 - RNA, 12 nt, Mycobacterium avium subsp. paratuberculosis
cagcgcgccguc

SEQ ID NO: 811982 - RNA, 14 nt, Mycobacterium avium subsp. paratuberculosis
cagcgcgcgcagcg

SEQ ID NO: 811983 - RNA, 13 nt, Mycobacterium avium subsp. paratuberculosis
cagcgcgcgauca

SEQ ID NO: 811984 - RNA, 14 nt, Mycobacterium avium subsp. paratuberculosis
cagcgcgcgaucag

SEQ ID NO: 811985 - RNA, 20 nt, Mycobacterium avium subsp. paratuberculosis
cagcgcgcgaucagcgccgu

SEQ ID NO: 811986 - RNA, 20 nt, Mycobacterium avium subsp. paratuberculosis
cagcgcgcgaucgccggugc

SEQ ID NO: 811987 - RNA, 13 nt, Mycobacterium avium subsp. paratuberculosis
cagcgcgcgcagc

SEQ ID NO: 811988 - RNA, 23 nt, Mycobacterium avium subsp. paratuberculosis
cagcgcgcgggagcgcuggucgg

SEQ ID NO: 811989 - RNA, 23 nt, Mycobacterium avium subsp. paratuberculosis
cagcgcgcgggcgcgcgccgccc

SEQ ID NO: 811990 - RNA, 19 nt, Mycobacterium avium subsp. paratuberculosis
cagcgcggauuccagcgcg

SEQ ID NO: 811991 - RNA, 20 nt, Mycobacterium avium subsp. paratuberculosis
cagcgcgcgguucuuggcgu

SEQ ID NO: 811992 - RNA, 20 nt, Mycobacterium avium subsp. paratuberculosis
cagcgcgcgcuugcgcucgg

SEQ ID NO: 811993 - RNA, 14 nt, Mycobacterium avium subsp. paratuberculosis
cagcgcgccgcuga

SEQ ID NO: 811994 - RNA, 12 nt, Mycobacterium avium subsp. paratuberculosis
cagcgcgccggc

SEQ ID NO: 811995 - RNA, 14 nt, Mycobacterium avium subsp. paratuberculosis
cagcgcgccggcca

SEQ ID NO: 811996 - RNA, 17 nt, Mycobacterium avium subsp. paratuberculosis
cagcgcgccggccagca

SEQ ID NO: 811997 - RNA, 18 nt, Mycobacterium avium subsp. paratuberculosis
cagcgcgccggccagcag

SEQ ID NO: 811998 - RNA, 13 nt, Mycobacterium avium subsp. paratuberculosis
cagcgcgccgcgc

SEQ ID NO: 811999 - RNA, 13 nt, Mycobacterium avium subsp. paratuberculosis
cagcgcgccgccg

SEQ ID NO: 812000 - RNA, 14 nt, Mycobacterium avium subsp. paratuberculosis
cagcgcgccgccga

SEQ ID NO: 812001 - RNA, 20 nt, Mycobacterium avium subsp. paratuberculosis
cagcgcgccgcacagccggc

SEQ ID NO: 812002 - RNA, 23 nt, Mycobacterium avium subsp. paratuberculosis
cagcgcgccgcacagccggcggc

SEQ ID NO: 812003 - RNA, 12 nt, Mycobacterium avium subsp. paratuberculosis
cagcgcgccgcc

SEQ ID NO: 812004 - RNA, 23 nt, Mycobacterium avium subsp. paratuberculosis
cagcgcgccgccgaugugaucgg

SEQ ID NO: 812005 - RNA, 15 nt, Mycobacterium avium subsp. paratuberculosis
cagcgagaaccggcg

SEQ ID NO: 812006 - RNA, 16 nt, Mycobacterium avium subsp. paratuberculosis
cagcgagaaccggcgc

SEQ ID NO: 812007 - RNA, 17 nt, Mycobacterium avium subsp. paratuberculosis
cagcgagaaccggcgca

SEQ ID NO: 812008 - RNA, 19 nt, Mycobacterium avium subsp. paratuberculosis
cagcgagaaccggcgcaga

SEQ ID NO: 812009 - RNA, 13 nt, Mycobacterium avium subsp. paratuberculosis
cagcgacucgggc

SEQ ID NO: 812010 - RNA, 21 nt, Mycobacterium avium subsp. paratuberculosis
cagcgacugcacccgggucag

SEQ ID NO: 812011 - RNA, 17 nt, Mycobacterium avium subsp. paratuberculosis
cagcgacuggaccacca

SEQ ID NO: 812012 - RNA, 20 nt, Mycobacterium avium subsp. paratuberculosis
cagcgacuugaccagcagcu

SEQ ID NO: 812013 - RNA, 22 nt, Mycobacterium avium subsp. paratuberculosis
cagcgacuugccgccggcgcag

SEQ ID NO: 812014 - RNA, 18 nt, Mycobacterium avium subsp. paratuberculosis
cagcgagaagucgccgac

SEQ ID NO: 812015 - RNA, 19 nt, Mycobacterium avium subsp. paratuberculosis
cagcgagaagucgccgacg

SEQ ID NO: 812016 - RNA, 21 nt, Mycobacterium avium subsp. paratuberculosis
cagcgagaagucgcucagcgu

SEQ ID NO: 812017 - RNA, 17 nt, Mycobacterium avium subsp. paratuberculosis
cagcgagaccggcacgg

SEQ ID NO: 812018 - RNA, 22 nt, Mycobacterium avium subsp. paratuberculosis
cagcgagaccggcacggugcac

SEQ ID NO: 812019 - RNA, 17 nt, Mycobacterium avium subsp. paratuberculosis
cagcgagaccucccggc

SEQ ID NO: 812020 - RNA, 21 nt, Mycobacterium avium subsp. paratuberculosis
cagcgagaccucccggcgcca

SEQ ID NO: 812021 - RNA, 19 nt, Mycobacterium avium subsp. paratuberculosis
cagcgagacgaccaggaug

SEQ ID NO: 812022 - RNA, 20 nt, Mycobacterium avium subsp. paratuberculosis
cagcgcggcguucagcagcg

SEQ ID NO: 812023 - RNA, 12 nt, Mycobacterium avium subsp. paratuberculosis
cagcgcggcgga

SEQ ID NO: 812024 - RNA, 15 nt, Mycobacterium avium subsp. paratuberculosis
cagcgcggcggucgc

SEQ ID NO: 812025 - RNA, 17 nt, Mycobacterium avium subsp. paratuberculosis
cagcgcggcggugagcc

SEQ ID NO: 812026 - RNA, 20 nt, Mycobacterium avium subsp. paratuberculosis
cagcgcggcggugagccgcc

SEQ ID NO: 812027 - RNA, 15 nt, Mycobacterium avium subsp. paratuberculosis
cagcgcggcgucacc

SEQ ID NO: 812028 - RNA, 16 nt, Mycobacterium avium subsp. paratuberculosis
cagcgcgggccagcag

SEQ ID NO: 812029 - RNA, 17 nt, Mycobacterium avium subsp. paratuberculosis
cagcgcgggccagcagu

SEQ ID NO: 812030 - RNA, 12 nt, Mycobacterium avium subsp. paratuberculosis
cagcgcgggcca

SEQ ID NO: 812031 - RNA, 18 nt, Mycobacterium avium subsp. paratuberculosis
cagcgcggucgccaccac

SEQ ID NO: 812032 - RNA, 21 nt, Mycobacterium avium subsp. paratuberculosis
cagcgcggucgccaccaccag

SEQ ID NO: 812033 - RNA, 20 nt, Mycobacterium avium subsp. paratuberculosis
cagcgcggggggagggucgg

SEQ ID NO: 812034 - RNA, 23 nt, Mycobacterium avium subsp. paratuberculosis
cagcgcgguaaagucuucggcga

SEQ ID NO: 812035 - RNA, 11 nt, Mycobacterium avium subsp. paratuberculosis
cagcgcgguca

SEQ ID NO: 812036 - RNA, 20 nt, Mycobacterium avium subsp. paratuberculosis
cagcgcggucaacaccggga

SEQ ID NO: 812037 - RNA, 22 nt, Mycobacterium avium subsp. paratuberculosis
cagcgcggucaacaccgggauc

SEQ ID NO: 812038 - RNA, 17 nt, Mycobacterium avium subsp. paratuberculosis
cagcgcggugagcagca

SEQ ID NO: 812039 - RNA, 22 nt, Mycobacterium avium subsp. paratuberculosis
cagcgcggugagcagcaugccg

SEQ ID NO: 812040 - RNA, 20 nt, Mycobacterium avium subsp. paratuberculosis
cagcgcggugaugugcagga

SEQ ID NO: 812041 - RNA, 20 nt, Mycobacterium avium subsp. paratuberculosis
cagcgcggugauguugucga

SEQ ID NO: 812042 - RNA, 15 nt, Mycobacterium avium subsp. paratuberculosis
cagcgcggugcccag

SEQ ID NO: 812043 - RNA, 22 nt, Mycobacterium avium subsp. paratuberculosis
cagcgcggugcccagccaggcc

SEQ ID NO: 812044 - RNA, 14 nt, Mycobacterium avium subsp. paratuberculosis
cagcgcggugccga

SEQ ID NO: 812045 - RNA, 15 nt, Mycobacterium avium subsp. paratuberculosis
cagcgcggugccgac

SEQ ID NO: 812046 - RNA, 17 nt, Mycobacterium avium subsp. paratuberculosis
cagcgcggugccgaccu

SEQ ID NO: 812047 - RNA, 14 nt, Mycobacterium avium subsp. paratuberculosis
cagcgcgguggcca

SEQ ID NO: 812048 - RNA, 16 nt, Mycobacterium avium subsp. paratuberculosis
cagcgcguccaaccgc

SEQ ID NO: 812049 - RNA, 17 nt, Mycobacterium avium subsp. paratuberculosis
cagcgcguccaggugcg

SEQ ID NO: 812050 - RNA, 20 nt, Mycobacterium avium subsp. paratuberculosis
cagcgcguccaggugcgccg

SEQ ID NO: 812051 - RNA, 21 nt, Mycobacterium avium subsp. paratuberculosis
cagcgcguccaggugcgccgc

SEQ ID NO: 812052 - RNA, 23 nt, Mycobacterium avium subsp. paratuberculosis
cagcgcguccaggugcgccgccg

SEQ ID NO: 812053 - RNA, 18 nt, Mycobacterium avium subsp. paratuberculosis
cagcgcgguuuccggcga

SEQ ID NO: 812054 - RNA, 19 nt, Mycobacterium avium subsp. paratuberculosis
cagcgcgguuuccggcgau

SEQ ID NO: 812055 - RNA, 24 nt, Mycobacterium avium subsp. paratuberculosis
cagcgcgguggucagcaccggcgu

SEQ ID NO: 812056 - RNA, 19 nt, Mycobacterium avium subsp. paratuberculosis
cagcgcgguggucagcggc

SEQ ID NO: 812057 - RNA, 20 nt, Mycobacterium avium subsp. paratuberculosis
cagcgcgguguacagcgcgc

SEQ ID NO: 812058 - RNA, 20 nt, Mycobacterium avium subsp. paratuberculosis
cagcgcggugucgacgucgg

SEQ ID NO: 812059 - RNA, 21 nt, Mycobacterium avium subsp. paratuberculosis
cagcgcggugugcggcggcuc

SEQ ID NO: 812060 - RNA, 23 nt, Mycobacterium avium subsp. paratuberculosis
cagcgcggugugcggcggcucgu

SEQ ID NO: 812061 - RNA, 19 nt, Mycobacterium avium subsp. paratuberculosis
cagcgcguacuccgacaga

SEQ ID NO: 812062 - RNA, 17 nt, Mycobacterium avium subsp. paratuberculosis
cagcgcguagagcauca

SEQ ID NO: 812063 - RNA, 23 nt, Mycobacterium avium subsp. paratuberculosis
cagcgcguagagcaucaggucgg

SEQ ID NO: 812064 - RNA, 12 nt, Mycobacterium avium subsp. paratuberculosis
cagcgcggcggg

SEQ ID NO: 812065 - RNA, 13 nt, Mycobacterium avium subsp. paratuberculosis
cagcgcggcgggc

SEQ ID NO: 812066 - RNA, 15 nt, Mycobacterium avium subsp. paratuberculosis
cagcgcggcgggcca

SEQ ID NO: 812067 - RNA, 14 nt, Mycobacterium avium subsp. paratuberculosis
cagcgcggcggcgc

SEQ ID NO: 812068 - RNA, 15 nt, Mycobacterium avium subsp. paratuberculosis
cagcgcggcggcgcc

SEQ ID NO: 812069 - RNA, 16 nt, Mycobacterium avium subsp. paratuberculosis
cagcgcggcggcgccg

SEQ ID NO: 812070 - RNA, 18 nt, Mycobacterium avium subsp. paratuberculosis
cagcgcggcggcgccguc

SEQ ID NO: 812071 - RNA, 14 nt, Mycobacterium avium subsp. paratuberculosis
cagcgcggcggcca

SEQ ID NO: 812072 - RNA, 19 nt, Mycobacterium avium subsp. paratuberculosis
cagcgcggcggccaccucg

SEQ ID NO: 812073 - RNA, 23 nt, Mycobacterium avium subsp. paratuberculosis
cagcgcggcggccaccucggcgg

SEQ ID NO: 812074 - RNA, 17 nt, Mycobacterium avium subsp. paratuberculosis
cagcgcggcggccagcu

SEQ ID NO: 812075 - RNA, 13 nt, Mycobacterium avium subsp. paratuberculosis
cagcgcggccgga

SEQ ID NO: 812076 - RNA, 12 nt, Mycobacterium avium subsp. paratuberculosis
cagcgcggccag

SEQ ID NO: 812077 - RNA, 15 nt, Mycobacterium avium subsp. paratuberculosis
cagcgcggccagcac

SEQ ID NO: 812078 - RNA, 22 nt, Mycobacterium avium subsp. paratuberculosis
cagcgcggccaccuccagcccg

SEQ ID NO: 812079 - RNA, 13 nt, Mycobacterium avium subsp. paratuberculosis
cagcgcggcgauc

SEQ ID NO: 812080 - RNA, 14 nt, Mycobacterium avium subsp. paratuberculosis
cagcgcggcgauca

SEQ ID NO: 812081 - RNA, 17 nt, Mycobacterium avium subsp. paratuberculosis
cagcgcggcgaucagca

SEQ ID NO: 812082 - RNA, 18 nt, Mycobacterium avium subsp. paratuberculosis
cagcgcggcgaucagcag

SEQ ID NO: 812083 - RNA, 20 nt, Mycobacterium avium subsp. paratuberculosis
cagcgcggcgaucagcagca

SEQ ID NO: 812084 - RNA, 22 nt, Mycobacterium avium subsp. paratuberculosis
cagcgcggcgaucagcugcucg

SEQ ID NO: 812085 - RNA, 14 nt, Mycobacterium avium subsp. paratuberculosis
cagcgcggcgaucg

SEQ ID NO: 812086 - RNA, 20 nt, Mycobacterium avium subsp. paratuberculosis
cagcgcggcgaucucggcgg

SEQ ID NO: 812087 - RNA, 22 nt, Mycobacterium avium subsp. paratuberculosis
cagcgcggcgaucucggcggcc

SEQ ID NO: 812088 - RNA, 23 nt, Mycobacterium avium subsp. paratuberculosis
cagcgcggcgaucucggcggccg

SEQ ID NO: 812089 - RNA, 20 nt, Mycobacterium avium subsp. paratuberculosis
cagcgcggcgaugaccgccu

SEQ ID NO: 812090 - RNA, 12 nt, Mycobacterium avium subsp. paratuberculosis
cagcgcggcccg

SEQ ID NO: 812091 - RNA, 13 nt, Mycobacterium avium subsp. paratuberculosis
cagcgcggcccgc

SEQ ID NO: 812092 - RNA, 17 nt, Mycobacterium avium subsp. paratuberculosis
cagcgcggcccgcggcg

SEQ ID NO: 812093 - RNA, 15 nt, Mycobacterium avium subsp. paratuberculosis
cagcgcggccacacc

SEQ ID NO: 812094 - RNA, 20 nt, Mycobacterium avium subsp. paratuberculosis
cagcgcggccacaccgauca

SEQ ID NO: 812095 - RNA, 14 nt, Mycobacterium avium subsp. paratuberculosis
cagcgcggccacca

SEQ ID NO: 812096 - RNA, 16 nt, Mycobacterium avium subsp. paratuberculosis
cagcgcggccaccacc

SEQ ID NO: 812097 - RNA, 17 nt, Mycobacterium avium subsp. paratuberculosis
cagcgcggccaccacca

SEQ ID NO: 812098 - RNA, 20 nt, Mycobacterium avium subsp. paratuberculosis
cagcgcggccaccaccacgg

SEQ ID NO: 812099 - RNA, 22 nt, Mycobacterium avium subsp. paratuberculosis
cagcgcggccaccaccacggcc

SEQ ID NO: 812100 - RNA, 23 nt, Mycobacterium avium subsp. paratuberculosis
cagcgcggccaccaccacggcca

SEQ ID NO: 812101 - RNA, 20 nt, Mycobacterium avium subsp. paratuberculosis
cagcgcggccaccacgacgg

SEQ ID NO: 812102 - RNA, 23 nt, Mycobacterium avium subsp. paratuberculosis
cagcgcgugcggggugugcaggc

SEQ ID NO: 812103 - RNA, 17 nt, Mycobacterium avium subsp. paratuberculosis
cagcgcguugaugacgg

SEQ ID NO: 812104 - RNA, 18 nt, Mycobacterium avium subsp. paratuberculosis
cagcgcguugcggccguc

SEQ ID NO: 812105 - RNA, 17 nt, Mycobacterium avium subsp. paratuberculosis
cagcgcuacugccgcug

SEQ ID NO: 812106 - RNA, 18 nt, Mycobacterium avium subsp. paratuberculosis
cagcgcuacugccgcugc

SEQ ID NO: 812107 - RNA, 15 nt, Mycobacterium avium subsp. paratuberculosis
cagcgcgucggcgac

SEQ ID NO: 812108 - RNA, 16 nt, Mycobacterium avium subsp. paratuberculosis
cagcgcgucggcgacc

SEQ ID NO: 812109 - RNA, 17 nt, Mycobacterium avium subsp. paratuberculosis
cagcgcgucggcgaccg

SEQ ID NO: 812110 - RNA, 20 nt, Mycobacterium avium subsp. paratuberculosis
cagcgcgucggcgaccgcgc

SEQ ID NO: 812111 - RNA, 18 nt, Mycobacterium avium subsp. paratuberculosis
cagcgcgucgggcucggc

SEQ ID NO: 812112 - RNA, 23 nt, Mycobacterium avium subsp. paratuberculosis
cagcgcgucgggcucggccgccg

SEQ ID NO: 812113 - RNA, 17 nt, Mycobacterium avium subsp. paratuberculosis
cagcgcgucgucgguca

SEQ ID NO: 812114 - RNA, 21 nt, Mycobacterium avium subsp. paratuberculosis
cagcgcgucgugcaacucccg

SEQ ID NO: 812115 - RNA, 19 nt, Mycobacterium avium subsp. paratuberculosis
cagcgcgugaccccggcga

SEQ ID NO: 812116 - RNA, 24 nt, Mycobacterium avium subsp. paratuberculosis
cagcgcgugaccccggcgaccagc

SEQ ID NO: 812117 - RNA, 17 nt, Mycobacterium avium subsp. paratuberculosis
cagcgcgugaucggugc

SEQ ID NO: 812118 - RNA, 18 nt, Mycobacterium avium subsp. paratuberculosis
cagcgcgugaucggugcc

SEQ ID NO: 812119 - RNA, 21 nt, Mycobacterium avium subsp. paratuberculosis
cagcgcgugaucggugcccgc

SEQ ID NO: 812120 - RNA, 19 nt, Mycobacterium avium subsp. paratuberculosis
cagcgcgugaugggugggc

SEQ ID NO: 812121 - RNA, 21 nt, Mycobacterium avium subsp. paratuberculosis
cagcgcgugaugggugggcag

SEQ ID NO: 812122 - RNA, 20 nt, Mycobacterium avium subsp. paratuberculosis
cagcgcgucggccagcgcgc

SEQ ID NO: 812123 - RNA, 14 nt, Mycobacterium avium subsp. paratuberculosis
cagcgcgucggcca

SEQ ID NO: 812124 - RNA, 20 nt, Mycobacterium avium subsp. paratuberculosis
cagcgcgucggccagcacca

SEQ ID NO: 812125 - RNA, 17 nt, Mycobacterium avium subsp. paratuberculosis
cagcgcgucggccagcg

SEQ ID NO: 812126 - RNA, 13 nt, Mycobacterium avium subsp. paratuberculosis
cagcgcgucgcgc

SEQ ID NO: 812127 - RNA, 20 nt, Mycobacterium avium subsp. paratuberculosis
cagcgcgucgcgcccggcgu

SEQ ID NO: 812128 - RNA, 21 nt, Mycobacterium avium subsp. paratuberculosis
cagcgcgucgcgcccggcguc

SEQ ID NO: 812129 - RNA, 15 nt, Mycobacterium avium subsp. paratuberculosis
cagcgcgucgcgggc

SEQ ID NO: 812130 - RNA, 21 nt, Mycobacterium avium subsp. paratuberculosis
cagcgcgucgcgggcccgggc

SEQ ID NO: 812131 - RNA, 16 nt, Mycobacterium avium subsp. paratuberculosis
cagcgcuuccagcgcg

SEQ ID NO: 812132 - RNA, 17 nt, Mycobacterium avium subsp. paratuberculosis
cagcgcuuccagcgcgg

SEQ ID NO: 812133 - RNA, 16 nt, Mycobacterium avium subsp. paratuberculosis
cagcgcugucgcgggc

SEQ ID NO: 812134 - RNA, 13 nt, Mycobacterium avium subsp. paratuberculosis
cagcgcucgucgu

SEQ ID NO: 812135 - RNA, 17 nt, Mycobacterium avium subsp. paratuberculosis
cagcgcuccuggccgga

SEQ ID NO: 812136 - RNA, 16 nt, Mycobacterium avium subsp. paratuberculosis
cagcgcucgacgaggc

SEQ ID NO: 812137 - RNA, 13 nt, Mycobacterium avium subsp. paratuberculosis
cagcgcuggccgg

SEQ ID NO: 812138 - RNA, 19 nt, Mycobacterium avium subsp. paratuberculosis
cagcgcuggccggccacca

SEQ ID NO: 812139 - RNA, 17 nt, Mycobacterium avium subsp. paratuberculosis
cagcggaaacgacgucg

SEQ ID NO: 812140 - RNA, 20 nt, Mycobacterium avium subsp. paratuberculosis
cagcggaaacgacgucgcca

SEQ ID NO: 812141 - RNA, 16 nt, Mycobacterium avium subsp. paratuberculosis
cagcggaaccgacacc

SEQ ID NO: 812142 - RNA, 21 nt, Mycobacterium avium subsp. paratuberculosis
cagcggaaccgggggccguca

SEQ ID NO: 812143 - RNA, 23 nt, Mycobacterium avium subsp. paratuberculosis
cagcggaaccgggggccgucaca

SEQ ID NO: 812144 - RNA, 19 nt, Mycobacterium avium subsp. paratuberculosis
cagcgcuuucgcgcacgcc

SEQ ID NO: 812145 - RNA, 19 nt, Mycobacterium avium subsp. paratuberculosis
cagcggacccggucggccg

SEQ ID NO: 812146 - RNA, 22 nt, Mycobacterium avium subsp. paratuberculosis
cagcggacccggucggccgcgu

SEQ ID NO: 812147 - RNA, 21 nt, Mycobacterium avium subsp. paratuberculosis
cagcggagcguucuccacccg

SEQ ID NO: 812148 - RNA, 18 nt, Mycobacterium avium subsp. paratuberculosis
cagcggauagaggcggcg

SEQ ID NO: 812149 - RNA, 19 nt, Mycobacterium avium subsp. paratuberculosis
cagcggauagaggcggcgc

SEQ ID NO: 812150 - RNA, 20 nt, Mycobacterium avium subsp. paratuberculosis
cagcggauagaggcggcgca

SEQ ID NO: 812151 - RNA, 16 nt, Mycobacterium avium subsp. paratuberculosis
cagcggaucggccugg

SEQ ID NO: 812152 - RNA, 13 nt, Mycobacterium avium subsp. paratuberculosis
cagcggaucggcg

SEQ ID NO: 812153 - RNA, 17 nt, Mycobacterium avium subsp. paratuberculosis
cagcggagugaccgcca

SEQ ID NO: 812154 - RNA, 14 nt, Mycobacterium avium subsp. paratuberculosis
cagcggcaccguca

SEQ ID NO: 812155 - RNA, 16 nt, Mycobacterium avium subsp. paratuberculosis
cagcggcaccgucacc

SEQ ID NO: 812156 - RNA, 18 nt, Mycobacterium avium subsp. paratuberculosis
cagcggcacccgguccgg

SEQ ID NO: 812157 - RNA, 14 nt, Mycobacterium avium subsp. paratuberculosis
cagcggcaccgcca

SEQ ID NO: 812158 - RNA, 18 nt, Mycobacterium avium subsp. paratuberculosis
cagcggcaacugggcggc

SEQ ID NO: 812159 - RNA, 17 nt, Mycobacterium avium subsp. paratuberculosis
cagcggcaacacgccgg

SEQ ID NO: 812160 - RNA, 18 nt, Mycobacterium avium subsp. paratuberculosis
cagcggcaacacgccggc

SEQ ID NO: 812161 - RNA, 20 nt, Mycobacterium avium subsp. paratuberculosis
cagcggcaacacgccggcgg

SEQ ID NO: 812162 - RNA, 21 nt, Mycobacterium avium subsp. paratuberculosis
cagcggcaacacgccggcggc

SEQ ID NO: 812163 - RNA, 23 nt, Mycobacterium avium subsp. paratuberculosis
cagcggcaacacgccggcggcca

SEQ ID NO: 812164 - RNA, 19 nt, Mycobacterium avium subsp. paratuberculosis
cagcggaucggcggucccg

SEQ ID NO: 812165 - RNA, 13 nt, Mycobacterium avium subsp. paratuberculosis
cagcggcacgucg

SEQ ID NO: 812166 - RNA, 16 nt, Mycobacterium avium subsp. paratuberculosis
cagcggcacgucgccg

SEQ ID NO: 812167 - RNA, 21 nt, Mycobacterium avium subsp. paratuberculosis
cagcggcacgggcaccgacga

SEQ ID NO: 812168 - RNA, 16 nt, Mycobacterium avium subsp. paratuberculosis
cagcggcagcacgucc

SEQ ID NO: 812169 - RNA, 14 nt, Mycobacterium avium subsp. paratuberculosis
cagcggcagcagca

SEQ ID NO: 812170 - RNA, 17 nt, Mycobacterium avium subsp. paratuberculosis
cagcggcagcagcacca

SEQ ID NO: 812171 - RNA, 17 nt, Mycobacterium avium subsp. paratuberculosis
cagcggcagccacggca

SEQ ID NO: 812172 - RNA, 13 nt, Mycobacterium avium subsp. paratuberculosis
cagcggcagcacg

SEQ ID NO: 812173 - RNA, 15 nt, Mycobacterium avium subsp. paratuberculosis
cagcggcagcggcgu

SEQ ID NO: 812174 - RNA, 14 nt, Mycobacterium avium subsp. paratuberculosis
cagcggcagcgucg

SEQ ID NO: 812175 - RNA, 16 nt, Mycobacterium avium subsp. paratuberculosis
cagcggcagcgucgcc

SEQ ID NO: 812176 - RNA, 14 nt, Mycobacterium avium subsp. paratuberculosis
cagauggucgccga

SEQ ID NO: 812177 - RNA, 18 nt, Mycobacterium avium subsp. paratuberculosis
cagauggucgccgacggu

SEQ ID NO: 812178 - RNA, 21 nt, Mycobacterium avium subsp. paratuberculosis
cagauggucgggacgucggcg

SEQ ID NO: 812179 - RNA, 23 nt, Mycobacterium avium subsp. paratuberculosis
cagauggucgggacgucggcgcg

SEQ ID NO: 812180 - RNA, 15 nt, Mycobacterium avium subsp. paratuberculosis
cagauggucucgauc

SEQ ID NO: 812181 - RNA, 16 nt, Mycobacterium avium subsp. paratuberculosis
cagaucaccacggugg

SEQ ID NO: 812182 - RNA, 20 nt, Mycobacterium avium subsp. paratuberculosis
cagaucaccacgguggccgc

SEQ ID NO: 812183 - RNA, 15 nt, Mycobacterium avium subsp. paratuberculosis
cagaugccugcccag

SEQ ID NO: 812184 - RNA, 15 nt, Mycobacterium avium subsp. paratuberculosis
cagaucagggcgaug

SEQ ID NO: 812185 - RNA, 21 nt, Mycobacterium avium subsp. paratuberculosis
cagaugcgugcgguggucggc

SEQ ID NO: 812186 - RNA, 23 nt, Mycobacterium avium subsp. paratuberculosis
cagaugcgugcgguggucggcgu

SEQ ID NO: 812187 - RNA, 15 nt, Mycobacterium avium subsp. paratuberculosis
cagaugcucgucggu

SEQ ID NO: 812188 - RNA, 14 nt, Mycobacterium avium subsp. paratuberculosis
cagaugccggugca

SEQ ID NO: 812189 - RNA, 16 nt, Mycobacterium avium subsp. paratuberculosis
cagaugccggugcaga

SEQ ID NO: 812190 - RNA, 16 nt, Mycobacterium avium subsp. paratuberculosis
cagaugcgccucgauc

SEQ ID NO: 812191 - RNA, 14 nt, Mycobacterium avium subsp. paratuberculosis
cagaugcgcgacgg

SEQ ID NO: 812192 - RNA, 18 nt, Mycobacterium avium subsp. paratuberculosis
cagaugcgcgacggccuc

SEQ ID NO: 812193 - RNA, 15 nt, Mycobacterium avium subsp. paratuberculosis
cagaugcgcgucgcg

SEQ ID NO: 812194 - RNA, 16 nt, Mycobacterium avium subsp. paratuberculosis
cagaugcgcgucgcgg

SEQ ID NO: 812195 - RNA, 19 nt, Mycobacterium avium subsp. paratuberculosis
cagaaguaacccaccggga

SEQ ID NO: 812196 - RNA, 15 nt, Mycobacterium avium subsp. paratuberculosis
cagaauucgccgggg

SEQ ID NO: 812197 - RNA, 18 nt, Mycobacterium avium subsp. paratuberculosis
cagaauucgccggggcac

SEQ ID NO: 812198 - RNA, 15 nt, Mycobacterium avium subsp. paratuberculosis
cagauacuucgucga

SEQ ID NO: 812199 - RNA, 16 nt, Mycobacterium avium subsp. paratuberculosis
cagauacgccgcgacg

SEQ ID NO: 812200 - RNA, 23 nt, Mycobacterium avium subsp. paratuberculosis
cagauacgccgcgacgaugucga

SEQ ID NO: 812201 - RNA, 20 nt, Mycobacterium avium subsp. paratuberculosis
cagauagaugagccgcagcc

SEQ ID NO: 812202 - RNA, 15 nt, Mycobacterium avium subsp. paratuberculosis
cagauaggacccggc

SEQ ID NO: 812203 - RNA, 14 nt, Mycobacterium avium subsp. paratuberculosis
cagauaggcggcga

SEQ ID NO: 812204 - RNA, 17 nt, Mycobacterium avium subsp. paratuberculosis
cagcaauugacgccgac

SEQ ID NO: 812205 - RNA, 18 nt, Mycobacterium avium subsp. paratuberculosis
cagcaauugacgccgaca

SEQ ID NO: 812206 - RNA, 17 nt, Mycobacterium avium subsp. paratuberculosis
cagcacacccucgaccc

SEQ ID NO: 812207 - RNA, 15 nt, Mycobacterium avium subsp. paratuberculosis
cagcacauagcgcag

SEQ ID NO: 812208 - RNA, 18 nt, Mycobacterium avium subsp. paratuberculosis
cagcacagccgucgcacu

SEQ ID NO: 812209 - RNA, 15 nt, Mycobacterium avium subsp. paratuberculosis
cagcacagcgaggcg

SEQ ID NO: 812210 - RNA, 16 nt, Mycobacterium avium subsp. paratuberculosis
cagcacauccagcccu

SEQ ID NO: 812211 - RNA, 17 nt, Mycobacterium avium subsp. paratuberculosis
cagcaccaacagcggcc

SEQ ID NO: 812212 - RNA, 20 nt, Mycobacterium avium subsp. paratuberculosis
cagcaauccgcugaacgggc

SEQ ID NO: 812213 - RNA, 23 nt, Mycobacterium avium subsp. paratuberculosis
cagcaauccgcugaacgggcagc

SEQ ID NO: 812214 - RNA, 16 nt, Mycobacterium avium subsp. paratuberculosis
cagcaacuccaccucg

SEQ ID NO: 812215 - RNA, 17 nt, Mycobacterium avium subsp. paratuberculosis
cagcaacugcucgacca

SEQ ID NO: 812216 - RNA, 19 nt, Mycobacterium avium subsp. paratuberculosis
cagcaacugcucgaccagc

SEQ ID NO: 812217 - RNA, 14 nt, Mycobacterium avium subsp. paratuberculosis
cagcaacggcggcg

SEQ ID NO: 812218 - RNA, 22 nt, Mycobacterium avium subsp. paratuberculosis
cagcaacucgcgcucccggcgc

SEQ ID NO: 812219 - RNA, 12 nt, Mycobacterium avium subsp. paratuberculosis
cagcaacgccga

SEQ ID NO: 812220 - RNA, 14 nt, Mycobacterium avium subsp. paratuberculosis
cagcaacgccgaca

SEQ ID NO: 812221 - RNA, 16 nt, Mycobacterium avium subsp. paratuberculosis
cagcaaccggaauggc

SEQ ID NO: 812222 - RNA, 23 nt, Mycobacterium avium subsp. paratuberculosis
cagcaaccggaauggcagcagcc

SEQ ID NO: 812223 - RNA, 14 nt, Mycobacterium avium subsp. paratuberculosis
cagcaaccggcggc

SEQ ID NO: 812224 - RNA, 12 nt, Mycobacterium avium subsp. paratuberculosis
cagcaccacguu

SEQ ID NO: 812225 - RNA, 15 nt, Mycobacterium avium subsp. paratuberculosis
cagcaccacggugau

SEQ ID NO: 812226 - RNA, 16 nt, Mycobacterium avium subsp. paratuberculosis
cagcaccacggugauc

SEQ ID NO: 812227 - RNA, 14 nt, Mycobacterium avium subsp. paratuberculosis
cagcaccacguccg

SEQ ID NO: 812228 - RNA, 16 nt, Mycobacterium avium subsp. paratuberculosis
cagcaccacguccgcg

SEQ ID NO: 812229 - RNA, 22 nt, Mycobacterium avium subsp. paratuberculosis
cagcaccacguccgcggugagc

SEQ ID NO: 812230 - RNA, 13 nt, Mycobacterium avium subsp. paratuberculosis
cagcaccagcgcc

SEQ ID NO: 812231 - RNA, 16 nt, Mycobacterium avium subsp. paratuberculosis
cagcaccagcgccgcg

SEQ ID NO: 812232 - RNA, 14 nt, Mycobacterium avium subsp. paratuberculosis
cagcaccagcacgg

SEQ ID NO: 812233 - RNA, 22 nt, Mycobacterium avium subsp. paratuberculosis
cagcaccagaugcaccucgccc

SEQ ID NO: 812234 - RNA, 12 nt, Mycobacterium avium subsp. paratuberculosis
cagcaccagcac

SEQ ID NO: 812235 - RNA, 14 nt, Mycobacterium avium subsp. paratuberculosis
cagcaccagcacca

SEQ ID NO: 812236 - RNA, 17 nt, Mycobacterium avium subsp. paratuberculosis
cagcaccagcacggcga

SEQ ID NO: 812237 - RNA, 15 nt, Mycobacterium avium subsp. paratuberculosis
cagcaccaccaacag

SEQ ID NO: 812238 - RNA, 16 nt, Mycobacterium avium subsp. paratuberculosis
cagcaccaccaacagc

SEQ ID NO: 812239 - RNA, 17 nt, Mycobacterium avium subsp. paratuberculosis
cagcaccaccaacagca

SEQ ID NO: 812240 - RNA, 21 nt, Mycobacterium avium subsp. paratuberculosis
cagcaccaccaacagcagcga

SEQ ID NO: 812241 - RNA, 16 nt, Mycobacterium avium subsp. paratuberculosis
cagcaccaccacgcug

SEQ ID NO: 812242 - RNA, 22 nt, Mycobacterium avium subsp. paratuberculosis
cagcaccaccacgcuggccccg

SEQ ID NO: 812243 - RNA, 17 nt, Mycobacterium avium subsp. paratuberculosis
cagcaccaccacguugc

SEQ ID NO: 812244 - RNA, 15 nt, Mycobacterium avium subsp. paratuberculosis
cagcaccaccagguc

SEQ ID NO: 812245 - RNA, 22 nt, Mycobacterium avium subsp. paratuberculosis
cagcaccaccaggucuccgucg

SEQ ID NO: 812246 - RNA, 23 nt, Mycobacterium avium subsp. paratuberculosis
cagcaccaccaggucuccgucgg

SEQ ID NO: 812247 - RNA, 13 nt, Mycobacterium avium subsp. paratuberculosis
cagcaccacaucg

SEQ ID NO: 812248 - RNA, 20 nt, Mycobacterium avium subsp. paratuberculosis
cagcaccacccggucgaugu

SEQ ID NO: 812249 - RNA, 12 nt, Mycobacterium avium subsp. paratuberculosis
cagcaccaccgu

SEQ ID NO: 812250 - RNA, 22 nt, Mycobacterium avium subsp. paratuberculosis
cagcaccaccgucaccgccgca

SEQ ID NO: 812251 - RNA, 16 nt, Mycobacterium avium subsp. paratuberculosis
cagcaccaccguggcg

SEQ ID NO: 812252 - RNA, 20 nt, Mycobacterium avium subsp. paratuberculosis
cagcaccaccguggcgaugg

SEQ ID NO: 812253 - RNA, 16 nt, Mycobacterium avium subsp. paratuberculosis
cagcaccauccgcgcg

SEQ ID NO: 812254 - RNA, 13 nt, Mycobacterium avium subsp. paratuberculosis
cagcaccaguucg

SEQ ID NO: 812255 - RNA, 19 nt, Mycobacterium avium subsp. paratuberculosis
cagcaccaguugcaccggc

SEQ ID NO: 812256 - RNA, 21 nt, Mycobacterium avium subsp. paratuberculosis
cagcaccaguugcaccggcac

SEQ ID NO: 812257 - RNA, 22 nt, Mycobacterium avium subsp. paratuberculosis
cagcaccaggcugaccagcgcc

SEQ ID NO: 812258 - RNA, 13 nt, Mycobacterium avium subsp. paratuberculosis
cagcaccagcccg

SEQ ID NO: 812259 - RNA, 20 nt, Mycobacterium avium subsp. paratuberculosis
cagcaccaggcccucgccgc

SEQ ID NO: 812260 - RNA, 16 nt, Mycobacterium avium subsp. paratuberculosis
cagcaccagggcgugu

SEQ ID NO: 812261 - RNA, 19 nt, Mycobacterium avium subsp. paratuberculosis
cagcaccagguggcccgac

SEQ ID NO: 812262 - RNA, 21 nt, Mycobacterium avium subsp. paratuberculosis
cagcaccagguugucgccgcg

SEQ ID NO: 812263 - RNA, 14 nt, Mycobacterium avium subsp. paratuberculosis
cagcaccagcgcgc

SEQ ID NO: 812264 - RNA, 15 nt, Mycobacterium avium subsp. paratuberculosis
cagcaccagcgcgcg

SEQ ID NO: 812265 - RNA, 14 nt, Mycobacterium avium subsp. paratuberculosis
cagcaccagcggca

SEQ ID NO: 812266 - RNA, 16 nt, Mycobacterium avium subsp. paratuberculosis
cagcaccagcggcacc

SEQ ID NO: 812267 - RNA, 17 nt, Mycobacterium avium subsp. paratuberculosis
cagcaccagcggcacca

SEQ ID NO: 812268 - RNA, 22 nt, Mycobacterium avium subsp. paratuberculosis
cagcaccagcguggccggcagg

SEQ ID NO: 812269 - RNA, 17 nt, Mycobacterium avium subsp. paratuberculosis
cagcacccagcacagcg

SEQ ID NO: 812270 - RNA, 21 nt, Mycobacterium avium subsp. paratuberculosis
cagcacccagcacagcgaggc

SEQ ID NO: 812271 - RNA, 18 nt, Mycobacterium avium subsp. paratuberculosis
cagcacccaggugcugcc

SEQ ID NO: 812272 - RNA, 17 nt, Mycobacterium avium subsp. paratuberculosis
cagcacccccucggcgc

SEQ ID NO: 812273 - RNA, 23 nt, Mycobacterium avium subsp. paratuberculosis
cagcacccccucggcgccggugg

SEQ ID NO: 812274 - RNA, 16 nt, Mycobacterium avium subsp. paratuberculosis
cagcaccccgaucgcg

SEQ ID NO: 812275 - RNA, 22 nt, Mycobacterium avium subsp. paratuberculosis
cagcaccccgaucgcgaucacc

SEQ ID NO: 812276 - RNA, 17 nt, Mycobacterium avium subsp. paratuberculosis
cagcaccccgccgcagc

SEQ ID NO: 812277 - RNA, 20 nt, Mycobacterium avium subsp. paratuberculosis
cagcaccccgguccaggcga

SEQ ID NO: 812278 - RNA, 22 nt, Mycobacterium avium subsp. paratuberculosis
cagcaccccgguccaggcgacc

SEQ ID NO: 812279 - RNA, 16 nt, Mycobacterium avium subsp. paratuberculosis
cagcaccccgucgagg

SEQ ID NO: 812280 - RNA, 18 nt, Mycobacterium avium subsp. paratuberculosis
cagcaccccgucgagguu

SEQ ID NO: 812281 - RNA, 18 nt, Mycobacterium avium subsp. paratuberculosis
cagcacccgcucgcgggc

SEQ ID NO: 812282 - RNA, 21 nt, Mycobacterium avium subsp. paratuberculosis
cagcacccgguuccaccgggc

SEQ ID NO: 812283 - RNA, 18 nt, Mycobacterium avium subsp. paratuberculosis
cagcacccggcccacgcc

SEQ ID NO: 812284 - RNA, 20 nt, Mycobacterium avium subsp. paratuberculosis
cagcacccggcccacgccgu

SEQ ID NO: 812285 - RNA, 15 nt, Mycobacterium avium subsp. paratuberculosis
cagcacccggccccc

SEQ ID NO: 812286 - RNA, 13 nt, Mycobacterium avium subsp. paratuberculosis
cagcacccgggcc

SEQ ID NO: 812287 - RNA, 15 nt, Mycobacterium avium subsp. paratuberculosis
cagcacccgggugau

SEQ ID NO: 812288 - RNA, 22 nt, Mycobacterium avium subsp. paratuberculosis
cagcacccgggugaucaacgcg

SEQ ID NO: 812289 - RNA, 16 nt, Mycobacterium avium subsp. paratuberculosis
cagcacccgacuucgg

SEQ ID NO: 812290 - RNA, 19 nt, Mycobacterium avium subsp. paratuberculosis
cagcacccgacuucggcuc

SEQ ID NO: 812291 - RNA, 15 nt, Mycobacterium avium subsp. paratuberculosis
cagcacccgcugauc

SEQ ID NO: 812292 - RNA, 17 nt, Mycobacterium avium subsp. paratuberculosis
cagcacccgcugcagcc

SEQ ID NO: 812293 - RNA, 19 nt, Mycobacterium avium subsp. paratuberculosis
cagcacccgcugcagccgg

SEQ ID NO: 812294 - RNA, 22 nt, Mycobacterium avium subsp. paratuberculosis
cagcaccgcaucccccucggcg

SEQ ID NO: 812295 - RNA, 13 nt, Mycobacterium avium subsp. paratuberculosis
cagcaccgccacc

SEQ ID NO: 812296 - RNA, 14 nt, Mycobacterium avium subsp. paratuberculosis
cagcaccgccacgc

SEQ ID NO: 812297 - RNA, 19 nt, Mycobacterium avium subsp. paratuberculosis
cagcaccgccacggcgacg

SEQ ID NO: 812298 - RNA, 13 nt, Mycobacterium avium subsp. paratuberculosis
cagcaccgccagc

SEQ ID NO: 812299 - RNA, 14 nt, Mycobacterium avium subsp. paratuberculosis
cagcaccgccagca

SEQ ID NO: 812300 - RNA, 13 nt, Mycobacterium avium subsp. paratuberculosis
cagcaccgagauc

SEQ ID NO: 812301 - RNA, 20 nt, Mycobacterium avium subsp. paratuberculosis
cagcaccgagaucucgucga

SEQ ID NO: 812302 - RNA, 12 nt, Mycobacterium avium subsp. paratuberculosis
cagcaccgacgc

SEQ ID NO: 812303 - RNA, 15 nt, Mycobacterium avium subsp. paratuberculosis
cagcaccgacgcggc

SEQ ID NO: 812304 - RNA, 16 nt, Mycobacterium avium subsp. paratuberculosis
cagcaccgacgcggcg

SEQ ID NO: 812305 - RNA, 17 nt, Mycobacterium avium subsp. paratuberculosis
cagcaccgacgcggcga

SEQ ID NO: 812306 - RNA, 20 nt, Mycobacterium avium subsp. paratuberculosis
cagcaccgacgcggcgacca

SEQ ID NO: 812307 - RNA, 14 nt, Mycobacterium avium subsp. paratuberculosis
cagcaccgaaccgg

SEQ ID NO: 812308 - RNA, 18 nt, Mycobacterium avium subsp. paratuberculosis
cagcaccgaaccggcggg

SEQ ID NO: 812309 - RNA, 20 nt, Mycobacterium avium subsp. paratuberculosis
cagcaccgaaccggcggggu

SEQ ID NO: 812310 - RNA, 23 nt, Mycobacterium avium subsp. paratuberculosis
cagcaccgaaucgccgagcucga

SEQ ID NO: 812311 - RNA, 22 nt, Mycobacterium avium subsp. paratuberculosis
cagcaccgacuccuccggcccg

SEQ ID NO: 812312 - RNA, 23 nt, Mycobacterium avium subsp. paratuberculosis
cagcaccgccagcauccgcuggu

SEQ ID NO: 812313 - RNA, 15 nt, Mycobacterium avium subsp. paratuberculosis
cagcaccgccagcgc

SEQ ID NO: 812314 - RNA, 23 nt, Mycobacterium avium subsp. paratuberculosis
cagcaccgaguugaucccccgaa

SEQ ID NO: 812315 - RNA, 14 nt, Mycobacterium avium subsp. paratuberculosis
cagcaccgccaccg

SEQ ID NO: 812316 - RNA, 20 nt, Mycobacterium avium subsp. paratuberculosis
cagcaccgccagcgccggca

SEQ ID NO: 812317 - RNA, 13 nt, Mycobacterium avium subsp. paratuberculosis
cagcaccgccgcg

SEQ ID NO: 812318 - RNA, 19 nt, Mycobacterium avium subsp. paratuberculosis
cagcaccgccccggucacc

SEQ ID NO: 812319 - RNA, 13 nt, Mycobacterium avium subsp. paratuberculosis
cagcaccgccgac

SEQ ID NO: 812320 - RNA, 14 nt, Mycobacterium avium subsp. paratuberculosis
cagcaccgccgaca

SEQ ID NO: 812321 - RNA, 19 nt, Mycobacterium avium subsp. paratuberculosis
cagcaccgccgagccgucg

SEQ ID NO: 812322 - RNA, 20 nt, Mycobacterium avium subsp. paratuberculosis
cagcaccgccgagccgucgu

SEQ ID NO: 812323 - RNA, 14 nt, Mycobacterium avium subsp. paratuberculosis
cagcaccgccucgg

SEQ ID NO: 812324 - RNA, 16 nt, Mycobacterium avium subsp. paratuberculosis
cagcaccgccucggcc

SEQ ID NO: 812325 - RNA, 17 nt, Mycobacterium avium subsp. paratuberculosis
cagcaccgccucggcca

SEQ ID NO: 812326 - RNA, 14 nt, Mycobacterium avium subsp. paratuberculosis
cagcaccgccgcgg

SEQ ID NO: 812327 - RNA, 15 nt, Mycobacterium avium subsp. paratuberculosis
cagcaccgccgcggc

SEQ ID NO: 812328 - RNA, 18 nt, Mycobacterium avium subsp. paratuberculosis
cagcaccgccgcggccgc

SEQ ID NO: 812329 - RNA, 16 nt, Mycobacterium avium subsp. paratuberculosis
cagcaccgccgcgggc

SEQ ID NO: 812330 - RNA, 13 nt, Mycobacterium avium subsp. paratuberculosis
cagcaccgcgaac

SEQ ID NO: 812331 - RNA, 12 nt, Mycobacterium avium subsp. paratuberculosis
cagcaccgcgac

SEQ ID NO: 812332 - RNA, 13 nt, Mycobacterium avium subsp. paratuberculosis
cagcaccggcagc

SEQ ID NO: 812333 - RNA, 14 nt, Mycobacterium avium subsp. paratuberculosis
cagcaccggcagca

SEQ ID NO: 812334 - RNA, 13 nt, Mycobacterium avium subsp. paratuberculosis
cagcaccggcaug

SEQ ID NO: 812335 - RNA, 15 nt, Mycobacterium avium subsp. paratuberculosis
cagcaccggccggau

SEQ ID NO: 812336 - RNA, 14 nt, Mycobacterium avium subsp. paratuberculosis
cagcaccggcgcca

SEQ ID NO: 812337 - RNA, 14 nt, Mycobacterium avium subsp. paratuberculosis
cagcaccggcgccc

SEQ ID NO: 812338 - RNA, 16 nt, Mycobacterium avium subsp. paratuberculosis
cagcaccggcgccucg

SEQ ID NO: 812339 - RNA, 17 nt, Mycobacterium avium subsp. paratuberculosis
cagcaccggcgccucgu

SEQ ID NO: 812340 - RNA, 20 nt, Mycobacterium avium subsp. paratuberculosis
cagcaccggcgccucgugca

SEQ ID NO: 812341 - RNA, 13 nt, Mycobacterium avium subsp. paratuberculosis
cagcaccggcgcg

SEQ ID NO: 812342 - RNA, 18 nt, Mycobacterium avium subsp. paratuberculosis
cagcaccggcgcgccgcg

SEQ ID NO: 812343 - RNA, 13 nt, Mycobacterium avium subsp. paratuberculosis
cagcaccgcgguc

SEQ ID NO: 812344 - RNA, 14 nt, Mycobacterium avium subsp. paratuberculosis
cagcaccgcgucga

SEQ ID NO: 812345 - RNA, 16 nt, Mycobacterium avium subsp. paratuberculosis
cagcaccgcgucgaug

SEQ ID NO: 812346 - RNA, 17 nt, Mycobacterium avium subsp. paratuberculosis
cagcaccgcgucggcgc

SEQ ID NO: 812347 - RNA, 19 nt, Mycobacterium avium subsp. paratuberculosis
cagcaccgcgucggcgcug

SEQ ID NO: 812348 - RNA, 14 nt, Mycobacterium avium subsp. paratuberculosis
cagcaccgcguugu

SEQ ID NO: 812349 - RNA, 17 nt, Mycobacterium avium subsp. paratuberculosis
cagcaccgcgcggcggu

SEQ ID NO: 812350 - RNA, 13 nt, Mycobacterium avium subsp. paratuberculosis
cagcaccgcggcc

SEQ ID NO: 812351 - RNA, 17 nt, Mycobacterium avium subsp. paratuberculosis
cagcaccgcggccgucg

SEQ ID NO: 812352 - RNA, 17 nt, Mycobacterium avium subsp. paratuberculosis
cagcaccgcggcgaucg

SEQ ID NO: 812353 - RNA, 22 nt, Mycobacterium avium subsp. paratuberculosis
cagcaccgcggcgaucgccgug

SEQ ID NO: 812354 - RNA, 23 nt, Mycobacterium avium subsp. paratuberculosis
cagcaccgcgacccaggccgccg

SEQ ID NO: 812355 - RNA, 15 nt, Mycobacterium avium subsp. paratuberculosis
cagcaccgcgaccgg

SEQ ID NO: 812356 - RNA, 19 nt, Mycobacterium avium subsp. paratuberculosis
cagcaccgcgaccgguccg

SEQ ID NO: 812357 - RNA, 13 nt, Mycobacterium avium subsp. paratuberculosis
cagcaccgcgacg

SEQ ID NO: 812358 - RNA, 13 nt, Mycobacterium avium subsp. paratuberculosis
cagcaccggcacc

SEQ ID NO: 812359 - RNA, 14 nt, Mycobacterium avium subsp. paratuberculosis
cagcaccggcaccg

SEQ ID NO: 812360 - RNA, 15 nt, Mycobacterium avium subsp. paratuberculosis
cagcaccggcaccgc

SEQ ID NO: 812361 - RNA, 16 nt, Mycobacterium avium subsp. paratuberculosis
cagcaccggcaccgcc

SEQ ID NO: 812362 - RNA, 22 nt, Mycobacterium avium subsp. paratuberculosis
cagcaccggcaccgcggcgaug

SEQ ID NO: 812363 - RNA, 20 nt, Mycobacterium avium subsp. paratuberculosis
cagcaccgcgacgaucgcga

SEQ ID NO: 812364 - RNA, 14 nt, Mycobacterium avium subsp. paratuberculosis
cagcaccggcuggu

SEQ ID NO: 812365 - RNA, 14 nt, Mycobacterium avium subsp. paratuberculosis
cagcaccggcgugg

SEQ ID NO: 812366 - RNA, 13 nt, Mycobacterium avium subsp. paratuberculosis
cagcaccggcgug

SEQ ID NO: 812367 - RNA, 15 nt, Mycobacterium avium subsp. paratuberculosis
cagcaccggcgucga

SEQ ID NO: 812368 - RNA, 19 nt, Mycobacterium avium subsp. paratuberculosis
cagcaccggcgucgacagc

SEQ ID NO: 812369 - RNA, 15 nt, Mycobacterium avium subsp. paratuberculosis
cagcaccgggcccag

SEQ ID NO: 812370 - RNA, 13 nt, Mycobacterium avium subsp. paratuberculosis
cagcaccggggcc

SEQ ID NO: 812371 - RNA, 14 nt, Mycobacterium avium subsp. paratuberculosis
cagcaccggggcca

SEQ ID NO: 812372 - RNA, 14 nt, Mycobacterium avium subsp. paratuberculosis
cagcaccgggugau

SEQ ID NO: 812373 - RNA, 18 nt, Mycobacterium avium subsp. paratuberculosis
cagcaccgggugauaccg

SEQ ID NO: 812374 - RNA, 21 nt, Mycobacterium avium subsp. paratuberculosis
cagcaccgggugauaccggcc

SEQ ID NO: 812375 - RNA, 22 nt, Mycobacterium avium subsp. paratuberculosis
cagcaccgggugauaccggccc

SEQ ID NO: 812376 - RNA, 16 nt, Mycobacterium avium subsp. paratuberculosis
cagcaccgucaccgcc

SEQ ID NO: 812377 - RNA, 13 nt, Mycobacterium avium subsp. paratuberculosis
cagcaccgucagc

SEQ ID NO: 812378 - RNA, 16 nt, Mycobacterium avium subsp. paratuberculosis
cagcaccguccacagc

SEQ ID NO: 812379 - RNA, 23 nt, Mycobacterium avium subsp. paratuberculosis
cagcaccguccacagccggcggc

SEQ ID NO: 812380 - RNA, 14 nt, Mycobacterium avium subsp. paratuberculosis
cagcaccucggcga

SEQ ID NO: 812381 - RNA, 15 nt, Mycobacterium avium subsp. paratuberculosis
cagcaccucggcgac

SEQ ID NO: 812382 - RNA, 16 nt, Mycobacterium avium subsp. paratuberculosis
cagcaccucggcgacc

SEQ ID NO: 812383 - RNA, 17 nt, Mycobacterium avium subsp. paratuberculosis
cagcaccucggcgacca

SEQ ID NO: 812384 - RNA, 19 nt, Mycobacterium avium subsp. paratuberculosis
cagcaccucgcccugcagc

SEQ ID NO: 812385 - RNA, 13 nt, Mycobacterium avium subsp. paratuberculosis
cagcaccucgcgc

SEQ ID NO: 812386 - RNA, 20 nt, Mycobacterium avium subsp. paratuberculosis
cagcaccucgcgcagcaccg

SEQ ID NO: 812387 - RNA, 20 nt, Mycobacterium avium subsp. paratuberculosis
cagcaccgucugcgccguca

SEQ ID NO: 812388 - RNA, 17 nt, Mycobacterium avium subsp. paratuberculosis
cagcaccgugggcccgu

SEQ ID NO: 812389 - RNA, 19 nt, Mycobacterium avium subsp. paratuberculosis
cagcaccgugggcccgugc

SEQ ID NO: 812390 - RNA, 23 nt, Mycobacterium avium subsp. paratuberculosis
cagcaccgugggcccgugcgggu

SEQ ID NO: 812391 - RNA, 16 nt, Mycobacterium avium subsp. paratuberculosis
cagcaccgucggcgug

SEQ ID NO: 812392 - RNA, 17 nt, Mycobacterium avium subsp. paratuberculosis
cagcaccuccgacagcc

SEQ ID NO: 812393 - RNA, 15 nt, Mycobacterium avium subsp. paratuberculosis
cagcaccuccggcag

SEQ ID NO: 812394 - RNA, 20 nt, Mycobacterium avium subsp. paratuberculosis
cagcacgcccagaucgccga

SEQ ID NO: 812395 - RNA, 22 nt, Mycobacterium avium subsp. paratuberculosis
cagcacgcccagaugcaggcuc

SEQ ID NO: 812396 - RNA, 14 nt, Mycobacterium avium subsp. paratuberculosis
cagcacgcccagcc

SEQ ID NO: 812397 - RNA, 21 nt, Mycobacterium avium subsp. paratuberculosis
cagcacgcccagcccgcgggc

SEQ ID NO: 812398 - RNA, 23 nt, Mycobacterium avium subsp. paratuberculosis
cagcacgaucggguagacgucgg

SEQ ID NO: 812399 - RNA, 19 nt, Mycobacterium avium subsp. paratuberculosis
cagcacgaugacgaccggg

SEQ ID NO: 812400 - RNA, 17 nt, Mycobacterium avium subsp. paratuberculosis
cagcacgaugaucccga

SEQ ID NO: 812401 - RNA, 19 nt, Mycobacterium avium subsp. paratuberculosis
cagcacgaucccgccgccc

SEQ ID NO: 812402 - RNA, 16 nt, Mycobacterium avium subsp. paratuberculosis
cagcaccuugccgguc

SEQ ID NO: 812403 - RNA, 18 nt, Mycobacterium avium subsp. paratuberculosis
cagcaccuugccggucgg

SEQ ID NO: 812404 - RNA, 18 nt, Mycobacterium avium subsp. paratuberculosis
cagcaccuuccaucgacg

SEQ ID NO: 812405 - RNA, 22 nt, Mycobacterium avium subsp. paratuberculosis
cagcaccuuccaucgacgcuga

SEQ ID NO: 812406 - RNA, 14 nt, Mycobacterium avium subsp. paratuberculosis
cagcaccuucgggc

SEQ ID NO: 812407 - RNA, 19 nt, Mycobacterium avium subsp. paratuberculosis
cagcaccuucagcgggcgc

SEQ ID NO: 812408 - RNA, 13 nt, Mycobacterium avium subsp. paratuberculosis
cagcaccuggcgc

SEQ ID NO: 812409 - RNA, 17 nt, Mycobacterium avium subsp. paratuberculosis
cagcaccuggcgcaccg

SEQ ID NO: 812410 - RNA, 22 nt, Mycobacterium avium subsp. paratuberculosis
cagcaccuggcgcaccgccgcg

SEQ ID NO: 812411 - RNA, 19 nt, Mycobacterium avium subsp. paratuberculosis
cagcaccucgucgcccggc

SEQ ID NO: 812412 - RNA, 20 nt, Mycobacterium avium subsp. paratuberculosis
cagcaccucgucgcccggcg

SEQ ID NO: 812413 - RNA, 13 nt, Mycobacterium avium subsp. paratuberculosis
cagcagcagcggc

SEQ ID NO: 812414 - RNA, 16 nt, Mycobacterium avium subsp. paratuberculosis
cagcagcagcggcagc

SEQ ID NO: 812415 - RNA, 15 nt, Mycobacterium avium subsp. paratuberculosis
cagcagcagcgccuc

SEQ ID NO: 812416 - RNA, 13 nt, Mycobacterium avium subsp. paratuberculosis
cagcagcagcgcg

SEQ ID NO: 812417 - RNA, 14 nt, Mycobacterium avium subsp. paratuberculosis
cagcagcagcgcgg

SEQ ID NO: 812418 - RNA, 14 nt, Mycobacterium avium subsp. paratuberculosis
cagcagcagguccu

SEQ ID NO: 812419 - RNA, 13 nt, Mycobacterium avium subsp. paratuberculosis
cagcagcaggucg

SEQ ID NO: 812420 - RNA, 20 nt, Mycobacterium avium subsp. paratuberculosis
cagcagcaggucggccagcu

SEQ ID NO: 812421 - RNA, 17 nt, Mycobacterium avium subsp. paratuberculosis
cagcagcaggucgucga

SEQ ID NO: 812422 - RNA, 14 nt, Mycobacterium avium subsp. paratuberculosis
cagcagcgccgcca

SEQ ID NO: 812423 - RNA, 16 nt, Mycobacterium avium subsp. paratuberculosis
cagcagcgccgccacc

SEQ ID NO: 812424 - RNA, 20 nt, Mycobacterium avium subsp. paratuberculosis
cagcagcgccgccaccggcc

SEQ ID NO: 812425 - RNA, 13 nt, Mycobacterium avium subsp. paratuberculosis
cagcagcgcccac

SEQ ID NO: 812426 - RNA, 22 nt, Mycobacterium avium subsp. paratuberculosis
cagcagcgcccaccgcucgucg

SEQ ID NO: 812427 - RNA, 23 nt, Mycobacterium avium subsp. paratuberculosis
cagcagcgcccaccgcucgucgg

SEQ ID NO: 812428 - RNA, 13 nt, Mycobacterium avium subsp. paratuberculosis
cagcagcgccagc

SEQ ID NO: 812429 - RNA, 17 nt, Mycobacterium avium subsp. paratuberculosis
cagcagcgccagcaccg

SEQ ID NO: 812430 - RNA, 16 nt, Mycobacterium avium subsp. paratuberculosis
cagcagcgccagcagc

SEQ ID NO: 812431 - RNA, 13 nt, Mycobacterium avium subsp. paratuberculosis
cagcagcgccaca

SEQ ID NO: 812432 - RNA, 14 nt, Mycobacterium avium subsp. paratuberculosis
cagcagccagcugg

SEQ ID NO: 812433 - RNA, 23 nt, Mycobacterium avium subsp. paratuberculosis
cagcagcgacuugaccagcagcu

SEQ ID NO: 812434 - RNA, 22 nt, Mycobacterium avium subsp. paratuberculosis
cagcagcgagaaccggcgcaga

SEQ ID NO: 812435 - RNA, 23 nt, Mycobacterium avium subsp. paratuberculosis
cagcagcgagaccggcacggugc

SEQ ID NO: 812436 - RNA, 12 nt, Mycobacterium avium subsp. paratuberculosis
cagcagcgaggc

SEQ ID NO: 812437 - RNA, 14 nt, Mycobacterium avium subsp. paratuberculosis
cagcagcgcaccgg

SEQ ID NO: 812438 - RNA, 19 nt, Mycobacterium avium subsp. paratuberculosis
cagcagcuccaucgacgga

SEQ ID NO: 812439 - RNA, 17 nt, Mycobacterium avium subsp. paratuberculosis
cagcagcguuccgucgg

SEQ ID NO: 812440 - RNA, 20 nt, Mycobacterium avium subsp. paratuberculosis
cagcagcguuccgucggcga

SEQ ID NO: 812441 - RNA, 19 nt, Mycobacterium avium subsp. paratuberculosis
cagcagcucggcgaucacc

SEQ ID NO: 812442 - RNA, 20 nt, Mycobacterium avium subsp. paratuberculosis
cagcagcucgguggcgucgg

SEQ ID NO: 812443 - RNA, 19 nt, Mycobacterium avium subsp. paratuberculosis
cagcagcugcccgagcggc

SEQ ID NO: 812444 - RNA, 16 nt, Mycobacterium avium subsp. paratuberculosis
cagcagcugcgggacc

SEQ ID NO: 812445 - RNA, 14 nt, Mycobacterium avium subsp. paratuberculosis
cagcagcugcguca

SEQ ID NO: 812446 - RNA, 19 nt, Mycobacterium avium subsp. paratuberculosis
cagcagcugcgucggcacc

SEQ ID NO: 812447 - RNA, 11 nt, Mycobacterium avium subsp. paratuberculosis
cagcagcgugg

SEQ ID NO: 812448 - RNA, 16 nt, Mycobacterium avium subsp. paratuberculosis
cagcagcgcgacgccg

SEQ ID NO: 812449 - RNA, 17 nt, Mycobacterium avium subsp. paratuberculosis
cagcagcgcgacgccga

SEQ ID NO: 812450 - RNA, 23 nt, Mycobacterium avium subsp. paratuberculosis
cagcagcgucgucaggccgugau

SEQ ID NO: 812451 - RNA, 16 nt, Mycobacterium avium subsp. paratuberculosis
cagcagcgucugcgcc

SEQ ID NO: 812452 - RNA, 17 nt, Mycobacterium avium subsp. paratuberculosis
cagcagcgucugcgcca

SEQ ID NO: 812453 - RNA, 14 nt, Mycobacterium avium subsp. paratuberculosis
cagcagcgccucgc

SEQ ID NO: 812454 - RNA, 17 nt, Mycobacterium avium subsp. paratuberculosis
cagcagcgccucgccgg

SEQ ID NO: 812455 - RNA, 20 nt, Mycobacterium avium subsp. paratuberculosis
cagcagcgccucgccgggcc

SEQ ID NO: 812456 - RNA, 17 nt, Mycobacterium avium subsp. paratuberculosis
cagcagcgccgcuucgu

SEQ ID NO: 812457 - RNA, 14 nt, Mycobacterium avium subsp. paratuberculosis
cagcagcgccggca

SEQ ID NO: 812458 - RNA, 15 nt, Mycobacterium avium subsp. paratuberculosis
cagcagcgccgcgac

SEQ ID NO: 812459 - RNA, 23 nt, Mycobacterium avium subsp. paratuberculosis
cagcacgccuuccacgaccuggc

SEQ ID NO: 812460 - RNA, 13 nt, Mycobacterium avium subsp. paratuberculosis
cagcacgccgguc

SEQ ID NO: 812461 - RNA, 13 nt, Mycobacterium avium subsp. paratuberculosis
cagcacgccgggc

SEQ ID NO: 812462 - RNA, 16 nt, Mycobacterium avium subsp. paratuberculosis
cagcacgccgggcaug

SEQ ID NO: 812463 - RNA, 23 nt, Mycobacterium avium subsp. paratuberculosis
cagcacgccguccuuggccgcca

SEQ ID NO: 812464 - RNA, 16 nt, Mycobacterium avium subsp. paratuberculosis
cagcacgccguugacc

SEQ ID NO: 812465 - RNA, 22 nt, Mycobacterium avium subsp. paratuberculosis
cagcacgccguugaccccgacg

SEQ ID NO: 812466 - RNA, 23 nt, Mycobacterium avium subsp. paratuberculosis
cagcacgccguugaccccgacgg

SEQ ID NO: 812467 - RNA, 14 nt, Mycobacterium avium subsp. paratuberculosis
cagcacgccgcgga

SEQ ID NO: 812468 - RNA, 18 nt, Mycobacterium avium subsp. paratuberculosis
cagcacgccgcggaaggc

SEQ ID NO: 812469 - RNA, 23 nt, Mycobacterium avium subsp. paratuberculosis
cagcacgccgcggaaggccagcu

SEQ ID NO: 812470 - RNA, 11 nt, Mycobacterium avium subsp. paratuberculosis
cagcacgccgg

SEQ ID NO: 812471 - RNA, 15 nt, Mycobacterium avium subsp. paratuberculosis
cagcacgccggccgg

SEQ ID NO: 812472 - RNA, 16 nt, Mycobacterium avium subsp. paratuberculosis
cagcacgccggccggc

SEQ ID NO: 812473 - RNA, 17 nt, Mycobacterium avium subsp. paratuberculosis
cagcacgccggccggcg

SEQ ID NO: 812474 - RNA, 18 nt, Mycobacterium avium subsp. paratuberculosis
cagcacgccggccggcgu

SEQ ID NO: 812475 - RNA, 18 nt, Mycobacterium avium subsp. paratuberculosis
cagcacgcaggcguggcc

SEQ ID NO: 812476 - RNA, 17 nt, Mycobacterium avium subsp. paratuberculosis
cagcacggcgaccagcg

SEQ ID NO: 812477 - RNA, 20 nt, Mycobacterium avium subsp. paratuberculosis
cagcacgcugaagcccaccg

SEQ ID NO: 812478 - RNA, 24 nt, Mycobacterium avium subsp. paratuberculosis
cagcacgcugaagcccaccgccgu

SEQ ID NO: 812479 - RNA, 14 nt, Mycobacterium avium subsp. paratuberculosis
cagcacggcaaugg

SEQ ID NO: 812480 - RNA, 13 nt, Mycobacterium avium subsp. paratuberculosis
cagcacggcaucg

SEQ ID NO: 812481 - RNA, 20 nt, Mycobacterium avium subsp. paratuberculosis
cagcacggcaucgauggcgg

SEQ ID NO: 812482 - RNA, 14 nt, Mycobacterium avium subsp. paratuberculosis
cagcacggccacug

SEQ ID NO: 812483 - RNA, 14 nt, Mycobacterium avium subsp. paratuberculosis
cagcacggccgcca

SEQ ID NO: 812484 - RNA, 14 nt, Mycobacterium avium subsp. paratuberculosis
cagcacggccgcgg

SEQ ID NO: 812485 - RNA, 16 nt, Mycobacterium avium subsp. paratuberculosis
cagcacggccgcggcc

SEQ ID NO: 812486 - RNA, 17 nt, Mycobacterium avium subsp. paratuberculosis
cagcacggccgcggcca

SEQ ID NO: 812487 - RNA, 18 nt, Mycobacterium avium subsp. paratuberculosis
cagcagauccucagcagc

SEQ ID NO: 812488 - RNA, 23 nt, Mycobacterium avium subsp. paratuberculosis
cagcagauagcccagccagccgg

SEQ ID NO: 812489 - RNA, 14 nt, Mycobacterium avium subsp. paratuberculosis
cagcagaucggcgu

SEQ ID NO: 812490 - RNA, 15 nt, Mycobacterium avium subsp. paratuberculosis
cagcagaucggcguc

SEQ ID NO: 812491 - RNA, 17 nt, Mycobacterium avium subsp. paratuberculosis
cagcagaugccgcccag

SEQ ID NO: 812492 - RNA, 17 nt, Mycobacterium avium subsp. paratuberculosis
cagcagaugcgcgucgc

SEQ ID NO: 812493 - RNA, 21 nt, Mycobacterium avium subsp. paratuberculosis
cagcagaugcgcgucgcggcg

SEQ ID NO: 812494 - RNA, 22 nt, Mycobacterium avium subsp. paratuberculosis
cagcagaugcgcgucgcggcgc

SEQ ID NO: 812495 - RNA, 16 nt, Mycobacterium avium subsp. paratuberculosis
cagcagcagcaccagg

SEQ ID NO: 812496 - RNA, 17 nt, Mycobacterium avium subsp. paratuberculosis
cagcagcagcagcggca

SEQ ID NO: 812497 - RNA, 14 nt, Mycobacterium avium subsp. paratuberculosis
cagcagcagcccga

SEQ ID NO: 812498 - RNA, 14 nt, Mycobacterium avium subsp. paratuberculosis
cagcagcagcccgc

SEQ ID NO: 812499 - RNA, 14 nt, Mycobacterium avium subsp. paratuberculosis
cagcagcacguugu

SEQ ID NO: 812500 - RNA, 21 nt, Mycobacterium avium subsp. paratuberculosis
cagcagaccgccggugcgcag

SEQ ID NO: 812501 - RNA, 21 nt, Mycobacterium avium subsp. paratuberculosis
cagcagaaaauagcccagcca

SEQ ID NO: 812502 - RNA, 15 nt, Mycobacterium avium subsp. paratuberculosis
cagcagacccgacgg

SEQ ID NO: 812503 - RNA, 17 nt, Mycobacterium avium subsp. paratuberculosis
cagcagacccgacggga

SEQ ID NO: 812504 - RNA, 13 nt, Mycobacterium avium subsp. paratuberculosis
cagccaaccgccg

SEQ ID NO: 812505 - RNA, 15 nt, Mycobacterium avium subsp. paratuberculosis
cagccaaccgccggg

SEQ ID NO: 812506 - RNA, 16 nt, Mycobacterium avium subsp. paratuberculosis
cagccaaccgccgggg

SEQ ID NO: 812507 - RNA, 19 nt, Mycobacterium avium subsp. paratuberculosis
cagccagaacacgccccgg

SEQ ID NO: 812508 - RNA, 18 nt, Mycobacterium avium subsp. paratuberculosis
cagccagaccucgccgac

SEQ ID NO: 812509 - RNA, 23 nt, Mycobacterium avium subsp. paratuberculosis
cagccagaccucgccgacggugu

SEQ ID NO: 812510 - RNA, 22 nt, Mycobacterium avium subsp. paratuberculosis
cagccagaucgaggccagcgcg

SEQ ID NO: 812511 - RNA, 23 nt, Mycobacterium avium subsp. paratuberculosis
cagccagaucgaggccagcgcga

SEQ ID NO: 812512 - RNA, 14 nt, Mycobacterium avium subsp. paratuberculosis
cagccagaugucgc

SEQ ID NO: 812513 - RNA, 20 nt, Mycobacterium avium subsp. paratuberculosis
cagccaaagccuacggcgcc

SEQ ID NO: 812514 - RNA, 22 nt, Mycobacterium avium subsp. paratuberculosis
cagccaaacagguuggcgccga

SEQ ID NO: 812515 - RNA, 19 nt, Mycobacterium avium subsp. paratuberculosis
cagcauuuccgagcgacga

SEQ ID NO: 812516 - RNA, 20 nt, Mycobacterium avium subsp. paratuberculosis
cagcauuucgcgcggcaucg

SEQ ID NO: 812517 - RNA, 21 nt, Mycobacterium avium subsp. paratuberculosis
cagcauggcgaugacgucguc

SEQ ID NO: 812518 - RNA, 13 nt, Mycobacterium avium subsp. paratuberculosis
cagcauggcccac

SEQ ID NO: 812519 - RNA, 15 nt, Mycobacterium avium subsp. paratuberculosis
cagcaugcgaugacc

SEQ ID NO: 812520 - RNA, 15 nt, Mycobacterium avium subsp. paratuberculosis
cagcaugcgccagag

SEQ ID NO: 812521 - RNA, 13 nt, Mycobacterium avium subsp. paratuberculosis
cagcaugccgguc

SEQ ID NO: 812522 - RNA, 13 nt, Mycobacterium avium subsp. paratuberculosis
cagcaugcccacg

SEQ ID NO: 812523 - RNA, 16 nt, Mycobacterium avium subsp. paratuberculosis
cagcaggacgcgcccg

SEQ ID NO: 812524 - RNA, 18 nt, Mycobacterium avium subsp. paratuberculosis
cagcaggacgcgcccggc

SEQ ID NO: 812525 - RNA, 19 nt, Mycobacterium avium subsp. paratuberculosis
cagcaggacgcgcccggcg

SEQ ID NO: 812526 - RNA, 19 nt, Mycobacterium avium subsp. paratuberculosis
cagcaggaucuccggccgg

SEQ ID NO: 812527 - RNA, 20 nt, Mycobacterium avium subsp. paratuberculosis
cagcaggaucuccggccggu

SEQ ID NO: 812528 - RNA, 21 nt, Mycobacterium avium subsp. paratuberculosis
cagcaggaucuccggccggug

SEQ ID NO: 812529 - RNA, 21 nt, Mycobacterium avium subsp. paratuberculosis
cagcaggaucuggugcgcgcg

SEQ ID NO: 812530 - RNA, 18 nt, Mycobacterium avium subsp. paratuberculosis
cagcaggaugaugaccga

SEQ ID NO: 812531 - RNA, 20 nt, Mycobacterium avium subsp. paratuberculosis
cagcaggaugaugaccgaca

SEQ ID NO: 812532 - RNA, 14 nt, Mycobacterium avium subsp. paratuberculosis
cagcaggaaguagc

SEQ ID NO: 812533 - RNA, 20 nt, Mycobacterium avium subsp. paratuberculosis
cagcaggaccgggaucgaca

SEQ ID NO: 812534 - RNA, 22 nt, Mycobacterium avium subsp. paratuberculosis
cagcaggaacucccgcgccgca

SEQ ID NO: 812535 - RNA, 18 nt, Mycobacterium avium subsp. paratuberculosis
cagcagcuugacgucggu

SEQ ID NO: 812536 - RNA, 21 nt, Mycobacterium avium subsp. paratuberculosis
cagcagcuugaucgccggggc

SEQ ID NO: 812537 - RNA, 18 nt, Mycobacterium avium subsp. paratuberculosis
cagcaucacgucggcgag

SEQ ID NO: 812538 - RNA, 17 nt, Mycobacterium avium subsp. paratuberculosis
cagcaugaucaccgcca

SEQ ID NO: 812539 - RNA, 19 nt, Mycobacterium avium subsp. paratuberculosis
cagcaugaucaccgccagc

SEQ ID NO: 812540 - RNA, 16 nt, Mycobacterium avium subsp. paratuberculosis
cagcaugaacgucacc

SEQ ID NO: 812541 - RNA, 19 nt, Mycobacterium avium subsp. paratuberculosis
cagcaugaagaucagcacc

SEQ ID NO: 812542 - RNA, 19 nt, Mycobacterium avium subsp. paratuberculosis
cagcauccgcaacgugcgc

SEQ ID NO: 812543 - RNA, 17 nt, Mycobacterium avium subsp. paratuberculosis
cagcauccagguggcgc

SEQ ID NO: 812544 - RNA, 20 nt, Mycobacterium avium subsp. paratuberculosis
cagcauccccuuggugcggu

SEQ ID NO: 812545 - RNA, 14 nt, Mycobacterium avium subsp. paratuberculosis
cagccccagcgagc

SEQ ID NO: 812546 - RNA, 23 nt, Mycobacterium avium subsp. paratuberculosis
cagccccagcgagcaggucaccg

SEQ ID NO: 812547 - RNA, 19 nt, Mycobacterium avium subsp. paratuberculosis
cagcccgauguuggccuca

SEQ ID NO: 812548 - RNA, 17 nt, Mycobacterium avium subsp. paratuberculosis
cagcccgauucagccgg

SEQ ID NO: 812549 - RNA, 19 nt, Mycobacterium avium subsp. paratuberculosis
cagcccgauucagccggcg

SEQ ID NO: 812550 - RNA, 14 nt, Mycobacterium avium subsp. paratuberculosis
cagccccagcacga

SEQ ID NO: 812551 - RNA, 17 nt, Mycobacterium avium subsp. paratuberculosis
cagccccagcacgauga

SEQ ID NO: 812552 - RNA, 22 nt, Mycobacterium avium subsp. paratuberculosis
cagccccagcacgaugacgacc

SEQ ID NO: 812553 - RNA, 14 nt, Mycobacterium avium subsp. paratuberculosis
cagccccaccaccg

SEQ ID NO: 812554 - RNA, 19 nt, Mycobacterium avium subsp. paratuberculosis
cagccccaccaccgccacc

SEQ ID NO: 812555 - RNA, 13 nt, Mycobacterium avium subsp. paratuberculosis
cagccccaccggc

SEQ ID NO: 812556 - RNA, 15 nt, Mycobacterium avium subsp. paratuberculosis
cagccccaccggcca

SEQ ID NO: 812557 - RNA, 19 nt, Mycobacterium avium subsp. paratuberculosis
cagccccaccggccacucg

SEQ ID NO: 812558 - RNA, 14 nt, Mycobacterium avium subsp. paratuberculosis
cagcccgcccacca

SEQ ID NO: 812559 - RNA, 17 nt, Mycobacterium avium subsp. paratuberculosis
cagcccgcccaccacga

SEQ ID NO: 812560 - RNA, 21 nt, Mycobacterium avium subsp. paratuberculosis
cagcccgcccagcgccacggu

SEQ ID NO: 812561 - RNA, 23 nt, Mycobacterium avium subsp. paratuberculosis
cagcccgcccagcgccacggugg

SEQ ID NO: 812562 - RNA, 21 nt, Mycobacterium avium subsp. paratuberculosis
cagcccgcccuuggccgcgga

SEQ ID NO: 812563 - RNA, 14 nt, Mycobacterium avium subsp. paratuberculosis
cagcccgccgaacc

SEQ ID NO: 812564 - RNA, 13 nt, Mycobacterium avium subsp. paratuberculosis
cagcccgccgacc

SEQ ID NO: 812565 - RNA, 17 nt, Mycobacterium avium subsp. paratuberculosis
cagcccgccgaccaccu

SEQ ID NO: 812566 - RNA, 12 nt, Mycobacterium avium subsp. paratuberculosis
cagcccgccgcg

SEQ ID NO: 812567 - RNA, 14 nt, Mycobacterium avium subsp. paratuberculosis
cagcccgccgcgga

SEQ ID NO: 812568 - RNA, 16 nt, Mycobacterium avium subsp. paratuberculosis
cagcccgccgcguccg

SEQ ID NO: 812569 - RNA, 11 nt, Mycobacterium avium subsp. paratuberculosis
cagcccgccgg

SEQ ID NO: 812570 - RNA, 13 nt, Mycobacterium avium subsp. paratuberculosis
cagcccgccggga

SEQ ID NO: 812571 - RNA, 16 nt, Mycobacterium avium subsp. paratuberculosis
cagcccgccgggaugc

SEQ ID NO: 812572 - RNA, 13 nt, Mycobacterium avium subsp. paratuberculosis
cagcccgccgggc

SEQ ID NO: 812573 - RNA, 15 nt, Mycobacterium avium subsp. paratuberculosis
cagcccgccgggcug

SEQ ID NO: 812574 - RNA, 13 nt, Mycobacterium avium subsp. paratuberculosis
cagcccgccgucg

SEQ ID NO: 812575 - RNA, 13 nt, Mycobacterium avium subsp. paratuberculosis
cagcccggucacc

SEQ ID NO: 812576 - RNA, 18 nt, Mycobacterium avium subsp. paratuberculosis
cagcccggucaccaucag

SEQ ID NO: 812577 - RNA, 20 nt, Mycobacterium avium subsp. paratuberculosis
cagcccggucaccaucagca

SEQ ID NO: 812578 - RNA, 13 nt, Mycobacterium avium subsp. paratuberculosis
cagcccgggcugc

SEQ ID NO: 812579 - RNA, 22 nt, Mycobacterium avium subsp. paratuberculosis
cagcccgggcugcagcagcgac

SEQ ID NO: 812580 - RNA, 15 nt, Mycobacterium avium subsp. paratuberculosis
cagcccggggguggc

SEQ ID NO: 812581 - RNA, 21 nt, Mycobacterium avium subsp. paratuberculosis
cagcccggggguggcgguccc

SEQ ID NO: 812582 - RNA, 16 nt, Mycobacterium avium subsp. paratuberculosis
cagcccggcguacagc

SEQ ID NO: 812583 - RNA, 22 nt, Mycobacterium avium subsp. paratuberculosis
cagcccggcguacagcaauccg

SEQ ID NO: 812584 - RNA, 22 nt, Mycobacterium avium subsp. paratuberculosis
cagcccggcuaauucgggccgc

SEQ ID NO: 812585 - RNA, 20 nt, Mycobacterium avium subsp. paratuberculosis
cagcccgggaaagcggguga

SEQ ID NO: 812586 - RNA, 21 nt, Mycobacterium avium subsp. paratuberculosis
cagcccgggauggaucgaguu

SEQ ID NO: 812587 - RNA, 20 nt, Mycobacterium avium subsp. paratuberculosis
cagcccgguuuccaguccgg

SEQ ID NO: 812588 - RNA, 21 nt, Mycobacterium avium subsp. paratuberculosis
cagcccggugaucgccgccca

SEQ ID NO: 812589 - RNA, 24 nt, Mycobacterium avium subsp. paratuberculosis
cagcccgguguccacgucgcccag

SEQ ID NO: 812590 - RNA, 19 nt, Mycobacterium avium subsp. paratuberculosis
cagcccggugacgaacauc

SEQ ID NO: 812591 - RNA, 21 nt, Mycobacterium avium subsp. paratuberculosis
cagcccggugacgaacaucga

SEQ ID NO: 812592 - RNA, 22 nt, Mycobacterium avium subsp. paratuberculosis
cagcccggugacgaacaucgac

SEQ ID NO: 812593 - RNA, 22 nt, Mycobacterium avium subsp. paratuberculosis
cagcccggcgaugaucaggccg

SEQ ID NO: 812594 - RNA, 22 nt, Mycobacterium avium subsp. paratuberculosis
cagcccggcgcucaccgcgaug

SEQ ID NO: 812595 - RNA, 20 nt, Mycobacterium avium subsp. paratuberculosis
cagcccggcgaacaccacgg

SEQ ID NO: 812596 - RNA, 17 nt, Mycobacterium avium subsp. paratuberculosis
cagcccgcgcaccgcga

SEQ ID NO: 812597 - RNA, 21 nt, Mycobacterium avium subsp. paratuberculosis
cagcccgcgccagcucggcgg

SEQ ID NO: 812598 - RNA, 13 nt, Mycobacterium avium subsp. paratuberculosis
cagcccgcgccga

SEQ ID NO: 812599 - RNA, 14 nt, Mycobacterium avium subsp. paratuberculosis
cagcccgcgccgag

SEQ ID NO: 812600 - RNA, 17 nt, Mycobacterium avium subsp. paratuberculosis
cagcccggccgccgagg

SEQ ID NO: 812601 - RNA, 17 nt, Mycobacterium avium subsp. paratuberculosis
cagcccaggcccagcag

SEQ ID NO: 812602 - RNA, 19 nt, Mycobacterium avium subsp. paratuberculosis
cagcccaggcccagcagca

SEQ ID NO: 812603 - RNA, 17 nt, Mycobacterium avium subsp. paratuberculosis
cagcccaggucgggacg

SEQ ID NO: 812604 - RNA, 18 nt, Mycobacterium avium subsp. paratuberculosis
cagcccaggucgggacgu

SEQ ID NO: 812605 - RNA, 14 nt, Mycobacterium avium subsp. paratuberculosis
cagcccagccgcca

SEQ ID NO: 812606 - RNA, 16 nt, Mycobacterium avium subsp. paratuberculosis
cagcccagccgccagc

SEQ ID NO: 812607 - RNA, 15 nt, Mycobacterium avium subsp. paratuberculosis
cagcccaccgaucgc

SEQ ID NO: 812608 - RNA, 16 nt, Mycobacterium avium subsp. paratuberculosis
cagccauucgucgggg

SEQ ID NO: 812609 - RNA, 17 nt, Mycobacterium avium subsp. paratuberculosis
cagccagcgcccggcga

SEQ ID NO: 812610 - RNA, 18 nt, Mycobacterium avium subsp. paratuberculosis
cagccagcgcccggcgac

SEQ ID NO: 812611 - RNA, 12 nt, Mycobacterium avium subsp. paratuberculosis
cagccagcucgg

SEQ ID NO: 812612 - RNA, 14 nt, Mycobacterium avium subsp. paratuberculosis
cagccagcucggcg

SEQ ID NO: 812613 - RNA, 13 nt, Mycobacterium avium subsp. paratuberculosis
cagccagcgguca

SEQ ID NO: 812614 - RNA, 15 nt, Mycobacterium avium subsp. paratuberculosis
cagccagcggucacg

SEQ ID NO: 812615 - RNA, 22 nt, Mycobacterium avium subsp. paratuberculosis
cagccagccuggcggcgacccg

SEQ ID NO: 812616 - RNA, 17 nt, Mycobacterium avium subsp. paratuberculosis
cagccagcgacaacgug

SEQ ID NO: 812617 - RNA, 16 nt, Mycobacterium avium subsp. paratuberculosis
cagccagcccgcgcaa

SEQ ID NO: 812618 - RNA, 12 nt, Mycobacterium avium subsp. paratuberculosis
cagccagcccgu

SEQ ID NO: 812619 - RNA, 17 nt, Mycobacterium avium subsp. paratuberculosis
cagccagccgcccagca

SEQ ID NO: 812620 - RNA, 18 nt, Mycobacterium avium subsp. paratuberculosis
cagccgcgguggcggugu

SEQ ID NO: 812621 - RNA, 22 nt, Mycobacterium avium subsp. paratuberculosis
cagccgcgguggcgguguucga

SEQ ID NO: 812622 - RNA, 12 nt, Mycobacterium avium subsp. paratuberculosis
cagccgcggcgg

SEQ ID NO: 812623 - RNA, 13 nt, Mycobacterium avium subsp. paratuberculosis
cagccgcggcggc

SEQ ID NO: 812624 - RNA, 18 nt, Mycobacterium avium subsp. paratuberculosis
cagccgcgcggccgccuc

SEQ ID NO: 812625 - RNA, 21 nt, Mycobacterium avium subsp. paratuberculosis
cagccgcgcgugcagccgggc

SEQ ID NO: 812626 - RNA, 21 nt, Mycobacterium avium subsp. paratuberculosis
cagccgcggacggccagcccg

SEQ ID NO: 812627 - RNA, 13 nt, Mycobacterium avium subsp. paratuberculosis
cagccgcgcggcg

SEQ ID NO: 812628 - RNA, 15 nt, Mycobacterium avium subsp. paratuberculosis
cagccgcgccgggcg

SEQ ID NO: 812629 - RNA, 14 nt, Mycobacterium avium subsp. paratuberculosis
cagccgcgcgacgc

SEQ ID NO: 812630 - RNA, 15 nt, Mycobacterium avium subsp. paratuberculosis
cagccgcgcgacgcc

SEQ ID NO: 812631 - RNA, 16 nt, Mycobacterium avium subsp. paratuberculosis
cagccgcgcgacgccg

SEQ ID NO: 812632 - RNA, 19 nt, Mycobacterium avium subsp. paratuberculosis
cagccgcgcgacgccguag

SEQ ID NO: 812633 - RNA, 14 nt, Mycobacterium avium subsp. paratuberculosis
cagccgcgcgagca

SEQ ID NO: 812634 - RNA, 17 nt, Mycobacterium avium subsp. paratuberculosis
cagccgcgcccacccgc

SEQ ID NO: 812635 - RNA, 19 nt, Mycobacterium avium subsp. paratuberculosis
cagccgcgcccacccgcgc

SEQ ID NO: 812636 - RNA, 22 nt, Mycobacterium avium subsp. paratuberculosis
cagccgcgcccacccgcgcacg

SEQ ID NO: 812637 - RNA, 14 nt, Mycobacterium avium subsp. paratuberculosis
cagccgcgccgaca

SEQ ID NO: 812638 - RNA, 15 nt, Mycobacterium avium subsp. paratuberculosis
cagccgcgccgacgc

SEQ ID NO: 812639 - RNA, 15 nt, Mycobacterium avium subsp. paratuberculosis
cagccgcgccgccgc

SEQ ID NO: 812640 - RNA, 13 nt, Mycobacterium avium subsp. paratuberculosis
cagccgcgccgcg

SEQ ID NO: 812641 - RNA, 18 nt, Mycobacterium avium subsp. paratuberculosis
cagccgcgauagccauca

SEQ ID NO: 812642 - RNA, 19 nt, Mycobacterium avium subsp. paratuberculosis
cagccgcgauagccaucag

SEQ ID NO: 812643 - RNA, 14 nt, Mycobacterium avium subsp. paratuberculosis
cagccgcgccaccg

SEQ ID NO: 812644 - RNA, 15 nt, Mycobacterium avium subsp. paratuberculosis
cagccgcgccaccgc

SEQ ID NO: 812645 - RNA, 15 nt, Mycobacterium avium subsp. paratuberculosis
cagccgcgacggcgg

SEQ ID NO: 812646 - RNA, 16 nt, Mycobacterium avium subsp. paratuberculosis
cagccgcgacggcggg

SEQ ID NO: 812647 - RNA, 20 nt, Mycobacterium avium subsp. paratuberculosis
cagccgcgacggcgggucga

SEQ ID NO: 812648 - RNA, 18 nt, Mycobacterium avium subsp. paratuberculosis
cagccgcucacacagccg

SEQ ID NO: 812649 - RNA, 17 nt, Mycobacterium avium subsp. paratuberculosis
cagccgcucccggcgca

SEQ ID NO: 812650 - RNA, 14 nt, Mycobacterium avium subsp. paratuberculosis
cagccgcuccgcgg

SEQ ID NO: 812651 - RNA, 16 nt, Mycobacterium avium subsp. paratuberculosis
cagccgcuccgcggcg

SEQ ID NO: 812652 - RNA, 19 nt, Mycobacterium avium subsp. paratuberculosis
cagccgcuccgcggcgggc

SEQ ID NO: 812653 - RNA, 21 nt, Mycobacterium avium subsp. paratuberculosis
cagccgcuccgcggcgggcgu

SEQ ID NO: 812654 - RNA, 17 nt, Mycobacterium avium subsp. paratuberculosis
cagccgcugcagcgccg

SEQ ID NO: 812655 - RNA, 18 nt, Mycobacterium avium subsp. paratuberculosis
cagccgcugcagcgccgc

SEQ ID NO: 812656 - RNA, 20 nt, Mycobacterium avium subsp. paratuberculosis
cagccgcugcagcgccgccc

SEQ ID NO: 812657 - RNA, 17 nt, Mycobacterium avium subsp. paratuberculosis
cagccgcugaacgcgau

SEQ ID NO: 812658 - RNA, 18 nt, Mycobacterium avium subsp. paratuberculosis
cagccgcugaacgcgauc

SEQ ID NO: 812659 - RNA, 13 nt, Mycobacterium avium subsp. paratuberculosis
cagccgcugacga

SEQ ID NO: 812660 - RNA, 18 nt, Mycobacterium avium subsp. paratuberculosis
cagccgcugacgauggcg

SEQ ID NO: 812661 - RNA, 21 nt, Mycobacterium avium subsp. paratuberculosis
cagccgcugacgauggcgacc

SEQ ID NO: 812662 - RNA, 22 nt, Mycobacterium avium subsp. paratuberculosis
cagccgcugacgauggcgaccg

SEQ ID NO: 812663 - RNA, 14 nt, Mycobacterium avium subsp. paratuberculosis
cagccgcugccgca

SEQ ID NO: 812664 - RNA, 23 nt, Mycobacterium avium subsp. paratuberculosis
cagccgcugccgcaccccguggu

SEQ ID NO: 812665 - RNA, 14 nt, Mycobacterium avium subsp. paratuberculosis
cagccgcugcgaca

SEQ ID NO: 812666 - RNA, 23 nt, Mycobacterium avium subsp. paratuberculosis
cagccgcugcgacaggucggcgg

SEQ ID NO: 812667 - RNA, 14 nt, Mycobacterium avium subsp. paratuberculosis
cagccggagccggc

SEQ ID NO: 812668 - RNA, 19 nt, Mycobacterium avium subsp. paratuberculosis
cagccggagccggccucgc

SEQ ID NO: 812669 - RNA, 17 nt, Mycobacterium avium subsp. paratuberculosis
cagccggaacacaacgc

SEQ ID NO: 812670 - RNA, 16 nt, Mycobacterium avium subsp. paratuberculosis
cagccggacagcgggu

SEQ ID NO: 812671 - RNA, 19 nt, Mycobacterium avium subsp. paratuberculosis
cagccggacccauucgucg

SEQ ID NO: 812672 - RNA, 20 nt, Mycobacterium avium subsp. paratuberculosis
cagccggacccauucgucgg

SEQ ID NO: 812673 - RNA, 22 nt, Mycobacterium avium subsp. paratuberculosis
cagccggacccauucgucggcg

SEQ ID NO: 812674 - RNA, 13 nt, Mycobacterium avium subsp. paratuberculosis
cagccgcuuggcc

SEQ ID NO: 812675 - RNA, 17 nt, Mycobacterium avium subsp. paratuberculosis
cagccgcuuggccgggc

SEQ ID NO: 812676 - RNA, 14 nt, Mycobacterium avium subsp. paratuberculosis
cagccgcuuggcgc

SEQ ID NO: 812677 - RNA, 18 nt, Mycobacterium avium subsp. paratuberculosis
cagccgcuuggcgcgccg

SEQ ID NO: 812678 - RNA, 20 nt, Mycobacterium avium subsp. paratuberculosis
cagccgcuuggcgcgccgca

SEQ ID NO: 812679 - RNA, 17 nt, Mycobacterium avium subsp. paratuberculosis
cagccgcugcugggugc

SEQ ID NO: 812680 - RNA, 17 nt, Mycobacterium avium subsp. paratuberculosis
cagccgcuggccgcgcc

SEQ ID NO: 812681 - RNA, 18 nt, Mycobacterium avium subsp. paratuberculosis
cagccgcuggccgcgcca

SEQ ID NO: 812682 - RNA, 20 nt, Mycobacterium avium subsp. paratuberculosis
cagccgcuggccgcgccaca

SEQ ID NO: 812683 - RNA, 22 nt, Mycobacterium avium subsp. paratuberculosis
cagccgcauguugugcccgacg

SEQ ID NO: 812684 - RNA, 24 nt, Mycobacterium avium subsp. paratuberculosis
cagccgcauguugugcccgacggc

SEQ ID NO: 812685 - RNA, 18 nt, Mycobacterium avium subsp. paratuberculosis
cagccgcauucggugagc

SEQ ID NO: 812686 - RNA, 19 nt, Mycobacterium avium subsp. paratuberculosis
cagccgcaggugcagcucc

SEQ ID NO: 812687 - RNA, 21 nt, Mycobacterium avium subsp. paratuberculosis
cagccgcaggugcucgccggc

SEQ ID NO: 812688 - RNA, 22 nt, Mycobacterium avium subsp. paratuberculosis
cagccgcaggugcucgccggcg

SEQ ID NO: 812689 - RNA, 23 nt, Mycobacterium avium subsp. paratuberculosis
cagccgcaggugcucgccggcgc

SEQ ID NO: 812690 - RNA, 16 nt, Mycobacterium avium subsp. paratuberculosis
cagccgccccgaucgg

SEQ ID NO: 812691 - RNA, 13 nt, Mycobacterium avium subsp. paratuberculosis
cagccgccgccga

SEQ ID NO: 812692 - RNA, 14 nt, Mycobacterium avium subsp. paratuberculosis
cagccgcgacagcc

SEQ ID NO: 812693 - RNA, 16 nt, Mycobacterium avium subsp. paratuberculosis
cagccgccggccacca

SEQ ID NO: 812694 - RNA, 13 nt, Mycobacterium avium subsp. paratuberculosis
cagccgccggcgg

SEQ ID NO: 812695 - RNA, 13 nt, Mycobacterium avium subsp. paratuberculosis
cagccgccggcuc

SEQ ID NO: 812696 - RNA, 19 nt, Mycobacterium avium subsp. paratuberculosis
cagccgccggcucagcggc

SEQ ID NO: 812697 - RNA, 20 nt, Mycobacterium avium subsp. paratuberculosis
cagccgccggcucagcggca

SEQ ID NO: 812698 - RNA, 12 nt, Mycobacterium avium subsp. paratuberculosis
cagccgccgggc

SEQ ID NO: 812699 - RNA, 20 nt, Mycobacterium avium subsp. paratuberculosis
cagccgccgggccacgccga

SEQ ID NO: 812700 - RNA, 17 nt, Mycobacterium avium subsp. paratuberculosis
cagccgccgcgccaccg

SEQ ID NO: 812701 - RNA, 20 nt, Mycobacterium avium subsp. paratuberculosis
cagccgccgcgccaccgagg

SEQ ID NO: 812702 - RNA, 16 nt, Mycobacterium avium subsp. paratuberculosis
cagccgccgcggagcg

SEQ ID NO: 812703 - RNA, 23 nt, Mycobacterium avium subsp. paratuberculosis
cagccgccgcggagcggcgguca

SEQ ID NO: 812704 - RNA, 15 nt, Mycobacterium avium subsp. paratuberculosis
cagccgcagcggcgg

SEQ ID NO: 812705 - RNA, 15 nt, Mycobacterium avium subsp. paratuberculosis
cagccgcagcagccg

SEQ ID NO: 812706 - RNA, 13 nt, Mycobacterium avium subsp. paratuberculosis
cagccgcagcgcg

SEQ ID NO: 812707 - RNA, 16 nt, Mycobacterium avium subsp. paratuberculosis
cagccgcagcgcgcga

SEQ ID NO: 812708 - RNA, 20 nt, Mycobacterium avium subsp. paratuberculosis
cagccgcagcgcgcgaccgc

SEQ ID NO: 812709 - RNA, 21 nt, Mycobacterium avium subsp. paratuberculosis
cagccgcagcgcgcgaccgcg

SEQ ID NO: 812710 - RNA, 13 nt, Mycobacterium avium subsp. paratuberculosis
cagccgcaccagg

SEQ ID NO: 812711 - RNA, 21 nt, Mycobacterium avium subsp. paratuberculosis
cagcccugcucggccagcggg

SEQ ID NO: 812712 - RNA, 22 nt, Mycobacterium avium subsp. paratuberculosis
cagcccugcucggccagcgggu

SEQ ID NO: 812713 - RNA, 18 nt, Mycobacterium avium subsp. paratuberculosis
cagcccugcuugaccgcg

SEQ ID NO: 812714 - RNA, 15 nt, Mycobacterium avium subsp. paratuberculosis
cagccgcacaccgcg

SEQ ID NO: 812715 - RNA, 16 nt, Mycobacterium avium subsp. paratuberculosis
cagccgcacaccgcgg

SEQ ID NO: 812716 - RNA, 17 nt, Mycobacterium avium subsp. paratuberculosis
cagccgcacaccgcggc

SEQ ID NO: 812717 - RNA, 14 nt, Mycobacterium avium subsp. paratuberculosis
cagccgcaccgcga

SEQ ID NO: 812718 - RNA, 15 nt, Mycobacterium avium subsp. paratuberculosis
cagccgcaccgcgac

SEQ ID NO: 812719 - RNA, 17 nt, Mycobacterium avium subsp. paratuberculosis
cagccgcaccggcgccg

SEQ ID NO: 812720 - RNA, 14 nt, Mycobacterium avium subsp. paratuberculosis
cagccgcaccucgg

SEQ ID NO: 812721 - RNA, 14 nt, Mycobacterium avium subsp. paratuberculosis
cagccgcacgaacc

SEQ ID NO: 812722 - RNA, 18 nt, Mycobacterium avium subsp. paratuberculosis
cagccgcacggauucguc

SEQ ID NO: 812723 - RNA, 14 nt, Mycobacterium avium subsp. paratuberculosis
cagcccucgucgau

SEQ ID NO: 812724 - RNA, 16 nt, Mycobacterium avium subsp. paratuberculosis
cagcccucgucgauga

SEQ ID NO: 812725 - RNA, 20 nt, Mycobacterium avium subsp. paratuberculosis
cagcccucgucgaugacguc

SEQ ID NO: 812726 - RNA, 21 nt, Mycobacterium avium subsp. paratuberculosis
cagcccguugucgagcaccgc

SEQ ID NO: 812727 - RNA, 22 nt, Mycobacterium avium subsp. paratuberculosis
cagcccguugucgagcaccgcg

SEQ ID NO: 812728 - RNA, 16 nt, Mycobacterium avium subsp. paratuberculosis
cagcccguuguggcgg

SEQ ID NO: 812729 - RNA, 18 nt, Mycobacterium avium subsp. paratuberculosis
cagcccguggccagcgcc

SEQ ID NO: 812730 - RNA, 19 nt, Mycobacterium avium subsp. paratuberculosis
cagcccguggccagcgcca

SEQ ID NO: 812731 - RNA, 21 nt, Mycobacterium avium subsp. paratuberculosis
cagcccguggccagcgccagc

SEQ ID NO: 812732 - RNA, 16 nt, Mycobacterium avium subsp. paratuberculosis
cagccgugcggcuugc

SEQ ID NO: 812733 - RNA, 15 nt, Mycobacterium avium subsp. paratuberculosis
cagccgugcugggcc

SEQ ID NO: 812734 - RNA, 14 nt, Mycobacterium avium subsp. paratuberculosis
cagccugaccgcgg

SEQ ID NO: 812735 - RNA, 16 nt, Mycobacterium avium subsp. paratuberculosis
cagccugaugccgguc

SEQ ID NO: 812736 - RNA, 21 nt, Mycobacterium avium subsp. paratuberculosis
cagccgucgaugccggcgacg

SEQ ID NO: 812737 - RNA, 16 nt, Mycobacterium avium subsp. paratuberculosis
cagccgucgucguccg

SEQ ID NO: 812738 - RNA, 18 nt, Mycobacterium avium subsp. paratuberculosis
cagccgugccccaggucg

SEQ ID NO: 812739 - RNA, 16 nt, Mycobacterium avium subsp. paratuberculosis
cagccgugcggcacgc

SEQ ID NO: 812740 - RNA, 15 nt, Mycobacterium avium subsp. paratuberculosis
cagccgugcggcggc

SEQ ID NO: 812741 - RNA, 18 nt, Mycobacterium avium subsp. paratuberculosis
cagccgucgcaccgccuc

SEQ ID NO: 812742 - RNA, 20 nt, Mycobacterium avium subsp. paratuberculosis
cagccgucgcacuagguccg

SEQ ID NO: 812743 - RNA, 20 nt, Mycobacterium avium subsp. paratuberculosis
cagccgucgcaucagcucgg

SEQ ID NO: 812744 - RNA, 14 nt, Mycobacterium avium subsp. paratuberculosis
cagccgucgccgcg

SEQ ID NO: 812745 - RNA, 15 nt, Mycobacterium avium subsp. paratuberculosis
cagccgucgccgcgc

SEQ ID NO: 812746 - RNA, 16 nt, Mycobacterium avium subsp. paratuberculosis
cagccgucgccgcgcc

SEQ ID NO: 812747 - RNA, 18 nt, Mycobacterium avium subsp. paratuberculosis
cagccgucgccgcgcccg

SEQ ID NO: 812748 - RNA, 15 nt, Mycobacterium avium subsp. paratuberculosis
cagccggcgcgguga

SEQ ID NO: 812749 - RNA, 13 nt, Mycobacterium avium subsp. paratuberculosis
cagccgucccgcc

SEQ ID NO: 812750 - RNA, 17 nt, Mycobacterium avium subsp. paratuberculosis
cagccgucccgccgucu

SEQ ID NO: 812751 - RNA, 21 nt, Mycobacterium avium subsp. paratuberculosis
cagccgucccuguucgcgccg

SEQ ID NO: 812752 - RNA, 23 nt, Mycobacterium avium subsp. paratuberculosis
cagccgucccuguucgcgccggu

SEQ ID NO: 812753 - RNA, 14 nt, Mycobacterium avium subsp. paratuberculosis
cagccggccgucca

SEQ ID NO: 812754 - RNA, 16 nt, Mycobacterium avium subsp. paratuberculosis
cagccggccguccacg

SEQ ID NO: 812755 - RNA, 13 nt, Mycobacterium avium subsp. paratuberculosis
cagccggcgagcg

SEQ ID NO: 812756 - RNA, 18 nt, Mycobacterium avium subsp. paratuberculosis
cagccggcgagcgcgcug

SEQ ID NO: 812757 - RNA, 16 nt, Mycobacterium avium subsp. paratuberculosis
cagccggcgcccgcag

SEQ ID NO: 812758 - RNA, 14 nt, Mycobacterium avium subsp. paratuberculosis
cagccggccgcuga

SEQ ID NO: 812759 - RNA, 14 nt, Mycobacterium avium subsp. paratuberculosis
cagccggccggcag

SEQ ID NO: 812760 - RNA, 15 nt, Mycobacterium avium subsp. paratuberculosis
cagccggccggcgaa

SEQ ID NO: 812761 - RNA, 16 nt, Mycobacterium avium subsp. paratuberculosis
cagccggccggcgaag

SEQ ID NO: 812762 - RNA, 15 nt, Mycobacterium avium subsp. paratuberculosis
cagccggccggcgga

SEQ ID NO: 812763 - RNA, 16 nt, Mycobacterium avium subsp. paratuberculosis
cagccggccggcggac

SEQ ID NO: 812764 - RNA, 17 nt, Mycobacterium avium subsp. paratuberculosis
cagccggccggcggacg

SEQ ID NO: 812765 - RNA, 14 nt, Mycobacterium avium subsp. paratuberculosis
cagccggcccgagc

SEQ ID NO: 812766 - RNA, 21 nt, Mycobacterium avium subsp. paratuberculosis
cagccggcccgagcccugcgc

SEQ ID NO: 812767 - RNA, 13 nt, Mycobacterium avium subsp. paratuberculosis
cagccggcccgca

SEQ ID NO: 812768 - RNA, 17 nt, Mycobacterium avium subsp. paratuberculosis
cagccggcccgcaucgc

SEQ ID NO: 812769 - RNA, 18 nt, Mycobacterium avium subsp. paratuberculosis
cagccggccaucucggcg

SEQ ID NO: 812770 - RNA, 19 nt, Mycobacterium avium subsp. paratuberculosis
cagccggccaucucggcgg

SEQ ID NO: 812771 - RNA, 14 nt, Mycobacterium avium subsp. paratuberculosis
cagccggcccucca

SEQ ID NO: 812772 - RNA, 14 nt, Mycobacterium avium subsp. paratuberculosis
cagccggccgaccg

SEQ ID NO: 812773 - RNA, 17 nt, Mycobacterium avium subsp. paratuberculosis
cagccggccgacgcggc

SEQ ID NO: 812774 - RNA, 13 nt, Mycobacterium avium subsp. paratuberculosis
cagccggccgagc

SEQ ID NO: 812775 - RNA, 21 nt, Mycobacterium avium subsp. paratuberculosis
cagccggccgagcgaaggucc

SEQ ID NO: 812776 - RNA, 16 nt, Mycobacterium avium subsp. paratuberculosis
cagccggccaccgccc

SEQ ID NO: 812777 - RNA, 18 nt, Mycobacterium avium subsp. paratuberculosis
cagccggccaccgcccca

SEQ ID NO: 812778 - RNA, 16 nt, Mycobacterium avium subsp. paratuberculosis
cagccggcagcauucg

SEQ ID NO: 812779 - RNA, 19 nt, Mycobacterium avium subsp. paratuberculosis
cagccggccaacagcagcg

SEQ ID NO: 812780 - RNA, 19 nt, Mycobacterium avium subsp. paratuberculosis
cagccggaucagcguuccg

SEQ ID NO: 812781 - RNA, 20 nt, Mycobacterium avium subsp. paratuberculosis
cagcgacgagagcggaucgg

SEQ ID NO: 812782 - RNA, 23 nt, Mycobacterium avium subsp. paratuberculosis
cagcgacgagagcggaucggcgg

SEQ ID NO: 812783 - RNA, 21 nt, Mycobacterium avium subsp. paratuberculosis
cagcgacaaucggcucgccuc

SEQ ID NO: 812784 - RNA, 17 nt, Mycobacterium avium subsp. paratuberculosis
cagcgacaaucucgggc

SEQ ID NO: 812785 - RNA, 20 nt, Mycobacterium avium subsp. paratuberculosis
cagcgacaacgggccgccuc

SEQ ID NO: 812786 - RNA, 14 nt, Mycobacterium avium subsp. paratuberculosis
cagcgacaacgugg

SEQ ID NO: 812787 - RNA, 21 nt, Mycobacterium avium subsp. paratuberculosis
cagcgacgccagcggcagcgc

SEQ ID NO: 812788 - RNA, 20 nt, Mycobacterium avium subsp. paratuberculosis
cagcgacggcaggucggugc

SEQ ID NO: 812789 - RNA, 14 nt, Mycobacterium avium subsp. paratuberculosis
cagcgacucgaccc

SEQ ID NO: 812790 - RNA, 15 nt, Mycobacterium avium subsp. paratuberculosis
cagcgacgucugcgg

SEQ ID NO: 812791 - RNA, 15 nt, Mycobacterium avium subsp. paratuberculosis
cagcgacuccagcgc

SEQ ID NO: 812792 - RNA, 16 nt, Mycobacterium avium subsp. paratuberculosis
cagcgacuccagcgcg

SEQ ID NO: 812793 - RNA, 17 nt, Mycobacterium avium subsp. paratuberculosis
cagcgacuccagcgcga

SEQ ID NO: 812794 - RNA, 20 nt, Mycobacterium avium subsp. paratuberculosis
cagcgacuccagcgcgauca

SEQ ID NO: 812795 - RNA, 13 nt, Mycobacterium avium subsp. paratuberculosis
cagcgacggcccg

SEQ ID NO: 812796 - RNA, 14 nt, Mycobacterium avium subsp. paratuberculosis
cagcgacggcccgc

SEQ ID NO: 812797 - RNA, 17 nt, Mycobacterium avium subsp. paratuberculosis
cagcgacggcccgccgg

SEQ ID NO: 812798 - RNA, 18 nt, Mycobacterium avium subsp. paratuberculosis
cagcgacggcccgccgga

SEQ ID NO: 812799 - RNA, 20 nt, Mycobacterium avium subsp. paratuberculosis
cagcgacggcccgccggagc

SEQ ID NO: 812800 - RNA, 23 nt, Mycobacterium avium subsp. paratuberculosis
cagcgacggcccgccggagccga

SEQ ID NO: 812801 - RNA, 13 nt, Mycobacterium avium subsp. paratuberculosis
cagcgacggccgg

SEQ ID NO: 812802 - RNA, 22 nt, Mycobacterium avium subsp. paratuberculosis
cagcgacgggccgggcacgucg

SEQ ID NO: 812803 - RNA, 23 nt, Mycobacterium avium subsp. paratuberculosis
cagcgacgggccgggcacgucga

SEQ ID NO: 812804 - RNA, 12 nt, Mycobacterium avium subsp. paratuberculosis
cagcgacgcggu

SEQ ID NO: 812805 - RNA, 14 nt, Mycobacterium avium subsp. paratuberculosis
cagcgacggaucgg

SEQ ID NO: 812806 - RNA, 17 nt, Mycobacterium avium subsp. paratuberculosis
cagcgacggaucggccg

SEQ ID NO: 812807 - RNA, 16 nt, Mycobacterium avium subsp. paratuberculosis
cagcgacgucaggucg

SEQ ID NO: 812808 - RNA, 21 nt, Mycobacterium avium subsp. paratuberculosis
cagcgacgucaggucgaccgg

SEQ ID NO: 812809 - RNA, 14 nt, Mycobacterium avium subsp. paratuberculosis
cagccuggcggcga

SEQ ID NO: 812810 - RNA, 16 nt, Mycobacterium avium subsp. paratuberculosis
cagccugcggugaugc

SEQ ID NO: 812811 - RNA, 22 nt, Mycobacterium avium subsp. paratuberculosis
cagccugcggugaugcgcggcg

SEQ ID NO: 812812 - RNA, 21 nt, Mycobacterium avium subsp. paratuberculosis
cagcgaauacaccguccagcu

SEQ ID NO: 812813 - RNA, 22 nt, Mycobacterium avium subsp. paratuberculosis
cagcgaauacaccguccagcuc

SEQ ID NO: 812814 - RNA, 14 nt, Mycobacterium avium subsp. paratuberculosis
cagcgaacugccgg

SEQ ID NO: 812815 - RNA, 16 nt, Mycobacterium avium subsp. paratuberculosis
cagcgaagcgaggcgc

SEQ ID NO: 812816 - RNA, 23 nt, Mycobacterium avium subsp. paratuberculosis
cagcgaaggcaugggcgugccgg

SEQ ID NO: 812817 - RNA, 15 nt, Mycobacterium avium subsp. paratuberculosis
cagcgaaucgaccgg

SEQ ID NO: 812818 - RNA, 18 nt, Mycobacterium avium subsp. paratuberculosis
cagcgaaucgaccggguu

SEQ ID NO: 812819 - RNA, 22 nt, Mycobacterium avium subsp. paratuberculosis
cagcgaauggcaauacgccucg

SEQ ID NO: 812820 - RNA, 17 nt, Mycobacterium avium subsp. paratuberculosis
cacgaauucgguggcga

SEQ ID NO: 812821 - RNA, 14 nt, Mycobacterium avium subsp. paratuberculosis
cacgaaggccgccg

SEQ ID NO: 812822 - RNA, 20 nt, Mycobacterium avium subsp. paratuberculosis
cacgaauacccuccgggcgg

SEQ ID NO: 812823 - RNA, 19 nt, Mycobacterium avium subsp. paratuberculosis
cacgaauacccuucggccg

SEQ ID NO: 812824 - RNA, 15 nt, Mycobacterium avium subsp. paratuberculosis
cacgaagucgaccgc

SEQ ID NO: 812825 - RNA, 21 nt, Mycobacterium avium subsp. paratuberculosis
cacgaagucguuggggauguc

SEQ ID NO: 812826 - RNA, 18 nt, Mycobacterium avium subsp. paratuberculosis
cacgaagugcccggcgcc

SEQ ID NO: 812827 - RNA, 19 nt, Mycobacterium avium subsp. paratuberculosis
cacgaagugcccggcgccg

SEQ ID NO: 812828 - RNA, 21 nt, Mycobacterium avium subsp. paratuberculosis
cacgaaguugaucgcggcgga

SEQ ID NO: 812829 - RNA, 21 nt, Mycobacterium avium subsp. paratuberculosis
cacgaaguugguguccacccg

SEQ ID NO: 812830 - RNA, 12 nt, Mycobacterium avium subsp. paratuberculosis
cacgacaccagc

SEQ ID NO: 812831 - RNA, 13 nt, Mycobacterium avium subsp. paratuberculosis
cacgacaccgacg

SEQ ID NO: 812832 - RNA, 14 nt, Mycobacterium avium subsp. paratuberculosis
cacgacaccgacga

SEQ ID NO: 812833 - RNA, 16 nt, Mycobacterium avium subsp. paratuberculosis
cacgacaccgacgacc

SEQ ID NO: 812834 - RNA, 17 nt, Mycobacterium avium subsp. paratuberculosis
cacgaccuggcgggcca

SEQ ID NO: 812835 - RNA, 16 nt, Mycobacterium avium subsp. paratuberculosis
cacgaccucggggucg

SEQ ID NO: 812836 - RNA, 17 nt, Mycobacterium avium subsp. paratuberculosis
cacgaccucggggucgg

SEQ ID NO: 812837 - RNA, 20 nt, Mycobacterium avium subsp. paratuberculosis
cacgaccucggggucggccg

SEQ ID NO: 812838 - RNA, 16 nt, Mycobacterium avium subsp. paratuberculosis
cacgaccuccgugccg

SEQ ID NO: 812839 - RNA, 14 nt, Mycobacterium avium subsp. paratuberculosis
cacgaccggcagca

SEQ ID NO: 812840 - RNA, 19 nt, Mycobacterium avium subsp. paratuberculosis
cacgaccggcagcaccggc

SEQ ID NO: 812841 - RNA, 20 nt, Mycobacterium avium subsp. paratuberculosis
cacgaccggcagcaccggcc

SEQ ID NO: 812842 - RNA, 20 nt, Mycobacterium avium subsp. paratuberculosis
cacgaccagugcccggccaa

SEQ ID NO: 812843 - RNA, 14 nt, Mycobacterium avium subsp. paratuberculosis
cacgaccagcggca

SEQ ID NO: 812844 - RNA, 15 nt, Mycobacterium avium subsp. paratuberculosis
cacgaccagcggcag

SEQ ID NO: 812845 - RNA, 16 nt, Mycobacterium avium subsp. paratuberculosis
cacgaccagcggcagc

SEQ ID NO: 812846 - RNA, 16 nt, Mycobacterium avium subsp. paratuberculosis
cacgaccccggcggca

SEQ ID NO: 812847 - RNA, 18 nt, Mycobacterium avium subsp. paratuberculosis
cacgaccccggcggcacc

SEQ ID NO: 812848 - RNA, 20 nt, Mycobacterium avium subsp. paratuberculosis
cacgaccccggcggcaccgc

SEQ ID NO: 812849 - RNA, 22 nt, Mycobacterium avium subsp. paratuberculosis
cacgaccccggcggcaccgccg

SEQ ID NO: 812850 - RNA, 14 nt, Mycobacterium avium subsp. paratuberculosis
cacgaccgccagca

SEQ ID NO: 812851 - RNA, 20 nt, Mycobacterium avium subsp. paratuberculosis
cacgaccgccagcagcagcc

SEQ ID NO: 812852 - RNA, 17 nt, Mycobacterium avium subsp. paratuberculosis
cacgaacaacugcauca

SEQ ID NO: 812853 - RNA, 23 nt, Mycobacterium avium subsp. paratuberculosis
cacgaacaccacguagccgaccu

SEQ ID NO: 812854 - RNA, 14 nt, Mycobacterium avium subsp. paratuberculosis
cacgaacagcagcg

SEQ ID NO: 812855 - RNA, 20 nt, Mycobacterium avium subsp. paratuberculosis
cacgaaauaaccgcgcggcg

SEQ ID NO: 812856 - RNA, 13 nt, Mycobacterium avium subsp. paratuberculosis
cacgaaccaggcg

SEQ ID NO: 812857 - RNA, 15 nt, Mycobacterium avium subsp. paratuberculosis
cacgaaccaggcgcc

SEQ ID NO: 812858 - RNA, 16 nt, Mycobacterium avium subsp. paratuberculosis
cacgaaccaggcgccg

SEQ ID NO: 812859 - RNA, 17 nt, Mycobacterium avium subsp. paratuberculosis
cacgaacccggcggccc

SEQ ID NO: 812860 - RNA, 14 nt, Mycobacterium avium subsp. paratuberculosis
cacgaaccgcucga

SEQ ID NO: 812861 - RNA, 23 nt, Mycobacterium avium subsp. paratuberculosis
cacgaaccgcucgaacacccggc

SEQ ID NO: 812862 - RNA, 13 nt, Mycobacterium avium subsp. paratuberculosis
cacgaacgcgacg

SEQ ID NO: 812863 - RNA, 13 nt, Mycobacterium avium subsp. paratuberculosis
cacgaacgcgccg

SEQ ID NO: 812864 - RNA, 16 nt, Mycobacterium avium subsp. paratuberculosis
cacgaacgcgccgccg

SEQ ID NO: 812865 - RNA, 17 nt, Mycobacterium avium subsp. paratuberculosis
cacgaacgcgccgccga

SEQ ID NO: 812866 - RNA, 13 nt, Mycobacterium avium subsp. paratuberculosis
cacgaacgcggcc

SEQ ID NO: 812867 - RNA, 14 nt, Mycobacterium avium subsp. paratuberculosis
cacgaacgcggcca

SEQ ID NO: 812868 - RNA, 18 nt, Mycobacterium avium subsp. paratuberculosis
cacgaacgcggccagcgg

SEQ ID NO: 812869 - RNA, 16 nt, Mycobacterium avium subsp. paratuberculosis
cacgaacgcggccgcc

SEQ ID NO: 812870 - RNA, 19 nt, Mycobacterium avium subsp. paratuberculosis
cacgaacgcggccgccauc

SEQ ID NO: 812871 - RNA, 20 nt, Mycobacterium avium subsp. paratuberculosis
cacgaacgcguucgucggcg

SEQ ID NO: 812872 - RNA, 23 nt, Mycobacterium avium subsp. paratuberculosis
cacgaacgcguucgucggcgcgu

SEQ ID NO: 812873 - RNA, 14 nt, Mycobacterium avium subsp. paratuberculosis
cacgaacggcgcga

SEQ ID NO: 812874 - RNA, 19 nt, Mycobacterium avium subsp. paratuberculosis
cacgaagaugaucagcgcg

SEQ ID NO: 812875 - RNA, 22 nt, Mycobacterium avium subsp. paratuberculosis
cacgaagaaguauucgccgucg

SEQ ID NO: 812876 - RNA, 13 nt, Mycobacterium avium subsp. paratuberculosis
cacgaacgacgcg

SEQ ID NO: 812877 - RNA, 15 nt, Mycobacterium avium subsp. paratuberculosis
cacgaacgacgcggc

SEQ ID NO: 812878 - RNA, 22 nt, Mycobacterium avium subsp. paratuberculosis
cacgaacgacgcggcacgccgc

SEQ ID NO: 812879 - RNA, 14 nt, Mycobacterium avium subsp. paratuberculosis
cacgaacugggugc

SEQ ID NO: 812880 - RNA, 13 nt, Mycobacterium avium subsp. paratuberculosis
cacgaagggcgcc

SEQ ID NO: 812881 - RNA, 17 nt, Mycobacterium avium subsp. paratuberculosis
cacgaagggcgccagca

SEQ ID NO: 812882 - RNA, 20 nt, Mycobacterium avium subsp. paratuberculosis
cacgaaguacagcgucagca

SEQ ID NO: 812883 - RNA, 14 nt, Mycobacterium avium subsp. paratuberculosis
cacgaagcgggcgg

SEQ ID NO: 812884 - RNA, 19 nt, Mycobacterium avium subsp. paratuberculosis
caccuucugcgcgccgucg

SEQ ID NO: 812885 - RNA, 15 nt, Mycobacterium avium subsp. paratuberculosis
caccuugcggccggc

SEQ ID NO: 812886 - RNA, 20 nt, Mycobacterium avium subsp. paratuberculosis
caccuugcggccggcggcgu

SEQ ID NO: 812887 - RNA, 19 nt, Mycobacterium avium subsp. paratuberculosis
caccuugcccgucgcgucc

SEQ ID NO: 812888 - RNA, 15 nt, Mycobacterium avium subsp. paratuberculosis
caccuugucggcgag

SEQ ID NO: 812889 - RNA, 15 nt, Mycobacterium avium subsp. paratuberculosis
caccuugucaccgaa

SEQ ID NO: 812890 - RNA, 20 nt, Mycobacterium avium subsp. paratuberculosis
caccuuggugagcaccgcga

SEQ ID NO: 812891 - RNA, 23 nt, Mycobacterium avium subsp. paratuberculosis
caccuuggccggugcgccgaccg

SEQ ID NO: 812892 - RNA, 22 nt, Mycobacterium avium subsp. paratuberculosis
caccuuggacgaaacccggcgg

SEQ ID NO: 812893 - RNA, 14 nt, Mycobacterium avium subsp. paratuberculosis
caccuguacguguc

SEQ ID NO: 812894 - RNA, 18 nt, Mycobacterium avium subsp. paratuberculosis
caccugguuggcccgcac

SEQ ID NO: 812895 - RNA, 19 nt, Mycobacterium avium subsp. paratuberculosis
caccugguuggcccgcacc

SEQ ID NO: 812896 - RNA, 16 nt, Mycobacterium avium subsp. paratuberculosis
caccuucaccgcgccg

SEQ ID NO: 812897 - RNA, 14 nt, Mycobacterium avium subsp. paratuberculosis
caccuucaucgccg

SEQ ID NO: 812898 - RNA, 17 nt, Mycobacterium avium subsp. paratuberculosis
caccuucaucgccgucg

SEQ ID NO: 812899 - RNA, 18 nt, Mycobacterium avium subsp. paratuberculosis
caccuuccaucgacgcug

SEQ ID NO: 812900 - RNA, 14 nt, Mycobacterium avium subsp. paratuberculosis
caccuucgcggucg

SEQ ID NO: 812901 - RNA, 19 nt, Mycobacterium avium subsp. paratuberculosis
caccuucgcggucggcaac

SEQ ID NO: 812902 - RNA, 16 nt, Mycobacterium avium subsp. paratuberculosis
caccugaucgcggcga

SEQ ID NO: 812903 - RNA, 20 nt, Mycobacterium avium subsp. paratuberculosis
caccugauaggggucggcga

SEQ ID NO: 812904 - RNA, 12 nt, Mycobacterium avium subsp. paratuberculosis
caccugaccgcg

SEQ ID NO: 812905 - RNA, 22 nt, Mycobacterium avium subsp. paratuberculosis
caccugaccgucggccagauag

SEQ ID NO: 812906 - RNA, 20 nt, Mycobacterium avium subsp. paratuberculosis
caccugacgcaucaccacgc

SEQ ID NO: 812907 - RNA, 16 nt, Mycobacterium avium subsp. paratuberculosis
caccucuucgcggucc

SEQ ID NO: 812908 - RNA, 15 nt, Mycobacterium avium subsp. paratuberculosis
caccucuucgggcag

SEQ ID NO: 812909 - RNA, 15 nt, Mycobacterium avium subsp. paratuberculosis
caccugaaccgcgca

SEQ ID NO: 812910 - RNA, 16 nt, Mycobacterium avium subsp. paratuberculosis
caccugcacggggacg

SEQ ID NO: 812911 - RNA, 13 nt, Mycobacterium avium subsp. paratuberculosis
caccugcaguucg

SEQ ID NO: 812912 - RNA, 17 nt, Mycobacterium avium subsp. paratuberculosis
caccugcaucacgaugg

SEQ ID NO: 812913 - RNA, 17 nt, Mycobacterium avium subsp. paratuberculosis
caccugccgcaacgggc

SEQ ID NO: 812914 - RNA, 20 nt, Mycobacterium avium subsp. paratuberculosis
caccugccgcaacgggccgc

SEQ ID NO: 812915 - RNA, 16 nt, Mycobacterium avium subsp. paratuberculosis
caccugccgcacaccg

SEQ ID NO: 812916 - RNA, 17 nt, Mycobacterium avium subsp. paratuberculosis
caccugccgcacaccgu

SEQ ID NO: 812917 - RNA, 13 nt, Mycobacterium avium subsp. paratuberculosis
caccugcgcgacg

SEQ ID NO: 812918 - RNA, 12 nt, Mycobacterium avium subsp. paratuberculosis
caccugcggccc

SEQ ID NO: 812919 - RNA, 17 nt, Mycobacterium avium subsp. paratuberculosis
caccugcggcccgucgc

SEQ ID NO: 812920 - RNA, 13 nt, Mycobacterium avium subsp. paratuberculosis
caccugcggcggc

SEQ ID NO: 812921 - RNA, 14 nt, Mycobacterium avium subsp. paratuberculosis
caccugcggcggca

SEQ ID NO: 812922 - RNA, 16 nt, Mycobacterium avium subsp. paratuberculosis
caccugcggcggcagu

SEQ ID NO: 812923 - RNA, 18 nt, Mycobacterium avium subsp. paratuberculosis
caccugcggcggcagucg

SEQ ID NO: 812924 - RNA, 21 nt, Mycobacterium avium subsp. paratuberculosis
caccugcgugccuugcaccca

SEQ ID NO: 812925 - RNA, 20 nt, Mycobacterium avium subsp. paratuberculosis
caccuggaggccaacgagcg

SEQ ID NO: 812926 - RNA, 21 nt, Mycobacterium avium subsp. paratuberculosis
caccuggaggccaacgagcgc

SEQ ID NO: 812927 - RNA, 21 nt, Mycobacterium avium subsp. paratuberculosis
caccugcucgaugcgcgccag

SEQ ID NO: 812928 - RNA, 23 nt, Mycobacterium avium subsp. paratuberculosis
caccuggcugugcacgauggaca

SEQ ID NO: 812929 - RNA, 22 nt, Mycobacterium avium subsp. paratuberculosis
caccuggcgcagcaccgacucc

SEQ ID NO: 812930 - RNA, 11 nt, Mycobacterium avium subsp. paratuberculosis
caccuggccgu

SEQ ID NO: 812931 - RNA, 19 nt, Mycobacterium avium subsp. paratuberculosis
caccuggccgucgguggcc

SEQ ID NO: 812932 - RNA, 20 nt, Mycobacterium avium subsp. paratuberculosis
caccuggcgcaccgccgcgg

SEQ ID NO: 812933 - RNA, 19 nt, Mycobacterium avium subsp. paratuberculosis
caccucgguggacgccgcg

SEQ ID NO: 812934 - RNA, 17 nt, Mycobacterium avium subsp. paratuberculosis
caccucgucccagcgca

SEQ ID NO: 812935 - RNA, 17 nt, Mycobacterium avium subsp. paratuberculosis
caccucgucgcccggcg

SEQ ID NO: 812936 - RNA, 17 nt, Mycobacterium avium subsp. paratuberculosis
caccucgucggcgguca

SEQ ID NO: 812937 - RNA, 22 nt, Mycobacterium avium subsp. paratuberculosis
caccucggugaucucaccggcg

SEQ ID NO: 812938 - RNA, 19 nt, Mycobacterium avium subsp. paratuberculosis
caccucggugaugucgacg

SEQ ID NO: 812939 - RNA, 16 nt, Mycobacterium avium subsp. paratuberculosis
caccucgggcacgucc

SEQ ID NO: 812940 - RNA, 16 nt, Mycobacterium avium subsp. paratuberculosis
caccucggccgggucc

SEQ ID NO: 812941 - RNA, 22 nt, Mycobacterium avium subsp. paratuberculosis
caccucggcggcaccgcccggg

SEQ ID NO: 812942 - RNA, 13 nt, Mycobacterium avium subsp. paratuberculosis
caccucggcgucg

SEQ ID NO: 812943 - RNA, 17 nt, Mycobacterium avium subsp. paratuberculosis
caccucggcgucggcgc

SEQ ID NO: 812944 - RNA, 18 nt, Mycobacterium avium subsp. paratuberculosis
caccucggcgucggcgcg

SEQ ID NO: 812945 - RNA, 19 nt, Mycobacterium avium subsp. paratuberculosis
caccucggcgucggcgcgu

SEQ ID NO: 812946 - RNA, 15 nt, Mycobacterium avium subsp. paratuberculosis
caccucgcugcgcga

SEQ ID NO: 812947 - RNA, 18 nt, Mycobacterium avium subsp. paratuberculosis
caccucgcuggcggcgcg

SEQ ID NO: 812948 - RNA, 14 nt, Mycobacterium avium subsp. paratuberculosis
caccucggccagcg

SEQ ID NO: 812949 - RNA, 22 nt, Mycobacterium avium subsp. paratuberculosis
caccucggccagcgccgcgcgc

SEQ ID NO: 812950 - RNA, 23 nt, Mycobacterium avium subsp. paratuberculosis
caccucggccuugaccacggugc

SEQ ID NO: 812951 - RNA, 16 nt, Mycobacterium avium subsp. paratuberculosis
caccucggccuugccg

SEQ ID NO: 812952 - RNA, 22 nt, Mycobacterium avium subsp. paratuberculosis
caccucggccuugccgcuguga

SEQ ID NO: 812953 - RNA, 16 nt, Mycobacterium avium subsp. paratuberculosis
caccucggcgaccucg

SEQ ID NO: 812954 - RNA, 22 nt, Mycobacterium avium subsp. paratuberculosis
caccucggcgaccucggggaug

SEQ ID NO: 812955 - RNA, 13 nt, Mycobacterium avium subsp. paratuberculosis
caccucggcgacg

SEQ ID NO: 812956 - RNA, 16 nt, Mycobacterium avium subsp. paratuberculosis
caccucggcgacgaug

SEQ ID NO: 812957 - RNA, 16 nt, Mycobacterium avium subsp. paratuberculosis
caccucggcgacgucc

SEQ ID NO: 812958 - RNA, 13 nt, Mycobacterium avium subsp. paratuberculosis
caccucggcgauc

SEQ ID NO: 812959 - RNA, 13 nt, Mycobacterium avium subsp. paratuberculosis
caccucggcgaug

SEQ ID NO: 812960 - RNA, 16 nt, Mycobacterium avium subsp. paratuberculosis
caccucgcucagcccg

SEQ ID NO: 812961 - RNA, 18 nt, Mycobacterium avium subsp. paratuberculosis
caccucgauggccgggaa

SEQ ID NO: 812962 - RNA, 13 nt, Mycobacterium avium subsp. paratuberculosis
caccucgcccggc

SEQ ID NO: 812963 - RNA, 18 nt, Mycobacterium avium subsp. paratuberculosis
caccucgccgaucucgac

SEQ ID NO: 812964 - RNA, 14 nt, Mycobacterium avium subsp. paratuberculosis
caccucgcgcagca

SEQ ID NO: 812965 - RNA, 23 nt, Mycobacterium avium subsp. paratuberculosis
caccucgcgcucuugggcggccg

SEQ ID NO: 812966 - RNA, 12 nt, Mycobacterium avium subsp. paratuberculosis
caccgcggccaa

SEQ ID NO: 812967 - RNA, 16 nt, Mycobacterium avium subsp. paratuberculosis
caccgcggccaacccg

SEQ ID NO: 812968 - RNA, 20 nt, Mycobacterium avium subsp. paratuberculosis
caccgcggccaacccgggcg

SEQ ID NO: 812969 - RNA, 23 nt, Mycobacterium avium subsp. paratuberculosis
caccgcggccaacccgggcgcca

SEQ ID NO: 812970 - RNA, 15 nt, Mycobacterium avium subsp. paratuberculosis
caccgcggccaccug

SEQ ID NO: 812971 - RNA, 16 nt, Mycobacterium avium subsp. paratuberculosis
caccgcggccaccugg

SEQ ID NO: 812972 - RNA, 18 nt, Mycobacterium avium subsp. paratuberculosis
caccgcgcuugccgcgac

SEQ ID NO: 812973 - RNA, 16 nt, Mycobacterium avium subsp. paratuberculosis
caccuccccgcggugc

SEQ ID NO: 812974 - RNA, 18 nt, Mycobacterium avium subsp. paratuberculosis
caccuccccgcggugccg

SEQ ID NO: 812975 - RNA, 22 nt, Mycobacterium avium subsp. paratuberculosis
caccuccccgcggugccgcagc

SEQ ID NO: 812976 - RNA, 15 nt, Mycobacterium avium subsp. paratuberculosis
caccuccuccggucc

SEQ ID NO: 812977 - RNA, 15 nt, Mycobacterium avium subsp. paratuberculosis
caccuccucgcgggc

SEQ ID NO: 812978 - RNA, 16 nt, Mycobacterium avium subsp. paratuberculosis
caccuccugcacccgu

SEQ ID NO: 812979 - RNA, 21 nt, Mycobacterium avium subsp. paratuberculosis
caccuccuuggccaggcgggc

SEQ ID NO: 812980 - RNA, 17 nt, Mycobacterium avium subsp. paratuberculosis
caccucgaaacccagcu

SEQ ID NO: 812981 - RNA, 13 nt, Mycobacterium avium subsp. paratuberculosis
caccucgaacgcc

SEQ ID NO: 812982 - RNA, 22 nt, Mycobacterium avium subsp. paratuberculosis
caccucgaacuugaccgggcuc

SEQ ID NO: 812983 - RNA, 24 nt, Mycobacterium avium subsp. paratuberculosis
caccucgaacuugaccgggcucca

SEQ ID NO: 812984 - RNA, 19 nt, Mycobacterium avium subsp. paratuberculosis
caccucgaagccgacgucc

SEQ ID NO: 812985 - RNA, 17 nt, Mycobacterium avium subsp. paratuberculosis
caccucgaagccgaucg

SEQ ID NO: 812986 - RNA, 21 nt, Mycobacterium avium subsp. paratuberculosis
caccucgaagggcgccagccg

SEQ ID NO: 812987 - RNA, 22 nt, Mycobacterium avium subsp. paratuberculosis
caccucgaaguucuccucgccg

SEQ ID NO: 812988 - RNA, 19 nt, Mycobacterium avium subsp. paratuberculosis
caccucgaccgugaggccc

SEQ ID NO: 812989 - RNA, 16 nt, Mycobacterium avium subsp. paratuberculosis
caccucgaccagaucc

SEQ ID NO: 812990 - RNA, 15 nt, Mycobacterium avium subsp. paratuberculosis
caccucgacggcgug

SEQ ID NO: 812991 - RNA, 19 nt, Mycobacterium avium subsp. paratuberculosis
caccucgagcucaccgaca

SEQ ID NO: 812992 - RNA, 12 nt, Mycobacterium avium subsp. paratuberculosis
caccucgaggaa

SEQ ID NO: 812993 - RNA, 14 nt, Mycobacterium avium subsp. paratuberculosis
caccucgaggaacu

SEQ ID NO: 812994 - RNA, 14 nt, Mycobacterium avium subsp. paratuberculosis
caccucgaucaccg

SEQ ID NO: 812995 - RNA, 18 nt, Mycobacterium avium subsp. paratuberculosis
caccucgaucaccgggcg

SEQ ID NO: 812996 - RNA, 21 nt, Mycobacterium avium subsp. paratuberculosis
caccucgaucaccgggcggcc

SEQ ID NO: 812997 - RNA, 13 nt, Mycobacterium avium subsp. paratuberculosis
caccucgagcacg

SEQ ID NO: 812998 - RNA, 17 nt, Mycobacterium avium subsp. paratuberculosis
caccucgagcacgcccu

SEQ ID NO: 812999 - RNA, 23 nt, Mycobacterium avium subsp. paratuberculosis
caccucgagcacgcccugcggcu

SEQ ID NO: 813000 - RNA, 22 nt, Mycobacterium avium subsp. paratuberculosis
caccucgagcacucgcgggacg

SEQ ID NO: 813001 - RNA, 23 nt, Mycobacterium avium subsp. paratuberculosis
caccucgaugaccuucugaucgg

SEQ ID NO: 813002 - RNA, 14 nt, Mycobacterium avium subsp. paratuberculosis
cacgacgccgggcg

SEQ ID NO: 813003 - RNA, 15 nt, Mycobacterium avium subsp. paratuberculosis
cacgacgccgccgag

SEQ ID NO: 813004 - RNA, 13 nt, Mycobacterium avium subsp. paratuberculosis
cacgacgaccgcg

SEQ ID NO: 813005 - RNA, 14 nt, Mycobacterium avium subsp. paratuberculosis
cacgacgaccgcga

SEQ ID NO: 813006 - RNA, 20 nt, Mycobacterium avium subsp. paratuberculosis
cacgacgaccgcgacggcgc

SEQ ID NO: 813007 - RNA, 16 nt, Mycobacterium avium subsp. paratuberculosis
cacgacgacguggugg

SEQ ID NO: 813008 - RNA, 23 nt, Mycobacterium avium subsp. paratuberculosis
cacgacgacugggugcgcgggcg

SEQ ID NO: 813009 - RNA, 19 nt, Mycobacterium avium subsp. paratuberculosis
cacgacggucacggccgcc

SEQ ID NO: 813010 - RNA, 21 nt, Mycobacterium avium subsp. paratuberculosis
cacgacggucacggccgccag

SEQ ID NO: 813011 - RNA, 23 nt, Mycobacterium avium subsp. paratuberculosis
cacgacggucagcacgcugauca

SEQ ID NO: 813012 - RNA, 18 nt, Mycobacterium avium subsp. paratuberculosis
cacgacggcgcuggccgc

SEQ ID NO: 813013 - RNA, 20 nt, Mycobacterium avium subsp. paratuberculosis
cacgacggcgcuggccgcgg

SEQ ID NO: 813014 - RNA, 22 nt, Mycobacterium avium subsp. paratuberculosis
cacgacggcgcuggccgcggcc

SEQ ID NO: 813015 - RNA, 15 nt, Mycobacterium avium subsp. paratuberculosis
cacgacgcgaccgag

SEQ ID NO: 813016 - RNA, 12 nt, Mycobacterium avium subsp. paratuberculosis
cacgacgcggcg

SEQ ID NO: 813017 - RNA, 15 nt, Mycobacterium avium subsp. paratuberculosis
cacgacgcggcgcgc

SEQ ID NO: 813018 - RNA, 17 nt, Mycobacterium avium subsp. paratuberculosis
cacgacgcggucugcgg

SEQ ID NO: 813019 - RNA, 16 nt, Mycobacterium avium subsp. paratuberculosis
cacgacguacccccgc

SEQ ID NO: 813020 - RNA, 23 nt, Mycobacterium avium subsp. paratuberculosis
cacgacgucgagccagcgggccg

SEQ ID NO: 813021 - RNA, 21 nt, Mycobacterium avium subsp. paratuberculosis
cacgacguggagucgaagcgg

SEQ ID NO: 813022 - RNA, 14 nt, Mycobacterium avium subsp. paratuberculosis
cacgacugcgcggc

SEQ ID NO: 813023 - RNA, 15 nt, Mycobacterium avium subsp. paratuberculosis
cacgacugcgcggcc

SEQ ID NO: 813024 - RNA, 19 nt, Mycobacterium avium subsp. paratuberculosis
cacgacuucacaggccgcc

SEQ ID NO: 813025 - RNA, 20 nt, Mycobacterium avium subsp. paratuberculosis
cacgaucagggugucgaaca

SEQ ID NO: 813026 - RNA, 14 nt, Mycobacterium avium subsp. paratuberculosis
cacgaucagcgcgu

SEQ ID NO: 813027 - RNA, 16 nt, Mycobacterium avium subsp. paratuberculosis
cacgaucagcgcgucg

SEQ ID NO: 813028 - RNA, 18 nt, Mycobacterium avium subsp. paratuberculosis
cacgaucaccagaccggg

SEQ ID NO: 813029 - RNA, 20 nt, Mycobacterium avium subsp. paratuberculosis
cacgaucaccagaccggguu

SEQ ID NO: 813030 - RNA, 19 nt, Mycobacterium avium subsp. paratuberculosis
cacgaucaccaccaccgcc

SEQ ID NO: 813031 - RNA, 13 nt, Mycobacterium avium subsp. paratuberculosis
cacgaucacgucg

SEQ ID NO: 813032 - RNA, 20 nt, Mycobacterium avium subsp. paratuberculosis
cacgaucacgucggugacgc

SEQ ID NO: 813033 - RNA, 17 nt, Mycobacterium avium subsp. paratuberculosis
cacgaggcugugggcca

SEQ ID NO: 813034 - RNA, 20 nt, Mycobacterium avium subsp. paratuberculosis
cacgaggcugugggccagca

SEQ ID NO: 813035 - RNA, 16 nt, Mycobacterium avium subsp. paratuberculosis
cacgagcccagccguc

SEQ ID NO: 813036 - RNA, 14 nt, Mycobacterium avium subsp. paratuberculosis
cacgagcagacccg

SEQ ID NO: 813037 - RNA, 14 nt, Mycobacterium avium subsp. paratuberculosis
cacgagcgaacacg

SEQ ID NO: 813038 - RNA, 14 nt, Mycobacterium avium subsp. paratuberculosis
cacgaggccgggcu

SEQ ID NO: 813039 - RNA, 21 nt, Mycobacterium avium subsp. paratuberculosis
cacgaggccgggcuggcgcug

SEQ ID NO: 813040 - RNA, 17 nt, Mycobacterium avium subsp. paratuberculosis
cacgcaaaaaccaugcc

SEQ ID NO: 813041 - RNA, 15 nt, Mycobacterium avium subsp. paratuberculosis
cacgcacaccaccga

SEQ ID NO: 813042 - RNA, 19 nt, Mycobacterium avium subsp. paratuberculosis
cacgauguugaugucgcgc

SEQ ID NO: 813043 - RNA, 22 nt, Mycobacterium avium subsp. paratuberculosis
cacgauguugaugucgcgcggc

SEQ ID NO: 813044 - RNA, 18 nt, Mycobacterium avium subsp. paratuberculosis
cacgauuccucggaccgg

SEQ ID NO: 813045 - RNA, 16 nt, Mycobacterium avium subsp. paratuberculosis
cacgauggcgcggcgc

SEQ ID NO: 813046 - RNA, 17 nt, Mycobacterium avium subsp. paratuberculosis
cacgauggcgcggcgca

SEQ ID NO: 813047 - RNA, 19 nt, Mycobacterium avium subsp. paratuberculosis
cacgaugcugauacccgcg

SEQ ID NO: 813048 - RNA, 20 nt, Mycobacterium avium subsp. paratuberculosis
cacgaugcugauacccgcgc

SEQ ID NO: 813049 - RNA, 20 nt, Mycobacterium avium subsp. paratuberculosis
cacgaugcgcugugcgggug

SEQ ID NO: 813050 - RNA, 19 nt, Mycobacterium avium subsp. paratuberculosis
cacgaugcggugccgggug

SEQ ID NO: 813051 - RNA, 20 nt, Mycobacterium avium subsp. paratuberculosis
cacgaugcccuuggccagca

SEQ ID NO: 813052 - RNA, 15 nt, Mycobacterium avium subsp. paratuberculosis
cacgaugccgaccaa

SEQ ID NO: 813053 - RNA, 15 nt, Mycobacterium avium subsp. paratuberculosis
cacgaugacgaccgg

SEQ ID NO: 813054 - RNA, 18 nt, Mycobacterium avium subsp. paratuberculosis
cacgaugaucgucggcag

SEQ ID NO: 813055 - RNA, 21 nt, Mycobacterium avium subsp. paratuberculosis
cacgaugaucgucggcagcga

SEQ ID NO: 813056 - RNA, 23 nt, Mycobacterium avium subsp. paratuberculosis
cacgaugaucgucggcagcgacg

SEQ ID NO: 813057 - RNA, 19 nt, Mycobacterium avium subsp. paratuberculosis
cacgaucucgaccaggccg

SEQ ID NO: 813058 - RNA, 16 nt, Mycobacterium avium subsp. paratuberculosis
cacgaucgggcgcaga

SEQ ID NO: 813059 - RNA, 20 nt, Mycobacterium avium subsp. paratuberculosis
cacgaucggguagacgucgg

SEQ ID NO: 813060 - RNA, 22 nt, Mycobacterium avium subsp. paratuberculosis
cacgaucggguagacgucgggc

SEQ ID NO: 813061 - RNA, 16 nt, Mycobacterium avium subsp. paratuberculosis
cacgaucgucaccgug

SEQ ID NO: 813062 - RNA, 21 nt, Mycobacterium avium subsp. paratuberculosis
cacgaucgucaccgugccguc

SEQ ID NO: 813063 - RNA, 23 nt, Mycobacterium avium subsp. paratuberculosis
cacgaucgucaccgugccgucgc

SEQ ID NO: 813064 - RNA, 17 nt, Mycobacterium avium subsp. paratuberculosis
cacgaucucggucgcca

SEQ ID NO: 813065 - RNA, 21 nt, Mycobacterium avium subsp. paratuberculosis
cacgaucucggucgccagcac

SEQ ID NO: 813066 - RNA, 22 nt, Mycobacterium avium subsp. paratuberculosis
cacgaucucggucgccagcacc

SEQ ID NO: 813067 - RNA, 23 nt, Mycobacterium avium subsp. paratuberculosis
cacgaucucggucgccagcaccg

SEQ ID NO: 813068 - RNA, 16 nt, Mycobacterium avium subsp. paratuberculosis
cacgaucugcaggccg

SEQ ID NO: 813069 - RNA, 13 nt, Mycobacterium avium subsp. paratuberculosis
cacgaucgucgcc

SEQ ID NO: 813070 - RNA, 15 nt, Mycobacterium avium subsp. paratuberculosis
cacgaucgucgccgc

SEQ ID NO: 813071 - RNA, 17 nt, Mycobacterium avium subsp. paratuberculosis
cacgaucgucgccgcca

SEQ ID NO: 813072 - RNA, 17 nt, Mycobacterium avium subsp. paratuberculosis
cacgaucgucuggccgu

SEQ ID NO: 813073 - RNA, 14 nt, Mycobacterium avium subsp. paratuberculosis
cacgaucgcgguga

SEQ ID NO: 813074 - RNA, 14 nt, Mycobacterium avium subsp. paratuberculosis
cacgaucgcggcca

SEQ ID NO: 813075 - RNA, 17 nt, Mycobacterium avium subsp. paratuberculosis
cacgaucgcggugacgc

SEQ ID NO: 813076 - RNA, 23 nt, Mycobacterium avium subsp. paratuberculosis
cacgaucgcggugacgcgccggc

SEQ ID NO: 813077 - RNA, 12 nt, Mycobacterium avium subsp. paratuberculosis
cacgaucgcguc

SEQ ID NO: 813078 - RNA, 15 nt, Mycobacterium avium subsp. paratuberculosis
cacgaucgcgucgga

SEQ ID NO: 813079 - RNA, 18 nt, Mycobacterium avium subsp. paratuberculosis
cacgaucggcaugacgcc

SEQ ID NO: 813080 - RNA, 20 nt, Mycobacterium avium subsp. paratuberculosis
cacgaucggcaugacgccca

SEQ ID NO: 813081 - RNA, 13 nt, Mycobacterium avium subsp. paratuberculosis
cacgaucccgccg

SEQ ID NO: 813082 - RNA, 15 nt, Mycobacterium avium subsp. paratuberculosis
cacgaucccgccgcc

SEQ ID NO: 813083 - RNA, 15 nt, Mycobacterium avium subsp. paratuberculosis
cacgauccgcgcggc

SEQ ID NO: 813084 - RNA, 18 nt, Mycobacterium avium subsp. paratuberculosis
cacgauccgcgcggccac

SEQ ID NO: 813085 - RNA, 19 nt, Mycobacterium avium subsp. paratuberculosis
cacgauccgcgcggccacc

SEQ ID NO: 813086 - RNA, 14 nt, Mycobacterium avium subsp. paratuberculosis
cacgaucgagccgg

SEQ ID NO: 813087 - RNA, 12 nt, Mycobacterium avium subsp. paratuberculosis
cacgcacggcga

SEQ ID NO: 813088 - RNA, 14 nt, Mycobacterium avium subsp. paratuberculosis
cacgcacggcgaac

SEQ ID NO: 813089 - RNA, 16 nt, Mycobacterium avium subsp. paratuberculosis
cacgcacggcgaacgg

SEQ ID NO: 813090 - RNA, 14 nt, Mycobacterium avium subsp. paratuberculosis
cacgcaggcgucca

SEQ ID NO: 813091 - RNA, 23 nt, Mycobacterium avium subsp. paratuberculosis
cacgcaggcguggcccagccggu

SEQ ID NO: 813092 - RNA, 19 nt, Mycobacterium avium subsp. paratuberculosis
cacgcaggugcgccgcucg

SEQ ID NO: 813093 - RNA, 15 nt, Mycobacterium avium subsp. paratuberculosis
cacgcagugccgcac

SEQ ID NO: 813094 - RNA, 20 nt, Mycobacterium avium subsp. paratuberculosis
cacgcagugccgcaccagca

SEQ ID NO: 813095 - RNA, 22 nt, Mycobacterium avium subsp. paratuberculosis
cacgcagugccgcaccagcacc

SEQ ID NO: 813096 - RNA, 22 nt, Mycobacterium avium subsp. paratuberculosis
cacgcagaucuugugccagccg

SEQ ID NO: 813097 - RNA, 14 nt, Mycobacterium avium subsp. paratuberculosis
cacgcagcggugca

SEQ ID NO: 813098 - RNA, 18 nt, Mycobacterium avium subsp. paratuberculosis
cacgcagcggugcagccc

SEQ ID NO: 813099 - RNA, 19 nt, Mycobacterium avium subsp. paratuberculosis
cacgcaucagggccagccg

SEQ ID NO: 813100 - RNA, 17 nt, Mycobacterium avium subsp. paratuberculosis
cacgcaguguccgaucg

SEQ ID NO: 813101 - RNA, 22 nt, Mycobacterium avium subsp. paratuberculosis
cacgccacucgucgacguucga

SEQ ID NO: 813102 - RNA, 13 nt, Mycobacterium avium subsp. paratuberculosis
cacgccagcaucg

SEQ ID NO: 813103 - RNA, 18 nt, Mycobacterium avium subsp. paratuberculosis
cacgccagcgugacgccc

SEQ ID NO: 813104 - RNA, 21 nt, Mycobacterium avium subsp. paratuberculosis
cacgccagcgugacgccgggc

SEQ ID NO: 813105 - RNA, 21 nt, Mycobacterium avium subsp. paratuberculosis
cacgccagcgugacgcucggg

SEQ ID NO: 813106 - RNA, 22 nt, Mycobacterium avium subsp. paratuberculosis
cacgccagcgugacgcucgggc

SEQ ID NO: 813107 - RNA, 15 nt, Mycobacterium avium subsp. paratuberculosis
cacgcccgcagcgca

SEQ ID NO: 813108 - RNA, 19 nt, Mycobacterium avium subsp. paratuberculosis
cacgcccgcgaucggcgcc

SEQ ID NO: 813109 - RNA, 15 nt, Mycobacterium avium subsp. paratuberculosis
cacgcccggacccgc

SEQ ID NO: 813110 - RNA, 21 nt, Mycobacterium avium subsp. paratuberculosis
cacgccagucauggcaguugu

SEQ ID NO: 813111 - RNA, 23 nt, Mycobacterium avium subsp. paratuberculosis
cacgccccauugccgcgccgggg

SEQ ID NO: 813112 - RNA, 15 nt, Mycobacterium avium subsp. paratuberculosis
cacgccccggcgccg

SEQ ID NO: 813113 - RNA, 16 nt, Mycobacterium avium subsp. paratuberculosis
cacgccccggcgccgu

SEQ ID NO: 813114 - RNA, 14 nt, Mycobacterium avium subsp. paratuberculosis
cacgcccgacgacg

SEQ ID NO: 813115 - RNA, 16 nt, Mycobacterium avium subsp. paratuberculosis
cacgcccuggccgccg

SEQ ID NO: 813116 - RNA, 17 nt, Mycobacterium avium subsp. paratuberculosis
cacgcccuggccgccgg

SEQ ID NO: 813117 - RNA, 19 nt, Mycobacterium avium subsp. paratuberculosis
cacgcccuggaaggcgauc

SEQ ID NO: 813118 - RNA, 19 nt, Mycobacterium avium subsp. paratuberculosis
cacgcccguucgagcgccg

SEQ ID NO: 813119 - RNA, 13 nt, Mycobacterium avium subsp. paratuberculosis
cacgcccgggcau

SEQ ID NO: 813120 - RNA, 18 nt, Mycobacterium avium subsp. paratuberculosis
cacgcccgucccugcgcg

SEQ ID NO: 813121 - RNA, 20 nt, Mycobacterium avium subsp. paratuberculosis
cacgcccuagcgggccagga

SEQ ID NO: 813122 - RNA, 21 nt, Mycobacterium avium subsp. paratuberculosis
cacgccuggcggaaggccgcg

SEQ ID NO: 813123 - RNA, 19 nt, Mycobacterium avium subsp. paratuberculosis
cacgccuuccacgaccugg

SEQ ID NO: 813124 - RNA, 16 nt, Mycobacterium avium subsp. paratuberculosis
cacgccgcgcccgucg

SEQ ID NO: 813125 - RNA, 19 nt, Mycobacterium avium subsp. paratuberculosis
cacgccgcgcccgucgagc

SEQ ID NO: 813126 - RNA, 13 nt, Mycobacterium avium subsp. paratuberculosis
cacgccgcgcauc

SEQ ID NO: 813127 - RNA, 15 nt, Mycobacterium avium subsp. paratuberculosis
cacgcgaacaccaga

SEQ ID NO: 813128 - RNA, 14 nt, Mycobacterium avium subsp. paratuberculosis
cacgccgcgauccg

SEQ ID NO: 813129 - RNA, 17 nt, Mycobacterium avium subsp. paratuberculosis
cacgccgcucgucgggc

SEQ ID NO: 813130 - RNA, 18 nt, Mycobacterium avium subsp. paratuberculosis
cacgccgcucgucgggca

SEQ ID NO: 813131 - RNA, 17 nt, Mycobacterium avium subsp. paratuberculosis
cacgccgcggaaggcca

SEQ ID NO: 813132 - RNA, 20 nt, Mycobacterium avium subsp. paratuberculosis
cacgccgcggaaggccagcu

SEQ ID NO: 813133 - RNA, 15 nt, Mycobacterium avium subsp. paratuberculosis
cacgccgcgggaggc

SEQ ID NO: 813134 - RNA, 24 nt, Mycobacterium avium subsp. paratuberculosis
cacgccgcggucgcugacccgccg

SEQ ID NO: 813135 - RNA, 13 nt, Mycobacterium avium subsp. paratuberculosis
cacgccgccgcga

SEQ ID NO: 813136 - RNA, 14 nt, Mycobacterium avium subsp. paratuberculosis
cacgccgccggggc

SEQ ID NO: 813137 - RNA, 15 nt, Mycobacterium avium subsp. paratuberculosis
cacgccgccggggcg

SEQ ID NO: 813138 - RNA, 19 nt, Mycobacterium avium subsp. paratuberculosis
cacgccgcccaggccccgg

SEQ ID NO: 813139 - RNA, 21 nt, Mycobacterium avium subsp. paratuberculosis
cacgccgcccaggccccggcc

SEQ ID NO: 813140 - RNA, 15 nt, Mycobacterium avium subsp. paratuberculosis
cacgccgcccccgcc

SEQ ID NO: 813141 - RNA, 13 nt, Mycobacterium avium subsp. paratuberculosis
cacugucggcgcg

SEQ ID NO: 813142 - RNA, 15 nt, Mycobacterium avium subsp. paratuberculosis
cacugucggcgcgga

SEQ ID NO: 813143 - RNA, 13 nt, Mycobacterium avium subsp. paratuberculosis
cacuggcggccgg

SEQ ID NO: 813144 - RNA, 14 nt, Mycobacterium avium subsp. paratuberculosis
cacuggcggccggc

SEQ ID NO: 813145 - RNA, 17 nt, Mycobacterium avium subsp. paratuberculosis
cacuggcggccggccgc

SEQ ID NO: 813146 - RNA, 16 nt, Mycobacterium avium subsp. paratuberculosis
cacuggcgugacgcuc

SEQ ID NO: 813147 - RNA, 18 nt, Mycobacterium avium subsp. paratuberculosis
cacuggcgugacgcucgg

SEQ ID NO: 813148 - RNA, 20 nt, Mycobacterium avium subsp. paratuberculosis
cacuggcgugacgcucggcc

SEQ ID NO: 813149 - RNA, 12 nt, Mycobacterium avium subsp. paratuberculosis
cacugggcgucg

SEQ ID NO: 813150 - RNA, 14 nt, Mycobacterium avium subsp. paratuberculosis
cacugggcgucggc

SEQ ID NO: 813151 - RNA, 16 nt, Mycobacterium avium subsp. paratuberculosis
cacugguaaccgcccg

SEQ ID NO: 813152 - RNA, 16 nt, Mycobacterium avium subsp. paratuberculosis
cacuggucgugcugga

SEQ ID NO: 813153 - RNA, 19 nt, Mycobacterium avium subsp. paratuberculosis
cacuggucguugcacaccc

SEQ ID NO: 813154 - RNA, 22 nt, Mycobacterium avium subsp. paratuberculosis
cacuggucguugcacacccggu

SEQ ID NO: 813155 - RNA, 14 nt, Mycobacterium avium subsp. paratuberculosis
cacuggagugcugc

SEQ ID NO: 813156 - RNA, 22 nt, Mycobacterium avium subsp. paratuberculosis
cacuuguccaccauggcuuccg

SEQ ID NO: 813157 - RNA, 19 nt, Mycobacterium avium subsp. paratuberculosis
cacuuggccucgggcgacg

SEQ ID NO: 813158 - RNA, 14 nt, Mycobacterium avium subsp. paratuberculosis
cacuuccagcaccg

SEQ ID NO: 813159 - RNA, 18 nt, Mycobacterium avium subsp. paratuberculosis
cagaaaugcaggcccugc

SEQ ID NO: 813160 - RNA, 16 nt, Mycobacterium avium subsp. paratuberculosis
cagaaccgcucggcgg

SEQ ID NO: 813161 - RNA, 19 nt, Mycobacterium avium subsp. paratuberculosis
cagaacgaguuucccgucg

SEQ ID NO: 813162 - RNA, 17 nt, Mycobacterium avium subsp. paratuberculosis
cagaaccaccugggcgu

SEQ ID NO: 813163 - RNA, 15 nt, Mycobacterium avium subsp. paratuberculosis
cagaacaggugcggc

SEQ ID NO: 813164 - RNA, 19 nt, Mycobacterium avium subsp. paratuberculosis
cagaacaggugcggcaacc

SEQ ID NO: 813165 - RNA, 15 nt, Mycobacterium avium subsp. paratuberculosis
cagaacagccggucc

SEQ ID NO: 813166 - RNA, 16 nt, Mycobacterium avium subsp. paratuberculosis
cagaaccagcaccgcc

SEQ ID NO: 813167 - RNA, 20 nt, Mycobacterium avium subsp. paratuberculosis
cagaaccauuugcccagcag

SEQ ID NO: 813168 - RNA, 16 nt, Mycobacterium avium subsp. paratuberculosis
cagaaccgcaccccgu

SEQ ID NO: 813169 - RNA, 16 nt, Mycobacterium avium subsp. paratuberculosis
cagaacagccagucga

SEQ ID NO: 813170 - RNA, 17 nt, Mycobacterium avium subsp. paratuberculosis
cacugcacgcacggcga

SEQ ID NO: 813171 - RNA, 20 nt, Mycobacterium avium subsp. paratuberculosis
cacugcacgcacggcgaacg

SEQ ID NO: 813172 - RNA, 23 nt, Mycobacterium avium subsp. paratuberculosis
cacugccaagacguccgcgucgg

SEQ ID NO: 813173 - RNA, 24 nt, Mycobacterium avium subsp. paratuberculosis
cacugccaagacguccgcgucggc

SEQ ID NO: 813174 - RNA, 19 nt, Mycobacterium avium subsp. paratuberculosis
cacugccccggcgaacgcc

SEQ ID NO: 813175 - RNA, 22 nt, Mycobacterium avium subsp. paratuberculosis
cacugccccggcgaacgccucg

SEQ ID NO: 813176 - RNA, 23 nt, Mycobacterium avium subsp. paratuberculosis
cacugccccggcgaacgccucgg

SEQ ID NO: 813177 - RNA, 18 nt, Mycobacterium avium subsp. paratuberculosis
cacugcccgcaucgcaca

SEQ ID NO: 813178 - RNA, 15 nt, Mycobacterium avium subsp. paratuberculosis
cacugcccguagucg

SEQ ID NO: 813179 - RNA, 22 nt, Mycobacterium avium subsp. paratuberculosis
cacugcccguagucggcggcga

SEQ ID NO: 813180 - RNA, 19 nt, Mycobacterium avium subsp. paratuberculosis
cacuccugguuucgggggu

SEQ ID NO: 813181 - RNA, 19 nt, Mycobacterium avium subsp. paratuberculosis
cacugcaacuacgcacccg

SEQ ID NO: 813182 - RNA, 13 nt, Mycobacterium avium subsp. paratuberculosis
cacugcgcgcccg

SEQ ID NO: 813183 - RNA, 22 nt, Mycobacterium avium subsp. paratuberculosis
cacugcgccgucaucgacaccg

SEQ ID NO: 813184 - RNA, 14 nt, Mycobacterium avium subsp. paratuberculosis
cacugcugcgcaga

SEQ ID NO: 813185 - RNA, 21 nt, Mycobacterium avium subsp. paratuberculosis
cacugcuucgggucgccgguc

SEQ ID NO: 813186 - RNA, 22 nt, Mycobacterium avium subsp. paratuberculosis
cacuggacauucacgaggccgg

SEQ ID NO: 813187 - RNA, 14 nt, Mycobacterium avium subsp. paratuberculosis
cacugccgccgccc

SEQ ID NO: 813188 - RNA, 19 nt, Mycobacterium avium subsp. paratuberculosis
cacugaaggcgcgggcagg

SEQ ID NO: 813189 - RNA, 18 nt, Mycobacterium avium subsp. paratuberculosis
cacugaaagccgaggcgc

SEQ ID NO: 813190 - RNA, 17 nt, Mycobacterium avium subsp. paratuberculosis
cacucgccucggaggcc

SEQ ID NO: 813191 - RNA, 15 nt, Mycobacterium avium subsp. paratuberculosis
cacucuggcgugacg

SEQ ID NO: 813192 - RNA, 16 nt, Mycobacterium avium subsp. paratuberculosis
cacucuggcgugacgc

SEQ ID NO: 813193 - RNA, 19 nt, Mycobacterium avium subsp. paratuberculosis
cacucuggcgugacgcucg

SEQ ID NO: 813194 - RNA, 23 nt, Mycobacterium avium subsp. paratuberculosis
cacucuggcgugacgcucggcgc

SEQ ID NO: 813195 - RNA, 16 nt, Mycobacterium avium subsp. paratuberculosis
cacuccuugcugucgg

SEQ ID NO: 813196 - RNA, 15 nt, Mycobacterium avium subsp. paratuberculosis
cacucgaacggcccg

SEQ ID NO: 813197 - RNA, 20 nt, Mycobacterium avium subsp. paratuberculosis
cacucgaccuucgagccgcc

SEQ ID NO: 813198 - RNA, 21 nt, Mycobacterium avium subsp. paratuberculosis
cacucgaccuucgagccgccg

SEQ ID NO: 813199 - RNA, 21 nt, Mycobacterium avium subsp. paratuberculosis
cacucgagcguccggagaacc

SEQ ID NO: 813200 - RNA, 14 nt, Mycobacterium avium subsp. paratuberculosis
cacucgaucagcac

SEQ ID NO: 813201 - RNA, 16 nt, Mycobacterium avium subsp. paratuberculosis
cacucgaucagcaccg

SEQ ID NO: 813202 - RNA, 17 nt, Mycobacterium avium subsp. paratuberculosis
cacucgaucagcaccgc

SEQ ID NO: 813203 - RNA, 19 nt, Mycobacterium avium subsp. paratuberculosis
cacucgaucagcaccgcca

SEQ ID NO: 813204 - RNA, 21 nt, Mycobacterium avium subsp. paratuberculosis
cacgugcacccacgccagccg

SEQ ID NO: 813205 - RNA, 13 nt, Mycobacterium avium subsp. paratuberculosis
cacgugcaccgcg

SEQ ID NO: 813206 - RNA, 17 nt, Mycobacterium avium subsp. paratuberculosis
cacgugcaccgcggcca

SEQ ID NO: 813207 - RNA, 13 nt, Mycobacterium avium subsp. paratuberculosis
cacgucggcguag

SEQ ID NO: 813208 - RNA, 12 nt, Mycobacterium avium subsp. paratuberculosis
cacgugcacggc

SEQ ID NO: 813209 - RNA, 13 nt, Mycobacterium avium subsp. paratuberculosis
cacgugcacggcg

SEQ ID NO: 813210 - RNA, 16 nt, Mycobacterium avium subsp. paratuberculosis
cacgucuugcugggug

SEQ ID NO: 813211 - RNA, 13 nt, Mycobacterium avium subsp. paratuberculosis
cacgucugcucgg

SEQ ID NO: 813212 - RNA, 17 nt, Mycobacterium avium subsp. paratuberculosis
cacgucugcucggcggg

SEQ ID NO: 813213 - RNA, 16 nt, Mycobacterium avium subsp. paratuberculosis
cacgucguccggcgcg

SEQ ID NO: 813214 - RNA, 20 nt, Mycobacterium avium subsp. paratuberculosis
cacgucguccggcgcgcagc

SEQ ID NO: 813215 - RNA, 21 nt, Mycobacterium avium subsp. paratuberculosis
cacgucguccggcgcgcagca

SEQ ID NO: 813216 - RNA, 15 nt, Mycobacterium avium subsp. paratuberculosis
cacgucggugacgcc

SEQ ID NO: 813217 - RNA, 16 nt, Mycobacterium avium subsp. paratuberculosis
cacgucggugacgccc

SEQ ID NO: 813218 - RNA, 14 nt, Mycobacterium avium subsp. paratuberculosis
cacgucguaggcca

SEQ ID NO: 813219 - RNA, 16 nt, Mycobacterium avium subsp. paratuberculosis
cacgucguaggccauc

SEQ ID NO: 813220 - RNA, 14 nt, Mycobacterium avium subsp. paratuberculosis
cacgucgucggaca

SEQ ID NO: 813221 - RNA, 20 nt, Mycobacterium avium subsp. paratuberculosis
cacgucgucggacagcagca

SEQ ID NO: 813222 - RNA, 23 nt, Mycobacterium avium subsp. paratuberculosis
cacgucgucggacagcagcaccg

SEQ ID NO: 813223 - RNA, 20 nt, Mycobacterium avium subsp. paratuberculosis
cacgucguucaugaucggca

SEQ ID NO: 813224 - RNA, 14 nt, Mycobacterium avium subsp. paratuberculosis
cacgucguugagca

SEQ ID NO: 813225 - RNA, 18 nt, Mycobacterium avium subsp. paratuberculosis
cacgucgucgugcgcggg

SEQ ID NO: 813226 - RNA, 22 nt, Mycobacterium avium subsp. paratuberculosis
cacggugucgcuguaggccagc

SEQ ID NO: 813227 - RNA, 13 nt, Mycobacterium avium subsp. paratuberculosis
cacggugucggcg

SEQ ID NO: 813228 - RNA, 13 nt, Mycobacterium avium subsp. paratuberculosis
cacguccagcugg

SEQ ID NO: 813229 - RNA, 16 nt, Mycobacterium avium subsp. paratuberculosis
cacguccagcugggcu

SEQ ID NO: 813230 - RNA, 12 nt, Mycobacterium avium subsp. paratuberculosis
cacguccccggg

SEQ ID NO: 813231 - RNA, 22 nt, Mycobacterium avium subsp. paratuberculosis
cacguccccgggcgugccggac

SEQ ID NO: 813232 - RNA, 20 nt, Mycobacterium avium subsp. paratuberculosis
cacguccccgugcagccggg

SEQ ID NO: 813233 - RNA, 19 nt, Mycobacterium avium subsp. paratuberculosis
cacgucccgcccggcgccg

SEQ ID NO: 813234 - RNA, 24 nt, Mycobacterium avium subsp. paratuberculosis
cacgucccgcccggcgccggccga

SEQ ID NO: 813235 - RNA, 14 nt, Mycobacterium avium subsp. paratuberculosis
cacggugggcgccg

SEQ ID NO: 813236 - RNA, 15 nt, Mycobacterium avium subsp. paratuberculosis
cacggugggcgccgg

SEQ ID NO: 813237 - RNA, 20 nt, Mycobacterium avium subsp. paratuberculosis
cacgguguagacgcgggccg

SEQ ID NO: 813238 - RNA, 18 nt, Mycobacterium avium subsp. paratuberculosis
cacgguguagcugcgggu

SEQ ID NO: 813239 - RNA, 17 nt, Mycobacterium avium subsp. paratuberculosis
cacgguggccgccacca

SEQ ID NO: 813240 - RNA, 15 nt, Mycobacterium avium subsp. paratuberculosis
cacgguggccgcgaa

SEQ ID NO: 813241 - RNA, 13 nt, Mycobacterium avium subsp. paratuberculosis
cacgguggcgccg

SEQ ID NO: 813242 - RNA, 14 nt, Mycobacterium avium subsp. paratuberculosis
cacgguggcgccga

SEQ ID NO: 813243 - RNA, 21 nt, Mycobacterium avium subsp. paratuberculosis
cacgguggcgccgcgcagcca

SEQ ID NO: 813244 - RNA, 19 nt, Mycobacterium avium subsp. paratuberculosis
cacgguggcgccggcaucg

SEQ ID NO: 813245 - RNA, 12 nt, Mycobacterium avium subsp. paratuberculosis
cacgguggcggu

SEQ ID NO: 813246 - RNA, 16 nt, Mycobacterium avium subsp. paratuberculosis
cacgucgccggcgacc

SEQ ID NO: 813247 - RNA, 22 nt, Mycobacterium avium subsp. paratuberculosis
cacgucgccggcgaccgccacc

SEQ ID NO: 813248 - RNA, 14 nt, Mycobacterium avium subsp. paratuberculosis
cacgucgcgccgau

SEQ ID NO: 813249 - RNA, 21 nt, Mycobacterium avium subsp. paratuberculosis
cacgucgcgggugaccggcgc

SEQ ID NO: 813250 - RNA, 22 nt, Mycobacterium avium subsp. paratuberculosis
cacgucgcgggugaccggcgcc

SEQ ID NO: 813251 - RNA, 23 nt, Mycobacterium avium subsp. paratuberculosis
cacgucgcgggugaccggcgccg

SEQ ID NO: 813252 - RNA, 15 nt, Mycobacterium avium subsp. paratuberculosis
cacgucggccagcgc

SEQ ID NO: 813253 - RNA, 16 nt, Mycobacterium avium subsp. paratuberculosis
cacgucggccagcgcg

SEQ ID NO: 813254 - RNA, 17 nt, Mycobacterium avium subsp. paratuberculosis
cacgucggccagcgcgu

SEQ ID NO: 813255 - RNA, 19 nt, Mycobacterium avium subsp. paratuberculosis
cacgucggguucgccggug

SEQ ID NO: 813256 - RNA, 22 nt, Mycobacterium avium subsp. paratuberculosis
cacgucggguucgccggugacc

SEQ ID NO: 813257 - RNA, 17 nt, Mycobacterium avium subsp. paratuberculosis
cacgucggcggccgcga

SEQ ID NO: 813258 - RNA, 22 nt, Mycobacterium avium subsp. paratuberculosis
cacgucggcggccgcgaaggcg

SEQ ID NO: 813259 - RNA, 14 nt, Mycobacterium avium subsp. paratuberculosis
cacgucggccgcca

SEQ ID NO: 813260 - RNA, 15 nt, Mycobacterium avium subsp. paratuberculosis
cacgucggccugcac

SEQ ID NO: 813261 - RNA, 17 nt, Mycobacterium avium subsp. paratuberculosis
cacgucggccugcacga

SEQ ID NO: 813262 - RNA, 12 nt, Mycobacterium avium subsp. paratuberculosis
cacgucggcgag

SEQ ID NO: 813263 - RNA, 13 nt, Mycobacterium avium subsp. paratuberculosis
cacgucggcgaug

SEQ ID NO: 813264 - RNA, 14 nt, Mycobacterium avium subsp. paratuberculosis
cacgucggcgaugg

SEQ ID NO: 813265 - RNA, 20 nt, Mycobacterium avium subsp. paratuberculosis
cacgucggcgauggcggcgu

SEQ ID NO: 813266 - RNA, 13 nt, Mycobacterium avium subsp. paratuberculosis
cacgucggcgcgc

SEQ ID NO: 813267 - RNA, 19 nt, Mycobacterium avium subsp. paratuberculosis
cacguccuggacgucgucg

SEQ ID NO: 813268 - RNA, 15 nt, Mycobacterium avium subsp. paratuberculosis
cacguccuggcgcca

SEQ ID NO: 813269 - RNA, 13 nt, Mycobacterium avium subsp. paratuberculosis
cacguccagcccg

SEQ ID NO: 813270 - RNA, 23 nt, Mycobacterium avium subsp. paratuberculosis
cacguccagcccgcgccagcucg

SEQ ID NO: 813271 - RNA, 21 nt, Mycobacterium avium subsp. paratuberculosis
cacguccuagacacgaauacc

SEQ ID NO: 813272 - RNA, 14 nt, Mycobacterium avium subsp. paratuberculosis
cacguccucgucgg

SEQ ID NO: 813273 - RNA, 18 nt, Mycobacterium avium subsp. paratuberculosis
cacguccucgucggucca

SEQ ID NO: 813274 - RNA, 14 nt, Mycobacterium avium subsp. paratuberculosis
cacguccgcgguga

SEQ ID NO: 813275 - RNA, 20 nt, Mycobacterium avium subsp. paratuberculosis
cacguccgcggugagcaccg

SEQ ID NO: 813276 - RNA, 22 nt, Mycobacterium avium subsp. paratuberculosis
cacguccgcggugagcaccgga

SEQ ID NO: 813277 - RNA, 18 nt, Mycobacterium avium subsp. paratuberculosis
cacguccggaugcggcgc

SEQ ID NO: 813278 - RNA, 21 nt, Mycobacterium avium subsp. paratuberculosis
cacguccggaugcggcgccca

SEQ ID NO: 813279 - RNA, 23 nt, Mycobacterium avium subsp. paratuberculosis
cacguccggaugcggcgcccaca

SEQ ID NO: 813280 - RNA, 21 nt, Mycobacterium avium subsp. paratuberculosis
cacguccgccuccgaccagcc

SEQ ID NO: 813281 - RNA, 23 nt, Mycobacterium avium subsp. paratuberculosis
cacguccgccuccgaccagccgg

SEQ ID NO: 813282 - RNA, 19 nt, Mycobacterium avium subsp. paratuberculosis
cacggguuggggccgcgga

SEQ ID NO: 813283 - RNA, 21 nt, Mycobacterium avium subsp. paratuberculosis
cacgggugugacauccccggu

SEQ ID NO: 813284 - RNA, 16 nt, Mycobacterium avium subsp. paratuberculosis
cacgggucgccgaucu

SEQ ID NO: 813285 - RNA, 19 nt, Mycobacterium avium subsp. paratuberculosis
cacgggucgccguggccga

SEQ ID NO: 813286 - RNA, 13 nt, Mycobacterium avium subsp. paratuberculosis
cacgggucgcugu

SEQ ID NO: 813287 - RNA, 14 nt, Mycobacterium avium subsp. paratuberculosis
cacgggucgcugug

SEQ ID NO: 813288 - RNA, 18 nt, Mycobacterium avium subsp. paratuberculosis
cacgggucgcugugcagc

SEQ ID NO: 813289 - RNA, 14 nt, Mycobacterium avium subsp. paratuberculosis
cacggugccgccgu

SEQ ID NO: 813290 - RNA, 17 nt, Mycobacterium avium subsp. paratuberculosis
cacggugcccgucggca

SEQ ID NO: 813291 - RNA, 18 nt, Mycobacterium avium subsp. paratuberculosis
cacggugcccgucggcaa

SEQ ID NO: 813292 - RNA, 20 nt, Mycobacterium avium subsp. paratuberculosis
cacggugcccgucggcaacg

SEQ ID NO: 813293 - RNA, 14 nt, Mycobacterium avium subsp. paratuberculosis
cacggugcgcaccg

SEQ ID NO: 813294 - RNA, 15 nt, Mycobacterium avium subsp. paratuberculosis
cacggugcgcaccga

SEQ ID NO: 813295 - RNA, 13 nt, Mycobacterium avium subsp. paratuberculosis
cacggugcgccgg

SEQ ID NO: 813296 - RNA, 15 nt, Mycobacterium avium subsp. paratuberculosis
cacggugcgccggca

SEQ ID NO: 813297 - RNA, 18 nt, Mycobacterium avium subsp. paratuberculosis
cacggugcgccggcagcg

SEQ ID NO: 813298 - RNA, 22 nt, Mycobacterium avium subsp. paratuberculosis
cacggugcgggugccgaacacg

SEQ ID NO: 813299 - RNA, 15 nt, Mycobacterium avium subsp. paratuberculosis
cacggugaacgggcc

SEQ ID NO: 813300 - RNA, 16 nt, Mycobacterium avium subsp. paratuberculosis
cacggugaacgggccg

SEQ ID NO: 813301 - RNA, 16 nt, Mycobacterium avium subsp. paratuberculosis
cacggugaucagcagc

SEQ ID NO: 813302 - RNA, 20 nt, Mycobacterium avium subsp. paratuberculosis
cacggugaucagcagcaggu

SEQ ID NO: 813303 - RNA, 19 nt, Mycobacterium avium subsp. paratuberculosis
cacggugaucucgccgagc

SEQ ID NO: 813304 - RNA, 20 nt, Mycobacterium avium subsp. paratuberculosis
cacggugaucucgccgagca

SEQ ID NO: 813305 - RNA, 17 nt, Mycobacterium avium subsp. paratuberculosis
cacggugcacacgccga

SEQ ID NO: 813306 - RNA, 18 nt, Mycobacterium avium subsp. paratuberculosis
cacggugcagcagcgccg

SEQ ID NO: 813307 - RNA, 18 nt, Mycobacterium avium subsp. paratuberculosis
cacggcuaccuaggcguc

SEQ ID NO: 813308 - RNA, 20 nt, Mycobacterium avium subsp. paratuberculosis
cacggcuaccuaggcgucgu

SEQ ID NO: 813309 - RNA, 14 nt, Mycobacterium avium subsp. paratuberculosis
cacggcugccgacc

SEQ ID NO: 813310 - RNA, 15 nt, Mycobacterium avium subsp. paratuberculosis
cacggcugccgaccu

SEQ ID NO: 813311 - RNA, 18 nt, Mycobacterium avium subsp. paratuberculosis
cacggcugccgaccucga

SEQ ID NO: 813312 - RNA, 22 nt, Mycobacterium avium subsp. paratuberculosis
cacggcugccgaccucgauggc

SEQ ID NO: 813313 - RNA, 17 nt, Mycobacterium avium subsp. paratuberculosis
cacgggcggucggacgc

SEQ ID NO: 813314 - RNA, 20 nt, Mycobacterium avium subsp. paratuberculosis
cacgggcguguaguccaggu

SEQ ID NO: 813315 - RNA, 22 nt, Mycobacterium avium subsp. paratuberculosis
cacgggcguguaguccaggucg

SEQ ID NO: 813316 - RNA, 15 nt, Mycobacterium avium subsp. paratuberculosis
cacggggcgccgcug

SEQ ID NO: 813317 - RNA, 18 nt, Mycobacterium avium subsp. paratuberculosis
cacgggcugaccgccagg

SEQ ID NO: 813318 - RNA, 13 nt, Mycobacterium avium subsp. paratuberculosis
cacggcgccacca

SEQ ID NO: 813319 - RNA, 21 nt, Mycobacterium avium subsp. paratuberculosis
cacggcgccaccagccacacc

SEQ ID NO: 813320 - RNA, 13 nt, Mycobacterium avium subsp. paratuberculosis
cacggcgauguag

SEQ ID NO: 813321 - RNA, 18 nt, Mycobacterium avium subsp. paratuberculosis
cacggcgauguaggacgc

SEQ ID NO: 813322 - RNA, 20 nt, Mycobacterium avium subsp. paratuberculosis
cacggcgauguaggacgccg

SEQ ID NO: 813323 - RNA, 14 nt, Mycobacterium avium subsp. paratuberculosis
cacggccgcggcca

SEQ ID NO: 813324 - RNA, 16 nt, Mycobacterium avium subsp. paratuberculosis
cacggccgcggcccgg

SEQ ID NO: 813325 - RNA, 13 nt, Mycobacterium avium subsp. paratuberculosis
cacggccggccgg

SEQ ID NO: 813326 - RNA, 14 nt, Mycobacterium avium subsp. paratuberculosis
cacggccggccggc

SEQ ID NO: 813327 - RNA, 19 nt, Mycobacterium avium subsp. paratuberculosis
cacggccggccggccgagc

SEQ ID NO: 813328 - RNA, 14 nt, Mycobacterium avium subsp. paratuberculosis
cacggccguccagg

SEQ ID NO: 813329 - RNA, 16 nt, Mycobacterium avium subsp. paratuberculosis
cacggccguccaggcg

SEQ ID NO: 813330 - RNA, 18 nt, Mycobacterium avium subsp. paratuberculosis
cacggccucgaucaucac

SEQ ID NO: 813331 - RNA, 13 nt, Mycobacterium avium subsp. paratuberculosis
cacggccucgccc

SEQ ID NO: 813332 - RNA, 21 nt, Mycobacterium avium subsp. paratuberculosis
cacggccucgcccagcgccgc

SEQ ID NO: 813333 - RNA, 12 nt, Mycobacterium avium subsp. paratuberculosis
cacggccggcaa

SEQ ID NO: 813334 - RNA, 17 nt, Mycobacterium avium subsp. paratuberculosis
cacggccggcagcaucg

SEQ ID NO: 813335 - RNA, 20 nt, Mycobacterium avium subsp. paratuberculosis
cacggccggcagcaucggga

SEQ ID NO: 813336 - RNA, 22 nt, Mycobacterium avium subsp. paratuberculosis
cacggccggcagcaucgggacg

SEQ ID NO: 813337 - RNA, 23 nt, Mycobacterium avium subsp. paratuberculosis
cacggcccgcgccccggcggcca

SEQ ID NO: 813338 - RNA, 15 nt, Mycobacterium avium subsp. paratuberculosis
cacggcccgcggcac

SEQ ID NO: 813339 - RNA, 19 nt, Mycobacterium avium subsp. paratuberculosis
cacggcccgcggcacgcug

SEQ ID NO: 813340 - RNA, 15 nt, Mycobacterium avium subsp. paratuberculosis
cacggcccgcucggg

SEQ ID NO: 813341 - RNA, 15 nt, Mycobacterium avium subsp. paratuberculosis
cacggccgaugcagu

SEQ ID NO: 813342 - RNA, 13 nt, Mycobacterium avium subsp. paratuberculosis
cacggccgcagcg

SEQ ID NO: 813343 - RNA, 12 nt, Mycobacterium avium subsp. paratuberculosis
cacggcgguguc

SEQ ID NO: 813344 - RNA, 16 nt, Mycobacterium avium subsp. paratuberculosis
cacggcggugucggcg

SEQ ID NO: 813345 - RNA, 18 nt, Mycobacterium avium subsp. paratuberculosis
cacggcggugucggcggc

SEQ ID NO: 813346 - RNA, 19 nt, Mycobacterium avium subsp. paratuberculosis
cacggcggugucggcggca

SEQ ID NO: 813347 - RNA, 19 nt, Mycobacterium avium subsp. paratuberculosis
cacggcggcgugcaccgcc

SEQ ID NO: 813348 - RNA, 14 nt, Mycobacterium avium subsp. paratuberculosis
cacggcggcgaacg

SEQ ID NO: 813349 - RNA, 19 nt, Mycobacterium avium subsp. paratuberculosis
cacggcggcgaacgccgcc

SEQ ID NO: 813350 - RNA, 21 nt, Mycobacterium avium subsp. paratuberculosis
cacggcggcgaacgccgccgu

SEQ ID NO: 813351 - RNA, 13 nt, Mycobacterium avium subsp. paratuberculosis
cacggcggcgcgc

SEQ ID NO: 813352 - RNA, 15 nt, Mycobacterium avium subsp. paratuberculosis
cacggcggcgcgcac

SEQ ID NO: 813353 - RNA, 16 nt, Mycobacterium avium subsp. paratuberculosis
cacggcggcgcgcacg

SEQ ID NO: 813354 - RNA, 15 nt, Mycobacterium avium subsp. paratuberculosis
cacggcggcgcgggc

SEQ ID NO: 813355 - RNA, 20 nt, Mycobacterium avium subsp. paratuberculosis
cacggcggcgcgggcggcgu

SEQ ID NO: 813356 - RNA, 13 nt, Mycobacterium avium subsp. paratuberculosis
cacggcgcugagc

SEQ ID NO: 813357 - RNA, 13 nt, Mycobacterium avium subsp. paratuberculosis
cacggcgcuggcg

SEQ ID NO: 813358 - RNA, 14 nt, Mycobacterium avium subsp. paratuberculosis
cacggcgcuggcga

SEQ ID NO: 813359 - RNA, 16 nt, Mycobacterium avium subsp. paratuberculosis
cacggcgcuggcgacc

SEQ ID NO: 813360 - RNA, 14 nt, Mycobacterium avium subsp. paratuberculosis
cacggcggcagcgc

SEQ ID NO: 813361 - RNA, 15 nt, Mycobacterium avium subsp. paratuberculosis
cacggcggcagcgcg

SEQ ID NO: 813362 - RNA, 18 nt, Mycobacterium avium subsp. paratuberculosis
cacggcggcagcgcggcg

SEQ ID NO: 813363 - RNA, 19 nt, Mycobacterium avium subsp. paratuberculosis
cacggcggcagcgcggcgu

SEQ ID NO: 813364 - RNA, 19 nt, Mycobacterium avium subsp. paratuberculosis
cacggcgccgugccgcgcg

SEQ ID NO: 813365 - RNA, 14 nt, Mycobacterium avium subsp. paratuberculosis
cacggcgccgugcg

SEQ ID NO: 813366 - RNA, 13 nt, Mycobacterium avium subsp. paratuberculosis
cacggcgcgagga

SEQ ID NO: 813367 - RNA, 16 nt, Mycobacterium avium subsp. paratuberculosis
cacggcgcgcaccgcg

SEQ ID NO: 813368 - RNA, 23 nt, Mycobacterium avium subsp. paratuberculosis
cacggccaucacggugccgaguu

SEQ ID NO: 813369 - RNA, 17 nt, Mycobacterium avium subsp. paratuberculosis
cacggccaugcagacca

SEQ ID NO: 813370 - RNA, 20 nt, Mycobacterium avium subsp. paratuberculosis
cacggccaugcagaccagcc

SEQ ID NO: 813371 - RNA, 19 nt, Mycobacterium avium subsp. paratuberculosis
cacggcccaucaccagcgg

SEQ ID NO: 813372 - RNA, 16 nt, Mycobacterium avium subsp. paratuberculosis
cacggccccagccgcc

SEQ ID NO: 813373 - RNA, 17 nt, Mycobacterium avium subsp. paratuberculosis
cacggccccagccgccg

SEQ ID NO: 813374 - RNA, 15 nt, Mycobacterium avium subsp. paratuberculosis
cacggagcgcccggc

SEQ ID NO: 813375 - RNA, 18 nt, Mycobacterium avium subsp. paratuberculosis
cacggauacccgcggccu

SEQ ID NO: 813376 - RNA, 16 nt, Mycobacterium avium subsp. paratuberculosis
cacgcgcgcccggcac

SEQ ID NO: 813377 - RNA, 17 nt, Mycobacterium avium subsp. paratuberculosis
cacgcgcgcccggcacc

SEQ ID NO: 813378 - RNA, 18 nt, Mycobacterium avium subsp. paratuberculosis
cacgcgcgcccggcaccg

SEQ ID NO: 813379 - RNA, 20 nt, Mycobacterium avium subsp. paratuberculosis
cacgcgcgcccggcaccgcg

SEQ ID NO: 813380 - RNA, 11 nt, Mycobacterium avium subsp. paratuberculosis
cacgcgccggc

SEQ ID NO: 813381 - RNA, 15 nt, Mycobacterium avium subsp. paratuberculosis
cacgcgccggcgcgg

SEQ ID NO: 813382 - RNA, 20 nt, Mycobacterium avium subsp. paratuberculosis
cacgcgaugaucagcucgcg

SEQ ID NO: 813383 - RNA, 21 nt, Mycobacterium avium subsp. paratuberculosis
cacgcgaugaucagcucgcgc

SEQ ID NO: 813384 - RNA, 24 nt, Mycobacterium avium subsp. paratuberculosis
cacgcgaugaucagcucgcgcauc

SEQ ID NO: 813385 - RNA, 12 nt, Mycobacterium avium subsp. paratuberculosis
cacgcgaccgcg

SEQ ID NO: 813386 - RNA, 19 nt, Mycobacterium avium subsp. paratuberculosis
cacgcgaccgcgucgacgg

SEQ ID NO: 813387 - RNA, 19 nt, Mycobacterium avium subsp. paratuberculosis
cacgcgagacgagccgccg

SEQ ID NO: 813388 - RNA, 21 nt, Mycobacterium avium subsp. paratuberculosis
cacgcgagacgagccgccgcg

SEQ ID NO: 813389 - RNA, 16 nt, Mycobacterium avium subsp. paratuberculosis
cgacguuggccagcac

SEQ ID NO: 813390 - RNA, 21 nt, Mycobacterium avium subsp. paratuberculosis
cgacguuggccagcaccgcgg

SEQ ID NO: 813391 - RNA, 14 nt, Mycobacterium avium subsp. paratuberculosis
cgacuagcgcggcg

SEQ ID NO: 813392 - RNA, 17 nt, Mycobacterium avium subsp. paratuberculosis
cgacuagcgcggcggcc

SEQ ID NO: 813393 - RNA, 21 nt, Mycobacterium avium subsp. paratuberculosis
cgacuagcgcggcggccucgg

SEQ ID NO: 813394 - RNA, 22 nt, Mycobacterium avium subsp. paratuberculosis
cgacucauucgacuccggcgac

SEQ ID NO: 813395 - RNA, 16 nt, Mycobacterium avium subsp. paratuberculosis
cgacuccaccaccugg

SEQ ID NO: 813396 - RNA, 16 nt, Mycobacterium avium subsp. paratuberculosis
cgacuccagcaccggc

SEQ ID NO: 813397 - RNA, 17 nt, Mycobacterium avium subsp. paratuberculosis
cgacuccagcaccggcg

SEQ ID NO: 813398 - RNA, 18 nt, Mycobacterium avium subsp. paratuberculosis
cgacuccagcaccggcgc

SEQ ID NO: 813399 - RNA, 19 nt, Mycobacterium avium subsp. paratuberculosis
cgacuccagcaccggcgcc

SEQ ID NO: 813400 - RNA, 14 nt, Mycobacterium avium subsp. paratuberculosis
cgacuccagcagcg

SEQ ID NO: 813401 - RNA, 15 nt, Mycobacterium avium subsp. paratuberculosis
cgacuccagcagcgc

SEQ ID NO: 813402 - RNA, 17 nt, Mycobacterium avium subsp. paratuberculosis
cgacuccagcagcgcca

SEQ ID NO: 813403 - RNA, 22 nt, Mycobacterium avium subsp. paratuberculosis
cgacuccagcagcgccagcacc

SEQ ID NO: 813404 - RNA, 14 nt, Mycobacterium avium subsp. paratuberculosis
cgacuccagcgcga

SEQ ID NO: 813405 - RNA, 16 nt, Mycobacterium avium subsp. paratuberculosis
cgacuccagcgcgauc

SEQ ID NO: 813406 - RNA, 20 nt, Mycobacterium avium subsp. paratuberculosis
cgacugcgugcugggcaccg

SEQ ID NO: 813407 - RNA, 23 nt, Mycobacterium avium subsp. paratuberculosis
cgacuggaccaccaugauguagc

SEQ ID NO: 813408 - RNA, 15 nt, Mycobacterium avium subsp. paratuberculosis
cgacuggcccucgga

SEQ ID NO: 813409 - RNA, 19 nt, Mycobacterium avium subsp. paratuberculosis
cgacuggcccucggaggug

SEQ ID NO: 813410 - RNA, 22 nt, Mycobacterium avium subsp. paratuberculosis
cgacuguuugaugccgucggug

SEQ ID NO: 813411 - RNA, 18 nt, Mycobacterium avium subsp. paratuberculosis
cgacugucggcgccccgc

SEQ ID NO: 813412 - RNA, 14 nt, Mycobacterium avium subsp. paratuberculosis
cgacugucggcucg

SEQ ID NO: 813413 - RNA, 15 nt, Mycobacterium avium subsp. paratuberculosis
cgacugucggcucgc

SEQ ID NO: 813414 - RNA, 18 nt, Mycobacterium avium subsp. paratuberculosis
cgacuggcggcggcgguc

SEQ ID NO: 813415 - RNA, 16 nt, Mycobacterium avium subsp. paratuberculosis
cgacugggcgcccacc

SEQ ID NO: 813416 - RNA, 15 nt, Mycobacterium avium subsp. paratuberculosis
cgacuggucgucgag

SEQ ID NO: 813417 - RNA, 16 nt, Mycobacterium avium subsp. paratuberculosis
cgacuguccaggccga

SEQ ID NO: 813418 - RNA, 17 nt, Mycobacterium avium subsp. paratuberculosis
cgacuguccaggccgag

SEQ ID NO: 813419 - RNA, 18 nt, Mycobacterium avium subsp. paratuberculosis
cgacuucccaguccggcc

SEQ ID NO: 813420 - RNA, 21 nt, Mycobacterium avium subsp. paratuberculosis
cgacuucccaguccggccagc

SEQ ID NO: 813421 - RNA, 23 nt, Mycobacterium avium subsp. paratuberculosis
cgacuucccaguccggccagcgu

SEQ ID NO: 813422 - RNA, 16 nt, Mycobacterium avium subsp. paratuberculosis
cgacuucguugguggu

SEQ ID NO: 813423 - RNA, 21 nt, Mycobacterium avium subsp. paratuberculosis
cgacuucguugguggucgacg

SEQ ID NO: 813424 - RNA, 23 nt, Mycobacterium avium subsp. paratuberculosis
cgacuucguugguggucgacgcg

SEQ ID NO: 813425 - RNA, 13 nt, Mycobacterium avium subsp. paratuberculosis
cgacuucggcucg

SEQ ID NO: 813426 - RNA, 17 nt, Mycobacterium avium subsp. paratuberculosis
cgacuucggcucggcga

SEQ ID NO: 813427 - RNA, 19 nt, Mycobacterium avium subsp. paratuberculosis
cgacuucggcucggcgaca

SEQ ID NO: 813428 - RNA, 14 nt, Mycobacterium avium subsp. paratuberculosis
cgacuucuucgccg

SEQ ID NO: 813429 - RNA, 17 nt, Mycobacterium avium subsp. paratuberculosis
cgacuugaucgcggcgu

SEQ ID NO: 813430 - RNA, 15 nt, Mycobacterium avium subsp. paratuberculosis
cgacuugcgcgccgu

SEQ ID NO: 813431 - RNA, 19 nt, Mycobacterium avium subsp. paratuberculosis
cgacuugcgcgccgugacg

SEQ ID NO: 813432 - RNA, 18 nt, Mycobacterium avium subsp. paratuberculosis
cgacuucacaggccgccu

SEQ ID NO: 813433 - RNA, 21 nt, Mycobacterium avium subsp. paratuberculosis
cgacuuggccagcagccgcga

SEQ ID NO: 813434 - RNA, 14 nt, Mycobacterium avium subsp. paratuberculosis
cgacuugguggcca

SEQ ID NO: 813435 - RNA, 18 nt, Mycobacterium avium subsp. paratuberculosis
cgacuugguggccagcac

SEQ ID NO: 813436 - RNA, 17 nt, Mycobacterium avium subsp. paratuberculosis
cgagaaggcggcgucga

SEQ ID NO: 813437 - RNA, 16 nt, Mycobacterium avium subsp. paratuberculosis
cgagaagggccgccgc

SEQ ID NO: 813438 - RNA, 16 nt, Mycobacterium avium subsp. paratuberculosis
cgagaagucgccgacg

SEQ ID NO: 813439 - RNA, 18 nt, Mycobacterium avium subsp. paratuberculosis
cgagaagucgccgacgcc

SEQ ID NO: 813440 - RNA, 22 nt, Mycobacterium avium subsp. paratuberculosis
cgagaagaccugguugccgccc

SEQ ID NO: 813441 - RNA, 17 nt, Mycobacterium avium subsp. paratuberculosis
cgagaaaagcggcgaaa

SEQ ID NO: 813442 - RNA, 16 nt, Mycobacterium avium subsp. paratuberculosis
cgagaaacgcgcgcag

SEQ ID NO: 813443 - RNA, 16 nt, Mycobacterium avium subsp. paratuberculosis
cgagaacagaugccgg

SEQ ID NO: 813444 - RNA, 19 nt, Mycobacterium avium subsp. paratuberculosis
cgagaacagaugccggugc

SEQ ID NO: 813445 - RNA, 19 nt, Mycobacterium avium subsp. paratuberculosis
cgagaacaggccgagcgcg

SEQ ID NO: 813446 - RNA, 22 nt, Mycobacterium avium subsp. paratuberculosis
cgagaacaggccgagcgcgcug

SEQ ID NO: 813447 - RNA, 14 nt, Mycobacterium avium subsp. paratuberculosis
cgagaaccggcgca

SEQ ID NO: 813448 - RNA, 15 nt, Mycobacterium avium subsp. paratuberculosis
cgacgcucggcgaug

SEQ ID NO: 813449 - RNA, 13 nt, Mycobacterium avium subsp. paratuberculosis
cgacgcugaacag

SEQ ID NO: 813450 - RNA, 20 nt, Mycobacterium avium subsp. paratuberculosis
cgacgcugaacagcagcagc

SEQ ID NO: 813451 - RNA, 20 nt, Mycobacterium avium subsp. paratuberculosis
cgacgcugaagaagaugggc

SEQ ID NO: 813452 - RNA, 14 nt, Mycobacterium avium subsp. paratuberculosis
cgacgcugaccagc

SEQ ID NO: 813453 - RNA, 16 nt, Mycobacterium avium subsp. paratuberculosis
cgacgcugaccagcug

SEQ ID NO: 813454 - RNA, 23 nt, Mycobacterium avium subsp. paratuberculosis
cgacgcugacgaugcggccggcg

SEQ ID NO: 813455 - RNA, 22 nt, Mycobacterium avium subsp. paratuberculosis
cgacgcugagcacccgcccgga

SEQ ID NO: 813456 - RNA, 13 nt, Mycobacterium avium subsp. paratuberculosis
cgacgcugagccg

SEQ ID NO: 813457 - RNA, 17 nt, Mycobacterium avium subsp. paratuberculosis
cgacgcugagccgcucg

SEQ ID NO: 813458 - RNA, 14 nt, Mycobacterium avium subsp. paratuberculosis
cgacgcugagcgcc

SEQ ID NO: 813459 - RNA, 15 nt, Mycobacterium avium subsp. paratuberculosis
cgacgcugagcgcca

SEQ ID NO: 813460 - RNA, 18 nt, Mycobacterium avium subsp. paratuberculosis
cgacggcucuucgcggcg

SEQ ID NO: 813461 - RNA, 19 nt, Mycobacterium avium subsp. paratuberculosis
cgacggcucuucgcggcgg

SEQ ID NO: 813462 - RNA, 23 nt, Mycobacterium avium subsp. paratuberculosis
cgacggcucuucgcggcggggca

SEQ ID NO: 813463 - RNA, 20 nt, Mycobacterium avium subsp. paratuberculosis
cgacgggcagggugaccgag

SEQ ID NO: 813464 - RNA, 18 nt, Mycobacterium avium subsp. paratuberculosis
cgacgggcaugccgucgg

SEQ ID NO: 813465 - RNA, 16 nt, Mycobacterium avium subsp. paratuberculosis
cgacgggcccagcgcg

SEQ ID NO: 813466 - RNA, 23 nt, Mycobacterium avium subsp. paratuberculosis
cgacgggcccagcgcgacgucga

SEQ ID NO: 813467 - RNA, 15 nt, Mycobacterium avium subsp. paratuberculosis
cgacgggcccgcgcc

SEQ ID NO: 813468 - RNA, 17 nt, Mycobacterium avium subsp. paratuberculosis
cgacgggcccgcgccuu

SEQ ID NO: 813469 - RNA, 20 nt, Mycobacterium avium subsp. paratuberculosis
cgacgggccgaucacgcgga

SEQ ID NO: 813470 - RNA, 13 nt, Mycobacterium avium subsp. paratuberculosis
cgacgggccgggc

SEQ ID NO: 813471 - RNA, 23 nt, Mycobacterium avium subsp. paratuberculosis
cgacgggccgggcacgucgacgc

SEQ ID NO: 813472 - RNA, 21 nt, Mycobacterium avium subsp. paratuberculosis
cgacggcuggaaucccgccuc

SEQ ID NO: 813473 - RNA, 17 nt, Mycobacterium avium subsp. paratuberculosis
cgacggcuggguggcga

SEQ ID NO: 813474 - RNA, 15 nt, Mycobacterium avium subsp. paratuberculosis
cgacggcugcccggc

SEQ ID NO: 813475 - RNA, 17 nt, Mycobacterium avium subsp. paratuberculosis
cgacgggaacucggcca

SEQ ID NO: 813476 - RNA, 23 nt, Mycobacterium avium subsp. paratuberculosis
cgacgggaagaucgcagcgguga

SEQ ID NO: 813477 - RNA, 14 nt, Mycobacterium avium subsp. paratuberculosis
cgacgggcguccga

SEQ ID NO: 813478 - RNA, 14 nt, Mycobacterium avium subsp. paratuberculosis
cgacgggcgugccg

SEQ ID NO: 813479 - RNA, 17 nt, Mycobacterium avium subsp. paratuberculosis
cgacgggcgugccggcg

SEQ ID NO: 813480 - RNA, 22 nt, Mycobacterium avium subsp. paratuberculosis
cgacgggcguguagccugcggc

SEQ ID NO: 813481 - RNA, 14 nt, Mycobacterium avium subsp. paratuberculosis
cgacgggcugcugc

SEQ ID NO: 813482 - RNA, 23 nt, Mycobacterium avium subsp. paratuberculosis
cgacgggcugucccggccgcgac

SEQ ID NO: 813483 - RNA, 23 nt, Mycobacterium avium subsp. paratuberculosis
cgacggggaacucggugaugccg

SEQ ID NO: 813484 - RNA, 15 nt, Mycobacterium avium subsp. paratuberculosis
cgacggggucggaca

SEQ ID NO: 813485 - RNA, 15 nt, Mycobacterium avium subsp. paratuberculosis
cgacgggugggugga

SEQ ID NO: 813486 - RNA, 13 nt, Mycobacterium avium subsp. paratuberculosis
cgacggguugcgg

SEQ ID NO: 813487 - RNA, 20 nt, Mycobacterium avium subsp. paratuberculosis
cgacgggauaguccggcaug

SEQ ID NO: 813488 - RNA, 15 nt, Mycobacterium avium subsp. paratuberculosis
cgacggucaccggca

SEQ ID NO: 813489 - RNA, 14 nt, Mycobacterium avium subsp. paratuberculosis
cgacggucagcacg

SEQ ID NO: 813490 - RNA, 15 nt, Mycobacterium avium subsp. paratuberculosis
cgacggucagcacgc

SEQ ID NO: 813491 - RNA, 18 nt, Mycobacterium avium subsp. paratuberculosis
cgacggucagcacgcuga

SEQ ID NO: 813492 - RNA, 22 nt, Mycobacterium avium subsp. paratuberculosis
cgacggucagcacgcugaucac

SEQ ID NO: 813493 - RNA, 12 nt, Mycobacterium avium subsp. paratuberculosis
cgacggucacgc

SEQ ID NO: 813494 - RNA, 16 nt, Mycobacterium avium subsp. paratuberculosis
cgacggucacggccgc

SEQ ID NO: 813495 - RNA, 19 nt, Mycobacterium avium subsp. paratuberculosis
cgacggucacggccgccag

SEQ ID NO: 813496 - RNA, 21 nt, Mycobacterium avium subsp. paratuberculosis
cgacggucacggccgccagca

SEQ ID NO: 813497 - RNA, 20 nt, Mycobacterium avium subsp. paratuberculosis
cgacggugucguagacgacg

SEQ ID NO: 813498 - RNA, 18 nt, Mycobacterium avium subsp. paratuberculosis
cgacgguugccucggcca

SEQ ID NO: 813499 - RNA, 19 nt, Mycobacterium avium subsp. paratuberculosis
cgacgguugccucggccag

SEQ ID NO: 813500 - RNA, 18 nt, Mycobacterium avium subsp. paratuberculosis
cgacgguuguucagcccg

SEQ ID NO: 813501 - RNA, 20 nt, Mycobacterium avium subsp. paratuberculosis
cgacgguuguucagcccggu

SEQ ID NO: 813502 - RNA, 17 nt, Mycobacterium avium subsp. paratuberculosis
cgacgguuugcccggcg

SEQ ID NO: 813503 - RNA, 18 nt, Mycobacterium avium subsp. paratuberculosis
cgacgguuugcccggcga

SEQ ID NO: 813504 - RNA, 21 nt, Mycobacterium avium subsp. paratuberculosis
cgacguaaccguacggcccga

SEQ ID NO: 813505 - RNA, 22 nt, Mycobacterium avium subsp. paratuberculosis
cgacguaaccguacggcccgaa

SEQ ID NO: 813506 - RNA, 17 nt, Mycobacterium avium subsp. paratuberculosis
cgacguacagcgagccg

SEQ ID NO: 813507 - RNA, 20 nt, Mycobacterium avium subsp. paratuberculosis
cgacguacagcgagccgucg

SEQ ID NO: 813508 - RNA, 22 nt, Mycobacterium avium subsp. paratuberculosis
cgacguacagcgagccgucgac

SEQ ID NO: 813509 - RNA, 17 nt, Mycobacterium avium subsp. paratuberculosis
cgacguacaucagcucg

SEQ ID NO: 813510 - RNA, 18 nt, Mycobacterium avium subsp. paratuberculosis
cgacguacaucagcucgu

SEQ ID NO: 813511 - RNA, 15 nt, Mycobacterium avium subsp. paratuberculosis
cgacgugccggcggc

SEQ ID NO: 813512 - RNA, 16 nt, Mycobacterium avium subsp. paratuberculosis
cgacgugccggcggca

SEQ ID NO: 813513 - RNA, 16 nt, Mycobacterium avium subsp. paratuberculosis
cgacgugccguugacg

SEQ ID NO: 813514 - RNA, 20 nt, Mycobacterium avium subsp. paratuberculosis
cgacgugccguugacgaaca

SEQ ID NO: 813515 - RNA, 13 nt, Mycobacterium avium subsp. paratuberculosis
cgacgugcgcggc

SEQ ID NO: 813516 - RNA, 21 nt, Mycobacterium avium subsp. paratuberculosis
cgacgugcucggcggccgcca

SEQ ID NO: 813517 - RNA, 16 nt, Mycobacterium avium subsp. paratuberculosis
cgacguugcgggccag

SEQ ID NO: 813518 - RNA, 20 nt, Mycobacterium avium subsp. paratuberculosis
cgacguugcgggccaggucg

SEQ ID NO: 813519 - RNA, 18 nt, Mycobacterium avium subsp. paratuberculosis
cgacguugccgcugguca

SEQ ID NO: 813520 - RNA, 14 nt, Mycobacterium avium subsp. paratuberculosis
cgacgugcccgauc

SEQ ID NO: 813521 - RNA, 21 nt, Mycobacterium avium subsp. paratuberculosis
cgacgugcccgaucucgucgg

SEQ ID NO: 813522 - RNA, 23 nt, Mycobacterium avium subsp. paratuberculosis
cgacgugcccgaucucgucggug

SEQ ID NO: 813523 - RNA, 21 nt, Mycobacterium avium subsp. paratuberculosis
cgacgugauggucgucguggu

SEQ ID NO: 813524 - RNA, 15 nt, Mycobacterium avium subsp. paratuberculosis
cgacgugaucggcgg

SEQ ID NO: 813525 - RNA, 19 nt, Mycobacterium avium subsp. paratuberculosis
cgacgugaucggcggccug

SEQ ID NO: 813526 - RNA, 23 nt, Mycobacterium avium subsp. paratuberculosis
cgacgugaucggcggccugcggc

SEQ ID NO: 813527 - RNA, 16 nt, Mycobacterium avium subsp. paratuberculosis
cgacgugaucuggucg

SEQ ID NO: 813528 - RNA, 19 nt, Mycobacterium avium subsp. paratuberculosis
cgacgugaucuggucggcc

SEQ ID NO: 813529 - RNA, 18 nt, Mycobacterium avium subsp. paratuberculosis
cgacgugcagcgccagca

SEQ ID NO: 813530 - RNA, 19 nt, Mycobacterium avium subsp. paratuberculosis
cgacgugcagcgccagcac

SEQ ID NO: 813531 - RNA, 23 nt, Mycobacterium avium subsp. paratuberculosis
cgacgugacgaccuggucgccgc

SEQ ID NO: 813532 - RNA, 16 nt, Mycobacterium avium subsp. paratuberculosis
cgacgucugcggcucg

SEQ ID NO: 813533 - RNA, 18 nt, Mycobacterium avium subsp. paratuberculosis
cgacgucugcggcucggc

SEQ ID NO: 813534 - RNA, 22 nt, Mycobacterium avium subsp. paratuberculosis
cgacgucugcggcucggcgcug

SEQ ID NO: 813535 - RNA, 19 nt, Mycobacterium avium subsp. paratuberculosis
cgacgucugguuggccggc

SEQ ID NO: 813536 - RNA, 20 nt, Mycobacterium avium subsp. paratuberculosis
cgacgucugguuggccggcg

SEQ ID NO: 813537 - RNA, 22 nt, Mycobacterium avium subsp. paratuberculosis
cgacgucugguuggccggcggg

SEQ ID NO: 813538 - RNA, 14 nt, Mycobacterium avium subsp. paratuberculosis
cgacgucgccacca

SEQ ID NO: 813539 - RNA, 19 nt, Mycobacterium avium subsp. paratuberculosis
cgacgucgccaccagaccg

SEQ ID NO: 813540 - RNA, 14 nt, Mycobacterium avium subsp. paratuberculosis
cgacgucgccggcc

SEQ ID NO: 813541 - RNA, 21 nt, Mycobacterium avium subsp. paratuberculosis
cgacgucgccggccugcccgc

SEQ ID NO: 813542 - RNA, 17 nt, Mycobacterium avium subsp. paratuberculosis
cgacgucgagggcgccg

SEQ ID NO: 813543 - RNA, 23 nt, Mycobacterium avium subsp. paratuberculosis
cgacgucgaugugcucggggcag

SEQ ID NO: 813544 - RNA, 23 nt, Mycobacterium avium subsp. paratuberculosis
cgacgucgaccagguaggcgccc

SEQ ID NO: 813545 - RNA, 14 nt, Mycobacterium avium subsp. paratuberculosis
cgacgucgaccgcg

SEQ ID NO: 813546 - RNA, 15 nt, Mycobacterium avium subsp. paratuberculosis
cgacgucgaccgcga

SEQ ID NO: 813547 - RNA, 16 nt, Mycobacterium avium subsp. paratuberculosis
cgacgucgaccgcgcc

SEQ ID NO: 813548 - RNA, 18 nt, Mycobacterium avium subsp. paratuberculosis
cgacgucgaccgcgccgg

SEQ ID NO: 813549 - RNA, 12 nt, Mycobacterium avium subsp. paratuberculosis
cgacgucgacga

SEQ ID NO: 813550 - RNA, 16 nt, Mycobacterium avium subsp. paratuberculosis
cgacgucgacggcagc

SEQ ID NO: 813551 - RNA, 17 nt, Mycobacterium avium subsp. paratuberculosis
cgacgucgacggcagcg

SEQ ID NO: 813552 - RNA, 18 nt, Mycobacterium avium subsp. paratuberculosis
cgacgucgacggcagcgc

SEQ ID NO: 813553 - RNA, 16 nt, Mycobacterium avium subsp. paratuberculosis
cgacguccucgaugcc

SEQ ID NO: 813554 - RNA, 14 nt, Mycobacterium avium subsp. paratuberculosis
cgacguccucgccc

SEQ ID NO: 813555 - RNA, 23 nt, Mycobacterium avium subsp. paratuberculosis
cgacguccucgcccgggugcugc

SEQ ID NO: 813556 - RNA, 12 nt, Mycobacterium avium subsp. paratuberculosis
cgacgucgacgu

SEQ ID NO: 813557 - RNA, 14 nt, Mycobacterium avium subsp. paratuberculosis
cgacgucgacgucg

SEQ ID NO: 813558 - RNA, 16 nt, Mycobacterium avium subsp. paratuberculosis
cgacgucgacgucgag

SEQ ID NO: 813559 - RNA, 13 nt, Mycobacterium avium subsp. paratuberculosis
cgacgucgacuga

SEQ ID NO: 813560 - RNA, 23 nt, Mycobacterium avium subsp. paratuberculosis
cgacgucgagaaaggccagcacg

SEQ ID NO: 813561 - RNA, 17 nt, Mycobacterium avium subsp. paratuberculosis
cgacguccuugaucagc

SEQ ID NO: 813562 - RNA, 12 nt, Mycobacterium avium subsp. paratuberculosis
cgacgucgaacg

SEQ ID NO: 813563 - RNA, 21 nt, Mycobacterium avium subsp. paratuberculosis
cgacgucgaagggucggucga

SEQ ID NO: 813564 - RNA, 17 nt, Mycobacterium avium subsp. paratuberculosis
cgacguccucgacgauc

SEQ ID NO: 813565 - RNA, 16 nt, Mycobacterium avium subsp. paratuberculosis
cgacguaggccagauc

SEQ ID NO: 813566 - RNA, 19 nt, Mycobacterium avium subsp. paratuberculosis
cgacguaggugagcaacgc

SEQ ID NO: 813567 - RNA, 14 nt, Mycobacterium avium subsp. paratuberculosis
cgacguaguccggc

SEQ ID NO: 813568 - RNA, 15 nt, Mycobacterium avium subsp. paratuberculosis
cgacguaguccggcc

SEQ ID NO: 813569 - RNA, 16 nt, Mycobacterium avium subsp. paratuberculosis
cgacguaguccggcca

SEQ ID NO: 813570 - RNA, 16 nt, Mycobacterium avium subsp. paratuberculosis
cgacguagucgcgcac

SEQ ID NO: 813571 - RNA, 18 nt, Mycobacterium avium subsp. paratuberculosis
cgacguagucgcgcacca

SEQ ID NO: 813572 - RNA, 17 nt, Mycobacterium avium subsp. paratuberculosis
cgacguagacgagccgg

SEQ ID NO: 813573 - RNA, 15 nt, Mycobacterium avium subsp. paratuberculosis
cgacguagcccgccg

SEQ ID NO: 813574 - RNA, 17 nt, Mycobacterium avium subsp. paratuberculosis
cgacguagcccgccgaa

SEQ ID NO: 813575 - RNA, 15 nt, Mycobacterium avium subsp. paratuberculosis
cgacguaggacagca

SEQ ID NO: 813576 - RNA, 15 nt, Mycobacterium avium subsp. paratuberculosis
cgagcccagccgucg

SEQ ID NO: 813577 - RNA, 20 nt, Mycobacterium avium subsp. paratuberculosis
cgagccgccggaucggcagc

SEQ ID NO: 813578 - RNA, 17 nt, Mycobacterium avium subsp. paratuberculosis
cgagccgccugcgcgcc

SEQ ID NO: 813579 - RNA, 18 nt, Mycobacterium avium subsp. paratuberculosis
cgagccgccugcgcgccg

SEQ ID NO: 813580 - RNA, 21 nt, Mycobacterium avium subsp. paratuberculosis
cgagccgccugcgcgccgucg

SEQ ID NO: 813581 - RNA, 24 nt, Mycobacterium avium subsp. paratuberculosis
cgagccgccugcgcgccgucggcg

SEQ ID NO: 813582 - RNA, 17 nt, Mycobacterium avium subsp. paratuberculosis
cgagccgcggauggccu

SEQ ID NO: 813583 - RNA, 22 nt, Mycobacterium avium subsp. paratuberculosis
cgagccgcggauggccucggcg

SEQ ID NO: 813584 - RNA, 13 nt, Mycobacterium avium subsp. paratuberculosis
cgagccgcggccc

SEQ ID NO: 813585 - RNA, 14 nt, Mycobacterium avium subsp. paratuberculosis
cgagccgcggcccg

SEQ ID NO: 813586 - RNA, 15 nt, Mycobacterium avium subsp. paratuberculosis
cgagccgcggcccgc

SEQ ID NO: 813587 - RNA, 17 nt, Mycobacterium avium subsp. paratuberculosis
cgagccgcgccacgcgc

SEQ ID NO: 813588 - RNA, 18 nt, Mycobacterium avium subsp. paratuberculosis
cgagccgcgccacgcgca

SEQ ID NO: 813589 - RNA, 19 nt, Mycobacterium avium subsp. paratuberculosis
cgagccgcgccacgcgcag

SEQ ID NO: 813590 - RNA, 13 nt, Mycobacterium avium subsp. paratuberculosis
cgagccgcgcgcc

SEQ ID NO: 813591 - RNA, 15 nt, Mycobacterium avium subsp. paratuberculosis
cgagccgcgcgccga

SEQ ID NO: 813592 - RNA, 16 nt, Mycobacterium avium subsp. paratuberculosis
cgagccgcgcgccgag

SEQ ID NO: 813593 - RNA, 13 nt, Mycobacterium avium subsp. paratuberculosis
cgagccggccgga

SEQ ID NO: 813594 - RNA, 15 nt, Mycobacterium avium subsp. paratuberculosis
cgagccggccgucag

SEQ ID NO: 813595 - RNA, 13 nt, Mycobacterium avium subsp. paratuberculosis
cgagccggcggcg

SEQ ID NO: 813596 - RNA, 13 nt, Mycobacterium avium subsp. paratuberculosis
cgagccggcgucg

SEQ ID NO: 813597 - RNA, 15 nt, Mycobacterium avium subsp. paratuberculosis
cgagccggcgucgcc

SEQ ID NO: 813598 - RNA, 17 nt, Mycobacterium avium subsp. paratuberculosis
cgagccggcgucgccgc

SEQ ID NO: 813599 - RNA, 17 nt, Mycobacterium avium subsp. paratuberculosis
cgagccggcccggggug

SEQ ID NO: 813600 - RNA, 20 nt, Mycobacterium avium subsp. paratuberculosis
cgagccggcccggggugugc

SEQ ID NO: 813601 - RNA, 15 nt, Mycobacterium avium subsp. paratuberculosis
cgagccggccgaagc

SEQ ID NO: 813602 - RNA, 16 nt, Mycobacterium avium subsp. paratuberculosis
cgagccggccgaagcg

SEQ ID NO: 813603 - RNA, 15 nt, Mycobacterium avium subsp. paratuberculosis
cgagccggcacgcgc

SEQ ID NO: 813604 - RNA, 16 nt, Mycobacterium avium subsp. paratuberculosis
cgagccggcacgcgcg

SEQ ID NO: 813605 - RNA, 18 nt, Mycobacterium avium subsp. paratuberculosis
cgagccggcacgcgcgcc

SEQ ID NO: 813606 - RNA, 17 nt, Mycobacterium avium subsp. paratuberculosis
cgagccggcacggccgg

SEQ ID NO: 813607 - RNA, 18 nt, Mycobacterium avium subsp. paratuberculosis
cgagccggcacggccggc

SEQ ID NO: 813608 - RNA, 19 nt, Mycobacterium avium subsp. paratuberculosis
cgagccggcacggccggcc

SEQ ID NO: 813609 - RNA, 18 nt, Mycobacterium avium subsp. paratuberculosis
cgagccgcuccaccgcgu

SEQ ID NO: 813610 - RNA, 20 nt, Mycobacterium avium subsp. paratuberculosis
cgagccgcuccaccgcgucc

SEQ ID NO: 813611 - RNA, 21 nt, Mycobacterium avium subsp. paratuberculosis
cgagccgcucccgcagcgggg

SEQ ID NO: 813612 - RNA, 22 nt, Mycobacterium avium subsp. paratuberculosis
cgagccgcucccgcagcggggc

SEQ ID NO: 813613 - RNA, 21 nt, Mycobacterium avium subsp. paratuberculosis
cgagccgcuugguggcgccgg

SEQ ID NO: 813614 - RNA, 14 nt, Mycobacterium avium subsp. paratuberculosis
cgagccggacaucu

SEQ ID NO: 813615 - RNA, 21 nt, Mycobacterium avium subsp. paratuberculosis
cgagccggagccuugcuggcg

SEQ ID NO: 813616 - RNA, 18 nt, Mycobacterium avium subsp. paratuberculosis
cgagccaccacugcgccg

SEQ ID NO: 813617 - RNA, 21 nt, Mycobacterium avium subsp. paratuberculosis
cgagccaccacugcgccguca

SEQ ID NO: 813618 - RNA, 23 nt, Mycobacterium avium subsp. paratuberculosis
cgagccaccacugcgccgucauc

SEQ ID NO: 813619 - RNA, 21 nt, Mycobacterium avium subsp. paratuberculosis
cgagccaccucgaucagcggc

SEQ ID NO: 813620 - RNA, 19 nt, Mycobacterium avium subsp. paratuberculosis
cgagcagugcaucgcugcc

SEQ ID NO: 813621 - RNA, 17 nt, Mycobacterium avium subsp. paratuberculosis
cgagcagggugacgcga

SEQ ID NO: 813622 - RNA, 17 nt, Mycobacterium avium subsp. paratuberculosis
cgagcaguagacgccgc

SEQ ID NO: 813623 - RNA, 18 nt, Mycobacterium avium subsp. paratuberculosis
cgagcaguagacgccgcc

SEQ ID NO: 813624 - RNA, 19 nt, Mycobacterium avium subsp. paratuberculosis
cgagcaguagacgccgccg

SEQ ID NO: 813625 - RNA, 22 nt, Mycobacterium avium subsp. paratuberculosis
cgagcaguugcgcguugcgcgg

SEQ ID NO: 813626 - RNA, 16 nt, Mycobacterium avium subsp. paratuberculosis
cgagccagcgggccga

SEQ ID NO: 813627 - RNA, 19 nt, Mycobacterium avium subsp. paratuberculosis
cgagccagcugcgcgucgg

SEQ ID NO: 813628 - RNA, 20 nt, Mycobacterium avium subsp. paratuberculosis
cgagccauaaaccggccggc

SEQ ID NO: 813629 - RNA, 22 nt, Mycobacterium avium subsp. paratuberculosis
cgagcccaccgcgcccagcccc

SEQ ID NO: 813630 - RNA, 15 nt, Mycobacterium avium subsp. paratuberculosis
cgagcgcgccgagau

SEQ ID NO: 813631 - RNA, 14 nt, Mycobacterium avium subsp. paratuberculosis
cgagcgcgccgagc

SEQ ID NO: 813632 - RNA, 20 nt, Mycobacterium avium subsp. paratuberculosis
cgagcgcgccgagcagcugg

SEQ ID NO: 813633 - RNA, 19 nt, Mycobacterium avium subsp. paratuberculosis
cgagcgcugguugucgacg

SEQ ID NO: 813634 - RNA, 23 nt, Mycobacterium avium subsp. paratuberculosis
cgagcgcugguugucgacgcugc

SEQ ID NO: 813635 - RNA, 16 nt, Mycobacterium avium subsp. paratuberculosis
cgagcgcuucgggagc

SEQ ID NO: 813636 - RNA, 17 nt, Mycobacterium avium subsp. paratuberculosis
cgagcggaugccguagc

SEQ ID NO: 813637 - RNA, 13 nt, Mycobacterium avium subsp. paratuberculosis
cgagcggcccgca

SEQ ID NO: 813638 - RNA, 15 nt, Mycobacterium avium subsp. paratuberculosis
cgagcggcccgcacc

SEQ ID NO: 813639 - RNA, 14 nt, Mycobacterium avium subsp. paratuberculosis
cgagcggcccgucg

SEQ ID NO: 813640 - RNA, 18 nt, Mycobacterium avium subsp. paratuberculosis
cgagcggcccgucgccga

SEQ ID NO: 813641 - RNA, 19 nt, Mycobacterium avium subsp. paratuberculosis
cgagcggcccgucgccgau

SEQ ID NO: 813642 - RNA, 20 nt, Mycobacterium avium subsp. paratuberculosis
cgagcggcccgucgccgauc

SEQ ID NO: 813643 - RNA, 13 nt, Mycobacterium avium subsp. paratuberculosis
cgagcggcccugc

SEQ ID NO: 813644 - RNA, 17 nt, Mycobacterium avium subsp. paratuberculosis
cgagcggcccugcgcgg

SEQ ID NO: 813645 - RNA, 18 nt, Mycobacterium avium subsp. paratuberculosis
cgagcggcccugcgcggc

SEQ ID NO: 813646 - RNA, 13 nt, Mycobacterium avium subsp. paratuberculosis
cgagcggcgcugc

SEQ ID NO: 813647 - RNA, 23 nt, Mycobacterium avium subsp. paratuberculosis
cgagcggcgcugcagcagcccga

SEQ ID NO: 813648 - RNA, 21 nt, Mycobacterium avium subsp. paratuberculosis
cgagcggcuugccgccgcagc

SEQ ID NO: 813649 - RNA, 15 nt, Mycobacterium avium subsp. paratuberculosis
cgagcggcaccuugg

SEQ ID NO: 813650 - RNA, 15 nt, Mycobacterium avium subsp. paratuberculosis
cgagcggcgccuggu

SEQ ID NO: 813651 - RNA, 12 nt, Mycobacterium avium subsp. paratuberculosis
cgagcggccguc

SEQ ID NO: 813652 - RNA, 17 nt, Mycobacterium avium subsp. paratuberculosis
cgagcggccguccacca

SEQ ID NO: 813653 - RNA, 18 nt, Mycobacterium avium subsp. paratuberculosis
cgagcggcgacuccagca

SEQ ID NO: 813654 - RNA, 21 nt, Mycobacterium avium subsp. paratuberculosis
cgagcggcgacuccagcagcg

SEQ ID NO: 813655 - RNA, 14 nt, Mycobacterium avium subsp. paratuberculosis
cgagcggcgcaggc

SEQ ID NO: 813656 - RNA, 15 nt, Mycobacterium avium subsp. paratuberculosis
cgagcggcgcaggcc

SEQ ID NO: 813657 - RNA, 19 nt, Mycobacterium avium subsp. paratuberculosis
cgagcggcgcaggccgguc

SEQ ID NO: 813658 - RNA, 13 nt, Mycobacterium avium subsp. paratuberculosis
cgagcggcgccac

SEQ ID NO: 813659 - RNA, 17 nt, Mycobacterium avium subsp. paratuberculosis
cgagcggcgccacgugg

SEQ ID NO: 813660 - RNA, 13 nt, Mycobacterium avium subsp. paratuberculosis
cgagcgccgcggc

SEQ ID NO: 813661 - RNA, 17 nt, Mycobacterium avium subsp. paratuberculosis
cgagcgccgcguucacc

SEQ ID NO: 813662 - RNA, 14 nt, Mycobacterium avium subsp. paratuberculosis
cgagcgccggacgc

SEQ ID NO: 813663 - RNA, 14 nt, Mycobacterium avium subsp. paratuberculosis
cgagccggugccga

SEQ ID NO: 813664 - RNA, 22 nt, Mycobacterium avium subsp. paratuberculosis
cgagccggugccgaggcaguuc

SEQ ID NO: 813665 - RNA, 16 nt, Mycobacterium avium subsp. paratuberculosis
cgagccgguccgacca

SEQ ID NO: 813666 - RNA, 18 nt, Mycobacterium avium subsp. paratuberculosis
cgagccgguccgaccagc

SEQ ID NO: 813667 - RNA, 22 nt, Mycobacterium avium subsp. paratuberculosis
cgagccgguccgaccagcggcc

SEQ ID NO: 813668 - RNA, 21 nt, Mycobacterium avium subsp. paratuberculosis
cgagccggucgggaucgaucc

SEQ ID NO: 813669 - RNA, 18 nt, Mycobacterium avium subsp. paratuberculosis
cgagccggucugggcgac

SEQ ID NO: 813670 - RNA, 20 nt, Mycobacterium avium subsp. paratuberculosis
cgagccggucugggcgacca

SEQ ID NO: 813671 - RNA, 20 nt, Mycobacterium avium subsp. paratuberculosis
cgagccgggucauccagccg

SEQ ID NO: 813672 - RNA, 23 nt, Mycobacterium avium subsp. paratuberculosis
cgagccggugaugacgucgccca

SEQ ID NO: 813673 - RNA, 12 nt, Mycobacterium avium subsp. paratuberculosis
cgagccggugcc

SEQ ID NO: 813674 - RNA, 19 nt, Mycobacterium avium subsp. paratuberculosis
cgagccgggcgcgggcgcc

SEQ ID NO: 813675 - RNA, 15 nt, Mycobacterium avium subsp. paratuberculosis
cgagccgggcggcca

SEQ ID NO: 813676 - RNA, 16 nt, Mycobacterium avium subsp. paratuberculosis
cgagccgggcggccag

SEQ ID NO: 813677 - RNA, 19 nt, Mycobacterium avium subsp. paratuberculosis
cgagccgggcggccagcgu

SEQ ID NO: 813678 - RNA, 22 nt, Mycobacterium avium subsp. paratuberculosis
cgagccgggcggccagcguggc

SEQ ID NO: 813679 - RNA, 12 nt, Mycobacterium avium subsp. paratuberculosis
cgagccggggcu

SEQ ID NO: 813680 - RNA, 15 nt, Mycobacterium avium subsp. paratuberculosis
cgagccgggcagcgc

SEQ ID NO: 813681 - RNA, 17 nt, Mycobacterium avium subsp. paratuberculosis
cgagccgggcagcgcga

SEQ ID NO: 813682 - RNA, 13 nt, Mycobacterium avium subsp. paratuberculosis
cgagccgggccag

SEQ ID NO: 813683 - RNA, 16 nt, Mycobacterium avium subsp. paratuberculosis
cgagccgggcccgggu

SEQ ID NO: 813684 - RNA, 17 nt, Mycobacterium avium subsp. paratuberculosis
cgagccgggcccgggug

SEQ ID NO: 813685 - RNA, 15 nt, Mycobacterium avium subsp. paratuberculosis
cgagccgggccgggu

SEQ ID NO: 813686 - RNA, 23 nt, Mycobacterium avium subsp. paratuberculosis
cgagccgggccggguccacgccg

SEQ ID NO: 813687 - RNA, 13 nt, Mycobacterium avium subsp. paratuberculosis
cgagcagcccggc

SEQ ID NO: 813688 - RNA, 15 nt, Mycobacterium avium subsp. paratuberculosis
cgagcagcccggcga

SEQ ID NO: 813689 - RNA, 20 nt, Mycobacterium avium subsp. paratuberculosis
cgagcagcccggcgaacacc

SEQ ID NO: 813690 - RNA, 13 nt, Mycobacterium avium subsp. paratuberculosis
cgagcagccgauc

SEQ ID NO: 813691 - RNA, 21 nt, Mycobacterium avium subsp. paratuberculosis
cgagcagccgaucuggcgggc

SEQ ID NO: 813692 - RNA, 22 nt, Mycobacterium avium subsp. paratuberculosis
cgagcagccgaucuggcgggcg

SEQ ID NO: 813693 - RNA, 21 nt, Mycobacterium avium subsp. paratuberculosis
cgagcagaucgggucgcccgg

SEQ ID NO: 813694 - RNA, 15 nt, Mycobacterium avium subsp. paratuberculosis
cgagcagcaccgcga

SEQ ID NO: 813695 - RNA, 17 nt, Mycobacterium avium subsp. paratuberculosis
cgagcagcaccgcgacc

SEQ ID NO: 813696 - RNA, 20 nt, Mycobacterium avium subsp. paratuberculosis
cgagcagcaccgcgacccag

SEQ ID NO: 813697 - RNA, 13 nt, Mycobacterium avium subsp. paratuberculosis
cgagcagcagccg

SEQ ID NO: 813698 - RNA, 18 nt, Mycobacterium avium subsp. paratuberculosis
cgagcagcagccgcagcg

SEQ ID NO: 813699 - RNA, 20 nt, Mycobacterium avium subsp. paratuberculosis
cgagcagcagccgcagcggc

SEQ ID NO: 813700 - RNA, 16 nt, Mycobacterium avium subsp. paratuberculosis
cgagcagcagccgccg

SEQ ID NO: 813701 - RNA, 19 nt, Mycobacterium avium subsp. paratuberculosis
cgagcagcagcgcggugcc

SEQ ID NO: 813702 - RNA, 16 nt, Mycobacterium avium subsp. paratuberculosis
cgagcagccgcgccgg

SEQ ID NO: 813703 - RNA, 21 nt, Mycobacterium avium subsp. paratuberculosis
cgagcagccgcgccgggcgga

SEQ ID NO: 813704 - RNA, 15 nt, Mycobacterium avium subsp. paratuberculosis
cgagcagccgggugc

SEQ ID NO: 813705 - RNA, 19 nt, Mycobacterium avium subsp. paratuberculosis
cgagcagcgcgaugccggc

SEQ ID NO: 813706 - RNA, 12 nt, Mycobacterium avium subsp. paratuberculosis
cgagcagcgcgc

SEQ ID NO: 813707 - RNA, 17 nt, Mycobacterium avium subsp. paratuberculosis
cgagcagcgcccgggug

SEQ ID NO: 813708 - RNA, 18 nt, Mycobacterium avium subsp. paratuberculosis
cgagcagcgcccgggugc

SEQ ID NO: 813709 - RNA, 14 nt, Mycobacterium avium subsp. paratuberculosis
cgagcagggcgggc

SEQ ID NO: 813710 - RNA, 19 nt, Mycobacterium avium subsp. paratuberculosis
cgagcagggcgggcaggcc

SEQ ID NO: 813711 - RNA, 17 nt, Mycobacterium avium subsp. paratuberculosis
cgagcaccgugccgucg

SEQ ID NO: 813712 - RNA, 20 nt, Mycobacterium avium subsp. paratuberculosis
cgagcaccgugccgucggcg

SEQ ID NO: 813713 - RNA, 22 nt, Mycobacterium avium subsp. paratuberculosis
cgagcaccgggccgaaggcggc

SEQ ID NO: 813714 - RNA, 13 nt, Mycobacterium avium subsp. paratuberculosis
cgagcaccgggcg

SEQ ID NO: 813715 - RNA, 15 nt, Mycobacterium avium subsp. paratuberculosis
cgagcaccucgucgc

SEQ ID NO: 813716 - RNA, 18 nt, Mycobacterium avium subsp. paratuberculosis
cgagcaccgcguccgcgu

SEQ ID NO: 813717 - RNA, 20 nt, Mycobacterium avium subsp. paratuberculosis
cgagcaccgcguccgcgucg

SEQ ID NO: 813718 - RNA, 18 nt, Mycobacterium avium subsp. paratuberculosis
cgagcaccggcagcaccg

SEQ ID NO: 813719 - RNA, 20 nt, Mycobacterium avium subsp. paratuberculosis
cgagcaccggcagccgcagc

SEQ ID NO: 813720 - RNA, 21 nt, Mycobacterium avium subsp. paratuberculosis
cgagcaccggcagccgcagcg

SEQ ID NO: 813721 - RNA, 22 nt, Mycobacterium avium subsp. paratuberculosis
cgagcaccggcagccgcagcga

SEQ ID NO: 813722 - RNA, 13 nt, Mycobacterium avium subsp. paratuberculosis
cgagcaccggcgg

SEQ ID NO: 813723 - RNA, 14 nt, Mycobacterium avium subsp. paratuberculosis
cgagcaccggcggc

SEQ ID NO: 813724 - RNA, 15 nt, Mycobacterium avium subsp. paratuberculosis
cgagcaccggcggca

SEQ ID NO: 813725 - RNA, 19 nt, Mycobacterium avium subsp. paratuberculosis
cgagcaccggcggcagcga

SEQ ID NO: 813726 - RNA, 12 nt, Mycobacterium avium subsp. paratuberculosis
cgagcaccggcu

SEQ ID NO: 813727 - RNA, 14 nt, Mycobacterium avium subsp. paratuberculosis
cgagcaccgcgacc

SEQ ID NO: 813728 - RNA, 20 nt, Mycobacterium avium subsp. paratuberculosis
cgagcaccgcgaccacgccg

SEQ ID NO: 813729 - RNA, 19 nt, Mycobacterium avium subsp. paratuberculosis
cgagcaccgcgaucaccga

SEQ ID NO: 813730 - RNA, 20 nt, Mycobacterium avium subsp. paratuberculosis
cgagcaccgcgaucaccgag

SEQ ID NO: 813731 - RNA, 18 nt, Mycobacterium avium subsp. paratuberculosis
cgagcaccgcgaucgccg

SEQ ID NO: 813732 - RNA, 19 nt, Mycobacterium avium subsp. paratuberculosis
cgagcaccgcgaucgccga

SEQ ID NO: 813733 - RNA, 20 nt, Mycobacterium avium subsp. paratuberculosis
cgagcaccgcgaucgccgac

SEQ ID NO: 813734 - RNA, 20 nt, Mycobacterium avium subsp. paratuberculosis
cgagcacccagaaacaccau

SEQ ID NO: 813735 - RNA, 22 nt, Mycobacterium avium subsp. paratuberculosis
cgagcaauuaaccggcaggccg

SEQ ID NO: 813736 - RNA, 13 nt, Mycobacterium avium subsp. paratuberculosis
cgagcacccggcg

SEQ ID NO: 813737 - RNA, 14 nt, Mycobacterium avium subsp. paratuberculosis
cgagcacccggcgg

SEQ ID NO: 813738 - RNA, 18 nt, Mycobacterium avium subsp. paratuberculosis
cgagcacccggcggggac

SEQ ID NO: 813739 - RNA, 19 nt, Mycobacterium avium subsp. paratuberculosis
cgagcacccggcggggacc

SEQ ID NO: 813740 - RNA, 12 nt, Mycobacterium avium subsp. paratuberculosis
cgagcaccagcg

SEQ ID NO: 813741 - RNA, 13 nt, Mycobacterium avium subsp. paratuberculosis
cgagcaccagcgu

SEQ ID NO: 813742 - RNA, 14 nt, Mycobacterium avium subsp. paratuberculosis
cgagcaccaggcgc

SEQ ID NO: 813743 - RNA, 14 nt, Mycobacterium avium subsp. paratuberculosis
cgagcaccccggcg

SEQ ID NO: 813744 - RNA, 15 nt, Mycobacterium avium subsp. paratuberculosis
cgagcaccccggcgg

SEQ ID NO: 813745 - RNA, 16 nt, Mycobacterium avium subsp. paratuberculosis
cgagcaccccggcggc

SEQ ID NO: 813746 - RNA, 17 nt, Mycobacterium avium subsp. paratuberculosis
cgagcaccccggcggcc

SEQ ID NO: 813747 - RNA, 19 nt, Mycobacterium avium subsp. paratuberculosis
cgagcaccccggcggccgc

SEQ ID NO: 813748 - RNA, 23 nt, Mycobacterium avium subsp. paratuberculosis
cgagcaccccggcggccgcgucg

SEQ ID NO: 813749 - RNA, 22 nt, Mycobacterium avium subsp. paratuberculosis
cgagcaccccgucgagcagccg

SEQ ID NO: 813750 - RNA, 21 nt, Mycobacterium avium subsp. paratuberculosis
cgagaguuugcccucgucgac

SEQ ID NO: 813751 - RNA, 22 nt, Mycobacterium avium subsp. paratuberculosis
cgagaguuugcccucgucgacc

SEQ ID NO: 813752 - RNA, 23 nt, Mycobacterium avium subsp. paratuberculosis
cgagaguuugcccucgucgacca

SEQ ID NO: 813753 - RNA, 21 nt, Mycobacterium avium subsp. paratuberculosis
cgagagugcaacuagcgacgg

SEQ ID NO: 813754 - RNA, 16 nt, Mycobacterium avium subsp. paratuberculosis
cgagaucaacaccgcg

SEQ ID NO: 813755 - RNA, 13 nt, Mycobacterium avium subsp. paratuberculosis
cgagaucaccggc

SEQ ID NO: 813756 - RNA, 15 nt, Mycobacterium avium subsp. paratuberculosis
cgagaucaccggcuu

SEQ ID NO: 813757 - RNA, 23 nt, Mycobacterium avium subsp. paratuberculosis
cgagaucaccggcuuggcgguga

SEQ ID NO: 813758 - RNA, 16 nt, Mycobacterium avium subsp. paratuberculosis
cgagacgaugcggucc

SEQ ID NO: 813759 - RNA, 14 nt, Mycobacterium avium subsp. paratuberculosis
cgagaucagcacca

SEQ ID NO: 813760 - RNA, 21 nt, Mycobacterium avium subsp. paratuberculosis
cgagaucagcaccagguggcc

SEQ ID NO: 813761 - RNA, 17 nt, Mycobacterium avium subsp. paratuberculosis
cgagaucagcaccgggu

SEQ ID NO: 813762 - RNA, 17 nt, Mycobacterium avium subsp. paratuberculosis
cgagcacaccgucgccc

SEQ ID NO: 813763 - RNA, 18 nt, Mycobacterium avium subsp. paratuberculosis
cgagcacaccgucgcccg

SEQ ID NO: 813764 - RNA, 20 nt, Mycobacterium avium subsp. paratuberculosis
cgagcacaccgucgcccgcc

SEQ ID NO: 813765 - RNA, 20 nt, Mycobacterium avium subsp. paratuberculosis
cgagaucagggcgcgcaccg

SEQ ID NO: 813766 - RNA, 13 nt, Mycobacterium avium subsp. paratuberculosis
cgagcacagcggc

SEQ ID NO: 813767 - RNA, 14 nt, Mycobacterium avium subsp. paratuberculosis
cgagcacagcggcg

SEQ ID NO: 813768 - RNA, 18 nt, Mycobacterium avium subsp. paratuberculosis
cgagcacagcggcggaug

SEQ ID NO: 813769 - RNA, 19 nt, Mycobacterium avium subsp. paratuberculosis
cgagcacaggaacgcgacg

SEQ ID NO: 813770 - RNA, 22 nt, Mycobacterium avium subsp. paratuberculosis
cgagcacacccucaccccgccc

SEQ ID NO: 813771 - RNA, 15 nt, Mycobacterium avium subsp. paratuberculosis
cgagcaccaccaggc

SEQ ID NO: 813772 - RNA, 21 nt, Mycobacterium avium subsp. paratuberculosis
cgagcaccaccaggcccacca

SEQ ID NO: 813773 - RNA, 13 nt, Mycobacterium avium subsp. paratuberculosis
cgagcaccacccg

SEQ ID NO: 813774 - RNA, 20 nt, Mycobacterium avium subsp. paratuberculosis
cgagaagcccgugcgacggc

SEQ ID NO: 813775 - RNA, 14 nt, Mycobacterium avium subsp. paratuberculosis
cgagacacgcgccg

SEQ ID NO: 813776 - RNA, 15 nt, Mycobacterium avium subsp. paratuberculosis
cgagacacgcgccgg

SEQ ID NO: 813777 - RNA, 14 nt, Mycobacterium avium subsp. paratuberculosis
cgagacgaccagga

SEQ ID NO: 813778 - RNA, 16 nt, Mycobacterium avium subsp. paratuberculosis
cgagacgaccaggaug

SEQ ID NO: 813779 - RNA, 15 nt, Mycobacterium avium subsp. paratuberculosis
cgagaccgucggugc

SEQ ID NO: 813780 - RNA, 16 nt, Mycobacterium avium subsp. paratuberculosis
cgagaccucccggcgc

SEQ ID NO: 813781 - RNA, 17 nt, Mycobacterium avium subsp. paratuberculosis
cgagaccgcuugcggcu

SEQ ID NO: 813782 - RNA, 16 nt, Mycobacterium avium subsp. paratuberculosis
cgagacgagccgccgc

SEQ ID NO: 813783 - RNA, 17 nt, Mycobacterium avium subsp. paratuberculosis
cgagacgagccgccgcg

SEQ ID NO: 813784 - RNA, 11 nt, Mycobacterium avium subsp. paratuberculosis
cgagacggcgu

SEQ ID NO: 813785 - RNA, 15 nt, Mycobacterium avium subsp. paratuberculosis
cgagaguaucgccac

SEQ ID NO: 813786 - RNA, 20 nt, Mycobacterium avium subsp. paratuberculosis
cgagaguaucgccacgccga

SEQ ID NO: 813787 - RNA, 22 nt, Mycobacterium avium subsp. paratuberculosis
cgagaguaucgccacgccgacc

SEQ ID NO: 813788 - RNA, 16 nt, Mycobacterium avium subsp. paratuberculosis
cgagaguccgccgccg

SEQ ID NO: 813789 - RNA, 17 nt, Mycobacterium avium subsp. paratuberculosis
cgagaguccgccgccgg

SEQ ID NO: 813790 - RNA, 18 nt, Mycobacterium avium subsp. paratuberculosis
cgagaguccgccgccggg

SEQ ID NO: 813791 - RNA, 18 nt, Mycobacterium avium subsp. paratuberculosis
cgagagucgcuggcgcgc

SEQ ID NO: 813792 - RNA, 14 nt, Mycobacterium avium subsp. paratuberculosis
cgaccgccgcgaac

SEQ ID NO: 813793 - RNA, 12 nt, Mycobacterium avium subsp. paratuberculosis
cgaccgccgcgg

SEQ ID NO: 813794 - RNA, 13 nt, Mycobacterium avium subsp. paratuberculosis
cgaccgccgcggc

SEQ ID NO: 813795 - RNA, 14 nt, Mycobacterium avium subsp. paratuberculosis
cgaccgccgcggcc

SEQ ID NO: 813796 - RNA, 15 nt, Mycobacterium avium subsp. paratuberculosis
cgaccgccgcggccg

SEQ ID NO: 813797 - RNA, 18 nt, Mycobacterium avium subsp. paratuberculosis
cgaccgccgcggccgccu

SEQ ID NO: 813798 - RNA, 16 nt, Mycobacterium avium subsp. paratuberculosis
cgaccgcccgggccag

SEQ ID NO: 813799 - RNA, 21 nt, Mycobacterium avium subsp. paratuberculosis
cgaccgcccgggccaggcgcg

SEQ ID NO: 813800 - RNA, 15 nt, Mycobacterium avium subsp. paratuberculosis
cgaccgcccggggcg

SEQ ID NO: 813801 - RNA, 19 nt, Mycobacterium avium subsp. paratuberculosis
cgaccgcccggggcgcgga

SEQ ID NO: 813802 - RNA, 21 nt, Mycobacterium avium subsp. paratuberculosis
cgaccgcccggggcgcggacc

SEQ ID NO: 813803 - RNA, 20 nt, Mycobacterium avium subsp. paratuberculosis
cgaccgccgagcgggcgauc

SEQ ID NO: 813804 - RNA, 12 nt, Mycobacterium avium subsp. paratuberculosis
cgaccgccgcca

SEQ ID NO: 813805 - RNA, 14 nt, Mycobacterium avium subsp. paratuberculosis
cgaccgccgccgcg

SEQ ID NO: 813806 - RNA, 15 nt, Mycobacterium avium subsp. paratuberculosis
cgaccgccgccgcga

SEQ ID NO: 813807 - RNA, 17 nt, Mycobacterium avium subsp. paratuberculosis
cgaccgccgccgcgacc

SEQ ID NO: 813808 - RNA, 20 nt, Mycobacterium avium subsp. paratuberculosis
cgaccgccucgauggcccgc

SEQ ID NO: 813809 - RNA, 24 nt, Mycobacterium avium subsp. paratuberculosis
cgaccgccucgauggcccgcucgg

SEQ ID NO: 813810 - RNA, 19 nt, Mycobacterium avium subsp. paratuberculosis
cgaccgccgcuagaccgau

SEQ ID NO: 813811 - RNA, 23 nt, Mycobacterium avium subsp. paratuberculosis
cgaccgccgcuagaccgauggcg

SEQ ID NO: 813812 - RNA, 14 nt, Mycobacterium avium subsp. paratuberculosis
cgaccgccggacac

SEQ ID NO: 813813 - RNA, 18 nt, Mycobacterium avium subsp. paratuberculosis
cgaccgccggacaccacc

SEQ ID NO: 813814 - RNA, 19 nt, Mycobacterium avium subsp. paratuberculosis
cgaccgccggacaccaccg

SEQ ID NO: 813815 - RNA, 17 nt, Mycobacterium avium subsp. paratuberculosis
cgaccgccgguggggug

SEQ ID NO: 813816 - RNA, 15 nt, Mycobacterium avium subsp. paratuberculosis
cgaccgccaccucga

SEQ ID NO: 813817 - RNA, 19 nt, Mycobacterium avium subsp. paratuberculosis
cgaccgccagcagcagccg

SEQ ID NO: 813818 - RNA, 21 nt, Mycobacterium avium subsp. paratuberculosis
cgaccgccagcagcagccgcg

SEQ ID NO: 813819 - RNA, 22 nt, Mycobacterium avium subsp. paratuberculosis
cgaccgccagcagcagccgcgc

SEQ ID NO: 813820 - RNA, 14 nt, Mycobacterium avium subsp. paratuberculosis
cgaccgcaggucga

SEQ ID NO: 813821 - RNA, 17 nt, Mycobacterium avium subsp. paratuberculosis
cgaccgcaggucgaugg

SEQ ID NO: 813822 - RNA, 15 nt, Mycobacterium avium subsp. paratuberculosis
cgaccgccaccaccc

SEQ ID NO: 813823 - RNA, 18 nt, Mycobacterium avium subsp. paratuberculosis
cgaccgccaccacccggc

SEQ ID NO: 813824 - RNA, 13 nt, Mycobacterium avium subsp. paratuberculosis
cgaccgccccgcc

SEQ ID NO: 813825 - RNA, 14 nt, Mycobacterium avium subsp. paratuberculosis
cgaccgccccgcua

SEQ ID NO: 813826 - RNA, 17 nt, Mycobacterium avium subsp. paratuberculosis
cgaccgccuugucggcg

SEQ ID NO: 813827 - RNA, 19 nt, Mycobacterium avium subsp. paratuberculosis
cgaccgccuugucggcgau

SEQ ID NO: 813828 - RNA, 23 nt, Mycobacterium avium subsp. paratuberculosis
cgaccgccuugucggcgaugucg

SEQ ID NO: 813829 - RNA, 24 nt, Mycobacterium avium subsp. paratuberculosis
cgaccgccucggauuccgcggaac

SEQ ID NO: 813830 - RNA, 15 nt, Mycobacterium avium subsp. paratuberculosis
cgaccgccucgucgg

SEQ ID NO: 813831 - RNA, 16 nt, Mycobacterium avium subsp. paratuberculosis
cgaccgccucgucggg

SEQ ID NO: 813832 - RNA, 16 nt, Mycobacterium avium subsp. paratuberculosis
cgaccgcgacgaucac

SEQ ID NO: 813833 - RNA, 15 nt, Mycobacterium avium subsp. paratuberculosis
cgaccgcgacggcgc

SEQ ID NO: 813834 - RNA, 18 nt, Mycobacterium avium subsp. paratuberculosis
cgaccgcgacggcgcccg

SEQ ID NO: 813835 - RNA, 11 nt, Mycobacterium avium subsp. paratuberculosis
cgaccgcgauc

SEQ ID NO: 813836 - RNA, 21 nt, Mycobacterium avium subsp. paratuberculosis
cgaccgcgaucagggccgcgg

SEQ ID NO: 813837 - RNA, 14 nt, Mycobacterium avium subsp. paratuberculosis
cgaccgcgaugcag

SEQ ID NO: 813838 - RNA, 15 nt, Mycobacterium avium subsp. paratuberculosis
cgaccgcgaugcaga

SEQ ID NO: 813839 - RNA, 22 nt, Mycobacterium avium subsp. paratuberculosis
cgaccgcgaugcagaacagccg

SEQ ID NO: 813840 - RNA, 13 nt, Mycobacterium avium subsp. paratuberculosis
cgaccgcgaugcg

SEQ ID NO: 813841 - RNA, 19 nt, Mycobacterium avium subsp. paratuberculosis
cgaccgcgaugcgacaccg

SEQ ID NO: 813842 - RNA, 20 nt, Mycobacterium avium subsp. paratuberculosis
cgaccgcgaugcgacaccgc

SEQ ID NO: 813843 - RNA, 21 nt, Mycobacterium avium subsp. paratuberculosis
cgaccgcgaugcgacaccgcg

SEQ ID NO: 813844 - RNA, 18 nt, Mycobacterium avium subsp. paratuberculosis
cgaccgcgaugguggcgu

SEQ ID NO: 813845 - RNA, 20 nt, Mycobacterium avium subsp. paratuberculosis
cgaccgcgaugguggcguca

SEQ ID NO: 813846 - RNA, 13 nt, Mycobacterium avium subsp. paratuberculosis
cgaccgcgcaccg

SEQ ID NO: 813847 - RNA, 17 nt, Mycobacterium avium subsp. paratuberculosis
cgaccgcgcaccggcgc

SEQ ID NO: 813848 - RNA, 18 nt, Mycobacterium avium subsp. paratuberculosis
cgaccgcgcaccggcgcu

SEQ ID NO: 813849 - RNA, 15 nt, Mycobacterium avium subsp. paratuberculosis
cgaccgcgcaggcgg

SEQ ID NO: 813850 - RNA, 19 nt, Mycobacterium avium subsp. paratuberculosis
cgaccgcgcaggcggcgac

SEQ ID NO: 813851 - RNA, 22 nt, Mycobacterium avium subsp. paratuberculosis
cgaccgcgcaggcggcgacggc

SEQ ID NO: 813852 - RNA, 21 nt, Mycobacterium avium subsp. paratuberculosis
cgaccgcgccggggugggcca

SEQ ID NO: 813853 - RNA, 14 nt, Mycobacterium avium subsp. paratuberculosis
cgaccgcggcuccg

SEQ ID NO: 813854 - RNA, 17 nt, Mycobacterium avium subsp. paratuberculosis
cgaccgcggcuccggcc

SEQ ID NO: 813855 - RNA, 19 nt, Mycobacterium avium subsp. paratuberculosis
cgaccgcggcuccggccgc

SEQ ID NO: 813856 - RNA, 20 nt, Mycobacterium avium subsp. paratuberculosis
cgaccgcggcuccggccgcg

SEQ ID NO: 813857 - RNA, 23 nt, Mycobacterium avium subsp. paratuberculosis
cgaccgcggcuccggccgcgccg

SEQ ID NO: 813858 - RNA, 15 nt, Mycobacterium avium subsp. paratuberculosis
cgaccgcggccgcga

SEQ ID NO: 813859 - RNA, 16 nt, Mycobacterium avium subsp. paratuberculosis
cgaccgcggccgcgac

SEQ ID NO: 813860 - RNA, 17 nt, Mycobacterium avium subsp. paratuberculosis
cgaccgcggccgcgacg

SEQ ID NO: 813861 - RNA, 20 nt, Mycobacterium avium subsp. paratuberculosis
cgaccgcggccugggugacc

SEQ ID NO: 813862 - RNA, 14 nt, Mycobacterium avium subsp. paratuberculosis
cgaccgcggaugac

SEQ ID NO: 813863 - RNA, 20 nt, Mycobacterium avium subsp. paratuberculosis
cgaccgcggaugacgggugc

SEQ ID NO: 813864 - RNA, 16 nt, Mycobacterium avium subsp. paratuberculosis
cgaccgcgcgcggcgc

SEQ ID NO: 813865 - RNA, 20 nt, Mycobacterium avium subsp. paratuberculosis
cgaccgcgcgcggcgccgcg

SEQ ID NO: 813866 - RNA, 23 nt, Mycobacterium avium subsp. paratuberculosis
cgaccgcgcgcggcgccgcguac

SEQ ID NO: 813867 - RNA, 13 nt, Mycobacterium avium subsp. paratuberculosis
cgaccgcgcggcg

SEQ ID NO: 813868 - RNA, 14 nt, Mycobacterium avium subsp. paratuberculosis
cgaccgcgcggcga

SEQ ID NO: 813869 - RNA, 15 nt, Mycobacterium avium subsp. paratuberculosis
cgaccgcgccgaaca

SEQ ID NO: 813870 - RNA, 18 nt, Mycobacterium avium subsp. paratuberculosis
cgaccggucucgaccgcg

SEQ ID NO: 813871 - RNA, 21 nt, Mycobacterium avium subsp. paratuberculosis
cgaccggucucgaccgcggcg

SEQ ID NO: 813872 - RNA, 15 nt, Mycobacterium avium subsp. paratuberculosis
cgaccgguccgccgc

SEQ ID NO: 813873 - RNA, 17 nt, Mycobacterium avium subsp. paratuberculosis
cgaccgguccgccgccg

SEQ ID NO: 813874 - RNA, 18 nt, Mycobacterium avium subsp. paratuberculosis
cgaccgguccgccgccgg

SEQ ID NO: 813875 - RNA, 21 nt, Mycobacterium avium subsp. paratuberculosis
cgaccgguccgccgccggcgg

SEQ ID NO: 813876 - RNA, 22 nt, Mycobacterium avium subsp. paratuberculosis
cgaccgguccgccgccggcgga

SEQ ID NO: 813877 - RNA, 19 nt, Mycobacterium avium subsp. paratuberculosis
cgaccgguccgcgguucga

SEQ ID NO: 813878 - RNA, 17 nt, Mycobacterium avium subsp. paratuberculosis
cgaccggguuggcgcgc

SEQ ID NO: 813879 - RNA, 21 nt, Mycobacterium avium subsp. paratuberculosis
cgaccggguuggcgcgcacca

SEQ ID NO: 813880 - RNA, 17 nt, Mycobacterium avium subsp. paratuberculosis
cgaccgggcgcuccguu

SEQ ID NO: 813881 - RNA, 16 nt, Mycobacterium avium subsp. paratuberculosis
cgaccggggcgccccg

SEQ ID NO: 813882 - RNA, 20 nt, Mycobacterium avium subsp. paratuberculosis
cgaccggggcgccccgcugg

SEQ ID NO: 813883 - RNA, 18 nt, Mycobacterium avium subsp. paratuberculosis
cgaccgggucugccacgc

SEQ ID NO: 813884 - RNA, 19 nt, Mycobacterium avium subsp. paratuberculosis
cgaccgggucugccacgcc

SEQ ID NO: 813885 - RNA, 15 nt, Mycobacterium avium subsp. paratuberculosis
cgaccgggugaacga

SEQ ID NO: 813886 - RNA, 20 nt, Mycobacterium avium subsp. paratuberculosis
cgaccgggugaacgaggccg

SEQ ID NO: 813887 - RNA, 22 nt, Mycobacterium avium subsp. paratuberculosis
cgaccgggugaacgaggccgcg

SEQ ID NO: 813888 - RNA, 23 nt, Mycobacterium avium subsp. paratuberculosis
cgaccgggugaacgaggccgcgc

SEQ ID NO: 813889 - RNA, 14 nt, Mycobacterium avium subsp. paratuberculosis
cgaccggcucgccg

SEQ ID NO: 813890 - RNA, 16 nt, Mycobacterium avium subsp. paratuberculosis
cgaccggcucgccguu

SEQ ID NO: 813891 - RNA, 15 nt, Mycobacterium avium subsp. paratuberculosis
cgaccggcucagccc

SEQ ID NO: 813892 - RNA, 16 nt, Mycobacterium avium subsp. paratuberculosis
cgaccggcucagcccg

SEQ ID NO: 813893 - RNA, 19 nt, Mycobacterium avium subsp. paratuberculosis
cgaccggcucagcccggcg

SEQ ID NO: 813894 - RNA, 21 nt, Mycobacterium avium subsp. paratuberculosis
cgaccggcucagcccggcgcu

SEQ ID NO: 813895 - RNA, 14 nt, Mycobacterium avium subsp. paratuberculosis
cgaccggcagcacc

SEQ ID NO: 813896 - RNA, 21 nt, Mycobacterium avium subsp. paratuberculosis
cgaccggcagcaccggccgga

SEQ ID NO: 813897 - RNA, 13 nt, Mycobacterium avium subsp. paratuberculosis
cgaccggcagccg

SEQ ID NO: 813898 - RNA, 15 nt, Mycobacterium avium subsp. paratuberculosis
cgaccggcagccgcg

SEQ ID NO: 813899 - RNA, 16 nt, Mycobacterium avium subsp. paratuberculosis
cgaccggcagccgcgc

SEQ ID NO: 813900 - RNA, 21 nt, Mycobacterium avium subsp. paratuberculosis
cgaccggcagccgcgcccacc

SEQ ID NO: 813901 - RNA, 14 nt, Mycobacterium avium subsp. paratuberculosis
cgaccggcccgaac

SEQ ID NO: 813902 - RNA, 16 nt, Mycobacterium avium subsp. paratuberculosis
cgaccggcccgaacac

SEQ ID NO: 813903 - RNA, 17 nt, Mycobacterium avium subsp. paratuberculosis
cgaccggcccgaacacc

SEQ ID NO: 813904 - RNA, 15 nt, Mycobacterium avium subsp. paratuberculosis
cgaccggaugaugcc

SEQ ID NO: 813905 - RNA, 16 nt, Mycobacterium avium subsp. paratuberculosis
cgaccggaugaugccg

SEQ ID NO: 813906 - RNA, 18 nt, Mycobacterium avium subsp. paratuberculosis
cgaccgcguccgaggcgg

SEQ ID NO: 813907 - RNA, 19 nt, Mycobacterium avium subsp. paratuberculosis
cgaccgcguccgaggcggu

SEQ ID NO: 813908 - RNA, 19 nt, Mycobacterium avium subsp. paratuberculosis
cgaccgcgucgacggcgug

SEQ ID NO: 813909 - RNA, 12 nt, Mycobacterium avium subsp. paratuberculosis
cgaccgcggugg

SEQ ID NO: 813910 - RNA, 21 nt, Mycobacterium avium subsp. paratuberculosis
cgaccgcgguggcggugcggu

SEQ ID NO: 813911 - RNA, 20 nt, Mycobacterium avium subsp. paratuberculosis
cgaccgcguacagggcgucg

SEQ ID NO: 813912 - RNA, 17 nt, Mycobacterium avium subsp. paratuberculosis
cgaccgcguagucguug

SEQ ID NO: 813913 - RNA, 23 nt, Mycobacterium avium subsp. paratuberculosis
cgaccgcguagucguugucggcg

SEQ ID NO: 813914 - RNA, 13 nt, Mycobacterium avium subsp. paratuberculosis
cgacaucggccgc

SEQ ID NO: 813915 - RNA, 14 nt, Mycobacterium avium subsp. paratuberculosis
cgacaucggcgccg

SEQ ID NO: 813916 - RNA, 16 nt, Mycobacterium avium subsp. paratuberculosis
cgacaucggcgccgac

SEQ ID NO: 813917 - RNA, 14 nt, Mycobacterium avium subsp. paratuberculosis
cgacaucggugacc

SEQ ID NO: 813918 - RNA, 21 nt, Mycobacterium avium subsp. paratuberculosis
cgacaucggugaccgucgccg

SEQ ID NO: 813919 - RNA, 22 nt, Mycobacterium avium subsp. paratuberculosis
cgacaucggugaccgucgccga

SEQ ID NO: 813920 - RNA, 14 nt, Mycobacterium avium subsp. paratuberculosis
cgacaucgucggcu

SEQ ID NO: 813921 - RNA, 15 nt, Mycobacterium avium subsp. paratuberculosis
cgacaucucgacggu

SEQ ID NO: 813922 - RNA, 17 nt, Mycobacterium avium subsp. paratuberculosis
cgacaucucgacgguga

SEQ ID NO: 813923 - RNA, 19 nt, Mycobacterium avium subsp. paratuberculosis
cgacaucucgacggugacc

SEQ ID NO: 813924 - RNA, 15 nt, Mycobacterium avium subsp. paratuberculosis
cgacaucucggugag

SEQ ID NO: 813925 - RNA, 21 nt, Mycobacterium avium subsp. paratuberculosis
cgacaucucggugaggugggc

SEQ ID NO: 813926 - RNA, 16 nt, Mycobacterium avium subsp. paratuberculosis
cgacaucugccgggcg

SEQ ID NO: 813927 - RNA, 17 nt, Mycobacterium avium subsp. paratuberculosis
cgacaucugccgggcgg

SEQ ID NO: 813928 - RNA, 21 nt, Mycobacterium avium subsp. paratuberculosis
cgacaucugccgggcggcgac

SEQ ID NO: 813929 - RNA, 13 nt, Mycobacterium avium subsp. paratuberculosis
cgacccgaacuuc

SEQ ID NO: 813930 - RNA, 21 nt, Mycobacterium avium subsp. paratuberculosis
cgacccgaacuucagcgcguc

SEQ ID NO: 813931 - RNA, 22 nt, Mycobacterium avium subsp. paratuberculosis
cgacccgaacuucagcgcgucg

SEQ ID NO: 813932 - RNA, 19 nt, Mycobacterium avium subsp. paratuberculosis
cgacccgagagcugcugcc

SEQ ID NO: 813933 - RNA, 22 nt, Mycobacterium avium subsp. paratuberculosis
cgacccgagagcugcugccgcc

SEQ ID NO: 813934 - RNA, 17 nt, Mycobacterium avium subsp. paratuberculosis
cgaccccguucgccgac

SEQ ID NO: 813935 - RNA, 20 nt, Mycobacterium avium subsp. paratuberculosis
cgaccccguucgccgacagc

SEQ ID NO: 813936 - RNA, 22 nt, Mycobacterium avium subsp. paratuberculosis
cgaccccuacgggcgcaccgcg

SEQ ID NO: 813937 - RNA, 23 nt, Mycobacterium avium subsp. paratuberculosis
cgaccccuacgggcgcaccgcgc

SEQ ID NO: 813938 - RNA, 21 nt, Mycobacterium avium subsp. paratuberculosis
cgaccccuccaacggccgcac

SEQ ID NO: 813939 - RNA, 20 nt, Mycobacterium avium subsp. paratuberculosis
cgaccccucggcggccgucg

SEQ ID NO: 813940 - RNA, 22 nt, Mycobacterium avium subsp. paratuberculosis
cgaccccugcacuaccccgucg

SEQ ID NO: 813941 - RNA, 19 nt, Mycobacterium avium subsp. paratuberculosis
cgacaugaccaccgcgucg

SEQ ID NO: 813942 - RNA, 13 nt, Mycobacterium avium subsp. paratuberculosis
cgaccccggcgag

SEQ ID NO: 813943 - RNA, 17 nt, Mycobacterium avium subsp. paratuberculosis
cgaccccggcggcaccg

SEQ ID NO: 813944 - RNA, 19 nt, Mycobacterium avium subsp. paratuberculosis
cgaccccggcggcaccgcc

SEQ ID NO: 813945 - RNA, 22 nt, Mycobacterium avium subsp. paratuberculosis
cgaccccggcggcaccgccgcg

SEQ ID NO: 813946 - RNA, 12 nt, Mycobacterium avium subsp. paratuberculosis
cgacccgccgug

SEQ ID NO: 813947 - RNA, 13 nt, Mycobacterium avium subsp. paratuberculosis
cgacccgccuacu

SEQ ID NO: 813948 - RNA, 11 nt, Mycobacterium avium subsp. paratuberculosis
cgacccgccgc

SEQ ID NO: 813949 - RNA, 15 nt, Mycobacterium avium subsp. paratuberculosis
cgacccgccgcagcc

SEQ ID NO: 813950 - RNA, 16 nt, Mycobacterium avium subsp. paratuberculosis
cgacccgccgcagccc

SEQ ID NO: 813951 - RNA, 16 nt, Mycobacterium avium subsp. paratuberculosis
cgacccgauccagacg

SEQ ID NO: 813952 - RNA, 17 nt, Mycobacterium avium subsp. paratuberculosis
cgacccgauccagacgg

SEQ ID NO: 813953 - RNA, 15 nt, Mycobacterium avium subsp. paratuberculosis
cgacccgcaccaccg

SEQ ID NO: 813954 - RNA, 20 nt, Mycobacterium avium subsp. paratuberculosis
cgacccgcacgaugccgcgc

SEQ ID NO: 813955 - RNA, 16 nt, Mycobacterium avium subsp. paratuberculosis
cgacccgcauccgccg

SEQ ID NO: 813956 - RNA, 17 nt, Mycobacterium avium subsp. paratuberculosis
cgacccgcauccgccgg

SEQ ID NO: 813957 - RNA, 19 nt, Mycobacterium avium subsp. paratuberculosis
cgacccgcauccgccgggc

SEQ ID NO: 813958 - RNA, 20 nt, Mycobacterium avium subsp. paratuberculosis
cgacccgcauccgccgggcg

SEQ ID NO: 813959 - RNA, 22 nt, Mycobacterium avium subsp. paratuberculosis
cgacccgcauccgccgggcggc

SEQ ID NO: 813960 - RNA, 23 nt, Mycobacterium avium subsp. paratuberculosis
cgacccgcauccgccgggcggcg

SEQ ID NO: 813961 - RNA, 13 nt, Mycobacterium avium subsp. paratuberculosis
cgacccgcccgcc

SEQ ID NO: 813962 - RNA, 21 nt, Mycobacterium avium subsp. paratuberculosis
cgacccgcuggaacagcgggc

SEQ ID NO: 813963 - RNA, 19 nt, Mycobacterium avium subsp. paratuberculosis
cgacccgcuucgcccggcu

SEQ ID NO: 813964 - RNA, 22 nt, Mycobacterium avium subsp. paratuberculosis
cgacccgcuucgcccggcugcg

SEQ ID NO: 813965 - RNA, 12 nt, Mycobacterium avium subsp. paratuberculosis
cgacccgcggcg

SEQ ID NO: 813966 - RNA, 15 nt, Mycobacterium avium subsp. paratuberculosis
cgacccgcggcgccg

SEQ ID NO: 813967 - RNA, 17 nt, Mycobacterium avium subsp. paratuberculosis
cgacccgcggcgccgcg

SEQ ID NO: 813968 - RNA, 17 nt, Mycobacterium avium subsp. paratuberculosis
cgacccgcuccgacgcg

SEQ ID NO: 813969 - RNA, 21 nt, Mycobacterium avium subsp. paratuberculosis
cgacccgcuccgacgcggugg

SEQ ID NO: 813970 - RNA, 18 nt, Mycobacterium avium subsp. paratuberculosis
cgacccgcucgacgcgca

SEQ ID NO: 813971 - RNA, 15 nt, Mycobacterium avium subsp. paratuberculosis
cgacccggaugaugu

SEQ ID NO: 813972 - RNA, 13 nt, Mycobacterium avium subsp. paratuberculosis
cgacccggccacc

SEQ ID NO: 813973 - RNA, 14 nt, Mycobacterium avium subsp. paratuberculosis
cgacccggccagcg

SEQ ID NO: 813974 - RNA, 16 nt, Mycobacterium avium subsp. paratuberculosis
cgacccggccagcggc

SEQ ID NO: 813975 - RNA, 23 nt, Mycobacterium avium subsp. paratuberculosis
cgacccggccagcggcagcggcg

SEQ ID NO: 813976 - RNA, 14 nt, Mycobacterium avium subsp. paratuberculosis
cgacccggccgagc

SEQ ID NO: 813977 - RNA, 16 nt, Mycobacterium avium subsp. paratuberculosis
cgacccggccgagcgc

SEQ ID NO: 813978 - RNA, 17 nt, Mycobacterium avium subsp. paratuberculosis
cgacccggccgagcgcg

SEQ ID NO: 813979 - RNA, 20 nt, Mycobacterium avium subsp. paratuberculosis
cgacccggccgagcgcgccg

SEQ ID NO: 813980 - RNA, 16 nt, Mycobacterium avium subsp. paratuberculosis
cgacccggccgcgccg

SEQ ID NO: 813981 - RNA, 17 nt, Mycobacterium avium subsp. paratuberculosis
cgacccggccgcgccgg

SEQ ID NO: 813982 - RNA, 17 nt, Mycobacterium avium subsp. paratuberculosis
cgacccugcguccggcc

SEQ ID NO: 813983 - RNA, 19 nt, Mycobacterium avium subsp. paratuberculosis
cgacccugcguccggcccg

SEQ ID NO: 813984 - RNA, 22 nt, Mycobacterium avium subsp. paratuberculosis
cgacccugcguccggcccggcg

SEQ ID NO: 813985 - RNA, 18 nt, Mycobacterium avium subsp. paratuberculosis
cgacccguuccccggccg

SEQ ID NO: 813986 - RNA, 21 nt, Mycobacterium avium subsp. paratuberculosis
cgacccguuccccggccgacg

SEQ ID NO: 813987 - RNA, 14 nt, Mycobacterium avium subsp. paratuberculosis
cgacccguuccggc

SEQ ID NO: 813988 - RNA, 15 nt, Mycobacterium avium subsp. paratuberculosis
cgacccguuccggcg

SEQ ID NO: 813989 - RNA, 17 nt, Mycobacterium avium subsp. paratuberculosis
cgacccguuccggcgag

SEQ ID NO: 813990 - RNA, 15 nt, Mycobacterium avium subsp. paratuberculosis
cgacccguccagcag

SEQ ID NO: 813991 - RNA, 20 nt, Mycobacterium avium subsp. paratuberculosis
cgacccguccagcagcaugu

SEQ ID NO: 813992 - RNA, 14 nt, Mycobacterium avium subsp. paratuberculosis
cgacccguccagcg

SEQ ID NO: 813993 - RNA, 16 nt, Mycobacterium avium subsp. paratuberculosis
cgacccguccagcgug

SEQ ID NO: 813994 - RNA, 17 nt, Mycobacterium avium subsp. paratuberculosis
cgacccguccagcgugu

SEQ ID NO: 813995 - RNA, 16 nt, Mycobacterium avium subsp. paratuberculosis
cgacccgucggggugc

SEQ ID NO: 813996 - RNA, 19 nt, Mycobacterium avium subsp. paratuberculosis
cgacccgucggggugcgcc

SEQ ID NO: 813997 - RNA, 22 nt, Mycobacterium avium subsp. paratuberculosis
cgacccgucggggugcgccagg

SEQ ID NO: 813998 - RNA, 16 nt, Mycobacterium avium subsp. paratuberculosis
cgacccgguggcccgg

SEQ ID NO: 813999 - RNA, 20 nt, Mycobacterium avium subsp. paratuberculosis
cgacccgguagcgcagcacc

SEQ ID NO: 814000 - RNA, 23 nt, Mycobacterium avium subsp. paratuberculosis
cgacccgguagcgcagcaccagg

SEQ ID NO: 814001 - RNA, 17 nt, Mycobacterium avium subsp. paratuberculosis
cgacccgguccaccugg

SEQ ID NO: 814002 - RNA, 18 nt, Mycobacterium avium subsp. paratuberculosis
cgacccgggccagcagga

SEQ ID NO: 814003 - RNA, 21 nt, Mycobacterium avium subsp. paratuberculosis
cgaccgcaccgaccagcggga

SEQ ID NO: 814004 - RNA, 14 nt, Mycobacterium avium subsp. paratuberculosis
cgaccgcagcaggc

SEQ ID NO: 814005 - RNA, 13 nt, Mycobacterium avium subsp. paratuberculosis
cgaccgagggcgc

SEQ ID NO: 814006 - RNA, 14 nt, Mycobacterium avium subsp. paratuberculosis
cgaccgagggcgcg

SEQ ID NO: 814007 - RNA, 15 nt, Mycobacterium avium subsp. paratuberculosis
cgaccgaggucgacg

SEQ ID NO: 814008 - RNA, 19 nt, Mycobacterium avium subsp. paratuberculosis
cgaccgaggucgacgcccc

SEQ ID NO: 814009 - RNA, 20 nt, Mycobacterium avium subsp. paratuberculosis
cgacccuuccggaacgacgc

SEQ ID NO: 814010 - RNA, 16 nt, Mycobacterium avium subsp. paratuberculosis
cgaccgacagccgcac

SEQ ID NO: 814011 - RNA, 23 nt, Mycobacterium avium subsp. paratuberculosis
cgaccgacaguucggcgcgcauc

SEQ ID NO: 814012 - RNA, 13 nt, Mycobacterium avium subsp. paratuberculosis
cgaccgacccggc

SEQ ID NO: 814013 - RNA, 19 nt, Mycobacterium avium subsp. paratuberculosis
cgaccgacccggccagcgg

SEQ ID NO: 814014 - RNA, 14 nt, Mycobacterium avium subsp. paratuberculosis
cgaccgacgcccgg

SEQ ID NO: 814015 - RNA, 15 nt, Mycobacterium avium subsp. paratuberculosis
cgaccgacgcgguca

SEQ ID NO: 814016 - RNA, 17 nt, Mycobacterium avium subsp. paratuberculosis
cgaccgacgcggucacc

SEQ ID NO: 814017 - RNA, 18 nt, Mycobacterium avium subsp. paratuberculosis
cgaccgacgcggucaccg

SEQ ID NO: 814018 - RNA, 20 nt, Mycobacterium avium subsp. paratuberculosis
cgaccgacgcggucaccggc

SEQ ID NO: 814019 - RNA, 23 nt, Mycobacterium avium subsp. paratuberculosis
cgaccgacgcggucaccggcucg

SEQ ID NO: 814020 - RNA, 17 nt, Mycobacterium avium subsp. paratuberculosis
cgacgcgggcgacguca

SEQ ID NO: 814021 - RNA, 22 nt, Mycobacterium avium subsp. paratuberculosis
cgacgcgggcgacgucaacuuc

SEQ ID NO: 814022 - RNA, 17 nt, Mycobacterium avium subsp. paratuberculosis
cgacgcggcucgcgcgg

SEQ ID NO: 814023 - RNA, 21 nt, Mycobacterium avium subsp. paratuberculosis
cgacgcgggauugccgagcac

SEQ ID NO: 814024 - RNA, 22 nt, Mycobacterium avium subsp. paratuberculosis
cgacgcgggauugccgagcacc

SEQ ID NO: 814025 - RNA, 14 nt, Mycobacterium avium subsp. paratuberculosis
cgacgcggggcggc

SEQ ID NO: 814026 - RNA, 16 nt, Mycobacterium avium subsp. paratuberculosis
cgacgcggggcggcgg

SEQ ID NO: 814027 - RNA, 21 nt, Mycobacterium avium subsp. paratuberculosis
cgacgcggggcggcggcgccg

SEQ ID NO: 814028 - RNA, 22 nt, Mycobacterium avium subsp. paratuberculosis
cgacgcggggcggcggcgccgg

SEQ ID NO: 814029 - RNA, 13 nt, Mycobacterium avium subsp. paratuberculosis
cgacgcggucacc

SEQ ID NO: 814030 - RNA, 16 nt, Mycobacterium avium subsp. paratuberculosis
cgacgcggucaccggc

SEQ ID NO: 814031 - RNA, 16 nt, Mycobacterium avium subsp. paratuberculosis
cgacgcggucugcggu

SEQ ID NO: 814032 - RNA, 13 nt, Mycobacterium avium subsp. paratuberculosis
cgacgcggugaca

SEQ ID NO: 814033 - RNA, 20 nt, Mycobacterium avium subsp. paratuberculosis
cgacgcggugacaugcccgg

SEQ ID NO: 814034 - RNA, 22 nt, Mycobacterium avium subsp. paratuberculosis
cgacgcggugacaugcccgggc

SEQ ID NO: 814035 - RNA, 21 nt, Mycobacterium avium subsp. paratuberculosis
cgacgcggugagcgcgccggc

SEQ ID NO: 814036 - RNA, 14 nt, Mycobacterium avium subsp. paratuberculosis
cgacgcgguggcgu

SEQ ID NO: 814037 - RNA, 15 nt, Mycobacterium avium subsp. paratuberculosis
cgacgcgucgacagu

SEQ ID NO: 814038 - RNA, 16 nt, Mycobacterium avium subsp. paratuberculosis
cgacgcgucgcggcgg

SEQ ID NO: 814039 - RNA, 17 nt, Mycobacterium avium subsp. paratuberculosis
cgacgcucaggcgucca

SEQ ID NO: 814040 - RNA, 21 nt, Mycobacterium avium subsp. paratuberculosis
cgacgcucaggcguccagcca

SEQ ID NO: 814041 - RNA, 14 nt, Mycobacterium avium subsp. paratuberculosis
cgacgcucgccacc

SEQ ID NO: 814042 - RNA, 20 nt, Mycobacterium avium subsp. paratuberculosis
cgacgcucgccaccccgcgc

SEQ ID NO: 814043 - RNA, 21 nt, Mycobacterium avium subsp. paratuberculosis
cgacgcucgccaccccgcgcc

SEQ ID NO: 814044 - RNA, 22 nt, Mycobacterium avium subsp. paratuberculosis
cgacgcucgccaccccgcgcca

SEQ ID NO: 814045 - RNA, 23 nt, Mycobacterium avium subsp. paratuberculosis
cgacgcguuguugcucggcggcc

SEQ ID NO: 814046 - RNA, 16 nt, Mycobacterium avium subsp. paratuberculosis
cgacgcgugcgucauc

SEQ ID NO: 814047 - RNA, 14 nt, Mycobacterium avium subsp. paratuberculosis
cgacgcggcgcgcg

SEQ ID NO: 814048 - RNA, 18 nt, Mycobacterium avium subsp. paratuberculosis
cgacgcggcgcgcgaugg

SEQ ID NO: 814049 - RNA, 13 nt, Mycobacterium avium subsp. paratuberculosis
cgacgcggcggcc

SEQ ID NO: 814050 - RNA, 22 nt, Mycobacterium avium subsp. paratuberculosis
cgacgcggcggccgacagcgcg

SEQ ID NO: 814051 - RNA, 20 nt, Mycobacterium avium subsp. paratuberculosis
cgacgcgcacccgggaccgg

SEQ ID NO: 814052 - RNA, 12 nt, Mycobacterium avium subsp. paratuberculosis
cgacgcgacgcg

SEQ ID NO: 814053 - RNA, 17 nt, Mycobacterium avium subsp. paratuberculosis
cgacgcgacgcgcucgg

SEQ ID NO: 814054 - RNA, 16 nt, Mycobacterium avium subsp. paratuberculosis
cgacgccgcgcagcgg

SEQ ID NO: 814055 - RNA, 14 nt, Mycobacterium avium subsp. paratuberculosis
cgacgcgaccggcc

SEQ ID NO: 814056 - RNA, 16 nt, Mycobacterium avium subsp. paratuberculosis
cgacgcgaccggcccg

SEQ ID NO: 814057 - RNA, 22 nt, Mycobacterium avium subsp. paratuberculosis
cgacgcgaacgcgccccgccgg

SEQ ID NO: 814058 - RNA, 14 nt, Mycobacterium avium subsp. paratuberculosis
cgacgccugcgcga

SEQ ID NO: 814059 - RNA, 17 nt, Mycobacterium avium subsp. paratuberculosis
cgacgccugcgcgaaca

SEQ ID NO: 814060 - RNA, 20 nt, Mycobacterium avium subsp. paratuberculosis
cgacgccugcgcgaacagcg

SEQ ID NO: 814061 - RNA, 18 nt, Mycobacterium avium subsp. paratuberculosis
cgacgccgcgcuggccgg

SEQ ID NO: 814062 - RNA, 20 nt, Mycobacterium avium subsp. paratuberculosis
cgacgccgcgcuggccgggu

SEQ ID NO: 814063 - RNA, 20 nt, Mycobacterium avium subsp. paratuberculosis
cgacgccgauggugaccucg

SEQ ID NO: 814064 - RNA, 23 nt, Mycobacterium avium subsp. paratuberculosis
cgacgccgauggugaccucgguc

SEQ ID NO: 814065 - RNA, 15 nt, Mycobacterium avium subsp. paratuberculosis
cgacgccgccgccga

SEQ ID NO: 814066 - RNA, 23 nt, Mycobacterium avium subsp. paratuberculosis
cgacgccgccgccgagcucggcc

SEQ ID NO: 814067 - RNA, 13 nt, Mycobacterium avium subsp. paratuberculosis
cgacgccgacacc

SEQ ID NO: 814068 - RNA, 17 nt, Mycobacterium avium subsp. paratuberculosis
cgacgccgacaccagcg

SEQ ID NO: 814069 - RNA, 19 nt, Mycobacterium avium subsp. paratuberculosis
cgacgccgacaccagcgcg

SEQ ID NO: 814070 - RNA, 20 nt, Mycobacterium avium subsp. paratuberculosis
cgacgccgacaccagcgcgc

SEQ ID NO: 814071 - RNA, 15 nt, Mycobacterium avium subsp. paratuberculosis
cgacgccgacaucgc

SEQ ID NO: 814072 - RNA, 19 nt, Mycobacterium avium subsp. paratuberculosis
cgacgccgacaucgcggcg

SEQ ID NO: 814073 - RNA, 14 nt, Mycobacterium avium subsp. paratuberculosis
cgacgccgaccgcg

SEQ ID NO: 814074 - RNA, 11 nt, Mycobacterium avium subsp. paratuberculosis
cgacgccgacg

SEQ ID NO: 814075 - RNA, 17 nt, Mycobacterium avium subsp. paratuberculosis
cgacgccgacgcccagc

SEQ ID NO: 814076 - RNA, 21 nt, Mycobacterium avium subsp. paratuberculosis
cgacgccgaguaacucggccu

SEQ ID NO: 814077 - RNA, 20 nt, Mycobacterium avium subsp. paratuberculosis
cgacgccgauccgcagccgc

SEQ ID NO: 814078 - RNA, 13 nt, Mycobacterium avium subsp. paratuberculosis
cgacgccagcugc

SEQ ID NO: 814079 - RNA, 18 nt, Mycobacterium avium subsp. paratuberculosis
cgacgccagcugccgcga

SEQ ID NO: 814080 - RNA, 17 nt, Mycobacterium avium subsp. paratuberculosis
cgacgccaguucgucgg

SEQ ID NO: 814081 - RNA, 22 nt, Mycobacterium avium subsp. paratuberculosis
cgacgccaguucgucggccguc

SEQ ID NO: 814082 - RNA, 16 nt, Mycobacterium avium subsp. paratuberculosis
cgacgccaugggccca

SEQ ID NO: 814083 - RNA, 15 nt, Mycobacterium avium subsp. paratuberculosis
cgacgccaugucgau

SEQ ID NO: 814084 - RNA, 22 nt, Mycobacterium avium subsp. paratuberculosis
cgacgccaugucgaugucgacg

SEQ ID NO: 814085 - RNA, 16 nt, Mycobacterium avium subsp. paratuberculosis
cgacgcccacagcgcc

SEQ ID NO: 814086 - RNA, 19 nt, Mycobacterium avium subsp. paratuberculosis
cgacgcccacagcgccagc

SEQ ID NO: 814087 - RNA, 20 nt, Mycobacterium avium subsp. paratuberculosis
cgacgcccacagcgccagca

SEQ ID NO: 814088 - RNA, 22 nt, Mycobacterium avium subsp. paratuberculosis
cgacgcccacagcgccagcacg

SEQ ID NO: 814089 - RNA, 14 nt, Mycobacterium avium subsp. paratuberculosis
cgacgcccaccugg

SEQ ID NO: 814090 - RNA, 20 nt, Mycobacterium avium subsp. paratuberculosis
cgacgcccagaacgacgcgc

SEQ ID NO: 814091 - RNA, 15 nt, Mycobacterium avium subsp. paratuberculosis
cgacgcccagcaccg

SEQ ID NO: 814092 - RNA, 16 nt, Mycobacterium avium subsp. paratuberculosis
cgacgcccagcaccga

SEQ ID NO: 814093 - RNA, 19 nt, Mycobacterium avium subsp. paratuberculosis
cgacgcccagcaccgaguu

SEQ ID NO: 814094 - RNA, 16 nt, Mycobacterium avium subsp. paratuberculosis
cgacgcccagcgcggc

SEQ ID NO: 814095 - RNA, 18 nt, Mycobacterium avium subsp. paratuberculosis
cgacgcccagcgcggcga

SEQ ID NO: 814096 - RNA, 23 nt, Mycobacterium avium subsp. paratuberculosis
cgacgcccagcgcggcgaacccg

SEQ ID NO: 814097 - RNA, 18 nt, Mycobacterium avium subsp. paratuberculosis
cgacgccgaagaucagcg

SEQ ID NO: 814098 - RNA, 20 nt, Mycobacterium avium subsp. paratuberculosis
cgacgccgaagaucagcgcg

SEQ ID NO: 814099 - RNA, 21 nt, Mycobacterium avium subsp. paratuberculosis
cgacgccgaagaucagcgcgu

SEQ ID NO: 814100 - RNA, 16 nt, Mycobacterium avium subsp. paratuberculosis
cgacgccagcggcagc

SEQ ID NO: 814101 - RNA, 19 nt, Mycobacterium avium subsp. paratuberculosis
cgacgccagcggcagcgcc

SEQ ID NO: 814102 - RNA, 20 nt, Mycobacterium avium subsp. paratuberculosis
cgacgccagcggcagcgcca

SEQ ID NO: 814103 - RNA, 22 nt, Mycobacterium avium subsp. paratuberculosis
cgacgccagcggcagcgccagc

SEQ ID NO: 814104 - RNA, 14 nt, Mycobacterium avium subsp. paratuberculosis
cgacgauggcccgg

SEQ ID NO: 814105 - RNA, 21 nt, Mycobacterium avium subsp. paratuberculosis
cgacgauggcccggaccgccg

SEQ ID NO: 814106 - RNA, 13 nt, Mycobacterium avium subsp. paratuberculosis
cgacgccagcggg

SEQ ID NO: 814107 - RNA, 14 nt, Mycobacterium avium subsp. paratuberculosis
cgacgccagcgggc

SEQ ID NO: 814108 - RNA, 17 nt, Mycobacterium avium subsp. paratuberculosis
cgacgccagcgggccgu

SEQ ID NO: 814109 - RNA, 20 nt, Mycobacterium avium subsp. paratuberculosis
cgacgaugucgacccgcggc

SEQ ID NO: 814110 - RNA, 21 nt, Mycobacterium avium subsp. paratuberculosis
cgacgaugucgacccgcggcg

SEQ ID NO: 814111 - RNA, 22 nt, Mycobacterium avium subsp. paratuberculosis
cgacgaugucgacccgcggcgc

SEQ ID NO: 814112 - RNA, 15 nt, Mycobacterium avium subsp. paratuberculosis
cgacgauggcgucca

SEQ ID NO: 814113 - RNA, 17 nt, Mycobacterium avium subsp. paratuberculosis
cgacgauggcguccacc

SEQ ID NO: 814114 - RNA, 19 nt, Mycobacterium avium subsp. paratuberculosis
cgacgauggcguccaccga

SEQ ID NO: 814115 - RNA, 14 nt, Mycobacterium avium subsp. paratuberculosis
cgacgaugcggccg

SEQ ID NO: 814116 - RNA, 19 nt, Mycobacterium avium subsp. paratuberculosis
cgacgaugcggggcggcgg

SEQ ID NO: 814117 - RNA, 15 nt, Mycobacterium avium subsp. paratuberculosis
cgacgaugcguucgg

SEQ ID NO: 814118 - RNA, 18 nt, Mycobacterium avium subsp. paratuberculosis
cgacgaugcguucgggau

SEQ ID NO: 814119 - RNA, 17 nt, Mycobacterium avium subsp. paratuberculosis
cgacgaugccggccggg

SEQ ID NO: 814120 - RNA, 19 nt, Mycobacterium avium subsp. paratuberculosis
cgacgaugccggccgggac

SEQ ID NO: 814121 - RNA, 20 nt, Mycobacterium avium subsp. paratuberculosis
cgacgaugccggccgggacg

SEQ ID NO: 814122 - RNA, 17 nt, Mycobacterium avium subsp. paratuberculosis
cgacgaugccggcgucg

SEQ ID NO: 814123 - RNA, 20 nt, Mycobacterium avium subsp. paratuberculosis
cgacgaugccggcgucgucg

SEQ ID NO: 814124 - RNA, 15 nt, Mycobacterium avium subsp. paratuberculosis
cgacgaucuugccga

SEQ ID NO: 814125 - RNA, 13 nt, Mycobacterium avium subsp. paratuberculosis
cgacgaugaacag

SEQ ID NO: 814126 - RNA, 20 nt, Mycobacterium avium subsp. paratuberculosis
cgacgaugaacagucggccg

SEQ ID NO: 814127 - RNA, 21 nt, Mycobacterium avium subsp. paratuberculosis
cgacgaugaacagucggccgg

SEQ ID NO: 814128 - RNA, 18 nt, Mycobacterium avium subsp. paratuberculosis
cgacgaugaagacccgcc

SEQ ID NO: 814129 - RNA, 15 nt, Mycobacterium avium subsp. paratuberculosis
cgacgaucgcgccgg

SEQ ID NO: 814130 - RNA, 16 nt, Mycobacterium avium subsp. paratuberculosis
cgacgaucgcgccggc

SEQ ID NO: 814131 - RNA, 17 nt, Mycobacterium avium subsp. paratuberculosis
cgacgaucgcgccggcc

SEQ ID NO: 814132 - RNA, 18 nt, Mycobacterium avium subsp. paratuberculosis
cgaccuucugcugcacgu

SEQ ID NO: 814133 - RNA, 20 nt, Mycobacterium avium subsp. paratuberculosis
cgaccuucugcugcacgucc

SEQ ID NO: 814134 - RNA, 18 nt, Mycobacterium avium subsp. paratuberculosis
cgaccuugcagcccgcgu

SEQ ID NO: 814135 - RNA, 16 nt, Mycobacterium avium subsp. paratuberculosis
cgaccuuuugcccggc

SEQ ID NO: 814136 - RNA, 18 nt, Mycobacterium avium subsp. paratuberculosis
cgaccuuggggucaccgu

SEQ ID NO: 814137 - RNA, 20 nt, Mycobacterium avium subsp. paratuberculosis
cgaccuuggggucaccgucc

SEQ ID NO: 814138 - RNA, 16 nt, Mycobacterium avium subsp. paratuberculosis
cgaccuugcgcagccg

SEQ ID NO: 814139 - RNA, 20 nt, Mycobacterium avium subsp. paratuberculosis
cgaccuugcgcagccggcag

SEQ ID NO: 814140 - RNA, 22 nt, Mycobacterium avium subsp. paratuberculosis
cgaccuugcgcagccggcagca

SEQ ID NO: 814141 - RNA, 20 nt, Mycobacterium avium subsp. paratuberculosis
cgaccugggucaucaccuug

SEQ ID NO: 814142 - RNA, 18 nt, Mycobacterium avium subsp. paratuberculosis
cgaccuggucgccgaacg

SEQ ID NO: 814143 - RNA, 20 nt, Mycobacterium avium subsp. paratuberculosis
cgaccuggucgccgaacgug

SEQ ID NO: 814144 - RNA, 17 nt, Mycobacterium avium subsp. paratuberculosis
cgaccuggucgccgccg

SEQ ID NO: 814145 - RNA, 21 nt, Mycobacterium avium subsp. paratuberculosis
cgaccugguugacaccaccga

SEQ ID NO: 814146 - RNA, 19 nt, Mycobacterium avium subsp. paratuberculosis
cgaccuguccgaucaccgu

SEQ ID NO: 814147 - RNA, 20 nt, Mycobacterium avium subsp. paratuberculosis
cgaccuguuuggccagccag

SEQ ID NO: 814148 - RNA, 23 nt, Mycobacterium avium subsp. paratuberculosis
cgaccuucgagccgccgccggcg

SEQ ID NO: 814149 - RNA, 21 nt, Mycobacterium avium subsp. paratuberculosis
cgaccuucggagacguggcgg

SEQ ID NO: 814150 - RNA, 16 nt, Mycobacterium avium subsp. paratuberculosis
cgaccuggcggccgga

SEQ ID NO: 814151 - RNA, 13 nt, Mycobacterium avium subsp. paratuberculosis
cgaccuggcgggc

SEQ ID NO: 814152 - RNA, 16 nt, Mycobacterium avium subsp. paratuberculosis
cgaccuggcgggccag

SEQ ID NO: 814153 - RNA, 20 nt, Mycobacterium avium subsp. paratuberculosis
cgaccuggcgggccagcuug

SEQ ID NO: 814154 - RNA, 17 nt, Mycobacterium avium subsp. paratuberculosis
cgaccugggcgccgucg

SEQ ID NO: 814155 - RNA, 20 nt, Mycobacterium avium subsp. paratuberculosis
cgaccugggcgccgucgccg

SEQ ID NO: 814156 - RNA, 23 nt, Mycobacterium avium subsp. paratuberculosis
cgaccugggcgccgucgccgacg

SEQ ID NO: 814157 - RNA, 16 nt, Mycobacterium avium subsp. paratuberculosis
cgaccugggcggccac

SEQ ID NO: 814158 - RNA, 17 nt, Mycobacterium avium subsp. paratuberculosis
cgaccugggcggccacc

SEQ ID NO: 814159 - RNA, 18 nt, Mycobacterium avium subsp. paratuberculosis
cgaccugggcggccaccg

SEQ ID NO: 814160 - RNA, 12 nt, Mycobacterium avium subsp. paratuberculosis
cgaccgucggga

SEQ ID NO: 814161 - RNA, 19 nt, Mycobacterium avium subsp. paratuberculosis
cgaccgucgggacggccag

SEQ ID NO: 814162 - RNA, 15 nt, Mycobacterium avium subsp. paratuberculosis
cgaccgucgucccgg

SEQ ID NO: 814163 - RNA, 23 nt, Mycobacterium avium subsp. paratuberculosis
cgaccgucuucuucagccgcagc

SEQ ID NO: 814164 - RNA, 18 nt, Mycobacterium avium subsp. paratuberculosis
cgaccgugaggcccggcg

SEQ ID NO: 814165 - RNA, 21 nt, Mycobacterium avium subsp. paratuberculosis
cgaccgugaggcccggcgugg

SEQ ID NO: 814166 - RNA, 18 nt, Mycobacterium avium subsp. paratuberculosis
cgaccgugcccaccagcc

SEQ ID NO: 814167 - RNA, 19 nt, Mycobacterium avium subsp. paratuberculosis
cgaccgugcccaccagccg

SEQ ID NO: 814168 - RNA, 23 nt, Mycobacterium avium subsp. paratuberculosis
cgaccgugcccaccagccggccg

SEQ ID NO: 814169 - RNA, 16 nt, Mycobacterium avium subsp. paratuberculosis
cgaccgucagcagggc

SEQ ID NO: 814170 - RNA, 17 nt, Mycobacterium avium subsp. paratuberculosis
cgaccgucagcagggcc

SEQ ID NO: 814171 - RNA, 23 nt, Mycobacterium avium subsp. paratuberculosis
cgaccgucagcagggccucgccg

SEQ ID NO: 814172 - RNA, 15 nt, Mycobacterium avium subsp. paratuberculosis
cgaccgucacgcugg

SEQ ID NO: 814173 - RNA, 16 nt, Mycobacterium avium subsp. paratuberculosis
cgaccgucacgcuggc

SEQ ID NO: 814174 - RNA, 20 nt, Mycobacterium avium subsp. paratuberculosis
cgaccgucacgcuggcguga

SEQ ID NO: 814175 - RNA, 15 nt, Mycobacterium avium subsp. paratuberculosis
cgaccgguugcccgg

SEQ ID NO: 814176 - RNA, 18 nt, Mycobacterium avium subsp. paratuberculosis
cgaccguagccggucggc

SEQ ID NO: 814177 - RNA, 19 nt, Mycobacterium avium subsp. paratuberculosis
cgaccguagccggucggcc

SEQ ID NO: 814178 - RNA, 20 nt, Mycobacterium avium subsp. paratuberculosis
cgaccguagccggucggccc

SEQ ID NO: 814179 - RNA, 21 nt, Mycobacterium avium subsp. paratuberculosis
cgaccgucaucaucaccggga

SEQ ID NO: 814180 - RNA, 15 nt, Mycobacterium avium subsp. paratuberculosis
cgacgauccgggccg

SEQ ID NO: 814181 - RNA, 19 nt, Mycobacterium avium subsp. paratuberculosis
cgacgauccgggccggucg

SEQ ID NO: 814182 - RNA, 21 nt, Mycobacterium avium subsp. paratuberculosis
cgacgauccgggccggucggu

SEQ ID NO: 814183 - RNA, 14 nt, Mycobacterium avium subsp. paratuberculosis
cgacgauccgggcg

SEQ ID NO: 814184 - RNA, 15 nt, Mycobacterium avium subsp. paratuberculosis
cgacgauccgggcgc

SEQ ID NO: 814185 - RNA, 15 nt, Mycobacterium avium subsp. paratuberculosis
cgacgaucccggcga

SEQ ID NO: 814186 - RNA, 16 nt, Mycobacterium avium subsp. paratuberculosis
cgacgaucccggcgag

SEQ ID NO: 814187 - RNA, 18 nt, Mycobacterium avium subsp. paratuberculosis
cgacgaucccggcgagca

SEQ ID NO: 814188 - RNA, 15 nt, Mycobacterium avium subsp. paratuberculosis
cgacgauccgcgccg

SEQ ID NO: 814189 - RNA, 16 nt, Mycobacterium avium subsp. paratuberculosis
cgacgauccgcgccgc

SEQ ID NO: 814190 - RNA, 18 nt, Mycobacterium avium subsp. paratuberculosis
cgacgauccgcgccgcga

SEQ ID NO: 814191 - RNA, 18 nt, Mycobacterium avium subsp. paratuberculosis
cgacgauaucggccgcgg

SEQ ID NO: 814192 - RNA, 19 nt, Mycobacterium avium subsp. paratuberculosis
cgacgauaucggccgcggg

SEQ ID NO: 814193 - RNA, 23 nt, Mycobacterium avium subsp. paratuberculosis
cgacgauaucggccgcggggccg

SEQ ID NO: 814194 - RNA, 15 nt, Mycobacterium avium subsp. paratuberculosis
cgacgaucacggugu

SEQ ID NO: 814195 - RNA, 19 nt, Mycobacterium avium subsp. paratuberculosis
cgacgaucagcagccgggc

SEQ ID NO: 814196 - RNA, 17 nt, Mycobacterium avium subsp. paratuberculosis
cgacgagaucagcacca

SEQ ID NO: 814197 - RNA, 19 nt, Mycobacterium avium subsp. paratuberculosis
cgacgagaucagcaccagg

SEQ ID NO: 814198 - RNA, 22 nt, Mycobacterium avium subsp. paratuberculosis
cgacgagaucagcaccaggugg

SEQ ID NO: 814199 - RNA, 17 nt, Mycobacterium avium subsp. paratuberculosis
cgacgagagcggaucgg

SEQ ID NO: 814200 - RNA, 20 nt, Mycobacterium avium subsp. paratuberculosis
cgacgagagcggaucggcgg

SEQ ID NO: 814201 - RNA, 22 nt, Mycobacterium avium subsp. paratuberculosis
cgacgagagcggaucggcggcg

SEQ ID NO: 814202 - RNA, 23 nt, Mycobacterium avium subsp. paratuberculosis
cgacgagagcggaucggcggcga

SEQ ID NO: 814203 - RNA, 14 nt, Mycobacterium avium subsp. paratuberculosis
cgacgagcccgccg

SEQ ID NO: 814204 - RNA, 17 nt, Mycobacterium avium subsp. paratuberculosis
cgacgagcccgccggcg

SEQ ID NO: 814205 - RNA, 14 nt, Mycobacterium avium subsp. paratuberculosis
cgacgagcccgcgc

SEQ ID NO: 814206 - RNA, 15 nt, Mycobacterium avium subsp. paratuberculosis
cgacgagcccgcgcc

SEQ ID NO: 814207 - RNA, 14 nt, Mycobacterium avium subsp. paratuberculosis
cgacgagccgacgu

SEQ ID NO: 814208 - RNA, 15 nt, Mycobacterium avium subsp. paratuberculosis
cgacgagccgacgua

SEQ ID NO: 814209 - RNA, 20 nt, Mycobacterium avium subsp. paratuberculosis
cgacgagccgacguaaccgu

SEQ ID NO: 814210 - RNA, 14 nt, Mycobacterium avium subsp. paratuberculosis
cgacgaaucccgcc

SEQ ID NO: 814211 - RNA, 13 nt, Mycobacterium avium subsp. paratuberculosis
cgacgacaccacc

SEQ ID NO: 814212 - RNA, 20 nt, Mycobacterium avium subsp. paratuberculosis
cgacgacacccuucaucagc

SEQ ID NO: 814213 - RNA, 22 nt, Mycobacterium avium subsp. paratuberculosis
cgacgacacccuucaucagcac

SEQ ID NO: 814214 - RNA, 23 nt, Mycobacterium avium subsp. paratuberculosis
cgacgacacccuucaucagcacc

SEQ ID NO: 814215 - RNA, 13 nt, Mycobacterium avium subsp. paratuberculosis
cgacgacgucguc

SEQ ID NO: 814216 - RNA, 14 nt, Mycobacterium avium subsp. paratuberculosis
cgacgacguggugg

SEQ ID NO: 814217 - RNA, 14 nt, Mycobacterium avium subsp. paratuberculosis
cgacgacguugcgg

SEQ ID NO: 814218 - RNA, 23 nt, Mycobacterium avium subsp. paratuberculosis
cgacgacguugcgggccaggucg

SEQ ID NO: 814219 - RNA, 20 nt, Mycobacterium avium subsp. paratuberculosis
cgacgacugggugcgcgggc

SEQ ID NO: 814220 - RNA, 21 nt, Mycobacterium avium subsp. paratuberculosis
cgacgacugggugcgcgggcg

SEQ ID NO: 814221 - RNA, 18 nt, Mycobacterium avium subsp. paratuberculosis
cgacgacuucggccucgg

SEQ ID NO: 814222 - RNA, 14 nt, Mycobacterium avium subsp. paratuberculosis
cgacgaagucgacg

SEQ ID NO: 814223 - RNA, 16 nt, Mycobacterium avium subsp. paratuberculosis
cgacgaagucgacggc

SEQ ID NO: 814224 - RNA, 19 nt, Mycobacterium avium subsp. paratuberculosis
cgacgaagucgacggcggu

SEQ ID NO: 814225 - RNA, 22 nt, Mycobacterium avium subsp. paratuberculosis
cgacgaagccgccgcccucggu

SEQ ID NO: 814226 - RNA, 13 nt, Mycobacterium avium subsp. paratuberculosis
cgacgaagccggu

SEQ ID NO: 814227 - RNA, 13 nt, Mycobacterium avium subsp. paratuberculosis
cgacgaacaccac

SEQ ID NO: 814228 - RNA, 14 nt, Mycobacterium avium subsp. paratuberculosis
cgacgaacaccacc

SEQ ID NO: 814229 - RNA, 17 nt, Mycobacterium avium subsp. paratuberculosis
cgacgaacaccaccggc

SEQ ID NO: 814230 - RNA, 18 nt, Mycobacterium avium subsp. paratuberculosis
cgacgaacaccaccggca

SEQ ID NO: 814231 - RNA, 18 nt, Mycobacterium avium subsp. paratuberculosis
cgacgaaaucgucgggca

SEQ ID NO: 814232 - RNA, 23 nt, Mycobacterium avium subsp. paratuberculosis
cgacgaaaucgucgggccggauc

SEQ ID NO: 814233 - RNA, 14 nt, Mycobacterium avium subsp. paratuberculosis
cgacgaagaugcgc

SEQ ID NO: 814234 - RNA, 16 nt, Mycobacterium avium subsp. paratuberculosis
cgacgaagcagcucgc

SEQ ID NO: 814235 - RNA, 11 nt, Mycobacterium avium subsp. paratuberculosis
cgaaucaccca

SEQ ID NO: 814236 - RNA, 18 nt, Mycobacterium avium subsp. paratuberculosis
cgaaucacccacggccac

SEQ ID NO: 814237 - RNA, 15 nt, Mycobacterium avium subsp. paratuberculosis
cgaauaccagggcga

SEQ ID NO: 814238 - RNA, 18 nt, Mycobacterium avium subsp. paratuberculosis
cgaauacccgcccagcac

SEQ ID NO: 814239 - RNA, 20 nt, Mycobacterium avium subsp. paratuberculosis
cgaauacccuccgggcggca

SEQ ID NO: 814240 - RNA, 19 nt, Mycobacterium avium subsp. paratuberculosis
cgaauacgccaucagcacc

SEQ ID NO: 814241 - RNA, 18 nt, Mycobacterium avium subsp. paratuberculosis
cgaauacaccugccgcac

SEQ ID NO: 814242 - RNA, 14 nt, Mycobacterium avium subsp. paratuberculosis
cgaaguuggcgucg

SEQ ID NO: 814243 - RNA, 15 nt, Mycobacterium avium subsp. paratuberculosis
cgaaguuggcgucgg

SEQ ID NO: 814244 - RNA, 18 nt, Mycobacterium avium subsp. paratuberculosis
cgaaguuggcgucgggca

SEQ ID NO: 814245 - RNA, 20 nt, Mycobacterium avium subsp. paratuberculosis
cgaaggcguuggagccgacc

SEQ ID NO: 814246 - RNA, 15 nt, Mycobacterium avium subsp. paratuberculosis
cgaaggcggcgccgg

SEQ ID NO: 814247 - RNA, 14 nt, Mycobacterium avium subsp. paratuberculosis
cgaaggcggcgccg

SEQ ID NO: 814248 - RNA, 12 nt, Mycobacterium avium subsp. paratuberculosis
cgaaggcggccg

SEQ ID NO: 814249 - RNA, 13 nt, Mycobacterium avium subsp. paratuberculosis
cgaaggcggccgc

SEQ ID NO: 814250 - RNA, 14 nt, Mycobacterium avium subsp. paratuberculosis
cgaaggccgggcug

SEQ ID NO: 814251 - RNA, 15 nt, Mycobacterium avium subsp. paratuberculosis
cgaaggccgggcugg

SEQ ID NO: 814252 - RNA, 12 nt, Mycobacterium avium subsp. paratuberculosis
cgaaggccgccg

SEQ ID NO: 814253 - RNA, 19 nt, Mycobacterium avium subsp. paratuberculosis
cgaaggccuggaacaccca

SEQ ID NO: 814254 - RNA, 13 nt, Mycobacterium avium subsp. paratuberculosis
cgaaggcgcgcag

SEQ ID NO: 814255 - RNA, 14 nt, Mycobacterium avium subsp. paratuberculosis
cgaaggcgcgcagg

SEQ ID NO: 814256 - RNA, 12 nt, Mycobacterium avium subsp. paratuberculosis
cgaaggcggcgu

SEQ ID NO: 814257 - RNA, 18 nt, Mycobacterium avium subsp. paratuberculosis
cgaaggcggcgucgaugu

SEQ ID NO: 814258 - RNA, 22 nt, Mycobacterium avium subsp. paratuberculosis
cgaauugccgguggugcggccc

SEQ ID NO: 814259 - RNA, 18 nt, Mycobacterium avium subsp. paratuberculosis
cgaauugcgcugcaccgc

SEQ ID NO: 814260 - RNA, 20 nt, Mycobacterium avium subsp. paratuberculosis
cgaauugcuuacgcaucgcc

SEQ ID NO: 814261 - RNA, 16 nt, Mycobacterium avium subsp. paratuberculosis
cgaauuguggcggccc

SEQ ID NO: 814262 - RNA, 14 nt, Mycobacterium avium subsp. paratuberculosis
cgaauuguucggcc

SEQ ID NO: 814263 - RNA, 16 nt, Mycobacterium avium subsp. paratuberculosis
cgaauuccucagcgcc

SEQ ID NO: 814264 - RNA, 17 nt, Mycobacterium avium subsp. paratuberculosis
cgaauuccucagcgccc

SEQ ID NO: 814265 - RNA, 22 nt, Mycobacterium avium subsp. paratuberculosis
cgaauuccuugcggaugcgggc

SEQ ID NO: 814266 - RNA, 23 nt, Mycobacterium avium subsp. paratuberculosis
cgaauucggcgaugaacgggaug

SEQ ID NO: 814267 - RNA, 15 nt, Mycobacterium avium subsp. paratuberculosis
cgaauucgguggcga

SEQ ID NO: 814268 - RNA, 18 nt, Mycobacterium avium subsp. paratuberculosis
cgaaugucgaccaccggg

SEQ ID NO: 814269 - RNA, 15 nt, Mycobacterium avium subsp. paratuberculosis
cgaaucccggccucg

SEQ ID NO: 814270 - RNA, 16 nt, Mycobacterium avium subsp. paratuberculosis
cgaauccagcgcgccg

SEQ ID NO: 814271 - RNA, 23 nt, Mycobacterium avium subsp. paratuberculosis
cgacaacguggugugcaccagcg

SEQ ID NO: 814272 - RNA, 15 nt, Mycobacterium avium subsp. paratuberculosis
cgacaacggccccca

SEQ ID NO: 814273 - RNA, 14 nt, Mycobacterium avium subsp. paratuberculosis
cgacaacagcacga

SEQ ID NO: 814274 - RNA, 16 nt, Mycobacterium avium subsp. paratuberculosis
cgacaacagcacgaac

SEQ ID NO: 814275 - RNA, 15 nt, Mycobacterium avium subsp. paratuberculosis
cgacaacagcgccga

SEQ ID NO: 814276 - RNA, 14 nt, Mycobacterium avium subsp. paratuberculosis
cgacaacauccgcg

SEQ ID NO: 814277 - RNA, 23 nt, Mycobacterium avium subsp. paratuberculosis
cgacaaccguugaggcgagccga

SEQ ID NO: 814278 - RNA, 22 nt, Mycobacterium avium subsp. paratuberculosis
cgacaaaggaggggcgcggcau

SEQ ID NO: 814279 - RNA, 18 nt, Mycobacterium avium subsp. paratuberculosis
cgacacguggaccgagcg

SEQ ID NO: 814280 - RNA, 20 nt, Mycobacterium avium subsp. paratuberculosis
cgacacguggaccgagcgcg

SEQ ID NO: 814281 - RNA, 21 nt, Mycobacterium avium subsp. paratuberculosis
cgacacguggaccgagcgcgc

SEQ ID NO: 814282 - RNA, 13 nt, Mycobacterium avium subsp. paratuberculosis
cgacacgucgaca

SEQ ID NO: 814283 - RNA, 19 nt, Mycobacterium avium subsp. paratuberculosis
cgacacugcaacuacgcac

SEQ ID NO: 814284 - RNA, 12 nt, Mycobacterium avium subsp. paratuberculosis
cgacagacccga

SEQ ID NO: 814285 - RNA, 19 nt, Mycobacterium avium subsp. paratuberculosis
cgacacguccagcucucga

SEQ ID NO: 814286 - RNA, 13 nt, Mycobacterium avium subsp. paratuberculosis
cgacacggugaac

SEQ ID NO: 814287 - RNA, 15 nt, Mycobacterium avium subsp. paratuberculosis
cgacaccaccgcgcg

SEQ ID NO: 814288 - RNA, 16 nt, Mycobacterium avium subsp. paratuberculosis
cgacaccaccggccgc

SEQ ID NO: 814289 - RNA, 18 nt, Mycobacterium avium subsp. paratuberculosis
cgacaccaccggccgccc

SEQ ID NO: 814290 - RNA, 22 nt, Mycobacterium avium subsp. paratuberculosis
cgacaccaccggccgcccggcg

SEQ ID NO: 814291 - RNA, 14 nt, Mycobacterium avium subsp. paratuberculosis
cgacagcacgccgg

SEQ ID NO: 814292 - RNA, 15 nt, Mycobacterium avium subsp. paratuberculosis
cgacagcacgccggg

SEQ ID NO: 814293 - RNA, 16 nt, Mycobacterium avium subsp. paratuberculosis
cgacagcacgccgggc

SEQ ID NO: 814294 - RNA, 17 nt, Mycobacterium avium subsp. paratuberculosis
cgacagcacgccgggca

SEQ ID NO: 814295 - RNA, 13 nt, Mycobacterium avium subsp. paratuberculosis
cgacagcacgggc

SEQ ID NO: 814296 - RNA, 14 nt, Mycobacterium avium subsp. paratuberculosis
cgacagcacccggc

SEQ ID NO: 814297 - RNA, 15 nt, Mycobacterium avium subsp. paratuberculosis
cgacagcacccggcc

SEQ ID NO: 814298 - RNA, 20 nt, Mycobacterium avium subsp. paratuberculosis
cgacagcaaaccgaccgccg

SEQ ID NO: 814299 - RNA, 23 nt, Mycobacterium avium subsp. paratuberculosis
cgacagcaaaccgaccgccgcgg

SEQ ID NO: 814300 - RNA, 12 nt, Mycobacterium avium subsp. paratuberculosis
cgacagcaacgc

SEQ ID NO: 814301 - RNA, 23 nt, Mycobacterium avium subsp. paratuberculosis
cgacagcaacgccagggccccgu

SEQ ID NO: 814302 - RNA, 19 nt, Mycobacterium avium subsp. paratuberculosis
cgacagauacuucgucgaa

SEQ ID NO: 814303 - RNA, 20 nt, Mycobacterium avium subsp. paratuberculosis
cgacagauacuucgucgaac

SEQ ID NO: 814304 - RNA, 20 nt, Mycobacterium avium subsp. paratuberculosis
cgacagaugcggcaccagcc

SEQ ID NO: 814305 - RNA, 21 nt, Mycobacterium avium subsp. paratuberculosis
cgacaagggccgggcgcuggc

SEQ ID NO: 814306 - RNA, 22 nt, Mycobacterium avium subsp. paratuberculosis
cgacaagggccgggcgcuggcc

SEQ ID NO: 814307 - RNA, 22 nt, Mycobacterium avium subsp. paratuberculosis
cgacaaggucgaccgcgcaccg

SEQ ID NO: 814308 - RNA, 16 nt, Mycobacterium avium subsp. paratuberculosis
cgacagcccccgcagc

SEQ ID NO: 814309 - RNA, 19 nt, Mycobacterium avium subsp. paratuberculosis
cgacagcccccgcagcccg

SEQ ID NO: 814310 - RNA, 21 nt, Mycobacterium avium subsp. paratuberculosis
cgacagggugccaaggucgcc

SEQ ID NO: 814311 - RNA, 22 nt, Mycobacterium avium subsp. paratuberculosis
cgacagggugccaaggucgccg

SEQ ID NO: 814312 - RNA, 19 nt, Mycobacterium avium subsp. paratuberculosis
cgacagggugccgaacagc

SEQ ID NO: 814313 - RNA, 18 nt, Mycobacterium avium subsp. paratuberculosis
cgacagguagcaggcgcg

SEQ ID NO: 814314 - RNA, 18 nt, Mycobacterium avium subsp. paratuberculosis
cgacagggagccgacgaa

SEQ ID NO: 814315 - RNA, 15 nt, Mycobacterium avium subsp. paratuberculosis
cgacagcacgggcgg

SEQ ID NO: 814316 - RNA, 16 nt, Mycobacterium avium subsp. paratuberculosis
cgacagcagcgugguc

SEQ ID NO: 814317 - RNA, 23 nt, Mycobacterium avium subsp. paratuberculosis
cgacagcagcucauacagcggcg

SEQ ID NO: 814318 - RNA, 21 nt, Mycobacterium avium subsp. paratuberculosis
cgacagcaggaucuccggccg

SEQ ID NO: 814319 - RNA, 12 nt, Mycobacterium avium subsp. paratuberculosis
cgacagcacccg

SEQ ID NO: 814320 - RNA, 19 nt, Mycobacterium avium subsp. paratuberculosis
cgacagcaccucgcccugc

SEQ ID NO: 814321 - RNA, 16 nt, Mycobacterium avium subsp. paratuberculosis
cgacaucacgaacgcg

SEQ ID NO: 814322 - RNA, 19 nt, Mycobacterium avium subsp. paratuberculosis
cgacaucacgaacgcguuc

SEQ ID NO: 814323 - RNA, 21 nt, Mycobacterium avium subsp. paratuberculosis
cgacaucaccaaccgcucggc

SEQ ID NO: 814324 - RNA, 17 nt, Mycobacterium avium subsp. paratuberculosis
cgacaggucgaagggca

SEQ ID NO: 814325 - RNA, 20 nt, Mycobacterium avium subsp. paratuberculosis
cgacaggucgaagggcaucg

SEQ ID NO: 814326 - RNA, 14 nt, Mycobacterium avium subsp. paratuberculosis
cgacaggucgagca

SEQ ID NO: 814327 - RNA, 13 nt, Mycobacterium avium subsp. paratuberculosis
cgacaggucggcg

SEQ ID NO: 814328 - RNA, 21 nt, Mycobacterium avium subsp. paratuberculosis
cgacagguucuuggcggccug

SEQ ID NO: 814329 - RNA, 19 nt, Mycobacterium avium subsp. paratuberculosis
cgacaucgaaugcagcggc

SEQ ID NO: 814330 - RNA, 21 nt, Mycobacterium avium subsp. paratuberculosis
cgacaucgccaucagcagcgc

SEQ ID NO: 814331 - RNA, 17 nt, Mycobacterium avium subsp. paratuberculosis
cgacaucgcccggucca

SEQ ID NO: 814332 - RNA, 13 nt, Mycobacterium avium subsp. paratuberculosis
cgacaucgccgcg

SEQ ID NO: 814333 - RNA, 15 nt, Mycobacterium avium subsp. paratuberculosis
cgacaucgccgcggc

SEQ ID NO: 814334 - RNA, 17 nt, Mycobacterium avium subsp. paratuberculosis
cgacaucgccgcggccg

SEQ ID NO: 814335 - RNA, 15 nt, Mycobacterium avium subsp. paratuberculosis
cgacaucgccggcga

SEQ ID NO: 814336 - RNA, 18 nt, Mycobacterium avium subsp. paratuberculosis
cgacaucagaucgccgac

SEQ ID NO: 814337 - RNA, 14 nt, Mycobacterium avium subsp. paratuberculosis
cgacaucaccgcgg

SEQ ID NO: 814338 - RNA, 17 nt, Mycobacterium avium subsp. paratuberculosis
cgacaucagugcgggca

SEQ ID NO: 814339 - RNA, 20 nt, Mycobacterium avium subsp. paratuberculosis
cgacauccagaugcccagca

SEQ ID NO: 814340 - RNA, 19 nt, Mycobacterium avium subsp. paratuberculosis
cgacauccaggaccgcgcg

SEQ ID NO: 814341 - RNA, 22 nt, Mycobacterium avium subsp. paratuberculosis
cgacauccaggaccgcgcgccg

SEQ ID NO: 814342 - RNA, 23 nt, Mycobacterium avium subsp. paratuberculosis
cgacauccaggaccgcgcgccgg

SEQ ID NO: 814343 - RNA, 16 nt, Mycobacterium avium subsp. paratuberculosis
cgacauccugcgcauc

SEQ ID NO: 814344 - RNA, 17 nt, Mycobacterium avium subsp. paratuberculosis
cgacauccugcgcaucg

SEQ ID NO: 814345 - RNA, 15 nt, Mycobacterium avium subsp. paratuberculosis
cgacauccuggguug

SEQ ID NO: 814346 - RNA, 23 nt, Mycobacterium avium subsp. paratuberculosis
cgaagaacuugucgucgucggcg

SEQ ID NO: 814347 - RNA, 20 nt, Mycobacterium avium subsp. paratuberculosis
cgaagaagagggcgugacgc

SEQ ID NO: 814348 - RNA, 19 nt, Mycobacterium avium subsp. paratuberculosis
cgaagaaggcuccgccgau

SEQ ID NO: 814349 - RNA, 17 nt, Mycobacterium avium subsp. paratuberculosis
cgaagaacgacgccacc

SEQ ID NO: 814350 - RNA, 16 nt, Mycobacterium avium subsp. paratuberculosis
cgaagaagcggccgac

SEQ ID NO: 814351 - RNA, 17 nt, Mycobacterium avium subsp. paratuberculosis
cgaagaagcggccgacg

SEQ ID NO: 814352 - RNA, 18 nt, Mycobacterium avium subsp. paratuberculosis
cgaagaagcggccgacga

SEQ ID NO: 814353 - RNA, 20 nt, Mycobacterium avium subsp. paratuberculosis
cgaagaagcggccgacgaac

SEQ ID NO: 814354 - RNA, 16 nt, Mycobacterium avium subsp. paratuberculosis
cgaagaaggcgugcga

SEQ ID NO: 814355 - RNA, 14 nt, Mycobacterium avium subsp. paratuberculosis
cgaacucgcggcgg

SEQ ID NO: 814356 - RNA, 18 nt, Mycobacterium avium subsp. paratuberculosis
cgaagaccacgaacugcg

SEQ ID NO: 814357 - RNA, 15 nt, Mycobacterium avium subsp. paratuberculosis
cgaagaccagcgugu

SEQ ID NO: 814358 - RNA, 21 nt, Mycobacterium avium subsp. paratuberculosis
cgaagaccagcgugucgccgg

SEQ ID NO: 814359 - RNA, 21 nt, Mycobacterium avium subsp. paratuberculosis
cgaagaccggugcgcgcacca

SEQ ID NO: 814360 - RNA, 22 nt, Mycobacterium avium subsp. paratuberculosis
cgaagaccggugcgcgcaccag

SEQ ID NO: 814361 - RNA, 17 nt, Mycobacterium avium subsp. paratuberculosis
cgaagccggugcccauc

SEQ ID NO: 814362 - RNA, 13 nt, Mycobacterium avium subsp. paratuberculosis
cgaagccgucgac

SEQ ID NO: 814363 - RNA, 14 nt, Mycobacterium avium subsp. paratuberculosis
cgaagccgucgacc

SEQ ID NO: 814364 - RNA, 21 nt, Mycobacterium avium subsp. paratuberculosis
cgaagccgucgaccccgccgg

SEQ ID NO: 814365 - RNA, 15 nt, Mycobacterium avium subsp. paratuberculosis
cgaagccgugacccg

SEQ ID NO: 814366 - RNA, 22 nt, Mycobacterium avium subsp. paratuberculosis
cgaagccguggcaggcacgagc

SEQ ID NO: 814367 - RNA, 14 nt, Mycobacterium avium subsp. paratuberculosis
cgaagccggccccg

SEQ ID NO: 814368 - RNA, 15 nt, Mycobacterium avium subsp. paratuberculosis
cgaagccggccccgc

SEQ ID NO: 814369 - RNA, 17 nt, Mycobacterium avium subsp. paratuberculosis
cgaagccggccccgccc

SEQ ID NO: 814370 - RNA, 20 nt, Mycobacterium avium subsp. paratuberculosis
cgaagccggccccgcccggg

SEQ ID NO: 814371 - RNA, 13 nt, Mycobacterium avium subsp. paratuberculosis
cgaagccgccgcc

SEQ ID NO: 814372 - RNA, 19 nt, Mycobacterium avium subsp. paratuberculosis
cgaagccgaucaccggcgc

SEQ ID NO: 814373 - RNA, 21 nt, Mycobacterium avium subsp. paratuberculosis
cgaagccgaucaccggcgcgu

SEQ ID NO: 814374 - RNA, 14 nt, Mycobacterium avium subsp. paratuberculosis
cgaagccgaucgcg

SEQ ID NO: 814375 - RNA, 17 nt, Mycobacterium avium subsp. paratuberculosis
cgaagccgccgcccucg

SEQ ID NO: 814376 - RNA, 14 nt, Mycobacterium avium subsp. paratuberculosis
cgaagccgccgucc

SEQ ID NO: 814377 - RNA, 21 nt, Mycobacterium avium subsp. paratuberculosis
cgaagccgccguccccgcgcg

SEQ ID NO: 814378 - RNA, 23 nt, Mycobacterium avium subsp. paratuberculosis
cgaagccgccguccccgcgcggc

SEQ ID NO: 814379 - RNA, 14 nt, Mycobacterium avium subsp. paratuberculosis
cgaagcccgcagcg

SEQ ID NO: 814380 - RNA, 20 nt, Mycobacterium avium subsp. paratuberculosis
cgaagcccgcagcgaacgcg

SEQ ID NO: 814381 - RNA, 19 nt, Mycobacterium avium subsp. paratuberculosis
cgaagcccgccgucacgcc

SEQ ID NO: 814382 - RNA, 20 nt, Mycobacterium avium subsp. paratuberculosis
cgaagcccgugccgaugccg

SEQ ID NO: 814383 - RNA, 21 nt, Mycobacterium avium subsp. paratuberculosis
cgaagcccgugccgaugccgg

SEQ ID NO: 814384 - RNA, 15 nt, Mycobacterium avium subsp. paratuberculosis
cgaagccgaagucgc

SEQ ID NO: 814385 - RNA, 12 nt, Mycobacterium avium subsp. paratuberculosis
cgaagccgacac

SEQ ID NO: 814386 - RNA, 15 nt, Mycobacterium avium subsp. paratuberculosis
cgaagccgacaccgg

SEQ ID NO: 814387 - RNA, 14 nt, Mycobacterium avium subsp. paratuberculosis
cgaagccgacgucg

SEQ ID NO: 814388 - RNA, 16 nt, Mycobacterium avium subsp. paratuberculosis
cgaagccgacgucgac

SEQ ID NO: 814389 - RNA, 14 nt, Mycobacterium avium subsp. paratuberculosis
cgaaggaggccagc

SEQ ID NO: 814390 - RNA, 20 nt, Mycobacterium avium subsp. paratuberculosis
cgaaggccaggugcacgccg

SEQ ID NO: 814391 - RNA, 19 nt, Mycobacterium avium subsp. paratuberculosis
cgaaggcaugggcgugccg

SEQ ID NO: 814392 - RNA, 18 nt, Mycobacterium avium subsp. paratuberculosis
cgaagcguuccgccgucc

SEQ ID NO: 814393 - RNA, 18 nt, Mycobacterium avium subsp. paratuberculosis
cgaagcguuucagcaacc

SEQ ID NO: 814394 - RNA, 22 nt, Mycobacterium avium subsp. paratuberculosis
cgaagcguuucagcaacccgaa

SEQ ID NO: 814395 - RNA, 20 nt, Mycobacterium avium subsp. paratuberculosis
cgaagcucaucaccggcgcg

SEQ ID NO: 814396 - RNA, 23 nt, Mycobacterium avium subsp. paratuberculosis
cgaagcucaucaccggcgcgccg

SEQ ID NO: 814397 - RNA, 16 nt, Mycobacterium avium subsp. paratuberculosis
cgaagcugcgcagccg

SEQ ID NO: 814398 - RNA, 18 nt, Mycobacterium avium subsp. paratuberculosis
cgaagcugcgcagccgug

SEQ ID NO: 814399 - RNA, 16 nt, Mycobacterium avium subsp. paratuberculosis
cgaagcugucgccgag

SEQ ID NO: 814400 - RNA, 12 nt, Mycobacterium avium subsp. paratuberculosis
cgaagcgccgca

SEQ ID NO: 814401 - RNA, 22 nt, Mycobacterium avium subsp. paratuberculosis
cgaagcgcgaugcggcucacca

SEQ ID NO: 814402 - RNA, 14 nt, Mycobacterium avium subsp. paratuberculosis
cgaagcgcagcacc

SEQ ID NO: 814403 - RNA, 14 nt, Mycobacterium avium subsp. paratuberculosis
cgaagcgcagcguc

SEQ ID NO: 814404 - RNA, 15 nt, Mycobacterium avium subsp. paratuberculosis
cgaagcgcagcagcu

SEQ ID NO: 814405 - RNA, 21 nt, Mycobacterium avium subsp. paratuberculosis
cgaagcguaugccgguggcgu

SEQ ID NO: 814406 - RNA, 16 nt, Mycobacterium avium subsp. paratuberculosis
cgaagcgggucgggga

SEQ ID NO: 814407 - RNA, 19 nt, Mycobacterium avium subsp. paratuberculosis
cgaagcggugcaccaccgu

SEQ ID NO: 814408 - RNA, 17 nt, Mycobacterium avium subsp. paratuberculosis
cgaagcgggacugcagc

SEQ ID NO: 814409 - RNA, 20 nt, Mycobacterium avium subsp. paratuberculosis
cgaagcgggcggcgaacacc

SEQ ID NO: 814410 - RNA, 21 nt, Mycobacterium avium subsp. paratuberculosis
cgaagcgggcggcgaacacca

SEQ ID NO: 814411 - RNA, 16 nt, Mycobacterium avium subsp. paratuberculosis
cgaagcggccggggag

SEQ ID NO: 814412 - RNA, 21 nt, Mycobacterium avium subsp. paratuberculosis
cgaagcggccggggaguucgc

SEQ ID NO: 814413 - RNA, 17 nt, Mycobacterium avium subsp. paratuberculosis
cgaagcggcgcacgcag

SEQ ID NO: 814414 - RNA, 23 nt, Mycobacterium avium subsp. paratuberculosis
cgaaaucggguccagcgccgagc

SEQ ID NO: 814415 - RNA, 17 nt, Mycobacterium avium subsp. paratuberculosis
cgaaaucuucgccguca

SEQ ID NO: 814416 - RNA, 13 nt, Mycobacterium avium subsp. paratuberculosis
cgaaaucgcgggc

SEQ ID NO: 814417 - RNA, 17 nt, Mycobacterium avium subsp. paratuberculosis
cgaacaacagggccgcg

SEQ ID NO: 814418 - RNA, 18 nt, Mycobacterium avium subsp. paratuberculosis
cgaacaacagggccgcgc

SEQ ID NO: 814419 - RNA, 22 nt, Mycobacterium avium subsp. paratuberculosis
cgaacaacagggccgcgcgggc

SEQ ID NO: 814420 - RNA, 18 nt, Mycobacterium avium subsp. paratuberculosis
cgaacaacccggccgcga

SEQ ID NO: 814421 - RNA, 23 nt, Mycobacterium avium subsp. paratuberculosis
cgaacaauuccucugcgcgccaa

SEQ ID NO: 814422 - RNA, 15 nt, Mycobacterium avium subsp. paratuberculosis
cgaacaccaccggca

SEQ ID NO: 814423 - RNA, 21 nt, Mycobacterium avium subsp. paratuberculosis
cgaacaccacgguccccgcgc

SEQ ID NO: 814424 - RNA, 20 nt, Mycobacterium avium subsp. paratuberculosis
cgaacaccacguagccgacc

SEQ ID NO: 814425 - RNA, 17 nt, Mycobacterium avium subsp. paratuberculosis
cgaacaccagcacccag

SEQ ID NO: 814426 - RNA, 20 nt, Mycobacterium avium subsp. paratuberculosis
cgaaccggaucuggcccugg

SEQ ID NO: 814427 - RNA, 23 nt, Mycobacterium avium subsp. paratuberculosis
cgaaccggaucuggcccuggcag

SEQ ID NO: 814428 - RNA, 14 nt, Mycobacterium avium subsp. paratuberculosis
cgaacaccggcagc

SEQ ID NO: 814429 - RNA, 16 nt, Mycobacterium avium subsp. paratuberculosis
cgaacaccggcagcgc

SEQ ID NO: 814430 - RNA, 21 nt, Mycobacterium avium subsp. paratuberculosis
cgaacacccggcuucgcugcg

SEQ ID NO: 814431 - RNA, 15 nt, Mycobacterium avium subsp. paratuberculosis
cgaacaccggcgcga

SEQ ID NO: 814432 - RNA, 22 nt, Mycobacterium avium subsp. paratuberculosis
cgaacacccagaugcccagcgg

SEQ ID NO: 814433 - RNA, 18 nt, Mycobacterium avium subsp. paratuberculosis
cgaaccucgcggcggcgu

SEQ ID NO: 814434 - RNA, 20 nt, Mycobacterium avium subsp. paratuberculosis
cgaaccucgcggcggcgucg

SEQ ID NO: 814435 - RNA, 23 nt, Mycobacterium avium subsp. paratuberculosis
cgaaccucgcggcggcgucggcg

SEQ ID NO: 814436 - RNA, 13 nt, Mycobacterium avium subsp. paratuberculosis
cgaaccggcgggg

SEQ ID NO: 814437 - RNA, 13 nt, Mycobacterium avium subsp. paratuberculosis
cgaaccgggcggu

SEQ ID NO: 814438 - RNA, 23 nt, Mycobacterium avium subsp. paratuberculosis
cgaaccgggcggugaccacgccg

SEQ ID NO: 814439 - RNA, 23 nt, Mycobacterium avium subsp. paratuberculosis
cgaaccggggccgcaccugaucg

SEQ ID NO: 814440 - RNA, 18 nt, Mycobacterium avium subsp. paratuberculosis
cgaaccgguugcgggccg

SEQ ID NO: 814441 - RNA, 19 nt, Mycobacterium avium subsp. paratuberculosis
cgaaccgguugcgggccga

SEQ ID NO: 814442 - RNA, 17 nt, Mycobacterium avium subsp. paratuberculosis
cgaaccgugcacgaucg

SEQ ID NO: 814443 - RNA, 23 nt, Mycobacterium avium subsp. paratuberculosis
cgaaccgugcacgaucgcgguga

SEQ ID NO: 814444 - RNA, 14 nt, Mycobacterium avium subsp. paratuberculosis
cgaacuccagaucg

SEQ ID NO: 814445 - RNA, 21 nt, Mycobacterium avium subsp. paratuberculosis
cgaacuccagaucgccgccca

SEQ ID NO: 814446 - RNA, 17 nt, Mycobacterium avium subsp. paratuberculosis
cgaacucaccgguggcc

SEQ ID NO: 814447 - RNA, 21 nt, Mycobacterium avium subsp. paratuberculosis
cgaacucaccgguggccgcgu

SEQ ID NO: 814448 - RNA, 22 nt, Mycobacterium avium subsp. paratuberculosis
cgaacucaccgguggccgcguc

SEQ ID NO: 814449 - RNA, 23 nt, Mycobacterium avium subsp. paratuberculosis
cgaacucaccgguggccgcgucg

SEQ ID NO: 814450 - RNA, 16 nt, Mycobacterium avium subsp. paratuberculosis
cgaacgucucgcggga

SEQ ID NO: 814451 - RNA, 17 nt, Mycobacterium avium subsp. paratuberculosis
cgaacgucgagcgcggc

SEQ ID NO: 814452 - RNA, 20 nt, Mycobacterium avium subsp. paratuberculosis
cgaacgucgagcgcggcccg

SEQ ID NO: 814453 - RNA, 21 nt, Mycobacterium avium subsp. paratuberculosis
cgaacgucgaugucacguuga

SEQ ID NO: 814454 - RNA, 14 nt, Mycobacterium avium subsp. paratuberculosis
cgaacgugcgcggc

SEQ ID NO: 814455 - RNA, 15 nt, Mycobacterium avium subsp. paratuberculosis
cgaacgugcgcggcg

SEQ ID NO: 814456 - RNA, 17 nt, Mycobacterium avium subsp. paratuberculosis
cgaacgugcgcggcgcg

SEQ ID NO: 814457 - RNA, 13 nt, Mycobacterium avium subsp. paratuberculosis
cgaacuccgccga

SEQ ID NO: 814458 - RNA, 16 nt, Mycobacterium avium subsp. paratuberculosis
cgaacucggcgccgcc

SEQ ID NO: 814459 - RNA, 18 nt, Mycobacterium avium subsp. paratuberculosis
cgaacucggcgccgccgg

SEQ ID NO: 814460 - RNA, 15 nt, Mycobacterium avium subsp. paratuberculosis
cgaacucgggcccga

SEQ ID NO: 814461 - RNA, 18 nt, Mycobacterium avium subsp. paratuberculosis
cgaacucgucgacgccca

SEQ ID NO: 814462 - RNA, 13 nt, Mycobacterium avium subsp. paratuberculosis
cgaacucgucgau

SEQ ID NO: 814463 - RNA, 20 nt, Mycobacterium avium subsp. paratuberculosis
cgaacucucccaggacagcu

SEQ ID NO: 814464 - RNA, 15 nt, Mycobacterium avium subsp. paratuberculosis
cgaacuccgagccgg

SEQ ID NO: 814465 - RNA, 17 nt, Mycobacterium avium subsp. paratuberculosis
cgaacuccauccgccgu

SEQ ID NO: 814466 - RNA, 12 nt, Mycobacterium avium subsp. paratuberculosis
cgaacuccgcgc

SEQ ID NO: 814467 - RNA, 21 nt, Mycobacterium avium subsp. paratuberculosis
cgaacuccugcucgcgggcca

SEQ ID NO: 814468 - RNA, 16 nt, Mycobacterium avium subsp. paratuberculosis
cgaacuccuugacccg

SEQ ID NO: 814469 - RNA, 21 nt, Mycobacterium avium subsp. paratuberculosis
cgaacuccuugacccggccca

SEQ ID NO: 814470 - RNA, 23 nt, Mycobacterium avium subsp. paratuberculosis
cgaacuccuugacccggcccauc

SEQ ID NO: 814471 - RNA, 19 nt, Mycobacterium avium subsp. paratuberculosis
cgaacgucaccaacaugau

SEQ ID NO: 814472 - RNA, 15 nt, Mycobacterium avium subsp. paratuberculosis
cgaacgucacggcga

SEQ ID NO: 814473 - RNA, 17 nt, Mycobacterium avium subsp. paratuberculosis
cgaacggcaccucgauc

SEQ ID NO: 814474 - RNA, 18 nt, Mycobacterium avium subsp. paratuberculosis
cgaacgggugaccggcgg

SEQ ID NO: 814475 - RNA, 14 nt, Mycobacterium avium subsp. paratuberculosis
cgaacgggugcggc

SEQ ID NO: 814476 - RNA, 17 nt, Mycobacterium avium subsp. paratuberculosis
cgaacgggugcggcgcu

SEQ ID NO: 814477 - RNA, 20 nt, Mycobacterium avium subsp. paratuberculosis
cgaacggcaaccugggcggc

SEQ ID NO: 814478 - RNA, 18 nt, Mycobacterium avium subsp. paratuberculosis
cgaacggcaacggcggcg

SEQ ID NO: 814479 - RNA, 15 nt, Mycobacterium avium subsp. paratuberculosis
cgaacggaccgggcg

SEQ ID NO: 814480 - RNA, 15 nt, Mycobacterium avium subsp. paratuberculosis
cgaacgcuggcggcg

SEQ ID NO: 814481 - RNA, 18 nt, Mycobacterium avium subsp. paratuberculosis
cgaaccuggcugccuggu

SEQ ID NO: 814482 - RNA, 21 nt, Mycobacterium avium subsp. paratuberculosis
cgaaccuggcugccugguugg

SEQ ID NO: 814483 - RNA, 23 nt, Mycobacterium avium subsp. paratuberculosis
cgaacgcgucccgggccuuggcc

SEQ ID NO: 814484 - RNA, 19 nt, Mycobacterium avium subsp. paratuberculosis
cgaacgcggccgccagcgc

SEQ ID NO: 814485 - RNA, 17 nt, Mycobacterium avium subsp. paratuberculosis
cgaacgcggccgccauc

SEQ ID NO: 814486 - RNA, 20 nt, Mycobacterium avium subsp. paratuberculosis
cgaacgcggccgccaucgau

SEQ ID NO: 814487 - RNA, 15 nt, Mycobacterium avium subsp. paratuberculosis
cgaacgcggcgaaca

SEQ ID NO: 814488 - RNA, 17 nt, Mycobacterium avium subsp. paratuberculosis
cgaacgcggcgaacacc

SEQ ID NO: 814489 - RNA, 23 nt, Mycobacterium avium subsp. paratuberculosis
cgaacgcggcgaacaccucggcg

SEQ ID NO: 814490 - RNA, 16 nt, Mycobacterium avium subsp. paratuberculosis
cgaacgcggcgccgac

SEQ ID NO: 814491 - RNA, 12 nt, Mycobacterium avium subsp. paratuberculosis
cgaacgcggcgg

SEQ ID NO: 814492 - RNA, 13 nt, Mycobacterium avium subsp. paratuberculosis
cgaacgcggcuga

SEQ ID NO: 814493 - RNA, 15 nt, Mycobacterium avium subsp. paratuberculosis
cgaacgcggcugauc

SEQ ID NO: 814494 - RNA, 22 nt, Mycobacterium avium subsp. paratuberculosis
cgaacgcggcugaucagccggc

SEQ ID NO: 814495 - RNA, 20 nt, Mycobacterium avium subsp. paratuberculosis
cgaacgcgguuuugaugccg

SEQ ID NO: 814496 - RNA, 22 nt, Mycobacterium avium subsp. paratuberculosis
cgaacgcgguuuugaugccgcc

SEQ ID NO: 814497 - RNA, 16 nt, Mycobacterium avium subsp. paratuberculosis
cgaacgcguacacggc

SEQ ID NO: 814498 - RNA, 20 nt, Mycobacterium avium subsp. paratuberculosis
cgaacgcguacacggcccgc

SEQ ID NO: 814499 - RNA, 16 nt, Mycobacterium avium subsp. paratuberculosis
ccuugcagcacaccgg

SEQ ID NO: 814500 - RNA, 14 nt, Mycobacterium avium subsp. paratuberculosis
ccuugccccaccac

SEQ ID NO: 814501 - RNA, 15 nt, Mycobacterium avium subsp. paratuberculosis
ccuugccccaccacc

SEQ ID NO: 814502 - RNA, 20 nt, Mycobacterium avium subsp. paratuberculosis
ccuugccccaccaccgccgg

SEQ ID NO: 814503 - RNA, 21 nt, Mycobacterium avium subsp. paratuberculosis
ccuugccccaccaccgccggc

SEQ ID NO: 814504 - RNA, 17 nt, Mycobacterium avium subsp. paratuberculosis
ccuugcccggcucggug

SEQ ID NO: 814505 - RNA, 17 nt, Mycobacterium avium subsp. paratuberculosis
ccuugccgaugccggcg

SEQ ID NO: 814506 - RNA, 15 nt, Mycobacterium avium subsp. paratuberculosis
ccuugaucucgucgc

SEQ ID NO: 814507 - RNA, 11 nt, Mycobacterium avium subsp. paratuberculosis
ccuugauccgg

SEQ ID NO: 814508 - RNA, 15 nt, Mycobacterium avium subsp. paratuberculosis
ccuugauccggccgc

SEQ ID NO: 814509 - RNA, 13 nt, Mycobacterium avium subsp. paratuberculosis
ccuugauccgggc

SEQ ID NO: 814510 - RNA, 12 nt, Mycobacterium avium subsp. paratuberculosis
ccuugagccggu

SEQ ID NO: 814511 - RNA, 20 nt, Mycobacterium avium subsp. paratuberculosis
ccuugagccgguccgacggc

SEQ ID NO: 814512 - RNA, 14 nt, Mycobacterium avium subsp. paratuberculosis
ccuugaccagcugc

SEQ ID NO: 814513 - RNA, 19 nt, Mycobacterium avium subsp. paratuberculosis
ccuugacgacggccaccgc

SEQ ID NO: 814514 - RNA, 21 nt, Mycobacterium avium subsp. paratuberculosis
ccuugaccgccuuggccacgu

SEQ ID NO: 814515 - RNA, 14 nt, Mycobacterium avium subsp. paratuberculosis
ccuugacccggccg

SEQ ID NO: 814516 - RNA, 16 nt, Mycobacterium avium subsp. paratuberculosis
ccuugaccacggugcg

SEQ ID NO: 814517 - RNA, 16 nt, Mycobacterium avium subsp. paratuberculosis
ccuugagcuccgguga

SEQ ID NO: 814518 - RNA, 16 nt, Mycobacterium avium subsp. paratuberculosis
ccuugagcuucccggc

SEQ ID NO: 814519 - RNA, 19 nt, Mycobacterium avium subsp. paratuberculosis
ccuugagcuucccggcggu

SEQ ID NO: 814520 - RNA, 20 nt, Mycobacterium avium subsp. paratuberculosis
ccuugagcuucccggcgguc

SEQ ID NO: 814521 - RNA, 16 nt, Mycobacterium avium subsp. paratuberculosis
ccuugaccaccgagcc

SEQ ID NO: 814522 - RNA, 23 nt, Mycobacterium avium subsp. paratuberculosis
ccuugaccaccgagccgggcagc

SEQ ID NO: 814523 - RNA, 15 nt, Mycobacterium avium subsp. paratuberculosis
ccuucggagacgugg

SEQ ID NO: 814524 - RNA, 16 nt, Mycobacterium avium subsp. paratuberculosis
ccuucggcgccagccc

SEQ ID NO: 814525 - RNA, 17 nt, Mycobacterium avium subsp. paratuberculosis
ccuucggcgccagcccg

SEQ ID NO: 814526 - RNA, 14 nt, Mycobacterium avium subsp. paratuberculosis
ccuucggcgcccgc

SEQ ID NO: 814527 - RNA, 19 nt, Mycobacterium avium subsp. paratuberculosis
ccuucggcgcccgcuccgg

SEQ ID NO: 814528 - RNA, 22 nt, Mycobacterium avium subsp. paratuberculosis
ccuucacgcuggccuccagcuu

SEQ ID NO: 814529 - RNA, 14 nt, Mycobacterium avium subsp. paratuberculosis
ccuucagcgggcgc

SEQ ID NO: 814530 - RNA, 22 nt, Mycobacterium avium subsp. paratuberculosis
ccuucagcgggcgcagcucguc

SEQ ID NO: 814531 - RNA, 19 nt, Mycobacterium avium subsp. paratuberculosis
ccuucaccagggugccccg

SEQ ID NO: 814532 - RNA, 21 nt, Mycobacterium avium subsp. paratuberculosis
ccuucaucgccgucgccaccg

SEQ ID NO: 814533 - RNA, 15 nt, Mycobacterium avium subsp. paratuberculosis
ccuucggccggcagc

SEQ ID NO: 814534 - RNA, 17 nt, Mycobacterium avium subsp. paratuberculosis
ccuucggccggcagcgg

SEQ ID NO: 814535 - RNA, 22 nt, Mycobacterium avium subsp. paratuberculosis
ccuucgcggucggcaacccgac

SEQ ID NO: 814536 - RNA, 14 nt, Mycobacterium avium subsp. paratuberculosis
ccuucgcggugugc

SEQ ID NO: 814537 - RNA, 20 nt, Mycobacterium avium subsp. paratuberculosis
ccuuccaccaccgcggcgcc

SEQ ID NO: 814538 - RNA, 23 nt, Mycobacterium avium subsp. paratuberculosis
ccuuccaccaccgcggcgccguc

SEQ ID NO: 814539 - RNA, 15 nt, Mycobacterium avium subsp. paratuberculosis
ccuucgaugucgccg

SEQ ID NO: 814540 - RNA, 15 nt, Mycobacterium avium subsp. paratuberculosis
ccuucaccgcgccgg

SEQ ID NO: 814541 - RNA, 14 nt, Mycobacterium avium subsp. paratuberculosis
ccuguccgaucacc

SEQ ID NO: 814542 - RNA, 19 nt, Mycobacterium avium subsp. paratuberculosis
ccugucaguuugcgcgacg

SEQ ID NO: 814543 - RNA, 18 nt, Mycobacterium avium subsp. paratuberculosis
ccuguagggcgagcucgu

SEQ ID NO: 814544 - RNA, 21 nt, Mycobacterium avium subsp. paratuberculosis
ccugucaacgagacacccucg

SEQ ID NO: 814545 - RNA, 14 nt, Mycobacterium avium subsp. paratuberculosis
cgaaaaacgcgucg

SEQ ID NO: 814546 - RNA, 15 nt, Mycobacterium avium subsp. paratuberculosis
cgaaaaccagcaccg

SEQ ID NO: 814547 - RNA, 17 nt, Mycobacterium avium subsp. paratuberculosis
ccuugcuggcggccuuc

SEQ ID NO: 814548 - RNA, 21 nt, Mycobacterium avium subsp. paratuberculosis
ccuuggacgaaacccggcgga

SEQ ID NO: 814549 - RNA, 19 nt, Mycobacterium avium subsp. paratuberculosis
ccuugcugauccccagcgg

SEQ ID NO: 814550 - RNA, 14 nt, Mycobacterium avium subsp. paratuberculosis
ccuugcugacgccg

SEQ ID NO: 814551 - RNA, 19 nt, Mycobacterium avium subsp. paratuberculosis
ccuugcugacgccgcggug

SEQ ID NO: 814552 - RNA, 15 nt, Mycobacterium avium subsp. paratuberculosis
ccuugcugagccggc

SEQ ID NO: 814553 - RNA, 19 nt, Mycobacterium avium subsp. paratuberculosis
ccuugcugagccggcccug

SEQ ID NO: 814554 - RNA, 18 nt, Mycobacterium avium subsp. paratuberculosis
cgaaaauggcugcccggc

SEQ ID NO: 814555 - RNA, 12 nt, Mycobacterium avium subsp. paratuberculosis
cgaaacccggcg

SEQ ID NO: 814556 - RNA, 18 nt, Mycobacterium avium subsp. paratuberculosis
cgaaaccggucaacggcu

SEQ ID NO: 814557 - RNA, 19 nt, Mycobacterium avium subsp. paratuberculosis
cgaaaccgucuccggcgcg

SEQ ID NO: 814558 - RNA, 18 nt, Mycobacterium avium subsp. paratuberculosis
cgaaauccacgaugccgg

SEQ ID NO: 814559 - RNA, 22 nt, Mycobacterium avium subsp. paratuberculosis
cgaaauccacgaugccgggcac

SEQ ID NO: 814560 - RNA, 14 nt, Mycobacterium avium subsp. paratuberculosis
cgaaauagcggcgc

SEQ ID NO: 814561 - RNA, 15 nt, Mycobacterium avium subsp. paratuberculosis
cgaaauagcggcgca

SEQ ID NO: 814562 - RNA, 22 nt, Mycobacterium avium subsp. paratuberculosis
cgaaauagcggcgcaccuggcg

SEQ ID NO: 814563 - RNA, 15 nt, Mycobacterium avium subsp. paratuberculosis
cgaaaucaacgcgcc

SEQ ID NO: 814564 - RNA, 19 nt, Mycobacterium avium subsp. paratuberculosis
cgaaaucaacgcgccgaac

SEQ ID NO: 814565 - RNA, 19 nt, Mycobacterium avium subsp. paratuberculosis
cgaaagugcaacugccgac

SEQ ID NO: 814566 - RNA, 20 nt, Mycobacterium avium subsp. paratuberculosis
cgaaagugcaacuggcaacg

SEQ ID NO: 814567 - RNA, 19 nt, Mycobacterium avium subsp. paratuberculosis
cgaaagugcuacugccgac

SEQ ID NO: 814568 - RNA, 20 nt, Mycobacterium avium subsp. paratuberculosis
cgaaagugcuacugccgacg

SEQ ID NO: 814569 - RNA, 21 nt, Mycobacterium avium subsp. paratuberculosis
cgaaagguuuucccggccgcc

SEQ ID NO: 814570 - RNA, 22 nt, Mycobacterium avium subsp. paratuberculosis
cgaaagguuuucccggccgccg

SEQ ID NO: 814571 - RNA, 14 nt, Mycobacterium avium subsp. paratuberculosis
cgaaaggcccaccg

SEQ ID NO: 814572 - RNA, 17 nt, Mycobacterium avium subsp. paratuberculosis
cgaaaccuugaucggcc

SEQ ID NO: 814573 - RNA, 18 nt, Mycobacterium avium subsp. paratuberculosis
cgaaagccuccgcgauca

SEQ ID NO: 814574 - RNA, 14 nt, Mycobacterium avium subsp. paratuberculosis
ccugguuucaggug

SEQ ID NO: 814575 - RNA, 18 nt, Mycobacterium avium subsp. paratuberculosis
ccugguugacaccaccga

SEQ ID NO: 814576 - RNA, 15 nt, Mycobacterium avium subsp. paratuberculosis
ccugguuggcccgca

SEQ ID NO: 814577 - RNA, 17 nt, Mycobacterium avium subsp. paratuberculosis
ccugguuggcccgcacc

SEQ ID NO: 814578 - RNA, 19 nt, Mycobacterium avium subsp. paratuberculosis
ccugguuggcccgcaccac

SEQ ID NO: 814579 - RNA, 21 nt, Mycobacterium avium subsp. paratuberculosis
ccugguugacgcccccgguga

SEQ ID NO: 814580 - RNA, 17 nt, Mycobacterium avium subsp. paratuberculosis
ccugguugagcaccgcg

SEQ ID NO: 814581 - RNA, 16 nt, Mycobacterium avium subsp. paratuberculosis
ccugguugagugccgu

SEQ ID NO: 814582 - RNA, 17 nt, Mycobacterium avium subsp. paratuberculosis
ccugguugagugccguc

SEQ ID NO: 814583 - RNA, 14 nt, Mycobacterium avium subsp. paratuberculosis
ccuggucggucagc

SEQ ID NO: 814584 - RNA, 14 nt, Mycobacterium avium subsp. paratuberculosis
ccuggucggccggc

SEQ ID NO: 814585 - RNA, 12 nt, Mycobacterium avium subsp. paratuberculosis
ccuggucggcga

SEQ ID NO: 814586 - RNA, 20 nt, Mycobacterium avium subsp. paratuberculosis
ccuggucggccagggcgugg

SEQ ID NO: 814587 - RNA, 12 nt, Mycobacterium avium subsp. paratuberculosis
ccuggucggccg

SEQ ID NO: 814588 - RNA, 16 nt, Mycobacterium avium subsp. paratuberculosis
ccuggugaccgacgac

SEQ ID NO: 814589 - RNA, 20 nt, Mycobacterium avium subsp. paratuberculosis
ccuggugaugaaucgucccg

SEQ ID NO: 814590 - RNA, 14 nt, Mycobacterium avium subsp. paratuberculosis
ccuggugcaacacc

SEQ ID NO: 814591 - RNA, 14 nt, Mycobacterium avium subsp. paratuberculosis
ccuggucgccgccg

SEQ ID NO: 814592 - RNA, 21 nt, Mycobacterium avium subsp. paratuberculosis
ccuggucgaacagcacgccgg

SEQ ID NO: 814593 - RNA, 11 nt, Mycobacterium avium subsp. paratuberculosis
ccugguccggc

SEQ ID NO: 814594 - RNA, 18 nt, Mycobacterium avium subsp. paratuberculosis
ccuggucaaggugcugaa

SEQ ID NO: 814595 - RNA, 15 nt, Mycobacterium avium subsp. paratuberculosis
ccugguccaccgcgg

SEQ ID NO: 814596 - RNA, 20 nt, Mycobacterium avium subsp. paratuberculosis
ccugguccaccgcggcggcc

SEQ ID NO: 814597 - RNA, 17 nt, Mycobacterium avium subsp. paratuberculosis
ccuggggcagaucgucg

SEQ ID NO: 814598 - RNA, 22 nt, Mycobacterium avium subsp. paratuberculosis
ccugggcggcgacacgccgacg

SEQ ID NO: 814599 - RNA, 13 nt, Mycobacterium avium subsp. paratuberculosis
ccugggcgucguc

SEQ ID NO: 814600 - RNA, 16 nt, Mycobacterium avium subsp. paratuberculosis
ccugggccucguccag

SEQ ID NO: 814601 - RNA, 12 nt, Mycobacterium avium subsp. paratuberculosis
ccugggacagcc

SEQ ID NO: 814602 - RNA, 18 nt, Mycobacterium avium subsp. paratuberculosis
ccugggacagccggucga

SEQ ID NO: 814603 - RNA, 20 nt, Mycobacterium avium subsp. paratuberculosis
ccugggacagccggucgacg

SEQ ID NO: 814604 - RNA, 16 nt, Mycobacterium avium subsp. paratuberculosis
ccugggacagcgagaa

SEQ ID NO: 814605 - RNA, 21 nt, Mycobacterium avium subsp. paratuberculosis
ccugggaugucuagccgccga

SEQ ID NO: 814606 - RNA, 22 nt, Mycobacterium avium subsp. paratuberculosis
ccugggaugucuagccgccgag

SEQ ID NO: 814607 - RNA, 13 nt, Mycobacterium avium subsp. paratuberculosis
ccugggauugccg

SEQ ID NO: 814608 - RNA, 22 nt, Mycobacterium avium subsp. paratuberculosis
ccugggauugccgggcaccagc

SEQ ID NO: 814609 - RNA, 21 nt, Mycobacterium avium subsp. paratuberculosis
ccugggugagcggcgcgucca

SEQ ID NO: 814610 - RNA, 20 nt, Mycobacterium avium subsp. paratuberculosis
ccugggugaguucgucggcg

SEQ ID NO: 814611 - RNA, 19 nt, Mycobacterium avium subsp. paratuberculosis
ccugggugaucuuggugaa

SEQ ID NO: 814612 - RNA, 19 nt, Mycobacterium avium subsp. paratuberculosis
ccugggugcgcggcgccgu

SEQ ID NO: 814613 - RNA, 20 nt, Mycobacterium avium subsp. paratuberculosis
ccugggucucgggaucgccg

SEQ ID NO: 814614 - RNA, 17 nt, Mycobacterium avium subsp. paratuberculosis
ccugggucugcggccgg

SEQ ID NO: 814615 - RNA, 15 nt, Mycobacterium avium subsp. paratuberculosis
ccugggggucgguga

SEQ ID NO: 814616 - RNA, 19 nt, Mycobacterium avium subsp. paratuberculosis
ccuggguaagccaggucac

SEQ ID NO: 814617 - RNA, 15 nt, Mycobacterium avium subsp. paratuberculosis
ccugguagcugagca

SEQ ID NO: 814618 - RNA, 15 nt, Mycobacterium avium subsp. paratuberculosis
ccugguacgcgccgu

SEQ ID NO: 814619 - RNA, 16 nt, Mycobacterium avium subsp. paratuberculosis
ccugguacgcgccguc

SEQ ID NO: 814620 - RNA, 20 nt, Mycobacterium avium subsp. paratuberculosis
ccugcccggucugcggccgc

SEQ ID NO: 814621 - RNA, 16 nt, Mycobacterium avium subsp. paratuberculosis
ccugcccgucgggcgc

SEQ ID NO: 814622 - RNA, 13 nt, Mycobacterium avium subsp. paratuberculosis
ccugccgccaccg

SEQ ID NO: 814623 - RNA, 14 nt, Mycobacterium avium subsp. paratuberculosis
ccugccgccaccgc

SEQ ID NO: 814624 - RNA, 21 nt, Mycobacterium avium subsp. paratuberculosis
ccugccggaugccgcgcggcg

SEQ ID NO: 814625 - RNA, 12 nt, Mycobacterium avium subsp. paratuberculosis
ccugccggcgcc

SEQ ID NO: 814626 - RNA, 14 nt, Mycobacterium avium subsp. paratuberculosis
ccugccggcgccgg

SEQ ID NO: 814627 - RNA, 15 nt, Mycobacterium avium subsp. paratuberculosis
ccugccggcgccgga

SEQ ID NO: 814628 - RNA, 13 nt, Mycobacterium avium subsp. paratuberculosis
ccugccgggcguc

SEQ ID NO: 814629 - RNA, 16 nt, Mycobacterium avium subsp. paratuberculosis
ccugccggcgaucacc

SEQ ID NO: 814630 - RNA, 14 nt, Mycobacterium avium subsp. paratuberculosis
ccugccggccgccg

SEQ ID NO: 814631 - RNA, 15 nt, Mycobacterium avium subsp. paratuberculosis
ccuggccggacgggu

SEQ ID NO: 814632 - RNA, 15 nt, Mycobacterium avium subsp. paratuberculosis
ccuggccggccaucu

SEQ ID NO: 814633 - RNA, 20 nt, Mycobacterium avium subsp. paratuberculosis
ccuggccgccggccgcgcag

SEQ ID NO: 814634 - RNA, 12 nt, Mycobacterium avium subsp. paratuberculosis
ccuggccgccgg

SEQ ID NO: 814635 - RNA, 18 nt, Mycobacterium avium subsp. paratuberculosis
ccuggcccccgccccagc

SEQ ID NO: 814636 - RNA, 23 nt, Mycobacterium avium subsp. paratuberculosis
ccuggcccccgccccagcccggc

SEQ ID NO: 814637 - RNA, 22 nt, Mycobacterium avium subsp. paratuberculosis
ccuggccccagaaccgcucggc

SEQ ID NO: 814638 - RNA, 14 nt, Mycobacterium avium subsp. paratuberculosis
ccuggcccuugacc

SEQ ID NO: 814639 - RNA, 17 nt, Mycobacterium avium subsp. paratuberculosis
ccuggcccuugaccgcc

SEQ ID NO: 814640 - RNA, 15 nt, Mycobacterium avium subsp. paratuberculosis
ccugccgucaccggc

SEQ ID NO: 814641 - RNA, 17 nt, Mycobacterium avium subsp. paratuberculosis
ccuggcggaaggccgcg

SEQ ID NO: 814642 - RNA, 18 nt, Mycobacterium avium subsp. paratuberculosis
ccuggcgggccagcuugu

SEQ ID NO: 814643 - RNA, 12 nt, Mycobacterium avium subsp. paratuberculosis
ccuggcgggcgg

SEQ ID NO: 814644 - RNA, 15 nt, Mycobacterium avium subsp. paratuberculosis
ccuggcuguagcggu

SEQ ID NO: 814645 - RNA, 15 nt, Mycobacterium avium subsp. paratuberculosis
ccuggcugacggcgu

SEQ ID NO: 814646 - RNA, 16 nt, Mycobacterium avium subsp. paratuberculosis
ccuggcugacggcguc

SEQ ID NO: 814647 - RNA, 16 nt, Mycobacterium avium subsp. paratuberculosis
ccuggcgguggcccgg

SEQ ID NO: 814648 - RNA, 14 nt, Mycobacterium avium subsp. paratuberculosis
ccuggcuccccggc

SEQ ID NO: 814649 - RNA, 21 nt, Mycobacterium avium subsp. paratuberculosis
ccuggcuccccggcgaucucg

SEQ ID NO: 814650 - RNA, 18 nt, Mycobacterium avium subsp. paratuberculosis
ccuggcgcaccgccgcgg

SEQ ID NO: 814651 - RNA, 19 nt, Mycobacterium avium subsp. paratuberculosis
ccuggcgcaccgccgcggg

SEQ ID NO: 814652 - RNA, 15 nt, Mycobacterium avium subsp. paratuberculosis
ccuggcgcagcaccg

SEQ ID NO: 814653 - RNA, 18 nt, Mycobacterium avium subsp. paratuberculosis
ccuggcgcuggugcagca

SEQ ID NO: 814654 - RNA, 14 nt, Mycobacterium avium subsp. paratuberculosis
ccuggccgucgcgg

SEQ ID NO: 814655 - RNA, 14 nt, Mycobacterium avium subsp. paratuberculosis
ccuggccgucggug

SEQ ID NO: 814656 - RNA, 19 nt, Mycobacterium avium subsp. paratuberculosis
ccuggccuggucggccggc

SEQ ID NO: 814657 - RNA, 15 nt, Mycobacterium avium subsp. paratuberculosis
ccuggcgaaccgcgg

SEQ ID NO: 814658 - RNA, 18 nt, Mycobacterium avium subsp. paratuberculosis
ccuggcgaaccgcggcgg

SEQ ID NO: 814659 - RNA, 13 nt, Mycobacterium avium subsp. paratuberculosis
cgauucaucgccg

SEQ ID NO: 814660 - RNA, 16 nt, Mycobacterium avium subsp. paratuberculosis
cgauucaucgccgaac

SEQ ID NO: 814661 - RNA, 18 nt, Mycobacterium avium subsp. paratuberculosis
cgauucaucgccgaaccg

SEQ ID NO: 814662 - RNA, 22 nt, Mycobacterium avium subsp. paratuberculosis
cgauucgguaccagggcagcgc

SEQ ID NO: 814663 - RNA, 23 nt, Mycobacterium avium subsp. paratuberculosis
cgauucgguaccagggcagcgcc

SEQ ID NO: 814664 - RNA, 22 nt, Mycobacterium avium subsp. paratuberculosis
cgauugcaccaccgucuugccg

SEQ ID NO: 814665 - RNA, 22 nt, Mycobacterium avium subsp. paratuberculosis
cgauguugaucgccaugcuggc

SEQ ID NO: 814666 - RNA, 15 nt, Mycobacterium avium subsp. paratuberculosis
cgauguucaccccga

SEQ ID NO: 814667 - RNA, 14 nt, Mycobacterium avium subsp. paratuberculosis
cgauucagccggcg

SEQ ID NO: 814668 - RNA, 15 nt, Mycobacterium avium subsp. paratuberculosis
cgauucagccggcgg

SEQ ID NO: 814669 - RNA, 17 nt, Mycobacterium avium subsp. paratuberculosis
cgauucacccagcgagc

SEQ ID NO: 814670 - RNA, 23 nt, Mycobacterium avium subsp. paratuberculosis
cgauuaggucgguggccaccacc

SEQ ID NO: 814671 - RNA, 14 nt, Mycobacterium avium subsp. paratuberculosis
cgcaacgccggcgu

SEQ ID NO: 814672 - RNA, 15 nt, Mycobacterium avium subsp. paratuberculosis
cgcaacgccggcgug

SEQ ID NO: 814673 - RNA, 22 nt, Mycobacterium avium subsp. paratuberculosis
cgcaacgccggcgugcacaggc

SEQ ID NO: 814674 - RNA, 15 nt, Mycobacterium avium subsp. paratuberculosis
cgcaacgcgcgcgac

SEQ ID NO: 814675 - RNA, 14 nt, Mycobacterium avium subsp. paratuberculosis
cgcaacgcggcggu

SEQ ID NO: 814676 - RNA, 16 nt, Mycobacterium avium subsp. paratuberculosis
cgcaacgcugaccgca

SEQ ID NO: 814677 - RNA, 19 nt, Mycobacterium avium subsp. paratuberculosis
cgcaacgcuuucgggucga

SEQ ID NO: 814678 - RNA, 13 nt, Mycobacterium avium subsp. paratuberculosis
cgcaacggcgcaa

SEQ ID NO: 814679 - RNA, 15 nt, Mycobacterium avium subsp. paratuberculosis
cgcaacggcggucgu

SEQ ID NO: 814680 - RNA, 22 nt, Mycobacterium avium subsp. paratuberculosis
cgcaacggcggucgugcggcug

SEQ ID NO: 814681 - RNA, 23 nt, Mycobacterium avium subsp. paratuberculosis
cgcaacggcggucgugcggcugc

SEQ ID NO: 814682 - RNA, 15 nt, Mycobacterium avium subsp. paratuberculosis
cgcaacggcgucgac

SEQ ID NO: 814683 - RNA, 23 nt, Mycobacterium avium subsp. paratuberculosis
cgcaacggcgucgacacccgggc

SEQ ID NO: 814684 - RNA, 22 nt, Mycobacterium avium subsp. paratuberculosis
cgcaacagguuucgcucgucgg

SEQ ID NO: 814685 - RNA, 12 nt, Mycobacterium avium subsp. paratuberculosis
cgcaacgagcug

SEQ ID NO: 814686 - RNA, 13 nt, Mycobacterium avium subsp. paratuberculosis
cgcaacgagcuga

SEQ ID NO: 814687 - RNA, 15 nt, Mycobacterium avium subsp. paratuberculosis
cgcaacgagcugacg

SEQ ID NO: 814688 - RNA, 22 nt, Mycobacterium avium subsp. paratuberculosis
cgcaacgagcugacgaacgcgc

SEQ ID NO: 814689 - RNA, 16 nt, Mycobacterium avium subsp. paratuberculosis
cgcaacgaggcggugg

SEQ ID NO: 814690 - RNA, 23 nt, Mycobacterium avium subsp. paratuberculosis
cgcaacgaggcgguggugaugga

SEQ ID NO: 814691 - RNA, 21 nt, Mycobacterium avium subsp. paratuberculosis
cgcaacgauucacccagcgag

SEQ ID NO: 814692 - RNA, 18 nt, Mycobacterium avium subsp. paratuberculosis
cgcaacaccacgucggug

SEQ ID NO: 814693 - RNA, 20 nt, Mycobacterium avium subsp. paratuberculosis
cgcaacaccacgucggugcc

SEQ ID NO: 814694 - RNA, 15 nt, Mycobacterium avium subsp. paratuberculosis
cgcaacaccagcacg

SEQ ID NO: 814695 - RNA, 13 nt, Mycobacterium avium subsp. paratuberculosis
cgcaacaccgaaa

SEQ ID NO: 814696 - RNA, 18 nt, Mycobacterium avium subsp. paratuberculosis
cgcaacacggccucgauc

SEQ ID NO: 814697 - RNA, 20 nt, Mycobacterium avium subsp. paratuberculosis
cgcaacagcauuucgcgcgg

SEQ ID NO: 814698 - RNA, 16 nt, Mycobacterium avium subsp. paratuberculosis
cgcaacagccggcccg

SEQ ID NO: 814699 - RNA, 17 nt, Mycobacterium avium subsp. paratuberculosis
cgcaacagccggcccga

SEQ ID NO: 814700 - RNA, 13 nt, Mycobacterium avium subsp. paratuberculosis
cgauuucgggauc

SEQ ID NO: 814701 - RNA, 17 nt, Mycobacterium avium subsp. paratuberculosis
cgauuucgucggcggug

SEQ ID NO: 814702 - RNA, 19 nt, Mycobacterium avium subsp. paratuberculosis
cgauuucgccugcagccgc

SEQ ID NO: 814703 - RNA, 13 nt, Mycobacterium avium subsp. paratuberculosis
cgcaaagcaccgc

SEQ ID NO: 814704 - RNA, 14 nt, Mycobacterium avium subsp. paratuberculosis
cgauguaccaggcc

SEQ ID NO: 814705 - RNA, 23 nt, Mycobacterium avium subsp. paratuberculosis
cgauguagccgggcucgagcacc

SEQ ID NO: 814706 - RNA, 23 nt, Mycobacterium avium subsp. paratuberculosis
cgauguagcggacgggccgcauc

SEQ ID NO: 814707 - RNA, 19 nt, Mycobacterium avium subsp. paratuberculosis
cgauguaggacaggucgcg

SEQ ID NO: 814708 - RNA, 15 nt, Mycobacterium avium subsp. paratuberculosis
cgauguaggacgccg

SEQ ID NO: 814709 - RNA, 21 nt, Mycobacterium avium subsp. paratuberculosis
cgauguaggacgccgcaccgc

SEQ ID NO: 814710 - RNA, 13 nt, Mycobacterium avium subsp. paratuberculosis
cgaugugggccgc

SEQ ID NO: 814711 - RNA, 21 nt, Mycobacterium avium subsp. paratuberculosis
cgauguggguggucagcgcgg

SEQ ID NO: 814712 - RNA, 18 nt, Mycobacterium avium subsp. paratuberculosis
cgauguggacgaugcggg

SEQ ID NO: 814713 - RNA, 15 nt, Mycobacterium avium subsp. paratuberculosis
cgauguggccggcga

SEQ ID NO: 814714 - RNA, 14 nt, Mycobacterium avium subsp. paratuberculosis
cgaugugcucgauc

SEQ ID NO: 814715 - RNA, 23 nt, Mycobacterium avium subsp. paratuberculosis
cgauguguaacaacucgccggag

SEQ ID NO: 814716 - RNA, 20 nt, Mycobacterium avium subsp. paratuberculosis
cgaugugccacuucgacggc

SEQ ID NO: 814717 - RNA, 13 nt, Mycobacterium avium subsp. paratuberculosis
cgaugugaucgcg

SEQ ID NO: 814718 - RNA, 17 nt, Mycobacterium avium subsp. paratuberculosis
cgaugugaucggcggcc

SEQ ID NO: 814719 - RNA, 18 nt, Mycobacterium avium subsp. paratuberculosis
cgaugugaucggcggcca

SEQ ID NO: 814720 - RNA, 23 nt, Mycobacterium avium subsp. paratuberculosis
cgaugugaucggcggccaccagc

SEQ ID NO: 814721 - RNA, 14 nt, Mycobacterium avium subsp. paratuberculosis
cgaugugcgcgcug

SEQ ID NO: 814722 - RNA, 21 nt, Mycobacterium avium subsp. paratuberculosis
cgaugugcucggucaacccga

SEQ ID NO: 814723 - RNA, 23 nt, Mycobacterium avium subsp. paratuberculosis
cgaugugcucggucaacccgauc

SEQ ID NO: 814724 - RNA, 17 nt, Mycobacterium avium subsp. paratuberculosis
cgaugggcgcgaucagg

SEQ ID NO: 814725 - RNA, 16 nt, Mycobacterium avium subsp. paratuberculosis
cgauggggacgucgac

SEQ ID NO: 814726 - RNA, 18 nt, Mycobacterium avium subsp. paratuberculosis
cgauggggauggugcgcc

SEQ ID NO: 814727 - RNA, 19 nt, Mycobacterium avium subsp. paratuberculosis
cgauggggauggugcgccg

SEQ ID NO: 814728 - RNA, 22 nt, Mycobacterium avium subsp. paratuberculosis
cgauggggauggugcgccgggu

SEQ ID NO: 814729 - RNA, 19 nt, Mycobacterium avium subsp. paratuberculosis
cgaugggggugccgcagcg

SEQ ID NO: 814730 - RNA, 13 nt, Mycobacterium avium subsp. paratuberculosis
cgaugggccgccc

SEQ ID NO: 814731 - RNA, 22 nt, Mycobacterium avium subsp. paratuberculosis
cgauggcucgcgggggccgcga

SEQ ID NO: 814732 - RNA, 18 nt, Mycobacterium avium subsp. paratuberculosis
cgauggguguggcgucga

SEQ ID NO: 814733 - RNA, 23 nt, Mycobacterium avium subsp. paratuberculosis
cgauggguguggcgucgaugccg

SEQ ID NO: 814734 - RNA, 20 nt, Mycobacterium avium subsp. paratuberculosis
cgauggguucuucgaccacg

SEQ ID NO: 814735 - RNA, 22 nt, Mycobacterium avium subsp. paratuberculosis
cgauggguucuucgaccacgcg

SEQ ID NO: 814736 - RNA, 17 nt, Mycobacterium avium subsp. paratuberculosis
cgauggguuggccgucg

SEQ ID NO: 814737 - RNA, 15 nt, Mycobacterium avium subsp. paratuberculosis
cgaugggugaucgcg

SEQ ID NO: 814738 - RNA, 21 nt, Mycobacterium avium subsp. paratuberculosis
cgaugggugaucgcggcccgc

SEQ ID NO: 814739 - RNA, 18 nt, Mycobacterium avium subsp. paratuberculosis
cgauggugcugcccggcg

SEQ ID NO: 814740 - RNA, 19 nt, Mycobacterium avium subsp. paratuberculosis
cgauggugcugcccggcgc

SEQ ID NO: 814741 - RNA, 15 nt, Mycobacterium avium subsp. paratuberculosis
cgaugguggcgcugc

SEQ ID NO: 814742 - RNA, 23 nt, Mycobacterium avium subsp. paratuberculosis
cgaugguggcgcugccgagcacc

SEQ ID NO: 814743 - RNA, 17 nt, Mycobacterium avium subsp. paratuberculosis
cgauggugggcagccgg

SEQ ID NO: 814744 - RNA, 22 nt, Mycobacterium avium subsp. paratuberculosis
cgaugguguagccgugccccag

SEQ ID NO: 814745 - RNA, 16 nt, Mycobacterium avium subsp. paratuberculosis
cgaugguguaguccug

SEQ ID NO: 814746 - RNA, 14 nt, Mycobacterium avium subsp. paratuberculosis
cgauggugugcagc

SEQ ID NO: 814747 - RNA, 20 nt, Mycobacterium avium subsp. paratuberculosis
cgauggaauucgucggcggu

SEQ ID NO: 814748 - RNA, 21 nt, Mycobacterium avium subsp. paratuberculosis
cgauggaauucgucggcggug

SEQ ID NO: 814749 - RNA, 17 nt, Mycobacterium avium subsp. paratuberculosis
cgauggacacgcugccg

SEQ ID NO: 814750 - RNA, 18 nt, Mycobacterium avium subsp. paratuberculosis
cgauggacacgcugccga

SEQ ID NO: 814751 - RNA, 15 nt, Mycobacterium avium subsp. paratuberculosis
cgauggacagcagcc

SEQ ID NO: 814752 - RNA, 16 nt, Mycobacterium avium subsp. paratuberculosis
cgauggaagcgcccgc

SEQ ID NO: 814753 - RNA, 18 nt, Mycobacterium avium subsp. paratuberculosis
cgauggaagcgcccgcgc

SEQ ID NO: 814754 - RNA, 19 nt, Mycobacterium avium subsp. paratuberculosis
cgauggaagcgcccgcgcg

SEQ ID NO: 814755 - RNA, 22 nt, Mycobacterium avium subsp. paratuberculosis
cgaugcuucccauuucggcgaa

SEQ ID NO: 814756 - RNA, 14 nt, Mycobacterium avium subsp. paratuberculosis
cgaugcggugccgg

SEQ ID NO: 814757 - RNA, 17 nt, Mycobacterium avium subsp. paratuberculosis
cgaugcggugccgggcc

SEQ ID NO: 814758 - RNA, 19 nt, Mycobacterium avium subsp. paratuberculosis
cgaugcggugccgggccag

SEQ ID NO: 814759 - RNA, 14 nt, Mycobacterium avium subsp. paratuberculosis
cgaugcggucccgc

SEQ ID NO: 814760 - RNA, 21 nt, Mycobacterium avium subsp. paratuberculosis
cgaugcgggcgccgaacgucg

SEQ ID NO: 814761 - RNA, 16 nt, Mycobacterium avium subsp. paratuberculosis
cgaugcgggucacggu

SEQ ID NO: 814762 - RNA, 14 nt, Mycobacterium avium subsp. paratuberculosis
cgaugcggggccgg

SEQ ID NO: 814763 - RNA, 15 nt, Mycobacterium avium subsp. paratuberculosis
cgaugcggggccggc

SEQ ID NO: 814764 - RNA, 18 nt, Mycobacterium avium subsp. paratuberculosis
cgaugcggggccggcggc

SEQ ID NO: 814765 - RNA, 19 nt, Mycobacterium avium subsp. paratuberculosis
cgaugcggggccggcggcg

SEQ ID NO: 814766 - RNA, 13 nt, Mycobacterium avium subsp. paratuberculosis
cgaugcggggcgg

SEQ ID NO: 814767 - RNA, 13 nt, Mycobacterium avium subsp. paratuberculosis
cgaugcgggcccg

SEQ ID NO: 814768 - RNA, 14 nt, Mycobacterium avium subsp. paratuberculosis
cgaugcgggcccgc

SEQ ID NO: 814769 - RNA, 12 nt, Mycobacterium avium subsp. paratuberculosis
cgaugcggcccg

SEQ ID NO: 814770 - RNA, 13 nt, Mycobacterium avium subsp. paratuberculosis
cgaugcggcccgg

SEQ ID NO: 814771 - RNA, 14 nt, Mycobacterium avium subsp. paratuberculosis
cgaugcggcccggc

SEQ ID NO: 814772 - RNA, 13 nt, Mycobacterium avium subsp. paratuberculosis
cgaugcggccggc

SEQ ID NO: 814773 - RNA, 12 nt, Mycobacterium avium subsp. paratuberculosis
cgaugcggccgu

SEQ ID NO: 814774 - RNA, 13 nt, Mycobacterium avium subsp. paratuberculosis
cgaugcggccguc

SEQ ID NO: 814775 - RNA, 11 nt, Mycobacterium avium subsp. paratuberculosis
cgauggcgacc

SEQ ID NO: 814776 - RNA, 15 nt, Mycobacterium avium subsp. paratuberculosis
cgauggcgaccgcgc

SEQ ID NO: 814777 - RNA, 19 nt, Mycobacterium avium subsp. paratuberculosis
cgauggcgcccagcgucuc

SEQ ID NO: 814778 - RNA, 13 nt, Mycobacterium avium subsp. paratuberculosis
cgauggcgcuggc

SEQ ID NO: 814779 - RNA, 18 nt, Mycobacterium avium subsp. paratuberculosis
cgauggcgcuggccgcga

SEQ ID NO: 814780 - RNA, 13 nt, Mycobacterium avium subsp. paratuberculosis
cgauggcgcggcg

SEQ ID NO: 814781 - RNA, 18 nt, Mycobacterium avium subsp. paratuberculosis
cgauggcgcggcgcaccg

SEQ ID NO: 814782 - RNA, 14 nt, Mycobacterium avium subsp. paratuberculosis
cgauggcgcggccg

SEQ ID NO: 814783 - RNA, 16 nt, Mycobacterium avium subsp. paratuberculosis
cgauggccuccgaccc

SEQ ID NO: 814784 - RNA, 21 nt, Mycobacterium avium subsp. paratuberculosis
cgauggccuccgacccgucca

SEQ ID NO: 814785 - RNA, 17 nt, Mycobacterium avium subsp. paratuberculosis
cgauggccucgucgaug

SEQ ID NO: 814786 - RNA, 20 nt, Mycobacterium avium subsp. paratuberculosis
cgauggccucgucgaugucg

SEQ ID NO: 814787 - RNA, 15 nt, Mycobacterium avium subsp. paratuberculosis
cgauggccucgucgc

SEQ ID NO: 814788 - RNA, 18 nt, Mycobacterium avium subsp. paratuberculosis
cgauggccucgucgcgga

SEQ ID NO: 814789 - RNA, 17 nt, Mycobacterium avium subsp. paratuberculosis
cgauggaggugccgcgc

SEQ ID NO: 814790 - RNA, 15 nt, Mycobacterium avium subsp. paratuberculosis
cgauggacgccagca

SEQ ID NO: 814791 - RNA, 14 nt, Mycobacterium avium subsp. paratuberculosis
cgauggacgcggug

SEQ ID NO: 814792 - RNA, 17 nt, Mycobacterium avium subsp. paratuberculosis
cgauggacgcgguggug

SEQ ID NO: 814793 - RNA, 17 nt, Mycobacterium avium subsp. paratuberculosis
cgauggacguccagcgg

SEQ ID NO: 814794 - RNA, 24 nt, Mycobacterium avium subsp. paratuberculosis
cgaugcauuggugcacgccguacc

SEQ ID NO: 814795 - RNA, 17 nt, Mycobacterium avium subsp. paratuberculosis
cgaugcauucguccauc

SEQ ID NO: 814796 - RNA, 17 nt, Mycobacterium avium subsp. paratuberculosis
cgaugcacggucggccc

SEQ ID NO: 814797 - RNA, 20 nt, Mycobacterium avium subsp. paratuberculosis
cgaugcacggucggccccgc

SEQ ID NO: 814798 - RNA, 16 nt, Mycobacterium avium subsp. paratuberculosis
cgaugcagaucaccac

SEQ ID NO: 814799 - RNA, 17 nt, Mycobacterium avium subsp. paratuberculosis
cgaugcagaucaccacg

SEQ ID NO: 814800 - RNA, 17 nt, Mycobacterium avium subsp. paratuberculosis
cgaugaccucgcgggug

SEQ ID NO: 814801 - RNA, 14 nt, Mycobacterium avium subsp. paratuberculosis
cgaugaccggcccg

SEQ ID NO: 814802 - RNA, 16 nt, Mycobacterium avium subsp. paratuberculosis
cgaugaccggcccggc

SEQ ID NO: 814803 - RNA, 17 nt, Mycobacterium avium subsp. paratuberculosis
cgaugaccggcccggcg

SEQ ID NO: 814804 - RNA, 19 nt, Mycobacterium avium subsp. paratuberculosis
cgaugaccggcccggcggc

SEQ ID NO: 814805 - RNA, 14 nt, Mycobacterium avium subsp. paratuberculosis
cgaugaccgcggcg

SEQ ID NO: 814806 - RNA, 15 nt, Mycobacterium avium subsp. paratuberculosis
cgaugaccgcggcgg

SEQ ID NO: 814807 - RNA, 16 nt, Mycobacterium avium subsp. paratuberculosis
cgaugaccgcggcggg

SEQ ID NO: 814808 - RNA, 17 nt, Mycobacterium avium subsp. paratuberculosis
cgaugaccgcggcgggc

SEQ ID NO: 814809 - RNA, 23 nt, Mycobacterium avium subsp. paratuberculosis
cgaugaccggacgauucgcgauc

SEQ ID NO: 814810 - RNA, 17 nt, Mycobacterium avium subsp. paratuberculosis
cgaugaccucgcacagc

SEQ ID NO: 814811 - RNA, 15 nt, Mycobacterium avium subsp. paratuberculosis
cgaugaccucgcgcc

SEQ ID NO: 814812 - RNA, 16 nt, Mycobacterium avium subsp. paratuberculosis
cgaugaccucgcgccc

SEQ ID NO: 814813 - RNA, 18 nt, Mycobacterium avium subsp. paratuberculosis
cgaugaccucgcgcccgg

SEQ ID NO: 814814 - RNA, 23 nt, Mycobacterium avium subsp. paratuberculosis
cgaugcccaagccggccaggccc

SEQ ID NO: 814815 - RNA, 20 nt, Mycobacterium avium subsp. paratuberculosis
cgaugccagcgcaccgggcc

SEQ ID NO: 814816 - RNA, 22 nt, Mycobacterium avium subsp. paratuberculosis
cgaugccagcgcaccgggcccg

SEQ ID NO: 814817 - RNA, 22 nt, Mycobacterium avium subsp. paratuberculosis
cgaugccgaacgucaccaacau

SEQ ID NO: 814818 - RNA, 12 nt, Mycobacterium avium subsp. paratuberculosis
cgaugccgacac

SEQ ID NO: 814819 - RNA, 20 nt, Mycobacterium avium subsp. paratuberculosis
cgaugccgacaccccacacc

SEQ ID NO: 814820 - RNA, 18 nt, Mycobacterium avium subsp. paratuberculosis
cgaugccgaccgacagcc

SEQ ID NO: 814821 - RNA, 23 nt, Mycobacterium avium subsp. paratuberculosis
cgaugccgaggauuucgcgaucg

SEQ ID NO: 814822 - RNA, 11 nt, Mycobacterium avium subsp. paratuberculosis
cgaugccgauc

SEQ ID NO: 814823 - RNA, 20 nt, Mycobacterium avium subsp. paratuberculosis
cgaugccgaucacggugauc

SEQ ID NO: 814824 - RNA, 13 nt, Mycobacterium avium subsp. paratuberculosis
cgaugccgcgcug

SEQ ID NO: 814825 - RNA, 14 nt, Mycobacterium avium subsp. paratuberculosis
cgaugccgcgcugc

SEQ ID NO: 814826 - RNA, 19 nt, Mycobacterium avium subsp. paratuberculosis
cgaugccgcgcugcgccgg

SEQ ID NO: 814827 - RNA, 23 nt, Mycobacterium avium subsp. paratuberculosis
cgaugccgcgcaggccguccagc

SEQ ID NO: 814828 - RNA, 13 nt, Mycobacterium avium subsp. paratuberculosis
cgaugccgccgac

SEQ ID NO: 814829 - RNA, 23 nt, Mycobacterium avium subsp. paratuberculosis
cgaugccgccgagggccagcagc

SEQ ID NO: 814830 - RNA, 12 nt, Mycobacterium avium subsp. paratuberculosis
cgaugcgcagca

SEQ ID NO: 814831 - RNA, 17 nt, Mycobacterium avium subsp. paratuberculosis
cgaugcgcugugcgggu

SEQ ID NO: 814832 - RNA, 23 nt, Mycobacterium avium subsp. paratuberculosis
cgaugcggaucucggugccggug

SEQ ID NO: 814833 - RNA, 16 nt, Mycobacterium avium subsp. paratuberculosis
cgaugcggcagcuuga

SEQ ID NO: 814834 - RNA, 22 nt, Mycobacterium avium subsp. paratuberculosis
cgaugcggcagcuugaugcugg

SEQ ID NO: 814835 - RNA, 21 nt, Mycobacterium avium subsp. paratuberculosis
cgaugcgcugcuguugcucgg

SEQ ID NO: 814836 - RNA, 15 nt, Mycobacterium avium subsp. paratuberculosis
cgaugcgcggcccgu

SEQ ID NO: 814837 - RNA, 15 nt, Mycobacterium avium subsp. paratuberculosis
cgaugcgcgguaaca

SEQ ID NO: 814838 - RNA, 12 nt, Mycobacterium avium subsp. paratuberculosis
cgaugcgcgcca

SEQ ID NO: 814839 - RNA, 18 nt, Mycobacterium avium subsp. paratuberculosis
cgaugcgcuccagcaggc

SEQ ID NO: 814840 - RNA, 19 nt, Mycobacterium avium subsp. paratuberculosis
cgaugcgcuccagcaggcu

SEQ ID NO: 814841 - RNA, 14 nt, Mycobacterium avium subsp. paratuberculosis
cgaugcgcucgccg

SEQ ID NO: 814842 - RNA, 15 nt, Mycobacterium avium subsp. paratuberculosis
cgaugcgcucgccga

SEQ ID NO: 814843 - RNA, 17 nt, Mycobacterium avium subsp. paratuberculosis
cgaugcgcucgccgauc

SEQ ID NO: 814844 - RNA, 18 nt, Mycobacterium avium subsp. paratuberculosis
cgaugcgcucgccgaucu

SEQ ID NO: 814845 - RNA, 13 nt, Mycobacterium avium subsp. paratuberculosis
cgaugcgcucggc

SEQ ID NO: 814846 - RNA, 17 nt, Mycobacterium avium subsp. paratuberculosis
cgaugcgcucggcgacc

SEQ ID NO: 814847 - RNA, 20 nt, Mycobacterium avium subsp. paratuberculosis
cgaugcgcucggcgaccugc

SEQ ID NO: 814848 - RNA, 17 nt, Mycobacterium avium subsp. paratuberculosis
cgaugcgcgccagcagc

SEQ ID NO: 814849 - RNA, 12 nt, Mycobacterium avium subsp. paratuberculosis
cgaugcgcccgc

SEQ ID NO: 814850 - RNA, 12 nt, Mycobacterium avium subsp. paratuberculosis
cgaugcgccgca

SEQ ID NO: 814851 - RNA, 13 nt, Mycobacterium avium subsp. paratuberculosis
cgaugcgccgcac

SEQ ID NO: 814852 - RNA, 18 nt, Mycobacterium avium subsp. paratuberculosis
cgaugcgcccgcgccacc

SEQ ID NO: 814853 - RNA, 15 nt, Mycobacterium avium subsp. paratuberculosis
cgaugcgcccgcugc

SEQ ID NO: 814854 - RNA, 19 nt, Mycobacterium avium subsp. paratuberculosis
cgaugcgcccgcugcggcg

SEQ ID NO: 814855 - RNA, 15 nt, Mycobacterium avium subsp. paratuberculosis
cgaugcgcagcagcg

SEQ ID NO: 814856 - RNA, 23 nt, Mycobacterium avium subsp. paratuberculosis
cgaugccggcgauccgcgcggcg

SEQ ID NO: 814857 - RNA, 13 nt, Mycobacterium avium subsp. paratuberculosis
cgaugccggccag

SEQ ID NO: 814858 - RNA, 20 nt, Mycobacterium avium subsp. paratuberculosis
cgaugccggccuggcccagc

SEQ ID NO: 814859 - RNA, 22 nt, Mycobacterium avium subsp. paratuberculosis
cgaugccggccuggcccagccg

SEQ ID NO: 814860 - RNA, 23 nt, Mycobacterium avium subsp. paratuberculosis
cgaugccggccuggcccagccgc

SEQ ID NO: 814861 - RNA, 16 nt, Mycobacterium avium subsp. paratuberculosis
cgaugccggccagcgg

SEQ ID NO: 814862 - RNA, 18 nt, Mycobacterium avium subsp. paratuberculosis
cgaugccggccagcggcc

SEQ ID NO: 814863 - RNA, 21 nt, Mycobacterium avium subsp. paratuberculosis
cgaugccggccaggcacagca

SEQ ID NO: 814864 - RNA, 22 nt, Mycobacterium avium subsp. paratuberculosis
cgaugccggccaggcacagcag

SEQ ID NO: 814865 - RNA, 20 nt, Mycobacterium avium subsp. paratuberculosis
cgaugccguagaccagcauc

SEQ ID NO: 814866 - RNA, 14 nt, Mycobacterium avium subsp. paratuberculosis
cgaugccgggcacg

SEQ ID NO: 814867 - RNA, 17 nt, Mycobacterium avium subsp. paratuberculosis
cgaugccgggcacgaau

SEQ ID NO: 814868 - RNA, 14 nt, Mycobacterium avium subsp. paratuberculosis
cgaugccgguggcc

SEQ ID NO: 814869 - RNA, 18 nt, Mycobacterium avium subsp. paratuberculosis
cgaugccgguggccuugc

SEQ ID NO: 814870 - RNA, 14 nt, Mycobacterium avium subsp. paratuberculosis
cgaugccgugccgg

SEQ ID NO: 814871 - RNA, 22 nt, Mycobacterium avium subsp. paratuberculosis
cgaugccgugcugggcggacgg

SEQ ID NO: 814872 - RNA, 14 nt, Mycobacterium avium subsp. paratuberculosis
cgaugccguggugc

SEQ ID NO: 814873 - RNA, 20 nt, Mycobacterium avium subsp. paratuberculosis
cgaugccguucgcgccguag

SEQ ID NO: 814874 - RNA, 23 nt, Mycobacterium avium subsp. paratuberculosis
cgaugcgcaccgugccgcccguc

SEQ ID NO: 814875 - RNA, 18 nt, Mycobacterium avium subsp. paratuberculosis
cgaugcgacgcaccucgg

SEQ ID NO: 814876 - RNA, 22 nt, Mycobacterium avium subsp. paratuberculosis
cgaugcgacgcaccucggccgg

SEQ ID NO: 814877 - RNA, 18 nt, Mycobacterium avium subsp. paratuberculosis
cgaugccuuccucggcgc

SEQ ID NO: 814878 - RNA, 13 nt, Mycobacterium avium subsp. paratuberculosis
cgaugccgggcac

SEQ ID NO: 814879 - RNA, 15 nt, Mycobacterium avium subsp. paratuberculosis
cgaucugaccgagca

SEQ ID NO: 814880 - RNA, 17 nt, Mycobacterium avium subsp. paratuberculosis
cgaucugaccgagcagc

SEQ ID NO: 814881 - RNA, 13 nt, Mycobacterium avium subsp. paratuberculosis
cgaucugcaccag

SEQ ID NO: 814882 - RNA, 19 nt, Mycobacterium avium subsp. paratuberculosis
cgaucugcaccagcgcgga

SEQ ID NO: 814883 - RNA, 23 nt, Mycobacterium avium subsp. paratuberculosis
cgaucugcaccagcgcggacacc

SEQ ID NO: 814884 - RNA, 15 nt, Mycobacterium avium subsp. paratuberculosis
cgaucugcagccggc

SEQ ID NO: 814885 - RNA, 17 nt, Mycobacterium avium subsp. paratuberculosis
cgaucugcagccggcgc

SEQ ID NO: 814886 - RNA, 18 nt, Mycobacterium avium subsp. paratuberculosis
cgaucugcagccggcgcg

SEQ ID NO: 814887 - RNA, 14 nt, Mycobacterium avium subsp. paratuberculosis
cgaucugcaggccg

SEQ ID NO: 814888 - RNA, 14 nt, Mycobacterium avium subsp. paratuberculosis
cgaucucgccgucc

SEQ ID NO: 814889 - RNA, 15 nt, Mycobacterium avium subsp. paratuberculosis
cgaucucgccguccu

SEQ ID NO: 814890 - RNA, 21 nt, Mycobacterium avium subsp. paratuberculosis
cgaucucgauggacgcggugg

SEQ ID NO: 814891 - RNA, 17 nt, Mycobacterium avium subsp. paratuberculosis
cgaucucgauggccacg

SEQ ID NO: 814892 - RNA, 19 nt, Mycobacterium avium subsp. paratuberculosis
cgaucucgauggccucguc

SEQ ID NO: 814893 - RNA, 21 nt, Mycobacterium avium subsp. paratuberculosis
cgaucucgauggccucgucga

SEQ ID NO: 814894 - RNA, 23 nt, Mycobacterium avium subsp. paratuberculosis
cgaucucgauggccucgucgaug

SEQ ID NO: 814895 - RNA, 19 nt, Mycobacterium avium subsp. paratuberculosis
cgaucucuucgccggacag

SEQ ID NO: 814896 - RNA, 18 nt, Mycobacterium avium subsp. paratuberculosis
cgaucucgccgaaggccg

SEQ ID NO: 814897 - RNA, 21 nt, Mycobacterium avium subsp. paratuberculosis
cgaucucgccgaaggccgggu

SEQ ID NO: 814898 - RNA, 18 nt, Mycobacterium avium subsp. paratuberculosis
cgaucuggcgcagcguca

SEQ ID NO: 814899 - RNA, 21 nt, Mycobacterium avium subsp. paratuberculosis
cgaucuggcgcagcgucaacg

SEQ ID NO: 814900 - RNA, 18 nt, Mycobacterium avium subsp. paratuberculosis
cgaucuggcgcaucagcg

SEQ ID NO: 814901 - RNA, 20 nt, Mycobacterium avium subsp. paratuberculosis
cgaucuggcgcaucagcggg

SEQ ID NO: 814902 - RNA, 14 nt, Mycobacterium avium subsp. paratuberculosis
cgaucugcggcacg

SEQ ID NO: 814903 - RNA, 15 nt, Mycobacterium avium subsp. paratuberculosis
cgaucugcggcacgg

SEQ ID NO: 814904 - RNA, 18 nt, Mycobacterium avium subsp. paratuberculosis
cgaucugcuccucgguca

SEQ ID NO: 814905 - RNA, 20 nt, Mycobacterium avium subsp. paratuberculosis
cgaucugcucgaugcggccc

SEQ ID NO: 814906 - RNA, 20 nt, Mycobacterium avium subsp. paratuberculosis
cgaucugcucggugucgauc

SEQ ID NO: 814907 - RNA, 20 nt, Mycobacterium avium subsp. paratuberculosis
cgaucuucgcggcguacugc

SEQ ID NO: 814908 - RNA, 14 nt, Mycobacterium avium subsp. paratuberculosis
cgaugaccagcgcg

SEQ ID NO: 814909 - RNA, 15 nt, Mycobacterium avium subsp. paratuberculosis
cgaugaccagcgcga

SEQ ID NO: 814910 - RNA, 17 nt, Mycobacterium avium subsp. paratuberculosis
cgaugaccagcgcgaac

SEQ ID NO: 814911 - RNA, 22 nt, Mycobacterium avium subsp. paratuberculosis
cgaucugggaucggugcgcggc

SEQ ID NO: 814912 - RNA, 16 nt, Mycobacterium avium subsp. paratuberculosis
cgaucuggcggacccg

SEQ ID NO: 814913 - RNA, 16 nt, Mycobacterium avium subsp. paratuberculosis
cgaucuggcgggcggu

SEQ ID NO: 814914 - RNA, 19 nt, Mycobacterium avium subsp. paratuberculosis
cgaucuggcgggcggucca

SEQ ID NO: 814915 - RNA, 14 nt, Mycobacterium avium subsp. paratuberculosis
cgaucugguccagc

SEQ ID NO: 814916 - RNA, 17 nt, Mycobacterium avium subsp. paratuberculosis
cgaucugguccagcgug

SEQ ID NO: 814917 - RNA, 22 nt, Mycobacterium avium subsp. paratuberculosis
cgaucugguccagcgugcgcgg

SEQ ID NO: 814918 - RNA, 17 nt, Mycobacterium avium subsp. paratuberculosis
cgaucugguucaccgcc

SEQ ID NO: 814919 - RNA, 20 nt, Mycobacterium avium subsp. paratuberculosis
cgaucugguucaccgccacc

SEQ ID NO: 814920 - RNA, 22 nt, Mycobacterium avium subsp. paratuberculosis
cgaucugguucaccgccaccag

SEQ ID NO: 814921 - RNA, 18 nt, Mycobacterium avium subsp. paratuberculosis
cgaucugguugaaccggu

SEQ ID NO: 814922 - RNA, 14 nt, Mycobacterium avium subsp. paratuberculosis
cgaucugucgcgcu

SEQ ID NO: 814923 - RNA, 16 nt, Mycobacterium avium subsp. paratuberculosis
cgaucugucgcgcuca

SEQ ID NO: 814924 - RNA, 17 nt, Mycobacterium avium subsp. paratuberculosis
cgaucgaucagccgcga

SEQ ID NO: 814925 - RNA, 15 nt, Mycobacterium avium subsp. paratuberculosis
cgaucgaucaucgcc

SEQ ID NO: 814926 - RNA, 16 nt, Mycobacterium avium subsp. paratuberculosis
cgaucgaucaucgccu

SEQ ID NO: 814927 - RNA, 19 nt, Mycobacterium avium subsp. paratuberculosis
cgaucgaucaucgccucgg

SEQ ID NO: 814928 - RNA, 22 nt, Mycobacterium avium subsp. paratuberculosis
cgaucgaucccuuggcggcggc

SEQ ID NO: 814929 - RNA, 20 nt, Mycobacterium avium subsp. paratuberculosis
cgaucgaugaauccgcgcag

SEQ ID NO: 814930 - RNA, 21 nt, Mycobacterium avium subsp. paratuberculosis
cgaucgaugaauccgcgcagc

SEQ ID NO: 814931 - RNA, 20 nt, Mycobacterium avium subsp. paratuberculosis
cgaucgaugcccagcgcgcg

SEQ ID NO: 814932 - RNA, 15 nt, Mycobacterium avium subsp. paratuberculosis
cgaucgaggacaccg

SEQ ID NO: 814933 - RNA, 16 nt, Mycobacterium avium subsp. paratuberculosis
cgaucgaggacaccgc

SEQ ID NO: 814934 - RNA, 17 nt, Mycobacterium avium subsp. paratuberculosis
cgaucgaggacaccgcg

SEQ ID NO: 814935 - RNA, 14 nt, Mycobacterium avium subsp. paratuberculosis
cgaucguccggcgc

SEQ ID NO: 814936 - RNA, 15 nt, Mycobacterium avium subsp. paratuberculosis
cgaucguccggcgcc

SEQ ID NO: 814937 - RNA, 15 nt, Mycobacterium avium subsp. paratuberculosis
cgaucgucgaccacc

SEQ ID NO: 814938 - RNA, 17 nt, Mycobacterium avium subsp. paratuberculosis
cgaucgucgaccaccac

SEQ ID NO: 814939 - RNA, 19 nt, Mycobacterium avium subsp. paratuberculosis
cgaucgucgaccaccacga

SEQ ID NO: 814940 - RNA, 16 nt, Mycobacterium avium subsp. paratuberculosis
cgaucgacgucaccac

SEQ ID NO: 814941 - RNA, 13 nt, Mycobacterium avium subsp. paratuberculosis
cgaucgacgucag

SEQ ID NO: 814942 - RNA, 12 nt, Mycobacterium avium subsp. paratuberculosis
cgauccggcgcc

SEQ ID NO: 814943 - RNA, 16 nt, Mycobacterium avium subsp. paratuberculosis
cgauccggcgcccgau

SEQ ID NO: 814944 - RNA, 15 nt, Mycobacterium avium subsp. paratuberculosis
cgauccggcgccgcg

SEQ ID NO: 814945 - RNA, 17 nt, Mycobacterium avium subsp. paratuberculosis
cgauccggcgccgcggg

SEQ ID NO: 814946 - RNA, 18 nt, Mycobacterium avium subsp. paratuberculosis
cgauccggcgccgcgggc

SEQ ID NO: 814947 - RNA, 13 nt, Mycobacterium avium subsp. paratuberculosis
cgauccggcgcgu

SEQ ID NO: 814948 - RNA, 15 nt, Mycobacterium avium subsp. paratuberculosis
cgauccggccggcgg

SEQ ID NO: 814949 - RNA, 16 nt, Mycobacterium avium subsp. paratuberculosis
cgauccggccggcggc

SEQ ID NO: 814950 - RNA, 16 nt, Mycobacterium avium subsp. paratuberculosis
cgaucgacgacgccag

SEQ ID NO: 814951 - RNA, 14 nt, Mycobacterium avium subsp. paratuberculosis
cgaucgacgccgac

SEQ ID NO: 814952 - RNA, 15 nt, Mycobacterium avium subsp. paratuberculosis
cgaucgacgccgaca

SEQ ID NO: 814953 - RNA, 17 nt, Mycobacterium avium subsp. paratuberculosis
cgaucgacgccgacauc

SEQ ID NO: 814954 - RNA, 16 nt, Mycobacterium avium subsp. paratuberculosis
cgaucgucucgucgag

SEQ ID NO: 814955 - RNA, 17 nt, Mycobacterium avium subsp. paratuberculosis
cgaucgugaauucggcc

SEQ ID NO: 814956 - RNA, 19 nt, Mycobacterium avium subsp. paratuberculosis
cgaucgugaauucggccgg

SEQ ID NO: 814957 - RNA, 14 nt, Mycobacterium avium subsp. paratuberculosis
cgaucgugacgccg

SEQ ID NO: 814958 - RNA, 21 nt, Mycobacterium avium subsp. paratuberculosis
cgaucgugacgccguccgacg

SEQ ID NO: 814959 - RNA, 16 nt, Mycobacterium avium subsp. paratuberculosis
cgaucgucgccgccaa

SEQ ID NO: 814960 - RNA, 16 nt, Mycobacterium avium subsp. paratuberculosis
cgaucgucgccgucac

SEQ ID NO: 814961 - RNA, 21 nt, Mycobacterium avium subsp. paratuberculosis
cgaucuccaccgagugcggcg

SEQ ID NO: 814962 - RNA, 24 nt, Mycobacterium avium subsp. paratuberculosis
cgaucuccaccgagugcggcgcgg

SEQ ID NO: 814963 - RNA, 21 nt, Mycobacterium avium subsp. paratuberculosis
cgaucuccagcggccgggcga

SEQ ID NO: 814964 - RNA, 18 nt, Mycobacterium avium subsp. paratuberculosis
cgaucuccaucccgcuga

SEQ ID NO: 814965 - RNA, 17 nt, Mycobacterium avium subsp. paratuberculosis
cgaucuccgucaccgug

SEQ ID NO: 814966 - RNA, 18 nt, Mycobacterium avium subsp. paratuberculosis
cgaucuccgucaccgugg

SEQ ID NO: 814967 - RNA, 14 nt, Mycobacterium avium subsp. paratuberculosis
cgaucuccucggcg

SEQ ID NO: 814968 - RNA, 17 nt, Mycobacterium avium subsp. paratuberculosis
cgaucuccuuguugacg

SEQ ID NO: 814969 - RNA, 17 nt, Mycobacterium avium subsp. paratuberculosis
cgaucucgaccagcgcc

SEQ ID NO: 814970 - RNA, 19 nt, Mycobacterium avium subsp. paratuberculosis
cgaucucgaccagcgccga

SEQ ID NO: 814971 - RNA, 16 nt, Mycobacterium avium subsp. paratuberculosis
cgaucucgaccaggcc

SEQ ID NO: 814972 - RNA, 20 nt, Mycobacterium avium subsp. paratuberculosis
cgaucucgagcauccggugc

SEQ ID NO: 814973 - RNA, 18 nt, Mycobacterium avium subsp. paratuberculosis
cgaguucagaagucgccc

SEQ ID NO: 814974 - RNA, 18 nt, Mycobacterium avium subsp. paratuberculosis
cgaguuccgcgucggccc

SEQ ID NO: 814975 - RNA, 21 nt, Mycobacterium avium subsp. paratuberculosis
cgagugugaacccugggcggc

SEQ ID NO: 814976 - RNA, 23 nt, Mycobacterium avium subsp. paratuberculosis
cgagugugaacccugggcggcga

SEQ ID NO: 814977 - RNA, 21 nt, Mycobacterium avium subsp. paratuberculosis
cgaguguguacacagggcggc

SEQ ID NO: 814978 - RNA, 23 nt, Mycobacterium avium subsp. paratuberculosis
cgaguguguacacagggcggcga

SEQ ID NO: 814979 - RNA, 15 nt, Mycobacterium avium subsp. paratuberculosis
cgaguggcgccgucg

SEQ ID NO: 814980 - RNA, 17 nt, Mycobacterium avium subsp. paratuberculosis
cgagugggaccgucggc

SEQ ID NO: 814981 - RNA, 21 nt, Mycobacterium avium subsp. paratuberculosis
cgagugguaccggguggccgu

SEQ ID NO: 814982 - RNA, 13 nt, Mycobacterium avium subsp. paratuberculosis
cgaguggucggcc

SEQ ID NO: 814983 - RNA, 17 nt, Mycobacterium avium subsp. paratuberculosis
cgaguggucggccgccc

SEQ ID NO: 814984 - RNA, 13 nt, Mycobacterium avium subsp. paratuberculosis
cgagugcggcgcg

SEQ ID NO: 814985 - RNA, 21 nt, Mycobacterium avium subsp. paratuberculosis
cgagugcucgauggccagcgc

SEQ ID NO: 814986 - RNA, 18 nt, Mycobacterium avium subsp. paratuberculosis
cgagugaggccgaggcga

SEQ ID NO: 814987 - RNA, 13 nt, Mycobacterium avium subsp. paratuberculosis
cgagugccggcca

SEQ ID NO: 814988 - RNA, 14 nt, Mycobacterium avium subsp. paratuberculosis
cgagugccggccag

SEQ ID NO: 814989 - RNA, 16 nt, Mycobacterium avium subsp. paratuberculosis
cgagugccggccagcu

SEQ ID NO: 814990 - RNA, 22 nt, Mycobacterium avium subsp. paratuberculosis
cgagugccggccagcucgccgc

SEQ ID NO: 814991 - RNA, 18 nt, Mycobacterium avium subsp. paratuberculosis
cgagugccugcgcccaca

SEQ ID NO: 814992 - RNA, 19 nt, Mycobacterium avium subsp. paratuberculosis
cgagugcgaaucaucgugg

SEQ ID NO: 814993 - RNA, 14 nt, Mycobacterium avium subsp. paratuberculosis
cgaguccggccagg

SEQ ID NO: 814994 - RNA, 22 nt, Mycobacterium avium subsp. paratuberculosis
cgaguccggccaggucgccgcg

SEQ ID NO: 814995 - RNA, 17 nt, Mycobacterium avium subsp. paratuberculosis
cgaguccgggccgccgg

SEQ ID NO: 814996 - RNA, 19 nt, Mycobacterium avium subsp. paratuberculosis
cgaguccgggccgccggcc

SEQ ID NO: 814997 - RNA, 23 nt, Mycobacterium avium subsp. paratuberculosis
cgaguccgggccgccggccgcgg

SEQ ID NO: 814998 - RNA, 23 nt, Mycobacterium avium subsp. paratuberculosis
cgagucccgcgcggcgcagggcg

SEQ ID NO: 814999 - RNA, 14 nt, Mycobacterium avium subsp. paratuberculosis
cgagucccggcgca

SEQ ID NO: 815000 - RNA, 18 nt, Mycobacterium avium subsp. paratuberculosis
cgagucccggcgcaccag

SEQ ID NO: 815001 - RNA, 17 nt, Mycobacterium avium subsp. paratuberculosis
cgaguccgcggaggcga

SEQ ID NO: 815002 - RNA, 17 nt, Mycobacterium avium subsp. paratuberculosis
cgaguccucgcgguugc

SEQ ID NO: 815003 - RNA, 17 nt, Mycobacterium avium subsp. paratuberculosis
cgagucgaagccgucca

SEQ ID NO: 815004 - RNA, 15 nt, Mycobacterium avium subsp. paratuberculosis
cgagucgaagccgug

SEQ ID NO: 815005 - RNA, 16 nt, Mycobacterium avium subsp. paratuberculosis
cgagucgaagccgugg

SEQ ID NO: 815006 - RNA, 17 nt, Mycobacterium avium subsp. paratuberculosis
cgagucgaaggcgcggg

SEQ ID NO: 815007 - RNA, 17 nt, Mycobacterium avium subsp. paratuberculosis
cgagucgacgugcucgg

SEQ ID NO: 815008 - RNA, 19 nt, Mycobacterium avium subsp. paratuberculosis
cgagucgacgugcucggcg

SEQ ID NO: 815009 - RNA, 17 nt, Mycobacterium avium subsp. paratuberculosis
cgagucgagcaccgcga

SEQ ID NO: 815010 - RNA, 19 nt, Mycobacterium avium subsp. paratuberculosis
cgagucggugaccaccugc

SEQ ID NO: 815011 - RNA, 20 nt, Mycobacterium avium subsp. paratuberculosis
cgagucguagaggggccgga

SEQ ID NO: 815012 - RNA, 21 nt, Mycobacterium avium subsp. paratuberculosis
cgagucguagaggggccggac

SEQ ID NO: 815013 - RNA, 14 nt, Mycobacterium avium subsp. paratuberculosis
cgagucgcggauca

SEQ ID NO: 815014 - RNA, 14 nt, Mycobacterium avium subsp. paratuberculosis
cgagucggagaccc

SEQ ID NO: 815015 - RNA, 16 nt, Mycobacterium avium subsp. paratuberculosis
cgagucggagacccgc

SEQ ID NO: 815016 - RNA, 16 nt, Mycobacterium avium subsp. paratuberculosis
cgagucggccaccgcg

SEQ ID NO: 815017 - RNA, 21 nt, Mycobacterium avium subsp. paratuberculosis
cgagucggcgaaggcgcgcag

SEQ ID NO: 815018 - RNA, 16 nt, Mycobacterium avium subsp. paratuberculosis
cgagucgacgcugugc

SEQ ID NO: 815019 - RNA, 15 nt, Mycobacterium avium subsp. paratuberculosis
cgagucgaucgccag

SEQ ID NO: 815020 - RNA, 18 nt, Mycobacterium avium subsp. paratuberculosis
cgagucgaucgccagcgc

SEQ ID NO: 815021 - RNA, 18 nt, Mycobacterium avium subsp. paratuberculosis
cgagucgaugaccucgcg

SEQ ID NO: 815022 - RNA, 21 nt, Mycobacterium avium subsp. paratuberculosis
cgaguagaacuucgccagcgg

SEQ ID NO: 815023 - RNA, 15 nt, Mycobacterium avium subsp. paratuberculosis
cgaguaccgacgaga

SEQ ID NO: 815024 - RNA, 18 nt, Mycobacterium avium subsp. paratuberculosis
cgaguauccgcgcagcgu

SEQ ID NO: 815025 - RNA, 19 nt, Mycobacterium avium subsp. paratuberculosis
cgaguauccgcgcagcguc

SEQ ID NO: 815026 - RNA, 17 nt, Mycobacterium avium subsp. paratuberculosis
cgaguccagccagccgc

SEQ ID NO: 815027 - RNA, 20 nt, Mycobacterium avium subsp. paratuberculosis
cgaguccagccagccgcgcc

SEQ ID NO: 815028 - RNA, 16 nt, Mycobacterium avium subsp. paratuberculosis
cgagucacccggcugg

SEQ ID NO: 815029 - RNA, 19 nt, Mycobacterium avium subsp. paratuberculosis
cgagucacccggcuggccg

SEQ ID NO: 815030 - RNA, 22 nt, Mycobacterium avium subsp. paratuberculosis
cgagucacccggcuggccgcac

SEQ ID NO: 815031 - RNA, 21 nt, Mycobacterium avium subsp. paratuberculosis
cgagucaucgccacccgcacc

SEQ ID NO: 815032 - RNA, 23 nt, Mycobacterium avium subsp. paratuberculosis
cgagguucauguggaagccgcga

SEQ ID NO: 815033 - RNA, 16 nt, Mycobacterium avium subsp. paratuberculosis
cgagguucucgaacgg

SEQ ID NO: 815034 - RNA, 20 nt, Mycobacterium avium subsp. paratuberculosis
cgagguucucgaacgggucg

SEQ ID NO: 815035 - RNA, 20 nt, Mycobacterium avium subsp. paratuberculosis
cgaggugugaggagucggga

SEQ ID NO: 815036 - RNA, 21 nt, Mycobacterium avium subsp. paratuberculosis
cgaggugugaggagucgggca

SEQ ID NO: 815037 - RNA, 17 nt, Mycobacterium avium subsp. paratuberculosis
cgaggugucgacgcuga

SEQ ID NO: 815038 - RNA, 14 nt, Mycobacterium avium subsp. paratuberculosis
cgaggugccgcggg

SEQ ID NO: 815039 - RNA, 15 nt, Mycobacterium avium subsp. paratuberculosis
cgaggugggcaccag

SEQ ID NO: 815040 - RNA, 20 nt, Mycobacterium avium subsp. paratuberculosis
cgaggugggcaccagcugcg

SEQ ID NO: 815041 - RNA, 22 nt, Mycobacterium avium subsp. paratuberculosis
cgaggugggcaccagcugcgga

SEQ ID NO: 815042 - RNA, 24 nt, Mycobacterium avium subsp. paratuberculosis
cgagguugucccgggcgaacgucg

SEQ ID NO: 815043 - RNA, 14 nt, Mycobacterium avium subsp. paratuberculosis
cgaguacaccucga

SEQ ID NO: 815044 - RNA, 18 nt, Mycobacterium avium subsp. paratuberculosis
cgagguugaugccgacgu

SEQ ID NO: 815045 - RNA, 21 nt, Mycobacterium avium subsp. paratuberculosis
cgagguugaugccgacgucgg

SEQ ID NO: 815046 - RNA, 15 nt, Mycobacterium avium subsp. paratuberculosis
cgagggugccggcca

SEQ ID NO: 815047 - RNA, 20 nt, Mycobacterium avium subsp. paratuberculosis
cgagggugccggccaccggc

SEQ ID NO: 815048 - RNA, 22 nt, Mycobacterium avium subsp. paratuberculosis
cgagggugccggccaccggcgc

SEQ ID NO: 815049 - RNA, 23 nt, Mycobacterium avium subsp. paratuberculosis
cgagggugccggccaccggcgcg

SEQ ID NO: 815050 - RNA, 21 nt, Mycobacterium avium subsp. paratuberculosis
cgagguagugcgcgauggcgu

SEQ ID NO: 815051 - RNA, 16 nt, Mycobacterium avium subsp. paratuberculosis
cgagguacugcagcag

SEQ ID NO: 815052 - RNA, 15 nt, Mycobacterium avium subsp. paratuberculosis
cgagguagaccgccg

SEQ ID NO: 815053 - RNA, 14 nt, Mycobacterium avium subsp. paratuberculosis
cgagguagccgcgc

SEQ ID NO: 815054 - RNA, 12 nt, Mycobacterium avium subsp. paratuberculosis
cgaggucaucga

SEQ ID NO: 815055 - RNA, 17 nt, Mycobacterium avium subsp. paratuberculosis
cgaggucaucgagccga

SEQ ID NO: 815056 - RNA, 22 nt, Mycobacterium avium subsp. paratuberculosis
cgaggucaucgagccgagcacc

SEQ ID NO: 815057 - RNA, 14 nt, Mycobacterium avium subsp. paratuberculosis
cgaggucagcgcgu

SEQ ID NO: 815058 - RNA, 14 nt, Mycobacterium avium subsp. paratuberculosis
cgaggucaccgcgg

SEQ ID NO: 815059 - RNA, 19 nt, Mycobacterium avium subsp. paratuberculosis
cgagguccuugcggaaccg

SEQ ID NO: 815060 - RNA, 17 nt, Mycobacterium avium subsp. paratuberculosis
cgaggucgaaccacgcg

SEQ ID NO: 815061 - RNA, 12 nt, Mycobacterium avium subsp. paratuberculosis
cgaggucgacgg

SEQ ID NO: 815062 - RNA, 17 nt, Mycobacterium avium subsp. paratuberculosis
cgaggucgacggagucg

SEQ ID NO: 815063 - RNA, 22 nt, Mycobacterium avium subsp. paratuberculosis
cgaggucgacggagucgucggc

SEQ ID NO: 815064 - RNA, 23 nt, Mycobacterium avium subsp. paratuberculosis
cgaggucgacggagucgucggcg

SEQ ID NO: 815065 - RNA, 14 nt, Mycobacterium avium subsp. paratuberculosis
cgaggucgccgaca

SEQ ID NO: 815066 - RNA, 19 nt, Mycobacterium avium subsp. paratuberculosis
cgaggucgccgacagcguc

SEQ ID NO: 815067 - RNA, 20 nt, Mycobacterium avium subsp. paratuberculosis
cgaggucgccgacgccgucg

SEQ ID NO: 815068 - RNA, 13 nt, Mycobacterium avium subsp. paratuberculosis
cgagguggcccgc

SEQ ID NO: 815069 - RNA, 20 nt, Mycobacterium avium subsp. paratuberculosis
cgagguggcccgccacgugc

SEQ ID NO: 815070 - RNA, 13 nt, Mycobacterium avium subsp. paratuberculosis
cgagguggccgcc

SEQ ID NO: 815071 - RNA, 14 nt, Mycobacterium avium subsp. paratuberculosis
cgagguggccgcca

SEQ ID NO: 815072 - RNA, 18 nt, Mycobacterium avium subsp. paratuberculosis
cgagguggccgccagcac

SEQ ID NO: 815073 - RNA, 22 nt, Mycobacterium avium subsp. paratuberculosis
cgagguggccgccagcaccucg

SEQ ID NO: 815074 - RNA, 15 nt, Mycobacterium avium subsp. paratuberculosis
cgaggugcgccaguu

SEQ ID NO: 815075 - RNA, 17 nt, Mycobacterium avium subsp. paratuberculosis
cgaggugcucgcgcagg

SEQ ID NO: 815076 - RNA, 17 nt, Mycobacterium avium subsp. paratuberculosis
cgaggugaaccgcgacg

SEQ ID NO: 815077 - RNA, 18 nt, Mycobacterium avium subsp. paratuberculosis
cgaggugaaccgcgacgc

SEQ ID NO: 815078 - RNA, 22 nt, Mycobacterium avium subsp. paratuberculosis
cgaggugaaccgcgacgcgauc

SEQ ID NO: 815079 - RNA, 23 nt, Mycobacterium avium subsp. paratuberculosis
cgaggugaaccgcgacgcgaucg

SEQ ID NO: 815080 - RNA, 22 nt, Mycobacterium avium subsp. paratuberculosis
cgaggugaagccguugucgagu

SEQ ID NO: 815081 - RNA, 20 nt, Mycobacterium avium subsp. paratuberculosis
cgaggugaagucguccagcg

SEQ ID NO: 815082 - RNA, 24 nt, Mycobacterium avium subsp. paratuberculosis
cgaggugaagucguccagcgucga

SEQ ID NO: 815083 - RNA, 17 nt, Mycobacterium avium subsp. paratuberculosis
cgaggugaccggcgagg

SEQ ID NO: 815084 - RNA, 20 nt, Mycobacterium avium subsp. paratuberculosis
cgaggucuucggucccggcg

SEQ ID NO: 815085 - RNA, 22 nt, Mycobacterium avium subsp. paratuberculosis
cgaggucuucggucccggcggg

SEQ ID NO: 815086 - RNA, 23 nt, Mycobacterium avium subsp. paratuberculosis
cgaggugaucgcgaacgcgccgg

SEQ ID NO: 815087 - RNA, 23 nt, Mycobacterium avium subsp. paratuberculosis
cgaggugauguuggccgcgacgc

SEQ ID NO: 815088 - RNA, 21 nt, Mycobacterium avium subsp. paratuberculosis
cgaggugcaacacucgagcgc

SEQ ID NO: 815089 - RNA, 13 nt, Mycobacterium avium subsp. paratuberculosis
cgaggugcacgcc

SEQ ID NO: 815090 - RNA, 16 nt, Mycobacterium avium subsp. paratuberculosis
cgaggugcacgcccag

SEQ ID NO: 815091 - RNA, 14 nt, Mycobacterium avium subsp. paratuberculosis
cgaggucgcgcagc

SEQ ID NO: 815092 - RNA, 16 nt, Mycobacterium avium subsp. paratuberculosis
cgaggucgcgcagcac

SEQ ID NO: 815093 - RNA, 19 nt, Mycobacterium avium subsp. paratuberculosis
cgaggucgcgcagcaccuc

SEQ ID NO: 815094 - RNA, 17 nt, Mycobacterium avium subsp. paratuberculosis
cgaggucgcggcggccg

SEQ ID NO: 815095 - RNA, 19 nt, Mycobacterium avium subsp. paratuberculosis
cgaggucgcggcggccggc

SEQ ID NO: 815096 - RNA, 21 nt, Mycobacterium avium subsp. paratuberculosis
cgaggucgcggcggccggcgc

SEQ ID NO: 815097 - RNA, 16 nt, Mycobacterium avium subsp. paratuberculosis
cgaggucggacgccuc

SEQ ID NO: 815098 - RNA, 14 nt, Mycobacterium avium subsp. paratuberculosis
cgaggucggccagc

SEQ ID NO: 815099 - RNA, 22 nt, Mycobacterium avium subsp. paratuberculosis
cgaggucggccagcaggucguc

SEQ ID NO: 815100 - RNA, 16 nt, Mycobacterium avium subsp. paratuberculosis
cgaggucggucgcggc

SEQ ID NO: 815101 - RNA, 19 nt, Mycobacterium avium subsp. paratuberculosis
cgaggucggucgcggcauc

SEQ ID NO: 815102 - RNA, 20 nt, Mycobacterium avium subsp. paratuberculosis
cgaggucggucgcggcaucc

SEQ ID NO: 815103 - RNA, 24 nt, Mycobacterium avium subsp. paratuberculosis
cgaggucguagaugguccgcagau

SEQ ID NO: 815104 - RNA, 13 nt, Mycobacterium avium subsp. paratuberculosis
cgaggucgucgag

SEQ ID NO: 815105 - RNA, 22 nt, Mycobacterium avium subsp. paratuberculosis
cgaggucgucgagggccaccgg

SEQ ID NO: 815106 - RNA, 23 nt, Mycobacterium avium subsp. paratuberculosis
cgaggucgucgagggccaccggc

SEQ ID NO: 815107 - RNA, 15 nt, Mycobacterium avium subsp. paratuberculosis
cgaggucgucggcca

SEQ ID NO: 815108 - RNA, 15 nt, Mycobacterium avium subsp. paratuberculosis
cgaggucgucgggcg

SEQ ID NO: 815109 - RNA, 20 nt, Mycobacterium avium subsp. paratuberculosis
cgaggucguucgacaugcug

SEQ ID NO: 815110 - RNA, 20 nt, Mycobacterium avium subsp. paratuberculosis
cgaggcugugggccagcagc

SEQ ID NO: 815111 - RNA, 23 nt, Mycobacterium avium subsp. paratuberculosis
cgaggcugugggccagcagcguc

SEQ ID NO: 815112 - RNA, 20 nt, Mycobacterium avium subsp. paratuberculosis
cgaggcugacgaucgucgac

SEQ ID NO: 815113 - RNA, 12 nt, Mycobacterium avium subsp. paratuberculosis
cgagcgguuggc

SEQ ID NO: 815114 - RNA, 18 nt, Mycobacterium avium subsp. paratuberculosis
cgagcgguuggcgacgcu

SEQ ID NO: 815115 - RNA, 20 nt, Mycobacterium avium subsp. paratuberculosis
cgagcgguucgaucucgucg

SEQ ID NO: 815116 - RNA, 21 nt, Mycobacterium avium subsp. paratuberculosis
cgagcgguucgaucucgucgg

SEQ ID NO: 815117 - RNA, 13 nt, Mycobacterium avium subsp. paratuberculosis
cgagcgggcgggc

SEQ ID NO: 815118 - RNA, 16 nt, Mycobacterium avium subsp. paratuberculosis
cgagcgggcacgccgc

SEQ ID NO: 815119 - RNA, 21 nt, Mycobacterium avium subsp. paratuberculosis
cgagcgggcacgccgccgcga

SEQ ID NO: 815120 - RNA, 15 nt, Mycobacterium avium subsp. paratuberculosis
cgagcgggucgucgu

SEQ ID NO: 815121 - RNA, 17 nt, Mycobacterium avium subsp. paratuberculosis
cgagggucgagacaccg

SEQ ID NO: 815122 - RNA, 17 nt, Mycobacterium avium subsp. paratuberculosis
cgaggggcagcagcgcc

SEQ ID NO: 815123 - RNA, 18 nt, Mycobacterium avium subsp. paratuberculosis
cgaggggguggguccggu

SEQ ID NO: 815124 - RNA, 23 nt, Mycobacterium avium subsp. paratuberculosis
cgaggggguggguccggucagca

SEQ ID NO: 815125 - RNA, 20 nt, Mycobacterium avium subsp. paratuberculosis
cgaggggcuugagcgcgucg

SEQ ID NO: 815126 - RNA, 22 nt, Mycobacterium avium subsp. paratuberculosis
cgaggggcuugagcgcgucguc

SEQ ID NO: 815127 - RNA, 19 nt, Mycobacterium avium subsp. paratuberculosis
cgagggggaagucgaccgg

SEQ ID NO: 815128 - RNA, 12 nt, Mycobacterium avium subsp. paratuberculosis
cgagggcggcgg

SEQ ID NO: 815129 - RNA, 12 nt, Mycobacterium avium subsp. paratuberculosis
cgagggcggcga

SEQ ID NO: 815130 - RNA, 14 nt, Mycobacterium avium subsp. paratuberculosis
cgagggcgggccag

SEQ ID NO: 815131 - RNA, 14 nt, Mycobacterium avium subsp. paratuberculosis
cgagggcguucgcg

SEQ ID NO: 815132 - RNA, 15 nt, Mycobacterium avium subsp. paratuberculosis
cgagggcguucgcgg

SEQ ID NO: 815133 - RNA, 16 nt, Mycobacterium avium subsp. paratuberculosis
cgagggcguucgcggu

SEQ ID NO: 815134 - RNA, 19 nt, Mycobacterium avium subsp. paratuberculosis
cgagggcgcggcguagccg

SEQ ID NO: 815135 - RNA, 17 nt, Mycobacterium avium subsp. paratuberculosis
cgagggccagcagccag

SEQ ID NO: 815136 - RNA, 21 nt, Mycobacterium avium subsp. paratuberculosis
cgagggccagcagccagcugg

SEQ ID NO: 815137 - RNA, 15 nt, Mycobacterium avium subsp. paratuberculosis
cgagggcgacgaugc

SEQ ID NO: 815138 - RNA, 17 nt, Mycobacterium avium subsp. paratuberculosis
cgagggcgacgaugccg

SEQ ID NO: 815139 - RNA, 12 nt, Mycobacterium avium subsp. paratuberculosis
cgagggcgccgu

SEQ ID NO: 815140 - RNA, 13 nt, Mycobacterium avium subsp. paratuberculosis
cgagggcgcgcag

SEQ ID NO: 815141 - RNA, 14 nt, Mycobacterium avium subsp. paratuberculosis
cgagggcgcgcagc

SEQ ID NO: 815142 - RNA, 23 nt, Mycobacterium avium subsp. paratuberculosis
cgagggcaacgucuggccaccga

SEQ ID NO: 815143 - RNA, 18 nt, Mycobacterium avium subsp. paratuberculosis
cgagggccguugcggcca

SEQ ID NO: 815144 - RNA, 15 nt, Mycobacterium avium subsp. paratuberculosis
cgagggccuccacca

SEQ ID NO: 815145 - RNA, 17 nt, Mycobacterium avium subsp. paratuberculosis
cgauauggaucagaccc

SEQ ID NO: 815146 - RNA, 17 nt, Mycobacterium avium subsp. paratuberculosis
cgaucaacaccgccagc

SEQ ID NO: 815147 - RNA, 18 nt, Mycobacterium avium subsp. paratuberculosis
cgaucaacaccgccagca

SEQ ID NO: 815148 - RNA, 23 nt, Mycobacterium avium subsp. paratuberculosis
cgaucaacaccgccagcaccgcc

SEQ ID NO: 815149 - RNA, 14 nt, Mycobacterium avium subsp. paratuberculosis
cgaucaacaccggu

SEQ ID NO: 815150 - RNA, 21 nt, Mycobacterium avium subsp. paratuberculosis
cgaucaacaccgguccggccg

SEQ ID NO: 815151 - RNA, 17 nt, Mycobacterium avium subsp. paratuberculosis
cgaucaaaucccgcagc

SEQ ID NO: 815152 - RNA, 12 nt, Mycobacterium avium subsp. paratuberculosis
cgaucacccagg

SEQ ID NO: 815153 - RNA, 21 nt, Mycobacterium avium subsp. paratuberculosis
cgaucacccccgacaccgugg

SEQ ID NO: 815154 - RNA, 18 nt, Mycobacterium avium subsp. paratuberculosis
cgaucaccccgacggaga

SEQ ID NO: 815155 - RNA, 13 nt, Mycobacterium avium subsp. paratuberculosis
cgaucaccgccgc

SEQ ID NO: 815156 - RNA, 14 nt, Mycobacterium avium subsp. paratuberculosis
cgaucaccgccgcg

SEQ ID NO: 815157 - RNA, 15 nt, Mycobacterium avium subsp. paratuberculosis
cgaucaccgccgcgg

SEQ ID NO: 815158 - RNA, 16 nt, Mycobacterium avium subsp. paratuberculosis
cgaucaccgccgcggc

SEQ ID NO: 815159 - RNA, 17 nt, Mycobacterium avium subsp. paratuberculosis
cgaucaccgccgcggcg

SEQ ID NO: 815160 - RNA, 12 nt, Mycobacterium avium subsp. paratuberculosis
cgaucaccgcgg

SEQ ID NO: 815161 - RNA, 16 nt, Mycobacterium avium subsp. paratuberculosis
cgaucaccgcggccac

SEQ ID NO: 815162 - RNA, 20 nt, Mycobacterium avium subsp. paratuberculosis
cgaucaccgcggccaccacc

SEQ ID NO: 815163 - RNA, 22 nt, Mycobacterium avium subsp. paratuberculosis
cgaucaccgcggccaccaccgc

SEQ ID NO: 815164 - RNA, 14 nt, Mycobacterium avium subsp. paratuberculosis
cgaucaccgcggcg

SEQ ID NO: 815165 - RNA, 15 nt, Mycobacterium avium subsp. paratuberculosis
cgaucaccgcggcga

SEQ ID NO: 815166 - RNA, 21 nt, Mycobacterium avium subsp. paratuberculosis
cgaucaccgcguucucggcgg

SEQ ID NO: 815167 - RNA, 22 nt, Mycobacterium avium subsp. paratuberculosis
cgaucaccgcguucucggcgga

SEQ ID NO: 815168 - RNA, 15 nt, Mycobacterium avium subsp. paratuberculosis
cgaucaccgcugcca

SEQ ID NO: 815169 - RNA, 14 nt, Mycobacterium avium subsp. paratuberculosis
cgaucaccgacagc

SEQ ID NO: 815170 - RNA, 11 nt, Mycobacterium avium subsp. paratuberculosis
cgaucaccgac

SEQ ID NO: 815171 - RNA, 14 nt, Mycobacterium avium subsp. paratuberculosis
cgaucaccccggcg

SEQ ID NO: 815172 - RNA, 17 nt, Mycobacterium avium subsp. paratuberculosis
cgaucaccccggcgacg

SEQ ID NO: 815173 - RNA, 18 nt, Mycobacterium avium subsp. paratuberculosis
cgaucaccccggcgacgg

SEQ ID NO: 815174 - RNA, 23 nt, Mycobacterium avium subsp. paratuberculosis
cgaucaccccggcgacggcggug

SEQ ID NO: 815175 - RNA, 19 nt, Mycobacterium avium subsp. paratuberculosis
cgaguucugguaggcggcc

SEQ ID NO: 815176 - RNA, 13 nt, Mycobacterium avium subsp. paratuberculosis
cgaguugaacgcg

SEQ ID NO: 815177 - RNA, 14 nt, Mycobacterium avium subsp. paratuberculosis
cgaguucggcggcc

SEQ ID NO: 815178 - RNA, 17 nt, Mycobacterium avium subsp. paratuberculosis
cgaguucggcggcccgc

SEQ ID NO: 815179 - RNA, 14 nt, Mycobacterium avium subsp. paratuberculosis
cgaguucgucgacc

SEQ ID NO: 815180 - RNA, 15 nt, Mycobacterium avium subsp. paratuberculosis
cgaguucgucgacca

SEQ ID NO: 815181 - RNA, 19 nt, Mycobacterium avium subsp. paratuberculosis
cgaguucgucgaccagcgg

SEQ ID NO: 815182 - RNA, 14 nt, Mycobacterium avium subsp. paratuberculosis
cgaguucgccgucg

SEQ ID NO: 815183 - RNA, 18 nt, Mycobacterium avium subsp. paratuberculosis
cgaguucgccgucgacgg

SEQ ID NO: 815184 - RNA, 12 nt, Mycobacterium avium subsp. paratuberculosis
cgaguucgaccu

SEQ ID NO: 815185 - RNA, 17 nt, Mycobacterium avium subsp. paratuberculosis
cgaguuggccaucguca

SEQ ID NO: 815186 - RNA, 19 nt, Mycobacterium avium subsp. paratuberculosis
cgaguuggccaucgucauc

SEQ ID NO: 815187 - RNA, 15 nt, Mycobacterium avium subsp. paratuberculosis
cgaguuucccgucgu

SEQ ID NO: 815188 - RNA, 17 nt, Mycobacterium avium subsp. paratuberculosis
cgaguuucccgucgucg

SEQ ID NO: 815189 - RNA, 23 nt, Mycobacterium avium subsp. paratuberculosis
cgaguuuggccugaaccagcucg

SEQ ID NO: 815190 - RNA, 14 nt, Mycobacterium avium subsp. paratuberculosis
cgaguuuggcgucg

SEQ ID NO: 815191 - RNA, 17 nt, Mycobacterium avium subsp. paratuberculosis
cgaguuuggcgucgaug

SEQ ID NO: 815192 - RNA, 18 nt, Mycobacterium avium subsp. paratuberculosis
cgaguuuggcgucgaugc

SEQ ID NO: 815193 - RNA, 19 nt, Mycobacterium avium subsp. paratuberculosis
cgaguuuggcgucgaugcg

SEQ ID NO: 815194 - RNA, 15 nt, Mycobacterium avium subsp. paratuberculosis
cgaguuuggccagcu

SEQ ID NO: 815195 - RNA, 18 nt, Mycobacterium avium subsp. paratuberculosis
cgaguuuggccagcucgg

SEQ ID NO: 815196 - RNA, 19 nt, Mycobacterium avium subsp. paratuberculosis
cgauaccagccgcggacgg

SEQ ID NO: 815197 - RNA, 21 nt, Mycobacterium avium subsp. paratuberculosis
cgauaccagccgcggacggcc

SEQ ID NO: 815198 - RNA, 20 nt, Mycobacterium avium subsp. paratuberculosis
cgauaccguccgcgcccacc

SEQ ID NO: 815199 - RNA, 15 nt, Mycobacterium avium subsp. paratuberculosis
cgauacgacgggaug

SEQ ID NO: 815200 - RNA, 18 nt, Mycobacterium avium subsp. paratuberculosis
cgaucagggugucgaaca

SEQ ID NO: 815201 - RNA, 23 nt, Mycobacterium avium subsp. paratuberculosis
cgaucagguaguacaggugcagc

SEQ ID NO: 815202 - RNA, 23 nt, Mycobacterium avium subsp. paratuberculosis
cgaucauuccgccgaaacccgcu

SEQ ID NO: 815203 - RNA, 18 nt, Mycobacterium avium subsp. paratuberculosis
cgaucauguagcgcuggu

SEQ ID NO: 815204 - RNA, 13 nt, Mycobacterium avium subsp. paratuberculosis
cgauccacagcgc

SEQ ID NO: 815205 - RNA, 15 nt, Mycobacterium avium subsp. paratuberculosis
cgaucauggucggcg

SEQ ID NO: 815206 - RNA, 15 nt, Mycobacterium avium subsp. paratuberculosis
cgauccacggcgacc

SEQ ID NO: 815207 - RNA, 17 nt, Mycobacterium avium subsp. paratuberculosis
cgauccacggcgacccc

SEQ ID NO: 815208 - RNA, 17 nt, Mycobacterium avium subsp. paratuberculosis
cgauccacucccgcgcg

SEQ ID NO: 815209 - RNA, 20 nt, Mycobacterium avium subsp. paratuberculosis
cgauccacucccgcgcgcug

SEQ ID NO: 815210 - RNA, 18 nt, Mycobacterium avium subsp. paratuberculosis
cgauccacuccgagguca

SEQ ID NO: 815211 - RNA, 16 nt, Mycobacterium avium subsp. paratuberculosis
cgauccacccaccggc

SEQ ID NO: 815212 - RNA, 16 nt, Mycobacterium avium subsp. paratuberculosis
cgaucccgccgcccgc

SEQ ID NO: 815213 - RNA, 12 nt, Mycobacterium avium subsp. paratuberculosis
cgaucccgccgg

SEQ ID NO: 815214 - RNA, 15 nt, Mycobacterium avium subsp. paratuberculosis
cgaucccgccggcga

SEQ ID NO: 815215 - RNA, 18 nt, Mycobacterium avium subsp. paratuberculosis
cgaucccgccggcgaucg

SEQ ID NO: 815216 - RNA, 21 nt, Mycobacterium avium subsp. paratuberculosis
cgaucccgccggcgaucgacg

SEQ ID NO: 815217 - RNA, 16 nt, Mycobacterium avium subsp. paratuberculosis
cgauccacuggaugcc

SEQ ID NO: 815218 - RNA, 13 nt, Mycobacterium avium subsp. paratuberculosis
cgaucccggccac

SEQ ID NO: 815219 - RNA, 15 nt, Mycobacterium avium subsp. paratuberculosis
cgaucccggccacgu

SEQ ID NO: 815220 - RNA, 20 nt, Mycobacterium avium subsp. paratuberculosis
cgaucccggccacgucgaug

SEQ ID NO: 815221 - RNA, 21 nt, Mycobacterium avium subsp. paratuberculosis
cgaucccggccacgucgaugc

SEQ ID NO: 815222 - RNA, 13 nt, Mycobacterium avium subsp. paratuberculosis
cgaucccggcgag

SEQ ID NO: 815223 - RNA, 14 nt, Mycobacterium avium subsp. paratuberculosis
cgaucccggcgagc

SEQ ID NO: 815224 - RNA, 16 nt, Mycobacterium avium subsp. paratuberculosis
cgaucccuuggcggcg

SEQ ID NO: 815225 - RNA, 17 nt, Mycobacterium avium subsp. paratuberculosis
cgaucccuuggcggcgg

SEQ ID NO: 815226 - RNA, 19 nt, Mycobacterium avium subsp. paratuberculosis
cgaucccuuggcggcggcc

SEQ ID NO: 815227 - RNA, 20 nt, Mycobacterium avium subsp. paratuberculosis
cgaucccuuggcggcggcca

SEQ ID NO: 815228 - RNA, 21 nt, Mycobacterium avium subsp. paratuberculosis
cgaucccuuggcggcggccag

SEQ ID NO: 815229 - RNA, 20 nt, Mycobacterium avium subsp. paratuberculosis
cgaucccggcgagcacgccg

SEQ ID NO: 815230 - RNA, 23 nt, Mycobacterium avium subsp. paratuberculosis
cgaucccggacuccucgguggcc

SEQ ID NO: 815231 - RNA, 16 nt, Mycobacterium avium subsp. paratuberculosis
cgaucccgggccguuc

SEQ ID NO: 815232 - RNA, 14 nt, Mycobacterium avium subsp. paratuberculosis
cgaucccgucggcc

SEQ ID NO: 815233 - RNA, 16 nt, Mycobacterium avium subsp. paratuberculosis
cgaucccgucggccau

SEQ ID NO: 815234 - RNA, 18 nt, Mycobacterium avium subsp. paratuberculosis
cgaucccgucggccauca

SEQ ID NO: 815235 - RNA, 15 nt, Mycobacterium avium subsp. paratuberculosis
cgaucccgucgucgg

SEQ ID NO: 815236 - RNA, 19 nt, Mycobacterium avium subsp. paratuberculosis
cgaucccgucgucggcgcc

SEQ ID NO: 815237 - RNA, 20 nt, Mycobacterium avium subsp. paratuberculosis
cgauccgcggguacggucgg

SEQ ID NO: 815238 - RNA, 22 nt, Mycobacterium avium subsp. paratuberculosis
cgauccgcggguacggucggcc

SEQ ID NO: 815239 - RNA, 14 nt, Mycobacterium avium subsp. paratuberculosis
cgauccgcgccgcc

SEQ ID NO: 815240 - RNA, 18 nt, Mycobacterium avium subsp. paratuberculosis
cgauccgcgccgcgaugc

SEQ ID NO: 815241 - RNA, 13 nt, Mycobacterium avium subsp. paratuberculosis
cgauccgcgcggc

SEQ ID NO: 815242 - RNA, 14 nt, Mycobacterium avium subsp. paratuberculosis
cgauccgcgcggcg

SEQ ID NO: 815243 - RNA, 16 nt, Mycobacterium avium subsp. paratuberculosis
cgauccgcgcggcgac

SEQ ID NO: 815244 - RNA, 20 nt, Mycobacterium avium subsp. paratuberculosis
cgauccgcgcggcgacgauc

SEQ ID NO: 815245 - RNA, 17 nt, Mycobacterium avium subsp. paratuberculosis
cgauccgcgcgucgggc

SEQ ID NO: 815246 - RNA, 12 nt, Mycobacterium avium subsp. paratuberculosis
cgauccgccggc

SEQ ID NO: 815247 - RNA, 15 nt, Mycobacterium avium subsp. paratuberculosis
cgauccgccggugcc

SEQ ID NO: 815248 - RNA, 22 nt, Mycobacterium avium subsp. paratuberculosis
cgauccgccggugccguugauc

SEQ ID NO: 815249 - RNA, 12 nt, Mycobacterium avium subsp. paratuberculosis
cgauccgcagcc

SEQ ID NO: 815250 - RNA, 16 nt, Mycobacterium avium subsp. paratuberculosis
cgauccgcagccgcug

SEQ ID NO: 815251 - RNA, 21 nt, Mycobacterium avium subsp. paratuberculosis
cgauccgcaggaaagcgucac

SEQ ID NO: 815252 - RNA, 13 nt, Mycobacterium avium subsp. paratuberculosis
cgauccgcaggcc

SEQ ID NO: 815253 - RNA, 17 nt, Mycobacterium avium subsp. paratuberculosis
cgauccgcaggccgucg

SEQ ID NO: 815254 - RNA, 18 nt, Mycobacterium avium subsp. paratuberculosis
cgauccgcaggccgucgc

SEQ ID NO: 815255 - RNA, 16 nt, Mycobacterium avium subsp. paratuberculosis
cgaucagagcgggccg

SEQ ID NO: 815256 - RNA, 18 nt, Mycobacterium avium subsp. paratuberculosis
cgaucagagcgggccgac

SEQ ID NO: 815257 - RNA, 17 nt, Mycobacterium avium subsp. paratuberculosis
cgaucacguucucggcg

SEQ ID NO: 815258 - RNA, 14 nt, Mycobacterium avium subsp. paratuberculosis
cgaucacgucggug

SEQ ID NO: 815259 - RNA, 14 nt, Mycobacterium avium subsp. paratuberculosis
cgaucagcgcgccg

SEQ ID NO: 815260 - RNA, 15 nt, Mycobacterium avium subsp. paratuberculosis
cgaucagcgcgccgc

SEQ ID NO: 815261 - RNA, 13 nt, Mycobacterium avium subsp. paratuberculosis
cgaucagcgcgcc

SEQ ID NO: 815262 - RNA, 17 nt, Mycobacterium avium subsp. paratuberculosis
cgaucagcgcgcacagc

SEQ ID NO: 815263 - RNA, 18 nt, Mycobacterium avium subsp. paratuberculosis
cgaucagcgcgcacagcg

SEQ ID NO: 815264 - RNA, 13 nt, Mycobacterium avium subsp. paratuberculosis
cgaucagcgcgaa

SEQ ID NO: 815265 - RNA, 14 nt, Mycobacterium avium subsp. paratuberculosis
cgaucagcagcacc

SEQ ID NO: 815266 - RNA, 17 nt, Mycobacterium avium subsp. paratuberculosis
cgaucagcacgucgcgg

SEQ ID NO: 815267 - RNA, 22 nt, Mycobacterium avium subsp. paratuberculosis
cgaucagcagaugcgugcggug

SEQ ID NO: 815268 - RNA, 15 nt, Mycobacterium avium subsp. paratuberculosis
cgaucagcaccaggu

SEQ ID NO: 815269 - RNA, 21 nt, Mycobacterium avium subsp. paratuberculosis
cgaucagcaccagguugucgc

SEQ ID NO: 815270 - RNA, 23 nt, Mycobacterium avium subsp. paratuberculosis
cgaucagcaccagguugucgccg

SEQ ID NO: 815271 - RNA, 18 nt, Mycobacterium avium subsp. paratuberculosis
cgaucagcgcgucgaggu

SEQ ID NO: 815272 - RNA, 16 nt, Mycobacterium avium subsp. paratuberculosis
cgaucagcugcucggc

SEQ ID NO: 815273 - RNA, 19 nt, Mycobacterium avium subsp. paratuberculosis
cgaucagcugcucggccac

SEQ ID NO: 815274 - RNA, 20 nt, Mycobacterium avium subsp. paratuberculosis
cgaucagcugcucggccacc

SEQ ID NO: 815275 - RNA, 13 nt, Mycobacterium avium subsp. paratuberculosis
cgaucagcggcgg

SEQ ID NO: 815276 - RNA, 15 nt, Mycobacterium avium subsp. paratuberculosis
cgaucagcggcgggc

SEQ ID NO: 815277 - RNA, 21 nt, Mycobacterium avium subsp. paratuberculosis
cgaucagcggcgggcccagca

SEQ ID NO: 815278 - RNA, 18 nt, Mycobacterium avium subsp. paratuberculosis
cgaucagcgucagcaccg

SEQ ID NO: 815279 - RNA, 21 nt, Mycobacterium avium subsp. paratuberculosis
cgaucagcgucagcaccgcga

SEQ ID NO: 815280 - RNA, 23 nt, Mycobacterium avium subsp. paratuberculosis
cgaucagcgucagcaccgcgacg

SEQ ID NO: 815281 - RNA, 14 nt, Mycobacterium avium subsp. paratuberculosis
cgaucagcgucauc

SEQ ID NO: 815282 - RNA, 18 nt, Mycobacterium avium subsp. paratuberculosis
cgaucagcgucaucacgu

SEQ ID NO: 815283 - RNA, 15 nt, Mycobacterium avium subsp. paratuberculosis
cgaucagcucguggc

SEQ ID NO: 815284 - RNA, 16 nt, Mycobacterium avium subsp. paratuberculosis
cgaucagcucguggcg

SEQ ID NO: 815285 - RNA, 17 nt, Mycobacterium avium subsp. paratuberculosis
cgaucagcucguggcgg

SEQ ID NO: 815286 - RNA, 22 nt, Mycobacterium avium subsp. paratuberculosis
cgaucagcucguggcgggcccg

SEQ ID NO: 815287 - RNA, 18 nt, Mycobacterium avium subsp. paratuberculosis
cgaucaggcugccgcugc

SEQ ID NO: 815288 - RNA, 22 nt, Mycobacterium avium subsp. paratuberculosis
cgaucaggcugccgcugcgccg

SEQ ID NO: 815289 - RNA, 13 nt, Mycobacterium avium subsp. paratuberculosis
cgaucaggcugga

SEQ ID NO: 815290 - RNA, 17 nt, Mycobacterium avium subsp. paratuberculosis
cgaucagggccgcggcc

SEQ ID NO: 815291 - RNA, 21 nt, Mycobacterium avium subsp. paratuberculosis
cgaucagggccgcggccgccg

SEQ ID NO: 815292 - RNA, 22 nt, Mycobacterium avium subsp. paratuberculosis
cgaucagggccgcggccgccgc

SEQ ID NO: 815293 - RNA, 15 nt, Mycobacterium avium subsp. paratuberculosis
cgaucagggcggcgc

SEQ ID NO: 815294 - RNA, 16 nt, Mycobacterium avium subsp. paratuberculosis
cgaucagggcggcgcc

SEQ ID NO: 815295 - RNA, 18 nt, Mycobacterium avium subsp. paratuberculosis
cgaucagggcggcgccgc

SEQ ID NO: 815296 - RNA, 22 nt, Mycobacterium avium subsp. paratuberculosis
cgaucagggcggcgccgcggcc

SEQ ID NO: 815297 - RNA, 18 nt, Mycobacterium avium subsp. paratuberculosis
cgaucaggaucggcgggc

SEQ ID NO: 815298 - RNA, 14 nt, Mycobacterium avium subsp. paratuberculosis
cgaucaggccggcc

SEQ ID NO: 815299 - RNA, 17 nt, Mycobacterium avium subsp. paratuberculosis
cgaucaggccggccacc

SEQ ID NO: 815300 - RNA, 13 nt, Mycobacterium avium subsp. paratuberculosis
cgaucaggcgcag

SEQ ID NO: 815301 - RNA, 16 nt, Mycobacterium avium subsp. paratuberculosis
cgaucaggcgcagccc

SEQ ID NO: 815302 - RNA, 17 nt, Mycobacterium avium subsp. paratuberculosis
cgaucaggcgcagcccg

SEQ ID NO: 815303 - RNA, 18 nt, Mycobacterium avium subsp. paratuberculosis
cgaucaggcgcagcccga

SEQ ID NO: 815304 - RNA, 21 nt, Mycobacterium avium subsp. paratuberculosis
cgcauuggugccggccucguc

SEQ ID NO: 815305 - RNA, 13 nt, Mycobacterium avium subsp. paratuberculosis
cgcauuucccgag

SEQ ID NO: 815306 - RNA, 16 nt, Mycobacterium avium subsp. paratuberculosis
cgccaacugguccugc

SEQ ID NO: 815307 - RNA, 22 nt, Mycobacterium avium subsp. paratuberculosis
cgccaacugaauuccuggccgg

SEQ ID NO: 815308 - RNA, 21 nt, Mycobacterium avium subsp. paratuberculosis
cgccacaccucggcgaccucg

SEQ ID NO: 815309 - RNA, 17 nt, Mycobacterium avium subsp. paratuberculosis
cgccacaauggauccga

SEQ ID NO: 815310 - RNA, 14 nt, Mycobacterium avium subsp. paratuberculosis
cgccacaacuggcc

SEQ ID NO: 815311 - RNA, 16 nt, Mycobacterium avium subsp. paratuberculosis
cgccacaacuggccgg

SEQ ID NO: 815312 - RNA, 17 nt, Mycobacterium avium subsp. paratuberculosis
cgccacaacuggccggg

SEQ ID NO: 815313 - RNA, 19 nt, Mycobacterium avium subsp. paratuberculosis
cgccacaacuggucgugcu

SEQ ID NO: 815314 - RNA, 19 nt, Mycobacterium avium subsp. paratuberculosis
cgccaaugguuuucgucga

SEQ ID NO: 815315 - RNA, 22 nt, Mycobacterium avium subsp. paratuberculosis
cgccaaugguuuucgucgauca

SEQ ID NO: 815316 - RNA, 18 nt, Mycobacterium avium subsp. paratuberculosis
cgccacaaacagcgcggc

SEQ ID NO: 815317 - RNA, 13 nt, Mycobacterium avium subsp. paratuberculosis
cgccacaucagcu

SEQ ID NO: 815318 - RNA, 17 nt, Mycobacterium avium subsp. paratuberculosis
cgccacaucagcucggc

SEQ ID NO: 815319 - RNA, 21 nt, Mycobacterium avium subsp. paratuberculosis
cgccacaucagcucggcggcc

SEQ ID NO: 815320 - RNA, 23 nt, Mycobacterium avium subsp. paratuberculosis
cgccacaucagcucggcggccuc

SEQ ID NO: 815321 - RNA, 14 nt, Mycobacterium avium subsp. paratuberculosis
cgccacaucgggau

SEQ ID NO: 815322 - RNA, 21 nt, Mycobacterium avium subsp. paratuberculosis
cgccacagcgccucgcggucg

SEQ ID NO: 815323 - RNA, 20 nt, Mycobacterium avium subsp. paratuberculosis
cgccacagcgucucgaccgc

SEQ ID NO: 815324 - RNA, 14 nt, Mycobacterium avium subsp. paratuberculosis
cgccacagcagcac

SEQ ID NO: 815325 - RNA, 16 nt, Mycobacterium avium subsp. paratuberculosis
cgccacagcagcacca

SEQ ID NO: 815326 - RNA, 22 nt, Mycobacterium avium subsp. paratuberculosis
cgccacaccgaagaaccccgag

SEQ ID NO: 815327 - RNA, 19 nt, Mycobacterium avium subsp. paratuberculosis
cgccaccaccacggggcgg

SEQ ID NO: 815328 - RNA, 21 nt, Mycobacterium avium subsp. paratuberculosis
cgccaccaccacggggcgggu

SEQ ID NO: 815329 - RNA, 12 nt, Mycobacterium avium subsp. paratuberculosis
cgccaccaccag

SEQ ID NO: 815330 - RNA, 13 nt, Mycobacterium avium subsp. paratuberculosis
cgccaccaccagc

SEQ ID NO: 815331 - RNA, 19 nt, Mycobacterium avium subsp. paratuberculosis
cgccaccaccagcgggcug

SEQ ID NO: 815332 - RNA, 16 nt, Mycobacterium avium subsp. paratuberculosis
cgccaccaccagcggu

SEQ ID NO: 815333 - RNA, 15 nt, Mycobacterium avium subsp. paratuberculosis
cgccaccaccgcgcc

SEQ ID NO: 815334 - RNA, 16 nt, Mycobacterium avium subsp. paratuberculosis
cgccaccaccgcgccg

SEQ ID NO: 815335 - RNA, 17 nt, Mycobacterium avium subsp. paratuberculosis
cgccaccaccgcgccgu

SEQ ID NO: 815336 - RNA, 19 nt, Mycobacterium avium subsp. paratuberculosis
cgccaccaccgcgccgucg

SEQ ID NO: 815337 - RNA, 20 nt, Mycobacterium avium subsp. paratuberculosis
cgccaccaccgcgccgucgu

SEQ ID NO: 815338 - RNA, 15 nt, Mycobacterium avium subsp. paratuberculosis
cgccaccacccggcg

SEQ ID NO: 815339 - RNA, 17 nt, Mycobacterium avium subsp. paratuberculosis
cgccaccacccggcgau

SEQ ID NO: 815340 - RNA, 19 nt, Mycobacterium avium subsp. paratuberculosis
cgccaccaccuucaucgcc

SEQ ID NO: 815341 - RNA, 23 nt, Mycobacterium avium subsp. paratuberculosis
cgccaccaccuucaucgccgucg

SEQ ID NO: 815342 - RNA, 19 nt, Mycobacterium avium subsp. paratuberculosis
cgccaccacggcgcccucg

SEQ ID NO: 815343 - RNA, 15 nt, Mycobacterium avium subsp. paratuberculosis
cgccaccacggcguc

SEQ ID NO: 815344 - RNA, 16 nt, Mycobacterium avium subsp. paratuberculosis
cgccaccacggcgucg

SEQ ID NO: 815345 - RNA, 17 nt, Mycobacterium avium subsp. paratuberculosis
cgccaccacggcgucgc

SEQ ID NO: 815346 - RNA, 20 nt, Mycobacterium avium subsp. paratuberculosis
cgccaccacggcgucgcuga

SEQ ID NO: 815347 - RNA, 20 nt, Mycobacterium avium subsp. paratuberculosis
cgccaccagccacaccgccg

SEQ ID NO: 815348 - RNA, 17 nt, Mycobacterium avium subsp. paratuberculosis
cgccaccagcaccggga

SEQ ID NO: 815349 - RNA, 13 nt, Mycobacterium avium subsp. paratuberculosis
cgccaccagaccg

SEQ ID NO: 815350 - RNA, 15 nt, Mycobacterium avium subsp. paratuberculosis
cgccaccagaccggc

SEQ ID NO: 815351 - RNA, 16 nt, Mycobacterium avium subsp. paratuberculosis
cgccaccagaccggcg

SEQ ID NO: 815352 - RNA, 17 nt, Mycobacterium avium subsp. paratuberculosis
cgccaccagaccggcga

SEQ ID NO: 815353 - RNA, 19 nt, Mycobacterium avium subsp. paratuberculosis
cgccaccagaccggcgaag

SEQ ID NO: 815354 - RNA, 11 nt, Mycobacterium avium subsp. paratuberculosis
cgccaccagca

SEQ ID NO: 815355 - RNA, 13 nt, Mycobacterium avium subsp. paratuberculosis
cgccaccccgaac

SEQ ID NO: 815356 - RNA, 21 nt, Mycobacterium avium subsp. paratuberculosis
cgccaccccgaacccggccag

SEQ ID NO: 815357 - RNA, 15 nt, Mycobacterium avium subsp. paratuberculosis
cgccaccccgagcuc

SEQ ID NO: 815358 - RNA, 19 nt, Mycobacterium avium subsp. paratuberculosis
cgccaccccgagcucgggc

SEQ ID NO: 815359 - RNA, 22 nt, Mycobacterium avium subsp. paratuberculosis
cgccaccccgagcucgggcgcg

SEQ ID NO: 815360 - RNA, 13 nt, Mycobacterium avium subsp. paratuberculosis
cgcauggccggcg

SEQ ID NO: 815361 - RNA, 15 nt, Mycobacterium avium subsp. paratuberculosis
cgcauggccggcgaa

SEQ ID NO: 815362 - RNA, 22 nt, Mycobacterium avium subsp. paratuberculosis
cgcauggccggcgaaccgccgc

SEQ ID NO: 815363 - RNA, 19 nt, Mycobacterium avium subsp. paratuberculosis
cgcauggagaugcuucagc

SEQ ID NO: 815364 - RNA, 18 nt, Mycobacterium avium subsp. paratuberculosis
cgcaucugcucggcgucc

SEQ ID NO: 815365 - RNA, 19 nt, Mycobacterium avium subsp. paratuberculosis
cgcaugaccgauccgccgg

SEQ ID NO: 815366 - RNA, 21 nt, Mycobacterium avium subsp. paratuberculosis
cgcaugaccgauccgccggcg

SEQ ID NO: 815367 - RNA, 23 nt, Mycobacterium avium subsp. paratuberculosis
cgcaugaccgauccgccggcgaa

SEQ ID NO: 815368 - RNA, 13 nt, Mycobacterium avium subsp. paratuberculosis
cgcaucggcgccg

SEQ ID NO: 815369 - RNA, 15 nt, Mycobacterium avium subsp. paratuberculosis
cgcaucggcgacgcc

SEQ ID NO: 815370 - RNA, 16 nt, Mycobacterium avium subsp. paratuberculosis
cgcaucggcgacgccg

SEQ ID NO: 815371 - RNA, 12 nt, Mycobacterium avium subsp. paratuberculosis
cgcaucggcgcc

SEQ ID NO: 815372 - RNA, 20 nt, Mycobacterium avium subsp. paratuberculosis
cgcaucgggcgacaucucgg

SEQ ID NO: 815373 - RNA, 17 nt, Mycobacterium avium subsp. paratuberculosis
cgcaucggucaccagcu

SEQ ID NO: 815374 - RNA, 19 nt, Mycobacterium avium subsp. paratuberculosis
cgcaucggucaccagcucc

SEQ ID NO: 815375 - RNA, 19 nt, Mycobacterium avium subsp. paratuberculosis
cgcaucguugccggcggcg

SEQ ID NO: 815376 - RNA, 19 nt, Mycobacterium avium subsp. paratuberculosis
cgcaucucgaaugcggcug

SEQ ID NO: 815377 - RNA, 17 nt, Mycobacterium avium subsp. paratuberculosis
cgcagguuguccagccg

SEQ ID NO: 815378 - RNA, 19 nt, Mycobacterium avium subsp. paratuberculosis
cgcagguuguccagccggu

SEQ ID NO: 815379 - RNA, 17 nt, Mycobacterium avium subsp. paratuberculosis
cgcagguugucggccaa

SEQ ID NO: 815380 - RNA, 20 nt, Mycobacterium avium subsp. paratuberculosis
cgcagguucaugugaccggg

SEQ ID NO: 815381 - RNA, 14 nt, Mycobacterium avium subsp. paratuberculosis
cgcaggugugcggc

SEQ ID NO: 815382 - RNA, 17 nt, Mycobacterium avium subsp. paratuberculosis
cgcaggugccggugacg

SEQ ID NO: 815383 - RNA, 17 nt, Mycobacterium avium subsp. paratuberculosis
cgcagguggugggcgug

SEQ ID NO: 815384 - RNA, 16 nt, Mycobacterium avium subsp. paratuberculosis
cgcagguguccagccc

SEQ ID NO: 815385 - RNA, 13 nt, Mycobacterium avium subsp. paratuberculosis
cgcaggugggcgg

SEQ ID NO: 815386 - RNA, 15 nt, Mycobacterium avium subsp. paratuberculosis
cgcaggugggcggug

SEQ ID NO: 815387 - RNA, 22 nt, Mycobacterium avium subsp. paratuberculosis
cgcauccucauagccggccgcg

SEQ ID NO: 815388 - RNA, 14 nt, Mycobacterium avium subsp. paratuberculosis
cgcaucgcggcgau

SEQ ID NO: 815389 - RNA, 15 nt, Mycobacterium avium subsp. paratuberculosis
cgcaucgcggcgaug

SEQ ID NO: 815390 - RNA, 21 nt, Mycobacterium avium subsp. paratuberculosis
cgcaucgcgggccaccggcgc

SEQ ID NO: 815391 - RNA, 22 nt, Mycobacterium avium subsp. paratuberculosis
cgcaucgcgggccaccggcgcc

SEQ ID NO: 815392 - RNA, 23 nt, Mycobacterium avium subsp. paratuberculosis
cgcaucgcgggccaccggcgcca

SEQ ID NO: 815393 - RNA, 16 nt, Mycobacterium avium subsp. paratuberculosis
cgcaucgccucggcgg

SEQ ID NO: 815394 - RNA, 18 nt, Mycobacterium avium subsp. paratuberculosis
cgcaucgccucggcggcc

SEQ ID NO: 815395 - RNA, 20 nt, Mycobacterium avium subsp. paratuberculosis
cgcaucgccucggcggccgc

SEQ ID NO: 815396 - RNA, 16 nt, Mycobacterium avium subsp. paratuberculosis
cgcaucgccggcgaug

SEQ ID NO: 815397 - RNA, 15 nt, Mycobacterium avium subsp. paratuberculosis
cgcaucgccggcgcg

SEQ ID NO: 815398 - RNA, 16 nt, Mycobacterium avium subsp. paratuberculosis
cgcaucgccggcgcgc

SEQ ID NO: 815399 - RNA, 12 nt, Mycobacterium avium subsp. paratuberculosis
cgcaucgccguc

SEQ ID NO: 815400 - RNA, 22 nt, Mycobacterium avium subsp. paratuberculosis
cgcaucgccguccacgggucgc

SEQ ID NO: 815401 - RNA, 15 nt, Mycobacterium avium subsp. paratuberculosis
cgcaucgccgaaccg

SEQ ID NO: 815402 - RNA, 12 nt, Mycobacterium avium subsp. paratuberculosis
cgcaucgccgag

SEQ ID NO: 815403 - RNA, 18 nt, Mycobacterium avium subsp. paratuberculosis
cgcaucgccgagagcguc

SEQ ID NO: 815404 - RNA, 20 nt, Mycobacterium avium subsp. paratuberculosis
cgcaucgacugcgacacccg

SEQ ID NO: 815405 - RNA, 21 nt, Mycobacterium avium subsp. paratuberculosis
cgcaucgacugcgacacccgc

SEQ ID NO: 815406 - RNA, 15 nt, Mycobacterium avium subsp. paratuberculosis
cgcaucgaaccgccg

SEQ ID NO: 815407 - RNA, 18 nt, Mycobacterium avium subsp. paratuberculosis
cgcaucgaaccgccgcgc

SEQ ID NO: 815408 - RNA, 14 nt, Mycobacterium avium subsp. paratuberculosis
cgccagaucgccau

SEQ ID NO: 815409 - RNA, 15 nt, Mycobacterium avium subsp. paratuberculosis
cgccagaucgccugg

SEQ ID NO: 815410 - RNA, 16 nt, Mycobacterium avium subsp. paratuberculosis
cgccagaucgcugaug

SEQ ID NO: 815411 - RNA, 17 nt, Mycobacterium avium subsp. paratuberculosis
cgccagaucgcugaugc

SEQ ID NO: 815412 - RNA, 19 nt, Mycobacterium avium subsp. paratuberculosis
cgccagaucgcugaugcgc

SEQ ID NO: 815413 - RNA, 17 nt, Mycobacterium avium subsp. paratuberculosis
cgccagaugcgccgcgg

SEQ ID NO: 815414 - RNA, 18 nt, Mycobacterium avium subsp. paratuberculosis
cgccagaugcgccgcgga

SEQ ID NO: 815415 - RNA, 13 nt, Mycobacterium avium subsp. paratuberculosis
cgccagcaacacc

SEQ ID NO: 815416 - RNA, 14 nt, Mycobacterium avium subsp. paratuberculosis
cgccagcaacaccc

SEQ ID NO: 815417 - RNA, 22 nt, Mycobacterium avium subsp. paratuberculosis
cgccagcaacacccagccgcug

SEQ ID NO: 815418 - RNA, 20 nt, Mycobacterium avium subsp. paratuberculosis
cgccagcagcagccgcgccg

SEQ ID NO: 815419 - RNA, 22 nt, Mycobacterium avium subsp. paratuberculosis
cgccagcagcagccgcgccgcc

SEQ ID NO: 815420 - RNA, 23 nt, Mycobacterium avium subsp. paratuberculosis
cgccagcagcagccgcgccgccg

SEQ ID NO: 815421 - RNA, 19 nt, Mycobacterium avium subsp. paratuberculosis
cgccagcagcacggcaaug

SEQ ID NO: 815422 - RNA, 17 nt, Mycobacterium avium subsp. paratuberculosis
cgccagcagcugcggga

SEQ ID NO: 815423 - RNA, 20 nt, Mycobacterium avium subsp. paratuberculosis
cgccagcagcugcgggacca

SEQ ID NO: 815424 - RNA, 16 nt, Mycobacterium avium subsp. paratuberculosis
cgccagcagcgcgccg

SEQ ID NO: 815425 - RNA, 19 nt, Mycobacterium avium subsp. paratuberculosis
cgccagcagcgcgccgcgc

SEQ ID NO: 815426 - RNA, 14 nt, Mycobacterium avium subsp. paratuberculosis
cgccagcagcggca

SEQ ID NO: 815427 - RNA, 16 nt, Mycobacterium avium subsp. paratuberculosis
cgccagcagcggcacc

SEQ ID NO: 815428 - RNA, 20 nt, Mycobacterium avium subsp. paratuberculosis
cgccagcagcggcacccggu

SEQ ID NO: 815429 - RNA, 16 nt, Mycobacterium avium subsp. paratuberculosis
cgccagcagcagcgcc

SEQ ID NO: 815430 - RNA, 22 nt, Mycobacterium avium subsp. paratuberculosis
cgccagcagcagcgccgccacc

SEQ ID NO: 815431 - RNA, 18 nt, Mycobacterium avium subsp. paratuberculosis
cgccagcagcagcgcggc

SEQ ID NO: 815432 - RNA, 21 nt, Mycobacterium avium subsp. paratuberculosis
cgccagcagcagcgcggcaug

SEQ ID NO: 815433 - RNA, 20 nt, Mycobacterium avium subsp. paratuberculosis
cgccagccaggcgaugaagc

SEQ ID NO: 815434 - RNA, 13 nt, Mycobacterium avium subsp. paratuberculosis
cgccagcagggca

SEQ ID NO: 815435 - RNA, 22 nt, Mycobacterium avium subsp. paratuberculosis
cgccagcagggcaucucccgcg

SEQ ID NO: 815436 - RNA, 23 nt, Mycobacterium avium subsp. paratuberculosis
cgccagcagggcaucucccgcgc

SEQ ID NO: 815437 - RNA, 19 nt, Mycobacterium avium subsp. paratuberculosis
cgccagccccaccggccac

SEQ ID NO: 815438 - RNA, 14 nt, Mycobacterium avium subsp. paratuberculosis
cgccagccgcaccg

SEQ ID NO: 815439 - RNA, 13 nt, Mycobacterium avium subsp. paratuberculosis
cgccagcgaccgc

SEQ ID NO: 815440 - RNA, 23 nt, Mycobacterium avium subsp. paratuberculosis
cgccagcgaccgcaggucgaugg

SEQ ID NO: 815441 - RNA, 16 nt, Mycobacterium avium subsp. paratuberculosis
cgccagcgacggccgg

SEQ ID NO: 815442 - RNA, 15 nt, Mycobacterium avium subsp. paratuberculosis
cgccagcccgcccag

SEQ ID NO: 815443 - RNA, 16 nt, Mycobacterium avium subsp. paratuberculosis
cgccagcccgcccagc

SEQ ID NO: 815444 - RNA, 20 nt, Mycobacterium avium subsp. paratuberculosis
cgccagcccgcccagcgcca

SEQ ID NO: 815445 - RNA, 14 nt, Mycobacterium avium subsp. paratuberculosis
cgccagcccgccga

SEQ ID NO: 815446 - RNA, 15 nt, Mycobacterium avium subsp. paratuberculosis
cgccagcccgccgaa

SEQ ID NO: 815447 - RNA, 16 nt, Mycobacterium avium subsp. paratuberculosis
cgccagcccgccgaac

SEQ ID NO: 815448 - RNA, 18 nt, Mycobacterium avium subsp. paratuberculosis
cgccagcccgccgaacca

SEQ ID NO: 815449 - RNA, 23 nt, Mycobacterium avium subsp. paratuberculosis
cgccagcccgccgaaccagaucg

SEQ ID NO: 815450 - RNA, 12 nt, Mycobacterium avium subsp. paratuberculosis
cgccagcccggc

SEQ ID NO: 815451 - RNA, 14 nt, Mycobacterium avium subsp. paratuberculosis
cgccagcccggcgu

SEQ ID NO: 815452 - RNA, 15 nt, Mycobacterium avium subsp. paratuberculosis
cgccagcccggcgua

SEQ ID NO: 815453 - RNA, 22 nt, Mycobacterium avium subsp. paratuberculosis
cgccagcccggugaucgccgcc

SEQ ID NO: 815454 - RNA, 23 nt, Mycobacterium avium subsp. paratuberculosis
cgccagcccggugaucgccgccc

SEQ ID NO: 815455 - RNA, 14 nt, Mycobacterium avium subsp. paratuberculosis
cgccagcgccaccc

SEQ ID NO: 815456 - RNA, 14 nt, Mycobacterium avium subsp. paratuberculosis
cgccagcgccacgc

SEQ ID NO: 815457 - RNA, 16 nt, Mycobacterium avium subsp. paratuberculosis
cgccagcgccacgcuc

SEQ ID NO: 815458 - RNA, 19 nt, Mycobacterium avium subsp. paratuberculosis
cgccagcgccacgcucaug

SEQ ID NO: 815459 - RNA, 13 nt, Mycobacterium avium subsp. paratuberculosis
cgccagcgcaccg

SEQ ID NO: 815460 - RNA, 11 nt, Mycobacterium avium subsp. paratuberculosis
cgccagcgccc

SEQ ID NO: 815461 - RNA, 13 nt, Mycobacterium avium subsp. paratuberculosis
cgccagcgcccgc

SEQ ID NO: 815462 - RNA, 15 nt, Mycobacterium avium subsp. paratuberculosis
cgccagcgcccgcgc

SEQ ID NO: 815463 - RNA, 15 nt, Mycobacterium avium subsp. paratuberculosis
cgccagcgccgcaac

SEQ ID NO: 815464 - RNA, 22 nt, Mycobacterium avium subsp. paratuberculosis
cgccagcgccgcaacggcuccc

SEQ ID NO: 815465 - RNA, 12 nt, Mycobacterium avium subsp. paratuberculosis
cgccagcggccg

SEQ ID NO: 815466 - RNA, 19 nt, Mycobacterium avium subsp. paratuberculosis
cgccagcgguccagcguga

SEQ ID NO: 815467 - RNA, 20 nt, Mycobacterium avium subsp. paratuberculosis
cgccagcggcuugccguugu

SEQ ID NO: 815468 - RNA, 15 nt, Mycobacterium avium subsp. paratuberculosis
cgccagcucggcggc

SEQ ID NO: 815469 - RNA, 15 nt, Mycobacterium avium subsp. paratuberculosis
cgccagcgggccgac

SEQ ID NO: 815470 - RNA, 20 nt, Mycobacterium avium subsp. paratuberculosis
cgccagcgggccgugccgcc

SEQ ID NO: 815471 - RNA, 21 nt, Mycobacterium avium subsp. paratuberculosis
cgccagcgggccgugccgcca

SEQ ID NO: 815472 - RNA, 17 nt, Mycobacterium avium subsp. paratuberculosis
cgccagcucggcggccg

SEQ ID NO: 815473 - RNA, 16 nt, Mycobacterium avium subsp. paratuberculosis
cgccagcucguccagc

SEQ ID NO: 815474 - RNA, 13 nt, Mycobacterium avium subsp. paratuberculosis
cgccagcugcgga

SEQ ID NO: 815475 - RNA, 19 nt, Mycobacterium avium subsp. paratuberculosis
cgccagcugcggaucgggc

SEQ ID NO: 815476 - RNA, 22 nt, Mycobacterium avium subsp. paratuberculosis
cgccagcugcggaucgggcgug

SEQ ID NO: 815477 - RNA, 15 nt, Mycobacterium avium subsp. paratuberculosis
cgccagcugccgcga

SEQ ID NO: 815478 - RNA, 20 nt, Mycobacterium avium subsp. paratuberculosis
cgccagcugccgcgacucgg

SEQ ID NO: 815479 - RNA, 23 nt, Mycobacterium avium subsp. paratuberculosis
cgccaggaaccacaccccggcca

SEQ ID NO: 815480 - RNA, 14 nt, Mycobacterium avium subsp. paratuberculosis
cgccagcugggcag

SEQ ID NO: 815481 - RNA, 14 nt, Mycobacterium avium subsp. paratuberculosis
cgccagcugggugg

SEQ ID NO: 815482 - RNA, 14 nt, Mycobacterium avium subsp. paratuberculosis
cgccagaucagcgu

SEQ ID NO: 815483 - RNA, 21 nt, Mycobacterium avium subsp. paratuberculosis
cgccagaucagcguggucagc

SEQ ID NO: 815484 - RNA, 23 nt, Mycobacterium avium subsp. paratuberculosis
cgccagaucagcguggucagcgu

SEQ ID NO: 815485 - RNA, 15 nt, Mycobacterium avium subsp. paratuberculosis
cgccagaucccgcag

SEQ ID NO: 815486 - RNA, 16 nt, Mycobacterium avium subsp. paratuberculosis
cgccagaucccgcagc

SEQ ID NO: 815487 - RNA, 19 nt, Mycobacterium avium subsp. paratuberculosis
cgccagauagggcagcguc

SEQ ID NO: 815488 - RNA, 14 nt, Mycobacterium avium subsp. paratuberculosis
cgccacuucuccac

SEQ ID NO: 815489 - RNA, 19 nt, Mycobacterium avium subsp. paratuberculosis
cgccacuucuccacgccga

SEQ ID NO: 815490 - RNA, 21 nt, Mycobacterium avium subsp. paratuberculosis
cgccacuucuccacgccgacg

SEQ ID NO: 815491 - RNA, 24 nt, Mycobacterium avium subsp. paratuberculosis
cgccacuucuccacgccgacgaac

SEQ ID NO: 815492 - RNA, 20 nt, Mycobacterium avium subsp. paratuberculosis
cgccacguagcagcagaccg

SEQ ID NO: 815493 - RNA, 23 nt, Mycobacterium avium subsp. paratuberculosis
cgccacguagcagcagaccgcga

SEQ ID NO: 815494 - RNA, 18 nt, Mycobacterium avium subsp. paratuberculosis
cgccacguaucgcgccug

SEQ ID NO: 815495 - RNA, 14 nt, Mycobacterium avium subsp. paratuberculosis
cgccacugggcguc

SEQ ID NO: 815496 - RNA, 16 nt, Mycobacterium avium subsp. paratuberculosis
cgccacugggcgucgg

SEQ ID NO: 815497 - RNA, 18 nt, Mycobacterium avium subsp. paratuberculosis
cgccacugggcgucggcg

SEQ ID NO: 815498 - RNA, 22 nt, Mycobacterium avium subsp. paratuberculosis
cgccacggguugagccagacgg

SEQ ID NO: 815499 - RNA, 15 nt, Mycobacterium avium subsp. paratuberculosis
cgccacgguggcggu

SEQ ID NO: 815500 - RNA, 18 nt, Mycobacterium avium subsp. paratuberculosis
cgccacggggcccgcgac

SEQ ID NO: 815501 - RNA, 12 nt, Mycobacterium avium subsp. paratuberculosis
cgccacggggcg

SEQ ID NO: 815502 - RNA, 14 nt, Mycobacterium avium subsp. paratuberculosis
cgccacggggcgcc

SEQ ID NO: 815503 - RNA, 19 nt, Mycobacterium avium subsp. paratuberculosis
cgccacggggcgccgcugc

SEQ ID NO: 815504 - RNA, 13 nt, Mycobacterium avium subsp. paratuberculosis
cgccacggcggug

SEQ ID NO: 815505 - RNA, 19 nt, Mycobacterium avium subsp. paratuberculosis
cgccacggcggugucggcg

SEQ ID NO: 815506 - RNA, 21 nt, Mycobacterium avium subsp. paratuberculosis
cgccacggcggugucggcggc

SEQ ID NO: 815507 - RNA, 15 nt, Mycobacterium avium subsp. paratuberculosis
cgccacggcggccga

SEQ ID NO: 815508 - RNA, 20 nt, Mycobacterium avium subsp. paratuberculosis
cgccacggcggccgaauccg

SEQ ID NO: 815509 - RNA, 12 nt, Mycobacterium avium subsp. paratuberculosis
cgccacggcggg

SEQ ID NO: 815510 - RNA, 13 nt, Mycobacterium avium subsp. paratuberculosis
cgccacggcgcca

SEQ ID NO: 815511 - RNA, 15 nt, Mycobacterium avium subsp. paratuberculosis
cgccacggcgccaug

SEQ ID NO: 815512 - RNA, 20 nt, Mycobacterium avium subsp. paratuberculosis
cgccacggcgccaugcgccg

SEQ ID NO: 815513 - RNA, 16 nt, Mycobacterium avium subsp. paratuberculosis
cgccacggccggcagc

SEQ ID NO: 815514 - RNA, 12 nt, Mycobacterium avium subsp. paratuberculosis
cgccacggcgaa

SEQ ID NO: 815515 - RNA, 16 nt, Mycobacterium avium subsp. paratuberculosis
cgccacggcgaacacc

SEQ ID NO: 815516 - RNA, 16 nt, Mycobacterium avium subsp. paratuberculosis
cgccacggcgacgacc

SEQ ID NO: 815517 - RNA, 17 nt, Mycobacterium avium subsp. paratuberculosis
cgccacggcgacgacca

SEQ ID NO: 815518 - RNA, 23 nt, Mycobacterium avium subsp. paratuberculosis
cgccacggcgacgaccaccagga

SEQ ID NO: 815519 - RNA, 11 nt, Mycobacterium avium subsp. paratuberculosis
cgccacgccga

SEQ ID NO: 815520 - RNA, 14 nt, Mycobacterium avium subsp. paratuberculosis
cgccacgccgacca

SEQ ID NO: 815521 - RNA, 16 nt, Mycobacterium avium subsp. paratuberculosis
cgccacgccgaccagg

SEQ ID NO: 815522 - RNA, 15 nt, Mycobacterium avium subsp. paratuberculosis
cgccacgcccgcagc

SEQ ID NO: 815523 - RNA, 16 nt, Mycobacterium avium subsp. paratuberculosis
cgccacgcccgcagcg

SEQ ID NO: 815524 - RNA, 23 nt, Mycobacterium avium subsp. paratuberculosis
cgccacgcccgcagcgcaucggu

SEQ ID NO: 815525 - RNA, 12 nt, Mycobacterium avium subsp. paratuberculosis
cgccacgccgcc

SEQ ID NO: 815526 - RNA, 21 nt, Mycobacterium avium subsp. paratuberculosis
cgccacgccgcccccgccgcg

SEQ ID NO: 815527 - RNA, 15 nt, Mycobacterium avium subsp. paratuberculosis
cgccacgccgcgauc

SEQ ID NO: 815528 - RNA, 16 nt, Mycobacterium avium subsp. paratuberculosis
cgccacgcacaccgcg

SEQ ID NO: 815529 - RNA, 14 nt, Mycobacterium avium subsp. paratuberculosis
cgccacgccccggc

SEQ ID NO: 815530 - RNA, 15 nt, Mycobacterium avium subsp. paratuberculosis
cgccacgccccggcg

SEQ ID NO: 815531 - RNA, 21 nt, Mycobacterium avium subsp. paratuberculosis
cgccacgcccagggcgccaga

SEQ ID NO: 815532 - RNA, 15 nt, Mycobacterium avium subsp. paratuberculosis
cgccaccgucgccgg

SEQ ID NO: 815533 - RNA, 16 nt, Mycobacterium avium subsp. paratuberculosis
cgccaccgucgccggc

SEQ ID NO: 815534 - RNA, 14 nt, Mycobacterium avium subsp. paratuberculosis
cgccaccgucgucg

SEQ ID NO: 815535 - RNA, 19 nt, Mycobacterium avium subsp. paratuberculosis
cgccaccgucgucgagcgc

SEQ ID NO: 815536 - RNA, 19 nt, Mycobacterium avium subsp. paratuberculosis
cgccacgacugcgcggccg

SEQ ID NO: 815537 - RNA, 21 nt, Mycobacterium avium subsp. paratuberculosis
cgccacgacugcgcggccggc

SEQ ID NO: 815538 - RNA, 15 nt, Mycobacterium avium subsp. paratuberculosis
cgccacgaucaccac

SEQ ID NO: 815539 - RNA, 18 nt, Mycobacterium avium subsp. paratuberculosis
cgccacgaucaccaccac

SEQ ID NO: 815540 - RNA, 20 nt, Mycobacterium avium subsp. paratuberculosis
cgccacgaucaccaccaccg

SEQ ID NO: 815541 - RNA, 15 nt, Mycobacterium avium subsp. paratuberculosis
cgccaccggcccggc

SEQ ID NO: 815542 - RNA, 18 nt, Mycobacterium avium subsp. paratuberculosis
cgccaccggcccggccgg

SEQ ID NO: 815543 - RNA, 16 nt, Mycobacterium avium subsp. paratuberculosis
cgccaccggcuggccg

SEQ ID NO: 815544 - RNA, 17 nt, Mycobacterium avium subsp. paratuberculosis
cgccaccggcuggccgg

SEQ ID NO: 815545 - RNA, 22 nt, Mycobacterium avium subsp. paratuberculosis
cgccaccggguaagugucgugg

SEQ ID NO: 815546 - RNA, 13 nt, Mycobacterium avium subsp. paratuberculosis
cgccaccgcgggg

SEQ ID NO: 815547 - RNA, 14 nt, Mycobacterium avium subsp. paratuberculosis
cgccaccggccggu

SEQ ID NO: 815548 - RNA, 16 nt, Mycobacterium avium subsp. paratuberculosis
cgccaccggccggucc

SEQ ID NO: 815549 - RNA, 22 nt, Mycobacterium avium subsp. paratuberculosis
cgccaccccgggaacgacggug

SEQ ID NO: 815550 - RNA, 23 nt, Mycobacterium avium subsp. paratuberculosis
cgccaccccgggaacgacggugc

SEQ ID NO: 815551 - RNA, 13 nt, Mycobacterium avium subsp. paratuberculosis
cgccacccgaggc

SEQ ID NO: 815552 - RNA, 13 nt, Mycobacterium avium subsp. paratuberculosis
cgccaccccgcgc

SEQ ID NO: 815553 - RNA, 22 nt, Mycobacterium avium subsp. paratuberculosis
cgccacccgcaccucgcuggcg

SEQ ID NO: 815554 - RNA, 13 nt, Mycobacterium avium subsp. paratuberculosis
cgccacccgcugc

SEQ ID NO: 815555 - RNA, 18 nt, Mycobacterium avium subsp. paratuberculosis
cgccacccugcgcaccgc

SEQ ID NO: 815556 - RNA, 19 nt, Mycobacterium avium subsp. paratuberculosis
cgccacccugcgcaccgcg

SEQ ID NO: 815557 - RNA, 22 nt, Mycobacterium avium subsp. paratuberculosis
cgccaccgagaucaugccggcg

SEQ ID NO: 815558 - RNA, 21 nt, Mycobacterium avium subsp. paratuberculosis
cgccaccgaggugacgucgcg

SEQ ID NO: 815559 - RNA, 17 nt, Mycobacterium avium subsp. paratuberculosis
cgccaccgagucgcgcg

SEQ ID NO: 815560 - RNA, 22 nt, Mycobacterium avium subsp. paratuberculosis
cgccaccgacaccaccggccgc

SEQ ID NO: 815561 - RNA, 22 nt, Mycobacterium avium subsp. paratuberculosis
cgccaccgcgaaagcgucggcu

SEQ ID NO: 815562 - RNA, 13 nt, Mycobacterium avium subsp. paratuberculosis
cgccaccgcgaac

SEQ ID NO: 815563 - RNA, 12 nt, Mycobacterium avium subsp. paratuberculosis
cgccaccgcccg

SEQ ID NO: 815564 - RNA, 15 nt, Mycobacterium avium subsp. paratuberculosis
cgccaccgcccgcug

SEQ ID NO: 815565 - RNA, 20 nt, Mycobacterium avium subsp. paratuberculosis
cgccaccgcccgcugaccgc

SEQ ID NO: 815566 - RNA, 16 nt, Mycobacterium avium subsp. paratuberculosis
cgccaccgaugcgggc

SEQ ID NO: 815567 - RNA, 18 nt, Mycobacterium avium subsp. paratuberculosis
cgccaccgaugcgggcca

SEQ ID NO: 815568 - RNA, 15 nt, Mycobacterium avium subsp. paratuberculosis
cgcaggaugcccagc

SEQ ID NO: 815569 - RNA, 19 nt, Mycobacterium avium subsp. paratuberculosis
cgcaggaugcccagcacca

SEQ ID NO: 815570 - RNA, 21 nt, Mycobacterium avium subsp. paratuberculosis
cgcaggaugcccagcaccacu

SEQ ID NO: 815571 - RNA, 19 nt, Mycobacterium avium subsp. paratuberculosis
cgcaggaugccgaugucgg

SEQ ID NO: 815572 - RNA, 16 nt, Mycobacterium avium subsp. paratuberculosis
cgcaggaucgagccgg

SEQ ID NO: 815573 - RNA, 17 nt, Mycobacterium avium subsp. paratuberculosis
cgcaggaucgagccggc

SEQ ID NO: 815574 - RNA, 22 nt, Mycobacterium avium subsp. paratuberculosis
cgcaggaucgagccggccguca

SEQ ID NO: 815575 - RNA, 15 nt, Mycobacterium avium subsp. paratuberculosis
cgcagcgcgcgaccg

SEQ ID NO: 815576 - RNA, 17 nt, Mycobacterium avium subsp. paratuberculosis
cgcagcgcgcgaccgcg

SEQ ID NO: 815577 - RNA, 18 nt, Mycobacterium avium subsp. paratuberculosis
cgcaggcauuuccagguc

SEQ ID NO: 815578 - RNA, 16 nt, Mycobacterium avium subsp. paratuberculosis
cgcaggcagcagcacc

SEQ ID NO: 815579 - RNA, 14 nt, Mycobacterium avium subsp. paratuberculosis
cgcaggcacucgcg

SEQ ID NO: 815580 - RNA, 18 nt, Mycobacterium avium subsp. paratuberculosis
cgcaggcacucgcgcagg

SEQ ID NO: 815581 - RNA, 22 nt, Mycobacterium avium subsp. paratuberculosis
cgcaggcacucgcgcaggguca

SEQ ID NO: 815582 - RNA, 20 nt, Mycobacterium avium subsp. paratuberculosis
cgcaggauggccugcacggu

SEQ ID NO: 815583 - RNA, 22 nt, Mycobacterium avium subsp. paratuberculosis
cgcagcgcauccgacaccgccu

SEQ ID NO: 815584 - RNA, 12 nt, Mycobacterium avium subsp. paratuberculosis
cgcagcgcaucg

SEQ ID NO: 815585 - RNA, 17 nt, Mycobacterium avium subsp. paratuberculosis
cgcagcgcaucgccggc

SEQ ID NO: 815586 - RNA, 18 nt, Mycobacterium avium subsp. paratuberculosis
cgcagcgcaucgccggcg

SEQ ID NO: 815587 - RNA, 21 nt, Mycobacterium avium subsp. paratuberculosis
cgcagcgcaucgccggcgaug

SEQ ID NO: 815588 - RNA, 21 nt, Mycobacterium avium subsp. paratuberculosis
cgcagcgcaucguugccggcg

SEQ ID NO: 815589 - RNA, 19 nt, Mycobacterium avium subsp. paratuberculosis
cgcagcgcacgucgccgcc

SEQ ID NO: 815590 - RNA, 14 nt, Mycobacterium avium subsp. paratuberculosis
cgcagcgcagcacc

SEQ ID NO: 815591 - RNA, 12 nt, Mycobacterium avium subsp. paratuberculosis
cgcagcgcccgg

SEQ ID NO: 815592 - RNA, 16 nt, Mycobacterium avium subsp. paratuberculosis
cgcagcgcccggcagc

SEQ ID NO: 815593 - RNA, 17 nt, Mycobacterium avium subsp. paratuberculosis
cgcagcgcccggcagcg

SEQ ID NO: 815594 - RNA, 19 nt, Mycobacterium avium subsp. paratuberculosis
cgcagcgcccggcagcggu

SEQ ID NO: 815595 - RNA, 21 nt, Mycobacterium avium subsp. paratuberculosis
cgcagcgcccggcagcgguca

SEQ ID NO: 815596 - RNA, 16 nt, Mycobacterium avium subsp. paratuberculosis
cgcagcgccaggcaga

SEQ ID NO: 815597 - RNA, 12 nt, Mycobacterium avium subsp. paratuberculosis
cgcagcgccgcg

SEQ ID NO: 815598 - RNA, 15 nt, Mycobacterium avium subsp. paratuberculosis
cgcagcgccgcgccg

SEQ ID NO: 815599 - RNA, 16 nt, Mycobacterium avium subsp. paratuberculosis
cgcagcgccgcgccga

SEQ ID NO: 815600 - RNA, 19 nt, Mycobacterium avium subsp. paratuberculosis
cgcagcgccgcgccgaccu

SEQ ID NO: 815601 - RNA, 18 nt, Mycobacterium avium subsp. paratuberculosis
cgcagcgccgucucgacc

SEQ ID NO: 815602 - RNA, 21 nt, Mycobacterium avium subsp. paratuberculosis
cgcagcgccgucucgacccgg

SEQ ID NO: 815603 - RNA, 12 nt, Mycobacterium avium subsp. paratuberculosis
cgcagcgcgacg

SEQ ID NO: 815604 - RNA, 22 nt, Mycobacterium avium subsp. paratuberculosis
cgcagcgcgacgaacagcaccg

SEQ ID NO: 815605 - RNA, 23 nt, Mycobacterium avium subsp. paratuberculosis
cgcagcgcgacgaacagcaccgc

SEQ ID NO: 815606 - RNA, 11 nt, Mycobacterium avium subsp. paratuberculosis
cgcagcgcgau

SEQ ID NO: 815607 - RNA, 21 nt, Mycobacterium avium subsp. paratuberculosis
cgcagcgcgauguccgacagc

SEQ ID NO: 815608 - RNA, 13 nt, Mycobacterium avium subsp. paratuberculosis
cgcagcgccucgg

SEQ ID NO: 815609 - RNA, 14 nt, Mycobacterium avium subsp. paratuberculosis
cgcagcgccucggc

SEQ ID NO: 815610 - RNA, 16 nt, Mycobacterium avium subsp. paratuberculosis
cgcagcgccucggcgg

SEQ ID NO: 815611 - RNA, 18 nt, Mycobacterium avium subsp. paratuberculosis
cgcagcgccucggcgugg

SEQ ID NO: 815612 - RNA, 20 nt, Mycobacterium avium subsp. paratuberculosis
cgcaggcuggcaucgucggc

SEQ ID NO: 815613 - RNA, 21 nt, Mycobacterium avium subsp. paratuberculosis
cgcaggcuggcaucgucggcg

SEQ ID NO: 815614 - RNA, 15 nt, Mycobacterium avium subsp. paratuberculosis
cgcagguccggcagc

SEQ ID NO: 815615 - RNA, 17 nt, Mycobacterium avium subsp. paratuberculosis
cgcagguccggcagcgc

SEQ ID NO: 815616 - RNA, 22 nt, Mycobacterium avium subsp. paratuberculosis
cgcagguccggcagcgcgccca

SEQ ID NO: 815617 - RNA, 22 nt, Mycobacterium avium subsp. paratuberculosis
cgcagguccguggugaucgccg

SEQ ID NO: 815618 - RNA, 13 nt, Mycobacterium avium subsp. paratuberculosis
cgcagguccucgg

SEQ ID NO: 815619 - RNA, 18 nt, Mycobacterium avium subsp. paratuberculosis
cgcagguccucggacucg

SEQ ID NO: 815620 - RNA, 21 nt, Mycobacterium avium subsp. paratuberculosis
cgcagguccucggacucgucg

SEQ ID NO: 815621 - RNA, 15 nt, Mycobacterium avium subsp. paratuberculosis
cgcaggucgauggcg

SEQ ID NO: 815622 - RNA, 20 nt, Mycobacterium avium subsp. paratuberculosis
cgcagggccagcgccucggc

SEQ ID NO: 815623 - RNA, 21 nt, Mycobacterium avium subsp. paratuberculosis
cgcagggccagcgccucggcg

SEQ ID NO: 815624 - RNA, 15 nt, Mycobacterium avium subsp. paratuberculosis
cgcaggugaugcggc

SEQ ID NO: 815625 - RNA, 18 nt, Mycobacterium avium subsp. paratuberculosis
cgcaggugaugcggcccg

SEQ ID NO: 815626 - RNA, 20 nt, Mycobacterium avium subsp. paratuberculosis
cgcaggugaucaaagccggu

SEQ ID NO: 815627 - RNA, 15 nt, Mycobacterium avium subsp. paratuberculosis
cgcaggucgggccgg

SEQ ID NO: 815628 - RNA, 20 nt, Mycobacterium avium subsp. paratuberculosis
cgcaggucgggccggccgau

SEQ ID NO: 815629 - RNA, 12 nt, Mycobacterium avium subsp. paratuberculosis
cgcaggugcgcc

SEQ ID NO: 815630 - RNA, 16 nt, Mycobacterium avium subsp. paratuberculosis
cgcaggugcgccgcuc

SEQ ID NO: 815631 - RNA, 18 nt, Mycobacterium avium subsp. paratuberculosis
cgcaggugcgccgcucgu

SEQ ID NO: 815632 - RNA, 20 nt, Mycobacterium avium subsp. paratuberculosis
cgcaggugcgccgcucgucg

SEQ ID NO: 815633 - RNA, 15 nt, Mycobacterium avium subsp. paratuberculosis
cgcaggugcucgccg

SEQ ID NO: 815634 - RNA, 16 nt, Mycobacterium avium subsp. paratuberculosis
cgcaggugcucgccgg

SEQ ID NO: 815635 - RNA, 17 nt, Mycobacterium avium subsp. paratuberculosis
cgcaggugcucgccggc

SEQ ID NO: 815636 - RNA, 23 nt, Mycobacterium avium subsp. paratuberculosis
cgcaggugcucgccggcgcggaa

SEQ ID NO: 815637 - RNA, 17 nt, Mycobacterium avium subsp. paratuberculosis
cgcaggcguggcccagc

SEQ ID NO: 815638 - RNA, 18 nt, Mycobacterium avium subsp. paratuberculosis
cgcaggcguggcccagcc

SEQ ID NO: 815639 - RNA, 19 nt, Mycobacterium avium subsp. paratuberculosis
cgcaggcguggcccagccg

SEQ ID NO: 815640 - RNA, 21 nt, Mycobacterium avium subsp. paratuberculosis
cgcaggcguccagggccaccg

SEQ ID NO: 815641 - RNA, 16 nt, Mycobacterium avium subsp. paratuberculosis
cgcaggccgcgagccc

SEQ ID NO: 815642 - RNA, 15 nt, Mycobacterium avium subsp. paratuberculosis
cgcaggccguccagc

SEQ ID NO: 815643 - RNA, 20 nt, Mycobacterium avium subsp. paratuberculosis
cgcaggccguccagcagcag

SEQ ID NO: 815644 - RNA, 21 nt, Mycobacterium avium subsp. paratuberculosis
cgcaggcggcgcgcagccggc

SEQ ID NO: 815645 - RNA, 13 nt, Mycobacterium avium subsp. paratuberculosis
cgcaggccgcccg

SEQ ID NO: 815646 - RNA, 13 nt, Mycobacterium avium subsp. paratuberculosis
cgcaggccccgga

SEQ ID NO: 815647 - RNA, 20 nt, Mycobacterium avium subsp. paratuberculosis
cgcagaaaaaggccgccgcu

SEQ ID NO: 815648 - RNA, 21 nt, Mycobacterium avium subsp. paratuberculosis
cgcagaaaccccacgaucgcg

SEQ ID NO: 815649 - RNA, 22 nt, Mycobacterium avium subsp. paratuberculosis
cgcagaaaugggccaugccggc

SEQ ID NO: 815650 - RNA, 16 nt, Mycobacterium avium subsp. paratuberculosis
cgcacuucgcgggcgg

SEQ ID NO: 815651 - RNA, 20 nt, Mycobacterium avium subsp. paratuberculosis
cgcacuucgcgggcggcgca

SEQ ID NO: 815652 - RNA, 18 nt, Mycobacterium avium subsp. paratuberculosis
cgcacuuggccucgggcg

SEQ ID NO: 815653 - RNA, 21 nt, Mycobacterium avium subsp. paratuberculosis
cgcacuuggccucgggcgacg

SEQ ID NO: 815654 - RNA, 23 nt, Mycobacterium avium subsp. paratuberculosis
cgcacuuggccucgggcgacgac

SEQ ID NO: 815655 - RNA, 22 nt, Mycobacterium avium subsp. paratuberculosis
cgcagcaauuucguucguccaa

SEQ ID NO: 815656 - RNA, 22 nt, Mycobacterium avium subsp. paratuberculosis
cgcagcacaaaagggcccaugc

SEQ ID NO: 815657 - RNA, 19 nt, Mycobacterium avium subsp. paratuberculosis
cgcagcaauugacgccgac

SEQ ID NO: 815658 - RNA, 20 nt, Mycobacterium avium subsp. paratuberculosis
cgcagcaauugacgccgaca

SEQ ID NO: 815659 - RNA, 21 nt, Mycobacterium avium subsp. paratuberculosis
cgcagcaauugacgccgacag

SEQ ID NO: 815660 - RNA, 22 nt, Mycobacterium avium subsp. paratuberculosis
cgcagcaauugacgccgacagc

SEQ ID NO: 815661 - RNA, 20 nt, Mycobacterium avium subsp. paratuberculosis
cgcagaacucgucgccaccg

SEQ ID NO: 815662 - RNA, 18 nt, Mycobacterium avium subsp. paratuberculosis
cgcagaacaccaccgcca

SEQ ID NO: 815663 - RNA, 19 nt, Mycobacterium avium subsp. paratuberculosis
cgcagaacaccacggugua

SEQ ID NO: 815664 - RNA, 14 nt, Mycobacterium avium subsp. paratuberculosis
cgcagaacaccagc

SEQ ID NO: 815665 - RNA, 17 nt, Mycobacterium avium subsp. paratuberculosis
cgcagaacaccagcgca

SEQ ID NO: 815666 - RNA, 22 nt, Mycobacterium avium subsp. paratuberculosis
cgcagcaccauccgcgcgagcg

SEQ ID NO: 815667 - RNA, 16 nt, Mycobacterium avium subsp. paratuberculosis
cgcagcaccgcgucgg

SEQ ID NO: 815668 - RNA, 17 nt, Mycobacterium avium subsp. paratuberculosis
cgcagcaccgcgucggc

SEQ ID NO: 815669 - RNA, 14 nt, Mycobacterium avium subsp. paratuberculosis
cgcagcaccgacuc

SEQ ID NO: 815670 - RNA, 19 nt, Mycobacterium avium subsp. paratuberculosis
cgcagcaccgaugccagac

SEQ ID NO: 815671 - RNA, 18 nt, Mycobacterium avium subsp. paratuberculosis
cgcagcaccuccgacagc

SEQ ID NO: 815672 - RNA, 19 nt, Mycobacterium avium subsp. paratuberculosis
cgcagcacgcugaagccca

SEQ ID NO: 815673 - RNA, 23 nt, Mycobacterium avium subsp. paratuberculosis
cgcagcacgcugaagcccaccgc

SEQ ID NO: 815674 - RNA, 12 nt, Mycobacterium avium subsp. paratuberculosis
cgcagcaccuug

SEQ ID NO: 815675 - RNA, 16 nt, Mycobacterium avium subsp. paratuberculosis
cgcagcagcagcccga

SEQ ID NO: 815676 - RNA, 22 nt, Mycobacterium avium subsp. paratuberculosis
cgcagcagccaggacagcguca

SEQ ID NO: 815677 - RNA, 14 nt, Mycobacterium avium subsp. paratuberculosis
cgcagcagccgcgc

SEQ ID NO: 815678 - RNA, 18 nt, Mycobacterium avium subsp. paratuberculosis
cgcagcagccgcgccacc

SEQ ID NO: 815679 - RNA, 19 nt, Mycobacterium avium subsp. paratuberculosis
cgcagcagcaggucggcca

SEQ ID NO: 815680 - RNA, 20 nt, Mycobacterium avium subsp. paratuberculosis
cgcagcagcaggucggccag

SEQ ID NO: 815681 - RNA, 14 nt, Mycobacterium avium subsp. paratuberculosis
cgcagcacggccac

SEQ ID NO: 815682 - RNA, 17 nt, Mycobacterium avium subsp. paratuberculosis
cgcagcaccuugccggu

SEQ ID NO: 815683 - RNA, 18 nt, Mycobacterium avium subsp. paratuberculosis
cgcagcacguguucggga

SEQ ID NO: 815684 - RNA, 22 nt, Mycobacterium avium subsp. paratuberculosis
cgcagcacguguucgggaucgg

SEQ ID NO: 815685 - RNA, 13 nt, Mycobacterium avium subsp. paratuberculosis
cgcagccagcgca

SEQ ID NO: 815686 - RNA, 14 nt, Mycobacterium avium subsp. paratuberculosis
cgcagccagcgcag

SEQ ID NO: 815687 - RNA, 16 nt, Mycobacterium avium subsp. paratuberculosis
cgcagccagcgccgca

SEQ ID NO: 815688 - RNA, 19 nt, Mycobacterium avium subsp. paratuberculosis
cgcagccagcgccgcacug

SEQ ID NO: 815689 - RNA, 12 nt, Mycobacterium avium subsp. paratuberculosis
cgcagccagacc

SEQ ID NO: 815690 - RNA, 14 nt, Mycobacterium avium subsp. paratuberculosis
cgcagccagaccuc

SEQ ID NO: 815691 - RNA, 14 nt, Mycobacterium avium subsp. paratuberculosis
cgcagccagcucgg

SEQ ID NO: 815692 - RNA, 19 nt, Mycobacterium avium subsp. paratuberculosis
cgcagccagucgccggcca

SEQ ID NO: 815693 - RNA, 14 nt, Mycobacterium avium subsp. paratuberculosis
cgcagccaggugaa

SEQ ID NO: 815694 - RNA, 18 nt, Mycobacterium avium subsp. paratuberculosis
cgcagccaggugaacagg

SEQ ID NO: 815695 - RNA, 19 nt, Mycobacterium avium subsp. paratuberculosis
cgcagcagcgccagcagcg

SEQ ID NO: 815696 - RNA, 14 nt, Mycobacterium avium subsp. paratuberculosis
cgcagcagcggcuu

SEQ ID NO: 815697 - RNA, 22 nt, Mycobacterium avium subsp. paratuberculosis
cgcagcagcggcuugagcgcca

SEQ ID NO: 815698 - RNA, 21 nt, Mycobacterium avium subsp. paratuberculosis
cgcagcagcguuccgucggcg

SEQ ID NO: 815699 - RNA, 15 nt, Mycobacterium avium subsp. paratuberculosis
cgcagcagcucgucg

SEQ ID NO: 815700 - RNA, 13 nt, Mycobacterium avium subsp. paratuberculosis
cgcagcaggcgcc

SEQ ID NO: 815701 - RNA, 19 nt, Mycobacterium avium subsp. paratuberculosis
cgcagccaaugccggaucg

SEQ ID NO: 815702 - RNA, 20 nt, Mycobacterium avium subsp. paratuberculosis
cgcagccaaugccggaucgg

SEQ ID NO: 815703 - RNA, 22 nt, Mycobacterium avium subsp. paratuberculosis
cgcagccaaugccggaucggga

SEQ ID NO: 815704 - RNA, 17 nt, Mycobacterium avium subsp. paratuberculosis
cgcagccaccgcccgaa

SEQ ID NO: 815705 - RNA, 18 nt, Mycobacterium avium subsp. paratuberculosis
cgcagccaccgcccgaac

SEQ ID NO: 815706 - RNA, 16 nt, Mycobacterium avium subsp. paratuberculosis
cgcagccacgagccca

SEQ ID NO: 815707 - RNA, 23 nt, Mycobacterium avium subsp. paratuberculosis
cgcagccacgagcccagccgucg

SEQ ID NO: 815708 - RNA, 15 nt, Mycobacterium avium subsp. paratuberculosis
cgcagcgagucggcg

SEQ ID NO: 815709 - RNA, 16 nt, Mycobacterium avium subsp. paratuberculosis
cgcagcgagucggcga

SEQ ID NO: 815710 - RNA, 16 nt, Mycobacterium avium subsp. paratuberculosis
cgcagcgaggcgaugg

SEQ ID NO: 815711 - RNA, 15 nt, Mycobacterium avium subsp. paratuberculosis
cgcagcgaucggcgg

SEQ ID NO: 815712 - RNA, 17 nt, Mycobacterium avium subsp. paratuberculosis
cgcagcgaucggcggcu

SEQ ID NO: 815713 - RNA, 19 nt, Mycobacterium avium subsp. paratuberculosis
cgcagcgaaacucguugcc

SEQ ID NO: 815714 - RNA, 21 nt, Mycobacterium avium subsp. paratuberculosis
cgcagcgaagcgaggcgccac

SEQ ID NO: 815715 - RNA, 22 nt, Mycobacterium avium subsp. paratuberculosis
cgcagcgaagcgaggcgccaca

SEQ ID NO: 815716 - RNA, 19 nt, Mycobacterium avium subsp. paratuberculosis
cgcagcgacaaucggcucg

SEQ ID NO: 815717 - RNA, 22 nt, Mycobacterium avium subsp. paratuberculosis
cgcagcgaccugguccaccgcg

SEQ ID NO: 815718 - RNA, 14 nt, Mycobacterium avium subsp. paratuberculosis
cgcagccgucgauc

SEQ ID NO: 815719 - RNA, 19 nt, Mycobacterium avium subsp. paratuberculosis
cgcagccgucgcaucagcu

SEQ ID NO: 815720 - RNA, 19 nt, Mycobacterium avium subsp. paratuberculosis
cgcagccuucuucgccggg

SEQ ID NO: 815721 - RNA, 21 nt, Mycobacterium avium subsp. paratuberculosis
cgcagccuucuucgccggggc

SEQ ID NO: 815722 - RNA, 16 nt, Mycobacterium avium subsp. paratuberculosis
cgcagccuucuuggcg

SEQ ID NO: 815723 - RNA, 20 nt, Mycobacterium avium subsp. paratuberculosis
cgcagccgggugcgggccag

SEQ ID NO: 815724 - RNA, 13 nt, Mycobacterium avium subsp. paratuberculosis
cgcagccggucaa

SEQ ID NO: 815725 - RNA, 16 nt, Mycobacterium avium subsp. paratuberculosis
cgcagccgggcggcgc

SEQ ID NO: 815726 - RNA, 17 nt, Mycobacterium avium subsp. paratuberculosis
cgcagccgggcggcgcu

SEQ ID NO: 815727 - RNA, 14 nt, Mycobacterium avium subsp. paratuberculosis
cgcagccgggcggu

SEQ ID NO: 815728 - RNA, 16 nt, Mycobacterium avium subsp. paratuberculosis
cgcagccgggcgguga

SEQ ID NO: 815729 - RNA, 18 nt, Mycobacterium avium subsp. paratuberculosis
cgcaccgguuugucggcg

SEQ ID NO: 815730 - RNA, 20 nt, Mycobacterium avium subsp. paratuberculosis
cgcaccgguuugucggcgcc

SEQ ID NO: 815731 - RNA, 19 nt, Mycobacterium avium subsp. paratuberculosis
cgcaccgucaucgcggcga

SEQ ID NO: 815732 - RNA, 18 nt, Mycobacterium avium subsp. paratuberculosis
cgcaccguguagccgacc

SEQ ID NO: 815733 - RNA, 20 nt, Mycobacterium avium subsp. paratuberculosis
cgcaccguguagccgaccga

SEQ ID NO: 815734 - RNA, 23 nt, Mycobacterium avium subsp. paratuberculosis
cgcaccguguagccgaccgaccc

SEQ ID NO: 815735 - RNA, 13 nt, Mycobacterium avium subsp. paratuberculosis
cgcaccgugucgu

SEQ ID NO: 815736 - RNA, 21 nt, Mycobacterium avium subsp. paratuberculosis
cgcaccgugucgucgcugacg

SEQ ID NO: 815737 - RNA, 19 nt, Mycobacterium avium subsp. paratuberculosis
cgcaccgugccgcccgucg

SEQ ID NO: 815738 - RNA, 20 nt, Mycobacterium avium subsp. paratuberculosis
cgcaccgugccgcccgucgc

SEQ ID NO: 815739 - RNA, 12 nt, Mycobacterium avium subsp. paratuberculosis
cgcaccugccgu

SEQ ID NO: 815740 - RNA, 14 nt, Mycobacterium avium subsp. paratuberculosis
cgcaccugccgucg

SEQ ID NO: 815741 - RNA, 17 nt, Mycobacterium avium subsp. paratuberculosis
cgcaccugccgucgacg

SEQ ID NO: 815742 - RNA, 20 nt, Mycobacterium avium subsp. paratuberculosis
cgcaccugccgucgacgacc

SEQ ID NO: 815743 - RNA, 15 nt, Mycobacterium avium subsp. paratuberculosis
cgcaccugcgcgccg

SEQ ID NO: 815744 - RNA, 18 nt, Mycobacterium avium subsp. paratuberculosis
cgcaccugcgcgccguug

SEQ ID NO: 815745 - RNA, 14 nt, Mycobacterium avium subsp. paratuberculosis
cgcaccugcggccc

SEQ ID NO: 815746 - RNA, 15 nt, Mycobacterium avium subsp. paratuberculosis
cgcaccugcggcccc

SEQ ID NO: 815747 - RNA, 18 nt, Mycobacterium avium subsp. paratuberculosis
cgcaccuggcagcauccg

SEQ ID NO: 815748 - RNA, 23 nt, Mycobacterium avium subsp. paratuberculosis
cgcaccuggcagcauccgccgac

SEQ ID NO: 815749 - RNA, 12 nt, Mycobacterium avium subsp. paratuberculosis
cgcaccuggcgc

SEQ ID NO: 815750 - RNA, 19 nt, Mycobacterium avium subsp. paratuberculosis
cgcaccuggcgcagcaccg

SEQ ID NO: 815751 - RNA, 14 nt, Mycobacterium avium subsp. paratuberculosis
cgcaccucgccggc

SEQ ID NO: 815752 - RNA, 17 nt, Mycobacterium avium subsp. paratuberculosis
cgcaccucgccggccgc

SEQ ID NO: 815753 - RNA, 20 nt, Mycobacterium avium subsp. paratuberculosis
cgcaccucgcucagcccgga

SEQ ID NO: 815754 - RNA, 17 nt, Mycobacterium avium subsp. paratuberculosis
cgcaccucgcuggcggc

SEQ ID NO: 815755 - RNA, 17 nt, Mycobacterium avium subsp. paratuberculosis
cgcaccucggggcgugg

SEQ ID NO: 815756 - RNA, 19 nt, Mycobacterium avium subsp. paratuberculosis
cgcaccucggggcguggcg

SEQ ID NO: 815757 - RNA, 16 nt, Mycobacterium avium subsp. paratuberculosis
cgcaccucggccgggu

SEQ ID NO: 815758 - RNA, 19 nt, Mycobacterium avium subsp. paratuberculosis
cgcaccuucccggccgcca

SEQ ID NO: 815759 - RNA, 22 nt, Mycobacterium avium subsp. paratuberculosis
cgcaccugguugaacggcaccc

SEQ ID NO: 815760 - RNA, 21 nt, Mycobacterium avium subsp. paratuberculosis
cgcaccuggucggucagcucg

SEQ ID NO: 815761 - RNA, 22 nt, Mycobacterium avium subsp. paratuberculosis
cgcaccuggucggucagcucga

SEQ ID NO: 815762 - RNA, 19 nt, Mycobacterium avium subsp. paratuberculosis
cgcacgaaaccgcguggcg

SEQ ID NO: 815763 - RNA, 20 nt, Mycobacterium avium subsp. paratuberculosis
cgcacgaucugcaggccgag

SEQ ID NO: 815764 - RNA, 23 nt, Mycobacterium avium subsp. paratuberculosis
cgcacgaucugcaggccgaggcu

SEQ ID NO: 815765 - RNA, 21 nt, Mycobacterium avium subsp. paratuberculosis
cgcacgaugccgcgcucgaac

SEQ ID NO: 815766 - RNA, 18 nt, Mycobacterium avium subsp. paratuberculosis
cgcacgaucagggugucg

SEQ ID NO: 815767 - RNA, 19 nt, Mycobacterium avium subsp. paratuberculosis
cgcacgaucagggugucga

SEQ ID NO: 815768 - RNA, 18 nt, Mycobacterium avium subsp. paratuberculosis
cgcacgaccaugucggcg

SEQ ID NO: 815769 - RNA, 21 nt, Mycobacterium avium subsp. paratuberculosis
cgcacgaccaugucggcgacc

SEQ ID NO: 815770 - RNA, 16 nt, Mycobacterium avium subsp. paratuberculosis
cgcacgagcacccaga

SEQ ID NO: 815771 - RNA, 16 nt, Mycobacterium avium subsp. paratuberculosis
cgcacgaacggcgcga

SEQ ID NO: 815772 - RNA, 17 nt, Mycobacterium avium subsp. paratuberculosis
cgcaccgcgucgaugcg

SEQ ID NO: 815773 - RNA, 20 nt, Mycobacterium avium subsp. paratuberculosis
cgcaccgcgucgaugcgggc

SEQ ID NO: 815774 - RNA, 21 nt, Mycobacterium avium subsp. paratuberculosis
cgcaccggcagugaucggcgg

SEQ ID NO: 815775 - RNA, 14 nt, Mycobacterium avium subsp. paratuberculosis
cgcaccgcgcgcca

SEQ ID NO: 815776 - RNA, 14 nt, Mycobacterium avium subsp. paratuberculosis
cgcaccgcggagcg

SEQ ID NO: 815777 - RNA, 22 nt, Mycobacterium avium subsp. paratuberculosis
cgcaccgcggauuccagcgcgu

SEQ ID NO: 815778 - RNA, 14 nt, Mycobacterium avium subsp. paratuberculosis
cgcaccgcggccuc

SEQ ID NO: 815779 - RNA, 15 nt, Mycobacterium avium subsp. paratuberculosis
cgcaccgcggccucg

SEQ ID NO: 815780 - RNA, 18 nt, Mycobacterium avium subsp. paratuberculosis
cgcaccgcggccucggcg

SEQ ID NO: 815781 - RNA, 12 nt, Mycobacterium avium subsp. paratuberculosis
cgcaccgcggcg

SEQ ID NO: 815782 - RNA, 13 nt, Mycobacterium avium subsp. paratuberculosis
cgcaccgcggcgu

SEQ ID NO: 815783 - RNA, 14 nt, Mycobacterium avium subsp. paratuberculosis
cgcaccgcggcgug

SEQ ID NO: 815784 - RNA, 15 nt, Mycobacterium avium subsp. paratuberculosis
cgcaccgcggcgugg

SEQ ID NO: 815785 - RNA, 15 nt, Mycobacterium avium subsp. paratuberculosis
cgcaccgcgggcucg

SEQ ID NO: 815786 - RNA, 16 nt, Mycobacterium avium subsp. paratuberculosis
cgcaccgggaccagcg

SEQ ID NO: 815787 - RNA, 14 nt, Mycobacterium avium subsp. paratuberculosis
cgcaccgggcccgc

SEQ ID NO: 815788 - RNA, 15 nt, Mycobacterium avium subsp. paratuberculosis
cgcaccgggcccgcc

SEQ ID NO: 815789 - RNA, 22 nt, Mycobacterium avium subsp. paratuberculosis
cgcaccgggcccgcccgcagcg

SEQ ID NO: 815790 - RNA, 13 nt, Mycobacterium avium subsp. paratuberculosis
cgcaccggcgaug

SEQ ID NO: 815791 - RNA, 16 nt, Mycobacterium avium subsp. paratuberculosis
cgcaccggcgaugcag

SEQ ID NO: 815792 - RNA, 12 nt, Mycobacterium avium subsp. paratuberculosis
cgcaccggcgcc

SEQ ID NO: 815793 - RNA, 15 nt, Mycobacterium avium subsp. paratuberculosis
cgcaccggcgccucg

SEQ ID NO: 815794 - RNA, 13 nt, Mycobacterium avium subsp. paratuberculosis
cgcaccggccggc

SEQ ID NO: 815795 - RNA, 14 nt, Mycobacterium avium subsp. paratuberculosis
cgcaccggaaagcu

SEQ ID NO: 815796 - RNA, 17 nt, Mycobacterium avium subsp. paratuberculosis
cgcaccgccugugcgac

SEQ ID NO: 815797 - RNA, 21 nt, Mycobacterium avium subsp. paratuberculosis
cgcaccgccugugcgacggcg

SEQ ID NO: 815798 - RNA, 16 nt, Mycobacterium avium subsp. paratuberculosis
cgcaccgcgaaacgca

SEQ ID NO: 815799 - RNA, 12 nt, Mycobacterium avium subsp. paratuberculosis
cgcaccgcgacc

SEQ ID NO: 815800 - RNA, 18 nt, Mycobacterium avium subsp. paratuberculosis
cgcaccgcgaccgucauc

SEQ ID NO: 815801 - RNA, 13 nt, Mycobacterium avium subsp. paratuberculosis
cgcaccgcgacga

SEQ ID NO: 815802 - RNA, 13 nt, Mycobacterium avium subsp. paratuberculosis
cgcaccgcgagca

SEQ ID NO: 815803 - RNA, 15 nt, Mycobacterium avium subsp. paratuberculosis
cgcaccgcgagcaga

SEQ ID NO: 815804 - RNA, 20 nt, Mycobacterium avium subsp. paratuberculosis
cgcaagcugauucgggauca

SEQ ID NO: 815805 - RNA, 15 nt, Mycobacterium avium subsp. paratuberculosis
cgcaagcagagcagc

SEQ ID NO: 815806 - RNA, 17 nt, Mycobacterium avium subsp. paratuberculosis
cgcaagcaccggcuggc

SEQ ID NO: 815807 - RNA, 20 nt, Mycobacterium avium subsp. paratuberculosis
cgcaagcaccggcuggccga

SEQ ID NO: 815808 - RNA, 15 nt, Mycobacterium avium subsp. paratuberculosis
cgcaagcaccucgcg

SEQ ID NO: 815809 - RNA, 18 nt, Mycobacterium avium subsp. paratuberculosis
cgcacgcugucggggucg

SEQ ID NO: 815810 - RNA, 19 nt, Mycobacterium avium subsp. paratuberculosis
cgcacgcugucggggucgc

SEQ ID NO: 815811 - RNA, 16 nt, Mycobacterium avium subsp. paratuberculosis
cgcacggcccaucacc

SEQ ID NO: 815812 - RNA, 20 nt, Mycobacterium avium subsp. paratuberculosis
cgcacggcccaucaccagcg

SEQ ID NO: 815813 - RNA, 21 nt, Mycobacterium avium subsp. paratuberculosis
cgcacggcccaucaccagcgg

SEQ ID NO: 815814 - RNA, 15 nt, Mycobacterium avium subsp. paratuberculosis
cgcacggccgccagg

SEQ ID NO: 815815 - RNA, 13 nt, Mycobacterium avium subsp. paratuberculosis
cgcacgcuggccg

SEQ ID NO: 815816 - RNA, 14 nt, Mycobacterium avium subsp. paratuberculosis
cgcacgcuggccgg

SEQ ID NO: 815817 - RNA, 20 nt, Mycobacterium avium subsp. paratuberculosis
cgcacgcuggccggcagcgu

SEQ ID NO: 815818 - RNA, 15 nt, Mycobacterium avium subsp. paratuberculosis
cgcacgggcggcggg

SEQ ID NO: 815819 - RNA, 22 nt, Mycobacterium avium subsp. paratuberculosis
cgcacgggcggcgggggcgaga

SEQ ID NO: 815820 - RNA, 20 nt, Mycobacterium avium subsp. paratuberculosis
cgcacggcgcgcaccgcggg

SEQ ID NO: 815821 - RNA, 22 nt, Mycobacterium avium subsp. paratuberculosis
cgcacggcgcgcaccgcgggca

SEQ ID NO: 815822 - RNA, 13 nt, Mycobacterium avium subsp. paratuberculosis
cgcacggcgccca

SEQ ID NO: 815823 - RNA, 14 nt, Mycobacterium avium subsp. paratuberculosis
cgcacggcagcccg

SEQ ID NO: 815824 - RNA, 16 nt, Mycobacterium avium subsp. paratuberculosis
cgcacggcagcccgac

SEQ ID NO: 815825 - RNA, 15 nt, Mycobacterium avium subsp. paratuberculosis
cgcacgcggacacga

SEQ ID NO: 815826 - RNA, 15 nt, Mycobacterium avium subsp. paratuberculosis
cgcacggcgaacggc

SEQ ID NO: 815827 - RNA, 18 nt, Mycobacterium avium subsp. paratuberculosis
cgcacggcgaacggccgc

SEQ ID NO: 815828 - RNA, 16 nt, Mycobacterium avium subsp. paratuberculosis
cgcacgcagugccgca

SEQ ID NO: 815829 - RNA, 18 nt, Mycobacterium avium subsp. paratuberculosis
cgcacgcagugccgcacc

SEQ ID NO: 815830 - RNA, 20 nt, Mycobacterium avium subsp. paratuberculosis
cgcacgccaucgccucggcc

SEQ ID NO: 815831 - RNA, 14 nt, Mycobacterium avium subsp. paratuberculosis
cgcacgccagcauc

SEQ ID NO: 815832 - RNA, 15 nt, Mycobacterium avium subsp. paratuberculosis
cgcacgccagcaucg

SEQ ID NO: 815833 - RNA, 17 nt, Mycobacterium avium subsp. paratuberculosis
cgcacgccagcaucgag

SEQ ID NO: 815834 - RNA, 17 nt, Mycobacterium avium subsp. paratuberculosis
cgcacgcgaccgcgucg

SEQ ID NO: 815835 - RNA, 22 nt, Mycobacterium avium subsp. paratuberculosis
cgcacgccggguugggcggcgg

SEQ ID NO: 815836 - RNA, 16 nt, Mycobacterium avium subsp. paratuberculosis
cgcacguagacggugu

SEQ ID NO: 815837 - RNA, 19 nt, Mycobacterium avium subsp. paratuberculosis
cgcacguagcccagcgcgu

SEQ ID NO: 815838 - RNA, 14 nt, Mycobacterium avium subsp. paratuberculosis
cgcacggucgcggu

SEQ ID NO: 815839 - RNA, 15 nt, Mycobacterium avium subsp. paratuberculosis
cgcacggucgcggug

SEQ ID NO: 815840 - RNA, 20 nt, Mycobacterium avium subsp. paratuberculosis
cgcacggucgcggugucggc

SEQ ID NO: 815841 - RNA, 14 nt, Mycobacterium avium subsp. paratuberculosis
cgcacggugcagca

SEQ ID NO: 815842 - RNA, 21 nt, Mycobacterium avium subsp. paratuberculosis
cgcacggugcagcagcgccgc

SEQ ID NO: 815843 - RNA, 13 nt, Mycobacterium avium subsp. paratuberculosis
cgcacggugcccg

SEQ ID NO: 815844 - RNA, 14 nt, Mycobacterium avium subsp. paratuberculosis
cgcacggugcccgu

SEQ ID NO: 815845 - RNA, 16 nt, Mycobacterium avium subsp. paratuberculosis
cgcacggugcccgucg

SEQ ID NO: 815846 - RNA, 18 nt, Mycobacterium avium subsp. paratuberculosis
cgcacggugcccgucggc

SEQ ID NO: 815847 - RNA, 22 nt, Mycobacterium avium subsp. paratuberculosis
cgcacggugcccgucggcaacg

SEQ ID NO: 815848 - RNA, 19 nt, Mycobacterium avium subsp. paratuberculosis
cgcacguauccgcggucga

SEQ ID NO: 815849 - RNA, 22 nt, Mycobacterium avium subsp. paratuberculosis
cgcacguauccgcggucgacca

SEQ ID NO: 815850 - RNA, 11 nt, Mycobacterium avium subsp. paratuberculosis
cgcacgucgag

SEQ ID NO: 815851 - RNA, 12 nt, Mycobacterium avium subsp. paratuberculosis
cgcacgucgagg

SEQ ID NO: 815852 - RNA, 20 nt, Mycobacterium avium subsp. paratuberculosis
cgcacgucgaggucggacgc

SEQ ID NO: 815853 - RNA, 14 nt, Mycobacterium avium subsp. paratuberculosis
cgcacgucgccgcc

SEQ ID NO: 815854 - RNA, 15 nt, Mycobacterium avium subsp. paratuberculosis
cgcacgucggcaggu

SEQ ID NO: 815855 - RNA, 14 nt, Mycobacterium avium subsp. paratuberculosis
cgcacgucggccgc

SEQ ID NO: 815856 - RNA, 15 nt, Mycobacterium avium subsp. paratuberculosis
cgcacgucggccgcc

SEQ ID NO: 815857 - RNA, 16 nt, Mycobacterium avium subsp. paratuberculosis
cgcacgucggccgcca

SEQ ID NO: 815858 - RNA, 22 nt, Mycobacterium avium subsp. paratuberculosis
cgcacgucggccgccagggcca

SEQ ID NO: 815859 - RNA, 21 nt, Mycobacterium avium subsp. paratuberculosis
cgcacguggcugaccgacggc

SEQ ID NO: 815860 - RNA, 20 nt, Mycobacterium avium subsp. paratuberculosis
cgcacguguucucacggcga

SEQ ID NO: 815861 - RNA, 21 nt, Mycobacterium avium subsp. paratuberculosis
cgcacguguucucacggcgaa

SEQ ID NO: 815862 - RNA, 14 nt, Mycobacterium avium subsp. paratuberculosis
cgcacgucccgccc

SEQ ID NO: 815863 - RNA, 20 nt, Mycobacterium avium subsp. paratuberculosis
cgcacgugcgcgccgaccgc

SEQ ID NO: 815864 - RNA, 16 nt, Mycobacterium avium subsp. paratuberculosis
cgcacguuggcggcca

SEQ ID NO: 815865 - RNA, 17 nt, Mycobacterium avium subsp. paratuberculosis
cgcacguuggcggccag

SEQ ID NO: 815866 - RNA, 19 nt, Mycobacterium avium subsp. paratuberculosis
cgcacugcacggccucggu

SEQ ID NO: 815867 - RNA, 20 nt, Mycobacterium avium subsp. paratuberculosis
cgcacugcuucgggucgccg

SEQ ID NO: 815868 - RNA, 18 nt, Mycobacterium avium subsp. paratuberculosis
cgcacuggucgugcugga

SEQ ID NO: 815869 - RNA, 23 nt, Mycobacterium avium subsp. paratuberculosis
cgcacguuggcggccagcgcgcc

SEQ ID NO: 815870 - RNA, 14 nt, Mycobacterium avium subsp. paratuberculosis
cgcacucgaacggc

SEQ ID NO: 815871 - RNA, 18 nt, Mycobacterium avium subsp. paratuberculosis
cgcacuagguccggcgcg

SEQ ID NO: 815872 - RNA, 22 nt, Mycobacterium avium subsp. paratuberculosis
cgcacuagguccggcgcgacca

SEQ ID NO: 815873 - RNA, 19 nt, Mycobacterium avium subsp. paratuberculosis
cgcacucuugcgugcgggu

SEQ ID NO: 815874 - RNA, 21 nt, Mycobacterium avium subsp. paratuberculosis
cgcacucuugcgugcgggucg

SEQ ID NO: 815875 - RNA, 16 nt, Mycobacterium avium subsp. paratuberculosis
cgcacugaacgggaug

SEQ ID NO: 815876 - RNA, 14 nt, Mycobacterium avium subsp. paratuberculosis
cgcacucggugugg

SEQ ID NO: 815877 - RNA, 15 nt, Mycobacterium avium subsp. paratuberculosis
cgcacucgguguggc

SEQ ID NO: 815878 - RNA, 20 nt, Mycobacterium avium subsp. paratuberculosis
ccgaguugauaggucacgcc

SEQ ID NO: 815879 - RNA, 21 nt, Mycobacterium avium subsp. paratuberculosis
ccgaguugauaggucacgccg

SEQ ID NO: 815880 - RNA, 22 nt, Mycobacterium avium subsp. paratuberculosis
ccgaguugauaggucacgccgg

SEQ ID NO: 815881 - RNA, 18 nt, Mycobacterium avium subsp. paratuberculosis
ccgaguuugcggugaucc

SEQ ID NO: 815882 - RNA, 19 nt, Mycobacterium avium subsp. paratuberculosis
ccgaguuuggcgucgaugc

SEQ ID NO: 815883 - RNA, 14 nt, Mycobacterium avium subsp. paratuberculosis
ccgaguucggccag

SEQ ID NO: 815884 - RNA, 15 nt, Mycobacterium avium subsp. paratuberculosis
ccgaguuccugcgac

SEQ ID NO: 815885 - RNA, 16 nt, Mycobacterium avium subsp. paratuberculosis
ccgaguucgaccucgg

SEQ ID NO: 815886 - RNA, 14 nt, Mycobacterium avium subsp. paratuberculosis
ccgaguggcgccgu

SEQ ID NO: 815887 - RNA, 16 nt, Mycobacterium avium subsp. paratuberculosis
ccgaguggcgccgucg

SEQ ID NO: 815888 - RNA, 14 nt, Mycobacterium avium subsp. paratuberculosis
ccgagugggaccgu

SEQ ID NO: 815889 - RNA, 18 nt, Mycobacterium avium subsp. paratuberculosis
ccgagucgcgccgcgucg

SEQ ID NO: 815890 - RNA, 15 nt, Mycobacterium avium subsp. paratuberculosis
ccgagucggcgucgg

SEQ ID NO: 815891 - RNA, 21 nt, Mycobacterium avium subsp. paratuberculosis
ccgagucggugaccaccugca

SEQ ID NO: 815892 - RNA, 23 nt, Mycobacterium avium subsp. paratuberculosis
ccgagucgaucgccagcgcgcag

SEQ ID NO: 815893 - RNA, 18 nt, Mycobacterium avium subsp. paratuberculosis
ccgaguccuugaccuugg

SEQ ID NO: 815894 - RNA, 15 nt, Mycobacterium avium subsp. paratuberculosis
ccgagugcggcgcgg

SEQ ID NO: 815895 - RNA, 21 nt, Mycobacterium avium subsp. paratuberculosis
ccgaguaggaagccaugccgg

SEQ ID NO: 815896 - RNA, 22 nt, Mycobacterium avium subsp. paratuberculosis
ccgaguaggaagccaugccggg

SEQ ID NO: 815897 - RNA, 19 nt, Mycobacterium avium subsp. paratuberculosis
ccgagucgacgugcucggc

SEQ ID NO: 815898 - RNA, 12 nt, Mycobacterium avium subsp. paratuberculosis
ccgagucacccg

SEQ ID NO: 815899 - RNA, 14 nt, Mycobacterium avium subsp. paratuberculosis
ccgagucacccggc

SEQ ID NO: 815900 - RNA, 16 nt, Mycobacterium avium subsp. paratuberculosis
ccgagucacccggcug

SEQ ID NO: 815901 - RNA, 18 nt, Mycobacterium avium subsp. paratuberculosis
ccgagucacccggcuggc

SEQ ID NO: 815902 - RNA, 16 nt, Mycobacterium avium subsp. paratuberculosis
ccgaguccacgacguc

SEQ ID NO: 815903 - RNA, 18 nt, Mycobacterium avium subsp. paratuberculosis
ccgaguauccgcgcagcg

SEQ ID NO: 815904 - RNA, 23 nt, Mycobacterium avium subsp. paratuberculosis
ccgaguccgggccgccggccgcg

SEQ ID NO: 815905 - RNA, 15 nt, Mycobacterium avium subsp. paratuberculosis
ccgaggucgacgccc

SEQ ID NO: 815906 - RNA, 16 nt, Mycobacterium avium subsp. paratuberculosis
ccgaggucgccgacgc

SEQ ID NO: 815907 - RNA, 19 nt, Mycobacterium avium subsp. paratuberculosis
ccgaggucgccgacgccgu

SEQ ID NO: 815908 - RNA, 20 nt, Mycobacterium avium subsp. paratuberculosis
ccgaggucgcggcggccggc

SEQ ID NO: 815909 - RNA, 17 nt, Mycobacterium avium subsp. paratuberculosis
ccgaggucggucgcggc

SEQ ID NO: 815910 - RNA, 19 nt, Mycobacterium avium subsp. paratuberculosis
ccgaggugaauaccacugc

SEQ ID NO: 815911 - RNA, 21 nt, Mycobacterium avium subsp. paratuberculosis
ccgaggugaauaccacugcgc

SEQ ID NO: 815912 - RNA, 15 nt, Mycobacterium avium subsp. paratuberculosis
ccgaggugacgaggc

SEQ ID NO: 815913 - RNA, 18 nt, Mycobacterium avium subsp. paratuberculosis
ccgaggugacgucgcgcc

SEQ ID NO: 815914 - RNA, 22 nt, Mycobacterium avium subsp. paratuberculosis
ccgaggugacgucgcgccgcuc

SEQ ID NO: 815915 - RNA, 14 nt, Mycobacterium avium subsp. paratuberculosis
ccgaggugaucgcg

SEQ ID NO: 815916 - RNA, 24 nt, Mycobacterium avium subsp. paratuberculosis
ccgaggugaucgcgaacgcgccgg

SEQ ID NO: 815917 - RNA, 22 nt, Mycobacterium avium subsp. paratuberculosis
ccgaggugcaacacucgagcgc

SEQ ID NO: 815918 - RNA, 14 nt, Mycobacterium avium subsp. paratuberculosis
ccgaggugccgcgg

SEQ ID NO: 815919 - RNA, 19 nt, Mycobacterium avium subsp. paratuberculosis
ccgaggugcugucgucgcc

SEQ ID NO: 815920 - RNA, 15 nt, Mycobacterium avium subsp. paratuberculosis
ccgagguggcccagc

SEQ ID NO: 815921 - RNA, 17 nt, Mycobacterium avium subsp. paratuberculosis
ccgagguggcccagccg

SEQ ID NO: 815922 - RNA, 18 nt, Mycobacterium avium subsp. paratuberculosis
ccgagguggcccgccacg

SEQ ID NO: 815923 - RNA, 21 nt, Mycobacterium avium subsp. paratuberculosis
ccgagguggcccgccacgugc

SEQ ID NO: 815924 - RNA, 15 nt, Mycobacterium avium subsp. paratuberculosis
ccgagguggccgcca

SEQ ID NO: 815925 - RNA, 17 nt, Mycobacterium avium subsp. paratuberculosis
ccgagguggccgccagc

SEQ ID NO: 815926 - RNA, 16 nt, Mycobacterium avium subsp. paratuberculosis
ccgaggagacgucggc

SEQ ID NO: 815927 - RNA, 18 nt, Mycobacterium avium subsp. paratuberculosis
ccgaggagacgucggccg

SEQ ID NO: 815928 - RNA, 19 nt, Mycobacterium avium subsp. paratuberculosis
ccgaggagacgucggccgg

SEQ ID NO: 815929 - RNA, 15 nt, Mycobacterium avium subsp. paratuberculosis
ccgaggaggccgcgg

SEQ ID NO: 815930 - RNA, 16 nt, Mycobacterium avium subsp. paratuberculosis
ccgaggaggccgcggc

SEQ ID NO: 815931 - RNA, 20 nt, Mycobacterium avium subsp. paratuberculosis
ccgaggaaccggcagccggc

SEQ ID NO: 815932 - RNA, 12 nt, Mycobacterium avium subsp. paratuberculosis
ccgaggccgccc

SEQ ID NO: 815933 - RNA, 22 nt, Mycobacterium avium subsp. paratuberculosis
ccgaggccgcccgcuccugcag

SEQ ID NO: 815934 - RNA, 14 nt, Mycobacterium avium subsp. paratuberculosis
ccgaggccagcacg

SEQ ID NO: 815935 - RNA, 21 nt, Mycobacterium avium subsp. paratuberculosis
ccgaggcacagcagcacguug

SEQ ID NO: 815936 - RNA, 18 nt, Mycobacterium avium subsp. paratuberculosis
ccgaggaucuugaucgcg

SEQ ID NO: 815937 - RNA, 19 nt, Mycobacterium avium subsp. paratuberculosis
ccgaggaucuugaucgcga

SEQ ID NO: 815938 - RNA, 15 nt, Mycobacterium avium subsp. paratuberculosis
ccgaggaugaccgcg

SEQ ID NO: 815939 - RNA, 17 nt, Mycobacterium avium subsp. paratuberculosis
ccgaggaugaccgcggc

SEQ ID NO: 815940 - RNA, 23 nt, Mycobacterium avium subsp. paratuberculosis
ccgaggaugccgcccaccaccgg

SEQ ID NO: 815941 - RNA, 20 nt, Mycobacterium avium subsp. paratuberculosis
ccgaggauggggucgcgggc

SEQ ID NO: 815942 - RNA, 23 nt, Mycobacterium avium subsp. paratuberculosis
ccgaggauggggucgcgggcgcc

SEQ ID NO: 815943 - RNA, 19 nt, Mycobacterium avium subsp. paratuberculosis
ccgaggauuucgcgaucga

SEQ ID NO: 815944 - RNA, 18 nt, Mycobacterium avium subsp. paratuberculosis
ccgagggggaagucgacc

SEQ ID NO: 815945 - RNA, 17 nt, Mycobacterium avium subsp. paratuberculosis
ccgaggguucgguggcc

SEQ ID NO: 815946 - RNA, 18 nt, Mycobacterium avium subsp. paratuberculosis
ccgaggguucgguggccc

SEQ ID NO: 815947 - RNA, 16 nt, Mycobacterium avium subsp. paratuberculosis
ccgagggugccggcca

SEQ ID NO: 815948 - RNA, 14 nt, Mycobacterium avium subsp. paratuberculosis
ccgagguagucggc

SEQ ID NO: 815949 - RNA, 15 nt, Mycobacterium avium subsp. paratuberculosis
ccgaggucaccgcgg

SEQ ID NO: 815950 - RNA, 12 nt, Mycobacterium avium subsp. paratuberculosis
ccgaggucagcg

SEQ ID NO: 815951 - RNA, 18 nt, Mycobacterium avium subsp. paratuberculosis
ccgagguccucgcgcaac

SEQ ID NO: 815952 - RNA, 22 nt, Mycobacterium avium subsp. paratuberculosis
ccgagggcuucccacgccuugc

SEQ ID NO: 815953 - RNA, 16 nt, Mycobacterium avium subsp. paratuberculosis
ccgagggccagcagcc

SEQ ID NO: 815954 - RNA, 15 nt, Mycobacterium avium subsp. paratuberculosis
ccgagggcgacgaug

SEQ ID NO: 815955 - RNA, 21 nt, Mycobacterium avium subsp. paratuberculosis
ccgaggcgguuccgguggcgc

SEQ ID NO: 815956 - RNA, 22 nt, Mycobacterium avium subsp. paratuberculosis
ccgaggcgguuccgguggcgcg

SEQ ID NO: 815957 - RNA, 14 nt, Mycobacterium avium subsp. paratuberculosis
ccgaggcgugccgc

SEQ ID NO: 815958 - RNA, 19 nt, Mycobacterium avium subsp. paratuberculosis
ccgaggcugacgaucgucg

SEQ ID NO: 815959 - RNA, 20 nt, Mycobacterium avium subsp. paratuberculosis
ccgaggcugacgaucgucga

SEQ ID NO: 815960 - RNA, 21 nt, Mycobacterium avium subsp. paratuberculosis
ccgaggcugacgaucgucgac

SEQ ID NO: 815961 - RNA, 23 nt, Mycobacterium avium subsp. paratuberculosis
ccgaggcggguguauucgcccac

SEQ ID NO: 815962 - RNA, 22 nt, Mycobacterium avium subsp. paratuberculosis
ccgaggcgagugaggacgaggc

SEQ ID NO: 815963 - RNA, 16 nt, Mycobacterium avium subsp. paratuberculosis
ccgaggcgaucgcggc

SEQ ID NO: 815964 - RNA, 15 nt, Mycobacterium avium subsp. paratuberculosis
ccgaggcgcaacacc

SEQ ID NO: 815965 - RNA, 18 nt, Mycobacterium avium subsp. paratuberculosis
ccgaggcgcaacaccgga

SEQ ID NO: 815966 - RNA, 17 nt, Mycobacterium avium subsp. paratuberculosis
ccgagcgcaagggccga

SEQ ID NO: 815967 - RNA, 12 nt, Mycobacterium avium subsp. paratuberculosis
ccgagcgcgccg

SEQ ID NO: 815968 - RNA, 20 nt, Mycobacterium avium subsp. paratuberculosis
ccgagcgccgcguucacccg

SEQ ID NO: 815969 - RNA, 13 nt, Mycobacterium avium subsp. paratuberculosis
ccgagcggcgcca

SEQ ID NO: 815970 - RNA, 15 nt, Mycobacterium avium subsp. paratuberculosis
ccgagcggcgccacg

SEQ ID NO: 815971 - RNA, 14 nt, Mycobacterium avium subsp. paratuberculosis
ccgagcggcugcug

SEQ ID NO: 815972 - RNA, 15 nt, Mycobacterium avium subsp. paratuberculosis
ccgagcggcugcugg

SEQ ID NO: 815973 - RNA, 22 nt, Mycobacterium avium subsp. paratuberculosis
ccgagcggcugcuggucgacgu

SEQ ID NO: 815974 - RNA, 23 nt, Mycobacterium avium subsp. paratuberculosis
ccgagcggcugcuggucgacguc

SEQ ID NO: 815975 - RNA, 15 nt, Mycobacterium avium subsp. paratuberculosis
ccgagcggccgucca

SEQ ID NO: 815976 - RNA, 17 nt, Mycobacterium avium subsp. paratuberculosis
ccgagcggcgcaggccg

SEQ ID NO: 815977 - RNA, 22 nt, Mycobacterium avium subsp. paratuberculosis
ccgagcggaugccguagcgcau

SEQ ID NO: 815978 - RNA, 14 nt, Mycobacterium avium subsp. paratuberculosis
ccgagcgcgcgauc

SEQ ID NO: 815979 - RNA, 13 nt, Mycobacterium avium subsp. paratuberculosis
ccgagcgcgcugg

SEQ ID NO: 815980 - RNA, 18 nt, Mycobacterium avium subsp. paratuberculosis
ccgagcgcgccgagcagc

SEQ ID NO: 815981 - RNA, 13 nt, Mycobacterium avium subsp. paratuberculosis
ccgagcgcgccgc

SEQ ID NO: 815982 - RNA, 20 nt, Mycobacterium avium subsp. paratuberculosis
ccgagcgcugcccgugccgc

SEQ ID NO: 815983 - RNA, 21 nt, Mycobacterium avium subsp. paratuberculosis
ccgagcgcugguugucgacgc

SEQ ID NO: 815984 - RNA, 18 nt, Mycobacterium avium subsp. paratuberculosis
ccgagcugaucgcggccg

SEQ ID NO: 815985 - RNA, 20 nt, Mycobacterium avium subsp. paratuberculosis
ccgagcugaucgcggccggc

SEQ ID NO: 815986 - RNA, 22 nt, Mycobacterium avium subsp. paratuberculosis
ccgagcugaucgcggccggcga

SEQ ID NO: 815987 - RNA, 20 nt, Mycobacterium avium subsp. paratuberculosis
ccgagcugggccggcgccga

SEQ ID NO: 815988 - RNA, 20 nt, Mycobacterium avium subsp. paratuberculosis
ccgagcucggccaccagcgc

SEQ ID NO: 815989 - RNA, 14 nt, Mycobacterium avium subsp. paratuberculosis
ccgagcucgggcgc

SEQ ID NO: 815990 - RNA, 16 nt, Mycobacterium avium subsp. paratuberculosis
ccgagcucgggcgcga

SEQ ID NO: 815991 - RNA, 12 nt, Mycobacterium avium subsp. paratuberculosis
ccgagcggggug

SEQ ID NO: 815992 - RNA, 15 nt, Mycobacterium avium subsp. paratuberculosis
ccgagcggggugugg

SEQ ID NO: 815993 - RNA, 16 nt, Mycobacterium avium subsp. paratuberculosis
ccgagcgggucgucgu

SEQ ID NO: 815994 - RNA, 18 nt, Mycobacterium avium subsp. paratuberculosis
ccgagcgguccaacgggc

SEQ ID NO: 815995 - RNA, 21 nt, Mycobacterium avium subsp. paratuberculosis
ccgagcgguccaacgggcuca

SEQ ID NO: 815996 - RNA, 13 nt, Mycobacterium avium subsp. paratuberculosis
ccgagcgggccgu

SEQ ID NO: 815997 - RNA, 21 nt, Mycobacterium avium subsp. paratuberculosis
ccgagcgggccguggcaccgg

SEQ ID NO: 815998 - RNA, 21 nt, Mycobacterium avium subsp. paratuberculosis
ccgagcggcgcugcagcagcc

SEQ ID NO: 815999 - RNA, 13 nt, Mycobacterium avium subsp. paratuberculosis
ccgagcgucacgc

SEQ ID NO: 816000 - RNA, 17 nt, Mycobacterium avium subsp. paratuberculosis
ccgagcgucacgccagc

SEQ ID NO: 816001 - RNA, 21 nt, Mycobacterium avium subsp. paratuberculosis
ccgagcgucacgcuggcgugg

SEQ ID NO: 816002 - RNA, 21 nt, Mycobacterium avium subsp. paratuberculosis
ccgagcgucauuccgccgcgc

SEQ ID NO: 816003 - RNA, 13 nt, Mycobacterium avium subsp. paratuberculosis
ccgagcguucggc

SEQ ID NO: 816004 - RNA, 19 nt, Mycobacterium avium subsp. paratuberculosis
ccgagcguucggcgcggau

SEQ ID NO: 816005 - RNA, 12 nt, Mycobacterium avium subsp. paratuberculosis
ccgagcccgacg

SEQ ID NO: 816006 - RNA, 19 nt, Mycobacterium avium subsp. paratuberculosis
ccgagcauuucgcgcacgu

SEQ ID NO: 816007 - RNA, 12 nt, Mycobacterium avium subsp. paratuberculosis
ccgagccgccgg

SEQ ID NO: 816008 - RNA, 14 nt, Mycobacterium avium subsp. paratuberculosis
ccgagccgccggau

SEQ ID NO: 816009 - RNA, 23 nt, Mycobacterium avium subsp. paratuberculosis
ccgagccgccggaucggcagcgc

SEQ ID NO: 816010 - RNA, 16 nt, Mycobacterium avium subsp. paratuberculosis
ccgagccgacccgggc

SEQ ID NO: 816011 - RNA, 15 nt, Mycobacterium avium subsp. paratuberculosis
ccgagccgacgauga

SEQ ID NO: 816012 - RNA, 17 nt, Mycobacterium avium subsp. paratuberculosis
ccgagccgaggccgaug

SEQ ID NO: 816013 - RNA, 14 nt, Mycobacterium avium subsp. paratuberculosis
ccgagcccugcgcc

SEQ ID NO: 816014 - RNA, 15 nt, Mycobacterium avium subsp. paratuberculosis
ccgagcccugcgcca

SEQ ID NO: 816015 - RNA, 17 nt, Mycobacterium avium subsp. paratuberculosis
ccgagcccugcgccagc

SEQ ID NO: 816016 - RNA, 18 nt, Mycobacterium avium subsp. paratuberculosis
ccgagcccuuugcgcugc

SEQ ID NO: 816017 - RNA, 13 nt, Mycobacterium avium subsp. paratuberculosis
ccgagccggcggc

SEQ ID NO: 816018 - RNA, 15 nt, Mycobacterium avium subsp. paratuberculosis
ccgagccggcgucgc

SEQ ID NO: 816019 - RNA, 17 nt, Mycobacterium avium subsp. paratuberculosis
ccgagccggcgucgccg

SEQ ID NO: 816020 - RNA, 20 nt, Mycobacterium avium subsp. paratuberculosis
ccgagccggcgucgccgcug

SEQ ID NO: 816021 - RNA, 17 nt, Mycobacterium avium subsp. paratuberculosis
ccgagccgcuugguggc

SEQ ID NO: 816022 - RNA, 19 nt, Mycobacterium avium subsp. paratuberculosis
ccgagccgcuugguggcgc

SEQ ID NO: 816023 - RNA, 18 nt, Mycobacterium avium subsp. paratuberculosis
ccgagccgcgccacgcgc

SEQ ID NO: 816024 - RNA, 15 nt, Mycobacterium avium subsp. paratuberculosis
ccgagccgcgcgccg

SEQ ID NO: 816025 - RNA, 15 nt, Mycobacterium avium subsp. paratuberculosis
ccgagccgcaccgcc

SEQ ID NO: 816026 - RNA, 18 nt, Mycobacterium avium subsp. paratuberculosis
ccgagccgcuccaccgcg

SEQ ID NO: 816027 - RNA, 23 nt, Mycobacterium avium subsp. paratuberculosis
ccgagccgcuccaccgcguccug

SEQ ID NO: 816028 - RNA, 13 nt, Mycobacterium avium subsp. paratuberculosis
ccgagccgggcag

SEQ ID NO: 816029 - RNA, 16 nt, Mycobacterium avium subsp. paratuberculosis
ccgagccgggcagcgc

SEQ ID NO: 816030 - RNA, 19 nt, Mycobacterium avium subsp. paratuberculosis
ccgagccgggccagguccc

SEQ ID NO: 816031 - RNA, 14 nt, Mycobacterium avium subsp. paratuberculosis
ccgagccgggcggc

SEQ ID NO: 816032 - RNA, 16 nt, Mycobacterium avium subsp. paratuberculosis
ccgagccgggcggcca

SEQ ID NO: 816033 - RNA, 14 nt, Mycobacterium avium subsp. paratuberculosis
ccgagccggcacgg

SEQ ID NO: 816034 - RNA, 22 nt, Mycobacterium avium subsp. paratuberculosis
ccgagccgguccgaccagcggc

SEQ ID NO: 816035 - RNA, 23 nt, Mycobacterium avium subsp. paratuberculosis
ccgagccgguccgaccagcggcc

SEQ ID NO: 816036 - RNA, 15 nt, Mycobacterium avium subsp. paratuberculosis
ccgagccggugccgc

SEQ ID NO: 816037 - RNA, 15 nt, Mycobacterium avium subsp. paratuberculosis
ccgagccgucgucgc

SEQ ID NO: 816038 - RNA, 16 nt, Mycobacterium avium subsp. paratuberculosis
ccgagcaucagcugcc

SEQ ID NO: 816039 - RNA, 24 nt, Mycobacterium avium subsp. paratuberculosis
ccgagcaucagcugccguccgggu

SEQ ID NO: 816040 - RNA, 13 nt, Mycobacterium avium subsp. paratuberculosis
ccgagcaucgccg

SEQ ID NO: 816041 - RNA, 14 nt, Mycobacterium avium subsp. paratuberculosis
ccgagcaucgccga

SEQ ID NO: 816042 - RNA, 15 nt, Mycobacterium avium subsp. paratuberculosis
ccgagcaucgccgag

SEQ ID NO: 816043 - RNA, 18 nt, Mycobacterium avium subsp. paratuberculosis
ccgagcaucgccgagcgc

SEQ ID NO: 816044 - RNA, 19 nt, Mycobacterium avium subsp. paratuberculosis
ccgagcaucgccgagcgca

SEQ ID NO: 816045 - RNA, 22 nt, Mycobacterium avium subsp. paratuberculosis
ccgagcaucggguugccggcgg

SEQ ID NO: 816046 - RNA, 18 nt, Mycobacterium avium subsp. paratuberculosis
ccgagcagcagccgcagc

SEQ ID NO: 816047 - RNA, 21 nt, Mycobacterium avium subsp. paratuberculosis
ccgagcagcagccgcagcggc

SEQ ID NO: 816048 - RNA, 14 nt, Mycobacterium avium subsp. paratuberculosis
ccgagcagccgggc

SEQ ID NO: 816049 - RNA, 22 nt, Mycobacterium avium subsp. paratuberculosis
ccgagcaggcggaucggcccga

SEQ ID NO: 816050 - RNA, 16 nt, Mycobacterium avium subsp. paratuberculosis
ccgagcaccuggccgu

SEQ ID NO: 816051 - RNA, 19 nt, Mycobacterium avium subsp. paratuberculosis
ccgagcacgaacgcggccg

SEQ ID NO: 816052 - RNA, 22 nt, Mycobacterium avium subsp. paratuberculosis
ccgagcacgaacgcggccgcca

SEQ ID NO: 816053 - RNA, 18 nt, Mycobacterium avium subsp. paratuberculosis
ccgagcacgcagccgcgc

SEQ ID NO: 816054 - RNA, 21 nt, Mycobacterium avium subsp. paratuberculosis
ccgagcacgcagccgcgcccg

SEQ ID NO: 816055 - RNA, 23 nt, Mycobacterium avium subsp. paratuberculosis
ccgagcacgcagccgcgcccgau

SEQ ID NO: 816056 - RNA, 13 nt, Mycobacterium avium subsp. paratuberculosis
ccgagcacgcggc

SEQ ID NO: 816057 - RNA, 14 nt, Mycobacterium avium subsp. paratuberculosis
ccgagcacgcggcc

SEQ ID NO: 816058 - RNA, 17 nt, Mycobacterium avium subsp. paratuberculosis
ccgagcacgcggccgcg

SEQ ID NO: 816059 - RNA, 18 nt, Mycobacterium avium subsp. paratuberculosis
ccgagcacgcggccgcgc

SEQ ID NO: 816060 - RNA, 22 nt, Mycobacterium avium subsp. paratuberculosis
ccgagcacgcggccgcgccggc

SEQ ID NO: 816061 - RNA, 13 nt, Mycobacterium avium subsp. paratuberculosis
ccgagcacgucga

SEQ ID NO: 816062 - RNA, 16 nt, Mycobacterium avium subsp. paratuberculosis
ccgagcagcaccgcga

SEQ ID NO: 816063 - RNA, 22 nt, Mycobacterium avium subsp. paratuberculosis
ccgagcagcaccgcgacccagg

SEQ ID NO: 816064 - RNA, 13 nt, Mycobacterium avium subsp. paratuberculosis
ccgagcagcgggu

SEQ ID NO: 816065 - RNA, 19 nt, Mycobacterium avium subsp. paratuberculosis
ccgagcagcgggucgucgg

SEQ ID NO: 816066 - RNA, 12 nt, Mycobacterium avium subsp. paratuberculosis
ccgagcagcuca

SEQ ID NO: 816067 - RNA, 15 nt, Mycobacterium avium subsp. paratuberculosis
ccgagcagcucggcg

SEQ ID NO: 816068 - RNA, 21 nt, Mycobacterium avium subsp. paratuberculosis
ccgacguuguugucgaugaug

SEQ ID NO: 816069 - RNA, 22 nt, Mycobacterium avium subsp. paratuberculosis
ccgacgugucgucgucgccgcc

SEQ ID NO: 816070 - RNA, 23 nt, Mycobacterium avium subsp. paratuberculosis
ccgacgugucgucgucgccgccg

SEQ ID NO: 816071 - RNA, 20 nt, Mycobacterium avium subsp. paratuberculosis
ccgacuagcgcggcggccuc

SEQ ID NO: 816072 - RNA, 21 nt, Mycobacterium avium subsp. paratuberculosis
ccgacuagcgcggcggccucg

SEQ ID NO: 816073 - RNA, 23 nt, Mycobacterium avium subsp. paratuberculosis
ccgacgugcuuggccagcucggc

SEQ ID NO: 816074 - RNA, 16 nt, Mycobacterium avium subsp. paratuberculosis
ccgacguggguggugg

SEQ ID NO: 816075 - RNA, 22 nt, Mycobacterium avium subsp. paratuberculosis
ccgacgugggugguggugccgu

SEQ ID NO: 816076 - RNA, 13 nt, Mycobacterium avium subsp. paratuberculosis
ccgacgugccggu

SEQ ID NO: 816077 - RNA, 15 nt, Mycobacterium avium subsp. paratuberculosis
ccgacgugcagcgcc

SEQ ID NO: 816078 - RNA, 16 nt, Mycobacterium avium subsp. paratuberculosis
ccgacgugcagcgcca

SEQ ID NO: 816079 - RNA, 18 nt, Mycobacterium avium subsp. paratuberculosis
ccgacgugcagcgccagc

SEQ ID NO: 816080 - RNA, 14 nt, Mycobacterium avium subsp. paratuberculosis
ccgacgucagggug

SEQ ID NO: 816081 - RNA, 20 nt, Mycobacterium avium subsp. paratuberculosis
ccgacgucaggguggccucg

SEQ ID NO: 816082 - RNA, 15 nt, Mycobacterium avium subsp. paratuberculosis
ccgacgucccagcac

SEQ ID NO: 816083 - RNA, 23 nt, Mycobacterium avium subsp. paratuberculosis
ccgacguccuggaucgcgcaggu

SEQ ID NO: 816084 - RNA, 23 nt, Mycobacterium avium subsp. paratuberculosis
ccgacguccugguugaggaucug

SEQ ID NO: 816085 - RNA, 16 nt, Mycobacterium avium subsp. paratuberculosis
ccgacgucgaccaggu

SEQ ID NO: 816086 - RNA, 16 nt, Mycobacterium avium subsp. paratuberculosis
ccgacgucgacgcggg

SEQ ID NO: 816087 - RNA, 12 nt, Mycobacterium avium subsp. paratuberculosis
ccgacgucggaa

SEQ ID NO: 816088 - RNA, 12 nt, Mycobacterium avium subsp. paratuberculosis
ccgacgucgugg

SEQ ID NO: 816089 - RNA, 14 nt, Mycobacterium avium subsp. paratuberculosis
ccgacgucgugggc

SEQ ID NO: 816090 - RNA, 23 nt, Mycobacterium avium subsp. paratuberculosis
ccgacgucugguuggccggcggg

SEQ ID NO: 816091 - RNA, 22 nt, Mycobacterium avium subsp. paratuberculosis
ccgacugcggcgcuucgggugc

SEQ ID NO: 816092 - RNA, 12 nt, Mycobacterium avium subsp. paratuberculosis
ccgacugcgacg

SEQ ID NO: 816093 - RNA, 21 nt, Mycobacterium avium subsp. paratuberculosis
ccgacucgauguagccgggcu

SEQ ID NO: 816094 - RNA, 14 nt, Mycobacterium avium subsp. paratuberculosis
ccgacuccucacac

SEQ ID NO: 816095 - RNA, 18 nt, Mycobacterium avium subsp. paratuberculosis
ccgacuccucacaccucg

SEQ ID NO: 816096 - RNA, 15 nt, Mycobacterium avium subsp. paratuberculosis
ccgacuccagcagcg

SEQ ID NO: 816097 - RNA, 21 nt, Mycobacterium avium subsp. paratuberculosis
ccgacuugaucgcggcguagg

SEQ ID NO: 816098 - RNA, 22 nt, Mycobacterium avium subsp. paratuberculosis
ccgacuuggugccaugccgggu

SEQ ID NO: 816099 - RNA, 14 nt, Mycobacterium avium subsp. paratuberculosis
ccgacuucggcucg

SEQ ID NO: 816100 - RNA, 18 nt, Mycobacterium avium subsp. paratuberculosis
ccgacuucggcucggcga

SEQ ID NO: 816101 - RNA, 19 nt, Mycobacterium avium subsp. paratuberculosis
ccgacuucggcucggcgac

SEQ ID NO: 816102 - RNA, 14 nt, Mycobacterium avium subsp. paratuberculosis
ccgacugugcgaug

SEQ ID NO: 816103 - RNA, 17 nt, Mycobacterium avium subsp. paratuberculosis
ccgacuguuugaugccg

SEQ ID NO: 816104 - RNA, 21 nt, Mycobacterium avium subsp. paratuberculosis
ccgacuguuugaugccgucgg

SEQ ID NO: 816105 - RNA, 21 nt, Mycobacterium avium subsp. paratuberculosis
ccgagacgaucccguagccgu

SEQ ID NO: 816106 - RNA, 12 nt, Mycobacterium avium subsp. paratuberculosis
ccgagagcgcgu

SEQ ID NO: 816107 - RNA, 12 nt, Mycobacterium avium subsp. paratuberculosis
ccgagagcugcu

SEQ ID NO: 816108 - RNA, 20 nt, Mycobacterium avium subsp. paratuberculosis
ccgagaguccgccgccgggc

SEQ ID NO: 816109 - RNA, 12 nt, Mycobacterium avium subsp. paratuberculosis
ccgagacggcgu

SEQ ID NO: 816110 - RNA, 14 nt, Mycobacterium avium subsp. paratuberculosis
ccgagacggcgugg

SEQ ID NO: 816111 - RNA, 16 nt, Mycobacterium avium subsp. paratuberculosis
ccgagacgucggcgua

SEQ ID NO: 816112 - RNA, 14 nt, Mycobacterium avium subsp. paratuberculosis
ccgagacguggugg

SEQ ID NO: 816113 - RNA, 19 nt, Mycobacterium avium subsp. paratuberculosis
ccgagacugaugguggcgc

SEQ ID NO: 816114 - RNA, 20 nt, Mycobacterium avium subsp. paratuberculosis
ccgagacugaugguggcgcg

SEQ ID NO: 816115 - RNA, 17 nt, Mycobacterium avium subsp. paratuberculosis
ccgagaccaugccgccg

SEQ ID NO: 816116 - RNA, 21 nt, Mycobacterium avium subsp. paratuberculosis
ccgagaccaugccgccgaagc

SEQ ID NO: 816117 - RNA, 14 nt, Mycobacterium avium subsp. paratuberculosis
ccgagaaugccgua

SEQ ID NO: 816118 - RNA, 16 nt, Mycobacterium avium subsp. paratuberculosis
ccgagaaugccguaga

SEQ ID NO: 816119 - RNA, 18 nt, Mycobacterium avium subsp. paratuberculosis
ccgagaaugccguagauc

SEQ ID NO: 816120 - RNA, 17 nt, Mycobacterium avium subsp. paratuberculosis
ccgagaacaggccgagc

SEQ ID NO: 816121 - RNA, 19 nt, Mycobacterium avium subsp. paratuberculosis
ccgagaacaggccgagcgc

SEQ ID NO: 816122 - RNA, 15 nt, Mycobacterium avium subsp. paratuberculosis
ccgagaagggccgcc

SEQ ID NO: 816123 - RNA, 16 nt, Mycobacterium avium subsp. paratuberculosis
ccgagaagggccgccg

SEQ ID NO: 816124 - RNA, 16 nt, Mycobacterium avium subsp. paratuberculosis
ccgagauguaguccuc

SEQ ID NO: 816125 - RNA, 18 nt, Mycobacterium avium subsp. paratuberculosis
ccgagauggacagcaccu

SEQ ID NO: 816126 - RNA, 20 nt, Mycobacterium avium subsp. paratuberculosis
ccgagauggacagcaccuug

SEQ ID NO: 816127 - RNA, 16 nt, Mycobacterium avium subsp. paratuberculosis
ccgagauccaccgcgc

SEQ ID NO: 816128 - RNA, 17 nt, Mycobacterium avium subsp. paratuberculosis
ccgagauccaccgcgcg

SEQ ID NO: 816129 - RNA, 19 nt, Mycobacterium avium subsp. paratuberculosis
ccgagauccaccgcgcggc

SEQ ID NO: 816130 - RNA, 20 nt, Mycobacterium avium subsp. paratuberculosis
ccgagauccaccgcgcggcc

SEQ ID NO: 816131 - RNA, 15 nt, Mycobacterium avium subsp. paratuberculosis
ccgagaucaccggcu

SEQ ID NO: 816132 - RNA, 23 nt, Mycobacterium avium subsp. paratuberculosis
ccgagaucaccggcuuggcggug

SEQ ID NO: 816133 - RNA, 15 nt, Mycobacterium avium subsp. paratuberculosis
ccgagaucccagcgg

SEQ ID NO: 816134 - RNA, 21 nt, Mycobacterium avium subsp. paratuberculosis
ccgagaucgacgcugaccagc

SEQ ID NO: 816135 - RNA, 17 nt, Mycobacterium avium subsp. paratuberculosis
ccgagaucgcgggcugc

SEQ ID NO: 816136 - RNA, 17 nt, Mycobacterium avium subsp. paratuberculosis
ccgagaucgcgguggcg

SEQ ID NO: 816137 - RNA, 18 nt, Mycobacterium avium subsp. paratuberculosis
ccgagaucucgucgaugg

SEQ ID NO: 816138 - RNA, 16 nt, Mycobacterium avium subsp. paratuberculosis
ccgagaugaagacccg

SEQ ID NO: 816139 - RNA, 18 nt, Mycobacterium avium subsp. paratuberculosis
ccgagaugaagacccggc

SEQ ID NO: 816140 - RNA, 21 nt, Mycobacterium avium subsp. paratuberculosis
ccgagaugaagacccggccgu

SEQ ID NO: 816141 - RNA, 21 nt, Mycobacterium avium subsp. paratuberculosis
ccgagcaacagcccgaccguc

SEQ ID NO: 816142 - RNA, 17 nt, Mycobacterium avium subsp. paratuberculosis
ccgagcaaccgggauac

SEQ ID NO: 816143 - RNA, 16 nt, Mycobacterium avium subsp. paratuberculosis
ccgagcacaccgucgc

SEQ ID NO: 816144 - RNA, 22 nt, Mycobacterium avium subsp. paratuberculosis
ccgagcacaccgucgcccgccc

SEQ ID NO: 816145 - RNA, 13 nt, Mycobacterium avium subsp. paratuberculosis
ccgagcaccacca

SEQ ID NO: 816146 - RNA, 16 nt, Mycobacterium avium subsp. paratuberculosis
ccgagcaccaggcgca

SEQ ID NO: 816147 - RNA, 13 nt, Mycobacterium avium subsp. paratuberculosis
ccgagcaccccgg

SEQ ID NO: 816148 - RNA, 17 nt, Mycobacterium avium subsp. paratuberculosis
ccgagcaccccggcggc

SEQ ID NO: 816149 - RNA, 19 nt, Mycobacterium avium subsp. paratuberculosis
ccgagcaccccggcggccg

SEQ ID NO: 816150 - RNA, 20 nt, Mycobacterium avium subsp. paratuberculosis
ccgagcaccccggcggccgc

SEQ ID NO: 816151 - RNA, 21 nt, Mycobacterium avium subsp. paratuberculosis
ccgagcaccccggcggccgcg

SEQ ID NO: 816152 - RNA, 22 nt, Mycobacterium avium subsp. paratuberculosis
ccgagcaccccggcggccgcgu

SEQ ID NO: 816153 - RNA, 11 nt, Mycobacterium avium subsp. paratuberculosis
ccgagcaccgg

SEQ ID NO: 816154 - RNA, 15 nt, Mycobacterium avium subsp. paratuberculosis
ccgagcaccggcagc

SEQ ID NO: 816155 - RNA, 19 nt, Mycobacterium avium subsp. paratuberculosis
ccgagcaccggcagcaccg

SEQ ID NO: 816156 - RNA, 21 nt, Mycobacterium avium subsp. paratuberculosis
ccgagcaccggcagcaccgcc

SEQ ID NO: 816157 - RNA, 22 nt, Mycobacterium avium subsp. paratuberculosis
ccgagcaccggcagcaccgccg

SEQ ID NO: 816158 - RNA, 12 nt, Mycobacterium avium subsp. paratuberculosis
ccgagcaccggg

SEQ ID NO: 816159 - RNA, 14 nt, Mycobacterium avium subsp. paratuberculosis
ccgagcaccgggcc

SEQ ID NO: 816160 - RNA, 16 nt, Mycobacterium avium subsp. paratuberculosis
ccgagcaccgggccga

SEQ ID NO: 816161 - RNA, 18 nt, Mycobacterium avium subsp. paratuberculosis
ccgagcaccuccgacauc

SEQ ID NO: 816162 - RNA, 17 nt, Mycobacterium avium subsp. paratuberculosis
ccgagcaccucgucgcc

SEQ ID NO: 816163 - RNA, 19 nt, Mycobacterium avium subsp. paratuberculosis
ccgagcaccucgucgccgu

SEQ ID NO: 816164 - RNA, 20 nt, Mycobacterium avium subsp. paratuberculosis
ccgagcaccugaacggccgc

SEQ ID NO: 816165 - RNA, 17 nt, Mycobacterium avium subsp. paratuberculosis
ccgacgaugucgaaacc

SEQ ID NO: 816166 - RNA, 17 nt, Mycobacterium avium subsp. paratuberculosis
ccgacgcauguccgccg

SEQ ID NO: 816167 - RNA, 20 nt, Mycobacterium avium subsp. paratuberculosis
ccgacgcauguccgccguca

SEQ ID NO: 816168 - RNA, 16 nt, Mycobacterium avium subsp. paratuberculosis
ccgacaagggccgggc

SEQ ID NO: 816169 - RNA, 24 nt, Mycobacterium avium subsp. paratuberculosis
ccgacaagggccgggcgcuggccg

SEQ ID NO: 816170 - RNA, 14 nt, Mycobacterium avium subsp. paratuberculosis
ccgacaccaccgcg

SEQ ID NO: 816171 - RNA, 15 nt, Mycobacterium avium subsp. paratuberculosis
ccgacaccaccgcgc

SEQ ID NO: 816172 - RNA, 13 nt, Mycobacterium avium subsp. paratuberculosis
ccgacaccaccgg

SEQ ID NO: 816173 - RNA, 17 nt, Mycobacterium avium subsp. paratuberculosis
ccgacaacauccgcgac

SEQ ID NO: 816174 - RNA, 18 nt, Mycobacterium avium subsp. paratuberculosis
ccgacaacauccgcgacg

SEQ ID NO: 816175 - RNA, 16 nt, Mycobacterium avium subsp. paratuberculosis
ccgacaacgacagcac

SEQ ID NO: 816176 - RNA, 17 nt, Mycobacterium avium subsp. paratuberculosis
ccgaauuguucggccac

SEQ ID NO: 816177 - RNA, 21 nt, Mycobacterium avium subsp. paratuberculosis
ccgaauuguucggccaccgcg

SEQ ID NO: 816178 - RNA, 19 nt, Mycobacterium avium subsp. paratuberculosis
ccgaauugcgcugcaccgc

SEQ ID NO: 816179 - RNA, 19 nt, Mycobacterium avium subsp. paratuberculosis
ccgaauugcuuacgcaucg

SEQ ID NO: 816180 - RNA, 14 nt, Mycobacterium avium subsp. paratuberculosis
ccgaaugccacgcc

SEQ ID NO: 816181 - RNA, 16 nt, Mycobacterium avium subsp. paratuberculosis
ccgaaugccacgccga

SEQ ID NO: 816182 - RNA, 13 nt, Mycobacterium avium subsp. paratuberculosis
ccgacgcggcgac

SEQ ID NO: 816183 - RNA, 14 nt, Mycobacterium avium subsp. paratuberculosis
ccgacgcggcgacc

SEQ ID NO: 816184 - RNA, 18 nt, Mycobacterium avium subsp. paratuberculosis
ccgacgcggcgaccacca

SEQ ID NO: 816185 - RNA, 19 nt, Mycobacterium avium subsp. paratuberculosis
ccgacgcggcgaccaccac

SEQ ID NO: 816186 - RNA, 23 nt, Mycobacterium avium subsp. paratuberculosis
ccgacgcggcgaccaccaccgcc

SEQ ID NO: 816187 - RNA, 13 nt, Mycobacterium avium subsp. paratuberculosis
ccgacgcggcgcg

SEQ ID NO: 816188 - RNA, 21 nt, Mycobacterium avium subsp. paratuberculosis
ccgacgcggcgcgacaccgcg

SEQ ID NO: 816189 - RNA, 23 nt, Mycobacterium avium subsp. paratuberculosis
ccgacgcggcgcgacaccgcggc

SEQ ID NO: 816190 - RNA, 13 nt, Mycobacterium avium subsp. paratuberculosis
ccgacgcggcggc

SEQ ID NO: 816191 - RNA, 15 nt, Mycobacterium avium subsp. paratuberculosis
ccgacgcgccgucgg

SEQ ID NO: 816192 - RNA, 16 nt, Mycobacterium avium subsp. paratuberculosis
ccgacgcgccgucggc

SEQ ID NO: 816193 - RNA, 21 nt, Mycobacterium avium subsp. paratuberculosis
ccgacgccagcacguggccgg

SEQ ID NO: 816194 - RNA, 20 nt, Mycobacterium avium subsp. paratuberculosis
ccgacgcgcugcgcgccgcc

SEQ ID NO: 816195 - RNA, 16 nt, Mycobacterium avium subsp. paratuberculosis
ccgacgccgucgagcc

SEQ ID NO: 816196 - RNA, 20 nt, Mycobacterium avium subsp. paratuberculosis
ccgacgccgucgagccuggu

SEQ ID NO: 816197 - RNA, 16 nt, Mycobacterium avium subsp. paratuberculosis
ccgacgccggacccca

SEQ ID NO: 816198 - RNA, 22 nt, Mycobacterium avium subsp. paratuberculosis
ccgacgccuccacauacgcggc

SEQ ID NO: 816199 - RNA, 16 nt, Mycobacterium avium subsp. paratuberculosis
ccgacgcgacggucgu

SEQ ID NO: 816200 - RNA, 19 nt, Mycobacterium avium subsp. paratuberculosis
ccgacgccgacaccagcgc

SEQ ID NO: 816201 - RNA, 15 nt, Mycobacterium avium subsp. paratuberculosis
ccgacgccagcgggc

SEQ ID NO: 816202 - RNA, 12 nt, Mycobacterium avium subsp. paratuberculosis
ccgacgcccggc

SEQ ID NO: 816203 - RNA, 13 nt, Mycobacterium avium subsp. paratuberculosis
ccgacgcccggcu

SEQ ID NO: 816204 - RNA, 21 nt, Mycobacterium avium subsp. paratuberculosis
ccgacgcccggcuucgccgcc

SEQ ID NO: 816205 - RNA, 22 nt, Mycobacterium avium subsp. paratuberculosis
ccgacgcccggcuucgccgccg

SEQ ID NO: 816206 - RNA, 20 nt, Mycobacterium avium subsp. paratuberculosis
ccgacgccgaagaucagcgc

SEQ ID NO: 816207 - RNA, 21 nt, Mycobacterium avium subsp. paratuberculosis
ccgacgccgaagaucagcgcg

SEQ ID NO: 816208 - RNA, 14 nt, Mycobacterium avium subsp. paratuberculosis
ccgacgcccacagc

SEQ ID NO: 816209 - RNA, 15 nt, Mycobacterium avium subsp. paratuberculosis
ccgacgcccacagcg

SEQ ID NO: 816210 - RNA, 16 nt, Mycobacterium avium subsp. paratuberculosis
ccgacgcccacagcgc

SEQ ID NO: 816211 - RNA, 17 nt, Mycobacterium avium subsp. paratuberculosis
ccgacgcccacagcgcc

SEQ ID NO: 816212 - RNA, 18 nt, Mycobacterium avium subsp. paratuberculosis
ccgacgcccacagcgcca

SEQ ID NO: 816213 - RNA, 19 nt, Mycobacterium avium subsp. paratuberculosis
ccgacgcccacagcgccag

SEQ ID NO: 816214 - RNA, 20 nt, Mycobacterium avium subsp. paratuberculosis
ccgacgcccacagcgccagc

SEQ ID NO: 816215 - RNA, 13 nt, Mycobacterium avium subsp. paratuberculosis
ccgacgcccagca

SEQ ID NO: 816216 - RNA, 14 nt, Mycobacterium avium subsp. paratuberculosis
ccgacgcccagcac

SEQ ID NO: 816217 - RNA, 16 nt, Mycobacterium avium subsp. paratuberculosis
ccgacgcccagcaccg

SEQ ID NO: 816218 - RNA, 17 nt, Mycobacterium avium subsp. paratuberculosis
ccgacgcccagcaccga

SEQ ID NO: 816219 - RNA, 17 nt, Mycobacterium avium subsp. paratuberculosis
ccgacgcccagcgcggc

SEQ ID NO: 816220 - RNA, 16 nt, Mycobacterium avium subsp. paratuberculosis
ccgacguaggacagca

SEQ ID NO: 816221 - RNA, 16 nt, Mycobacterium avium subsp. paratuberculosis
ccgacguagacgagcc

SEQ ID NO: 816222 - RNA, 16 nt, Mycobacterium avium subsp. paratuberculosis
ccgacggucgggccca

SEQ ID NO: 816223 - RNA, 17 nt, Mycobacterium avium subsp. paratuberculosis
ccgacggucgggcccag

SEQ ID NO: 816224 - RNA, 18 nt, Mycobacterium avium subsp. paratuberculosis
ccgacggugagcaccgcc

SEQ ID NO: 816225 - RNA, 19 nt, Mycobacterium avium subsp. paratuberculosis
ccgacgguguccgcgggca

SEQ ID NO: 816226 - RNA, 23 nt, Mycobacterium avium subsp. paratuberculosis
ccgacggugucguagacgacguc

SEQ ID NO: 816227 - RNA, 20 nt, Mycobacterium avium subsp. paratuberculosis
ccgacggguucgcgcagcca

SEQ ID NO: 816228 - RNA, 22 nt, Mycobacterium avium subsp. paratuberculosis
ccgacggguucgcgcagccacc

SEQ ID NO: 816229 - RNA, 17 nt, Mycobacterium avium subsp. paratuberculosis
ccgacggucgccaccac

SEQ ID NO: 816230 - RNA, 19 nt, Mycobacterium avium subsp. paratuberculosis
ccgacggucgccaccacca

SEQ ID NO: 816231 - RNA, 21 nt, Mycobacterium avium subsp. paratuberculosis
ccgacggugcgugccagcagc

SEQ ID NO: 816232 - RNA, 23 nt, Mycobacterium avium subsp. paratuberculosis
ccgacggugcgugccagcagcuc

SEQ ID NO: 816233 - RNA, 13 nt, Mycobacterium avium subsp. paratuberculosis
ccgacgguggccc

SEQ ID NO: 816234 - RNA, 20 nt, Mycobacterium avium subsp. paratuberculosis
ccgacgguggcccccaccac

SEQ ID NO: 816235 - RNA, 14 nt, Mycobacterium avium subsp. paratuberculosis
ccgacgguggcgaa

SEQ ID NO: 816236 - RNA, 23 nt, Mycobacterium avium subsp. paratuberculosis
ccgacgguggcgaagcacgacca

SEQ ID NO: 816237 - RNA, 15 nt, Mycobacterium avium subsp. paratuberculosis
ccgacggcgcgcccg

SEQ ID NO: 816238 - RNA, 21 nt, Mycobacterium avium subsp. paratuberculosis
ccgacgggaacucggccagcu

SEQ ID NO: 816239 - RNA, 20 nt, Mycobacterium avium subsp. paratuberculosis
ccgacggcugcccggcccgc

SEQ ID NO: 816240 - RNA, 17 nt, Mycobacterium avium subsp. paratuberculosis
ccgacggcugcgguugg

SEQ ID NO: 816241 - RNA, 21 nt, Mycobacterium avium subsp. paratuberculosis
ccgacggcugcgguuggccgg

SEQ ID NO: 816242 - RNA, 22 nt, Mycobacterium avium subsp. paratuberculosis
ccgacggcugcgguuggccggc

SEQ ID NO: 816243 - RNA, 17 nt, Mycobacterium avium subsp. paratuberculosis
ccgacggcuggguggcg

SEQ ID NO: 816244 - RNA, 19 nt, Mycobacterium avium subsp. paratuberculosis
ccgacgggcccagcgcgac

SEQ ID NO: 816245 - RNA, 21 nt, Mycobacterium avium subsp. paratuberculosis
ccgacgggcccagcgcgacgu

SEQ ID NO: 816246 - RNA, 13 nt, Mycobacterium avium subsp. paratuberculosis
ccgacgggcccgc

SEQ ID NO: 816247 - RNA, 16 nt, Mycobacterium avium subsp. paratuberculosis
ccgacgggcguguagc

SEQ ID NO: 816248 - RNA, 16 nt, Mycobacterium avium subsp. paratuberculosis
ccgacggcgccgcggc

SEQ ID NO: 816249 - RNA, 18 nt, Mycobacterium avium subsp. paratuberculosis
ccgacggcgccgcggccg

SEQ ID NO: 816250 - RNA, 13 nt, Mycobacterium avium subsp. paratuberculosis
ccgacggcgccgg

SEQ ID NO: 816251 - RNA, 12 nt, Mycobacterium avium subsp. paratuberculosis
ccgacggcgcgc

SEQ ID NO: 816252 - RNA, 12 nt, Mycobacterium avium subsp. paratuberculosis
ccgacggcgacc

SEQ ID NO: 816253 - RNA, 20 nt, Mycobacterium avium subsp. paratuberculosis
ccgacggcaccucucgggaa

SEQ ID NO: 816254 - RNA, 17 nt, Mycobacterium avium subsp. paratuberculosis
ccgacggcagcaccgcc

SEQ ID NO: 816255 - RNA, 12 nt, Mycobacterium avium subsp. paratuberculosis
ccgacggccgca

SEQ ID NO: 816256 - RNA, 17 nt, Mycobacterium avium subsp. paratuberculosis
ccgacggccgcacccca

SEQ ID NO: 816257 - RNA, 20 nt, Mycobacterium avium subsp. paratuberculosis
ccgacggccgcaccccaccc

SEQ ID NO: 816258 - RNA, 12 nt, Mycobacterium avium subsp. paratuberculosis
ccgacggccgcg

SEQ ID NO: 816259 - RNA, 17 nt, Mycobacterium avium subsp. paratuberculosis
ccgacggccgcgccguu

SEQ ID NO: 816260 - RNA, 19 nt, Mycobacterium avium subsp. paratuberculosis
ccgacggccgcgccguuga

SEQ ID NO: 816261 - RNA, 15 nt, Mycobacterium avium subsp. paratuberculosis
ccgacgcggucaccg

SEQ ID NO: 816262 - RNA, 16 nt, Mycobacterium avium subsp. paratuberculosis
ccgacgcggucaccgg

SEQ ID NO: 816263 - RNA, 14 nt, Mycobacterium avium subsp. paratuberculosis
ccgacgcgguggcg

SEQ ID NO: 816264 - RNA, 23 nt, Mycobacterium avium subsp. paratuberculosis
ccgacgcgguggcgugcucgaug

SEQ ID NO: 816265 - RNA, 12 nt, Mycobacterium avium subsp. paratuberculosis
ccgacgcgucgc

SEQ ID NO: 816266 - RNA, 17 nt, Mycobacterium avium subsp. paratuberculosis
ccgacgcgucgcggcgg

SEQ ID NO: 816267 - RNA, 23 nt, Mycobacterium avium subsp. paratuberculosis
ccgacgcugacgaugcggccggc

SEQ ID NO: 816268 - RNA, 13 nt, Mycobacterium avium subsp. paratuberculosis
ccgacgcuggccg

SEQ ID NO: 816269 - RNA, 14 nt, Mycobacterium avium subsp. paratuberculosis
ccgacgcuggccga

SEQ ID NO: 816270 - RNA, 16 nt, Mycobacterium avium subsp. paratuberculosis
ccgacgcuggccgaga

SEQ ID NO: 816271 - RNA, 22 nt, Mycobacterium avium subsp. paratuberculosis
ccgacgcuggccgagagccggu

SEQ ID NO: 816272 - RNA, 20 nt, Mycobacterium avium subsp. paratuberculosis
ccgacgcucgccaccccgcg

SEQ ID NO: 816273 - RNA, 16 nt, Mycobacterium avium subsp. paratuberculosis
ccgacggagccgagca

SEQ ID NO: 816274 - RNA, 17 nt, Mycobacterium avium subsp. paratuberculosis
ccgacggagccgagcac

SEQ ID NO: 816275 - RNA, 20 nt, Mycobacterium avium subsp. paratuberculosis
ccgacggagccgagcaccag

SEQ ID NO: 816276 - RNA, 16 nt, Mycobacterium avium subsp. paratuberculosis
ccgcaguucggccgcc

SEQ ID NO: 816277 - RNA, 17 nt, Mycobacterium avium subsp. paratuberculosis
ccgcaguucggccgccg

SEQ ID NO: 816278 - RNA, 19 nt, Mycobacterium avium subsp. paratuberculosis
ccgcaguucggccgccgug

SEQ ID NO: 816279 - RNA, 21 nt, Mycobacterium avium subsp. paratuberculosis
ccgcaguucggccgccgugcu

SEQ ID NO: 816280 - RNA, 23 nt, Mycobacterium avium subsp. paratuberculosis
ccgcagugaaauucgcgccucgg

SEQ ID NO: 816281 - RNA, 18 nt, Mycobacterium avium subsp. paratuberculosis
ccgcagugccggcgcacc

SEQ ID NO: 816282 - RNA, 19 nt, Mycobacterium avium subsp. paratuberculosis
ccgcagugccggcgcaccg

SEQ ID NO: 816283 - RNA, 13 nt, Mycobacterium avium subsp. paratuberculosis
ccgcagggcgccg

SEQ ID NO: 816284 - RNA, 13 nt, Mycobacterium avium subsp. paratuberculosis
ccgcagucgauca

SEQ ID NO: 816285 - RNA, 16 nt, Mycobacterium avium subsp. paratuberculosis
ccgcagucgaucaccg

SEQ ID NO: 816286 - RNA, 17 nt, Mycobacterium avium subsp. paratuberculosis
ccgcagguggugggcgu

SEQ ID NO: 816287 - RNA, 20 nt, Mycobacterium avium subsp. paratuberculosis
ccgcagguucaugugaccgg

SEQ ID NO: 816288 - RNA, 22 nt, Mycobacterium avium subsp. paratuberculosis
ccgcaggugcucgccggcgcgg

SEQ ID NO: 816289 - RNA, 17 nt, Mycobacterium avium subsp. paratuberculosis
ccgcaggguggccagca

SEQ ID NO: 816290 - RNA, 14 nt, Mycobacterium avium subsp. paratuberculosis
ccgcauccgccggg

SEQ ID NO: 816291 - RNA, 14 nt, Mycobacterium avium subsp. paratuberculosis
ccgcauccgcgagc

SEQ ID NO: 816292 - RNA, 19 nt, Mycobacterium avium subsp. paratuberculosis
ccgcaucccccucggcggg

SEQ ID NO: 816293 - RNA, 22 nt, Mycobacterium avium subsp. paratuberculosis
ccgcaucaccuucugcgcgccg

SEQ ID NO: 816294 - RNA, 13 nt, Mycobacterium avium subsp. paratuberculosis
ccgcauccagcgc

SEQ ID NO: 816295 - RNA, 16 nt, Mycobacterium avium subsp. paratuberculosis
ccgcauccagcgccgc

SEQ ID NO: 816296 - RNA, 17 nt, Mycobacterium avium subsp. paratuberculosis
ccgcaucgaaccgccgc

SEQ ID NO: 816297 - RNA, 18 nt, Mycobacterium avium subsp. paratuberculosis
ccgcaucgaaccgccgcg

SEQ ID NO: 816298 - RNA, 17 nt, Mycobacterium avium subsp. paratuberculosis
ccgcaucgaauccacga

SEQ ID NO: 816299 - RNA, 16 nt, Mycobacterium avium subsp. paratuberculosis
ccgcaucgccgaaccg

SEQ ID NO: 816300 - RNA, 21 nt, Mycobacterium avium subsp. paratuberculosis
ccgcaucgccgagggcgacga

SEQ ID NO: 816301 - RNA, 14 nt, Mycobacterium avium subsp. paratuberculosis
ccgcaucgcggcga

SEQ ID NO: 816302 - RNA, 16 nt, Mycobacterium avium subsp. paratuberculosis
ccgcaucgcggcgaug

SEQ ID NO: 816303 - RNA, 17 nt, Mycobacterium avium subsp. paratuberculosis
ccgcaucgcggcgaugg

SEQ ID NO: 816304 - RNA, 15 nt, Mycobacterium avium subsp. paratuberculosis
ccgcaggaucgagcc

SEQ ID NO: 816305 - RNA, 17 nt, Mycobacterium avium subsp. paratuberculosis
ccgcaggaucgagccgg

SEQ ID NO: 816306 - RNA, 18 nt, Mycobacterium avium subsp. paratuberculosis
ccgcaggaucgagccggc

SEQ ID NO: 816307 - RNA, 20 nt, Mycobacterium avium subsp. paratuberculosis
ccgcaggaucgagccggccg

SEQ ID NO: 816308 - RNA, 21 nt, Mycobacterium avium subsp. paratuberculosis
ccgcaggaucgagccggccgu

SEQ ID NO: 816309 - RNA, 13 nt, Mycobacterium avium subsp. paratuberculosis
ccgcagcucguug

SEQ ID NO: 816310 - RNA, 18 nt, Mycobacterium avium subsp. paratuberculosis
ccgcagcugcugcggccg

SEQ ID NO: 816311 - RNA, 20 nt, Mycobacterium avium subsp. paratuberculosis
ccgcagcugcugcggccgga

SEQ ID NO: 816312 - RNA, 20 nt, Mycobacterium avium subsp. paratuberculosis
ccgcagcucccccggcguga

SEQ ID NO: 816313 - RNA, 13 nt, Mycobacterium avium subsp. paratuberculosis
ccgcagcucgauc

SEQ ID NO: 816314 - RNA, 16 nt, Mycobacterium avium subsp. paratuberculosis
ccgcagcucgaucacc

SEQ ID NO: 816315 - RNA, 19 nt, Mycobacterium avium subsp. paratuberculosis
ccgcagcucgcccagcacc

SEQ ID NO: 816316 - RNA, 14 nt, Mycobacterium avium subsp. paratuberculosis
ccgcagcucgccga

SEQ ID NO: 816317 - RNA, 15 nt, Mycobacterium avium subsp. paratuberculosis
ccgcagcucgccggu

SEQ ID NO: 816318 - RNA, 16 nt, Mycobacterium avium subsp. paratuberculosis
ccgcagcucgccggug

SEQ ID NO: 816319 - RNA, 17 nt, Mycobacterium avium subsp. paratuberculosis
ccgcagcuucugcagcu

SEQ ID NO: 816320 - RNA, 15 nt, Mycobacterium avium subsp. paratuberculosis
ccgcaggcggccagc

SEQ ID NO: 816321 - RNA, 18 nt, Mycobacterium avium subsp. paratuberculosis
ccgcaggcggccagcacc

SEQ ID NO: 816322 - RNA, 22 nt, Mycobacterium avium subsp. paratuberculosis
ccgcaggcgaaggucagaucgu

SEQ ID NO: 816323 - RNA, 17 nt, Mycobacterium avium subsp. paratuberculosis
ccgcacggugcagcagc

SEQ ID NO: 816324 - RNA, 14 nt, Mycobacterium avium subsp. paratuberculosis
ccgcaggccgucgc

SEQ ID NO: 816325 - RNA, 20 nt, Mycobacterium avium subsp. paratuberculosis
ccgcaggaugccgaugucgg

SEQ ID NO: 816326 - RNA, 12 nt, Mycobacterium avium subsp. paratuberculosis
ccgcaggccgcg

SEQ ID NO: 816327 - RNA, 13 nt, Mycobacterium avium subsp. paratuberculosis
ccgcaggccgcga

SEQ ID NO: 816328 - RNA, 15 nt, Mycobacterium avium subsp. paratuberculosis
ccgcaggccgcgagc

SEQ ID NO: 816329 - RNA, 13 nt, Mycobacterium avium subsp. paratuberculosis
ccgcacgcccggg

SEQ ID NO: 816330 - RNA, 12 nt, Mycobacterium avium subsp. paratuberculosis
ccgcacgccagc

SEQ ID NO: 816331 - RNA, 15 nt, Mycobacterium avium subsp. paratuberculosis
ccgcacgcccacagc

SEQ ID NO: 816332 - RNA, 16 nt, Mycobacterium avium subsp. paratuberculosis
ccgcacgccggguugg

SEQ ID NO: 816333 - RNA, 23 nt, Mycobacterium avium subsp. paratuberculosis
ccgcaccaccacguugcacggca

SEQ ID NO: 816334 - RNA, 15 nt, Mycobacterium avium subsp. paratuberculosis
ccgcacccagcgggc

SEQ ID NO: 816335 - RNA, 18 nt, Mycobacterium avium subsp. paratuberculosis
ccgcacccagcgggcgac

SEQ ID NO: 816336 - RNA, 23 nt, Mycobacterium avium subsp. paratuberculosis
ccgcacccagcgggcgacgucgg

SEQ ID NO: 816337 - RNA, 16 nt, Mycobacterium avium subsp. paratuberculosis
ccgcacggucgcggug

SEQ ID NO: 816338 - RNA, 20 nt, Mycobacterium avium subsp. paratuberculosis
ccgcacggucgcggugucgg

SEQ ID NO: 816339 - RNA, 19 nt, Mycobacterium avium subsp. paratuberculosis
ccgcacguagacggugucg

SEQ ID NO: 816340 - RNA, 17 nt, Mycobacterium avium subsp. paratuberculosis
ccgcacguauccgcggu

SEQ ID NO: 816341 - RNA, 17 nt, Mycobacterium avium subsp. paratuberculosis
ccgcacgucccgcccgg

SEQ ID NO: 816342 - RNA, 20 nt, Mycobacterium avium subsp. paratuberculosis
ccgcacgucccgcccggcgc

SEQ ID NO: 816343 - RNA, 23 nt, Mycobacterium avium subsp. paratuberculosis
ccgcacgucccgcccggcgccgg

SEQ ID NO: 816344 - RNA, 15 nt, Mycobacterium avium subsp. paratuberculosis
ccgcacgugcgcgcc

SEQ ID NO: 816345 - RNA, 18 nt, Mycobacterium avium subsp. paratuberculosis
ccgcacggcccaucacca

SEQ ID NO: 816346 - RNA, 12 nt, Mycobacterium avium subsp. paratuberculosis
ccgcacggccgc

SEQ ID NO: 816347 - RNA, 14 nt, Mycobacterium avium subsp. paratuberculosis
ccgcacggccgcca

SEQ ID NO: 816348 - RNA, 20 nt, Mycobacterium avium subsp. paratuberculosis
ccgcaccccacccgcgcgac

SEQ ID NO: 816349 - RNA, 13 nt, Mycobacterium avium subsp. paratuberculosis
ccgcacgcgaccg

SEQ ID NO: 816350 - RNA, 14 nt, Mycobacterium avium subsp. paratuberculosis
ccgcacgcgaccgc

SEQ ID NO: 816351 - RNA, 16 nt, Mycobacterium avium subsp. paratuberculosis
ccgccagcgcccgcgc

SEQ ID NO: 816352 - RNA, 14 nt, Mycobacterium avium subsp. paratuberculosis
ccgccagcccgaaa

SEQ ID NO: 816353 - RNA, 12 nt, Mycobacterium avium subsp. paratuberculosis
ccgccagccgcg

SEQ ID NO: 816354 - RNA, 15 nt, Mycobacterium avium subsp. paratuberculosis
ccgccagcgcggcga

SEQ ID NO: 816355 - RNA, 17 nt, Mycobacterium avium subsp. paratuberculosis
ccgccagcgcggcgauc

SEQ ID NO: 816356 - RNA, 22 nt, Mycobacterium avium subsp. paratuberculosis
ccgccagcgcggcgaucagcag

SEQ ID NO: 816357 - RNA, 14 nt, Mycobacterium avium subsp. paratuberculosis
ccgccagcgcgccg

SEQ ID NO: 816358 - RNA, 15 nt, Mycobacterium avium subsp. paratuberculosis
ccgccagcgcaccga

SEQ ID NO: 816359 - RNA, 19 nt, Mycobacterium avium subsp. paratuberculosis
ccgccagcgcgccgaucgc

SEQ ID NO: 816360 - RNA, 19 nt, Mycobacterium avium subsp. paratuberculosis
ccgccagcccgcgucgugu

SEQ ID NO: 816361 - RNA, 22 nt, Mycobacterium avium subsp. paratuberculosis
ccgccagcaccaccgucaccgc

SEQ ID NO: 816362 - RNA, 12 nt, Mycobacterium avium subsp. paratuberculosis
ccgccagcaccg

SEQ ID NO: 816363 - RNA, 16 nt, Mycobacterium avium subsp. paratuberculosis
ccgccagcaccgacag

SEQ ID NO: 816364 - RNA, 18 nt, Mycobacterium avium subsp. paratuberculosis
ccgccagccagccggugc

SEQ ID NO: 816365 - RNA, 16 nt, Mycobacterium avium subsp. paratuberculosis
ccgccagggcgcggcg

SEQ ID NO: 816366 - RNA, 21 nt, Mycobacterium avium subsp. paratuberculosis
ccgccagggcgcggcgcaccg

SEQ ID NO: 816367 - RNA, 22 nt, Mycobacterium avium subsp. paratuberculosis
ccgccaggaugucguccucggu

SEQ ID NO: 816368 - RNA, 16 nt, Mycobacterium avium subsp. paratuberculosis
ccgccaucaccgcgcu

SEQ ID NO: 816369 - RNA, 17 nt, Mycobacterium avium subsp. paratuberculosis
ccgccaucaccgcgcuu

SEQ ID NO: 816370 - RNA, 15 nt, Mycobacterium avium subsp. paratuberculosis
ccgccaggaaggcca

SEQ ID NO: 816371 - RNA, 23 nt, Mycobacterium avium subsp. paratuberculosis
ccgccaggaagacguaggcggcc

SEQ ID NO: 816372 - RNA, 19 nt, Mycobacterium avium subsp. paratuberculosis
ccgccagcgcggcggcgcc

SEQ ID NO: 816373 - RNA, 22 nt, Mycobacterium avium subsp. paratuberculosis
ccgccacucauguucagggugc

SEQ ID NO: 816374 - RNA, 20 nt, Mycobacterium avium subsp. paratuberculosis
ccgccagauagggcagcguc

SEQ ID NO: 816375 - RNA, 17 nt, Mycobacterium avium subsp. paratuberculosis
ccgccagaucgccauca

SEQ ID NO: 816376 - RNA, 20 nt, Mycobacterium avium subsp. paratuberculosis
ccgccagaucgccuggcagc

SEQ ID NO: 816377 - RNA, 13 nt, Mycobacterium avium subsp. paratuberculosis
ccgccacgacgcg

SEQ ID NO: 816378 - RNA, 14 nt, Mycobacterium avium subsp. paratuberculosis
ccgccacgacgcgg

SEQ ID NO: 816379 - RNA, 12 nt, Mycobacterium avium subsp. paratuberculosis
ccgccaccgcgc

SEQ ID NO: 816380 - RNA, 22 nt, Mycobacterium avium subsp. paratuberculosis
ccgccaccgcgcaaccgggccg

SEQ ID NO: 816381 - RNA, 14 nt, Mycobacterium avium subsp. paratuberculosis
ccgccaccgcgaaa

SEQ ID NO: 816382 - RNA, 22 nt, Mycobacterium avium subsp. paratuberculosis
ccgccaccgcgaaagcgucggc

SEQ ID NO: 816383 - RNA, 13 nt, Mycobacterium avium subsp. paratuberculosis
ccgccaccggccg

SEQ ID NO: 816384 - RNA, 14 nt, Mycobacterium avium subsp. paratuberculosis
ccgccaccggccgg

SEQ ID NO: 816385 - RNA, 12 nt, Mycobacterium avium subsp. paratuberculosis
ccgcauggccgg

SEQ ID NO: 816386 - RNA, 19 nt, Mycobacterium avium subsp. paratuberculosis
ccgcauguucucgagcccg

SEQ ID NO: 816387 - RNA, 21 nt, Mycobacterium avium subsp. paratuberculosis
ccgcauguucucgagcccgau

SEQ ID NO: 816388 - RNA, 15 nt, Mycobacterium avium subsp. paratuberculosis
ccgcauucggccgcc

SEQ ID NO: 816389 - RNA, 14 nt, Mycobacterium avium subsp. paratuberculosis
ccgcauucggugag

SEQ ID NO: 816390 - RNA, 16 nt, Mycobacterium avium subsp. paratuberculosis
ccgcauguccggggug

SEQ ID NO: 816391 - RNA, 17 nt, Mycobacterium avium subsp. paratuberculosis
ccgcaugucgaagaagu

SEQ ID NO: 816392 - RNA, 12 nt, Mycobacterium avium subsp. paratuberculosis
ccgcaugucgac

SEQ ID NO: 816393 - RNA, 19 nt, Mycobacterium avium subsp. paratuberculosis
ccgccaccccaggcgaugc

SEQ ID NO: 816394 - RNA, 15 nt, Mycobacterium avium subsp. paratuberculosis
ccgccaccgcccgcu

SEQ ID NO: 816395 - RNA, 16 nt, Mycobacterium avium subsp. paratuberculosis
ccgccaccgcccgcug

SEQ ID NO: 816396 - RNA, 16 nt, Mycobacterium avium subsp. paratuberculosis
ccgccacccgaggccg

SEQ ID NO: 816397 - RNA, 13 nt, Mycobacterium avium subsp. paratuberculosis
ccgccacccgcug

SEQ ID NO: 816398 - RNA, 17 nt, Mycobacterium avium subsp. paratuberculosis
ccgccaaaacggggugg

SEQ ID NO: 816399 - RNA, 14 nt, Mycobacterium avium subsp. paratuberculosis
ccgcaaucggcgcc

SEQ ID NO: 816400 - RNA, 18 nt, Mycobacterium avium subsp. paratuberculosis
ccgcaacgcugaccgcag

SEQ ID NO: 816401 - RNA, 13 nt, Mycobacterium avium subsp. paratuberculosis
ccgcaaccgucag

SEQ ID NO: 816402 - RNA, 19 nt, Mycobacterium avium subsp. paratuberculosis
ccgcaaccuucuuggccgg

SEQ ID NO: 816403 - RNA, 13 nt, Mycobacterium avium subsp. paratuberculosis
ccgcaacgcgcgc

SEQ ID NO: 816404 - RNA, 16 nt, Mycobacterium avium subsp. paratuberculosis
ccgcaacgccggcgug

SEQ ID NO: 816405 - RNA, 17 nt, Mycobacterium avium subsp. paratuberculosis
ccgcaacgccggcgugc

SEQ ID NO: 816406 - RNA, 20 nt, Mycobacterium avium subsp. paratuberculosis
ccgcaaccaaaaagcuagcg

SEQ ID NO: 816407 - RNA, 20 nt, Mycobacterium avium subsp. paratuberculosis
ccgcaaccacuuucgcgagc

SEQ ID NO: 816408 - RNA, 14 nt, Mycobacterium avium subsp. paratuberculosis
ccgcaaccgccggc

SEQ ID NO: 816409 - RNA, 16 nt, Mycobacterium avium subsp. paratuberculosis
ccgcaaccgccggcag

SEQ ID NO: 816410 - RNA, 17 nt, Mycobacterium avium subsp. paratuberculosis
ccgcaaccgccggcagc

SEQ ID NO: 816411 - RNA, 19 nt, Mycobacterium avium subsp. paratuberculosis
ccgcaaccgccggcagcgg

SEQ ID NO: 816412 - RNA, 15 nt, Mycobacterium avium subsp. paratuberculosis
ccgcaacaccacguc

SEQ ID NO: 816413 - RNA, 15 nt, Mycobacterium avium subsp. paratuberculosis
ccgcaacaccagcac

SEQ ID NO: 816414 - RNA, 12 nt, Mycobacterium avium subsp. paratuberculosis
ccgcaacacggc

SEQ ID NO: 816415 - RNA, 14 nt, Mycobacterium avium subsp. paratuberculosis
ccgcaacagccggc

SEQ ID NO: 816416 - RNA, 21 nt, Mycobacterium avium subsp. paratuberculosis
ccgcaacagccggcccgagcc

SEQ ID NO: 816417 - RNA, 15 nt, Mycobacterium avium subsp. paratuberculosis
ccgcacagccggcgg

SEQ ID NO: 816418 - RNA, 16 nt, Mycobacterium avium subsp. paratuberculosis
ccgcacagccggcggc

SEQ ID NO: 816419 - RNA, 18 nt, Mycobacterium avium subsp. paratuberculosis
ccgcacagccggcggcgg

SEQ ID NO: 816420 - RNA, 16 nt, Mycobacterium avium subsp. paratuberculosis
ccgcaauugcgccagc

SEQ ID NO: 816421 - RNA, 16 nt, Mycobacterium avium subsp. paratuberculosis
ccgcacaccgcgcaga

SEQ ID NO: 816422 - RNA, 13 nt, Mycobacterium avium subsp. paratuberculosis
ccgcacaccgcgg

SEQ ID NO: 816423 - RNA, 14 nt, Mycobacterium avium subsp. paratuberculosis
ccgcacaccgcggc

SEQ ID NO: 816424 - RNA, 17 nt, Mycobacterium avium subsp. paratuberculosis
ccgcacaccgcggcggc

SEQ ID NO: 816425 - RNA, 14 nt, Mycobacterium avium subsp. paratuberculosis
ccgcacaccggcca

SEQ ID NO: 816426 - RNA, 14 nt, Mycobacterium avium subsp. paratuberculosis
ccgcacaccgucuc

SEQ ID NO: 816427 - RNA, 15 nt, Mycobacterium avium subsp. paratuberculosis
ccgcaccacccagcc

SEQ ID NO: 816428 - RNA, 12 nt, Mycobacterium avium subsp. paratuberculosis
ccgcaccagauc

SEQ ID NO: 816429 - RNA, 16 nt, Mycobacterium avium subsp. paratuberculosis
ccgcaccagcaccccg

SEQ ID NO: 816430 - RNA, 18 nt, Mycobacterium avium subsp. paratuberculosis
ccgcaccaccgcccggac

SEQ ID NO: 816431 - RNA, 17 nt, Mycobacterium avium subsp. paratuberculosis
ccgaugaugguggcggc

SEQ ID NO: 816432 - RNA, 16 nt, Mycobacterium avium subsp. paratuberculosis
ccgaugucggcgaaca

SEQ ID NO: 816433 - RNA, 21 nt, Mycobacterium avium subsp. paratuberculosis
ccgaugucggcgaacaccugc

SEQ ID NO: 816434 - RNA, 13 nt, Mycobacterium avium subsp. paratuberculosis
ccgaugucggcgu

SEQ ID NO: 816435 - RNA, 22 nt, Mycobacterium avium subsp. paratuberculosis
ccgaugaugaaaccggccagca

SEQ ID NO: 816436 - RNA, 15 nt, Mycobacterium avium subsp. paratuberculosis
ccgaugaugaugccg

SEQ ID NO: 816437 - RNA, 14 nt, Mycobacterium avium subsp. paratuberculosis
ccgaugaaguaccc

SEQ ID NO: 816438 - RNA, 18 nt, Mycobacterium avium subsp. paratuberculosis
ccgaugaaguacccgguc

SEQ ID NO: 816439 - RNA, 15 nt, Mycobacterium avium subsp. paratuberculosis
ccgaugacgcugccg

SEQ ID NO: 816440 - RNA, 14 nt, Mycobacterium avium subsp. paratuberculosis
ccgaugucgucgaa

SEQ ID NO: 816441 - RNA, 22 nt, Mycobacterium avium subsp. paratuberculosis
ccgaugucgucgaacgcggcga

SEQ ID NO: 816442 - RNA, 13 nt, Mycobacterium avium subsp. paratuberculosis
ccgauguggccgg

SEQ ID NO: 816443 - RNA, 17 nt, Mycobacterium avium subsp. paratuberculosis
ccgauucaaccccgcgc

SEQ ID NO: 816444 - RNA, 23 nt, Mycobacterium avium subsp. paratuberculosis
ccgauucaaccccgcgcgcgggc

SEQ ID NO: 816445 - RNA, 15 nt, Mycobacterium avium subsp. paratuberculosis
ccgauguucaccccg

SEQ ID NO: 816446 - RNA, 16 nt, Mycobacterium avium subsp. paratuberculosis
ccgauguucaccccga

SEQ ID NO: 816447 - RNA, 16 nt, Mycobacterium avium subsp. paratuberculosis
ccgauuccauccggga

SEQ ID NO: 816448 - RNA, 17 nt, Mycobacterium avium subsp. paratuberculosis
ccgauuccccggcgugu

SEQ ID NO: 816449 - RNA, 15 nt, Mycobacterium avium subsp. paratuberculosis
ccgauuccggccggc

SEQ ID NO: 816450 - RNA, 15 nt, Mycobacterium avium subsp. paratuberculosis
ccgaugaccaccgcu

SEQ ID NO: 816451 - RNA, 16 nt, Mycobacterium avium subsp. paratuberculosis
ccgaugaccaccgcug

SEQ ID NO: 816452 - RNA, 13 nt, Mycobacterium avium subsp. paratuberculosis
ccgaugaccggcc

SEQ ID NO: 816453 - RNA, 22 nt, Mycobacterium avium subsp. paratuberculosis
ccgaugaccggcccggcggccg

SEQ ID NO: 816454 - RNA, 15 nt, Mycobacterium avium subsp. paratuberculosis
ccgaugacgagcagc

SEQ ID NO: 816455 - RNA, 21 nt, Mycobacterium avium subsp. paratuberculosis
ccgaugaacuugccgaucacc

SEQ ID NO: 816456 - RNA, 19 nt, Mycobacterium avium subsp. paratuberculosis
ccgaugaagaacaccccga

SEQ ID NO: 816457 - RNA, 23 nt, Mycobacterium avium subsp. paratuberculosis
ccgaugaagaacaccccgaccga

SEQ ID NO: 816458 - RNA, 18 nt, Mycobacterium avium subsp. paratuberculosis
ccgaucugaccgagcagc

SEQ ID NO: 816459 - RNA, 18 nt, Mycobacterium avium subsp. paratuberculosis
ccgaucugauaggucagc

SEQ ID NO: 816460 - RNA, 19 nt, Mycobacterium avium subsp. paratuberculosis
ccgaucugcucgaugcggc

SEQ ID NO: 816461 - RNA, 14 nt, Mycobacterium avium subsp. paratuberculosis
ccgaucugucgcgc

SEQ ID NO: 816462 - RNA, 15 nt, Mycobacterium avium subsp. paratuberculosis
ccgaucugucgcgcu

SEQ ID NO: 816463 - RNA, 12 nt, Mycobacterium avium subsp. paratuberculosis
ccgaucuggcgc

SEQ ID NO: 816464 - RNA, 22 nt, Mycobacterium avium subsp. paratuberculosis
ccgaucgugaauucggccgggu

SEQ ID NO: 816465 - RNA, 23 nt, Mycobacterium avium subsp. paratuberculosis
ccgaucuccaccgagugcggcgc

SEQ ID NO: 816466 - RNA, 17 nt, Mycobacterium avium subsp. paratuberculosis
ccgaucguccggcgcca

SEQ ID NO: 816467 - RNA, 19 nt, Mycobacterium avium subsp. paratuberculosis
ccgaucgggaccgucaccg

SEQ ID NO: 816468 - RNA, 23 nt, Mycobacterium avium subsp. paratuberculosis
ccgaucggggcgcagcccggcgg

SEQ ID NO: 816469 - RNA, 13 nt, Mycobacterium avium subsp. paratuberculosis
ccgaucggcccgg

SEQ ID NO: 816470 - RNA, 17 nt, Mycobacterium avium subsp. paratuberculosis
ccgaucggcccggccaa

SEQ ID NO: 816471 - RNA, 17 nt, Mycobacterium avium subsp. paratuberculosis
ccgauccgcgggccggc

SEQ ID NO: 816472 - RNA, 13 nt, Mycobacterium avium subsp. paratuberculosis
ccgauccgcgggu

SEQ ID NO: 816473 - RNA, 14 nt, Mycobacterium avium subsp. paratuberculosis
ccgaucccgggccg

SEQ ID NO: 816474 - RNA, 13 nt, Mycobacterium avium subsp. paratuberculosis
ccgauccggcgcc

SEQ ID NO: 816475 - RNA, 14 nt, Mycobacterium avium subsp. paratuberculosis
ccgauccggcgccc

SEQ ID NO: 816476 - RNA, 15 nt, Mycobacterium avium subsp. paratuberculosis
ccgauccggcgccgc

SEQ ID NO: 816477 - RNA, 21 nt, Mycobacterium avium subsp. paratuberculosis
ccgauccggcgccgcgggcgc

SEQ ID NO: 816478 - RNA, 22 nt, Mycobacterium avium subsp. paratuberculosis
ccgauccggcgccgcgggcgcc

SEQ ID NO: 816479 - RNA, 14 nt, Mycobacterium avium subsp. paratuberculosis
ccgauccgggcggc

SEQ ID NO: 816480 - RNA, 17 nt, Mycobacterium avium subsp. paratuberculosis
ccgaucgcgucgacgau

SEQ ID NO: 816481 - RNA, 14 nt, Mycobacterium avium subsp. paratuberculosis
ccgaucgcggcccc

SEQ ID NO: 816482 - RNA, 18 nt, Mycobacterium avium subsp. paratuberculosis
ccgaucgcggcgaucagc

SEQ ID NO: 816483 - RNA, 19 nt, Mycobacterium avium subsp. paratuberculosis
ccgaucgcggcgaucagcc

SEQ ID NO: 816484 - RNA, 17 nt, Mycobacterium avium subsp. paratuberculosis
ccgaucgcgaucaccgc

SEQ ID NO: 816485 - RNA, 16 nt, Mycobacterium avium subsp. paratuberculosis
ccgaucggcacgucga

SEQ ID NO: 816486 - RNA, 15 nt, Mycobacterium avium subsp. paratuberculosis
ccgaucgaucagccg

SEQ ID NO: 816487 - RNA, 20 nt, Mycobacterium avium subsp. paratuberculosis
ccgaucgcccgguaggccgc

SEQ ID NO: 816488 - RNA, 21 nt, Mycobacterium avium subsp. paratuberculosis
ccgaucgcccgguaggccgcc

SEQ ID NO: 816489 - RNA, 12 nt, Mycobacterium avium subsp. paratuberculosis
ccgaucgccgcg

SEQ ID NO: 816490 - RNA, 14 nt, Mycobacterium avium subsp. paratuberculosis
ccgaucgccgcggc

SEQ ID NO: 816491 - RNA, 16 nt, Mycobacterium avium subsp. paratuberculosis
ccgaucgccgcggcga

SEQ ID NO: 816492 - RNA, 17 nt, Mycobacterium avium subsp. paratuberculosis
ccgaucgccgcggcgau

SEQ ID NO: 816493 - RNA, 20 nt, Mycobacterium avium subsp. paratuberculosis
ccgaucgccuccgucagcgc

SEQ ID NO: 816494 - RNA, 16 nt, Mycobacterium avium subsp. paratuberculosis
ccgauccagggcccgc

SEQ ID NO: 816495 - RNA, 19 nt, Mycobacterium avium subsp. paratuberculosis
ccgaucccgaugcggacgc

SEQ ID NO: 816496 - RNA, 14 nt, Mycobacterium avium subsp. paratuberculosis
ccgaucccggccag

SEQ ID NO: 816497 - RNA, 16 nt, Mycobacterium avium subsp. paratuberculosis
ccgaucccgucgucgg

SEQ ID NO: 816498 - RNA, 17 nt, Mycobacterium avium subsp. paratuberculosis
ccgauccgcaccggacg

SEQ ID NO: 816499 - RNA, 18 nt, Mycobacterium avium subsp. paratuberculosis
ccgauccgcaccggacgc

SEQ ID NO: 816500 - RNA, 14 nt, Mycobacterium avium subsp. paratuberculosis
ccgauccgccggcg

SEQ ID NO: 816501 - RNA, 16 nt, Mycobacterium avium subsp. paratuberculosis
ccgauccgccggcgaa

SEQ ID NO: 816502 - RNA, 22 nt, Mycobacterium avium subsp. paratuberculosis
ccgauccgccguugcggcccac

SEQ ID NO: 816503 - RNA, 18 nt, Mycobacterium avium subsp. paratuberculosis
ccgaucaucucaccgacg

SEQ ID NO: 816504 - RNA, 20 nt, Mycobacterium avium subsp. paratuberculosis
ccgaucaucucaccgacgac

SEQ ID NO: 816505 - RNA, 19 nt, Mycobacterium avium subsp. paratuberculosis
ccgaucauggucggcgacg

SEQ ID NO: 816506 - RNA, 21 nt, Mycobacterium avium subsp. paratuberculosis
ccgaucauggucggcgacgcc

SEQ ID NO: 816507 - RNA, 22 nt, Mycobacterium avium subsp. paratuberculosis
ccgaucauggucggcgacgccg

SEQ ID NO: 816508 - RNA, 23 nt, Mycobacterium avium subsp. paratuberculosis
ccgaucauggucggcgacgccgu

SEQ ID NO: 816509 - RNA, 14 nt, Mycobacterium avium subsp. paratuberculosis
ccgauccacggcga

SEQ ID NO: 816510 - RNA, 19 nt, Mycobacterium avium subsp. paratuberculosis
ccgauccacggcgaccccg

SEQ ID NO: 816511 - RNA, 14 nt, Mycobacterium avium subsp. paratuberculosis
ccgaucagugccgc

SEQ ID NO: 816512 - RNA, 15 nt, Mycobacterium avium subsp. paratuberculosis
ccgaucagugccgcg

SEQ ID NO: 816513 - RNA, 17 nt, Mycobacterium avium subsp. paratuberculosis
ccgaucagugccgcgcc

SEQ ID NO: 816514 - RNA, 16 nt, Mycobacterium avium subsp. paratuberculosis
ccgaucagcggcgggc

SEQ ID NO: 816515 - RNA, 18 nt, Mycobacterium avium subsp. paratuberculosis
ccgaucagcggcgggccc

SEQ ID NO: 816516 - RNA, 14 nt, Mycobacterium avium subsp. paratuberculosis
ccgaucacgccggu

SEQ ID NO: 816517 - RNA, 13 nt, Mycobacterium avium subsp. paratuberculosis
ccgaucaccuugc

SEQ ID NO: 816518 - RNA, 19 nt, Mycobacterium avium subsp. paratuberculosis
ccgaucacggugaucgccg

SEQ ID NO: 816519 - RNA, 16 nt, Mycobacterium avium subsp. paratuberculosis
ccgaucagcagcaccu

SEQ ID NO: 816520 - RNA, 17 nt, Mycobacterium avium subsp. paratuberculosis
ccgaucagcaugccggu

SEQ ID NO: 816521 - RNA, 19 nt, Mycobacterium avium subsp. paratuberculosis
ccgaucagcaugccgguca

SEQ ID NO: 816522 - RNA, 11 nt, Mycobacterium avium subsp. paratuberculosis
ccgaucagccg

SEQ ID NO: 816523 - RNA, 16 nt, Mycobacterium avium subsp. paratuberculosis
ccgaucacgcggaucg

SEQ ID NO: 816524 - RNA, 13 nt, Mycobacterium avium subsp. paratuberculosis
ccgaucaccgccg

SEQ ID NO: 816525 - RNA, 13 nt, Mycobacterium avium subsp. paratuberculosis
ccgaucaccgcgu

SEQ ID NO: 816526 - RNA, 14 nt, Mycobacterium avium subsp. paratuberculosis
ccgaucaccgcguu

SEQ ID NO: 816527 - RNA, 16 nt, Mycobacterium avium subsp. paratuberculosis
ccgaucaccgcguugu

SEQ ID NO: 816528 - RNA, 23 nt, Mycobacterium avium subsp. paratuberculosis
ccgaucaccgcguugucggcgac

SEQ ID NO: 816529 - RNA, 12 nt, Mycobacterium avium subsp. paratuberculosis
ccgaucaccggc

SEQ ID NO: 816530 - RNA, 19 nt, Mycobacterium avium subsp. paratuberculosis
ccgaucaccggcacgugcg

SEQ ID NO: 816531 - RNA, 23 nt, Mycobacterium avium subsp. paratuberculosis
ccgaucaccggcacgugcggguu

SEQ ID NO: 816532 - RNA, 22 nt, Mycobacterium avium subsp. paratuberculosis
ccgaucaccggcagcagcgcgu

SEQ ID NO: 816533 - RNA, 18 nt, Mycobacterium avium subsp. paratuberculosis
ccgaucaccggcgcguug

SEQ ID NO: 816534 - RNA, 23 nt, Mycobacterium avium subsp. paratuberculosis
ccgaucaccgugaguucgcugac

SEQ ID NO: 816535 - RNA, 23 nt, Mycobacterium avium subsp. paratuberculosis
ccgaucaccugacagacccgauc

SEQ ID NO: 816536 - RNA, 12 nt, Mycobacterium avium subsp. paratuberculosis
ccgaucaccgcc

SEQ ID NO: 816537 - RNA, 20 nt, Mycobacterium avium subsp. paratuberculosis
ccgaucaccaggcccaggcc

SEQ ID NO: 816538 - RNA, 17 nt, Mycobacterium avium subsp. paratuberculosis
ccgaucacccccgacac

SEQ ID NO: 816539 - RNA, 19 nt, Mycobacterium avium subsp. paratuberculosis
ccgaucacccccgacaccg

SEQ ID NO: 816540 - RNA, 22 nt, Mycobacterium avium subsp. paratuberculosis
ccgaucacccccgacaccgugg

SEQ ID NO: 816541 - RNA, 22 nt, Mycobacterium avium subsp. paratuberculosis
ccgaucaacaccgccagcaccg

SEQ ID NO: 816542 - RNA, 20 nt, Mycobacterium avium subsp. paratuberculosis
ccgaucaacaggcccagcag

SEQ ID NO: 816543 - RNA, 23 nt, Mycobacterium avium subsp. paratuberculosis
ccgaucaacaggcccagcagcgc

SEQ ID NO: 816544 - RNA, 19 nt, Mycobacterium avium subsp. paratuberculosis
ccgauagccccgccaggcg

SEQ ID NO: 816545 - RNA, 16 nt, Mycobacterium avium subsp. paratuberculosis
ccgauaguagccagca

SEQ ID NO: 816546 - RNA, 22 nt, Mycobacterium avium subsp. paratuberculosis
ccgauagcuugagccccgccgg

SEQ ID NO: 816547 - RNA, 22 nt, Mycobacterium avium subsp. paratuberculosis
ccgcggauggccucggcgaugc

SEQ ID NO: 816548 - RNA, 22 nt, Mycobacterium avium subsp. paratuberculosis
ccgcggauggugacggccguga

SEQ ID NO: 816549 - RNA, 18 nt, Mycobacterium avium subsp. paratuberculosis
ccgcggauguggaggcga

SEQ ID NO: 816550 - RNA, 21 nt, Mycobacterium avium subsp. paratuberculosis
ccgcggauguggaggcgagca

SEQ ID NO: 816551 - RNA, 22 nt, Mycobacterium avium subsp. paratuberculosis
ccgcggauguggaggcgagcaa

SEQ ID NO: 816552 - RNA, 20 nt, Mycobacterium avium subsp. paratuberculosis
ccgcggaugacgggugcuca

SEQ ID NO: 816553 - RNA, 22 nt, Mycobacterium avium subsp. paratuberculosis
ccgcggaucgguuucuccaccc

SEQ ID NO: 816554 - RNA, 23 nt, Mycobacterium avium subsp. paratuberculosis
ccgcggaugaccaggucgccggc

SEQ ID NO: 816555 - RNA, 13 nt, Mycobacterium avium subsp. paratuberculosis
ccgcggaugacgg

SEQ ID NO: 816556 - RNA, 14 nt, Mycobacterium avium subsp. paratuberculosis
ccgcggccagcgcc

SEQ ID NO: 816557 - RNA, 18 nt, Mycobacterium avium subsp. paratuberculosis
ccgcggccagcgccccgc

SEQ ID NO: 816558 - RNA, 19 nt, Mycobacterium avium subsp. paratuberculosis
ccgcggccagcucggucgc

SEQ ID NO: 816559 - RNA, 15 nt, Mycobacterium avium subsp. paratuberculosis
ccgcggccagcugcc

SEQ ID NO: 816560 - RNA, 18 nt, Mycobacterium avium subsp. paratuberculosis
ccgcggccagcugcccgc

SEQ ID NO: 816561 - RNA, 16 nt, Mycobacterium avium subsp. paratuberculosis
ccgcggccagcugcga

SEQ ID NO: 816562 - RNA, 16 nt, Mycobacterium avium subsp. paratuberculosis
ccgcggauuccagcgc

SEQ ID NO: 816563 - RNA, 17 nt, Mycobacterium avium subsp. paratuberculosis
ccgcggauuccagcgcg

SEQ ID NO: 816564 - RNA, 19 nt, Mycobacterium avium subsp. paratuberculosis
ccgcggauuccggcaucgg

SEQ ID NO: 816565 - RNA, 14 nt, Mycobacterium avium subsp. paratuberculosis
ccgcggcaaggcgu

SEQ ID NO: 816566 - RNA, 18 nt, Mycobacterium avium subsp. paratuberculosis
ccgcggaguaggcgccgc

SEQ ID NO: 816567 - RNA, 19 nt, Mycobacterium avium subsp. paratuberculosis
ccgcggaucagcaggaccg

SEQ ID NO: 816568 - RNA, 22 nt, Mycobacterium avium subsp. paratuberculosis
ccgcggaucagcaggaccggga

SEQ ID NO: 816569 - RNA, 12 nt, Mycobacterium avium subsp. paratuberculosis
ccgcggaggcga

SEQ ID NO: 816570 - RNA, 17 nt, Mycobacterium avium subsp. paratuberculosis
ccgcggaggcgagcagc

SEQ ID NO: 816571 - RNA, 15 nt, Mycobacterium avium subsp. paratuberculosis
ccgcgcucggccauc

SEQ ID NO: 816572 - RNA, 20 nt, Mycobacterium avium subsp. paratuberculosis
ccgcgcucggccauccgggc

SEQ ID NO: 816573 - RNA, 14 nt, Mycobacterium avium subsp. paratuberculosis
ccgcgcucgcacca

SEQ ID NO: 816574 - RNA, 19 nt, Mycobacterium avium subsp. paratuberculosis
ccgcgcucgcaccagcgcu

SEQ ID NO: 816575 - RNA, 12 nt, Mycobacterium avium subsp. paratuberculosis
ccgcgcucggcg

SEQ ID NO: 816576 - RNA, 14 nt, Mycobacterium avium subsp. paratuberculosis
ccgcgcucggcgac

SEQ ID NO: 816577 - RNA, 13 nt, Mycobacterium avium subsp. paratuberculosis
ccgcgcucgugcu

SEQ ID NO: 816578 - RNA, 13 nt, Mycobacterium avium subsp. paratuberculosis
ccgcggcgggguc

SEQ ID NO: 816579 - RNA, 15 nt, Mycobacterium avium subsp. paratuberculosis
ccgcggcgguagcgg

SEQ ID NO: 816580 - RNA, 11 nt, Mycobacterium avium subsp. paratuberculosis
ccgcggcgguc

SEQ ID NO: 816581 - RNA, 12 nt, Mycobacterium avium subsp. paratuberculosis
ccgcggcggcca

SEQ ID NO: 816582 - RNA, 23 nt, Mycobacterium avium subsp. paratuberculosis
ccgcggcggcgucgaccgccccg

SEQ ID NO: 816583 - RNA, 13 nt, Mycobacterium avium subsp. paratuberculosis
ccgcggcggcgug

SEQ ID NO: 816584 - RNA, 19 nt, Mycobacterium avium subsp. paratuberculosis
ccgcggcggcgugccgccc

SEQ ID NO: 816585 - RNA, 21 nt, Mycobacterium avium subsp. paratuberculosis
ccgcggcggcgugccgcccgg

SEQ ID NO: 816586 - RNA, 12 nt, Mycobacterium avium subsp. paratuberculosis
ccgcggcggcuc

SEQ ID NO: 816587 - RNA, 14 nt, Mycobacterium avium subsp. paratuberculosis
ccgcggcggcucgg

SEQ ID NO: 816588 - RNA, 18 nt, Mycobacterium avium subsp. paratuberculosis
ccgcggcggcucggcggc

SEQ ID NO: 816589 - RNA, 20 nt, Mycobacterium avium subsp. paratuberculosis
ccgcggcggcucggcggcgu

SEQ ID NO: 816590 - RNA, 22 nt, Mycobacterium avium subsp. paratuberculosis
ccgcggcggcucggcggcgucg

SEQ ID NO: 816591 - RNA, 23 nt, Mycobacterium avium subsp. paratuberculosis
ccgcggcggcucggcggcgucgu

SEQ ID NO: 816592 - RNA, 13 nt, Mycobacterium avium subsp. paratuberculosis
ccgcggcgggcag

SEQ ID NO: 816593 - RNA, 18 nt, Mycobacterium avium subsp. paratuberculosis
ccgcggcgggcgcgucga

SEQ ID NO: 816594 - RNA, 21 nt, Mycobacterium avium subsp. paratuberculosis
ccgcggcgggcgcgucgaggu

SEQ ID NO: 816595 - RNA, 13 nt, Mycobacterium avium subsp. paratuberculosis
ccgcggccgcggc

SEQ ID NO: 816596 - RNA, 15 nt, Mycobacterium avium subsp. paratuberculosis
ccgcggccgcggcgg

SEQ ID NO: 816597 - RNA, 18 nt, Mycobacterium avium subsp. paratuberculosis
ccgcggcggcacccaggu

SEQ ID NO: 816598 - RNA, 12 nt, Mycobacterium avium subsp. paratuberculosis
ccgcggcggcag

SEQ ID NO: 816599 - RNA, 13 nt, Mycobacterium avium subsp. paratuberculosis
ccgcggcggcagc

SEQ ID NO: 816600 - RNA, 14 nt, Mycobacterium avium subsp. paratuberculosis
ccgcggcggccugc

SEQ ID NO: 816601 - RNA, 11 nt, Mycobacterium avium subsp. paratuberculosis
ccgcggcggcg

SEQ ID NO: 816602 - RNA, 15 nt, Mycobacterium avium subsp. paratuberculosis
ccgcggcggcgccau

SEQ ID NO: 816603 - RNA, 15 nt, Mycobacterium avium subsp. paratuberculosis
ccgcggcggcgccga

SEQ ID NO: 816604 - RNA, 17 nt, Mycobacterium avium subsp. paratuberculosis
ccgcggcggcgccgacg

SEQ ID NO: 816605 - RNA, 18 nt, Mycobacterium avium subsp. paratuberculosis
ccgcggcggcgccgacgg

SEQ ID NO: 816606 - RNA, 12 nt, Mycobacterium avium subsp. paratuberculosis
ccgcggccgcgg

SEQ ID NO: 816607 - RNA, 16 nt, Mycobacterium avium subsp. paratuberculosis
ccgcggcccugcagcg

SEQ ID NO: 816608 - RNA, 18 nt, Mycobacterium avium subsp. paratuberculosis
ccgcggcccugcagcgcc

SEQ ID NO: 816609 - RNA, 13 nt, Mycobacterium avium subsp. paratuberculosis
ccgcggccgccuc

SEQ ID NO: 816610 - RNA, 22 nt, Mycobacterium avium subsp. paratuberculosis
ccgcggccgccucccgcagcgc

SEQ ID NO: 816611 - RNA, 21 nt, Mycobacterium avium subsp. paratuberculosis
ccgcggccgccuucacgaccg

SEQ ID NO: 816612 - RNA, 22 nt, Mycobacterium avium subsp. paratuberculosis
ccgcggccgccuucacgaccgg

SEQ ID NO: 816613 - RNA, 11 nt, Mycobacterium avium subsp. paratuberculosis
ccgcggccgcg

SEQ ID NO: 816614 - RNA, 14 nt, Mycobacterium avium subsp. paratuberculosis
ccgcggccgcgcgc

SEQ ID NO: 816615 - RNA, 15 nt, Mycobacterium avium subsp. paratuberculosis
ccgcggccgcgcgcc

SEQ ID NO: 816616 - RNA, 12 nt, Mycobacterium avium subsp. paratuberculosis
ccgcggccgccg

SEQ ID NO: 816617 - RNA, 17 nt, Mycobacterium avium subsp. paratuberculosis
ccgcggccgccgccgcg

SEQ ID NO: 816618 - RNA, 18 nt, Mycobacterium avium subsp. paratuberculosis
ccgcggccgccgccgcgg

SEQ ID NO: 816619 - RNA, 15 nt, Mycobacterium avium subsp. paratuberculosis
ccgcggccgccgcga

SEQ ID NO: 816620 - RNA, 19 nt, Mycobacterium avium subsp. paratuberculosis
ccgcggccgccgcgacggc

SEQ ID NO: 816621 - RNA, 12 nt, Mycobacterium avium subsp. paratuberculosis
ccgcggcccgcu

SEQ ID NO: 816622 - RNA, 19 nt, Mycobacterium avium subsp. paratuberculosis
ccgcggcccggccaccagg

SEQ ID NO: 816623 - RNA, 16 nt, Mycobacterium avium subsp. paratuberculosis
ccgcgcggcggccaac

SEQ ID NO: 816624 - RNA, 14 nt, Mycobacterium avium subsp. paratuberculosis
ccgcgcggcgccag

SEQ ID NO: 816625 - RNA, 15 nt, Mycobacterium avium subsp. paratuberculosis
ccgcgcggcgccagc

SEQ ID NO: 816626 - RNA, 20 nt, Mycobacterium avium subsp. paratuberculosis
ccgcgcggcgccagcggccg

SEQ ID NO: 816627 - RNA, 23 nt, Mycobacterium avium subsp. paratuberculosis
ccgcgcggcgccagcggccgauc

SEQ ID NO: 816628 - RNA, 22 nt, Mycobacterium avium subsp. paratuberculosis
ccgcgcggcgcccccgcgacgu

SEQ ID NO: 816629 - RNA, 12 nt, Mycobacterium avium subsp. paratuberculosis
ccgcgcgggcca

SEQ ID NO: 816630 - RNA, 13 nt, Mycobacterium avium subsp. paratuberculosis
ccgcgcgggccag

SEQ ID NO: 816631 - RNA, 22 nt, Mycobacterium avium subsp. paratuberculosis
ccgcgcgggccgccgacgucgu

SEQ ID NO: 816632 - RNA, 14 nt, Mycobacterium avium subsp. paratuberculosis
ccgcgcgggcgacc

SEQ ID NO: 816633 - RNA, 17 nt, Mycobacterium avium subsp. paratuberculosis
ccgcgcgggcgaccugc

SEQ ID NO: 816634 - RNA, 20 nt, Mycobacterium avium subsp. paratuberculosis
ccgcgcgggcgaccugcggg

SEQ ID NO: 816635 - RNA, 21 nt, Mycobacterium avium subsp. paratuberculosis
ccgcgcgggcgaccugcgggc

SEQ ID NO: 816636 - RNA, 18 nt, Mycobacterium avium subsp. paratuberculosis
ccgcgcgggcggcgucgu

SEQ ID NO: 816637 - RNA, 19 nt, Mycobacterium avium subsp. paratuberculosis
ccgcgcgggcugcagggcc

SEQ ID NO: 816638 - RNA, 16 nt, Mycobacterium avium subsp. paratuberculosis
ccgcgcgggggccgcc

SEQ ID NO: 816639 - RNA, 22 nt, Mycobacterium avium subsp. paratuberculosis
ccgcgcucaacccgggccggac

SEQ ID NO: 816640 - RNA, 12 nt, Mycobacterium avium subsp. paratuberculosis
ccgcgcucaccg

SEQ ID NO: 816641 - RNA, 20 nt, Mycobacterium avium subsp. paratuberculosis
ccgcgcucaccgcggggugc

SEQ ID NO: 816642 - RNA, 21 nt, Mycobacterium avium subsp. paratuberculosis
ccgcgcucaccgucgcgguca

SEQ ID NO: 816643 - RNA, 18 nt, Mycobacterium avium subsp. paratuberculosis
ccgcgcuccugccagcgg

SEQ ID NO: 816644 - RNA, 19 nt, Mycobacterium avium subsp. paratuberculosis
ccgcgcuccugccagcggc

SEQ ID NO: 816645 - RNA, 21 nt, Mycobacterium avium subsp. paratuberculosis
ccgcgcuccugccagcggcgc

SEQ ID NO: 816646 - RNA, 16 nt, Mycobacterium avium subsp. paratuberculosis
ccgcgcggcgacgauc

SEQ ID NO: 816647 - RNA, 18 nt, Mycobacterium avium subsp. paratuberculosis
ccgcgcggcgauggccga

SEQ ID NO: 816648 - RNA, 13 nt, Mycobacterium avium subsp. paratuberculosis
ccgcgcggcgcag

SEQ ID NO: 816649 - RNA, 20 nt, Mycobacterium avium subsp. paratuberculosis
ccgcgcggcgcagggcggcc

SEQ ID NO: 816650 - RNA, 21 nt, Mycobacterium avium subsp. paratuberculosis
ccgcgcggcgcagggcggccg

SEQ ID NO: 816651 - RNA, 23 nt, Mycobacterium avium subsp. paratuberculosis
ccgcgcggcgcagggcggccggc

SEQ ID NO: 816652 - RNA, 18 nt, Mycobacterium avium subsp. paratuberculosis
ccgcgcggcgcaguucga

SEQ ID NO: 816653 - RNA, 12 nt, Mycobacterium avium subsp. paratuberculosis
ccgcgcggcggg

SEQ ID NO: 816654 - RNA, 13 nt, Mycobacterium avium subsp. paratuberculosis
ccgcgcggcgggc

SEQ ID NO: 816655 - RNA, 17 nt, Mycobacterium avium subsp. paratuberculosis
ccgcgcggcgggcccgc

SEQ ID NO: 816656 - RNA, 18 nt, Mycobacterium avium subsp. paratuberculosis
ccgcgcggcgggcccgca

SEQ ID NO: 816657 - RNA, 20 nt, Mycobacterium avium subsp. paratuberculosis
ccgcgcggcgggcccgcagc

SEQ ID NO: 816658 - RNA, 13 nt, Mycobacterium avium subsp. paratuberculosis
ccgcgcggcgguc

SEQ ID NO: 816659 - RNA, 21 nt, Mycobacterium avium subsp. paratuberculosis
ccgcgcggcgguccagcgagc

SEQ ID NO: 816660 - RNA, 16 nt, Mycobacterium avium subsp. paratuberculosis
ccgcgcggcggugacc

SEQ ID NO: 816661 - RNA, 18 nt, Mycobacterium avium subsp. paratuberculosis
ccgcgcggcggugaccgg

SEQ ID NO: 816662 - RNA, 14 nt, Mycobacterium avium subsp. paratuberculosis
ccgcgcggcggugc

SEQ ID NO: 816663 - RNA, 22 nt, Mycobacterium avium subsp. paratuberculosis
ccgcgcggcggugcucgcgccg

SEQ ID NO: 816664 - RNA, 23 nt, Mycobacterium avium subsp. paratuberculosis
ccgcgcggcggugcucgcgccgg

SEQ ID NO: 816665 - RNA, 20 nt, Mycobacterium avium subsp. paratuberculosis
ccgcgcggcggugucggugc

SEQ ID NO: 816666 - RNA, 12 nt, Mycobacterium avium subsp. paratuberculosis
ccgcgcggcguc

SEQ ID NO: 816667 - RNA, 16 nt, Mycobacterium avium subsp. paratuberculosis
ccgcgcggcgucggcc

SEQ ID NO: 816668 - RNA, 18 nt, Mycobacterium avium subsp. paratuberculosis
ccgcgcggcgucggccgg

SEQ ID NO: 816669 - RNA, 23 nt, Mycobacterium avium subsp. paratuberculosis
ccgcgcggcgucggccgggcugc

SEQ ID NO: 816670 - RNA, 18 nt, Mycobacterium avium subsp. paratuberculosis
ccgcgcggcgucggccug

SEQ ID NO: 816671 - RNA, 19 nt, Mycobacterium avium subsp. paratuberculosis
ccgcgcggcgucggccugc

SEQ ID NO: 816672 - RNA, 22 nt, Mycobacterium avium subsp. paratuberculosis
ccgcgcggcucacagcgcggcg

SEQ ID NO: 816673 - RNA, 14 nt, Mycobacterium avium subsp. paratuberculosis
ccgcgcggcucgcg

SEQ ID NO: 816674 - RNA, 17 nt, Mycobacterium avium subsp. paratuberculosis
ccgcgcggcucgcgggc

SEQ ID NO: 816675 - RNA, 16 nt, Mycobacterium avium subsp. paratuberculosis
ccgcgcggccagcggc

SEQ ID NO: 816676 - RNA, 12 nt, Mycobacterium avium subsp. paratuberculosis
ccgcgcggcccg

SEQ ID NO: 816677 - RNA, 21 nt, Mycobacterium avium subsp. paratuberculosis
ccgcgcggcccgcgacgucgg

SEQ ID NO: 816678 - RNA, 12 nt, Mycobacterium avium subsp. paratuberculosis
ccgcgcggccgc

SEQ ID NO: 816679 - RNA, 14 nt, Mycobacterium avium subsp. paratuberculosis
ccgcgcggccgccu

SEQ ID NO: 816680 - RNA, 12 nt, Mycobacterium avium subsp. paratuberculosis
ccgcgcggccgg

SEQ ID NO: 816681 - RNA, 14 nt, Mycobacterium avium subsp. paratuberculosis
ccgcgcggccggcc

SEQ ID NO: 816682 - RNA, 16 nt, Mycobacterium avium subsp. paratuberculosis
ccgcgcggccggccac

SEQ ID NO: 816683 - RNA, 21 nt, Mycobacterium avium subsp. paratuberculosis
ccgcgcggccggccacgcucg

SEQ ID NO: 816684 - RNA, 14 nt, Mycobacterium avium subsp. paratuberculosis
ccgcgcggacgcgg

SEQ ID NO: 816685 - RNA, 19 nt, Mycobacterium avium subsp. paratuberculosis
ccgcgcggacgcggcggac

SEQ ID NO: 816686 - RNA, 14 nt, Mycobacterium avium subsp. paratuberculosis
ccgcgcggccacca

SEQ ID NO: 816687 - RNA, 17 nt, Mycobacterium avium subsp. paratuberculosis
ccgcgcggccaccagcg

SEQ ID NO: 816688 - RNA, 18 nt, Mycobacterium avium subsp. paratuberculosis
ccgcgcggccaccagcgc

SEQ ID NO: 816689 - RNA, 21 nt, Mycobacterium avium subsp. paratuberculosis
ccgcgcggccaccagcgcggc

SEQ ID NO: 816690 - RNA, 13 nt, Mycobacterium avium subsp. paratuberculosis
ccgcgcgcgucga

SEQ ID NO: 816691 - RNA, 16 nt, Mycobacterium avium subsp. paratuberculosis
ccgcgcgcgucgacgu

SEQ ID NO: 816692 - RNA, 19 nt, Mycobacterium avium subsp. paratuberculosis
ccgcgcgcgucgacguucg

SEQ ID NO: 816693 - RNA, 21 nt, Mycobacterium avium subsp. paratuberculosis
ccgcgcgcucgggggugcccg

SEQ ID NO: 816694 - RNA, 15 nt, Mycobacterium avium subsp. paratuberculosis
ccgcgccgcgucguc

SEQ ID NO: 816695 - RNA, 20 nt, Mycobacterium avium subsp. paratuberculosis
ccgcgccgcgucgucgucga

SEQ ID NO: 816696 - RNA, 13 nt, Mycobacterium avium subsp. paratuberculosis
ccgcgccggaguu

SEQ ID NO: 816697 - RNA, 13 nt, Mycobacterium avium subsp. paratuberculosis
ccgcgccggccgg

SEQ ID NO: 816698 - RNA, 15 nt, Mycobacterium avium subsp. paratuberculosis
ccgcgccggccggac

SEQ ID NO: 816699 - RNA, 13 nt, Mycobacterium avium subsp. paratuberculosis
ccgcgccgggcac

SEQ ID NO: 816700 - RNA, 21 nt, Mycobacterium avium subsp. paratuberculosis
ccgcgccgggcaccaccaccg

SEQ ID NO: 816701 - RNA, 19 nt, Mycobacterium avium subsp. paratuberculosis
ccgcgccgggcgaagucgc

SEQ ID NO: 816702 - RNA, 22 nt, Mycobacterium avium subsp. paratuberculosis
ccgcgccggcggcggcgguccg

SEQ ID NO: 816703 - RNA, 12 nt, Mycobacterium avium subsp. paratuberculosis
ccgcgccggcgu

SEQ ID NO: 816704 - RNA, 20 nt, Mycobacterium avium subsp. paratuberculosis
ccgcgccggcgugucggcgc

SEQ ID NO: 816705 - RNA, 21 nt, Mycobacterium avium subsp. paratuberculosis
ccgcgccggcgugucggcgcc

SEQ ID NO: 816706 - RNA, 13 nt, Mycobacterium avium subsp. paratuberculosis
ccgcgccggcggc

SEQ ID NO: 816707 - RNA, 17 nt, Mycobacterium avium subsp. paratuberculosis
ccgcgccggccuuggcc

SEQ ID NO: 816708 - RNA, 13 nt, Mycobacterium avium subsp. paratuberculosis
ccgcgccggcgca

SEQ ID NO: 816709 - RNA, 17 nt, Mycobacterium avium subsp. paratuberculosis
ccgcgccguugaccgcg

SEQ ID NO: 816710 - RNA, 18 nt, Mycobacterium avium subsp. paratuberculosis
ccgcgccguugaccgcgg

SEQ ID NO: 816711 - RNA, 24 nt, Mycobacterium avium subsp. paratuberculosis
ccgcgccguugaccgcggcgaugg

SEQ ID NO: 816712 - RNA, 15 nt, Mycobacterium avium subsp. paratuberculosis
ccgcgccgucgucga

SEQ ID NO: 816713 - RNA, 15 nt, Mycobacterium avium subsp. paratuberculosis
ccgcgccgucgucgu

SEQ ID NO: 816714 - RNA, 20 nt, Mycobacterium avium subsp. paratuberculosis
ccgcgccgucuuccgggcca

SEQ ID NO: 816715 - RNA, 17 nt, Mycobacterium avium subsp. paratuberculosis
ccgcgccgugcgccagc

SEQ ID NO: 816716 - RNA, 22 nt, Mycobacterium avium subsp. paratuberculosis
ccgcgccgugcgccagcgaccg

SEQ ID NO: 816717 - RNA, 21 nt, Mycobacterium avium subsp. paratuberculosis
ccgcgccguagcggcccaggu

SEQ ID NO: 816718 - RNA, 12 nt, Mycobacterium avium subsp. paratuberculosis
ccgcgccggugu

SEQ ID NO: 816719 - RNA, 21 nt, Mycobacterium avium subsp. paratuberculosis
ccgcgccgggguguccagcgg

SEQ ID NO: 816720 - RNA, 16 nt, Mycobacterium avium subsp. paratuberculosis
ccgcgccggucccgcg

SEQ ID NO: 816721 - RNA, 21 nt, Mycobacterium avium subsp. paratuberculosis
ccgcgccggucccgcggcggc

SEQ ID NO: 816722 - RNA, 22 nt, Mycobacterium avium subsp. paratuberculosis
ccgcgccggucccgcggcggcg

SEQ ID NO: 816723 - RNA, 13 nt, Mycobacterium avium subsp. paratuberculosis
ccgcgccgggcgu

SEQ ID NO: 816724 - RNA, 13 nt, Mycobacterium avium subsp. paratuberculosis
ccgcgccgcggcc

SEQ ID NO: 816725 - RNA, 14 nt, Mycobacterium avium subsp. paratuberculosis
ccgcgccgcggcca

SEQ ID NO: 816726 - RNA, 15 nt, Mycobacterium avium subsp. paratuberculosis
ccgcgccgcggccag

SEQ ID NO: 816727 - RNA, 16 nt, Mycobacterium avium subsp. paratuberculosis
ccgcgccgcggccagc

SEQ ID NO: 816728 - RNA, 13 nt, Mycobacterium avium subsp. paratuberculosis
ccgcgccgcgccg

SEQ ID NO: 816729 - RNA, 14 nt, Mycobacterium avium subsp. paratuberculosis
ccgcgccgccgcgu

SEQ ID NO: 816730 - RNA, 18 nt, Mycobacterium avium subsp. paratuberculosis
ccgcgccgccgccagcca

SEQ ID NO: 816731 - RNA, 15 nt, Mycobacterium avium subsp. paratuberculosis
ccgcgccgcccggag

SEQ ID NO: 816732 - RNA, 14 nt, Mycobacterium avium subsp. paratuberculosis
ccgcgccgcccggc

SEQ ID NO: 816733 - RNA, 19 nt, Mycobacterium avium subsp. paratuberculosis
ccgcgccgcccggcgaucu

SEQ ID NO: 816734 - RNA, 11 nt, Mycobacterium avium subsp. paratuberculosis
ccgcgccgccg

SEQ ID NO: 816735 - RNA, 13 nt, Mycobacterium avium subsp. paratuberculosis
ccgcgccgccgcc

SEQ ID NO: 816736 - RNA, 14 nt, Mycobacterium avium subsp. paratuberculosis
ccgcgccgccgcca

SEQ ID NO: 816737 - RNA, 15 nt, Mycobacterium avium subsp. paratuberculosis
ccgcgccgaggcgcu

SEQ ID NO: 816738 - RNA, 15 nt, Mycobacterium avium subsp. paratuberculosis
ccgcgccgaucacga

SEQ ID NO: 816739 - RNA, 16 nt, Mycobacterium avium subsp. paratuberculosis
ccgcgccgaucacgaa

SEQ ID NO: 816740 - RNA, 19 nt, Mycobacterium avium subsp. paratuberculosis
ccgcgccgccacaccucgg

SEQ ID NO: 816741 - RNA, 22 nt, Mycobacterium avium subsp. paratuberculosis
ccgcgccgccacaccucggcga

SEQ ID NO: 816742 - RNA, 23 nt, Mycobacterium avium subsp. paratuberculosis
ccgcgccgccacaccucggcgac

SEQ ID NO: 816743 - RNA, 15 nt, Mycobacterium avium subsp. paratuberculosis
ccgcgccgaccagcg

SEQ ID NO: 816744 - RNA, 20 nt, Mycobacterium avium subsp. paratuberculosis
ccgcgccgaccagcgcguug

SEQ ID NO: 816745 - RNA, 12 nt, Mycobacterium avium subsp. paratuberculosis
ccgcgccgaccu

SEQ ID NO: 816746 - RNA, 14 nt, Mycobacterium avium subsp. paratuberculosis
ccgcgccgaccucg

SEQ ID NO: 816747 - RNA, 19 nt, Mycobacterium avium subsp. paratuberculosis
ccgcgccgaccucgucggc

SEQ ID NO: 816748 - RNA, 24 nt, Mycobacterium avium subsp. paratuberculosis
ccgcgccgaccucgucggcggugc

SEQ ID NO: 816749 - RNA, 12 nt, Mycobacterium avium subsp. paratuberculosis
ccgcgccgacgc

SEQ ID NO: 816750 - RNA, 13 nt, Mycobacterium avium subsp. paratuberculosis
ccgcgccgacgcc

SEQ ID NO: 816751 - RNA, 16 nt, Mycobacterium avium subsp. paratuberculosis
ccgcgccgacgcccac

SEQ ID NO: 816752 - RNA, 13 nt, Mycobacterium avium subsp. paratuberculosis
ccgcgccgacggc

SEQ ID NO: 816753 - RNA, 15 nt, Mycobacterium avium subsp. paratuberculosis
ccgcgccgacggccg

SEQ ID NO: 816754 - RNA, 16 nt, Mycobacterium avium subsp. paratuberculosis
ccgcgccgacggccgc

SEQ ID NO: 816755 - RNA, 19 nt, Mycobacterium avium subsp. paratuberculosis
ccgcgccgacggccgcgcc

SEQ ID NO: 816756 - RNA, 21 nt, Mycobacterium avium subsp. paratuberculosis
ccgcgccgacggccgcgccgu

SEQ ID NO: 816757 - RNA, 20 nt, Mycobacterium avium subsp. paratuberculosis
ccgcgcgagaguaucgccac

SEQ ID NO: 816758 - RNA, 21 nt, Mycobacterium avium subsp. paratuberculosis
ccgcgcgagaguaucgccacg

SEQ ID NO: 816759 - RNA, 22 nt, Mycobacterium avium subsp. paratuberculosis
ccgcgcgagaguaucgccacgc

SEQ ID NO: 816760 - RNA, 16 nt, Mycobacterium avium subsp. paratuberculosis
ccgcgcgacaucaccg

SEQ ID NO: 816761 - RNA, 19 nt, Mycobacterium avium subsp. paratuberculosis
ccgcgcgacaucaccgcgg

SEQ ID NO: 816762 - RNA, 22 nt, Mycobacterium avium subsp. paratuberculosis
ccgcgcgacaucaccgcgggcg

SEQ ID NO: 816763 - RNA, 19 nt, Mycobacterium avium subsp. paratuberculosis
ccgcgcgaccaucagcccg

SEQ ID NO: 816764 - RNA, 13 nt, Mycobacterium avium subsp. paratuberculosis
ccgcgcgaucggc

SEQ ID NO: 816765 - RNA, 15 nt, Mycobacterium avium subsp. paratuberculosis
ccgcgcgaucggcga

SEQ ID NO: 816766 - RNA, 17 nt, Mycobacterium avium subsp. paratuberculosis
ccgcgcgaucggcgagc

SEQ ID NO: 816767 - RNA, 19 nt, Mycobacterium avium subsp. paratuberculosis
ccgcgcgaucggcgagccg

SEQ ID NO: 816768 - RNA, 23 nt, Mycobacterium avium subsp. paratuberculosis
ccgcgcgaucggcgagccgggac

SEQ ID NO: 816769 - RNA, 18 nt, Mycobacterium avium subsp. paratuberculosis
ccgcgcgaucaggccggc

SEQ ID NO: 816770 - RNA, 19 nt, Mycobacterium avium subsp. paratuberculosis
ccgcgcgaucaggccggcc

SEQ ID NO: 816771 - RNA, 22 nt, Mycobacterium avium subsp. paratuberculosis
ccgcgcgaucaggccggccacc

SEQ ID NO: 816772 - RNA, 12 nt, Mycobacterium avium subsp. paratuberculosis
ccgcgcgagcgc

SEQ ID NO: 816773 - RNA, 22 nt, Mycobacterium avium subsp. paratuberculosis
ccgcgcgagcgcagcgccaggc

SEQ ID NO: 816774 - RNA, 16 nt, Mycobacterium avium subsp. paratuberculosis
ccgcgcgagcgcgcug

SEQ ID NO: 816775 - RNA, 17 nt, Mycobacterium avium subsp. paratuberculosis
ccgcgcgagcaucaccg

SEQ ID NO: 816776 - RNA, 22 nt, Mycobacterium avium subsp. paratuberculosis
ccgcgccuucuugcugcccgcg

SEQ ID NO: 816777 - RNA, 19 nt, Mycobacterium avium subsp. paratuberculosis
ccgcgccuuugacguucgc

SEQ ID NO: 816778 - RNA, 18 nt, Mycobacterium avium subsp. paratuberculosis
ccgcgccuucgacccggu

SEQ ID NO: 816779 - RNA, 19 nt, Mycobacterium avium subsp. paratuberculosis
ccgcgccuucgacccggug

SEQ ID NO: 816780 - RNA, 13 nt, Mycobacterium avium subsp. paratuberculosis
ccgcgccgugggc

SEQ ID NO: 816781 - RNA, 19 nt, Mycobacterium avium subsp. paratuberculosis
ccgcgccgugggcgucacg

SEQ ID NO: 816782 - RNA, 24 nt, Mycobacterium avium subsp. paratuberculosis
ccgcgccuccauucgggccagcgc

SEQ ID NO: 816783 - RNA, 19 nt, Mycobacterium avium subsp. paratuberculosis
ccgcgccucguugagcaca

SEQ ID NO: 816784 - RNA, 20 nt, Mycobacterium avium subsp. paratuberculosis
ccgcgccgguguucggcgcc

SEQ ID NO: 816785 - RNA, 13 nt, Mycobacterium avium subsp. paratuberculosis
ccgcgccuggcgc

SEQ ID NO: 816786 - RNA, 20 nt, Mycobacterium avium subsp. paratuberculosis
ccgcgccuggcgcagggcgu

SEQ ID NO: 816787 - RNA, 12 nt, Mycobacterium avium subsp. paratuberculosis
ccgcgcgcggcg

SEQ ID NO: 816788 - RNA, 14 nt, Mycobacterium avium subsp. paratuberculosis
ccgcgcgcggcgcg

SEQ ID NO: 816789 - RNA, 18 nt, Mycobacterium avium subsp. paratuberculosis
ccgcgcgcggcgcggagc

SEQ ID NO: 816790 - RNA, 20 nt, Mycobacterium avium subsp. paratuberculosis
ccgcgcgcggcgcggagccg

SEQ ID NO: 816791 - RNA, 14 nt, Mycobacterium avium subsp. paratuberculosis
ccgcgcgcgggcca

SEQ ID NO: 816792 - RNA, 14 nt, Mycobacterium avium subsp. paratuberculosis
ccgcgcgcgcggcc

SEQ ID NO: 816793 - RNA, 23 nt, Mycobacterium avium subsp. paratuberculosis
ccgcgcgcgcggccuccagccgc

SEQ ID NO: 816794 - RNA, 14 nt, Mycobacterium avium subsp. paratuberculosis
ccgcgcgcggccac

SEQ ID NO: 816795 - RNA, 13 nt, Mycobacterium avium subsp. paratuberculosis
ccgcgcgccggcc

SEQ ID NO: 816796 - RNA, 14 nt, Mycobacterium avium subsp. paratuberculosis
ccgcgcgccggcca

SEQ ID NO: 816797 - RNA, 16 nt, Mycobacterium avium subsp. paratuberculosis
ccgcgcgccggccagc

SEQ ID NO: 816798 - RNA, 14 nt, Mycobacterium avium subsp. paratuberculosis
ccgcgcgcaggcac

SEQ ID NO: 816799 - RNA, 20 nt, Mycobacterium avium subsp. paratuberculosis
ccgcgcgcaggccccggcgc

SEQ ID NO: 816800 - RNA, 14 nt, Mycobacterium avium subsp. paratuberculosis
ccgcgcgcaggcgc

SEQ ID NO: 816801 - RNA, 14 nt, Mycobacterium avium subsp. paratuberculosis
ccgcgcgcaccacg

SEQ ID NO: 816802 - RNA, 16 nt, Mycobacterium avium subsp. paratuberculosis
ccgcgcgaugcgggcg

SEQ ID NO: 816803 - RNA, 24 nt, Mycobacterium avium subsp. paratuberculosis
ccgcgcgaugcgggcgccgaacgu

SEQ ID NO: 816804 - RNA, 12 nt, Mycobacterium avium subsp. paratuberculosis
ccgcgcgcacca

SEQ ID NO: 816805 - RNA, 18 nt, Mycobacterium avium subsp. paratuberculosis
ccgcgcgccagcgcgugc

SEQ ID NO: 816806 - RNA, 21 nt, Mycobacterium avium subsp. paratuberculosis
ccgcgcgccagcgcgugcggg

SEQ ID NO: 816807 - RNA, 12 nt, Mycobacterium avium subsp. paratuberculosis
ccgcgcgccagg

SEQ ID NO: 816808 - RNA, 14 nt, Mycobacterium avium subsp. paratuberculosis
ccgcgcgcccgcgg

SEQ ID NO: 816809 - RNA, 15 nt, Mycobacterium avium subsp. paratuberculosis
ccgcgcgcccgcggc

SEQ ID NO: 816810 - RNA, 16 nt, Mycobacterium avium subsp. paratuberculosis
ccgcgcgcccgcggcc

SEQ ID NO: 816811 - RNA, 17 nt, Mycobacterium avium subsp. paratuberculosis
ccgcgcgcccgcggcca

SEQ ID NO: 816812 - RNA, 19 nt, Mycobacterium avium subsp. paratuberculosis
ccgcgcgcccgcggccauc

SEQ ID NO: 816813 - RNA, 16 nt, Mycobacterium avium subsp. paratuberculosis
ccgcgcgcccgucguc

SEQ ID NO: 816814 - RNA, 20 nt, Mycobacterium avium subsp. paratuberculosis
ccgcgcgcccuagucgacgc

SEQ ID NO: 816815 - RNA, 22 nt, Mycobacterium avium subsp. paratuberculosis
ccgcgcgcccuagucgacgccg

SEQ ID NO: 816816 - RNA, 12 nt, Mycobacterium avium subsp. paratuberculosis
ccgcgcgccgac

SEQ ID NO: 816817 - RNA, 13 nt, Mycobacterium avium subsp. paratuberculosis
ccgcgcgccgaga

SEQ ID NO: 816818 - RNA, 20 nt, Mycobacterium avium subsp. paratuberculosis
ccgcgugcacacccuuuucc

SEQ ID NO: 816819 - RNA, 17 nt, Mycobacterium avium subsp. paratuberculosis
ccgcgugacggccgcgg

SEQ ID NO: 816820 - RNA, 18 nt, Mycobacterium avium subsp. paratuberculosis
ccgcguggcaggucgggc

SEQ ID NO: 816821 - RNA, 19 nt, Mycobacterium avium subsp. paratuberculosis
ccgcguggcaggucgggcu

SEQ ID NO: 816822 - RNA, 14 nt, Mycobacterium avium subsp. paratuberculosis
ccgcguggccgcca

SEQ ID NO: 816823 - RNA, 14 nt, Mycobacterium avium subsp. paratuberculosis
ccgcgugacggccg

SEQ ID NO: 816824 - RNA, 20 nt, Mycobacterium avium subsp. paratuberculosis
ccgcgugggcaccccgauca

SEQ ID NO: 816825 - RNA, 14 nt, Mycobacterium avium subsp. paratuberculosis
ccgcguggcgcaca

SEQ ID NO: 816826 - RNA, 15 nt, Mycobacterium avium subsp. paratuberculosis
ccgcguggcgcacag

SEQ ID NO: 816827 - RNA, 18 nt, Mycobacterium avium subsp. paratuberculosis
ccgcguggcgcacagcgu

SEQ ID NO: 816828 - RNA, 19 nt, Mycobacterium avium subsp. paratuberculosis
ccgcguucacccgcgcccg

SEQ ID NO: 816829 - RNA, 19 nt, Mycobacterium avium subsp. paratuberculosis
ccgcguuccaggaccugac

SEQ ID NO: 816830 - RNA, 16 nt, Mycobacterium avium subsp. paratuberculosis
ccgcguucggcggcgc

SEQ ID NO: 816831 - RNA, 19 nt, Mycobacterium avium subsp. paratuberculosis
ccgcguucggcggcgcgcu

SEQ ID NO: 816832 - RNA, 18 nt, Mycobacterium avium subsp. paratuberculosis
ccgcgugucggcacacca

SEQ ID NO: 816833 - RNA, 16 nt, Mycobacterium avium subsp. paratuberculosis
ccgcgucggucagcgc

SEQ ID NO: 816834 - RNA, 17 nt, Mycobacterium avium subsp. paratuberculosis
ccgcgucggucagcgcc

SEQ ID NO: 816835 - RNA, 19 nt, Mycobacterium avium subsp. paratuberculosis
ccgcgucggucagcgccac

SEQ ID NO: 816836 - RNA, 21 nt, Mycobacterium avium subsp. paratuberculosis
ccgcgucggcggcggcggccg

SEQ ID NO: 816837 - RNA, 22 nt, Mycobacterium avium subsp. paratuberculosis
ccgcgucggcggcggcggccgc

SEQ ID NO: 816838 - RNA, 23 nt, Mycobacterium avium subsp. paratuberculosis
ccgcgucggcggucgccagcgcc

SEQ ID NO: 816839 - RNA, 15 nt, Mycobacterium avium subsp. paratuberculosis
ccgcgucggcgcugg

SEQ ID NO: 816840 - RNA, 13 nt, Mycobacterium avium subsp. paratuberculosis
ccgcgucggcgcc

SEQ ID NO: 816841 - RNA, 15 nt, Mycobacterium avium subsp. paratuberculosis
ccgcgucggcgccgg

SEQ ID NO: 816842 - RNA, 17 nt, Mycobacterium avium subsp. paratuberculosis
ccgcgucggcgccggcc

SEQ ID NO: 816843 - RNA, 15 nt, Mycobacterium avium subsp. paratuberculosis
ccgcgucggaggcca

SEQ ID NO: 816844 - RNA, 20 nt, Mycobacterium avium subsp. paratuberculosis
ccgcgucggcccccagcgag

SEQ ID NO: 816845 - RNA, 21 nt, Mycobacterium avium subsp. paratuberculosis
ccgcgucggcccccagcgagg

SEQ ID NO: 816846 - RNA, 18 nt, Mycobacterium avium subsp. paratuberculosis
ccgcguccacgaccccgg

SEQ ID NO: 816847 - RNA, 19 nt, Mycobacterium avium subsp. paratuberculosis
ccgcguccacgaccccggc

SEQ ID NO: 816848 - RNA, 22 nt, Mycobacterium avium subsp. paratuberculosis
ccgcguccacgaccccggcggc

SEQ ID NO: 816849 - RNA, 15 nt, Mycobacterium avium subsp. paratuberculosis
ccgcguccagcagca

SEQ ID NO: 816850 - RNA, 13 nt, Mycobacterium avium subsp. paratuberculosis
ccgcgugacggcc

SEQ ID NO: 816851 - RNA, 16 nt, Mycobacterium avium subsp. paratuberculosis
ccgcgucuuggacgcc

SEQ ID NO: 816852 - RNA, 17 nt, Mycobacterium avium subsp. paratuberculosis
ccgcgucuuggacgccc

SEQ ID NO: 816853 - RNA, 17 nt, Mycobacterium avium subsp. paratuberculosis
ccgcgugacaagccggc

SEQ ID NO: 816854 - RNA, 19 nt, Mycobacterium avium subsp. paratuberculosis
ccgcgugacaagccggcgu

SEQ ID NO: 816855 - RNA, 23 nt, Mycobacterium avium subsp. paratuberculosis
ccgcgugacaagccggcgucgau

SEQ ID NO: 816856 - RNA, 21 nt, Mycobacterium avium subsp. paratuberculosis
ccgcgugacaggggcagcagc

SEQ ID NO: 816857 - RNA, 23 nt, Mycobacterium avium subsp. paratuberculosis
ccgcgucguugagugcgcugugg

SEQ ID NO: 816858 - RNA, 15 nt, Mycobacterium avium subsp. paratuberculosis
ccgcgucgucgucga

SEQ ID NO: 816859 - RNA, 22 nt, Mycobacterium avium subsp. paratuberculosis
ccgcgucgucgucgaccgucag

SEQ ID NO: 816860 - RNA, 18 nt, Mycobacterium avium subsp. paratuberculosis
ccgcgucgugccgagcgu

SEQ ID NO: 816861 - RNA, 20 nt, Mycobacterium avium subsp. paratuberculosis
ccgcgucgugccgagcguga

SEQ ID NO: 816862 - RNA, 14 nt, Mycobacterium avium subsp. paratuberculosis
ccgcgucguggccc

SEQ ID NO: 816863 - RNA, 19 nt, Mycobacterium avium subsp. paratuberculosis
ccgcgucguggcccugcuc

SEQ ID NO: 816864 - RNA, 21 nt, Mycobacterium avium subsp. paratuberculosis
ccgcgucguguccgggcccga

SEQ ID NO: 816865 - RNA, 13 nt, Mycobacterium avium subsp. paratuberculosis
ccgcgucgggcag

SEQ ID NO: 816866 - RNA, 13 nt, Mycobacterium avium subsp. paratuberculosis
ccgcgucgucauc

SEQ ID NO: 816867 - RNA, 16 nt, Mycobacterium avium subsp. paratuberculosis
ccgcgucagcagcgcg

SEQ ID NO: 816868 - RNA, 19 nt, Mycobacterium avium subsp. paratuberculosis
ccgcgucagcagcgcgacg

SEQ ID NO: 816869 - RNA, 18 nt, Mycobacterium avium subsp. paratuberculosis
ccgcgucacgucggccug

SEQ ID NO: 816870 - RNA, 22 nt, Mycobacterium avium subsp. paratuberculosis
ccgcguagucguugucggcggu

SEQ ID NO: 816871 - RNA, 16 nt, Mycobacterium avium subsp. paratuberculosis
ccgcguauugcacggc

SEQ ID NO: 816872 - RNA, 21 nt, Mycobacterium avium subsp. paratuberculosis
ccgcguauugcacggcggcga

SEQ ID NO: 816873 - RNA, 20 nt, Mycobacterium avium subsp. paratuberculosis
ccgcguaggucuucggugaa

SEQ ID NO: 816874 - RNA, 21 nt, Mycobacterium avium subsp. paratuberculosis
ccgcguaggucuucggugaag

SEQ ID NO: 816875 - RNA, 15 nt, Mycobacterium avium subsp. paratuberculosis
ccgcguagcgccgcc

SEQ ID NO: 816876 - RNA, 17 nt, Mycobacterium avium subsp. paratuberculosis
ccgcguagcgccgcccg

SEQ ID NO: 816877 - RNA, 18 nt, Mycobacterium avium subsp. paratuberculosis
ccgcguagcucgccgcgg

SEQ ID NO: 816878 - RNA, 20 nt, Mycobacterium avium subsp. paratuberculosis
ccgcguagcucgccgcggcc

SEQ ID NO: 816879 - RNA, 24 nt, Mycobacterium avium subsp. paratuberculosis
ccgcguagcucgccgcggccacgc

SEQ ID NO: 816880 - RNA, 22 nt, Mycobacterium avium subsp. paratuberculosis
ccgcguaggccaggaccgggac

SEQ ID NO: 816881 - RNA, 15 nt, Mycobacterium avium subsp. paratuberculosis
ccgcgguggcggugu

SEQ ID NO: 816882 - RNA, 14 nt, Mycobacterium avium subsp. paratuberculosis
ccgcggugggccag

SEQ ID NO: 816883 - RNA, 14 nt, Mycobacterium avium subsp. paratuberculosis
ccgcguacgccgcc

SEQ ID NO: 816884 - RNA, 23 nt, Mycobacterium avium subsp. paratuberculosis
ccgcguacuucgcgcccuggauc

SEQ ID NO: 816885 - RNA, 18 nt, Mycobacterium avium subsp. paratuberculosis
ccgcgguggguccgccgg

SEQ ID NO: 816886 - RNA, 21 nt, Mycobacterium avium subsp. paratuberculosis
ccgcgguggguccgccgggcg

SEQ ID NO: 816887 - RNA, 23 nt, Mycobacterium avium subsp. paratuberculosis
ccgcgguggguccgccgggcgcg

SEQ ID NO: 816888 - RNA, 14 nt, Mycobacterium avium subsp. paratuberculosis
ccgcgguggugggc

SEQ ID NO: 816889 - RNA, 14 nt, Mycobacterium avium subsp. paratuberculosis
ccgcggugccgcag

SEQ ID NO: 816890 - RNA, 14 nt, Mycobacterium avium subsp. paratuberculosis
ccgcggugcgccac

SEQ ID NO: 816891 - RNA, 23 nt, Mycobacterium avium subsp. paratuberculosis
ccgcggugcgccacgcccgcagc

SEQ ID NO: 816892 - RNA, 13 nt, Mycobacterium avium subsp. paratuberculosis
ccgcggugcgcga

SEQ ID NO: 816893 - RNA, 19 nt, Mycobacterium avium subsp. paratuberculosis
ccgcggugcguuugaugac

SEQ ID NO: 816894 - RNA, 23 nt, Mycobacterium avium subsp. paratuberculosis
ccgcggugcguuugaugacgcga

SEQ ID NO: 816895 - RNA, 17 nt, Mycobacterium avium subsp. paratuberculosis
ccgcgguggaacccagc

SEQ ID NO: 816896 - RNA, 20 nt, Mycobacterium avium subsp. paratuberculosis
ccgcgguggaacccagcacc

SEQ ID NO: 816897 - RNA, 21 nt, Mycobacterium avium subsp. paratuberculosis
ccgcgguggaacccagcaccc

SEQ ID NO: 816898 - RNA, 15 nt, Mycobacterium avium subsp. paratuberculosis
ccgcgguggccggga

SEQ ID NO: 816899 - RNA, 16 nt, Mycobacterium avium subsp. paratuberculosis
ccgcgguggccgggau

SEQ ID NO: 816900 - RNA, 12 nt, Mycobacterium avium subsp. paratuberculosis
ccgcgguggcgc

SEQ ID NO: 816901 - RNA, 15 nt, Mycobacterium avium subsp. paratuberculosis
ccgcgguggcgccgc

SEQ ID NO: 816902 - RNA, 16 nt, Mycobacterium avium subsp. paratuberculosis
ccgcggcuccagcagc

SEQ ID NO: 816903 - RNA, 19 nt, Mycobacterium avium subsp. paratuberculosis
ccgcggcuccagcagcggc

SEQ ID NO: 816904 - RNA, 15 nt, Mycobacterium avium subsp. paratuberculosis
ccgcggcuccggccg

SEQ ID NO: 816905 - RNA, 17 nt, Mycobacterium avium subsp. paratuberculosis
ccgcggcuccggccgcg

SEQ ID NO: 816906 - RNA, 22 nt, Mycobacterium avium subsp. paratuberculosis
ccgcggcucgauggacgccagc

SEQ ID NO: 816907 - RNA, 16 nt, Mycobacterium avium subsp. paratuberculosis
ccgcggcucgcgacgc

SEQ ID NO: 816908 - RNA, 12 nt, Mycobacterium avium subsp. paratuberculosis
ccgcggcgucgg

SEQ ID NO: 816909 - RNA, 19 nt, Mycobacterium avium subsp. paratuberculosis
ccgcggcgucggguagggc

SEQ ID NO: 816910 - RNA, 16 nt, Mycobacterium avium subsp. paratuberculosis
ccgcggcgugcgccag

SEQ ID NO: 816911 - RNA, 17 nt, Mycobacterium avium subsp. paratuberculosis
ccgcggcguagcgccag

SEQ ID NO: 816912 - RNA, 22 nt, Mycobacterium avium subsp. paratuberculosis
ccgcggcguagcgccagucgcg

SEQ ID NO: 816913 - RNA, 13 nt, Mycobacterium avium subsp. paratuberculosis
ccgcggcgucauc

SEQ ID NO: 816914 - RNA, 16 nt, Mycobacterium avium subsp. paratuberculosis
ccgcggcggucgccac

SEQ ID NO: 816915 - RNA, 20 nt, Mycobacterium avium subsp. paratuberculosis
ccgcggcggucgccacucgg

SEQ ID NO: 816916 - RNA, 22 nt, Mycobacterium avium subsp. paratuberculosis
ccgcggcggucgccacucgggc

SEQ ID NO: 816917 - RNA, 14 nt, Mycobacterium avium subsp. paratuberculosis
ccgcggcggugccg

SEQ ID NO: 816918 - RNA, 16 nt, Mycobacterium avium subsp. paratuberculosis
ccgcggcggugccggu

SEQ ID NO: 816919 - RNA, 18 nt, Mycobacterium avium subsp. paratuberculosis
ccgcggcggugccggugu

SEQ ID NO: 816920 - RNA, 21 nt, Mycobacterium avium subsp. paratuberculosis
ccgcggcgguggccugcccgg

SEQ ID NO: 816921 - RNA, 13 nt, Mycobacterium avium subsp. paratuberculosis
ccgcggcgguguc

SEQ ID NO: 816922 - RNA, 14 nt, Mycobacterium avium subsp. paratuberculosis
ccgcggcggugucg

SEQ ID NO: 816923 - RNA, 15 nt, Mycobacterium avium subsp. paratuberculosis
ccgcggcggugucgg

SEQ ID NO: 816924 - RNA, 19 nt, Mycobacterium avium subsp. paratuberculosis
ccgcggcggugucggcgcc

SEQ ID NO: 816925 - RNA, 23 nt, Mycobacterium avium subsp. paratuberculosis
ccgcggcggugucggcgccccgg

SEQ ID NO: 816926 - RNA, 16 nt, Mycobacterium avium subsp. paratuberculosis
ccgcgggaauggccgc

SEQ ID NO: 816927 - RNA, 20 nt, Mycobacterium avium subsp. paratuberculosis
ccgcgggaauuggcaccgga

SEQ ID NO: 816928 - RNA, 17 nt, Mycobacterium avium subsp. paratuberculosis
ccgcgggacacggcggc

SEQ ID NO: 816929 - RNA, 18 nt, Mycobacterium avium subsp. paratuberculosis
ccgcgggacacggcggcg

SEQ ID NO: 816930 - RNA, 21 nt, Mycobacterium avium subsp. paratuberculosis
ccgcgggacacggcggcgcgg

SEQ ID NO: 816931 - RNA, 17 nt, Mycobacterium avium subsp. paratuberculosis
ccgcgggaggcccagua

SEQ ID NO: 816932 - RNA, 15 nt, Mycobacterium avium subsp. paratuberculosis
ccgcggugaccgccc

SEQ ID NO: 816933 - RNA, 17 nt, Mycobacterium avium subsp. paratuberculosis
ccgcggugaccgcccgc

SEQ ID NO: 816934 - RNA, 18 nt, Mycobacterium avium subsp. paratuberculosis
ccgcggugaccgcccgcu

SEQ ID NO: 816935 - RNA, 18 nt, Mycobacterium avium subsp. paratuberculosis
ccgcggugagcaccggau

SEQ ID NO: 816936 - RNA, 19 nt, Mycobacterium avium subsp. paratuberculosis
ccgcggugagcaccggauc

SEQ ID NO: 816937 - RNA, 16 nt, Mycobacterium avium subsp. paratuberculosis
ccgcggugagcggccg

SEQ ID NO: 816938 - RNA, 18 nt, Mycobacterium avium subsp. paratuberculosis
ccgcggugagcggccgca

SEQ ID NO: 816939 - RNA, 13 nt, Mycobacterium avium subsp. paratuberculosis
ccgcggugaugcc

SEQ ID NO: 816940 - RNA, 15 nt, Mycobacterium avium subsp. paratuberculosis
ccgcggugaugccga

SEQ ID NO: 816941 - RNA, 16 nt, Mycobacterium avium subsp. paratuberculosis
ccgcggugcagucggu

SEQ ID NO: 816942 - RNA, 19 nt, Mycobacterium avium subsp. paratuberculosis
ccgcggugcagucggucgg

SEQ ID NO: 816943 - RNA, 16 nt, Mycobacterium avium subsp. paratuberculosis
ccgcuaaagccgacug

SEQ ID NO: 816944 - RNA, 17 nt, Mycobacterium avium subsp. paratuberculosis
ccgcuaaagccgacugc

SEQ ID NO: 816945 - RNA, 16 nt, Mycobacterium avium subsp. paratuberculosis
ccgcguugaucagcgc

SEQ ID NO: 816946 - RNA, 19 nt, Mycobacterium avium subsp. paratuberculosis
ccgcguugaucagcgccag

SEQ ID NO: 816947 - RNA, 20 nt, Mycobacterium avium subsp. paratuberculosis
ccgcguugcggcgcagcguc

SEQ ID NO: 816948 - RNA, 13 nt, Mycobacterium avium subsp. paratuberculosis
ccgcguuggccgc

SEQ ID NO: 816949 - RNA, 14 nt, Mycobacterium avium subsp. paratuberculosis
ccgcguuggcgccg

SEQ ID NO: 816950 - RNA, 15 nt, Mycobacterium avium subsp. paratuberculosis
ccgcguuggcgccga

SEQ ID NO: 816951 - RNA, 16 nt, Mycobacterium avium subsp. paratuberculosis
ccgcguuggcgccgac

SEQ ID NO: 816952 - RNA, 17 nt, Mycobacterium avium subsp. paratuberculosis
ccgcguuguccggggug

SEQ ID NO: 816953 - RNA, 18 nt, Mycobacterium avium subsp. paratuberculosis
ccgcguuguccggggugg

SEQ ID NO: 816954 - RNA, 14 nt, Mycobacterium avium subsp. paratuberculosis
ccgcguugucgacc

SEQ ID NO: 816955 - RNA, 20 nt, Mycobacterium avium subsp. paratuberculosis
ccgcguugucgaccaccagg

SEQ ID NO: 816956 - RNA, 19 nt, Mycobacterium avium subsp. paratuberculosis
ccgcguugucggcgacggc

SEQ ID NO: 816957 - RNA, 15 nt, Mycobacterium avium subsp. paratuberculosis
ccgcguugugcacca

SEQ ID NO: 816958 - RNA, 17 nt, Mycobacterium avium subsp. paratuberculosis
ccgcguugugcaccaac

SEQ ID NO: 816959 - RNA, 19 nt, Mycobacterium avium subsp. paratuberculosis
ccgcuagguuuggccagca

SEQ ID NO: 816960 - RNA, 21 nt, Mycobacterium avium subsp. paratuberculosis
ccgcuagguuuggccagcacc

SEQ ID NO: 816961 - RNA, 17 nt, Mycobacterium avium subsp. paratuberculosis
ccgcuagucgcccagca

SEQ ID NO: 816962 - RNA, 20 nt, Mycobacterium avium subsp. paratuberculosis
ccgcuagaccgauggcggcg

SEQ ID NO: 816963 - RNA, 13 nt, Mycobacterium avium subsp. paratuberculosis
ccgcuccggucgc

SEQ ID NO: 816964 - RNA, 15 nt, Mycobacterium avium subsp. paratuberculosis
ccgcuccggucgcgu

SEQ ID NO: 816965 - RNA, 20 nt, Mycobacterium avium subsp. paratuberculosis
ccgcuccggucgcgucgugc

SEQ ID NO: 816966 - RNA, 24 nt, Mycobacterium avium subsp. paratuberculosis
ccgcuccggucgcgucgugcggcc

SEQ ID NO: 816967 - RNA, 16 nt, Mycobacterium avium subsp. paratuberculosis
ccgcuacccggcgaac

SEQ ID NO: 816968 - RNA, 15 nt, Mycobacterium avium subsp. paratuberculosis
ccgcuccggcggacc

SEQ ID NO: 816969 - RNA, 17 nt, Mycobacterium avium subsp. paratuberculosis
ccgcuccuccucgcgcc

SEQ ID NO: 816970 - RNA, 22 nt, Mycobacterium avium subsp. paratuberculosis
ccgcuccugcaggccgagccgc

SEQ ID NO: 816971 - RNA, 15 nt, Mycobacterium avium subsp. paratuberculosis
ccgcucgaacacccg

SEQ ID NO: 816972 - RNA, 16 nt, Mycobacterium avium subsp. paratuberculosis
ccgcucgaacacccgg

SEQ ID NO: 816973 - RNA, 14 nt, Mycobacterium avium subsp. paratuberculosis
ccgcucgucgaguc

SEQ ID NO: 816974 - RNA, 21 nt, Mycobacterium avium subsp. paratuberculosis
ccgcucguaguuggggccggc

SEQ ID NO: 816975 - RNA, 15 nt, Mycobacterium avium subsp. paratuberculosis
ccgcucgggugucgc

SEQ ID NO: 816976 - RNA, 23 nt, Mycobacterium avium subsp. paratuberculosis
ccgcucgggugucgccgagccgc

SEQ ID NO: 816977 - RNA, 23 nt, Mycobacterium avium subsp. paratuberculosis
ccgcucggucuugaucaggucgc

SEQ ID NO: 816978 - RNA, 16 nt, Mycobacterium avium subsp. paratuberculosis
ccgcucgaugggugug

SEQ ID NO: 816979 - RNA, 18 nt, Mycobacterium avium subsp. paratuberculosis
ccgcucggcucgauccac

SEQ ID NO: 816980 - RNA, 13 nt, Mycobacterium avium subsp. paratuberculosis
ccgcucgggcccg

SEQ ID NO: 816981 - RNA, 16 nt, Mycobacterium avium subsp. paratuberculosis
ccgcucgggcccgcgc

SEQ ID NO: 816982 - RNA, 20 nt, Mycobacterium avium subsp. paratuberculosis
ccgcucgggcccgcgcaccg

SEQ ID NO: 816983 - RNA, 13 nt, Mycobacterium avium subsp. paratuberculosis
ccgcucgggcgcc

SEQ ID NO: 816984 - RNA, 20 nt, Mycobacterium avium subsp. paratuberculosis
ccgcugaaagcucgcgucga

SEQ ID NO: 816985 - RNA, 21 nt, Mycobacterium avium subsp. paratuberculosis
ccgcugaaagcucgcgucgac

SEQ ID NO: 816986 - RNA, 16 nt, Mycobacterium avium subsp. paratuberculosis
ccgcugaagccgaacg

SEQ ID NO: 816987 - RNA, 23 nt, Mycobacterium avium subsp. paratuberculosis
ccgcugaagccgaacgcgcuguc

SEQ ID NO: 816988 - RNA, 21 nt, Mycobacterium avium subsp. paratuberculosis
ccgcugaccaggaagaugccg

SEQ ID NO: 816989 - RNA, 22 nt, Mycobacterium avium subsp. paratuberculosis
ccgcugaccaggaagaugccga

SEQ ID NO: 816990 - RNA, 15 nt, Mycobacterium avium subsp. paratuberculosis
ccgcugaccaggccg

SEQ ID NO: 816991 - RNA, 16 nt, Mycobacterium avium subsp. paratuberculosis
ccgcugaccgccgcgc

SEQ ID NO: 816992 - RNA, 16 nt, Mycobacterium avium subsp. paratuberculosis
ccgcugacgauggcga

SEQ ID NO: 816993 - RNA, 22 nt, Mycobacterium avium subsp. paratuberculosis
ccgcugacgauggcgaccgcgc

SEQ ID NO: 816994 - RNA, 20 nt, Mycobacterium avium subsp. paratuberculosis
ccgcugacggucgccgacuc

SEQ ID NO: 816995 - RNA, 20 nt, Mycobacterium avium subsp. paratuberculosis
ccgcugacugcgaucgccga

SEQ ID NO: 816996 - RNA, 23 nt, Mycobacterium avium subsp. paratuberculosis
ccgcugacugcgaucgccgacgc

SEQ ID NO: 816997 - RNA, 22 nt, Mycobacterium avium subsp. paratuberculosis
ccgcugcggcacaccagcguuc

SEQ ID NO: 816998 - RNA, 20 nt, Mycobacterium avium subsp. paratuberculosis
ccgcucuucgacgacccgau

SEQ ID NO: 816999 - RNA, 22 nt, Mycobacterium avium subsp. paratuberculosis
ccgcucuucggucaucgugauc

SEQ ID NO: 817000 - RNA, 18 nt, Mycobacterium avium subsp. paratuberculosis
ccgcucgucggccagcga

SEQ ID NO: 817001 - RNA, 14 nt, Mycobacterium avium subsp. paratuberculosis
ccgcucgucgggaa

SEQ ID NO: 817002 - RNA, 22 nt, Mycobacterium avium subsp. paratuberculosis
ccgcucgucgggaacgccgauc

SEQ ID NO: 817003 - RNA, 13 nt, Mycobacterium avium subsp. paratuberculosis
ccgcucgucgggc

SEQ ID NO: 817004 - RNA, 15 nt, Mycobacterium avium subsp. paratuberculosis
ccgcucgucgggcac

SEQ ID NO: 817005 - RNA, 16 nt, Mycobacterium avium subsp. paratuberculosis
ccgcuggcgccggcgu

SEQ ID NO: 817006 - RNA, 14 nt, Mycobacterium avium subsp. paratuberculosis
ccgcuggcccggcg

SEQ ID NO: 817007 - RNA, 22 nt, Mycobacterium avium subsp. paratuberculosis
ccgcuggccgccccgaacagcg

SEQ ID NO: 817008 - RNA, 13 nt, Mycobacterium avium subsp. paratuberculosis
ccgcuggccgcgc

SEQ ID NO: 817009 - RNA, 19 nt, Mycobacterium avium subsp. paratuberculosis
ccgcuggccgcgccacagc

SEQ ID NO: 817010 - RNA, 22 nt, Mycobacterium avium subsp. paratuberculosis
ccgcuggccgcgccacagcguc

SEQ ID NO: 817011 - RNA, 15 nt, Mycobacterium avium subsp. paratuberculosis
ccgcuggaucccggu

SEQ ID NO: 817012 - RNA, 18 nt, Mycobacterium avium subsp. paratuberculosis
ccgcuggaucccggugag

SEQ ID NO: 817013 - RNA, 19 nt, Mycobacterium avium subsp. paratuberculosis
ccgcuggauuccaccgugg

SEQ ID NO: 817014 - RNA, 22 nt, Mycobacterium avium subsp. paratuberculosis
ccgcugcgugcccggaucgccg

SEQ ID NO: 817015 - RNA, 14 nt, Mycobacterium avium subsp. paratuberculosis
ccgcugcggcuggg

SEQ ID NO: 817016 - RNA, 12 nt, Mycobacterium avium subsp. paratuberculosis
ccgcugcgggcc

SEQ ID NO: 817017 - RNA, 22 nt, Mycobacterium avium subsp. paratuberculosis
ccgcugcuccggguccgcggug

SEQ ID NO: 817018 - RNA, 20 nt, Mycobacterium avium subsp. paratuberculosis
ccgcugcucgaccucggcga

SEQ ID NO: 817019 - RNA, 24 nt, Mycobacterium avium subsp. paratuberculosis
ccgcugcucgaccucggcgaccag

SEQ ID NO: 817020 - RNA, 18 nt, Mycobacterium avium subsp. paratuberculosis
ccgcugcugcucggccgc

SEQ ID NO: 817021 - RNA, 21 nt, Mycobacterium avium subsp. paratuberculosis
ccgcugcugcucggccgcauc

SEQ ID NO: 817022 - RNA, 13 nt, Mycobacterium avium subsp. paratuberculosis
ccgcugcugcugc

SEQ ID NO: 817023 - RNA, 19 nt, Mycobacterium avium subsp. paratuberculosis
ccgcugcugggugccgcgu

SEQ ID NO: 817024 - RNA, 18 nt, Mycobacterium avium subsp. paratuberculosis
ccgcuggaacagcgggcc

SEQ ID NO: 817025 - RNA, 20 nt, Mycobacterium avium subsp. paratuberculosis
ccgcuggaacagcgggccgg

SEQ ID NO: 817026 - RNA, 22 nt, Mycobacterium avium subsp. paratuberculosis
ccgcuggaacagcgggccggcg

SEQ ID NO: 817027 - RNA, 24 nt, Mycobacterium avium subsp. paratuberculosis
ccgcuggaacagcgggccggcguc

SEQ ID NO: 817028 - RNA, 16 nt, Mycobacterium avium subsp. paratuberculosis
ccgccauccguucggc

SEQ ID NO: 817029 - RNA, 18 nt, Mycobacterium avium subsp. paratuberculosis
ccgccaucgaucgggcgu

SEQ ID NO: 817030 - RNA, 22 nt, Mycobacterium avium subsp. paratuberculosis
ccgccaucgaucgggcgucgca

SEQ ID NO: 817031 - RNA, 23 nt, Mycobacterium avium subsp. paratuberculosis
ccgccaucgaucgggcgucgcag

SEQ ID NO: 817032 - RNA, 19 nt, Mycobacterium avium subsp. paratuberculosis
ccgccauccgcgccgaacg

SEQ ID NO: 817033 - RNA, 20 nt, Mycobacterium avium subsp. paratuberculosis
ccgccauccgcgccgaacgc

SEQ ID NO: 817034 - RNA, 20 nt, Mycobacterium avium subsp. paratuberculosis
ccgcccgguccgggucgcug

SEQ ID NO: 817035 - RNA, 16 nt, Mycobacterium avium subsp. paratuberculosis
ccgcccguagacccac

SEQ ID NO: 817036 - RNA, 17 nt, Mycobacterium avium subsp. paratuberculosis
ccgcccguagacccaca

SEQ ID NO: 817037 - RNA, 21 nt, Mycobacterium avium subsp. paratuberculosis
ccgcccguagaugcggcccag

SEQ ID NO: 817038 - RNA, 14 nt, Mycobacterium avium subsp. paratuberculosis
ccgcccguccgggc

SEQ ID NO: 817039 - RNA, 17 nt, Mycobacterium avium subsp. paratuberculosis
ccgcccguccgggccgg

SEQ ID NO: 817040 - RNA, 20 nt, Mycobacterium avium subsp. paratuberculosis
ccgcccguccgggccggcca

SEQ ID NO: 817041 - RNA, 21 nt, Mycobacterium avium subsp. paratuberculosis
ccgcccguccgggccggccag

SEQ ID NO: 817042 - RNA, 21 nt, Mycobacterium avium subsp. paratuberculosis
ccgcccgucgccuccugcugg

SEQ ID NO: 817043 - RNA, 13 nt, Mycobacterium avium subsp. paratuberculosis
ccgccgagacggc

SEQ ID NO: 817044 - RNA, 14 nt, Mycobacterium avium subsp. paratuberculosis
ccgcccucaggcgu

SEQ ID NO: 817045 - RNA, 18 nt, Mycobacterium avium subsp. paratuberculosis
ccgccgacgguggccccc

SEQ ID NO: 817046 - RNA, 20 nt, Mycobacterium avium subsp. paratuberculosis
ccgccgacuccccgcccggc

SEQ ID NO: 817047 - RNA, 20 nt, Mycobacterium avium subsp. paratuberculosis
ccgccgagauccaccgcgcg

SEQ ID NO: 817048 - RNA, 21 nt, Mycobacterium avium subsp. paratuberculosis
ccgccgagauccaccgcgcgg

SEQ ID NO: 817049 - RNA, 15 nt, Mycobacterium avium subsp. paratuberculosis
ccgccgagcagauca

SEQ ID NO: 817050 - RNA, 23 nt, Mycobacterium avium subsp. paratuberculosis
ccgccgagcagaucacguugauc

SEQ ID NO: 817051 - RNA, 13 nt, Mycobacterium avium subsp. paratuberculosis
ccgccgagccgcg

SEQ ID NO: 817052 - RNA, 15 nt, Mycobacterium avium subsp. paratuberculosis
ccgccgagccgcggg

SEQ ID NO: 817053 - RNA, 17 nt, Mycobacterium avium subsp. paratuberculosis
ccgccgagccgcgggug

SEQ ID NO: 817054 - RNA, 20 nt, Mycobacterium avium subsp. paratuberculosis
ccgccgagccgcgggugacg

SEQ ID NO: 817055 - RNA, 16 nt, Mycobacterium avium subsp. paratuberculosis
ccgccgagccggcacg

SEQ ID NO: 817056 - RNA, 17 nt, Mycobacterium avium subsp. paratuberculosis
ccgccgagccggcacgg

SEQ ID NO: 817057 - RNA, 20 nt, Mycobacterium avium subsp. paratuberculosis
ccgccgagccggcacggccg

SEQ ID NO: 817058 - RNA, 15 nt, Mycobacterium avium subsp. paratuberculosis
ccgccgagccgucgu

SEQ ID NO: 817059 - RNA, 16 nt, Mycobacterium avium subsp. paratuberculosis
ccgccgagccgucguc

SEQ ID NO: 817060 - RNA, 13 nt, Mycobacterium avium subsp. paratuberculosis
ccgccgacggcug

SEQ ID NO: 817061 - RNA, 14 nt, Mycobacterium avium subsp. paratuberculosis
ccgccgacggcugc

SEQ ID NO: 817062 - RNA, 15 nt, Mycobacterium avium subsp. paratuberculosis
ccgccgacggcugcc

SEQ ID NO: 817063 - RNA, 13 nt, Mycobacterium avium subsp. paratuberculosis
ccgccgacgccug

SEQ ID NO: 817064 - RNA, 15 nt, Mycobacterium avium subsp. paratuberculosis
ccgccgacgccugcg

SEQ ID NO: 817065 - RNA, 17 nt, Mycobacterium avium subsp. paratuberculosis
ccgccgacgccugcgcg

SEQ ID NO: 817066 - RNA, 15 nt, Mycobacterium avium subsp. paratuberculosis
ccgccgacggagacg

SEQ ID NO: 817067 - RNA, 19 nt, Mycobacterium avium subsp. paratuberculosis
ccgccgacggagacgacca

SEQ ID NO: 817068 - RNA, 22 nt, Mycobacterium avium subsp. paratuberculosis
ccgccgacggagacgaccaggu

SEQ ID NO: 817069 - RNA, 22 nt, Mycobacterium avium subsp. paratuberculosis
ccgccgacgaagaugcgcccgg

SEQ ID NO: 817070 - RNA, 22 nt, Mycobacterium avium subsp. paratuberculosis
ccgccgacgacggcgaacgucg

SEQ ID NO: 817071 - RNA, 14 nt, Mycobacterium avium subsp. paratuberculosis
ccgccgacgauacg

SEQ ID NO: 817072 - RNA, 13 nt, Mycobacterium avium subsp. paratuberculosis
ccgccgaccgccg

SEQ ID NO: 817073 - RNA, 16 nt, Mycobacterium avium subsp. paratuberculosis
ccgccgaccgguccgc

SEQ ID NO: 817074 - RNA, 21 nt, Mycobacterium avium subsp. paratuberculosis
ccgccgaccgguccgccgccg

SEQ ID NO: 817075 - RNA, 17 nt, Mycobacterium avium subsp. paratuberculosis
ccgcccucgccccggau

SEQ ID NO: 817076 - RNA, 18 nt, Mycobacterium avium subsp. paratuberculosis
ccgcccucgccccggaug

SEQ ID NO: 817077 - RNA, 18 nt, Mycobacterium avium subsp. paratuberculosis
ccgcccucgcccucgcug

SEQ ID NO: 817078 - RNA, 14 nt, Mycobacterium avium subsp. paratuberculosis
ccgcccucggccgu

SEQ ID NO: 817079 - RNA, 21 nt, Mycobacterium avium subsp. paratuberculosis
ccgcccucggccguaccggcg

SEQ ID NO: 817080 - RNA, 15 nt, Mycobacterium avium subsp. paratuberculosis
ccgcccucggugacg

SEQ ID NO: 817081 - RNA, 12 nt, Mycobacterium avium subsp. paratuberculosis
ccgccgagcaga

SEQ ID NO: 817082 - RNA, 15 nt, Mycobacterium avium subsp. paratuberculosis
ccgccgagcgggcga

SEQ ID NO: 817083 - RNA, 11 nt, Mycobacterium avium subsp. paratuberculosis
ccgccgagcgu

SEQ ID NO: 817084 - RNA, 15 nt, Mycobacterium avium subsp. paratuberculosis
ccgccgagcgucacg

SEQ ID NO: 817085 - RNA, 18 nt, Mycobacterium avium subsp. paratuberculosis
ccgccgaggacacguugg

SEQ ID NO: 817086 - RNA, 15 nt, Mycobacterium avium subsp. paratuberculosis
ccgccgaggcgaugc

SEQ ID NO: 817087 - RNA, 17 nt, Mycobacterium avium subsp. paratuberculosis
ccgccgagucgcgccgc

SEQ ID NO: 817088 - RNA, 19 nt, Mycobacterium avium subsp. paratuberculosis
ccgccgagucgcgccgcgu

SEQ ID NO: 817089 - RNA, 22 nt, Mycobacterium avium subsp. paratuberculosis
ccgccgagucgcgccgcgucgc

SEQ ID NO: 817090 - RNA, 17 nt, Mycobacterium avium subsp. paratuberculosis
ccgccgagggccagcag

SEQ ID NO: 817091 - RNA, 19 nt, Mycobacterium avium subsp. paratuberculosis
ccgccgagggccagcagcc

SEQ ID NO: 817092 - RNA, 20 nt, Mycobacterium avium subsp. paratuberculosis
ccgccgagggccagcagcca

SEQ ID NO: 817093 - RNA, 22 nt, Mycobacterium avium subsp. paratuberculosis
ccgccgagggcccgggcaggca

SEQ ID NO: 817094 - RNA, 21 nt, Mycobacterium avium subsp. paratuberculosis
ccgccgcacacuuccgggaag

SEQ ID NO: 817095 - RNA, 14 nt, Mycobacterium avium subsp. paratuberculosis
ccgccgcacccagc

SEQ ID NO: 817096 - RNA, 16 nt, Mycobacterium avium subsp. paratuberculosis
ccgccgcacccagcgg

SEQ ID NO: 817097 - RNA, 17 nt, Mycobacterium avium subsp. paratuberculosis
ccgccgcacccagcggg

SEQ ID NO: 817098 - RNA, 18 nt, Mycobacterium avium subsp. paratuberculosis
ccgccgcacccagcgggc

SEQ ID NO: 817099 - RNA, 13 nt, Mycobacterium avium subsp. paratuberculosis
ccgccgaucaaca

SEQ ID NO: 817100 - RNA, 19 nt, Mycobacterium avium subsp. paratuberculosis
ccgccgauuccggccggcc

SEQ ID NO: 817101 - RNA, 17 nt, Mycobacterium avium subsp. paratuberculosis
ccgccgcaacagccggc

SEQ ID NO: 817102 - RNA, 18 nt, Mycobacterium avium subsp. paratuberculosis
ccgccgcaacagccggcc

SEQ ID NO: 817103 - RNA, 20 nt, Mycobacterium avium subsp. paratuberculosis
ccgccgcaacagccggcccg

SEQ ID NO: 817104 - RNA, 22 nt, Mycobacterium avium subsp. paratuberculosis
ccgccgcaacagccggcccgag

SEQ ID NO: 817105 - RNA, 13 nt, Mycobacterium avium subsp. paratuberculosis
ccgccgcaccggc

SEQ ID NO: 817106 - RNA, 15 nt, Mycobacterium avium subsp. paratuberculosis
ccgccgcaccggccg

SEQ ID NO: 817107 - RNA, 18 nt, Mycobacterium avium subsp. paratuberculosis
ccgccgcaccggccggcc

SEQ ID NO: 817108 - RNA, 17 nt, Mycobacterium avium subsp. paratuberculosis
ccgccgcaccgucgugc

SEQ ID NO: 817109 - RNA, 17 nt, Mycobacterium avium subsp. paratuberculosis
ccgccgcaccucgccgg

SEQ ID NO: 817110 - RNA, 20 nt, Mycobacterium avium subsp. paratuberculosis
ccgccgcaccucgccggccg

SEQ ID NO: 817111 - RNA, 22 nt, Mycobacterium avium subsp. paratuberculosis
ccgccgcagcccaggcccagca

SEQ ID NO: 817112 - RNA, 18 nt, Mycobacterium avium subsp. paratuberculosis
ccgccgccgucgguguag

SEQ ID NO: 817113 - RNA, 23 nt, Mycobacterium avium subsp. paratuberculosis
ccgccgccgugcauccagccguc

SEQ ID NO: 817114 - RNA, 13 nt, Mycobacterium avium subsp. paratuberculosis
ccgccgccgucgg

SEQ ID NO: 817115 - RNA, 18 nt, Mycobacterium avium subsp. paratuberculosis
ccgccgccugagcccgcc

SEQ ID NO: 817116 - RNA, 13 nt, Mycobacterium avium subsp. paratuberculosis
ccgccgccgcugu

SEQ ID NO: 817117 - RNA, 13 nt, Mycobacterium avium subsp. paratuberculosis
ccgccgccgcggg

SEQ ID NO: 817118 - RNA, 13 nt, Mycobacterium avium subsp. paratuberculosis
ccgccgccggcgc

SEQ ID NO: 817119 - RNA, 15 nt, Mycobacterium avium subsp. paratuberculosis
ccgccgccggcgcug

SEQ ID NO: 817120 - RNA, 14 nt, Mycobacterium avium subsp. paratuberculosis
ccgccgccggcggc

SEQ ID NO: 817121 - RNA, 14 nt, Mycobacterium avium subsp. paratuberculosis
ccgccgccggcguc

SEQ ID NO: 817122 - RNA, 12 nt, Mycobacterium avium subsp. paratuberculosis
ccgccgccgggc

SEQ ID NO: 817123 - RNA, 15 nt, Mycobacterium avium subsp. paratuberculosis
ccgccgccgaacagc

SEQ ID NO: 817124 - RNA, 15 nt, Mycobacterium avium subsp. paratuberculosis
ccgccgcccgucagc

SEQ ID NO: 817125 - RNA, 14 nt, Mycobacterium avium subsp. paratuberculosis
ccgccgccgcgacc

SEQ ID NO: 817126 - RNA, 13 nt, Mycobacterium avium subsp. paratuberculosis
ccgccgcagcgca

SEQ ID NO: 817127 - RNA, 13 nt, Mycobacterium avium subsp. paratuberculosis
ccgccgcagcggc

SEQ ID NO: 817128 - RNA, 16 nt, Mycobacterium avium subsp. paratuberculosis
ccgccgcagcggcgcc

SEQ ID NO: 817129 - RNA, 17 nt, Mycobacterium avium subsp. paratuberculosis
ccgccgcagcggcgccg

SEQ ID NO: 817130 - RNA, 18 nt, Mycobacterium avium subsp. paratuberculosis
ccgccgcagcggcgccgc

SEQ ID NO: 817131 - RNA, 13 nt, Mycobacterium avium subsp. paratuberculosis
ccgccgcaggcga

SEQ ID NO: 817132 - RNA, 20 nt, Mycobacterium avium subsp. paratuberculosis
ccgccgcauaccgcccgcgc

SEQ ID NO: 817133 - RNA, 23 nt, Mycobacterium avium subsp. paratuberculosis
ccgccgcauaccgcccgcgcugg

SEQ ID NO: 817134 - RNA, 13 nt, Mycobacterium avium subsp. paratuberculosis
ccgccgcccgcgc

SEQ ID NO: 817135 - RNA, 16 nt, Mycobacterium avium subsp. paratuberculosis
ccgccgcccgcgcggc

SEQ ID NO: 817136 - RNA, 17 nt, Mycobacterium avium subsp. paratuberculosis
ccgccgcccgcgcggcg

SEQ ID NO: 817137 - RNA, 18 nt, Mycobacterium avium subsp. paratuberculosis
ccgccgcccgcgcggcgg

SEQ ID NO: 817138 - RNA, 23 nt, Mycobacterium avium subsp. paratuberculosis
ccgccgcuagucgcccagcagcc

SEQ ID NO: 817139 - RNA, 13 nt, Mycobacterium avium subsp. paratuberculosis
ccgccgcucaccg

SEQ ID NO: 817140 - RNA, 14 nt, Mycobacterium avium subsp. paratuberculosis
ccgccgcucaccgc

SEQ ID NO: 817141 - RNA, 17 nt, Mycobacterium avium subsp. paratuberculosis
ccgccgcucaccgccga

SEQ ID NO: 817142 - RNA, 18 nt, Mycobacterium avium subsp. paratuberculosis
ccgccgcucaccgccgag

SEQ ID NO: 817143 - RNA, 22 nt, Mycobacterium avium subsp. paratuberculosis
ccgccgcucaccgccgagccgc

SEQ ID NO: 817144 - RNA, 23 nt, Mycobacterium avium subsp. paratuberculosis
ccgccgcucagcgauugcggccg

SEQ ID NO: 817145 - RNA, 14 nt, Mycobacterium avium subsp. paratuberculosis
ccgccgcugacgcg

SEQ ID NO: 817146 - RNA, 20 nt, Mycobacterium avium subsp. paratuberculosis
ccgccgcugacgcggcgggc

SEQ ID NO: 817147 - RNA, 23 nt, Mycobacterium avium subsp. paratuberculosis
ccgccgcugacgcggcgggcaua

SEQ ID NO: 817148 - RNA, 16 nt, Mycobacterium avium subsp. paratuberculosis
ccgccgcugcagcugc

SEQ ID NO: 817149 - RNA, 13 nt, Mycobacterium avium subsp. paratuberculosis
ccgccggccagcu

SEQ ID NO: 817150 - RNA, 16 nt, Mycobacterium avium subsp. paratuberculosis
ccgccggccagcuccg

SEQ ID NO: 817151 - RNA, 17 nt, Mycobacterium avium subsp. paratuberculosis
ccgccggccaggcgacu

SEQ ID NO: 817152 - RNA, 11 nt, Mycobacterium avium subsp. paratuberculosis
ccgccggccac

SEQ ID NO: 817153 - RNA, 15 nt, Mycobacterium avium subsp. paratuberculosis
ccgccggcaccgucc

SEQ ID NO: 817154 - RNA, 17 nt, Mycobacterium avium subsp. paratuberculosis
ccgccggcagcggcugc

SEQ ID NO: 817155 - RNA, 19 nt, Mycobacterium avium subsp. paratuberculosis
ccgccggcagcggcugcug

SEQ ID NO: 817156 - RNA, 20 nt, Mycobacterium avium subsp. paratuberculosis
ccgccggcagcggcugcugc

SEQ ID NO: 817157 - RNA, 15 nt, Mycobacterium avium subsp. paratuberculosis
ccgccgcguggccuc

SEQ ID NO: 817158 - RNA, 12 nt, Mycobacterium avium subsp. paratuberculosis
ccgccgcgucgc

SEQ ID NO: 817159 - RNA, 17 nt, Mycobacterium avium subsp. paratuberculosis
ccgccgcgucgccgccg

SEQ ID NO: 817160 - RNA, 18 nt, Mycobacterium avium subsp. paratuberculosis
ccgccgcgucgccgccgg

SEQ ID NO: 817161 - RNA, 19 nt, Mycobacterium avium subsp. paratuberculosis
ccgccgcgucgccgccggg

SEQ ID NO: 817162 - RNA, 21 nt, Mycobacterium avium subsp. paratuberculosis
ccgccgcgucgccgccgggcg

SEQ ID NO: 817163 - RNA, 20 nt, Mycobacterium avium subsp. paratuberculosis
ccgccgcgucggucagcgcc

SEQ ID NO: 817164 - RNA, 20 nt, Mycobacterium avium subsp. paratuberculosis
ccgccgcgcauccgcaccga

SEQ ID NO: 817165 - RNA, 14 nt, Mycobacterium avium subsp. paratuberculosis
ccgccgcgccaccg

SEQ ID NO: 817166 - RNA, 21 nt, Mycobacterium avium subsp. paratuberculosis
ccgccgcgucgugccgagcgu

SEQ ID NO: 817167 - RNA, 13 nt, Mycobacterium avium subsp. paratuberculosis
ccgccgcgcccgg

SEQ ID NO: 817168 - RNA, 12 nt, Mycobacterium avium subsp. paratuberculosis
ccgccgcgcagg

SEQ ID NO: 817169 - RNA, 19 nt, Mycobacterium avium subsp. paratuberculosis
ccgccgcgcaggccgccga

SEQ ID NO: 817170 - RNA, 15 nt, Mycobacterium avium subsp. paratuberculosis
ccgccgcgcccggcu

SEQ ID NO: 817171 - RNA, 21 nt, Mycobacterium avium subsp. paratuberculosis
ccgccgcgcccggcuucgccg

SEQ ID NO: 817172 - RNA, 20 nt, Mycobacterium avium subsp. paratuberculosis
ccgccgcguacaccggcuga

SEQ ID NO: 817173 - RNA, 21 nt, Mycobacterium avium subsp. paratuberculosis
ccgccgcguacagccagcccg

SEQ ID NO: 817174 - RNA, 21 nt, Mycobacterium avium subsp. paratuberculosis
ccgccgcguaggccaggaccg

SEQ ID NO: 817175 - RNA, 20 nt, Mycobacterium avium subsp. paratuberculosis
ccgccgcgucagcggcgggc

SEQ ID NO: 817176 - RNA, 12 nt, Mycobacterium avium subsp. paratuberculosis
ccgccgcguccg

SEQ ID NO: 817177 - RNA, 13 nt, Mycobacterium avium subsp. paratuberculosis
ccgccgcgauacg

SEQ ID NO: 817178 - RNA, 12 nt, Mycobacterium avium subsp. paratuberculosis
ccgccgcgaccg

SEQ ID NO: 817179 - RNA, 16 nt, Mycobacterium avium subsp. paratuberculosis
ccgccgcgaccgucag

SEQ ID NO: 817180 - RNA, 15 nt, Mycobacterium avium subsp. paratuberculosis
ccgccgcgacgaugc

SEQ ID NO: 817181 - RNA, 18 nt, Mycobacterium avium subsp. paratuberculosis
ccgccgcgaacgggucgg

SEQ ID NO: 817182 - RNA, 14 nt, Mycobacterium avium subsp. paratuberculosis
ccgccgcgagccgc

SEQ ID NO: 817183 - RNA, 22 nt, Mycobacterium avium subsp. paratuberculosis
ccgccgcgaacgggucgggggu

SEQ ID NO: 817184 - RNA, 20 nt, Mycobacterium avium subsp. paratuberculosis
ccgccgcgaacucaggcgcg

SEQ ID NO: 817185 - RNA, 12 nt, Mycobacterium avium subsp. paratuberculosis
ccgccgcgacca

SEQ ID NO: 817186 - RNA, 16 nt, Mycobacterium avium subsp. paratuberculosis
ccgccgcgaccacagc

SEQ ID NO: 817187 - RNA, 19 nt, Mycobacterium avium subsp. paratuberculosis
ccgccgcgacgaugccggc

SEQ ID NO: 817188 - RNA, 17 nt, Mycobacterium avium subsp. paratuberculosis
ccgccgcgacgccgugc

SEQ ID NO: 817189 - RNA, 13 nt, Mycobacterium avium subsp. paratuberculosis
ccgccgcgacggc

SEQ ID NO: 817190 - RNA, 14 nt, Mycobacterium avium subsp. paratuberculosis
ccgccgcgacggcc

SEQ ID NO: 817191 - RNA, 15 nt, Mycobacterium avium subsp. paratuberculosis
ccgccgcgacggccg

SEQ ID NO: 817192 - RNA, 14 nt, Mycobacterium avium subsp. paratuberculosis
ccgccgcgagcaga

SEQ ID NO: 817193 - RNA, 21 nt, Mycobacterium avium subsp. paratuberculosis
ccgccgggggagucggggugc

SEQ ID NO: 817194 - RNA, 23 nt, Mycobacterium avium subsp. paratuberculosis
ccgccgggggagucggggugcuc

SEQ ID NO: 817195 - RNA, 12 nt, Mycobacterium avium subsp. paratuberculosis
ccgccggggugu

SEQ ID NO: 817196 - RNA, 21 nt, Mycobacterium avium subsp. paratuberculosis
ccgccggggugugcagcggga

SEQ ID NO: 817197 - RNA, 15 nt, Mycobacterium avium subsp. paratuberculosis
ccgccggggacccgc

SEQ ID NO: 817198 - RNA, 14 nt, Mycobacterium avium subsp. paratuberculosis
ccgccggguggccg

SEQ ID NO: 817199 - RNA, 15 nt, Mycobacterium avium subsp. paratuberculosis
ccgccggguggccgc

SEQ ID NO: 817200 - RNA, 18 nt, Mycobacterium avium subsp. paratuberculosis
ccgccggguggccgccac

SEQ ID NO: 817201 - RNA, 14 nt, Mycobacterium avium subsp. paratuberculosis
ccgccggguggcgg

SEQ ID NO: 817202 - RNA, 22 nt, Mycobacterium avium subsp. paratuberculosis
ccgccggguccuugcgccccgg

SEQ ID NO: 817203 - RNA, 12 nt, Mycobacterium avium subsp. paratuberculosis
ccgccggggccc

SEQ ID NO: 817204 - RNA, 16 nt, Mycobacterium avium subsp. paratuberculosis
ccgccggggccccaac

SEQ ID NO: 817205 - RNA, 15 nt, Mycobacterium avium subsp. paratuberculosis
ccgccggggcgccgc

SEQ ID NO: 817206 - RNA, 17 nt, Mycobacterium avium subsp. paratuberculosis
ccgccggggcgccgccg

SEQ ID NO: 817207 - RNA, 16 nt, Mycobacterium avium subsp. paratuberculosis
ccgccggggcgggcag

SEQ ID NO: 817208 - RNA, 17 nt, Mycobacterium avium subsp. paratuberculosis
ccgccggggcgggcagc

SEQ ID NO: 817209 - RNA, 18 nt, Mycobacterium avium subsp. paratuberculosis
ccgccggggcgggcagca

SEQ ID NO: 817210 - RNA, 14 nt, Mycobacterium avium subsp. paratuberculosis
ccgccggggcgucg

SEQ ID NO: 817211 - RNA, 20 nt, Mycobacterium avium subsp. paratuberculosis
ccgccggggcgucggacgcc

SEQ ID NO: 817212 - RNA, 12 nt, Mycobacterium avium subsp. paratuberculosis
ccgccggugcca

SEQ ID NO: 817213 - RNA, 13 nt, Mycobacterium avium subsp. paratuberculosis
ccgccggugaucu

SEQ ID NO: 817214 - RNA, 23 nt, Mycobacterium avium subsp. paratuberculosis
ccgccggugaucucccgugcggu

SEQ ID NO: 817215 - RNA, 18 nt, Mycobacterium avium subsp. paratuberculosis
ccgccggugccagcaaca

SEQ ID NO: 817216 - RNA, 12 nt, Mycobacterium avium subsp. paratuberculosis
ccgccggucacg

SEQ ID NO: 817217 - RNA, 16 nt, Mycobacterium avium subsp. paratuberculosis
ccgccggucacggcgu

SEQ ID NO: 817218 - RNA, 21 nt, Mycobacterium avium subsp. paratuberculosis
ccgccgguccagugccggcga

SEQ ID NO: 817219 - RNA, 22 nt, Mycobacterium avium subsp. paratuberculosis
ccgccgguccagugccggcgag

SEQ ID NO: 817220 - RNA, 17 nt, Mycobacterium avium subsp. paratuberculosis
ccgccggucgcccccuc

SEQ ID NO: 817221 - RNA, 20 nt, Mycobacterium avium subsp. paratuberculosis
ccgccggugaagaucagcgc

SEQ ID NO: 817222 - RNA, 16 nt, Mycobacterium avium subsp. paratuberculosis
ccgccggugaccacgc

SEQ ID NO: 817223 - RNA, 15 nt, Mycobacterium avium subsp. paratuberculosis
ccgccgggcugaccg

SEQ ID NO: 817224 - RNA, 13 nt, Mycobacterium avium subsp. paratuberculosis
ccgccgggcgcga

SEQ ID NO: 817225 - RNA, 12 nt, Mycobacterium avium subsp. paratuberculosis
ccgccgggcggg

SEQ ID NO: 817226 - RNA, 16 nt, Mycobacterium avium subsp. paratuberculosis
ccgccgggcgggccgc

SEQ ID NO: 817227 - RNA, 19 nt, Mycobacterium avium subsp. paratuberculosis
ccgccgggcgggccgcagc

SEQ ID NO: 817228 - RNA, 16 nt, Mycobacterium avium subsp. paratuberculosis
ccgccgggcgucgcgc

SEQ ID NO: 817229 - RNA, 15 nt, Mycobacterium avium subsp. paratuberculosis
ccgccgggcggcguc

SEQ ID NO: 817230 - RNA, 14 nt, Mycobacterium avium subsp. paratuberculosis
ccgccggcggccuc

SEQ ID NO: 817231 - RNA, 20 nt, Mycobacterium avium subsp. paratuberculosis
ccgccggcggguuggccguc

SEQ ID NO: 817232 - RNA, 22 nt, Mycobacterium avium subsp. paratuberculosis
ccgccggcggguuggccgucga

SEQ ID NO: 817233 - RNA, 13 nt, Mycobacterium avium subsp. paratuberculosis
ccgccggcggcga

SEQ ID NO: 817234 - RNA, 14 nt, Mycobacterium avium subsp. paratuberculosis
ccgccggcggcgau

SEQ ID NO: 817235 - RNA, 11 nt, Mycobacterium avium subsp. paratuberculosis
ccgccggcggc

SEQ ID NO: 817236 - RNA, 14 nt, Mycobacterium avium subsp. paratuberculosis
ccgccggcgccguc

SEQ ID NO: 817237 - RNA, 12 nt, Mycobacterium avium subsp. paratuberculosis
ccgccggcgcgg

SEQ ID NO: 817238 - RNA, 14 nt, Mycobacterium avium subsp. paratuberculosis
ccgccggcgcccug

SEQ ID NO: 817239 - RNA, 16 nt, Mycobacterium avium subsp. paratuberculosis
ccgccggcccaggcag

SEQ ID NO: 817240 - RNA, 18 nt, Mycobacterium avium subsp. paratuberculosis
ccgccggcccagcuccac

SEQ ID NO: 817241 - RNA, 22 nt, Mycobacterium avium subsp. paratuberculosis
ccgcgaaaauaccgccggccgc

SEQ ID NO: 817242 - RNA, 14 nt, Mycobacterium avium subsp. paratuberculosis
ccgcgaaagcgucg

SEQ ID NO: 817243 - RNA, 15 nt, Mycobacterium avium subsp. paratuberculosis
ccgccugcccgggcg

SEQ ID NO: 817244 - RNA, 19 nt, Mycobacterium avium subsp. paratuberculosis
ccgcgaacaucgccagcaa

SEQ ID NO: 817245 - RNA, 20 nt, Mycobacterium avium subsp. paratuberculosis
ccgcgaacaucgccagcaac

SEQ ID NO: 817246 - RNA, 21 nt, Mycobacterium avium subsp. paratuberculosis
ccgcgaaagugcaacuggcaa

SEQ ID NO: 817247 - RNA, 19 nt, Mycobacterium avium subsp. paratuberculosis
ccgcgaaaucuucgccguc

SEQ ID NO: 817248 - RNA, 20 nt, Mycobacterium avium subsp. paratuberculosis
ccgcgaaaucuucgccguca

SEQ ID NO: 817249 - RNA, 14 nt, Mycobacterium avium subsp. paratuberculosis
ccgccugcgcgauc

SEQ ID NO: 817250 - RNA, 21 nt, Mycobacterium avium subsp. paratuberculosis
ccgccugcgcgaucgccggau

SEQ ID NO: 817251 - RNA, 14 nt, Mycobacterium avium subsp. paratuberculosis
ccgccugcgcgccg

SEQ ID NO: 817252 - RNA, 15 nt, Mycobacterium avium subsp. paratuberculosis
ccgccugcgcgccgu

SEQ ID NO: 817253 - RNA, 24 nt, Mycobacterium avium subsp. paratuberculosis
ccgccugcgcgccgucggcgaugc

SEQ ID NO: 817254 - RNA, 19 nt, Mycobacterium avium subsp. paratuberculosis
ccgccuugggccggucggu

SEQ ID NO: 817255 - RNA, 23 nt, Mycobacterium avium subsp. paratuberculosis
ccgccuugggccggucggucggc

SEQ ID NO: 817256 - RNA, 15 nt, Mycobacterium avium subsp. paratuberculosis
ccgccuugucggcga

SEQ ID NO: 817257 - RNA, 19 nt, Mycobacterium avium subsp. paratuberculosis
ccgcgaaggcggcgucgau

SEQ ID NO: 817258 - RNA, 21 nt, Mycobacterium avium subsp. paratuberculosis
ccgcgaaggcggcgucgaugu

SEQ ID NO: 817259 - RNA, 19 nt, Mycobacterium avium subsp. paratuberculosis
ccgcgaagguggcacgcca

SEQ ID NO: 817260 - RNA, 21 nt, Mycobacterium avium subsp. paratuberculosis
ccgcgaauugagguagucggc

SEQ ID NO: 817261 - RNA, 16 nt, Mycobacterium avium subsp. paratuberculosis
ccgcgaacgccucggc

SEQ ID NO: 817262 - RNA, 20 nt, Mycobacterium avium subsp. paratuberculosis
ccgcgaacgccucggcgagc

SEQ ID NO: 817263 - RNA, 15 nt, Mycobacterium avium subsp. paratuberculosis
ccgcgaacgccucgu

SEQ ID NO: 817264 - RNA, 23 nt, Mycobacterium avium subsp. paratuberculosis
ccgcgaacgccucguuggccagc

SEQ ID NO: 817265 - RNA, 17 nt, Mycobacterium avium subsp. paratuberculosis
ccgcgaagaugucgccg

SEQ ID NO: 817266 - RNA, 18 nt, Mycobacterium avium subsp. paratuberculosis
ccgcgaagaugucgccgu

SEQ ID NO: 817267 - RNA, 23 nt, Mycobacterium avium subsp. paratuberculosis
ccgcgaacgggugaccggcggcc

SEQ ID NO: 817268 - RNA, 16 nt, Mycobacterium avium subsp. paratuberculosis
ccgcgaacucaggcgc

SEQ ID NO: 817269 - RNA, 14 nt, Mycobacterium avium subsp. paratuberculosis
ccgcgaacucgucg

SEQ ID NO: 817270 - RNA, 15 nt, Mycobacterium avium subsp. paratuberculosis
ccgcgaacucgucga

SEQ ID NO: 817271 - RNA, 19 nt, Mycobacterium avium subsp. paratuberculosis
ccgcgaacucgucgacgcc

SEQ ID NO: 817272 - RNA, 17 nt, Mycobacterium avium subsp. paratuberculosis
ccgcgaacucgucgaug

SEQ ID NO: 817273 - RNA, 22 nt, Mycobacterium avium subsp. paratuberculosis
ccgcgaacucgucgaugcacgc

SEQ ID NO: 817274 - RNA, 16 nt, Mycobacterium avium subsp. paratuberculosis
ccgccuccagcacguc

SEQ ID NO: 817275 - RNA, 18 nt, Mycobacterium avium subsp. paratuberculosis
ccgccucccgcagcgcca

SEQ ID NO: 817276 - RNA, 19 nt, Mycobacterium avium subsp. paratuberculosis
ccgccuccgacagccgcac

SEQ ID NO: 817277 - RNA, 21 nt, Mycobacterium avium subsp. paratuberculosis
ccgccucaugccagacgcgca

SEQ ID NO: 817278 - RNA, 18 nt, Mycobacterium avium subsp. paratuberculosis
ccgccucggugagcagcu

SEQ ID NO: 817279 - RNA, 19 nt, Mycobacterium avium subsp. paratuberculosis
ccgccguuggccugguagc

SEQ ID NO: 817280 - RNA, 23 nt, Mycobacterium avium subsp. paratuberculosis
ccgccguuguugagcguggcagc

SEQ ID NO: 817281 - RNA, 14 nt, Mycobacterium avium subsp. paratuberculosis
ccgccucacagcga

SEQ ID NO: 817282 - RNA, 22 nt, Mycobacterium avium subsp. paratuberculosis
ccgccucacagcgacaacgggc

SEQ ID NO: 817283 - RNA, 17 nt, Mycobacterium avium subsp. paratuberculosis
ccgccucacgcagggcc

SEQ ID NO: 817284 - RNA, 18 nt, Mycobacterium avium subsp. paratuberculosis
ccgccucacgcagggcca

SEQ ID NO: 817285 - RNA, 22 nt, Mycobacterium avium subsp. paratuberculosis
ccgccguugcgagucaucgcca

SEQ ID NO: 817286 - RNA, 14 nt, Mycobacterium avium subsp. paratuberculosis
ccgccgucaccgcc

SEQ ID NO: 817287 - RNA, 17 nt, Mycobacterium avium subsp. paratuberculosis
ccgccgucaccgccagg

SEQ ID NO: 817288 - RNA, 22 nt, Mycobacterium avium subsp. paratuberculosis
ccgccgucaccgccaggaccac

SEQ ID NO: 817289 - RNA, 19 nt, Mycobacterium avium subsp. paratuberculosis
ccgccguagccggcggugg

SEQ ID NO: 817290 - RNA, 21 nt, Mycobacterium avium subsp. paratuberculosis
ccgccguagccggcgguggcc

SEQ ID NO: 817291 - RNA, 15 nt, Mycobacterium avium subsp. paratuberculosis
ccgccguagcgccgg

SEQ ID NO: 817292 - RNA, 20 nt, Mycobacterium avium subsp. paratuberculosis
ccgccguagcgccggcaaca

SEQ ID NO: 817293 - RNA, 21 nt, Mycobacterium avium subsp. paratuberculosis
ccgccgguugaucacccgggu

SEQ ID NO: 817294 - RNA, 16 nt, Mycobacterium avium subsp. paratuberculosis
ccgccgguggccgcgc

SEQ ID NO: 817295 - RNA, 17 nt, Mycobacterium avium subsp. paratuberculosis
ccgccgguggccgcgcu

SEQ ID NO: 817296 - RNA, 15 nt, Mycobacterium avium subsp. paratuberculosis
ccgccggugccguug

SEQ ID NO: 817297 - RNA, 16 nt, Mycobacterium avium subsp. paratuberculosis
ccgccggugccguuga

SEQ ID NO: 817298 - RNA, 18 nt, Mycobacterium avium subsp. paratuberculosis
ccgccggugccguugauc

SEQ ID NO: 817299 - RNA, 16 nt, Mycobacterium avium subsp. paratuberculosis
ccgccggugcgcagcu

SEQ ID NO: 817300 - RNA, 23 nt, Mycobacterium avium subsp. paratuberculosis
ccgccgguggagauggccagcac

SEQ ID NO: 817301 - RNA, 13 nt, Mycobacterium avium subsp. paratuberculosis
ccgccgguggccg

SEQ ID NO: 817302 - RNA, 14 nt, Mycobacterium avium subsp. paratuberculosis
ccgccgguggccgc

SEQ ID NO: 817303 - RNA, 12 nt, Mycobacterium avium subsp. paratuberculosis
ccgccgguggcg

SEQ ID NO: 817304 - RNA, 17 nt, Mycobacterium avium subsp. paratuberculosis
ccgccgguggcggcgag

SEQ ID NO: 817305 - RNA, 22 nt, Mycobacterium avium subsp. paratuberculosis
ccgccgguggcgucggugaugc

SEQ ID NO: 817306 - RNA, 18 nt, Mycobacterium avium subsp. paratuberculosis
ccgccggugucggcgacc

SEQ ID NO: 817307 - RNA, 16 nt, Mycobacterium avium subsp. paratuberculosis
ccgcgaccacgccgcg

SEQ ID NO: 817308 - RNA, 24 nt, Mycobacterium avium subsp. paratuberculosis
ccgcgaguucgcgcacgcuggccg

SEQ ID NO: 817309 - RNA, 23 nt, Mycobacterium avium subsp. paratuberculosis
ccgcgaguuguacccuucggccg

SEQ ID NO: 817310 - RNA, 20 nt, Mycobacterium avium subsp. paratuberculosis
ccgcgaggugucgacgcuga

SEQ ID NO: 817311 - RNA, 17 nt, Mycobacterium avium subsp. paratuberculosis
ccgcgagucaccggcuc

SEQ ID NO: 817312 - RNA, 19 nt, Mycobacterium avium subsp. paratuberculosis
ccgcgagucaccggcucgc

SEQ ID NO: 817313 - RNA, 21 nt, Mycobacterium avium subsp. paratuberculosis
ccgcgacggugagcaacaccg

SEQ ID NO: 817314 - RNA, 23 nt, Mycobacterium avium subsp. paratuberculosis
ccgcgacggugagcaacaccggc

SEQ ID NO: 817315 - RNA, 18 nt, Mycobacterium avium subsp. paratuberculosis
ccgcgacgguuguucagc

SEQ ID NO: 817316 - RNA, 20 nt, Mycobacterium avium subsp. paratuberculosis
ccgcgacgguuuccggcuuc

SEQ ID NO: 817317 - RNA, 14 nt, Mycobacterium avium subsp. paratuberculosis
ccgcgacguccauc

SEQ ID NO: 817318 - RNA, 22 nt, Mycobacterium avium subsp. paratuberculosis
ccgcgacguccaucgggaccgc

SEQ ID NO: 817319 - RNA, 12 nt, Mycobacterium avium subsp. paratuberculosis
ccgcgacgucgg

SEQ ID NO: 817320 - RNA, 17 nt, Mycobacterium avium subsp. paratuberculosis
ccgcgacgucgguguag

SEQ ID NO: 817321 - RNA, 23 nt, Mycobacterium avium subsp. paratuberculosis
ccgcgacgucgguguagucggcg

SEQ ID NO: 817322 - RNA, 16 nt, Mycobacterium avium subsp. paratuberculosis
ccgcgacucggugucg

SEQ ID NO: 817323 - RNA, 17 nt, Mycobacterium avium subsp. paratuberculosis
ccgcgacucggugucgc

SEQ ID NO: 817324 - RNA, 14 nt, Mycobacterium avium subsp. paratuberculosis
ccgcgacugucggc

SEQ ID NO: 817325 - RNA, 21 nt, Mycobacterium avium subsp. paratuberculosis
ccgcgacugucggcucgcccg

SEQ ID NO: 817326 - RNA, 21 nt, Mycobacterium avium subsp. paratuberculosis
ccgcgaucaacaccgguccgg

SEQ ID NO: 817327 - RNA, 24 nt, Mycobacterium avium subsp. paratuberculosis
ccgcgaucaacaccgguccggccg

SEQ ID NO: 817328 - RNA, 15 nt, Mycobacterium avium subsp. paratuberculosis
ccgcgaucagcucgu

SEQ ID NO: 817329 - RNA, 21 nt, Mycobacterium avium subsp. paratuberculosis
ccgcgaucagcucguggcggg

SEQ ID NO: 817330 - RNA, 21 nt, Mycobacterium avium subsp. paratuberculosis
ccgcgaucagggcccacagca

SEQ ID NO: 817331 - RNA, 19 nt, Mycobacterium avium subsp. paratuberculosis
ccgcgaucagggccgcggc

SEQ ID NO: 817332 - RNA, 22 nt, Mycobacterium avium subsp. paratuberculosis
ccgcgaucagggccgcggccgc

SEQ ID NO: 817333 - RNA, 14 nt, Mycobacterium avium subsp. paratuberculosis
ccgcgaucaccacc

SEQ ID NO: 817334 - RNA, 15 nt, Mycobacterium avium subsp. paratuberculosis
ccgcgaucaccaccc

SEQ ID NO: 817335 - RNA, 18 nt, Mycobacterium avium subsp. paratuberculosis
ccgcgaucaccaccccgg

SEQ ID NO: 817336 - RNA, 19 nt, Mycobacterium avium subsp. paratuberculosis
ccgcgaucaccaccccggu

SEQ ID NO: 817337 - RNA, 15 nt, Mycobacterium avium subsp. paratuberculosis
ccgcgaugauggcgu

SEQ ID NO: 817338 - RNA, 19 nt, Mycobacterium avium subsp. paratuberculosis
ccgcgaugauggcgucgac

SEQ ID NO: 817339 - RNA, 16 nt, Mycobacterium avium subsp. paratuberculosis
ccgcgaugcaacaccg

SEQ ID NO: 817340 - RNA, 18 nt, Mycobacterium avium subsp. paratuberculosis
ccgcgaugcaacaccgaa

SEQ ID NO: 817341 - RNA, 19 nt, Mycobacterium avium subsp. paratuberculosis
ccgcgaugcaacaccgaac

SEQ ID NO: 817342 - RNA, 20 nt, Mycobacterium avium subsp. paratuberculosis
ccgcgaugcaacaccgaacg

SEQ ID NO: 817343 - RNA, 19 nt, Mycobacterium avium subsp. paratuberculosis
ccgcgacaaggucgaccgc

SEQ ID NO: 817344 - RNA, 20 nt, Mycobacterium avium subsp. paratuberculosis
ccgcgacaaggucgaccgcg

SEQ ID NO: 817345 - RNA, 21 nt, Mycobacterium avium subsp. paratuberculosis
ccgcgacaaggucgaccgcgc

SEQ ID NO: 817346 - RNA, 15 nt, Mycobacterium avium subsp. paratuberculosis
ccgcgacacgucgac

SEQ ID NO: 817347 - RNA, 17 nt, Mycobacterium avium subsp. paratuberculosis
ccgcgacacgucgacac

SEQ ID NO: 817348 - RNA, 19 nt, Mycobacterium avium subsp. paratuberculosis
ccgcgacacgucgacacgc

SEQ ID NO: 817349 - RNA, 18 nt, Mycobacterium avium subsp. paratuberculosis
ccgcgacagccgcccggc

SEQ ID NO: 817350 - RNA, 21 nt, Mycobacterium avium subsp. paratuberculosis
ccgcgacagccgcccggcgcc

SEQ ID NO: 817351 - RNA, 15 nt, Mycobacterium avium subsp. paratuberculosis
ccgcgacaucggcgc

SEQ ID NO: 817352 - RNA, 16 nt, Mycobacterium avium subsp. paratuberculosis
ccgcgacaucggcgcc

SEQ ID NO: 817353 - RNA, 19 nt, Mycobacterium avium subsp. paratuberculosis
ccgcgacaucggcgccgac

SEQ ID NO: 817354 - RNA, 17 nt, Mycobacterium avium subsp. paratuberculosis
ccgcgacaucggugacc

SEQ ID NO: 817355 - RNA, 15 nt, Mycobacterium avium subsp. paratuberculosis
ccgcgacacgccgcg

SEQ ID NO: 817356 - RNA, 17 nt, Mycobacterium avium subsp. paratuberculosis
ccgcgacacgccgcgca

SEQ ID NO: 817357 - RNA, 16 nt, Mycobacterium avium subsp. paratuberculosis
ccgcgaccacagcgcc

SEQ ID NO: 817358 - RNA, 12 nt, Mycobacterium avium subsp. paratuberculosis
ccgcgaccacgc

SEQ ID NO: 817359 - RNA, 12 nt, Mycobacterium avium subsp. paratuberculosis
ccgcgaccagcu

SEQ ID NO: 817360 - RNA, 17 nt, Mycobacterium avium subsp. paratuberculosis
ccgcgacgcugagcgcc

SEQ ID NO: 817361 - RNA, 21 nt, Mycobacterium avium subsp. paratuberculosis
ccgcgacgcugagcgccaggc

SEQ ID NO: 817362 - RNA, 12 nt, Mycobacterium avium subsp. paratuberculosis
ccgcgacgcugc

SEQ ID NO: 817363 - RNA, 14 nt, Mycobacterium avium subsp. paratuberculosis
ccgcgacgcugccg

SEQ ID NO: 817364 - RNA, 20 nt, Mycobacterium avium subsp. paratuberculosis
ccgcgacgcugccggggcgc

SEQ ID NO: 817365 - RNA, 20 nt, Mycobacterium avium subsp. paratuberculosis
ccgcgacccagacuugggca

SEQ ID NO: 817366 - RNA, 16 nt, Mycobacterium avium subsp. paratuberculosis
ccgcgacccaggccgc

SEQ ID NO: 817367 - RNA, 13 nt, Mycobacterium avium subsp. paratuberculosis
ccgcgaccccgga

SEQ ID NO: 817368 - RNA, 17 nt, Mycobacterium avium subsp. paratuberculosis
ccgcgaccccggaccgc

SEQ ID NO: 817369 - RNA, 22 nt, Mycobacterium avium subsp. paratuberculosis
ccgcgaccccggaccgcggaac

SEQ ID NO: 817370 - RNA, 22 nt, Mycobacterium avium subsp. paratuberculosis
ccgcgaccccuccaacggccgc

SEQ ID NO: 817371 - RNA, 13 nt, Mycobacterium avium subsp. paratuberculosis
ccgcgacggccgc

SEQ ID NO: 817372 - RNA, 15 nt, Mycobacterium avium subsp. paratuberculosis
ccgcgacggccgccg

SEQ ID NO: 817373 - RNA, 16 nt, Mycobacterium avium subsp. paratuberculosis
ccgcgacggccgccga

SEQ ID NO: 817374 - RNA, 12 nt, Mycobacterium avium subsp. paratuberculosis
ccgcgacggcga

SEQ ID NO: 817375 - RNA, 15 nt, Mycobacterium avium subsp. paratuberculosis
ccgcgacggcgagcc

SEQ ID NO: 817376 - RNA, 16 nt, Mycobacterium avium subsp. paratuberculosis
ccgcgacggcgagccg

SEQ ID NO: 817377 - RNA, 18 nt, Mycobacterium avium subsp. paratuberculosis
ccgcgacggcgagccggg

SEQ ID NO: 817378 - RNA, 19 nt, Mycobacterium avium subsp. paratuberculosis
ccgcgacggcgagccgggc

SEQ ID NO: 817379 - RNA, 21 nt, Mycobacterium avium subsp. paratuberculosis
ccgcgacggcgagccgggccg

SEQ ID NO: 817380 - RNA, 13 nt, Mycobacterium avium subsp. paratuberculosis
ccgcgacggcgcc

SEQ ID NO: 817381 - RNA, 15 nt, Mycobacterium avium subsp. paratuberculosis
ccgcgacggcgcccg

SEQ ID NO: 817382 - RNA, 16 nt, Mycobacterium avium subsp. paratuberculosis
ccgcgacggcgcccgc

SEQ ID NO: 817383 - RNA, 18 nt, Mycobacterium avium subsp. paratuberculosis
ccgcgacggcgcccgccc

SEQ ID NO: 817384 - RNA, 20 nt, Mycobacterium avium subsp. paratuberculosis
ccgcgacggcgcccgccccg

SEQ ID NO: 817385 - RNA, 13 nt, Mycobacterium avium subsp. paratuberculosis
ccgcgacggcggg

SEQ ID NO: 817386 - RNA, 19 nt, Mycobacterium avium subsp. paratuberculosis
ccgcgacgggcucggcgua

SEQ ID NO: 817387 - RNA, 20 nt, Mycobacterium avium subsp. paratuberculosis
ccgcgacgggcucggcguac

SEQ ID NO: 817388 - RNA, 20 nt, Mycobacterium avium subsp. paratuberculosis
ccgcgacgggcugucccggc

SEQ ID NO: 817389 - RNA, 24 nt, Mycobacterium avium subsp. paratuberculosis
ccgcgacggguugcggaucggugc

SEQ ID NO: 817390 - RNA, 20 nt, Mycobacterium avium subsp. paratuberculosis
ccgcgacggucaguccgggu

SEQ ID NO: 817391 - RNA, 21 nt, Mycobacterium avium subsp. paratuberculosis
ccgcgacggucaguccggguu

SEQ ID NO: 817392 - RNA, 22 nt, Mycobacterium avium subsp. paratuberculosis
ccgcgacggucaguccggguug

SEQ ID NO: 817393 - RNA, 14 nt, Mycobacterium avium subsp. paratuberculosis
ccgcgaugguggcg

SEQ ID NO: 817394 - RNA, 18 nt, Mycobacterium avium subsp. paratuberculosis
ccgcgauguagcggacgg

SEQ ID NO: 817395 - RNA, 20 nt, Mycobacterium avium subsp. paratuberculosis
ccgcgauggcacacagcgug

SEQ ID NO: 817396 - RNA, 23 nt, Mycobacterium avium subsp. paratuberculosis
ccgcgauggcacacagcgugacc

SEQ ID NO: 817397 - RNA, 14 nt, Mycobacterium avium subsp. paratuberculosis
ccgcgauggcccgc

SEQ ID NO: 817398 - RNA, 17 nt, Mycobacterium avium subsp. paratuberculosis
ccgcgauggcccgcgcg

SEQ ID NO: 817399 - RNA, 22 nt, Mycobacterium avium subsp. paratuberculosis
ccgcgauggccuccgacccguc

SEQ ID NO: 817400 - RNA, 19 nt, Mycobacterium avium subsp. paratuberculosis
ccgcgaugcagaacagccg

SEQ ID NO: 817401 - RNA, 20 nt, Mycobacterium avium subsp. paratuberculosis
ccgcgaugcagaacagccgg

SEQ ID NO: 817402 - RNA, 14 nt, Mycobacterium avium subsp. paratuberculosis
ccgcgaugcccgcc

SEQ ID NO: 817403 - RNA, 17 nt, Mycobacterium avium subsp. paratuberculosis
ccgcgaugcccgccggc

SEQ ID NO: 817404 - RNA, 18 nt, Mycobacterium avium subsp. paratuberculosis
ccgcgaugcccgccggcc

SEQ ID NO: 817405 - RNA, 14 nt, Mycobacterium avium subsp. paratuberculosis
ccgcgaucaccgag

SEQ ID NO: 817406 - RNA, 14 nt, Mycobacterium avium subsp. paratuberculosis
ccgcgaucagcccc

SEQ ID NO: 817407 - RNA, 13 nt, Mycobacterium avium subsp. paratuberculosis
ccgcgcagcgugu

SEQ ID NO: 817408 - RNA, 13 nt, Mycobacterium avium subsp. paratuberculosis
ccgcgcagcucga

SEQ ID NO: 817409 - RNA, 17 nt, Mycobacterium avium subsp. paratuberculosis
ccgcgcagcucgacgac

SEQ ID NO: 817410 - RNA, 15 nt, Mycobacterium avium subsp. paratuberculosis
ccgcgcagcggggcg

SEQ ID NO: 817411 - RNA, 13 nt, Mycobacterium avium subsp. paratuberculosis
ccgcgcagcagcg

SEQ ID NO: 817412 - RNA, 17 nt, Mycobacterium avium subsp. paratuberculosis
ccgcgcagccagaccuc

SEQ ID NO: 817413 - RNA, 18 nt, Mycobacterium avium subsp. paratuberculosis
ccgcgcagccagaccucg

SEQ ID NO: 817414 - RNA, 23 nt, Mycobacterium avium subsp. paratuberculosis
ccgcgcagccagaccucgccgac

SEQ ID NO: 817415 - RNA, 16 nt, Mycobacterium avium subsp. paratuberculosis
ccgcgcagccagguga

SEQ ID NO: 817416 - RNA, 19 nt, Mycobacterium avium subsp. paratuberculosis
ccgcgcagccaggugaaca

SEQ ID NO: 817417 - RNA, 12 nt, Mycobacterium avium subsp. paratuberculosis
ccgcgcagcacc

SEQ ID NO: 817418 - RNA, 14 nt, Mycobacterium avium subsp. paratuberculosis
ccgcgcagcaccgc

SEQ ID NO: 817419 - RNA, 19 nt, Mycobacterium avium subsp. paratuberculosis
ccgcgcaaccgggccgcac

SEQ ID NO: 817420 - RNA, 18 nt, Mycobacterium avium subsp. paratuberculosis
ccgcgcaucaucgcccag

SEQ ID NO: 817421 - RNA, 19 nt, Mycobacterium avium subsp. paratuberculosis
ccgcgcaucaucgcccagc

SEQ ID NO: 817422 - RNA, 21 nt, Mycobacterium avium subsp. paratuberculosis
ccgcgcaucaucgcccagcgc

SEQ ID NO: 817423 - RNA, 22 nt, Mycobacterium avium subsp. paratuberculosis
ccgcgcaucaucgcccagcgca

SEQ ID NO: 817424 - RNA, 16 nt, Mycobacterium avium subsp. paratuberculosis
ccgcgcaucccgucga

SEQ ID NO: 817425 - RNA, 16 nt, Mycobacterium avium subsp. paratuberculosis
ccgcgcaggcggcgac

SEQ ID NO: 817426 - RNA, 23 nt, Mycobacterium avium subsp. paratuberculosis
ccgcgcaggcggcgacggccguc

SEQ ID NO: 817427 - RNA, 15 nt, Mycobacterium avium subsp. paratuberculosis
ccgcgcaggccgccg

SEQ ID NO: 817428 - RNA, 16 nt, Mycobacterium avium subsp. paratuberculosis
ccgcgcaggccgccga

SEQ ID NO: 817429 - RNA, 17 nt, Mycobacterium avium subsp. paratuberculosis
ccgcgcaggccgccgac

SEQ ID NO: 817430 - RNA, 19 nt, Mycobacterium avium subsp. paratuberculosis
ccgcgcaggccgccgacga

SEQ ID NO: 817431 - RNA, 16 nt, Mycobacterium avium subsp. paratuberculosis
ccgcgcaggccgucca

SEQ ID NO: 817432 - RNA, 13 nt, Mycobacterium avium subsp. paratuberculosis
ccgcgcaggcggc

SEQ ID NO: 817433 - RNA, 22 nt, Mycobacterium avium subsp. paratuberculosis
ccgcgcagggacgggcgugacg

SEQ ID NO: 817434 - RNA, 17 nt, Mycobacterium avium subsp. paratuberculosis
ccgcgcagucggcgucg

SEQ ID NO: 817435 - RNA, 21 nt, Mycobacterium avium subsp. paratuberculosis
ccgcgcagucggcgucgcggc

SEQ ID NO: 817436 - RNA, 15 nt, Mycobacterium avium subsp. paratuberculosis
ccgcgcaucggucag

SEQ ID NO: 817437 - RNA, 17 nt, Mycobacterium avium subsp. paratuberculosis
ccgcgcauguuggugau

SEQ ID NO: 817438 - RNA, 23 nt, Mycobacterium avium subsp. paratuberculosis
ccgcgcauguuggugaucagccc

SEQ ID NO: 817439 - RNA, 17 nt, Mycobacterium avium subsp. paratuberculosis
ccgcgcauucaccagcu

SEQ ID NO: 817440 - RNA, 18 nt, Mycobacterium avium subsp. paratuberculosis
ccgcgcauucaccagcug

SEQ ID NO: 817441 - RNA, 20 nt, Mycobacterium avium subsp. paratuberculosis
ccgcgccaccccgagcucgg

SEQ ID NO: 817442 - RNA, 13 nt, Mycobacterium avium subsp. paratuberculosis
ccgcgccaccgcg

SEQ ID NO: 817443 - RNA, 15 nt, Mycobacterium avium subsp. paratuberculosis
ccgcgccaccgcggg

SEQ ID NO: 817444 - RNA, 16 nt, Mycobacterium avium subsp. paratuberculosis
ccgcgccacgcgcagg

SEQ ID NO: 817445 - RNA, 12 nt, Mycobacterium avium subsp. paratuberculosis
ccgcgccgacca

SEQ ID NO: 817446 - RNA, 14 nt, Mycobacterium avium subsp. paratuberculosis
ccgcgccgaccagc

SEQ ID NO: 817447 - RNA, 16 nt, Mycobacterium avium subsp. paratuberculosis
ccgggagaaccucaac

SEQ ID NO: 817448 - RNA, 17 nt, Mycobacterium avium subsp. paratuberculosis
ccgggagauacggucgc

SEQ ID NO: 817449 - RNA, 22 nt, Mycobacterium avium subsp. paratuberculosis
ccgggagugcuggacggcccga

SEQ ID NO: 817450 - RNA, 21 nt, Mycobacterium avium subsp. paratuberculosis
ccgggaugccugcccgcgcag

SEQ ID NO: 817451 - RNA, 22 nt, Mycobacterium avium subsp. paratuberculosis
ccgggaugccugcccgcgcagg

SEQ ID NO: 817452 - RNA, 23 nt, Mycobacterium avium subsp. paratuberculosis
ccgggaugccugcccgcgcaggc

SEQ ID NO: 817453 - RNA, 20 nt, Mycobacterium avium subsp. paratuberculosis
ccgggauggcguucugcacc

SEQ ID NO: 817454 - RNA, 21 nt, Mycobacterium avium subsp. paratuberculosis
ccgggauggcguucugcaccg

SEQ ID NO: 817455 - RNA, 23 nt, Mycobacterium avium subsp. paratuberculosis
ccgggauggcguucugcaccgac

SEQ ID NO: 817456 - RNA, 17 nt, Mycobacterium avium subsp. paratuberculosis
ccgggaggacagggagg

SEQ ID NO: 817457 - RNA, 13 nt, Mycobacterium avium subsp. paratuberculosis
ccgggaggccagc

SEQ ID NO: 817458 - RNA, 14 nt, Mycobacterium avium subsp. paratuberculosis
ccgggaggccagca

SEQ ID NO: 817459 - RNA, 16 nt, Mycobacterium avium subsp. paratuberculosis
ccgggaggccagcacc

SEQ ID NO: 817460 - RNA, 12 nt, Mycobacterium avium subsp. paratuberculosis
ccgggacgacgg

SEQ ID NO: 817461 - RNA, 13 nt, Mycobacterium avium subsp. paratuberculosis
ccgggacgacggc

SEQ ID NO: 817462 - RNA, 22 nt, Mycobacterium avium subsp. paratuberculosis
ccgggacgacggcgccgcccgg

SEQ ID NO: 817463 - RNA, 15 nt, Mycobacterium avium subsp. paratuberculosis
ccgggaccggcguca

SEQ ID NO: 817464 - RNA, 15 nt, Mycobacterium avium subsp. paratuberculosis
ccgggaccgucggga

SEQ ID NO: 817465 - RNA, 16 nt, Mycobacterium avium subsp. paratuberculosis
ccgggaccgucgggaa

SEQ ID NO: 817466 - RNA, 14 nt, Mycobacterium avium subsp. paratuberculosis
ccgggauuucccgg

SEQ ID NO: 817467 - RNA, 16 nt, Mycobacterium avium subsp. paratuberculosis
ccgggaugcgccaccg

SEQ ID NO: 817468 - RNA, 21 nt, Mycobacterium avium subsp. paratuberculosis
ccgggaugcgccaccgacacc

SEQ ID NO: 817469 - RNA, 19 nt, Mycobacterium avium subsp. paratuberculosis
ccgggauggugaccagcgc

SEQ ID NO: 817470 - RNA, 14 nt, Mycobacterium avium subsp. paratuberculosis
ccgggcaacagcgc

SEQ ID NO: 817471 - RNA, 16 nt, Mycobacterium avium subsp. paratuberculosis
ccgggcaacagcgcgc

SEQ ID NO: 817472 - RNA, 18 nt, Mycobacterium avium subsp. paratuberculosis
ccgggcaacagcgcgccg

SEQ ID NO: 817473 - RNA, 21 nt, Mycobacterium avium subsp. paratuberculosis
ccgggcaacagcgcgccggcc

SEQ ID NO: 817474 - RNA, 14 nt, Mycobacterium avium subsp. paratuberculosis
ccgggcaaccacag

SEQ ID NO: 817475 - RNA, 18 nt, Mycobacterium avium subsp. paratuberculosis
ccgggcaaccacagcggc

SEQ ID NO: 817476 - RNA, 22 nt, Mycobacterium avium subsp. paratuberculosis
ccgggcaaccacagcggcgcau

SEQ ID NO: 817477 - RNA, 24 nt, Mycobacterium avium subsp. paratuberculosis
ccgggcaaccacagcggcgcauga

SEQ ID NO: 817478 - RNA, 14 nt, Mycobacterium avium subsp. paratuberculosis
ccgggcaccaccac

SEQ ID NO: 817479 - RNA, 16 nt, Mycobacterium avium subsp. paratuberculosis
ccgggcccgcugcagc

SEQ ID NO: 817480 - RNA, 18 nt, Mycobacterium avium subsp. paratuberculosis
ccgggcaaugaugucggc

SEQ ID NO: 817481 - RNA, 21 nt, Mycobacterium avium subsp. paratuberculosis
ccgggcacauagcucaggugc

SEQ ID NO: 817482 - RNA, 22 nt, Mycobacterium avium subsp. paratuberculosis
ccgggcacauagcucaggugcg

SEQ ID NO: 817483 - RNA, 18 nt, Mycobacterium avium subsp. paratuberculosis
ccgggcgacugcgugcug

SEQ ID NO: 817484 - RNA, 22 nt, Mycobacterium avium subsp. paratuberculosis
ccgggcgacugcgugcugggca

SEQ ID NO: 817485 - RNA, 14 nt, Mycobacterium avium subsp. paratuberculosis
ccgggcgaccccgg

SEQ ID NO: 817486 - RNA, 15 nt, Mycobacterium avium subsp. paratuberculosis
ccgggcgaccccggc

SEQ ID NO: 817487 - RNA, 14 nt, Mycobacterium avium subsp. paratuberculosis
ccgggccgccucga

SEQ ID NO: 817488 - RNA, 15 nt, Mycobacterium avium subsp. paratuberculosis
ccgggcgaaccacgg

SEQ ID NO: 817489 - RNA, 20 nt, Mycobacterium avium subsp. paratuberculosis
ccgggcgaaccacgggucgc

SEQ ID NO: 817490 - RNA, 18 nt, Mycobacterium avium subsp. paratuberculosis
ccgggcgaagucgccggc

SEQ ID NO: 817491 - RNA, 20 nt, Mycobacterium avium subsp. paratuberculosis
ccgggcgaagucgccggcca

SEQ ID NO: 817492 - RNA, 21 nt, Mycobacterium avium subsp. paratuberculosis
ccgggauugugcuccaggaug

SEQ ID NO: 817493 - RNA, 23 nt, Mycobacterium avium subsp. paratuberculosis
ccgggccgccgaugcgcccgcug

SEQ ID NO: 817494 - RNA, 17 nt, Mycobacterium avium subsp. paratuberculosis
ccgggccgccgcggcca

SEQ ID NO: 817495 - RNA, 13 nt, Mycobacterium avium subsp. paratuberculosis
ccgggccgccggc

SEQ ID NO: 817496 - RNA, 15 nt, Mycobacterium avium subsp. paratuberculosis
ccgggccgccggccg

SEQ ID NO: 817497 - RNA, 18 nt, Mycobacterium avium subsp. paratuberculosis
ccgggccgccggccgcgg

SEQ ID NO: 817498 - RNA, 19 nt, Mycobacterium avium subsp. paratuberculosis
ccgggcgacaccccgcgag

SEQ ID NO: 817499 - RNA, 18 nt, Mycobacterium avium subsp. paratuberculosis
ccgggcgacaugcccgcg

SEQ ID NO: 817500 - RNA, 18 nt, Mycobacterium avium subsp. paratuberculosis
ccgggccgaaggcggcgc

SEQ ID NO: 817501 - RNA, 22 nt, Mycobacterium avium subsp. paratuberculosis
ccgggccgaaggcggcgccggc

SEQ ID NO: 817502 - RNA, 17 nt, Mycobacterium avium subsp. paratuberculosis
ccgggcccggucccgcg

SEQ ID NO: 817503 - RNA, 23 nt, Mycobacterium avium subsp. paratuberculosis
ccgggcccguagcucgcgccgac

SEQ ID NO: 817504 - RNA, 17 nt, Mycobacterium avium subsp. paratuberculosis
ccgggcccucguccgac

SEQ ID NO: 817505 - RNA, 20 nt, Mycobacterium avium subsp. paratuberculosis
ccgggcccucguccgacagc

SEQ ID NO: 817506 - RNA, 23 nt, Mycobacterium avium subsp. paratuberculosis
ccgggcccucguccgacagcgcc

SEQ ID NO: 817507 - RNA, 16 nt, Mycobacterium avium subsp. paratuberculosis
ccgggccgcagcucgc

SEQ ID NO: 817508 - RNA, 22 nt, Mycobacterium avium subsp. paratuberculosis
ccgggccgcaggguggccagca

SEQ ID NO: 817509 - RNA, 17 nt, Mycobacterium avium subsp. paratuberculosis
ccgggccgcauccagcg

SEQ ID NO: 817510 - RNA, 20 nt, Mycobacterium avium subsp. paratuberculosis
ccgggccgcauccagcgccg

SEQ ID NO: 817511 - RNA, 23 nt, Mycobacterium avium subsp. paratuberculosis
ccgggccgcauccagcgccgcca

SEQ ID NO: 817512 - RNA, 14 nt, Mycobacterium avium subsp. paratuberculosis
ccgggccgccacgg

SEQ ID NO: 817513 - RNA, 16 nt, Mycobacterium avium subsp. paratuberculosis
ccgggccgccacggcg

SEQ ID NO: 817514 - RNA, 18 nt, Mycobacterium avium subsp. paratuberculosis
ccgggccgagcgcgccgc

SEQ ID NO: 817515 - RNA, 20 nt, Mycobacterium avium subsp. paratuberculosis
ccgggccgagcgcgccgccg

SEQ ID NO: 817516 - RNA, 21 nt, Mycobacterium avium subsp. paratuberculosis
ccgggccgagcgcgccgccgc

SEQ ID NO: 817517 - RNA, 17 nt, Mycobacterium avium subsp. paratuberculosis
ccgggccgccaucaccg

SEQ ID NO: 817518 - RNA, 16 nt, Mycobacterium avium subsp. paratuberculosis
ccgggccgcccgcgcg

SEQ ID NO: 817519 - RNA, 17 nt, Mycobacterium avium subsp. paratuberculosis
ccgggccgcccgcgcgu

SEQ ID NO: 817520 - RNA, 19 nt, Mycobacterium avium subsp. paratuberculosis
ccgggccgcccgcgcgugg

SEQ ID NO: 817521 - RNA, 15 nt, Mycobacterium avium subsp. paratuberculosis
ccgggcuggguccga

SEQ ID NO: 817522 - RNA, 14 nt, Mycobacterium avium subsp. paratuberculosis
ccgggcugcgguuc

SEQ ID NO: 817523 - RNA, 16 nt, Mycobacterium avium subsp. paratuberculosis
ccgggcuggccgucgg

SEQ ID NO: 817524 - RNA, 15 nt, Mycobacterium avium subsp. paratuberculosis
ccgggcugucgggca

SEQ ID NO: 817525 - RNA, 17 nt, Mycobacterium avium subsp. paratuberculosis
ccgggcugugggcgcag

SEQ ID NO: 817526 - RNA, 18 nt, Mycobacterium avium subsp. paratuberculosis
ccgggcuguugaccacgg

SEQ ID NO: 817527 - RNA, 21 nt, Mycobacterium avium subsp. paratuberculosis
ccgggcuguugaccacggccu

SEQ ID NO: 817528 - RNA, 13 nt, Mycobacterium avium subsp. paratuberculosis
ccgggcugacccg

SEQ ID NO: 817529 - RNA, 19 nt, Mycobacterium avium subsp. paratuberculosis
ccgggcugaccgucgacca

SEQ ID NO: 817530 - RNA, 14 nt, Mycobacterium avium subsp. paratuberculosis
ccgggcugaccucg

SEQ ID NO: 817531 - RNA, 23 nt, Mycobacterium avium subsp. paratuberculosis
ccgggcugaccucgcgcaccggc

SEQ ID NO: 817532 - RNA, 20 nt, Mycobacterium avium subsp. paratuberculosis
ccgggcugagcugugccgcg

SEQ ID NO: 817533 - RNA, 16 nt, Mycobacterium avium subsp. paratuberculosis
ccgggcugcccaccac

SEQ ID NO: 817534 - RNA, 19 nt, Mycobacterium avium subsp. paratuberculosis
ccgggcugcccaccaccag

SEQ ID NO: 817535 - RNA, 20 nt, Mycobacterium avium subsp. paratuberculosis
ccgggcugcccggcgccggu

SEQ ID NO: 817536 - RNA, 13 nt, Mycobacterium avium subsp. paratuberculosis
ccgggcugcagca

SEQ ID NO: 817537 - RNA, 17 nt, Mycobacterium avium subsp. paratuberculosis
ccgggcgguacgcgccg

SEQ ID NO: 817538 - RNA, 18 nt, Mycobacterium avium subsp. paratuberculosis
ccgggcgggggcugucca

SEQ ID NO: 817539 - RNA, 20 nt, Mycobacterium avium subsp. paratuberculosis
ccgggcggggugguggacgu

SEQ ID NO: 817540 - RNA, 18 nt, Mycobacterium avium subsp. paratuberculosis
ccgggcgggcugcgggca

SEQ ID NO: 817541 - RNA, 14 nt, Mycobacterium avium subsp. paratuberculosis
ccgggcggucgcgu

SEQ ID NO: 817542 - RNA, 17 nt, Mycobacterium avium subsp. paratuberculosis
ccgggcggucgcgucgu

SEQ ID NO: 817543 - RNA, 23 nt, Mycobacterium avium subsp. paratuberculosis
ccgggcggucgcgucgucggcgg

SEQ ID NO: 817544 - RNA, 20 nt, Mycobacterium avium subsp. paratuberculosis
ccgggcggugaccacgccgu

SEQ ID NO: 817545 - RNA, 22 nt, Mycobacterium avium subsp. paratuberculosis
ccgggcggugaccacgccgugc

SEQ ID NO: 817546 - RNA, 18 nt, Mycobacterium avium subsp. paratuberculosis
ccgggcucggucaccccg

SEQ ID NO: 817547 - RNA, 20 nt, Mycobacterium avium subsp. paratuberculosis
ccgggcucggucaccccgga

SEQ ID NO: 817548 - RNA, 13 nt, Mycobacterium avium subsp. paratuberculosis
ccgggcgggccgc

SEQ ID NO: 817549 - RNA, 21 nt, Mycobacterium avium subsp. paratuberculosis
ccgggcgggccgcagcaccac

SEQ ID NO: 817550 - RNA, 15 nt, Mycobacterium avium subsp. paratuberculosis
ccgggcggcggccuc

SEQ ID NO: 817551 - RNA, 17 nt, Mycobacterium avium subsp. paratuberculosis
ccgggcggcggggcugc

SEQ ID NO: 817552 - RNA, 21 nt, Mycobacterium avium subsp. paratuberculosis
ccgggcggcggggcugcccag

SEQ ID NO: 817553 - RNA, 18 nt, Mycobacterium avium subsp. paratuberculosis
ccgggcgccauccgcagc

SEQ ID NO: 817554 - RNA, 18 nt, Mycobacterium avium subsp. paratuberculosis
ccgggcgccauccgccac

SEQ ID NO: 817555 - RNA, 23 nt, Mycobacterium avium subsp. paratuberculosis
ccgggcgccauccgccacccgcu

SEQ ID NO: 817556 - RNA, 13 nt, Mycobacterium avium subsp. paratuberculosis
ccgggcggcgccg

SEQ ID NO: 817557 - RNA, 14 nt, Mycobacterium avium subsp. paratuberculosis
ccgggcggcgccga

SEQ ID NO: 817558 - RNA, 15 nt, Mycobacterium avium subsp. paratuberculosis
ccgggcggcgccgaa

SEQ ID NO: 817559 - RNA, 14 nt, Mycobacterium avium subsp. paratuberculosis
ccgggcgccccgac

SEQ ID NO: 817560 - RNA, 17 nt, Mycobacterium avium subsp. paratuberculosis
ccgggcggccucggcgu

SEQ ID NO: 817561 - RNA, 22 nt, Mycobacterium avium subsp. paratuberculosis
ccgggcggccucggcguccgcg

SEQ ID NO: 817562 - RNA, 12 nt, Mycobacterium avium subsp. paratuberculosis
ccgggcggccug

SEQ ID NO: 817563 - RNA, 17 nt, Mycobacterium avium subsp. paratuberculosis
ccgggcggcgacgucgu

SEQ ID NO: 817564 - RNA, 21 nt, Mycobacterium avium subsp. paratuberculosis
ccgggcggcgaguccggccag

SEQ ID NO: 817565 - RNA, 14 nt, Mycobacterium avium subsp. paratuberculosis
ccgggcgccacccg

SEQ ID NO: 817566 - RNA, 13 nt, Mycobacterium avium subsp. paratuberculosis
ccgggcgccacgc

SEQ ID NO: 817567 - RNA, 17 nt, Mycobacterium avium subsp. paratuberculosis
ccgggcgccacgcuggc

SEQ ID NO: 817568 - RNA, 13 nt, Mycobacterium avium subsp. paratuberculosis
ccgggcgaucagc

SEQ ID NO: 817569 - RNA, 14 nt, Mycobacterium avium subsp. paratuberculosis
ccgggcgaucagcc

SEQ ID NO: 817570 - RNA, 16 nt, Mycobacterium avium subsp. paratuberculosis
ccgggcgaucagcccg

SEQ ID NO: 817571 - RNA, 21 nt, Mycobacterium avium subsp. paratuberculosis
ccgggcgauggugccgccggu

SEQ ID NO: 817572 - RNA, 19 nt, Mycobacterium avium subsp. paratuberculosis
ccgggcgauucgucgucgu

SEQ ID NO: 817573 - RNA, 14 nt, Mycobacterium avium subsp. paratuberculosis
ccggguacaccgac

SEQ ID NO: 817574 - RNA, 14 nt, Mycobacterium avium subsp. paratuberculosis
ccggguacaccggc

SEQ ID NO: 817575 - RNA, 15 nt, Mycobacterium avium subsp. paratuberculosis
ccggguaucgacagu

SEQ ID NO: 817576 - RNA, 16 nt, Mycobacterium avium subsp. paratuberculosis
ccggguauuucgagca

SEQ ID NO: 817577 - RNA, 17 nt, Mycobacterium avium subsp. paratuberculosis
ccggguauuucgagcac

SEQ ID NO: 817578 - RNA, 22 nt, Mycobacterium avium subsp. paratuberculosis
ccgggucaccggaugcaccggc

SEQ ID NO: 817579 - RNA, 13 nt, Mycobacterium avium subsp. paratuberculosis
ccgggucacgaac

SEQ ID NO: 817580 - RNA, 21 nt, Mycobacterium avium subsp. paratuberculosis
ccgggguuuucguggucucgc

SEQ ID NO: 817581 - RNA, 18 nt, Mycobacterium avium subsp. paratuberculosis
ccgggguguaggcgucgg

SEQ ID NO: 817582 - RNA, 22 nt, Mycobacterium avium subsp. paratuberculosis
ccgggguguaggcgucggcgga

SEQ ID NO: 817583 - RNA, 17 nt, Mycobacterium avium subsp. paratuberculosis
ccgggguguccagcggg

SEQ ID NO: 817584 - RNA, 12 nt, Mycobacterium avium subsp. paratuberculosis
ccggggugccgc

SEQ ID NO: 817585 - RNA, 19 nt, Mycobacterium avium subsp. paratuberculosis
ccggggugggcacgucggc

SEQ ID NO: 817586 - RNA, 18 nt, Mycobacterium avium subsp. paratuberculosis
ccggggugggccaucggc

SEQ ID NO: 817587 - RNA, 20 nt, Mycobacterium avium subsp. paratuberculosis
ccggggugggccaucggcag

SEQ ID NO: 817588 - RNA, 20 nt, Mycobacterium avium subsp. paratuberculosis
ccgggguccgcaacgccggc

SEQ ID NO: 817589 - RNA, 17 nt, Mycobacterium avium subsp. paratuberculosis
ccgggguccucucggcg

SEQ ID NO: 817590 - RNA, 21 nt, Mycobacterium avium subsp. paratuberculosis
ccgggguccucucggcgccgu

SEQ ID NO: 817591 - RNA, 22 nt, Mycobacterium avium subsp. paratuberculosis
ccgggguccucucggcgccguc

SEQ ID NO: 817592 - RNA, 18 nt, Mycobacterium avium subsp. paratuberculosis
ccggggucgacagccuga

SEQ ID NO: 817593 - RNA, 20 nt, Mycobacterium avium subsp. paratuberculosis
ccggggucgacagccugacc

SEQ ID NO: 817594 - RNA, 23 nt, Mycobacterium avium subsp. paratuberculosis
ccggggucgacagccugaccgcg

SEQ ID NO: 817595 - RNA, 18 nt, Mycobacterium avium subsp. paratuberculosis
ccggggucgcgcgcgaac

SEQ ID NO: 817596 - RNA, 21 nt, Mycobacterium avium subsp. paratuberculosis
ccggggucggcgcccucggcg

SEQ ID NO: 817597 - RNA, 22 nt, Mycobacterium avium subsp. paratuberculosis
ccggggucggcgcccucggcga

SEQ ID NO: 817598 - RNA, 15 nt, Mycobacterium avium subsp. paratuberculosis
ccggggucugcacga

SEQ ID NO: 817599 - RNA, 12 nt, Mycobacterium avium subsp. paratuberculosis
ccggggugagca

SEQ ID NO: 817600 - RNA, 19 nt, Mycobacterium avium subsp. paratuberculosis
ccggggugagcagggccag

SEQ ID NO: 817601 - RNA, 22 nt, Mycobacterium avium subsp. paratuberculosis
ccggggugagcagggccagcgg

SEQ ID NO: 817602 - RNA, 16 nt, Mycobacterium avium subsp. paratuberculosis
ccggggugcaccgugg

SEQ ID NO: 817603 - RNA, 13 nt, Mycobacterium avium subsp. paratuberculosis
ccggggugcagca

SEQ ID NO: 817604 - RNA, 21 nt, Mycobacterium avium subsp. paratuberculosis
ccggggugcagcaccacgaac

SEQ ID NO: 817605 - RNA, 23 nt, Mycobacterium avium subsp. paratuberculosis
ccgggugacaacggugguggcga

SEQ ID NO: 817606 - RNA, 13 nt, Mycobacterium avium subsp. paratuberculosis
ccgggucgccguc

SEQ ID NO: 817607 - RNA, 14 nt, Mycobacterium avium subsp. paratuberculosis
ccgggucgccgucg

SEQ ID NO: 817608 - RNA, 15 nt, Mycobacterium avium subsp. paratuberculosis
ccgggucgccgucga

SEQ ID NO: 817609 - RNA, 13 nt, Mycobacterium avium subsp. paratuberculosis
ccgggugaccgcc

SEQ ID NO: 817610 - RNA, 14 nt, Mycobacterium avium subsp. paratuberculosis
ccgggugaccggcg

SEQ ID NO: 817611 - RNA, 18 nt, Mycobacterium avium subsp. paratuberculosis
ccgggugauaccggccca

SEQ ID NO: 817612 - RNA, 19 nt, Mycobacterium avium subsp. paratuberculosis
ccgggugauaccggcccag

SEQ ID NO: 817613 - RNA, 16 nt, Mycobacterium avium subsp. paratuberculosis
ccgggugaucaacgcg

SEQ ID NO: 817614 - RNA, 17 nt, Mycobacterium avium subsp. paratuberculosis
ccgggugaucaacgcgg

SEQ ID NO: 817615 - RNA, 19 nt, Mycobacterium avium subsp. paratuberculosis
ccgggugaucaacgcggac

SEQ ID NO: 817616 - RNA, 22 nt, Mycobacterium avium subsp. paratuberculosis
ccgggugaucaacgcggacacg

SEQ ID NO: 817617 - RNA, 17 nt, Mycobacterium avium subsp. paratuberculosis
ccgggucgagcgcgccg

SEQ ID NO: 817618 - RNA, 20 nt, Mycobacterium avium subsp. paratuberculosis
ccgggucgagcggcccgcac

SEQ ID NO: 817619 - RNA, 22 nt, Mycobacterium avium subsp. paratuberculosis
ccgggucgagcggcccgcaccg

SEQ ID NO: 817620 - RNA, 13 nt, Mycobacterium avium subsp. paratuberculosis
ccgggucgagcgc

SEQ ID NO: 817621 - RNA, 15 nt, Mycobacterium avium subsp. paratuberculosis
ccgggucgacgccga

SEQ ID NO: 817622 - RNA, 16 nt, Mycobacterium avium subsp. paratuberculosis
ccgggucgcacagccg

SEQ ID NO: 817623 - RNA, 21 nt, Mycobacterium avium subsp. paratuberculosis
ccgggucgcacagccgcagca

SEQ ID NO: 817624 - RNA, 23 nt, Mycobacterium avium subsp. paratuberculosis
ccgggucgcacagccgcagcagc

SEQ ID NO: 817625 - RNA, 13 nt, Mycobacterium avium subsp. paratuberculosis
ccgggucgcagcg

SEQ ID NO: 817626 - RNA, 17 nt, Mycobacterium avium subsp. paratuberculosis
ccgggucgcagcggcac

SEQ ID NO: 817627 - RNA, 19 nt, Mycobacterium avium subsp. paratuberculosis
ccgggucgcagcggcacgu

SEQ ID NO: 817628 - RNA, 15 nt, Mycobacterium avium subsp. paratuberculosis
ccgggucgccgauca

SEQ ID NO: 817629 - RNA, 17 nt, Mycobacterium avium subsp. paratuberculosis
ccgggucgccgaucacg

SEQ ID NO: 817630 - RNA, 15 nt, Mycobacterium avium subsp. paratuberculosis
ccggguccgcgguga

SEQ ID NO: 817631 - RNA, 21 nt, Mycobacterium avium subsp. paratuberculosis
ccgggucccccgccgaccggu

SEQ ID NO: 817632 - RNA, 17 nt, Mycobacterium avium subsp. paratuberculosis
ccggguccccgccgccg

SEQ ID NO: 817633 - RNA, 21 nt, Mycobacterium avium subsp. paratuberculosis
ccggguccccgccgccgugca

SEQ ID NO: 817634 - RNA, 19 nt, Mycobacterium avium subsp. paratuberculosis
ccggguccgaggugaucgc

SEQ ID NO: 817635 - RNA, 13 nt, Mycobacterium avium subsp. paratuberculosis
ccgggucgaacgg

SEQ ID NO: 817636 - RNA, 16 nt, Mycobacterium avium subsp. paratuberculosis
ccgggucgaacggcaa

SEQ ID NO: 817637 - RNA, 18 nt, Mycobacterium avium subsp. paratuberculosis
ccggguccuugcgccccg

SEQ ID NO: 817638 - RNA, 20 nt, Mycobacterium avium subsp. paratuberculosis
ccgggucgaccgccucggau

SEQ ID NO: 817639 - RNA, 17 nt, Mycobacterium avium subsp. paratuberculosis
ccgggucagcaccacca

SEQ ID NO: 817640 - RNA, 19 nt, Mycobacterium avium subsp. paratuberculosis
ccgggucauccagccgugg

SEQ ID NO: 817641 - RNA, 19 nt, Mycobacterium avium subsp. paratuberculosis
ccgggucauccccgugcgg

SEQ ID NO: 817642 - RNA, 14 nt, Mycobacterium avium subsp. paratuberculosis
ccggguccacgccg

SEQ ID NO: 817643 - RNA, 15 nt, Mycobacterium avium subsp. paratuberculosis
ccggguccagccgcg

SEQ ID NO: 817644 - RNA, 18 nt, Mycobacterium avium subsp. paratuberculosis
ccgggguagaggccgcgg

SEQ ID NO: 817645 - RNA, 13 nt, Mycobacterium avium subsp. paratuberculosis
ccggggguagcgg

SEQ ID NO: 817646 - RNA, 19 nt, Mycobacterium avium subsp. paratuberculosis
ccggggguccagggugccg

SEQ ID NO: 817647 - RNA, 14 nt, Mycobacterium avium subsp. paratuberculosis
ccggggucaccuug

SEQ ID NO: 817648 - RNA, 22 nt, Mycobacterium avium subsp. paratuberculosis
ccggggucaccuuggccggauc

SEQ ID NO: 817649 - RNA, 15 nt, Mycobacterium avium subsp. paratuberculosis
ccggggucagggcgc

SEQ ID NO: 817650 - RNA, 17 nt, Mycobacterium avium subsp. paratuberculosis
ccggggggcggggucga

SEQ ID NO: 817651 - RNA, 21 nt, Mycobacterium avium subsp. paratuberculosis
ccgggggcggugcagccgggg

SEQ ID NO: 817652 - RNA, 13 nt, Mycobacterium avium subsp. paratuberculosis
ccgggggaccagc

SEQ ID NO: 817653 - RNA, 14 nt, Mycobacterium avium subsp. paratuberculosis
ccgggggcaccgcc

SEQ ID NO: 817654 - RNA, 16 nt, Mycobacterium avium subsp. paratuberculosis
ccgggggcaccgccag

SEQ ID NO: 817655 - RNA, 21 nt, Mycobacterium avium subsp. paratuberculosis
ccgggggccgucacaggccgc

SEQ ID NO: 817656 - RNA, 14 nt, Mycobacterium avium subsp. paratuberculosis
ccgggggcgcgggc

SEQ ID NO: 817657 - RNA, 18 nt, Mycobacterium avium subsp. paratuberculosis
ccggggcucgacaggcag

SEQ ID NO: 817658 - RNA, 15 nt, Mycobacterium avium subsp. paratuberculosis
ccggggcuucgaacg

SEQ ID NO: 817659 - RNA, 22 nt, Mycobacterium avium subsp. paratuberculosis
ccggggcuucgaacgcccgcac

SEQ ID NO: 817660 - RNA, 15 nt, Mycobacterium avium subsp. paratuberculosis
ccggggcggcgaugc

SEQ ID NO: 817661 - RNA, 20 nt, Mycobacterium avium subsp. paratuberculosis
ccggggcggcgaugcgcggc

SEQ ID NO: 817662 - RNA, 21 nt, Mycobacterium avium subsp. paratuberculosis
ccggggcggcgaugcgcggcc

SEQ ID NO: 817663 - RNA, 22 nt, Mycobacterium avium subsp. paratuberculosis
ccggggcggcgaugcgcggccc

SEQ ID NO: 817664 - RNA, 15 nt, Mycobacterium avium subsp. paratuberculosis
ccggggcgcagcugc

SEQ ID NO: 817665 - RNA, 14 nt, Mycobacterium avium subsp. paratuberculosis
ccggggcgccgccg

SEQ ID NO: 817666 - RNA, 13 nt, Mycobacterium avium subsp. paratuberculosis
ccggggcgcgcug

SEQ ID NO: 817667 - RNA, 15 nt, Mycobacterium avium subsp. paratuberculosis
ccggggcgcugagca

SEQ ID NO: 817668 - RNA, 15 nt, Mycobacterium avium subsp. paratuberculosis
ccggggccgcggcuc

SEQ ID NO: 817669 - RNA, 18 nt, Mycobacterium avium subsp. paratuberculosis
ccggggccgcggcucgcg

SEQ ID NO: 817670 - RNA, 12 nt, Mycobacterium avium subsp. paratuberculosis
ccggggccggcg

SEQ ID NO: 817671 - RNA, 16 nt, Mycobacterium avium subsp. paratuberculosis
ccggggccggcgaugc

SEQ ID NO: 817672 - RNA, 14 nt, Mycobacterium avium subsp. paratuberculosis
ccggggccggugcg

SEQ ID NO: 817673 - RNA, 22 nt, Mycobacterium avium subsp. paratuberculosis
ccggggccggugcguccgccgg

SEQ ID NO: 817674 - RNA, 17 nt, Mycobacterium avium subsp. paratuberculosis
ccggggccuccagccag

SEQ ID NO: 817675 - RNA, 22 nt, Mycobacterium avium subsp. paratuberculosis
ccggggccuccagccagcgcgc

SEQ ID NO: 817676 - RNA, 19 nt, Mycobacterium avium subsp. paratuberculosis
ccggggcacgcgcgcccgg

SEQ ID NO: 817677 - RNA, 15 nt, Mycobacterium avium subsp. paratuberculosis
ccggggcacgguggg

SEQ ID NO: 817678 - RNA, 13 nt, Mycobacterium avium subsp. paratuberculosis
ccggggcagcacc

SEQ ID NO: 817679 - RNA, 20 nt, Mycobacterium avium subsp. paratuberculosis
ccggggcagcacccgcaccg

SEQ ID NO: 817680 - RNA, 17 nt, Mycobacterium avium subsp. paratuberculosis
ccggggcagcagcaucg

SEQ ID NO: 817681 - RNA, 14 nt, Mycobacterium avium subsp. paratuberculosis
ccggggccagcacc

SEQ ID NO: 817682 - RNA, 17 nt, Mycobacterium avium subsp. paratuberculosis
ccggggccagcacccag

SEQ ID NO: 817683 - RNA, 15 nt, Mycobacterium avium subsp. paratuberculosis
ccggggccagcacgc

SEQ ID NO: 817684 - RNA, 15 nt, Mycobacterium avium subsp. paratuberculosis
ccggggaucaccucg

SEQ ID NO: 817685 - RNA, 20 nt, Mycobacterium avium subsp. paratuberculosis
ccggggaucaccucgcugac

SEQ ID NO: 817686 - RNA, 14 nt, Mycobacterium avium subsp. paratuberculosis
ccggggacgacggc

SEQ ID NO: 817687 - RNA, 13 nt, Mycobacterium avium subsp. paratuberculosis
ccggggacggugc

SEQ ID NO: 817688 - RNA, 15 nt, Mycobacterium avium subsp. paratuberculosis
ccggggaacaccggc

SEQ ID NO: 817689 - RNA, 18 nt, Mycobacterium avium subsp. paratuberculosis
ccggggaacaccggcgag

SEQ ID NO: 817690 - RNA, 20 nt, Mycobacterium avium subsp. paratuberculosis
ccggggaacaccggcgaggu

SEQ ID NO: 817691 - RNA, 23 nt, Mycobacterium avium subsp. paratuberculosis
ccgggcuuggucaugaacgccgg

SEQ ID NO: 817692 - RNA, 15 nt, Mycobacterium avium subsp. paratuberculosis
ccggcuucaccguca

SEQ ID NO: 817693 - RNA, 16 nt, Mycobacterium avium subsp. paratuberculosis
ccggcuucaccgucag

SEQ ID NO: 817694 - RNA, 23 nt, Mycobacterium avium subsp. paratuberculosis
ccggcuggaacaucccggagccg

SEQ ID NO: 817695 - RNA, 19 nt, Mycobacterium avium subsp. paratuberculosis
ccggcugcucgcgcugccg

SEQ ID NO: 817696 - RNA, 21 nt, Mycobacterium avium subsp. paratuberculosis
ccggcugcucgcgcugccgcg

SEQ ID NO: 817697 - RNA, 22 nt, Mycobacterium avium subsp. paratuberculosis
ccggcugcucgcgcugccgcgc

SEQ ID NO: 817698 - RNA, 20 nt, Mycobacterium avium subsp. paratuberculosis
ccggcuggcaggucgcgccg

SEQ ID NO: 817699 - RNA, 23 nt, Mycobacterium avium subsp. paratuberculosis
ccggcuggcaggucgcgccggag

SEQ ID NO: 817700 - RNA, 14 nt, Mycobacterium avium subsp. paratuberculosis
ccggcuuccgagac

SEQ ID NO: 817701 - RNA, 16 nt, Mycobacterium avium subsp. paratuberculosis
ccggcuuccucgcgga

SEQ ID NO: 817702 - RNA, 19 nt, Mycobacterium avium subsp. paratuberculosis
ccggcuucgccgccgcacc

SEQ ID NO: 817703 - RNA, 22 nt, Mycobacterium avium subsp. paratuberculosis
ccggcuucgccgccgcaccggc

SEQ ID NO: 817704 - RNA, 14 nt, Mycobacterium avium subsp. paratuberculosis
ccggcuucgccgcg

SEQ ID NO: 817705 - RNA, 18 nt, Mycobacterium avium subsp. paratuberculosis
ccggcuucgcugcgccgg

SEQ ID NO: 817706 - RNA, 20 nt, Mycobacterium avium subsp. paratuberculosis
ccggcuucgcugcgccggcg

SEQ ID NO: 817707 - RNA, 13 nt, Mycobacterium avium subsp. paratuberculosis
ccggcuucgccgc

SEQ ID NO: 817708 - RNA, 19 nt, Mycobacterium avium subsp. paratuberculosis
ccggcuucgggaucagcgg

SEQ ID NO: 817709 - RNA, 15 nt, Mycobacterium avium subsp. paratuberculosis
ccggcuugccgaucg

SEQ ID NO: 817710 - RNA, 22 nt, Mycobacterium avium subsp. paratuberculosis
ccggcuugccgaucgccgcggc

SEQ ID NO: 817711 - RNA, 14 nt, Mycobacterium avium subsp. paratuberculosis
ccggcuucucggcg

SEQ ID NO: 817712 - RNA, 16 nt, Mycobacterium avium subsp. paratuberculosis
ccggcuucucggcgug

SEQ ID NO: 817713 - RNA, 17 nt, Mycobacterium avium subsp. paratuberculosis
ccggcuucucggcgugc

SEQ ID NO: 817714 - RNA, 14 nt, Mycobacterium avium subsp. paratuberculosis
ccggcuugggcgaa

SEQ ID NO: 817715 - RNA, 17 nt, Mycobacterium avium subsp. paratuberculosis
ccggcuuucgaagagcc

SEQ ID NO: 817716 - RNA, 14 nt, Mycobacterium avium subsp. paratuberculosis
ccggcuugaucucg

SEQ ID NO: 817717 - RNA, 17 nt, Mycobacterium avium subsp. paratuberculosis
ccgggacgaaggugcgc

SEQ ID NO: 817718 - RNA, 22 nt, Mycobacterium avium subsp. paratuberculosis
ccgggacccggaacccgcgugg

SEQ ID NO: 817719 - RNA, 15 nt, Mycobacterium avium subsp. paratuberculosis
ccgggacgcggucca

SEQ ID NO: 817720 - RNA, 16 nt, Mycobacterium avium subsp. paratuberculosis
ccgggacgcgguccag

SEQ ID NO: 817721 - RNA, 20 nt, Mycobacterium avium subsp. paratuberculosis
ccgggacgggggugccgacc

SEQ ID NO: 817722 - RNA, 20 nt, Mycobacterium avium subsp. paratuberculosis
ccgggacggguugcaggcca

SEQ ID NO: 817723 - RNA, 21 nt, Mycobacterium avium subsp. paratuberculosis
ccgggacggguugcaggccac

SEQ ID NO: 817724 - RNA, 23 nt, Mycobacterium avium subsp. paratuberculosis
ccgggaaagcgggugaccgacag

SEQ ID NO: 817725 - RNA, 22 nt, Mycobacterium avium subsp. paratuberculosis
ccgggaccagcgcggugccggu

SEQ ID NO: 817726 - RNA, 14 nt, Mycobacterium avium subsp. paratuberculosis
ccgggaaacccucg

SEQ ID NO: 817727 - RNA, 21 nt, Mycobacterium avium subsp. paratuberculosis
ccgggaaacccucgacgccgg

SEQ ID NO: 817728 - RNA, 18 nt, Mycobacterium avium subsp. paratuberculosis
ccggcugcugcacgacga

SEQ ID NO: 817729 - RNA, 22 nt, Mycobacterium avium subsp. paratuberculosis
ccggcugcugcacgacgaccgc

SEQ ID NO: 817730 - RNA, 13 nt, Mycobacterium avium subsp. paratuberculosis
ccggcugcgcagc

SEQ ID NO: 817731 - RNA, 17 nt, Mycobacterium avium subsp. paratuberculosis
ccggcugcgcagcgcag

SEQ ID NO: 817732 - RNA, 13 nt, Mycobacterium avium subsp. paratuberculosis
ccggcucgaucgc

SEQ ID NO: 817733 - RNA, 17 nt, Mycobacterium avium subsp. paratuberculosis
ccggcugcccgacccgc

SEQ ID NO: 817734 - RNA, 18 nt, Mycobacterium avium subsp. paratuberculosis
ccggcugcccgacccgca

SEQ ID NO: 817735 - RNA, 16 nt, Mycobacterium avium subsp. paratuberculosis
ccggcugcccgcgacu

SEQ ID NO: 817736 - RNA, 21 nt, Mycobacterium avium subsp. paratuberculosis
ccggcugagcgucggucucga

SEQ ID NO: 817737 - RNA, 13 nt, Mycobacterium avium subsp. paratuberculosis
ccggcugcagccg

SEQ ID NO: 817738 - RNA, 14 nt, Mycobacterium avium subsp. paratuberculosis
ccggcugcagccgg

SEQ ID NO: 817739 - RNA, 16 nt, Mycobacterium avium subsp. paratuberculosis
ccggcugcagccgggc

SEQ ID NO: 817740 - RNA, 18 nt, Mycobacterium avium subsp. paratuberculosis
ccggcugcagccgggcgg

SEQ ID NO: 817741 - RNA, 14 nt, Mycobacterium avium subsp. paratuberculosis
ccggcucgagcagu

SEQ ID NO: 817742 - RNA, 16 nt, Mycobacterium avium subsp. paratuberculosis
ccggcucgaucgcggu

SEQ ID NO: 817743 - RNA, 17 nt, Mycobacterium avium subsp. paratuberculosis
ccggcucgaucgcgguc

SEQ ID NO: 817744 - RNA, 19 nt, Mycobacterium avium subsp. paratuberculosis
ccggcucgaucgcggucac

SEQ ID NO: 817745 - RNA, 14 nt, Mycobacterium avium subsp. paratuberculosis
ccggcucgccgggc

SEQ ID NO: 817746 - RNA, 16 nt, Mycobacterium avium subsp. paratuberculosis
ccggcucgcggggugu

SEQ ID NO: 817747 - RNA, 21 nt, Mycobacterium avium subsp. paratuberculosis
ccggcucgcugaucugcggca

SEQ ID NO: 817748 - RNA, 13 nt, Mycobacterium avium subsp. paratuberculosis
ccggcucgccggc

SEQ ID NO: 817749 - RNA, 12 nt, Mycobacterium avium subsp. paratuberculosis
ccggcucggccc

SEQ ID NO: 817750 - RNA, 20 nt, Mycobacterium avium subsp. paratuberculosis
ccggcugacugccggcgacg

SEQ ID NO: 817751 - RNA, 15 nt, Mycobacterium avium subsp. paratuberculosis
ccggcugagcagcuc

SEQ ID NO: 817752 - RNA, 20 nt, Mycobacterium avium subsp. paratuberculosis
ccggcucgaaguggcagcgc

SEQ ID NO: 817753 - RNA, 20 nt, Mycobacterium avium subsp. paratuberculosis
ccggcucgaccucaccccgc

SEQ ID NO: 817754 - RNA, 18 nt, Mycobacterium avium subsp. paratuberculosis
ccggcuacucggacgccg

SEQ ID NO: 817755 - RNA, 19 nt, Mycobacterium avium subsp. paratuberculosis
ccggcuacucggacgccgg

SEQ ID NO: 817756 - RNA, 23 nt, Mycobacterium avium subsp. paratuberculosis
ccggcuacucggacgccggcagc

SEQ ID NO: 817757 - RNA, 18 nt, Mycobacterium avium subsp. paratuberculosis
ccggcuaauucgggccgc

SEQ ID NO: 817758 - RNA, 21 nt, Mycobacterium avium subsp. paratuberculosis
ccggcuaauucgggccgccgc

SEQ ID NO: 817759 - RNA, 20 nt, Mycobacterium avium subsp. paratuberculosis
ccggcuccgcaugcccgggc

SEQ ID NO: 817760 - RNA, 14 nt, Mycobacterium avium subsp. paratuberculosis
ccggcuaccgcgcg

SEQ ID NO: 817761 - RNA, 16 nt, Mycobacterium avium subsp. paratuberculosis
ccggcuaccgcgcgga

SEQ ID NO: 817762 - RNA, 17 nt, Mycobacterium avium subsp. paratuberculosis
ccggcuaccggcgcugg

SEQ ID NO: 817763 - RNA, 18 nt, Mycobacterium avium subsp. paratuberculosis
ccggcguuguccagguag

SEQ ID NO: 817764 - RNA, 22 nt, Mycobacterium avium subsp. paratuberculosis
ccggcguuauuugugcgcuggc

SEQ ID NO: 817765 - RNA, 21 nt, Mycobacterium avium subsp. paratuberculosis
ccggcguugcauuucggcguc

SEQ ID NO: 817766 - RNA, 16 nt, Mycobacterium avium subsp. paratuberculosis
ccggcgugaugacggc

SEQ ID NO: 817767 - RNA, 24 nt, Mycobacterium avium subsp. paratuberculosis
ccggcgugaugacggcggcggugc

SEQ ID NO: 817768 - RNA, 16 nt, Mycobacterium avium subsp. paratuberculosis
ccggcgugcacaggcc

SEQ ID NO: 817769 - RNA, 21 nt, Mycobacterium avium subsp. paratuberculosis
ccggcgugcacaggccgccgc

SEQ ID NO: 817770 - RNA, 22 nt, Mycobacterium avium subsp. paratuberculosis
ccggcgugcacaggccgccgca

SEQ ID NO: 817771 - RNA, 22 nt, Mycobacterium avium subsp. paratuberculosis
ccggcgugcaggauccgcucga

SEQ ID NO: 817772 - RNA, 23 nt, Mycobacterium avium subsp. paratuberculosis
ccggcgugcaggauccgcucgac

SEQ ID NO: 817773 - RNA, 18 nt, Mycobacterium avium subsp. paratuberculosis
ccggcgugccaccgcugg

SEQ ID NO: 817774 - RNA, 15 nt, Mycobacterium avium subsp. paratuberculosis
ccggcgucgccgcug

SEQ ID NO: 817775 - RNA, 20 nt, Mycobacterium avium subsp. paratuberculosis
ccggcgucgaugaugccggc

SEQ ID NO: 817776 - RNA, 13 nt, Mycobacterium avium subsp. paratuberculosis
ccggcgucgauga

SEQ ID NO: 817777 - RNA, 17 nt, Mycobacterium avium subsp. paratuberculosis
ccggcgugcuccagcag

SEQ ID NO: 817778 - RNA, 19 nt, Mycobacterium avium subsp. paratuberculosis
ccggcgugcuccagcaggc

SEQ ID NO: 817779 - RNA, 16 nt, Mycobacterium avium subsp. paratuberculosis
ccggcgugggccgcag

SEQ ID NO: 817780 - RNA, 17 nt, Mycobacterium avium subsp. paratuberculosis
ccggcgugggccgcagc

SEQ ID NO: 817781 - RNA, 21 nt, Mycobacterium avium subsp. paratuberculosis
ccggcgugggccgcagcgcgg

SEQ ID NO: 817782 - RNA, 14 nt, Mycobacterium avium subsp. paratuberculosis
ccggcguggguguc

SEQ ID NO: 817783 - RNA, 16 nt, Mycobacterium avium subsp. paratuberculosis
ccggcgugucgcgugc

SEQ ID NO: 817784 - RNA, 23 nt, Mycobacterium avium subsp. paratuberculosis
ccggcgugucggcgccaccgggu

SEQ ID NO: 817785 - RNA, 17 nt, Mycobacterium avium subsp. paratuberculosis
ccggcguuacccgaacc

SEQ ID NO: 817786 - RNA, 21 nt, Mycobacterium avium subsp. paratuberculosis
ccggcguuacccgaacccagc

SEQ ID NO: 817787 - RNA, 23 nt, Mycobacterium avium subsp. paratuberculosis
ccggcguuacccgaacccagcgc

SEQ ID NO: 817788 - RNA, 22 nt, Mycobacterium avium subsp. paratuberculosis
ccggcguguaguacugcucgac

SEQ ID NO: 817789 - RNA, 20 nt, Mycobacterium avium subsp. paratuberculosis
ccggcggucgcugcagcggc

SEQ ID NO: 817790 - RNA, 17 nt, Mycobacterium avium subsp. paratuberculosis
ccggcggucggaucgag

SEQ ID NO: 817791 - RNA, 15 nt, Mycobacterium avium subsp. paratuberculosis
ccggcggugcggcgg

SEQ ID NO: 817792 - RNA, 17 nt, Mycobacterium avium subsp. paratuberculosis
ccggcguccagcgccgc

SEQ ID NO: 817793 - RNA, 18 nt, Mycobacterium avium subsp. paratuberculosis
ccggcguccagcgccgcc

SEQ ID NO: 817794 - RNA, 19 nt, Mycobacterium avium subsp. paratuberculosis
ccggcguccagcgccgcca

SEQ ID NO: 817795 - RNA, 21 nt, Mycobacterium avium subsp. paratuberculosis
ccggcguccagcgccgccacg

SEQ ID NO: 817796 - RNA, 18 nt, Mycobacterium avium subsp. paratuberculosis
ccggcguccaguagccgc

SEQ ID NO: 817797 - RNA, 19 nt, Mycobacterium avium subsp. paratuberculosis
ccggcguccaguagccgcc

SEQ ID NO: 817798 - RNA, 21 nt, Mycobacterium avium subsp. paratuberculosis
ccggcguccaguagccgccgg

SEQ ID NO: 817799 - RNA, 17 nt, Mycobacterium avium subsp. paratuberculosis
ccggcguccaguucggc

SEQ ID NO: 817800 - RNA, 19 nt, Mycobacterium avium subsp. paratuberculosis
ccggcguccaguucggcca

SEQ ID NO: 817801 - RNA, 20 nt, Mycobacterium avium subsp. paratuberculosis
ccggcguccaguucggccag

SEQ ID NO: 817802 - RNA, 22 nt, Mycobacterium avium subsp. paratuberculosis
ccggcguccaguucggccagcg

SEQ ID NO: 817803 - RNA, 22 nt, Mycobacterium avium subsp. paratuberculosis
ccggcguccaguugcggcacgc

SEQ ID NO: 817804 - RNA, 23 nt, Mycobacterium avium subsp. paratuberculosis
ccggcgucgaaauagcggcgcac

SEQ ID NO: 817805 - RNA, 14 nt, Mycobacterium avium subsp. paratuberculosis
ccggcgucgacagc

SEQ ID NO: 817806 - RNA, 15 nt, Mycobacterium avium subsp. paratuberculosis
ccggcgucgacagcc

SEQ ID NO: 817807 - RNA, 16 nt, Mycobacterium avium subsp. paratuberculosis
ccggcgucgacagccg

SEQ ID NO: 817808 - RNA, 17 nt, Mycobacterium avium subsp. paratuberculosis
ccggcgucgacagccgg

SEQ ID NO: 817809 - RNA, 19 nt, Mycobacterium avium subsp. paratuberculosis
ccggcgucgacagccgguc

SEQ ID NO: 817810 - RNA, 21 nt, Mycobacterium avium subsp. paratuberculosis
ccggcgucgacagccggucgc

SEQ ID NO: 817811 - RNA, 20 nt, Mycobacterium avium subsp. paratuberculosis
ccggcggugauccgcccggc

SEQ ID NO: 817812 - RNA, 16 nt, Mycobacterium avium subsp. paratuberculosis
ccggcguccgcgaacg

SEQ ID NO: 817813 - RNA, 14 nt, Mycobacterium avium subsp. paratuberculosis
ccggcggugcaggg

SEQ ID NO: 817814 - RNA, 17 nt, Mycobacterium avium subsp. paratuberculosis
ccggcggugcaggguca

SEQ ID NO: 817815 - RNA, 19 nt, Mycobacterium avium subsp. paratuberculosis
ccggcggugccgaaccgga

SEQ ID NO: 817816 - RNA, 20 nt, Mycobacterium avium subsp. paratuberculosis
ccggcggugccggccagauc

SEQ ID NO: 817817 - RNA, 21 nt, Mycobacterium avium subsp. paratuberculosis
ccggcggugccggccagaucg

SEQ ID NO: 817818 - RNA, 14 nt, Mycobacterium avium subsp. paratuberculosis
ccggcgguccugcg

SEQ ID NO: 817819 - RNA, 18 nt, Mycobacterium avium subsp. paratuberculosis
ccggcgguccugcggcga

SEQ ID NO: 817820 - RNA, 20 nt, Mycobacterium avium subsp. paratuberculosis
ccggcgguccugcggcgaca

SEQ ID NO: 817821 - RNA, 13 nt, Mycobacterium avium subsp. paratuberculosis
ccggcggucgaca

SEQ ID NO: 817822 - RNA, 14 nt, Mycobacterium avium subsp. paratuberculosis
ccggcggucgacac

SEQ ID NO: 817823 - RNA, 19 nt, Mycobacterium avium subsp. paratuberculosis
ccggcggucaccaaggcga

SEQ ID NO: 817824 - RNA, 14 nt, Mycobacterium avium subsp. paratuberculosis
ccggcggucgccga

SEQ ID NO: 817825 - RNA, 23 nt, Mycobacterium avium subsp. paratuberculosis
ccggcggucgccgaaaggaucug

SEQ ID NO: 817826 - RNA, 13 nt, Mycobacterium avium subsp. paratuberculosis
ccggcggucagca

SEQ ID NO: 817827 - RNA, 15 nt, Mycobacterium avium subsp. paratuberculosis
ccggcggucagcacc

SEQ ID NO: 817828 - RNA, 19 nt, Mycobacterium avium subsp. paratuberculosis
ccggcggucagcaccguca

SEQ ID NO: 817829 - RNA, 23 nt, Mycobacterium avium subsp. paratuberculosis
ccggcggucagcaccgucaccgc

SEQ ID NO: 817830 - RNA, 19 nt, Mycobacterium avium subsp. paratuberculosis
ccggcgguaccgccgaucg

SEQ ID NO: 817831 - RNA, 18 nt, Mycobacterium avium subsp. paratuberculosis
ccggcgguaugcccgggc

SEQ ID NO: 817832 - RNA, 22 nt, Mycobacterium avium subsp. paratuberculosis
ccggcgguaugcccgggccguc

SEQ ID NO: 817833 - RNA, 21 nt, Mycobacterium avium subsp. paratuberculosis
ccggcggguuggucccgauca

SEQ ID NO: 817834 - RNA, 23 nt, Mycobacterium avium subsp. paratuberculosis
ccggcggguuggucccgaucacc

SEQ ID NO: 817835 - RNA, 22 nt, Mycobacterium avium subsp. paratuberculosis
ccggcggcugggcagccgcgcg

SEQ ID NO: 817836 - RNA, 21 nt, Mycobacterium avium subsp. paratuberculosis
ccggcggcugugaucgcugac

SEQ ID NO: 817837 - RNA, 14 nt, Mycobacterium avium subsp. paratuberculosis
ccggcggcgucgug

SEQ ID NO: 817838 - RNA, 22 nt, Mycobacterium avium subsp. paratuberculosis
ccggcggcgucccacgugguga

SEQ ID NO: 817839 - RNA, 15 nt, Mycobacterium avium subsp. paratuberculosis
ccggcggcggccuuc

SEQ ID NO: 817840 - RNA, 15 nt, Mycobacterium avium subsp. paratuberculosis
ccggcggcggcgguc

SEQ ID NO: 817841 - RNA, 18 nt, Mycobacterium avium subsp. paratuberculosis
ccggcggcggugcgucgg

SEQ ID NO: 817842 - RNA, 16 nt, Mycobacterium avium subsp. paratuberculosis
ccggcggcgggcucgg

SEQ ID NO: 817843 - RNA, 17 nt, Mycobacterium avium subsp. paratuberculosis
ccggcggcggugagcgc

SEQ ID NO: 817844 - RNA, 13 nt, Mycobacterium avium subsp. paratuberculosis
ccggcggcggugc

SEQ ID NO: 817845 - RNA, 14 nt, Mycobacterium avium subsp. paratuberculosis
ccggcggcggugcg

SEQ ID NO: 817846 - RNA, 16 nt, Mycobacterium avium subsp. paratuberculosis
ccggcggcggccagcg

SEQ ID NO: 817847 - RNA, 23 nt, Mycobacterium avium subsp. paratuberculosis
ccggcgccgccgaccgcccgcug

SEQ ID NO: 817848 - RNA, 15 nt, Mycobacterium avium subsp. paratuberculosis
ccggcggcgcucagc

SEQ ID NO: 817849 - RNA, 21 nt, Mycobacterium avium subsp. paratuberculosis
ccggcggcgcugccccagcca

SEQ ID NO: 817850 - RNA, 14 nt, Mycobacterium avium subsp. paratuberculosis
ccggcggcggaccg

SEQ ID NO: 817851 - RNA, 13 nt, Mycobacterium avium subsp. paratuberculosis
ccggcggcggcca

SEQ ID NO: 817852 - RNA, 17 nt, Mycobacterium avium subsp. paratuberculosis
ccggcggccgccaucau

SEQ ID NO: 817853 - RNA, 14 nt, Mycobacterium avium subsp. paratuberculosis
ccggcggccgccgc

SEQ ID NO: 817854 - RNA, 21 nt, Mycobacterium avium subsp. paratuberculosis
ccggcggccgccgcccgcgcg

SEQ ID NO: 817855 - RNA, 23 nt, Mycobacterium avium subsp. paratuberculosis
ccggcggccgccgcccgcgcggc

SEQ ID NO: 817856 - RNA, 15 nt, Mycobacterium avium subsp. paratuberculosis
ccggcggccgccggc

SEQ ID NO: 817857 - RNA, 19 nt, Mycobacterium avium subsp. paratuberculosis
ccggcggccgccggcaccg

SEQ ID NO: 817858 - RNA, 14 nt, Mycobacterium avium subsp. paratuberculosis
ccggcggccgcgac

SEQ ID NO: 817859 - RNA, 15 nt, Mycobacterium avium subsp. paratuberculosis
ccggcggccgcgacg

SEQ ID NO: 817860 - RNA, 13 nt, Mycobacterium avium subsp. paratuberculosis
ccggcggccgcgu

SEQ ID NO: 817861 - RNA, 15 nt, Mycobacterium avium subsp. paratuberculosis
ccggcggccgcgucg

SEQ ID NO: 817862 - RNA, 14 nt, Mycobacterium avium subsp. paratuberculosis
ccggcggccgccac

SEQ ID NO: 817863 - RNA, 16 nt, Mycobacterium avium subsp. paratuberculosis
ccggcggccgccacgc

SEQ ID NO: 817864 - RNA, 16 nt, Mycobacterium avium subsp. paratuberculosis
ccggcggccgccauca

SEQ ID NO: 817865 - RNA, 13 nt, Mycobacterium avium subsp. paratuberculosis
ccggcggccggcg

SEQ ID NO: 817866 - RNA, 14 nt, Mycobacterium avium subsp. paratuberculosis
ccggcggccggcgg

SEQ ID NO: 817867 - RNA, 14 nt, Mycobacterium avium subsp. paratuberculosis
ccggcggccccggu

SEQ ID NO: 817868 - RNA, 13 nt, Mycobacterium avium subsp. paratuberculosis
ccggcggccgaca

SEQ ID NO: 817869 - RNA, 18 nt, Mycobacterium avium subsp. paratuberculosis
ccggcggccgacagggug

SEQ ID NO: 817870 - RNA, 19 nt, Mycobacterium avium subsp. paratuberculosis
ccggcggccgacagggugc

SEQ ID NO: 817871 - RNA, 13 nt, Mycobacterium avium subsp. paratuberculosis
ccggcggccgcca

SEQ ID NO: 817872 - RNA, 13 nt, Mycobacterium avium subsp. paratuberculosis
ccggcggccaugg

SEQ ID NO: 817873 - RNA, 19 nt, Mycobacterium avium subsp. paratuberculosis
ccggcggccauggucgcgg

SEQ ID NO: 817874 - RNA, 12 nt, Mycobacterium avium subsp. paratuberculosis
ccggcgccgccg

SEQ ID NO: 817875 - RNA, 13 nt, Mycobacterium avium subsp. paratuberculosis
ccggcggccacgc

SEQ ID NO: 817876 - RNA, 16 nt, Mycobacterium avium subsp. paratuberculosis
ccggcggccacgcagg

SEQ ID NO: 817877 - RNA, 13 nt, Mycobacterium avium subsp. paratuberculosis
ccggcggccagca

SEQ ID NO: 817878 - RNA, 14 nt, Mycobacterium avium subsp. paratuberculosis
ccggcggccagcau

SEQ ID NO: 817879 - RNA, 16 nt, Mycobacterium avium subsp. paratuberculosis
ccggcggccagcaucg

SEQ ID NO: 817880 - RNA, 12 nt, Mycobacterium avium subsp. paratuberculosis
ccggcgccgcca

SEQ ID NO: 817881 - RNA, 14 nt, Mycobacterium avium subsp. paratuberculosis
ccggcgccgccacc

SEQ ID NO: 817882 - RNA, 15 nt, Mycobacterium avium subsp. paratuberculosis
ccggcgccgccacca

SEQ ID NO: 817883 - RNA, 16 nt, Mycobacterium avium subsp. paratuberculosis
ccggcgccgccaccac

SEQ ID NO: 817884 - RNA, 18 nt, Mycobacterium avium subsp. paratuberculosis
ccggcgcccugcacccag

SEQ ID NO: 817885 - RNA, 15 nt, Mycobacterium avium subsp. paratuberculosis
ccggcgccgaucugc

SEQ ID NO: 817886 - RNA, 21 nt, Mycobacterium avium subsp. paratuberculosis
ccggcgccgaucugcucggcu

SEQ ID NO: 817887 - RNA, 18 nt, Mycobacterium avium subsp. paratuberculosis
ccggcgcccuucggcgcc

SEQ ID NO: 817888 - RNA, 15 nt, Mycobacterium avium subsp. paratuberculosis
ccggcgccgaagccg

SEQ ID NO: 817889 - RNA, 20 nt, Mycobacterium avium subsp. paratuberculosis
ccggcgccgaagccgucgac

SEQ ID NO: 817890 - RNA, 21 nt, Mycobacterium avium subsp. paratuberculosis
ccggcgccgaagccgucgacc

SEQ ID NO: 817891 - RNA, 14 nt, Mycobacterium avium subsp. paratuberculosis
ccggcgccgacgac

SEQ ID NO: 817892 - RNA, 15 nt, Mycobacterium avium subsp. paratuberculosis
ccggcgccgacgacg

SEQ ID NO: 817893 - RNA, 17 nt, Mycobacterium avium subsp. paratuberculosis
ccggcgcagcgcgucgc

SEQ ID NO: 817894 - RNA, 16 nt, Mycobacterium avium subsp. paratuberculosis
ccggcgcagcggcccg

SEQ ID NO: 817895 - RNA, 22 nt, Mycobacterium avium subsp. paratuberculosis
ccggcgcacgcuuuuucgcgaa

SEQ ID NO: 817896 - RNA, 13 nt, Mycobacterium avium subsp. paratuberculosis
ccggcgcacggcg

SEQ ID NO: 817897 - RNA, 15 nt, Mycobacterium avium subsp. paratuberculosis
ccggcgcacggcgcc

SEQ ID NO: 817898 - RNA, 13 nt, Mycobacterium avium subsp. paratuberculosis
ccggcgcagcaac

SEQ ID NO: 817899 - RNA, 14 nt, Mycobacterium avium subsp. paratuberculosis
ccggcgcagccggc

SEQ ID NO: 817900 - RNA, 18 nt, Mycobacterium avium subsp. paratuberculosis
ccggcgcagccggccacc

SEQ ID NO: 817901 - RNA, 13 nt, Mycobacterium avium subsp. paratuberculosis
ccggcgcagcgcc

SEQ ID NO: 817902 - RNA, 15 nt, Mycobacterium avium subsp. paratuberculosis
ccggcgcagcgccgc

SEQ ID NO: 817903 - RNA, 17 nt, Mycobacterium avium subsp. paratuberculosis
ccggcgcagcgccgcgc

SEQ ID NO: 817904 - RNA, 18 nt, Mycobacterium avium subsp. paratuberculosis
ccggcgcagcgccgcgcc

SEQ ID NO: 817905 - RNA, 21 nt, Mycobacterium avium subsp. paratuberculosis
ccggcgcagcgccgcgccgac

SEQ ID NO: 817906 - RNA, 12 nt, Mycobacterium avium subsp. paratuberculosis
ccggcgccacga

SEQ ID NO: 817907 - RNA, 13 nt, Mycobacterium avium subsp. paratuberculosis
ccggcgccacgac

SEQ ID NO: 817908 - RNA, 18 nt, Mycobacterium avium subsp. paratuberculosis
ccggcgccacgcacaccg

SEQ ID NO: 817909 - RNA, 20 nt, Mycobacterium avium subsp. paratuberculosis
ccggcgccacgcacaccgcg

SEQ ID NO: 817910 - RNA, 22 nt, Mycobacterium avium subsp. paratuberculosis
ccggcgccacgcacaccgcgcg

SEQ ID NO: 817911 - RNA, 17 nt, Mycobacterium avium subsp. paratuberculosis
ccggcgccacgccgcga

SEQ ID NO: 817912 - RNA, 14 nt, Mycobacterium avium subsp. paratuberculosis
ccggcgcccggcuc

SEQ ID NO: 817913 - RNA, 16 nt, Mycobacterium avium subsp. paratuberculosis
ccggcgcccgucacgc

SEQ ID NO: 817914 - RNA, 18 nt, Mycobacterium avium subsp. paratuberculosis
ccggcgcaccgcgucgac

SEQ ID NO: 817915 - RNA, 18 nt, Mycobacterium avium subsp. paratuberculosis
ccggcgcaccgcgucgau

SEQ ID NO: 817916 - RNA, 19 nt, Mycobacterium avium subsp. paratuberculosis
ccggcgcaccgcgucgaug

SEQ ID NO: 817917 - RNA, 17 nt, Mycobacterium avium subsp. paratuberculosis
ccggcgcacccgcacga

SEQ ID NO: 817918 - RNA, 19 nt, Mycobacterium avium subsp. paratuberculosis
ccggcgcacccgcacgaug

SEQ ID NO: 817919 - RNA, 16 nt, Mycobacterium avium subsp. paratuberculosis
ccggcgauuucggccg

SEQ ID NO: 817920 - RNA, 22 nt, Mycobacterium avium subsp. paratuberculosis
ccggcgcacaggaacgcgucga

SEQ ID NO: 817921 - RNA, 23 nt, Mycobacterium avium subsp. paratuberculosis
ccggcgcacaggaacgcgucgac

SEQ ID NO: 817922 - RNA, 16 nt, Mycobacterium avium subsp. paratuberculosis
ccggcgcacaucgugg

SEQ ID NO: 817923 - RNA, 18 nt, Mycobacterium avium subsp. paratuberculosis
ccggcgcacaucguggcg

SEQ ID NO: 817924 - RNA, 12 nt, Mycobacterium avium subsp. paratuberculosis
ccggcgcaccag

SEQ ID NO: 817925 - RNA, 19 nt, Mycobacterium avium subsp. paratuberculosis
ccggcgcaccaggcgccac

SEQ ID NO: 817926 - RNA, 16 nt, Mycobacterium avium subsp. paratuberculosis
ccggcgcaccagggug

SEQ ID NO: 817927 - RNA, 16 nt, Mycobacterium avium subsp. paratuberculosis
ccggcgaugguggcgc

SEQ ID NO: 817928 - RNA, 21 nt, Mycobacterium avium subsp. paratuberculosis
ccggcgaugguggcgcugccg

SEQ ID NO: 817929 - RNA, 13 nt, Mycobacterium avium subsp. paratuberculosis
ccggcgaugucgg

SEQ ID NO: 817930 - RNA, 19 nt, Mycobacterium avium subsp. paratuberculosis
ccggcgauuaggucggugg

SEQ ID NO: 817931 - RNA, 22 nt, Mycobacterium avium subsp. paratuberculosis
ccggcgauuaggucgguggcca

SEQ ID NO: 817932 - RNA, 23 nt, Mycobacterium avium subsp. paratuberculosis
ccggcgauuaggucgguggccac

SEQ ID NO: 817933 - RNA, 14 nt, Mycobacterium avium subsp. paratuberculosis
ccggcgaugccagc

SEQ ID NO: 817934 - RNA, 16 nt, Mycobacterium avium subsp. paratuberculosis
ccggcgaugaucaggc

SEQ ID NO: 817935 - RNA, 20 nt, Mycobacterium avium subsp. paratuberculosis
ccggcgaugaucaggccgga

SEQ ID NO: 817936 - RNA, 17 nt, Mycobacterium avium subsp. paratuberculosis
ccggcgauggcgcggcc

SEQ ID NO: 817937 - RNA, 23 nt, Mycobacterium avium subsp. paratuberculosis
ccggcgauggcgcggccggccga

SEQ ID NO: 817938 - RNA, 18 nt, Mycobacterium avium subsp. paratuberculosis
ccggcgaugcccgugauc

SEQ ID NO: 817939 - RNA, 23 nt, Mycobacterium avium subsp. paratuberculosis
ccggcgaugcccgugaucgccac

SEQ ID NO: 817940 - RNA, 13 nt, Mycobacterium avium subsp. paratuberculosis
ccggcgaugccga

SEQ ID NO: 817941 - RNA, 16 nt, Mycobacterium avium subsp. paratuberculosis
ccggcgaugccgagcc

SEQ ID NO: 817942 - RNA, 20 nt, Mycobacterium avium subsp. paratuberculosis
ccggcgaugcgcacgucggc

SEQ ID NO: 817943 - RNA, 22 nt, Mycobacterium avium subsp. paratuberculosis
ccggcgaugcgcacgucggccg

SEQ ID NO: 817944 - RNA, 19 nt, Mycobacterium avium subsp. paratuberculosis
ccggcgaugcgcgccuccg

SEQ ID NO: 817945 - RNA, 22 nt, Mycobacterium avium subsp. paratuberculosis
ccggcgaugcgcgccuccgacg

SEQ ID NO: 817946 - RNA, 14 nt, Mycobacterium avium subsp. paratuberculosis
ccggcgaugaccgg

SEQ ID NO: 817947 - RNA, 17 nt, Mycobacterium avium subsp. paratuberculosis
ccggcgaugaccgggac

SEQ ID NO: 817948 - RNA, 18 nt, Mycobacterium avium subsp. paratuberculosis
ccggcgaugaccgggacg

SEQ ID NO: 817949 - RNA, 16 nt, Mycobacterium avium subsp. paratuberculosis
ccggcgaugcagauca

SEQ ID NO: 817950 - RNA, 18 nt, Mycobacterium avium subsp. paratuberculosis
ccggcgaugcagaucacc

SEQ ID NO: 817951 - RNA, 20 nt, Mycobacterium avium subsp. paratuberculosis
ccggcgaugcagaucaccac

SEQ ID NO: 817952 - RNA, 21 nt, Mycobacterium avium subsp. paratuberculosis
ccggcgaugcagaucaccacg

SEQ ID NO: 817953 - RNA, 12 nt, Mycobacterium avium subsp. paratuberculosis
ccggcgaucucg

SEQ ID NO: 817954 - RNA, 16 nt, Mycobacterium avium subsp. paratuberculosis
ccggcgaucucgagca

SEQ ID NO: 817955 - RNA, 19 nt, Mycobacterium avium subsp. paratuberculosis
ccggcgaucucgucgcgca

SEQ ID NO: 817956 - RNA, 20 nt, Mycobacterium avium subsp. paratuberculosis
ccggcgaugaacacgccgau

SEQ ID NO: 817957 - RNA, 21 nt, Mycobacterium avium subsp. paratuberculosis
ccggcgaugaacacgccgaua

SEQ ID NO: 817958 - RNA, 15 nt, Mycobacterium avium subsp. paratuberculosis
ccggcgauccgcgcg

SEQ ID NO: 817959 - RNA, 21 nt, Mycobacterium avium subsp. paratuberculosis
ccggcgauccgcgcggcgacg

SEQ ID NO: 817960 - RNA, 18 nt, Mycobacterium avium subsp. paratuberculosis
ccggcgaucgacgucacc

SEQ ID NO: 817961 - RNA, 16 nt, Mycobacterium avium subsp. paratuberculosis
ccggcgaucgucgccg

SEQ ID NO: 817962 - RNA, 17 nt, Mycobacterium avium subsp. paratuberculosis
ccggcgaucgucgccgu

SEQ ID NO: 817963 - RNA, 18 nt, Mycobacterium avium subsp. paratuberculosis
ccggcgaucgucgccguc

SEQ ID NO: 817964 - RNA, 16 nt, Mycobacterium avium subsp. paratuberculosis
ccggcgaggcggucgg

SEQ ID NO: 817965 - RNA, 20 nt, Mycobacterium avium subsp. paratuberculosis
ccggcgaggcggucggcgga

SEQ ID NO: 817966 - RNA, 14 nt, Mycobacterium avium subsp. paratuberculosis
ccggcgagcgcgug

SEQ ID NO: 817967 - RNA, 20 nt, Mycobacterium avium subsp. paratuberculosis
ccggcgagcucgcggccgua

SEQ ID NO: 817968 - RNA, 22 nt, Mycobacterium avium subsp. paratuberculosis
ccggcgaggugaaccgcgacgc

SEQ ID NO: 817969 - RNA, 22 nt, Mycobacterium avium subsp. paratuberculosis
ccggcgaggugggcaccagcug

SEQ ID NO: 817970 - RNA, 17 nt, Mycobacterium avium subsp. paratuberculosis
ccggcgaguacccgccg

SEQ ID NO: 817971 - RNA, 14 nt, Mycobacterium avium subsp. paratuberculosis
ccggcgaguccgcg

SEQ ID NO: 817972 - RNA, 15 nt, Mycobacterium avium subsp. paratuberculosis
ccggcgaguccgcgg

SEQ ID NO: 817973 - RNA, 17 nt, Mycobacterium avium subsp. paratuberculosis
ccggcgaguccgcggag

SEQ ID NO: 817974 - RNA, 23 nt, Mycobacterium avium subsp. paratuberculosis
ccggcgagugcgaaucaucgugg

SEQ ID NO: 817975 - RNA, 23 nt, Mycobacterium avium subsp. paratuberculosis
ccggcgaguggaagucagcgcgu

SEQ ID NO: 817976 - RNA, 17 nt, Mycobacterium avium subsp. paratuberculosis
ccggcgauaggcggcca

SEQ ID NO: 817977 - RNA, 19 nt, Mycobacterium avium subsp. paratuberculosis
ccggcgauaggcggccagc

SEQ ID NO: 817978 - RNA, 23 nt, Mycobacterium avium subsp. paratuberculosis
ccggcgagcacaggaacgcgacg

SEQ ID NO: 817979 - RNA, 15 nt, Mycobacterium avium subsp. paratuberculosis
ccggcgagcacgccg

SEQ ID NO: 817980 - RNA, 19 nt, Mycobacterium avium subsp. paratuberculosis
ccggcgagcacgccgccgg

SEQ ID NO: 817981 - RNA, 20 nt, Mycobacterium avium subsp. paratuberculosis
ccggcgagcacgccgccggu

SEQ ID NO: 817982 - RNA, 20 nt, Mycobacterium avium subsp. paratuberculosis
ccggcgagcagcccggcgaa

SEQ ID NO: 817983 - RNA, 18 nt, Mycobacterium avium subsp. paratuberculosis
ccggcgacgccggcgagg

SEQ ID NO: 817984 - RNA, 14 nt, Mycobacterium avium subsp. paratuberculosis
ccggcgacgcggcg

SEQ ID NO: 817985 - RNA, 16 nt, Mycobacterium avium subsp. paratuberculosis
ccggcgacgguggcgc

SEQ ID NO: 817986 - RNA, 18 nt, Mycobacterium avium subsp. paratuberculosis
ccggcgacgucgccggcc

SEQ ID NO: 817987 - RNA, 16 nt, Mycobacterium avium subsp. paratuberculosis
ccggcgacgucgucga

SEQ ID NO: 817988 - RNA, 20 nt, Mycobacterium avium subsp. paratuberculosis
ccggcgacgucgucgaugcc

SEQ ID NO: 817989 - RNA, 17 nt, Mycobacterium avium subsp. paratuberculosis
ccggcgacggccagcgc

SEQ ID NO: 817990 - RNA, 19 nt, Mycobacterium avium subsp. paratuberculosis
ccggcgacggccagcgcgg

SEQ ID NO: 817991 - RNA, 21 nt, Mycobacterium avium subsp. paratuberculosis
ccggcgacggccagcgcggcg

SEQ ID NO: 817992 - RNA, 15 nt, Mycobacterium avium subsp. paratuberculosis
ccggcgacggcgagu

SEQ ID NO: 817993 - RNA, 13 nt, Mycobacterium avium subsp. paratuberculosis
ccggcgacggcgg

SEQ ID NO: 817994 - RNA, 18 nt, Mycobacterium avium subsp. paratuberculosis
ccggcgacggcggccguc

SEQ ID NO: 817995 - RNA, 15 nt, Mycobacterium avium subsp. paratuberculosis
ccggcgacggcggug

SEQ ID NO: 817996 - RNA, 16 nt, Mycobacterium avium subsp. paratuberculosis
ccggcgacggcggugg

SEQ ID NO: 817997 - RNA, 14 nt, Mycobacterium avium subsp. paratuberculosis
ccggcgaccgccac

SEQ ID NO: 817998 - RNA, 22 nt, Mycobacterium avium subsp. paratuberculosis
ccggcgacaccgcauggccggc

SEQ ID NO: 817999 - RNA, 12 nt, Mycobacterium avium subsp. paratuberculosis
ccggcgacaccg

SEQ ID NO: 818000 - RNA, 21 nt, Mycobacterium avium subsp. paratuberculosis
ccggcgaccacccucaccacg

SEQ ID NO: 818001 - RNA, 12 nt, Mycobacterium avium subsp. paratuberculosis
ccggcgaccagc

SEQ ID NO: 818002 - RNA, 17 nt, Mycobacterium avium subsp. paratuberculosis
ccggcgaccagccccuc

SEQ ID NO: 818003 - RNA, 23 nt, Mycobacterium avium subsp. paratuberculosis
ccggcgaccagccccucgaccac

SEQ ID NO: 818004 - RNA, 24 nt, Mycobacterium avium subsp. paratuberculosis
ccggcgaccagccccucgaccacc

SEQ ID NO: 818005 - RNA, 18 nt, Mycobacterium avium subsp. paratuberculosis
ccggcgacgaagcagcuc

SEQ ID NO: 818006 - RNA, 20 nt, Mycobacterium avium subsp. paratuberculosis
ccggcgacgaagcagcucgc

SEQ ID NO: 818007 - RNA, 17 nt, Mycobacterium avium subsp. paratuberculosis
ccggcgacgaccgcacc

SEQ ID NO: 818008 - RNA, 19 nt, Mycobacterium avium subsp. paratuberculosis
ccggcgacgaccgcaccga

SEQ ID NO: 818009 - RNA, 20 nt, Mycobacterium avium subsp. paratuberculosis
ccggcgacgaccgcaccgac

SEQ ID NO: 818010 - RNA, 16 nt, Mycobacterium avium subsp. paratuberculosis
ccggcgaccgugccca

SEQ ID NO: 818011 - RNA, 20 nt, Mycobacterium avium subsp. paratuberculosis
ccggcgacgauaucggccgc

SEQ ID NO: 818012 - RNA, 15 nt, Mycobacterium avium subsp. paratuberculosis
ccggcgacgccgcgc

SEQ ID NO: 818013 - RNA, 17 nt, Mycobacterium avium subsp. paratuberculosis
ccggcgacgccgcgcug

SEQ ID NO: 818014 - RNA, 19 nt, Mycobacterium avium subsp. paratuberculosis
ccggccucgaugucgucga

SEQ ID NO: 818015 - RNA, 22 nt, Mycobacterium avium subsp. paratuberculosis
ccggccucgaugucgucgauga

SEQ ID NO: 818016 - RNA, 14 nt, Mycobacterium avium subsp. paratuberculosis
ccggccucgccggc

SEQ ID NO: 818017 - RNA, 15 nt, Mycobacterium avium subsp. paratuberculosis
ccggccucgccggcg

SEQ ID NO: 818018 - RNA, 23 nt, Mycobacterium avium subsp. paratuberculosis
ccggccucgccggcgccgggcgg

SEQ ID NO: 818019 - RNA, 17 nt, Mycobacterium avium subsp. paratuberculosis
ccggccgguuggcggcc

SEQ ID NO: 818020 - RNA, 21 nt, Mycobacterium avium subsp. paratuberculosis
ccggccgguuguugcggucca

SEQ ID NO: 818021 - RNA, 20 nt, Mycobacterium avium subsp. paratuberculosis
ccggccguagcggacgacgg

SEQ ID NO: 818022 - RNA, 21 nt, Mycobacterium avium subsp. paratuberculosis
ccggccguagcggacgacggc

SEQ ID NO: 818023 - RNA, 12 nt, Mycobacterium avium subsp. paratuberculosis
ccggccgucacg

SEQ ID NO: 818024 - RNA, 17 nt, Mycobacterium avium subsp. paratuberculosis
ccggccgucacgcuggc

SEQ ID NO: 818025 - RNA, 20 nt, Mycobacterium avium subsp. paratuberculosis
ccggccgucacgcuggcgug

SEQ ID NO: 818026 - RNA, 21 nt, Mycobacterium avium subsp. paratuberculosis
ccggccgucaggaacgccggc

SEQ ID NO: 818027 - RNA, 23 nt, Mycobacterium avium subsp. paratuberculosis
ccggccgucaggaacgccggcuu

SEQ ID NO: 818028 - RNA, 15 nt, Mycobacterium avium subsp. paratuberculosis
ccggccguccacggc

SEQ ID NO: 818029 - RNA, 17 nt, Mycobacterium avium subsp. paratuberculosis
ccggccguccacggcgg

SEQ ID NO: 818030 - RNA, 20 nt, Mycobacterium avium subsp. paratuberculosis
ccggccgugaugcgccggcg

SEQ ID NO: 818031 - RNA, 21 nt, Mycobacterium avium subsp. paratuberculosis
ccggccgugaugcgccggcgg

SEQ ID NO: 818032 - RNA, 14 nt, Mycobacterium avium subsp. paratuberculosis
ccggccgugccggc

SEQ ID NO: 818033 - RNA, 22 nt, Mycobacterium avium subsp. paratuberculosis
ccggccgugccggcucggcggc

SEQ ID NO: 818034 - RNA, 14 nt, Mycobacterium avium subsp. paratuberculosis
ccggccgugccgug

SEQ ID NO: 818035 - RNA, 15 nt, Mycobacterium avium subsp. paratuberculosis
ccggccgugccgugg

SEQ ID NO: 818036 - RNA, 16 nt, Mycobacterium avium subsp. paratuberculosis
ccggccguucgccggc

SEQ ID NO: 818037 - RNA, 23 nt, Mycobacterium avium subsp. paratuberculosis
ccggccguucgccggccagcacg

SEQ ID NO: 818038 - RNA, 17 nt, Mycobacterium avium subsp. paratuberculosis
ccggccguucuugcggg

SEQ ID NO: 818039 - RNA, 19 nt, Mycobacterium avium subsp. paratuberculosis
ccggccguucuugcgggug

SEQ ID NO: 818040 - RNA, 15 nt, Mycobacterium avium subsp. paratuberculosis
ccggccgguggccgg

SEQ ID NO: 818041 - RNA, 17 nt, Mycobacterium avium subsp. paratuberculosis
ccggccgguggccggug

SEQ ID NO: 818042 - RNA, 17 nt, Mycobacterium avium subsp. paratuberculosis
ccggccggugcuuggcg

SEQ ID NO: 818043 - RNA, 13 nt, Mycobacterium avium subsp. paratuberculosis
ccggccgguggcc

SEQ ID NO: 818044 - RNA, 15 nt, Mycobacterium avium subsp. paratuberculosis
ccggccgggucacgu

SEQ ID NO: 818045 - RNA, 18 nt, Mycobacterium avium subsp. paratuberculosis
ccggccgggucacgugca

SEQ ID NO: 818046 - RNA, 21 nt, Mycobacterium avium subsp. paratuberculosis
ccggccgggucgaccgcgaug

SEQ ID NO: 818047 - RNA, 15 nt, Mycobacterium avium subsp. paratuberculosis
ccggccgguccgccc

SEQ ID NO: 818048 - RNA, 20 nt, Mycobacterium avium subsp. paratuberculosis
ccggccggucgccgauggug

SEQ ID NO: 818049 - RNA, 15 nt, Mycobacterium avium subsp. paratuberculosis
ccggccggggcgcca

SEQ ID NO: 818050 - RNA, 13 nt, Mycobacterium avium subsp. paratuberculosis
ccggccgggcgga

SEQ ID NO: 818051 - RNA, 20 nt, Mycobacterium avium subsp. paratuberculosis
ccggccgggcggacggcacc

SEQ ID NO: 818052 - RNA, 15 nt, Mycobacterium avium subsp. paratuberculosis
ccggccgggacgcgg

SEQ ID NO: 818053 - RNA, 16 nt, Mycobacterium avium subsp. paratuberculosis
ccggccgggacgcggu

SEQ ID NO: 818054 - RNA, 13 nt, Mycobacterium avium subsp. paratuberculosis
ccggccgggcgac

SEQ ID NO: 818055 - RNA, 14 nt, Mycobacterium avium subsp. paratuberculosis
ccggccgggcgacu

SEQ ID NO: 818056 - RNA, 15 nt, Mycobacterium avium subsp. paratuberculosis
ccggccgggcgacug

SEQ ID NO: 818057 - RNA, 20 nt, Mycobacterium avium subsp. paratuberculosis
ccggccgggcgacugcgugc

SEQ ID NO: 818058 - RNA, 13 nt, Mycobacterium avium subsp. paratuberculosis
ccggccggccgug

SEQ ID NO: 818059 - RNA, 14 nt, Mycobacterium avium subsp. paratuberculosis
ccggccggcgagga

SEQ ID NO: 818060 - RNA, 15 nt, Mycobacterium avium subsp. paratuberculosis
ccggccggcaggucg

SEQ ID NO: 818061 - RNA, 15 nt, Mycobacterium avium subsp. paratuberculosis
ccggccggcggucag

SEQ ID NO: 818062 - RNA, 16 nt, Mycobacterium avium subsp. paratuberculosis
ccggccggcggucagg

SEQ ID NO: 818063 - RNA, 23 nt, Mycobacterium avium subsp. paratuberculosis
ccggccggcggucaggccgucuc

SEQ ID NO: 818064 - RNA, 13 nt, Mycobacterium avium subsp. paratuberculosis
ccggccggcgugg

SEQ ID NO: 818065 - RNA, 15 nt, Mycobacterium avium subsp. paratuberculosis
ccggccggcgcgacc

SEQ ID NO: 818066 - RNA, 15 nt, Mycobacterium avium subsp. paratuberculosis
ccggccggcgcggcg

SEQ ID NO: 818067 - RNA, 16 nt, Mycobacterium avium subsp. paratuberculosis
ccggccggcgcggcgg

SEQ ID NO: 818068 - RNA, 17 nt, Mycobacterium avium subsp. paratuberculosis
ccggccggcgcggcggc

SEQ ID NO: 818069 - RNA, 14 nt, Mycobacterium avium subsp. paratuberculosis
ccggccggcgcgug

SEQ ID NO: 818070 - RNA, 12 nt, Mycobacterium avium subsp. paratuberculosis
ccggccggcgga

SEQ ID NO: 818071 - RNA, 15 nt, Mycobacterium avium subsp. paratuberculosis
ccggccggcggacgc

SEQ ID NO: 818072 - RNA, 12 nt, Mycobacterium avium subsp. paratuberculosis
ccggccggcagc

SEQ ID NO: 818073 - RNA, 14 nt, Mycobacterium avium subsp. paratuberculosis
ccggccggcagcug

SEQ ID NO: 818074 - RNA, 21 nt, Mycobacterium avium subsp. paratuberculosis
ccggccggcagcugcccgucg

SEQ ID NO: 818075 - RNA, 14 nt, Mycobacterium avium subsp. paratuberculosis
ccggccggccgaac

SEQ ID NO: 818076 - RNA, 15 nt, Mycobacterium avium subsp. paratuberculosis
ccggccggccgaaca

SEQ ID NO: 818077 - RNA, 17 nt, Mycobacterium avium subsp. paratuberculosis
ccggccggccgaacacg

SEQ ID NO: 818078 - RNA, 13 nt, Mycobacterium avium subsp. paratuberculosis
ccggccggccgac

SEQ ID NO: 818079 - RNA, 12 nt, Mycobacterium avium subsp. paratuberculosis
ccggccggccgc

SEQ ID NO: 818080 - RNA, 13 nt, Mycobacterium avium subsp. paratuberculosis
ccggccggccgcc

SEQ ID NO: 818081 - RNA, 14 nt, Mycobacterium avium subsp. paratuberculosis
ccggccggccgccg

SEQ ID NO: 818082 - RNA, 16 nt, Mycobacterium avium subsp. paratuberculosis
ccggccggccgccggc

SEQ ID NO: 818083 - RNA, 18 nt, Mycobacterium avium subsp. paratuberculosis
ccggccggccgccggcgg

SEQ ID NO: 818084 - RNA, 18 nt, Mycobacterium avium subsp. paratuberculosis
ccggccuuggcccgcgcc

SEQ ID NO: 818085 - RNA, 19 nt, Mycobacterium avium subsp. paratuberculosis
ccggccuucucgcgcaccg

SEQ ID NO: 818086 - RNA, 21 nt, Mycobacterium avium subsp. paratuberculosis
ccggccuucucgcgcaccgcg

SEQ ID NO: 818087 - RNA, 17 nt, Mycobacterium avium subsp. paratuberculosis
ccggccuugcucgccgc

SEQ ID NO: 818088 - RNA, 17 nt, Mycobacterium avium subsp. paratuberculosis
ccggcgaaacacagcag

SEQ ID NO: 818089 - RNA, 18 nt, Mycobacterium avium subsp. paratuberculosis
ccggcgaaacacagcagc

SEQ ID NO: 818090 - RNA, 23 nt, Mycobacterium avium subsp. paratuberculosis
ccggcgaaacacagcagcacgcc

SEQ ID NO: 818091 - RNA, 14 nt, Mycobacterium avium subsp. paratuberculosis
ccggcgaacaccac

SEQ ID NO: 818092 - RNA, 18 nt, Mycobacterium avium subsp. paratuberculosis
ccggcgacacguccagcu

SEQ ID NO: 818093 - RNA, 20 nt, Mycobacterium avium subsp. paratuberculosis
ccggcgacaugcgcagcgcc

SEQ ID NO: 818094 - RNA, 21 nt, Mycobacterium avium subsp. paratuberculosis
ccggcgacaugcgcagcgccc

SEQ ID NO: 818095 - RNA, 20 nt, Mycobacterium avium subsp. paratuberculosis
ccggcgaaucagcagcuuga

SEQ ID NO: 818096 - RNA, 18 nt, Mycobacterium avium subsp. paratuberculosis
ccggcgaauccgaccggc

SEQ ID NO: 818097 - RNA, 19 nt, Mycobacterium avium subsp. paratuberculosis
ccggcgaauccgaccggcu

SEQ ID NO: 818098 - RNA, 20 nt, Mycobacterium avium subsp. paratuberculosis
ccggcgaauccgaccggcuc

SEQ ID NO: 818099 - RNA, 18 nt, Mycobacterium avium subsp. paratuberculosis
ccggcgaagcucgacgau

SEQ ID NO: 818100 - RNA, 18 nt, Mycobacterium avium subsp. paratuberculosis
ccggcgaacuccacccug

SEQ ID NO: 818101 - RNA, 23 nt, Mycobacterium avium subsp. paratuberculosis
ccggcgaacuccacccugccgac

SEQ ID NO: 818102 - RNA, 15 nt, Mycobacterium avium subsp. paratuberculosis
ccggcgaagccgcuc

SEQ ID NO: 818103 - RNA, 21 nt, Mycobacterium avium subsp. paratuberculosis
ccggcgaaccgccgcacccag

SEQ ID NO: 818104 - RNA, 17 nt, Mycobacterium avium subsp. paratuberculosis
ccggcgaacgacgucga

SEQ ID NO: 818105 - RNA, 17 nt, Mycobacterium avium subsp. paratuberculosis
ccggcgaacucgcggcg

SEQ ID NO: 818106 - RNA, 17 nt, Mycobacterium avium subsp. paratuberculosis
ccggccuggcccagccg

SEQ ID NO: 818107 - RNA, 15 nt, Mycobacterium avium subsp. paratuberculosis
ccggccuucaccagg

SEQ ID NO: 818108 - RNA, 12 nt, Mycobacterium avium subsp. paratuberculosis
ccggccugccac

SEQ ID NO: 818109 - RNA, 13 nt, Mycobacterium avium subsp. paratuberculosis
ccggccugccacc

SEQ ID NO: 818110 - RNA, 15 nt, Mycobacterium avium subsp. paratuberculosis
ccggccugccaccgc

SEQ ID NO: 818111 - RNA, 18 nt, Mycobacterium avium subsp. paratuberculosis
ccggccugccaccgcgaa

SEQ ID NO: 818112 - RNA, 17 nt, Mycobacterium avium subsp. paratuberculosis
ccggccugcccgccgcg

SEQ ID NO: 818113 - RNA, 18 nt, Mycobacterium avium subsp. paratuberculosis
ccggccugcccgccgcgg

SEQ ID NO: 818114 - RNA, 16 nt, Mycobacterium avium subsp. paratuberculosis
ccggccugccggaugc

SEQ ID NO: 818115 - RNA, 19 nt, Mycobacterium avium subsp. paratuberculosis
ccggccugagacgacgcca

SEQ ID NO: 818116 - RNA, 16 nt, Mycobacterium avium subsp. paratuberculosis
ccggccugcagcgcgg

SEQ ID NO: 818117 - RNA, 19 nt, Mycobacterium avium subsp. paratuberculosis
ccggccugcagcgcgguca

SEQ ID NO: 818118 - RNA, 22 nt, Mycobacterium avium subsp. paratuberculosis
ccggccugcagcgcggucaucg

SEQ ID NO: 818119 - RNA, 14 nt, Mycobacterium avium subsp. paratuberculosis
ccggccucgucggc

SEQ ID NO: 818120 - RNA, 15 nt, Mycobacterium avium subsp. paratuberculosis
ccggccucgucggcg

SEQ ID NO: 818121 - RNA, 23 nt, Mycobacterium avium subsp. paratuberculosis
ccggccucgugcaaggccugcgc

SEQ ID NO: 818122 - RNA, 16 nt, Mycobacterium avium subsp. paratuberculosis
ccggccucucgucgac

SEQ ID NO: 818123 - RNA, 19 nt, Mycobacterium avium subsp. paratuberculosis
ccggccucucgucgacgau

SEQ ID NO: 818124 - RNA, 22 nt, Mycobacterium avium subsp. paratuberculosis
ccggccucucgucgacgauggc

SEQ ID NO: 818125 - RNA, 14 nt, Mycobacterium avium subsp. paratuberculosis
ccggcauucgugug

SEQ ID NO: 818126 - RNA, 22 nt, Mycobacterium avium subsp. paratuberculosis
ccggcauucguguggcgcacgc

SEQ ID NO: 818127 - RNA, 22 nt, Mycobacterium avium subsp. paratuberculosis
ccggccaaggcaagucgucggu

SEQ ID NO: 818128 - RNA, 20 nt, Mycobacterium avium subsp. paratuberculosis
ccggccaacagcagcgccgc

SEQ ID NO: 818129 - RNA, 16 nt, Mycobacterium avium subsp. paratuberculosis
ccggccagggccgccg

SEQ ID NO: 818130 - RNA, 18 nt, Mycobacterium avium subsp. paratuberculosis
ccggccagggccgccgca

SEQ ID NO: 818131 - RNA, 20 nt, Mycobacterium avium subsp. paratuberculosis
ccggccaggauggagcugac

SEQ ID NO: 818132 - RNA, 21 nt, Mycobacterium avium subsp. paratuberculosis
ccggccaggcacagcagggca

SEQ ID NO: 818133 - RNA, 15 nt, Mycobacterium avium subsp. paratuberculosis
ccggccaggcccagc

SEQ ID NO: 818134 - RNA, 14 nt, Mycobacterium avium subsp. paratuberculosis
ccggccaggccggc

SEQ ID NO: 818135 - RNA, 15 nt, Mycobacterium avium subsp. paratuberculosis
ccggccaggccggcc

SEQ ID NO: 818136 - RNA, 16 nt, Mycobacterium avium subsp. paratuberculosis
ccggccaggccggccu

SEQ ID NO: 818137 - RNA, 19 nt, Mycobacterium avium subsp. paratuberculosis
ccggccaggccggccugcc

SEQ ID NO: 818138 - RNA, 22 nt, Mycobacterium avium subsp. paratuberculosis
ccggccaucaugcccaccaucc

SEQ ID NO: 818139 - RNA, 22 nt, Mycobacterium avium subsp. paratuberculosis
ccggccaguugaaguccggcgg

SEQ ID NO: 818140 - RNA, 18 nt, Mycobacterium avium subsp. paratuberculosis
ccggccauaaagccgucg

SEQ ID NO: 818141 - RNA, 15 nt, Mycobacterium avium subsp. paratuberculosis
ccggccaguccggca

SEQ ID NO: 818142 - RNA, 20 nt, Mycobacterium avium subsp. paratuberculosis
ccggccaguccggcagcagc

SEQ ID NO: 818143 - RNA, 21 nt, Mycobacterium avium subsp. paratuberculosis
ccggccagguccacaccgugg

SEQ ID NO: 818144 - RNA, 20 nt, Mycobacterium avium subsp. paratuberculosis
ccggccaggucgacgggguc

SEQ ID NO: 818145 - RNA, 13 nt, Mycobacterium avium subsp. paratuberculosis
ccggccaggucgc

SEQ ID NO: 818146 - RNA, 15 nt, Mycobacterium avium subsp. paratuberculosis
ccggccaggucgccg

SEQ ID NO: 818147 - RNA, 16 nt, Mycobacterium avium subsp. paratuberculosis
ccggccaggucgccgc

SEQ ID NO: 818148 - RNA, 18 nt, Mycobacterium avium subsp. paratuberculosis
ccggccaggucgccgcgc

SEQ ID NO: 818149 - RNA, 21 nt, Mycobacterium avium subsp. paratuberculosis
ccggccaggucgccgcgcagc

SEQ ID NO: 818150 - RNA, 20 nt, Mycobacterium avium subsp. paratuberculosis
ccggccagggugccgacgac

SEQ ID NO: 818151 - RNA, 12 nt, Mycobacterium avium subsp. paratuberculosis
ccggcccaccac

SEQ ID NO: 818152 - RNA, 13 nt, Mycobacterium avium subsp. paratuberculosis
ccggcccaccacc

SEQ ID NO: 818153 - RNA, 13 nt, Mycobacterium avium subsp. paratuberculosis
ccggcccaccggc

SEQ ID NO: 818154 - RNA, 14 nt, Mycobacterium avium subsp. paratuberculosis
ccggcccaccggcc

SEQ ID NO: 818155 - RNA, 15 nt, Mycobacterium avium subsp. paratuberculosis
ccggcccaccggccc

SEQ ID NO: 818156 - RNA, 19 nt, Mycobacterium avium subsp. paratuberculosis
ccggcccaccggcccggcg

SEQ ID NO: 818157 - RNA, 21 nt, Mycobacterium avium subsp. paratuberculosis
ccggccaugcccucgaucgag

SEQ ID NO: 818158 - RNA, 23 nt, Mycobacterium avium subsp. paratuberculosis
ccggccaugcccucgaucgagga

SEQ ID NO: 818159 - RNA, 20 nt, Mycobacterium avium subsp. paratuberculosis
ccggccaucuccugcacgcg

SEQ ID NO: 818160 - RNA, 23 nt, Mycobacterium avium subsp. paratuberculosis
ccggccaucuccugcacgcgcgg

SEQ ID NO: 818161 - RNA, 15 nt, Mycobacterium avium subsp. paratuberculosis
ccggccaucucggcg

SEQ ID NO: 818162 - RNA, 17 nt, Mycobacterium avium subsp. paratuberculosis
ccggccaucucggcggc

SEQ ID NO: 818163 - RNA, 19 nt, Mycobacterium avium subsp. paratuberculosis
ccggccaucugcgcgacga

SEQ ID NO: 818164 - RNA, 22 nt, Mycobacterium avium subsp. paratuberculosis
ccggccaugaccaugucgacgc

SEQ ID NO: 818165 - RNA, 23 nt, Mycobacterium avium subsp. paratuberculosis
ccggcaucgacaugcccggcgac

SEQ ID NO: 818166 - RNA, 14 nt, Mycobacterium avium subsp. paratuberculosis
ccggcaucgaccgc

SEQ ID NO: 818167 - RNA, 14 nt, Mycobacterium avium subsp. paratuberculosis
ccggcauccucggc

SEQ ID NO: 818168 - RNA, 19 nt, Mycobacterium avium subsp. paratuberculosis
ccggcauccucggcgcguc

SEQ ID NO: 818169 - RNA, 13 nt, Mycobacterium avium subsp. paratuberculosis
ccggcaucccacc

SEQ ID NO: 818170 - RNA, 16 nt, Mycobacterium avium subsp. paratuberculosis
ccggcaucccacccgg

SEQ ID NO: 818171 - RNA, 15 nt, Mycobacterium avium subsp. paratuberculosis
ccggcauccagcacg

SEQ ID NO: 818172 - RNA, 20 nt, Mycobacterium avium subsp. paratuberculosis
ccggcauccagcacggccgc

SEQ ID NO: 818173 - RNA, 22 nt, Mycobacterium avium subsp. paratuberculosis
ccggcauccagcacggccgcca

SEQ ID NO: 818174 - RNA, 17 nt, Mycobacterium avium subsp. paratuberculosis
ccggcaguugcggccgc

SEQ ID NO: 818175 - RNA, 21 nt, Mycobacterium avium subsp. paratuberculosis
ccggaaucgcgggaucggccg

SEQ ID NO: 818176 - RNA, 19 nt, Mycobacterium avium subsp. paratuberculosis
ccggcauaggccagcacca

SEQ ID NO: 818177 - RNA, 20 nt, Mycobacterium avium subsp. paratuberculosis
ccggaaggccaaggccagca

SEQ ID NO: 818178 - RNA, 14 nt, Mycobacterium avium subsp. paratuberculosis
ccgcuggggcccag

SEQ ID NO: 818179 - RNA, 14 nt, Mycobacterium avium subsp. paratuberculosis
ccggaagugccggc

SEQ ID NO: 818180 - RNA, 17 nt, Mycobacterium avium subsp. paratuberculosis
ccggaagugccggcgaa

SEQ ID NO: 818181 - RNA, 22 nt, Mycobacterium avium subsp. paratuberculosis
ccggaaguucucgccgugcagc

SEQ ID NO: 818182 - RNA, 15 nt, Mycobacterium avium subsp. paratuberculosis
ccggaagccgucggu

SEQ ID NO: 818183 - RNA, 17 nt, Mycobacterium avium subsp. paratuberculosis
ccggaagaccguugacg

SEQ ID NO: 818184 - RNA, 16 nt, Mycobacterium avium subsp. paratuberculosis
ccgcugggcggcgcgg

SEQ ID NO: 818185 - RNA, 18 nt, Mycobacterium avium subsp. paratuberculosis
ccgcugggcggcgcggcg

SEQ ID NO: 818186 - RNA, 18 nt, Mycobacterium avium subsp. paratuberculosis
ccgcugggcguggugcgg

SEQ ID NO: 818187 - RNA, 21 nt, Mycobacterium avium subsp. paratuberculosis
ccgcugggcguggugcggugc

SEQ ID NO: 818188 - RNA, 21 nt, Mycobacterium avium subsp. paratuberculosis
ccgcuggcguagaucugcacg

SEQ ID NO: 818189 - RNA, 15 nt, Mycobacterium avium subsp. paratuberculosis
ccgcuggcgucgauc

SEQ ID NO: 818190 - RNA, 17 nt, Mycobacterium avium subsp. paratuberculosis
ccgcuggcgucgaucgc

SEQ ID NO: 818191 - RNA, 15 nt, Mycobacterium avium subsp. paratuberculosis
ccggcccugcggcca

SEQ ID NO: 818192 - RNA, 18 nt, Mycobacterium avium subsp. paratuberculosis
ccggccgaccggucucga

SEQ ID NO: 818193 - RNA, 22 nt, Mycobacterium avium subsp. paratuberculosis
ccggccgacgaugaacagucgg

SEQ ID NO: 818194 - RNA, 13 nt, Mycobacterium avium subsp. paratuberculosis
ccggccgacgggc

SEQ ID NO: 818195 - RNA, 15 nt, Mycobacterium avium subsp. paratuberculosis
ccggccgacgggcgu

SEQ ID NO: 818196 - RNA, 12 nt, Mycobacterium avium subsp. paratuberculosis
ccggccgagccg

SEQ ID NO: 818197 - RNA, 19 nt, Mycobacterium avium subsp. paratuberculosis
ccggccgagccgagccgac

SEQ ID NO: 818198 - RNA, 21 nt, Mycobacterium avium subsp. paratuberculosis
ccggccgagccgaugcccagc

SEQ ID NO: 818199 - RNA, 14 nt, Mycobacterium avium subsp. paratuberculosis
ccggccgagccggc

SEQ ID NO: 818200 - RNA, 14 nt, Mycobacterium avium subsp. paratuberculosis
ccggccgagcgcag

SEQ ID NO: 818201 - RNA, 17 nt, Mycobacterium avium subsp. paratuberculosis
ccggccgagcgcgccga

SEQ ID NO: 818202 - RNA, 19 nt, Mycobacterium avium subsp. paratuberculosis
ccggccgaggucaccaccg

SEQ ID NO: 818203 - RNA, 17 nt, Mycobacterium avium subsp. paratuberculosis
ccggccgacaccccgau

SEQ ID NO: 818204 - RNA, 18 nt, Mycobacterium avium subsp. paratuberculosis
ccggccgaacacggccgc

SEQ ID NO: 818205 - RNA, 19 nt, Mycobacterium avium subsp. paratuberculosis
ccggccgaacacggccgcc

SEQ ID NO: 818206 - RNA, 21 nt, Mycobacterium avium subsp. paratuberculosis
ccggccgaacacggccgccuc

SEQ ID NO: 818207 - RNA, 12 nt, Mycobacterium avium subsp. paratuberculosis
ccggccgcccgc

SEQ ID NO: 818208 - RNA, 15 nt, Mycobacterium avium subsp. paratuberculosis
ccggccgcccgcacc

SEQ ID NO: 818209 - RNA, 12 nt, Mycobacterium avium subsp. paratuberculosis
ccggccgccagc

SEQ ID NO: 818210 - RNA, 20 nt, Mycobacterium avium subsp. paratuberculosis
ccggccgccagcagugucca

SEQ ID NO: 818211 - RNA, 17 nt, Mycobacterium avium subsp. paratuberculosis
ccggccgaccgccucga

SEQ ID NO: 818212 - RNA, 14 nt, Mycobacterium avium subsp. paratuberculosis
ccggccgcacacca

SEQ ID NO: 818213 - RNA, 18 nt, Mycobacterium avium subsp. paratuberculosis
ccggccgcacaccaccac

SEQ ID NO: 818214 - RNA, 13 nt, Mycobacterium avium subsp. paratuberculosis
ccggccgaugacc

SEQ ID NO: 818215 - RNA, 22 nt, Mycobacterium avium subsp. paratuberculosis
ccggccgaugaccucgcacagc

SEQ ID NO: 818216 - RNA, 14 nt, Mycobacterium avium subsp. paratuberculosis
ccggccgacgcggc

SEQ ID NO: 818217 - RNA, 17 nt, Mycobacterium avium subsp. paratuberculosis
ccggccgacgcggccuc

SEQ ID NO: 818218 - RNA, 16 nt, Mycobacterium avium subsp. paratuberculosis
ccggccgcucgcgggc

SEQ ID NO: 818219 - RNA, 13 nt, Mycobacterium avium subsp. paratuberculosis
ccggccgcgucgc

SEQ ID NO: 818220 - RNA, 13 nt, Mycobacterium avium subsp. paratuberculosis
ccggccgcggcgu

SEQ ID NO: 818221 - RNA, 19 nt, Mycobacterium avium subsp. paratuberculosis
ccggccgcgucgccgacca

SEQ ID NO: 818222 - RNA, 14 nt, Mycobacterium avium subsp. paratuberculosis
ccggccggacaccg

SEQ ID NO: 818223 - RNA, 19 nt, Mycobacterium avium subsp. paratuberculosis
ccggccggacaggucgagg

SEQ ID NO: 818224 - RNA, 20 nt, Mycobacterium avium subsp. paratuberculosis
ccggccggagaccgccgugg

SEQ ID NO: 818225 - RNA, 22 nt, Mycobacterium avium subsp. paratuberculosis
ccggccggauguuguccggaac

SEQ ID NO: 818226 - RNA, 16 nt, Mycobacterium avium subsp. paratuberculosis
ccggccgcggugaccg

SEQ ID NO: 818227 - RNA, 17 nt, Mycobacterium avium subsp. paratuberculosis
ccggccgcggugaccgc

SEQ ID NO: 818228 - RNA, 22 nt, Mycobacterium avium subsp. paratuberculosis
ccggccgcggugaccgcgccgc

SEQ ID NO: 818229 - RNA, 14 nt, Mycobacterium avium subsp. paratuberculosis
ccggccgcgccggc

SEQ ID NO: 818230 - RNA, 13 nt, Mycobacterium avium subsp. paratuberculosis
ccggccgcgcgcg

SEQ ID NO: 818231 - RNA, 18 nt, Mycobacterium avium subsp. paratuberculosis
ccggccgcggaugaccag

SEQ ID NO: 818232 - RNA, 23 nt, Mycobacterium avium subsp. paratuberculosis
ccggccgcggaugaccaggucgc

SEQ ID NO: 818233 - RNA, 13 nt, Mycobacterium avium subsp. paratuberculosis
ccggccgcggccc

SEQ ID NO: 818234 - RNA, 14 nt, Mycobacterium avium subsp. paratuberculosis
ccggccgcgcaccg

SEQ ID NO: 818235 - RNA, 13 nt, Mycobacterium avium subsp. paratuberculosis
ccggccgcgccca

SEQ ID NO: 818236 - RNA, 23 nt, Mycobacterium avium subsp. paratuberculosis
ccggccgcgcccaucgcggccgc

SEQ ID NO: 818237 - RNA, 13 nt, Mycobacterium avium subsp. paratuberculosis
ccggccgcgccgg

SEQ ID NO: 818238 - RNA, 13 nt, Mycobacterium avium subsp. paratuberculosis
ccggccgccugga

SEQ ID NO: 818239 - RNA, 16 nt, Mycobacterium avium subsp. paratuberculosis
ccggccgcgauccagc

SEQ ID NO: 818240 - RNA, 15 nt, Mycobacterium avium subsp. paratuberculosis
ccggccgccgcgauc

SEQ ID NO: 818241 - RNA, 13 nt, Mycobacterium avium subsp. paratuberculosis
ccggccgccgcgc

SEQ ID NO: 818242 - RNA, 15 nt, Mycobacterium avium subsp. paratuberculosis
ccggccgccgcgcau

SEQ ID NO: 818243 - RNA, 22 nt, Mycobacterium avium subsp. paratuberculosis
ccggccgccgcgcauccgcacc

SEQ ID NO: 818244 - RNA, 15 nt, Mycobacterium avium subsp. paratuberculosis
ccggccgccggaucg

SEQ ID NO: 818245 - RNA, 13 nt, Mycobacterium avium subsp. paratuberculosis
ccggccgccggcg

SEQ ID NO: 818246 - RNA, 16 nt, Mycobacterium avium subsp. paratuberculosis
ccggccgccggcggcc

SEQ ID NO: 818247 - RNA, 15 nt, Mycobacterium avium subsp. paratuberculosis
ccggccgccgggacg

SEQ ID NO: 818248 - RNA, 20 nt, Mycobacterium avium subsp. paratuberculosis
ccggccgccgaagccggcuc

SEQ ID NO: 818249 - RNA, 21 nt, Mycobacterium avium subsp. paratuberculosis
ccggccgccgaagccggcucg

SEQ ID NO: 818250 - RNA, 15 nt, Mycobacterium avium subsp. paratuberculosis
ccggccgccagcgcc

SEQ ID NO: 818251 - RNA, 10 nt, Mycobacterium avium subsp. paratuberculosis
ccggccgccc

SEQ ID NO: 818252 - RNA, 13 nt, Mycobacterium avium subsp. paratuberculosis
ccggccgcccggc

SEQ ID NO: 818253 - RNA, 14 nt, Mycobacterium avium subsp. paratuberculosis
ccggccgcccggcg

SEQ ID NO: 818254 - RNA, 17 nt, Mycobacterium avium subsp. paratuberculosis
ccggccgcccggcgagc

SEQ ID NO: 818255 - RNA, 12 nt, Mycobacterium avium subsp. paratuberculosis
ccggccgccgaa

SEQ ID NO: 818256 - RNA, 17 nt, Mycobacterium avium subsp. paratuberculosis
ccggcccuauggcaucg

SEQ ID NO: 818257 - RNA, 18 nt, Mycobacterium avium subsp. paratuberculosis
ccggcccuauggcaucgc

SEQ ID NO: 818258 - RNA, 21 nt, Mycobacterium avium subsp. paratuberculosis
ccggcccuauggcaucgccaa

SEQ ID NO: 818259 - RNA, 16 nt, Mycobacterium avium subsp. paratuberculosis
ccggcccugcacgcaa

SEQ ID NO: 818260 - RNA, 15 nt, Mycobacterium avium subsp. paratuberculosis
ccggcccggggugug

SEQ ID NO: 818261 - RNA, 13 nt, Mycobacterium avium subsp. paratuberculosis
ccggcccgccgcu

SEQ ID NO: 818262 - RNA, 23 nt, Mycobacterium avium subsp. paratuberculosis
ccggcccguccagaucggccagc

SEQ ID NO: 818263 - RNA, 17 nt, Mycobacterium avium subsp. paratuberculosis
ccggcccgucgagcggc

SEQ ID NO: 818264 - RNA, 20 nt, Mycobacterium avium subsp. paratuberculosis
ccggcccgucgagcggcuug

SEQ ID NO: 818265 - RNA, 17 nt, Mycobacterium avium subsp. paratuberculosis
ccggcccgcuggccgcc

SEQ ID NO: 818266 - RNA, 21 nt, Mycobacterium avium subsp. paratuberculosis
ccggcccggaacgcgucgccc

SEQ ID NO: 818267 - RNA, 20 nt, Mycobacterium avium subsp. paratuberculosis
ccggcccggggacacccucg

SEQ ID NO: 818268 - RNA, 19 nt, Mycobacterium avium subsp. paratuberculosis
ccggcccgcccggcggcgc

SEQ ID NO: 818269 - RNA, 21 nt, Mycobacterium avium subsp. paratuberculosis
ccggcccgcccggcggcgcug

SEQ ID NO: 818270 - RNA, 21 nt, Mycobacterium avium subsp. paratuberculosis
ccggcccgaacaccuccucgg

SEQ ID NO: 818271 - RNA, 14 nt, Mycobacterium avium subsp. paratuberculosis
ccggcccgaccgga

SEQ ID NO: 818272 - RNA, 22 nt, Mycobacterium avium subsp. paratuberculosis
ccggcccgagcccugcgccagc

SEQ ID NO: 818273 - RNA, 16 nt, Mycobacterium avium subsp. paratuberculosis
ccggcccgaucgcggc

SEQ ID NO: 818274 - RNA, 18 nt, Mycobacterium avium subsp. paratuberculosis
ccggcccgaucgcggcga

SEQ ID NO: 818275 - RNA, 19 nt, Mycobacterium avium subsp. paratuberculosis
ccggcccgaucgcggcgag

SEQ ID NO: 818276 - RNA, 14 nt, Mycobacterium avium subsp. paratuberculosis
ccggcccgcagcca

SEQ ID NO: 818277 - RNA, 13 nt, Mycobacterium avium subsp. paratuberculosis
ccggcccgcagcg

SEQ ID NO: 818278 - RNA, 15 nt, Mycobacterium avium subsp. paratuberculosis
ccggcccgcagcgcc

SEQ ID NO: 818279 - RNA, 13 nt, Mycobacterium avium subsp. paratuberculosis
ccggcccgcaucg

SEQ ID NO: 818280 - RNA, 14 nt, Mycobacterium avium subsp. paratuberculosis
ccggcccgcaucgc

SEQ ID NO: 818281 - RNA, 22 nt, Mycobacterium avium subsp. paratuberculosis
ccggcccgcaucgcggcgaugg

SEQ ID NO: 818282 - RNA, 17 nt, Mycobacterium avium subsp. paratuberculosis
ccggcccgcaugcaccg

SEQ ID NO: 818283 - RNA, 21 nt, Mycobacterium avium subsp. paratuberculosis
ccggcccgcaugcaccggugc

SEQ ID NO: 818284 - RNA, 17 nt, Mycobacterium avium subsp. paratuberculosis
ccggcccggcccgacgg

SEQ ID NO: 818285 - RNA, 13 nt, Mycobacterium avium subsp. paratuberculosis
ccggcccggccgg

SEQ ID NO: 818286 - RNA, 14 nt, Mycobacterium avium subsp. paratuberculosis
ccggcccggccggc

SEQ ID NO: 818287 - RNA, 12 nt, Mycobacterium avium subsp. paratuberculosis
ccggcccggcga

SEQ ID NO: 818288 - RNA, 15 nt, Mycobacterium avium subsp. paratuberculosis
ccggcccggcgaugc

SEQ ID NO: 818289 - RNA, 13 nt, Mycobacterium avium subsp. paratuberculosis
ccggcccggcgcg

SEQ ID NO: 818290 - RNA, 16 nt, Mycobacterium avium subsp. paratuberculosis
ccggcccggcgcggcc

SEQ ID NO: 818291 - RNA, 12 nt, Mycobacterium avium subsp. paratuberculosis
ccggcccggcgg

SEQ ID NO: 818292 - RNA, 13 nt, Mycobacterium avium subsp. paratuberculosis
ccggcccggcggc

SEQ ID NO: 818293 - RNA, 15 nt, Mycobacterium avium subsp. paratuberculosis
ccggcccggcggccg

SEQ ID NO: 818294 - RNA, 17 nt, Mycobacterium avium subsp. paratuberculosis
ccggcccggcggccggc

SEQ ID NO: 818295 - RNA, 16 nt, Mycobacterium avium subsp. paratuberculosis
ccggcccggcgggcau

SEQ ID NO: 818296 - RNA, 14 nt, Mycobacterium avium subsp. paratuberculosis
ccggcccggcgggu

SEQ ID NO: 818297 - RNA, 18 nt, Mycobacterium avium subsp. paratuberculosis
ccggcccggcgggucagc

SEQ ID NO: 818298 - RNA, 12 nt, Mycobacterium avium subsp. paratuberculosis
ccggcccggcgu

SEQ ID NO: 818299 - RNA, 15 nt, Mycobacterium avium subsp. paratuberculosis
ccggcccggcgucgu

SEQ ID NO: 818300 - RNA, 13 nt, Mycobacterium avium subsp. paratuberculosis
ccggccccaccgc

SEQ ID NO: 818301 - RNA, 16 nt, Mycobacterium avium subsp. paratuberculosis
ccggccccaccgccgc

SEQ ID NO: 818302 - RNA, 19 nt, Mycobacterium avium subsp. paratuberculosis
ccggccccaccgccgcugc

SEQ ID NO: 818303 - RNA, 17 nt, Mycobacterium avium subsp. paratuberculosis
ccggcccaucaccggac

SEQ ID NO: 818304 - RNA, 22 nt, Mycobacterium avium subsp. paratuberculosis
ccggcccaucaccggaccggcc

SEQ ID NO: 818305 - RNA, 24 nt, Mycobacterium avium subsp. paratuberculosis
ccggcccaucaccggaccggccag

SEQ ID NO: 818306 - RNA, 17 nt, Mycobacterium avium subsp. paratuberculosis
ccggcccaggcacagcg

SEQ ID NO: 818307 - RNA, 13 nt, Mycobacterium avium subsp. paratuberculosis
ccggcccagcgcg

SEQ ID NO: 818308 - RNA, 14 nt, Mycobacterium avium subsp. paratuberculosis
ccggcccagcgcgg

SEQ ID NO: 818309 - RNA, 14 nt, Mycobacterium avium subsp. paratuberculosis
ccggcccagcagcg

SEQ ID NO: 818310 - RNA, 15 nt, Mycobacterium avium subsp. paratuberculosis
ccggcccagccgcug

SEQ ID NO: 818311 - RNA, 13 nt, Mycobacterium avium subsp. paratuberculosis
ccggcccagccgg

SEQ ID NO: 818312 - RNA, 15 nt, Mycobacterium avium subsp. paratuberculosis
ccggcccagccgguc

SEQ ID NO: 818313 - RNA, 20 nt, Mycobacterium avium subsp. paratuberculosis
ccggcccccgagcuucgggu

SEQ ID NO: 818314 - RNA, 22 nt, Mycobacterium avium subsp. paratuberculosis
ccggcccccugcucagcggcca

SEQ ID NO: 818315 - RNA, 16 nt, Mycobacterium avium subsp. paratuberculosis
ccggccccgagccgac

SEQ ID NO: 818316 - RNA, 22 nt, Mycobacterium avium subsp. paratuberculosis
ccggccccgagcgucacgccag

SEQ ID NO: 818317 - RNA, 15 nt, Mycobacterium avium subsp. paratuberculosis
ccggccccgcccggc

SEQ ID NO: 818318 - RNA, 16 nt, Mycobacterium avium subsp. paratuberculosis
ccggccccgcccggcg

SEQ ID NO: 818319 - RNA, 22 nt, Mycobacterium avium subsp. paratuberculosis
ccggccccgcccggcgcgcagc

SEQ ID NO: 818320 - RNA, 22 nt, Mycobacterium avium subsp. paratuberculosis
ccggccccgcccggggcggcga

SEQ ID NO: 818321 - RNA, 17 nt, Mycobacterium avium subsp. paratuberculosis
ccggccccgcugccguc

SEQ ID NO: 818322 - RNA, 13 nt, Mycobacterium avium subsp. paratuberculosis
ccggccccggccg

SEQ ID NO: 818323 - RNA, 14 nt, Mycobacterium avium subsp. paratuberculosis
ccggccccggccgg

SEQ ID NO: 818324 - RNA, 15 nt, Mycobacterium avium subsp. paratuberculosis
ccggccccggcgacg

SEQ ID NO: 818325 - RNA, 16 nt, Mycobacterium avium subsp. paratuberculosis
ccggccccggcgacgg

SEQ ID NO: 818326 - RNA, 20 nt, Mycobacterium avium subsp. paratuberculosis
ccggccccgggggaccagcg

SEQ ID NO: 818327 - RNA, 17 nt, Mycobacterium avium subsp. paratuberculosis
ccggccccuaccgccga

SEQ ID NO: 818328 - RNA, 17 nt, Mycobacterium avium subsp. paratuberculosis
ccuccacauacgcggcg

SEQ ID NO: 818329 - RNA, 23 nt, Mycobacterium avium subsp. paratuberculosis
ccuccaccaccaugucguugacg

SEQ ID NO: 818330 - RNA, 15 nt, Mycobacterium avium subsp. paratuberculosis
ccuccaacggcacca

SEQ ID NO: 818331 - RNA, 16 nt, Mycobacterium avium subsp. paratuberculosis
ccuccaacggcaccac

SEQ ID NO: 818332 - RNA, 14 nt, Mycobacterium avium subsp. paratuberculosis
ccuccaacggccgc

SEQ ID NO: 818333 - RNA, 15 nt, Mycobacterium avium subsp. paratuberculosis
ccuccaacggccgca

SEQ ID NO: 818334 - RNA, 13 nt, Mycobacterium avium subsp. paratuberculosis
ccuccaccggcaa

SEQ ID NO: 818335 - RNA, 21 nt, Mycobacterium avium subsp. paratuberculosis
ccuccaccggcaaucgggacg

SEQ ID NO: 818336 - RNA, 23 nt, Mycobacterium avium subsp. paratuberculosis
ccuccacgacuucacaggccgcc

SEQ ID NO: 818337 - RNA, 13 nt, Mycobacterium avium subsp. paratuberculosis
ccuccacggugcg

SEQ ID NO: 818338 - RNA, 18 nt, Mycobacterium avium subsp. paratuberculosis
ccuccacggugcgcaccg

SEQ ID NO: 818339 - RNA, 16 nt, Mycobacterium avium subsp. paratuberculosis
ccuccgccgccccguc

SEQ ID NO: 818340 - RNA, 14 nt, Mycobacterium avium subsp. paratuberculosis
ccucaucgucgacc

SEQ ID NO: 818341 - RNA, 16 nt, Mycobacterium avium subsp. paratuberculosis
ccucauaggcguacac

SEQ ID NO: 818342 - RNA, 16 nt, Mycobacterium avium subsp. paratuberculosis
ccucagcccggcagcg

SEQ ID NO: 818343 - RNA, 21 nt, Mycobacterium avium subsp. paratuberculosis
ccucagccggcggugcgucga

SEQ ID NO: 818344 - RNA, 17 nt, Mycobacterium avium subsp. paratuberculosis
ccucaggcgagcacccg

SEQ ID NO: 818345 - RNA, 19 nt, Mycobacterium avium subsp. paratuberculosis
ccucaggcguccagcaccu

SEQ ID NO: 818346 - RNA, 21 nt, Mycobacterium avium subsp. paratuberculosis
ccucaggcgucggucagcagg

SEQ ID NO: 818347 - RNA, 18 nt, Mycobacterium avium subsp. paratuberculosis
ccucaggcugacgccacg

SEQ ID NO: 818348 - RNA, 12 nt, Mycobacterium avium subsp. paratuberculosis
ccuagucgacgc

SEQ ID NO: 818349 - RNA, 14 nt, Mycobacterium avium subsp. paratuberculosis
ccuagucgacgccg

SEQ ID NO: 818350 - RNA, 22 nt, Mycobacterium avium subsp. paratuberculosis
ccuagccuuggccgcaggcggc

SEQ ID NO: 818351 - RNA, 17 nt, Mycobacterium avium subsp. paratuberculosis
ccuaggaccccggcugc

SEQ ID NO: 818352 - RNA, 14 nt, Mycobacterium avium subsp. paratuberculosis
ccuaggacgccgcc

SEQ ID NO: 818353 - RNA, 13 nt, Mycobacterium avium subsp. paratuberculosis
ccuaggcgucguc

SEQ ID NO: 818354 - RNA, 19 nt, Mycobacterium avium subsp. paratuberculosis
ccuacuugcggccgcgacg

SEQ ID NO: 818355 - RNA, 17 nt, Mycobacterium avium subsp. paratuberculosis
ccuaccggcucggcccg

SEQ ID NO: 818356 - RNA, 21 nt, Mycobacterium avium subsp. paratuberculosis
ccuaccggguggccagcacca

SEQ ID NO: 818357 - RNA, 22 nt, Mycobacterium avium subsp. paratuberculosis
ccuaccggguggccagcaccag

SEQ ID NO: 818358 - RNA, 14 nt, Mycobacterium avium subsp. paratuberculosis
ccuacggcgccggu

SEQ ID NO: 818359 - RNA, 15 nt, Mycobacterium avium subsp. paratuberculosis
ccuacggcgccggua

SEQ ID NO: 818360 - RNA, 13 nt, Mycobacterium avium subsp. paratuberculosis
ccguuccucgacg

SEQ ID NO: 818361 - RNA, 17 nt, Mycobacterium avium subsp. paratuberculosis
ccguuccaucgggccca

SEQ ID NO: 818362 - RNA, 12 nt, Mycobacterium avium subsp. paratuberculosis
ccguuccagccg

SEQ ID NO: 818363 - RNA, 16 nt, Mycobacterium avium subsp. paratuberculosis
ccguuccagccggccc

SEQ ID NO: 818364 - RNA, 13 nt, Mycobacterium avium subsp. paratuberculosis
ccguuccaagcga

SEQ ID NO: 818365 - RNA, 18 nt, Mycobacterium avium subsp. paratuberculosis
ccguucggccagcgccgc

SEQ ID NO: 818366 - RNA, 18 nt, Mycobacterium avium subsp. paratuberculosis
ccuacaggugccggcggc

SEQ ID NO: 818367 - RNA, 16 nt, Mycobacterium avium subsp. paratuberculosis
ccguucgagcgccgga

SEQ ID NO: 818368 - RNA, 18 nt, Mycobacterium avium subsp. paratuberculosis
ccguucgagcgccggacg

SEQ ID NO: 818369 - RNA, 19 nt, Mycobacterium avium subsp. paratuberculosis
ccguucgagcgccggacgc

SEQ ID NO: 818370 - RNA, 18 nt, Mycobacterium avium subsp. paratuberculosis
ccguucgaugaugggcga

SEQ ID NO: 818371 - RNA, 13 nt, Mycobacterium avium subsp. paratuberculosis
ccguucgcgccgu

SEQ ID NO: 818372 - RNA, 15 nt, Mycobacterium avium subsp. paratuberculosis
ccucgcccugcagcg

SEQ ID NO: 818373 - RNA, 17 nt, Mycobacterium avium subsp. paratuberculosis
ccucgcccugcagcgcg

SEQ ID NO: 818374 - RNA, 23 nt, Mycobacterium avium subsp. paratuberculosis
ccucgcagcgacaaucggcucgc

SEQ ID NO: 818375 - RNA, 19 nt, Mycobacterium avium subsp. paratuberculosis
ccucgcagaaauccgucga

SEQ ID NO: 818376 - RNA, 22 nt, Mycobacterium avium subsp. paratuberculosis
ccucgccacugggcgucggcgc

SEQ ID NO: 818377 - RNA, 15 nt, Mycobacterium avium subsp. paratuberculosis
ccucgccgcaggcgu

SEQ ID NO: 818378 - RNA, 20 nt, Mycobacterium avium subsp. paratuberculosis
ccucgccgcccucgcccucg

SEQ ID NO: 818379 - RNA, 15 nt, Mycobacterium avium subsp. paratuberculosis
ccucgccgcgggcca

SEQ ID NO: 818380 - RNA, 19 nt, Mycobacterium avium subsp. paratuberculosis
ccucgccgcgggccagcca

SEQ ID NO: 818381 - RNA, 18 nt, Mycobacterium avium subsp. paratuberculosis
ccucgccgaaccggggcc

SEQ ID NO: 818382 - RNA, 22 nt, Mycobacterium avium subsp. paratuberculosis
ccucgccgaaccggggccgcac

SEQ ID NO: 818383 - RNA, 14 nt, Mycobacterium avium subsp. paratuberculosis
ccucgccgacggug

SEQ ID NO: 818384 - RNA, 21 nt, Mycobacterium avium subsp. paratuberculosis
ccucgccgacgucccagcaca

SEQ ID NO: 818385 - RNA, 12 nt, Mycobacterium avium subsp. paratuberculosis
ccucgccgagca

SEQ ID NO: 818386 - RNA, 14 nt, Mycobacterium avium subsp. paratuberculosis
ccucgccgagcaga

SEQ ID NO: 818387 - RNA, 13 nt, Mycobacterium avium subsp. paratuberculosis
ccucgccggcgcc

SEQ ID NO: 818388 - RNA, 15 nt, Mycobacterium avium subsp. paratuberculosis
ccucgccggcgccgg

SEQ ID NO: 818389 - RNA, 13 nt, Mycobacterium avium subsp. paratuberculosis
ccucgccggccgc

SEQ ID NO: 818390 - RNA, 21 nt, Mycobacterium avium subsp. paratuberculosis
ccucgccggagagcccgucgu

SEQ ID NO: 818391 - RNA, 13 nt, Mycobacterium avium subsp. paratuberculosis
ccucgccggaguu

SEQ ID NO: 818392 - RNA, 15 nt, Mycobacterium avium subsp. paratuberculosis
ccucgccggccgccg

SEQ ID NO: 818393 - RNA, 16 nt, Mycobacterium avium subsp. paratuberculosis
ccucgccggccgccgu

SEQ ID NO: 818394 - RNA, 14 nt, Mycobacterium avium subsp. paratuberculosis
ccucgccggccggg

SEQ ID NO: 818395 - RNA, 16 nt, Mycobacterium avium subsp. paratuberculosis
ccucgccggcggcgcc

SEQ ID NO: 818396 - RNA, 15 nt, Mycobacterium avium subsp. paratuberculosis
ccucgcacagcuugu

SEQ ID NO: 818397 - RNA, 17 nt, Mycobacterium avium subsp. paratuberculosis
ccucgcacagcuugucc

SEQ ID NO: 818398 - RNA, 20 nt, Mycobacterium avium subsp. paratuberculosis
ccucgaugucgucgaugaac

SEQ ID NO: 818399 - RNA, 18 nt, Mycobacterium avium subsp. paratuberculosis
ccucgauggguucuucga

SEQ ID NO: 818400 - RNA, 21 nt, Mycobacterium avium subsp. paratuberculosis
ccucgaugccgugccggugga

SEQ ID NO: 818401 - RNA, 15 nt, Mycobacterium avium subsp. paratuberculosis
ccucgaugcgcaccg

SEQ ID NO: 818402 - RNA, 21 nt, Mycobacterium avium subsp. paratuberculosis
ccucgaugcgcaccgugccgc

SEQ ID NO: 818403 - RNA, 16 nt, Mycobacterium avium subsp. paratuberculosis
ccucgaugcggccguc

SEQ ID NO: 818404 - RNA, 14 nt, Mycobacterium avium subsp. paratuberculosis
ccucgauggcccgc

SEQ ID NO: 818405 - RNA, 17 nt, Mycobacterium avium subsp. paratuberculosis
ccucgauggccgggaag

SEQ ID NO: 818406 - RNA, 16 nt, Mycobacterium avium subsp. paratuberculosis
ccucgauggcggcggc

SEQ ID NO: 818407 - RNA, 13 nt, Mycobacterium avium subsp. paratuberculosis
ccucgaugacgcc

SEQ ID NO: 818408 - RNA, 23 nt, Mycobacterium avium subsp. paratuberculosis
ccucgaucgcgaccaccggccga

SEQ ID NO: 818409 - RNA, 19 nt, Mycobacterium avium subsp. paratuberculosis
ccucgaucugguucaccgc

SEQ ID NO: 818410 - RNA, 17 nt, Mycobacterium avium subsp. paratuberculosis
ccucgaucagcggcauc

SEQ ID NO: 818411 - RNA, 18 nt, Mycobacterium avium subsp. paratuberculosis
ccucgaucaucaccaccg

SEQ ID NO: 818412 - RNA, 23 nt, Mycobacterium avium subsp. paratuberculosis
ccucgaucaucaccaccgccgcc

SEQ ID NO: 818413 - RNA, 23 nt, Mycobacterium avium subsp. paratuberculosis
ccucgaucaucgcgucggugucg

SEQ ID NO: 818414 - RNA, 20 nt, Mycobacterium avium subsp. paratuberculosis
ccucgauccgguccagcccg

SEQ ID NO: 818415 - RNA, 14 nt, Mycobacterium avium subsp. paratuberculosis
ccucgaucgacacc

SEQ ID NO: 818416 - RNA, 16 nt, Mycobacterium avium subsp. paratuberculosis
ccucgaucgaggagau

SEQ ID NO: 818417 - RNA, 16 nt, Mycobacterium avium subsp. paratuberculosis
ccucgaucaccgacag

SEQ ID NO: 818418 - RNA, 19 nt, Mycobacterium avium subsp. paratuberculosis
ccucgaucagagcgggccg

SEQ ID NO: 818419 - RNA, 12 nt, Mycobacterium avium subsp. paratuberculosis
ccucgaucagcc

SEQ ID NO: 818420 - RNA, 13 nt, Mycobacterium avium subsp. paratuberculosis
ccucgaucagcca

SEQ ID NO: 818421 - RNA, 18 nt, Mycobacterium avium subsp. paratuberculosis
ccucgaucagccacaccg

SEQ ID NO: 818422 - RNA, 16 nt, Mycobacterium avium subsp. paratuberculosis
ccucgagugccugcgc

SEQ ID NO: 818423 - RNA, 14 nt, Mycobacterium avium subsp. paratuberculosis
ccucgaucaacgcc

SEQ ID NO: 818424 - RNA, 16 nt, Mycobacterium avium subsp. paratuberculosis
ccucgaucaacgccgg

SEQ ID NO: 818425 - RNA, 18 nt, Mycobacterium avium subsp. paratuberculosis
ccucgaucaacgccgggu

SEQ ID NO: 818426 - RNA, 20 nt, Mycobacterium avium subsp. paratuberculosis
ccucgaucaacgccgggucg

SEQ ID NO: 818427 - RNA, 19 nt, Mycobacterium avium subsp. paratuberculosis
ccuccucgaugucgguggu

SEQ ID NO: 818428 - RNA, 20 nt, Mycobacterium avium subsp. paratuberculosis
ccuccgugcuggccggguug

SEQ ID NO: 818429 - RNA, 21 nt, Mycobacterium avium subsp. paratuberculosis
ccuccgugcuggccggguugg

SEQ ID NO: 818430 - RNA, 22 nt, Mycobacterium avium subsp. paratuberculosis
ccuccgggcggcaccgcugccg

SEQ ID NO: 818431 - RNA, 17 nt, Mycobacterium avium subsp. paratuberculosis
ccuccgguccgggcugc

SEQ ID NO: 818432 - RNA, 12 nt, Mycobacterium avium subsp. paratuberculosis
ccuccggcgccu

SEQ ID NO: 818433 - RNA, 20 nt, Mycobacterium avium subsp. paratuberculosis
ccuccgggaaggcggccgcg

SEQ ID NO: 818434 - RNA, 18 nt, Mycobacterium avium subsp. paratuberculosis
ccuccgggcugaccucgc

SEQ ID NO: 818435 - RNA, 18 nt, Mycobacterium avium subsp. paratuberculosis
ccuccgggcugccguaga

SEQ ID NO: 818436 - RNA, 19 nt, Mycobacterium avium subsp. paratuberculosis
ccuccggguccccgccgcc

SEQ ID NO: 818437 - RNA, 20 nt, Mycobacterium avium subsp. paratuberculosis
ccuccggguccccgccgccg

SEQ ID NO: 818438 - RNA, 12 nt, Mycobacterium avium subsp. paratuberculosis
ccuccggcccga

SEQ ID NO: 818439 - RNA, 14 nt, Mycobacterium avium subsp. paratuberculosis
ccuccggcccgauc

SEQ ID NO: 818440 - RNA, 21 nt, Mycobacterium avium subsp. paratuberculosis
ccuccggcccgaucgcggcga

SEQ ID NO: 818441 - RNA, 19 nt, Mycobacterium avium subsp. paratuberculosis
ccuccggagaucgccccgg

SEQ ID NO: 818442 - RNA, 16 nt, Mycobacterium avium subsp. paratuberculosis
ccuccggagugacguc

SEQ ID NO: 818443 - RNA, 19 nt, Mycobacterium avium subsp. paratuberculosis
ccuccggcaggccgcggcc

SEQ ID NO: 818444 - RNA, 22 nt, Mycobacterium avium subsp. paratuberculosis
ccuccggcaggccgcggccguc

SEQ ID NO: 818445 - RNA, 19 nt, Mycobacterium avium subsp. paratuberculosis
ccuccggcaguacgcgccg

SEQ ID NO: 818446 - RNA, 13 nt, Mycobacterium avium subsp. paratuberculosis
ccuccgcgaucag

SEQ ID NO: 818447 - RNA, 17 nt, Mycobacterium avium subsp. paratuberculosis
ccuccgcgaucagcucg

SEQ ID NO: 818448 - RNA, 15 nt, Mycobacterium avium subsp. paratuberculosis
ccuccgcgcgcggcc

SEQ ID NO: 818449 - RNA, 12 nt, Mycobacterium avium subsp. paratuberculosis
ccuccgcggcgc

SEQ ID NO: 818450 - RNA, 13 nt, Mycobacterium avium subsp. paratuberculosis
ccuccgcggcgcc

SEQ ID NO: 818451 - RNA, 14 nt, Mycobacterium avium subsp. paratuberculosis
ccuccgcggcgccg

SEQ ID NO: 818452 - RNA, 21 nt, Mycobacterium avium subsp. paratuberculosis
ccuccuggcggguggcgauga

SEQ ID NO: 818453 - RNA, 23 nt, Mycobacterium avium subsp. paratuberculosis
ccucgacguaggccagaucuccg

SEQ ID NO: 818454 - RNA, 23 nt, Mycobacterium avium subsp. paratuberculosis
ccucgacguaggugagcaacgcc

SEQ ID NO: 818455 - RNA, 18 nt, Mycobacterium avium subsp. paratuberculosis
ccucgacguccaggccgg

SEQ ID NO: 818456 - RNA, 23 nt, Mycobacterium avium subsp. paratuberculosis
ccucgacguccaggccggcgccg

SEQ ID NO: 818457 - RNA, 24 nt, Mycobacterium avium subsp. paratuberculosis
ccucgacguccaggccggcgccgc

SEQ ID NO: 818458 - RNA, 18 nt, Mycobacterium avium subsp. paratuberculosis
ccuccucguccgcggcgg

SEQ ID NO: 818459 - RNA, 19 nt, Mycobacterium avium subsp. paratuberculosis
ccuccucuucgcugccgcc

SEQ ID NO: 818460 - RNA, 13 nt, Mycobacterium avium subsp. paratuberculosis
ccuccugcacccg

SEQ ID NO: 818461 - RNA, 21 nt, Mycobacterium avium subsp. paratuberculosis
ccucgaggaucgcggccacgc

SEQ ID NO: 818462 - RNA, 15 nt, Mycobacterium avium subsp. paratuberculosis
ccucgaggccgaggu

SEQ ID NO: 818463 - RNA, 18 nt, Mycobacterium avium subsp. paratuberculosis
ccucgagcaucucgaacc

SEQ ID NO: 818464 - RNA, 23 nt, Mycobacterium avium subsp. paratuberculosis
ccucgagccauaaaccggccggc

SEQ ID NO: 818465 - RNA, 24 nt, Mycobacterium avium subsp. paratuberculosis
ccucgagccguuugaugccguccg

SEQ ID NO: 818466 - RNA, 20 nt, Mycobacterium avium subsp. paratuberculosis
ccucgagcgcgucgaccagc

SEQ ID NO: 818467 - RNA, 14 nt, Mycobacterium avium subsp. paratuberculosis
ccucgagcgucacg

SEQ ID NO: 818468 - RNA, 16 nt, Mycobacterium avium subsp. paratuberculosis
ccucgagcuugccguc

SEQ ID NO: 818469 - RNA, 18 nt, Mycobacterium avium subsp. paratuberculosis
ccucgagcacucgcggga

SEQ ID NO: 818470 - RNA, 14 nt, Mycobacterium avium subsp. paratuberculosis
ccucgagcagcgcg

SEQ ID NO: 818471 - RNA, 14 nt, Mycobacterium avium subsp. paratuberculosis
ccucgagcaccggc

SEQ ID NO: 818472 - RNA, 22 nt, Mycobacterium avium subsp. paratuberculosis
ccucgagcaccggcggcagcga

SEQ ID NO: 818473 - RNA, 14 nt, Mycobacterium avium subsp. paratuberculosis
ccucgagcaacggc

SEQ ID NO: 818474 - RNA, 19 nt, Mycobacterium avium subsp. paratuberculosis
ccucgagcaacggccgcag

SEQ ID NO: 818475 - RNA, 16 nt, Mycobacterium avium subsp. paratuberculosis
ccucgagcaccacggc

SEQ ID NO: 818476 - RNA, 20 nt, Mycobacterium avium subsp. paratuberculosis
ccucgagcaccacggcccgc

SEQ ID NO: 818477 - RNA, 18 nt, Mycobacterium avium subsp. paratuberculosis
ccugaagaagcggccgua

SEQ ID NO: 818478 - RNA, 18 nt, Mycobacterium avium subsp. paratuberculosis
ccugaaccgcgcacucga

SEQ ID NO: 818479 - RNA, 18 nt, Mycobacterium avium subsp. paratuberculosis
ccucuucgcugccgccgc

SEQ ID NO: 818480 - RNA, 13 nt, Mycobacterium avium subsp. paratuberculosis
ccucuucggcgcc

SEQ ID NO: 818481 - RNA, 14 nt, Mycobacterium avium subsp. paratuberculosis
ccucuucggcgcgc

SEQ ID NO: 818482 - RNA, 21 nt, Mycobacterium avium subsp. paratuberculosis
ccucuucgcggauccgggccg

SEQ ID NO: 818483 - RNA, 22 nt, Mycobacterium avium subsp. paratuberculosis
ccucuucgcggauccgggccgc

SEQ ID NO: 818484 - RNA, 13 nt, Mycobacterium avium subsp. paratuberculosis
ccucuugcggcgc

SEQ ID NO: 818485 - RNA, 14 nt, Mycobacterium avium subsp. paratuberculosis
ccucugcgaccacc

SEQ ID NO: 818486 - RNA, 20 nt, Mycobacterium avium subsp. paratuberculosis
ccucugcgaccacccggacg

SEQ ID NO: 818487 - RNA, 23 nt, Mycobacterium avium subsp. paratuberculosis
ccucucagcgcugucgcgggccc

SEQ ID NO: 818488 - RNA, 13 nt, Mycobacterium avium subsp. paratuberculosis
ccucugccacggc

SEQ ID NO: 818489 - RNA, 15 nt, Mycobacterium avium subsp. paratuberculosis
ccucugccacggcgg

SEQ ID NO: 818490 - RNA, 20 nt, Mycobacterium avium subsp. paratuberculosis
ccucggugaucucaccggcg

SEQ ID NO: 818491 - RNA, 20 nt, Mycobacterium avium subsp. paratuberculosis
ccucggugaugucgacgucg

SEQ ID NO: 818492 - RNA, 17 nt, Mycobacterium avium subsp. paratuberculosis
ccucggugcggaacacc

SEQ ID NO: 818493 - RNA, 22 nt, Mycobacterium avium subsp. paratuberculosis
ccucggugcggaacaccgccuu

SEQ ID NO: 818494 - RNA, 13 nt, Mycobacterium avium subsp. paratuberculosis
ccucgguggacgc

SEQ ID NO: 818495 - RNA, 13 nt, Mycobacterium avium subsp. paratuberculosis
ccucgguggccac

SEQ ID NO: 818496 - RNA, 12 nt, Mycobacterium avium subsp. paratuberculosis
ccucgguggcgg

SEQ ID NO: 818497 - RNA, 18 nt, Mycobacterium avium subsp. paratuberculosis
ccucgguguacagcgcca

SEQ ID NO: 818498 - RNA, 21 nt, Mycobacterium avium subsp. paratuberculosis
ccucgguguacagcgccaugu

SEQ ID NO: 818499 - RNA, 22 nt, Mycobacterium avium subsp. paratuberculosis
ccucgguuucgaacugggucug

SEQ ID NO: 818500 - RNA, 15 nt, Mycobacterium avium subsp. paratuberculosis
ccucguagcggccgc

SEQ ID NO: 818501 - RNA, 16 nt, Mycobacterium avium subsp. paratuberculosis
ccucguagcggccgca

SEQ ID NO: 818502 - RNA, 20 nt, Mycobacterium avium subsp. paratuberculosis
ccucggucagguagccgagg

SEQ ID NO: 818503 - RNA, 15 nt, Mycobacterium avium subsp. paratuberculosis
ccucgcgcagcaccg

SEQ ID NO: 818504 - RNA, 14 nt, Mycobacterium avium subsp. paratuberculosis
ccucgcgauggcgg

SEQ ID NO: 818505 - RNA, 23 nt, Mycobacterium avium subsp. paratuberculosis
ccucgcgcaaugccgccgcgacg

SEQ ID NO: 818506 - RNA, 18 nt, Mycobacterium avium subsp. paratuberculosis
ccucgccguacgcgccgg

SEQ ID NO: 818507 - RNA, 24 nt, Mycobacterium avium subsp. paratuberculosis
ccucgccguacgcgccggccagcc

SEQ ID NO: 818508 - RNA, 22 nt, Mycobacterium avium subsp. paratuberculosis
ccucgccgucgaaggccgggcu

SEQ ID NO: 818509 - RNA, 16 nt, Mycobacterium avium subsp. paratuberculosis
ccucgccgucgcgauc

SEQ ID NO: 818510 - RNA, 16 nt, Mycobacterium avium subsp. paratuberculosis
ccucgccggucagcgc

SEQ ID NO: 818511 - RNA, 19 nt, Mycobacterium avium subsp. paratuberculosis
ccucgccguugccggcccg

SEQ ID NO: 818512 - RNA, 13 nt, Mycobacterium avium subsp. paratuberculosis
ccucgcgcccggc

SEQ ID NO: 818513 - RNA, 15 nt, Mycobacterium avium subsp. paratuberculosis
ccucgcgcccggcgc

SEQ ID NO: 818514 - RNA, 16 nt, Mycobacterium avium subsp. paratuberculosis
ccucgcgcccggcgcc

SEQ ID NO: 818515 - RNA, 13 nt, Mycobacterium avium subsp. paratuberculosis
ccucgcgccgcca

SEQ ID NO: 818516 - RNA, 14 nt, Mycobacterium avium subsp. paratuberculosis
ccucgcgccgccac

SEQ ID NO: 818517 - RNA, 17 nt, Mycobacterium avium subsp. paratuberculosis
ccucgcgccgccacgcg

SEQ ID NO: 818518 - RNA, 18 nt, Mycobacterium avium subsp. paratuberculosis
ccucgcgccgccacgcgg

SEQ ID NO: 818519 - RNA, 23 nt, Mycobacterium avium subsp. paratuberculosis
ccucgcgccgccacgcggcgcgc

SEQ ID NO: 818520 - RNA, 16 nt, Mycobacterium avium subsp. paratuberculosis
ccucgcgcggggcggc

SEQ ID NO: 818521 - RNA, 19 nt, Mycobacterium avium subsp. paratuberculosis
ccucgcgcggggcggccgc

SEQ ID NO: 818522 - RNA, 21 nt, Mycobacterium avium subsp. paratuberculosis
ccucgcgcggggcggccgccg

SEQ ID NO: 818523 - RNA, 22 nt, Mycobacterium avium subsp. paratuberculosis
ccucgcgcggggcggccgccgg

SEQ ID NO: 818524 - RNA, 14 nt, Mycobacterium avium subsp. paratuberculosis
ccucgcgcgucacg

SEQ ID NO: 818525 - RNA, 16 nt, Mycobacterium avium subsp. paratuberculosis
ccucgcgccguggccc

SEQ ID NO: 818526 - RNA, 17 nt, Mycobacterium avium subsp. paratuberculosis
ccucgcgggcgaccugg

SEQ ID NO: 818527 - RNA, 23 nt, Mycobacterium avium subsp. paratuberculosis
ccucgcgcucuugggcggccggc

SEQ ID NO: 818528 - RNA, 13 nt, Mycobacterium avium subsp. paratuberculosis
ccucgcggaaccg

SEQ ID NO: 818529 - RNA, 14 nt, Mycobacterium avium subsp. paratuberculosis
ccucgcggucgacg

SEQ ID NO: 818530 - RNA, 14 nt, Mycobacterium avium subsp. paratuberculosis
ccucgcguacccgg

SEQ ID NO: 818531 - RNA, 19 nt, Mycobacterium avium subsp. paratuberculosis
ccucgcuaaucgccgcgcg

SEQ ID NO: 818532 - RNA, 13 nt, Mycobacterium avium subsp. paratuberculosis
ccucgcuacgcga

SEQ ID NO: 818533 - RNA, 14 nt, Mycobacterium avium subsp. paratuberculosis
ccucggcgaccagc

SEQ ID NO: 818534 - RNA, 15 nt, Mycobacterium avium subsp. paratuberculosis
ccucggcgaccucgg

SEQ ID NO: 818535 - RNA, 19 nt, Mycobacterium avium subsp. paratuberculosis
ccucgcucaacccgucgcg

SEQ ID NO: 818536 - RNA, 14 nt, Mycobacterium avium subsp. paratuberculosis
ccucgcucagcccg

SEQ ID NO: 818537 - RNA, 14 nt, Mycobacterium avium subsp. paratuberculosis
ccucggcgagccgc

SEQ ID NO: 818538 - RNA, 13 nt, Mycobacterium avium subsp. paratuberculosis
ccucggcgaucgg

SEQ ID NO: 818539 - RNA, 11 nt, Mycobacterium avium subsp. paratuberculosis
ccucggcgaug

SEQ ID NO: 818540 - RNA, 15 nt, Mycobacterium avium subsp. paratuberculosis
ccucggcgaugccga

SEQ ID NO: 818541 - RNA, 15 nt, Mycobacterium avium subsp. paratuberculosis
ccucggcgccucggc

SEQ ID NO: 818542 - RNA, 18 nt, Mycobacterium avium subsp. paratuberculosis
ccucggcgaggucgucga

SEQ ID NO: 818543 - RNA, 15 nt, Mycobacterium avium subsp. paratuberculosis
ccucggcggccucgg

SEQ ID NO: 818544 - RNA, 20 nt, Mycobacterium avium subsp. paratuberculosis
ccucggcgcggaugacgugc

SEQ ID NO: 818545 - RNA, 20 nt, Mycobacterium avium subsp. paratuberculosis
ccucggcgcucgccgcgcgg

SEQ ID NO: 818546 - RNA, 21 nt, Mycobacterium avium subsp. paratuberculosis
ccucggcgcugcccgccgcgg

SEQ ID NO: 818547 - RNA, 15 nt, Mycobacterium avium subsp. paratuberculosis
ccucggugaccucga

SEQ ID NO: 818548 - RNA, 18 nt, Mycobacterium avium subsp. paratuberculosis
ccucggucgcgugaccgg

SEQ ID NO: 818549 - RNA, 22 nt, Mycobacterium avium subsp. paratuberculosis
ccucggucgcgugaccggcggu

SEQ ID NO: 818550 - RNA, 18 nt, Mycobacterium avium subsp. paratuberculosis
ccucgguacccccgccgg

SEQ ID NO: 818551 - RNA, 15 nt, Mycobacterium avium subsp. paratuberculosis
ccucggucagcucgg

SEQ ID NO: 818552 - RNA, 15 nt, Mycobacterium avium subsp. paratuberculosis
ccucggcggcaccgc

SEQ ID NO: 818553 - RNA, 15 nt, Mycobacterium avium subsp. paratuberculosis
ccucggcggccagcg

SEQ ID NO: 818554 - RNA, 13 nt, Mycobacterium avium subsp. paratuberculosis
ccucggcggcccc

SEQ ID NO: 818555 - RNA, 14 nt, Mycobacterium avium subsp. paratuberculosis
ccucggcggccgcc

SEQ ID NO: 818556 - RNA, 15 nt, Mycobacterium avium subsp. paratuberculosis
ccucggcggccgccc

SEQ ID NO: 818557 - RNA, 13 nt, Mycobacterium avium subsp. paratuberculosis
ccucggcggccgg

SEQ ID NO: 818558 - RNA, 16 nt, Mycobacterium avium subsp. paratuberculosis
ccucggcggcggcgcg

SEQ ID NO: 818559 - RNA, 15 nt, Mycobacterium avium subsp. paratuberculosis
ccugauacgacgucc

SEQ ID NO: 818560 - RNA, 23 nt, Mycobacterium avium subsp. paratuberculosis
ccugauacgacguccgggccgcc

SEQ ID NO: 818561 - RNA, 12 nt, Mycobacterium avium subsp. paratuberculosis
ccugaucgcggc

SEQ ID NO: 818562 - RNA, 14 nt, Mycobacterium avium subsp. paratuberculosis
ccugaucgcggcga

SEQ ID NO: 818563 - RNA, 23 nt, Mycobacterium avium subsp. paratuberculosis
ccugaucgcggcgagcagcgcga

SEQ ID NO: 818564 - RNA, 20 nt, Mycobacterium avium subsp. paratuberculosis
ccugaucgaguuccgcgucg

SEQ ID NO: 818565 - RNA, 21 nt, Mycobacterium avium subsp. paratuberculosis
ccugaucgaguuccgcgucgg

SEQ ID NO: 818566 - RNA, 22 nt, Mycobacterium avium subsp. paratuberculosis
ccugaucgaguuccgcgucggc

SEQ ID NO: 818567 - RNA, 13 nt, Mycobacterium avium subsp. paratuberculosis
ccugauccgcggu

SEQ ID NO: 818568 - RNA, 14 nt, Mycobacterium avium subsp. paratuberculosis
ccugacccggccgu

SEQ ID NO: 818569 - RNA, 15 nt, Mycobacterium avium subsp. paratuberculosis
ccugacacagcaccg

SEQ ID NO: 818570 - RNA, 17 nt, Mycobacterium avium subsp. paratuberculosis
ccugacacagcaccggc

SEQ ID NO: 818571 - RNA, 21 nt, Mycobacterium avium subsp. paratuberculosis
ccugacacagcaccggcgucg

SEQ ID NO: 818572 - RNA, 22 nt, Mycobacterium avium subsp. paratuberculosis
ccugacacagcaccggcgucga

SEQ ID NO: 818573 - RNA, 23 nt, Mycobacterium avium subsp. paratuberculosis
ccugacacagcaccggcgucgac

SEQ ID NO: 818574 - RNA, 15 nt, Mycobacterium avium subsp. paratuberculosis
ccugacacgaccgcc

SEQ ID NO: 818575 - RNA, 16 nt, Mycobacterium avium subsp. paratuberculosis
ccugacagacccgauc

SEQ ID NO: 818576 - RNA, 17 nt, Mycobacterium avium subsp. paratuberculosis
ccugacagacccgaucg

SEQ ID NO: 818577 - RNA, 16 nt, Mycobacterium avium subsp. paratuberculosis
ccugcacuaccccguc

SEQ ID NO: 818578 - RNA, 16 nt, Mycobacterium avium subsp. paratuberculosis
ccugcagccgccgcgc

SEQ ID NO: 818579 - RNA, 16 nt, Mycobacterium avium subsp. paratuberculosis
ccugcagccggguggc

SEQ ID NO: 818580 - RNA, 13 nt, Mycobacterium avium subsp. paratuberculosis
ccugcagcaccag

SEQ ID NO: 818581 - RNA, 21 nt, Mycobacterium avium subsp. paratuberculosis
ccugcagcaccaggcccucgc

SEQ ID NO: 818582 - RNA, 14 nt, Mycobacterium avium subsp. paratuberculosis
ccugcagcaccgaa

SEQ ID NO: 818583 - RNA, 16 nt, Mycobacterium avium subsp. paratuberculosis
ccugcagcaccgaacc

SEQ ID NO: 818584 - RNA, 13 nt, Mycobacterium avium subsp. paratuberculosis
ccugcaugccggg

SEQ ID NO: 818585 - RNA, 17 nt, Mycobacterium avium subsp. paratuberculosis
ccugcagcucgccggcg

SEQ ID NO: 818586 - RNA, 18 nt, Mycobacterium avium subsp. paratuberculosis
ccugcagcucgccggcgc

SEQ ID NO: 818587 - RNA, 14 nt, Mycobacterium avium subsp. paratuberculosis
ccugcagcucggug

SEQ ID NO: 818588 - RNA, 19 nt, Mycobacterium avium subsp. paratuberculosis
ccugcagcucggugcgcac

SEQ ID NO: 818589 - RNA, 23 nt, Mycobacterium avium subsp. paratuberculosis
ccugcagcucggugcgcaccccg

SEQ ID NO: 818590 - RNA, 14 nt, Mycobacterium avium subsp. paratuberculosis
ccugcagcgcggcg

SEQ ID NO: 818591 - RNA, 15 nt, Mycobacterium avium subsp. paratuberculosis
ccugcagcgcggcga

SEQ ID NO: 818592 - RNA, 19 nt, Mycobacterium avium subsp. paratuberculosis
ccugcagcgcggcgaucag

SEQ ID NO: 818593 - RNA, 21 nt, Mycobacterium avium subsp. paratuberculosis
ccugcagcgcggcgaucagcu

SEQ ID NO: 818594 - RNA, 23 nt, Mycobacterium avium subsp. paratuberculosis
ccugcagcgcggucaucgucauc

SEQ ID NO: 818595 - RNA, 14 nt, Mycobacterium avium subsp. paratuberculosis
ccugcagcgccguc

SEQ ID NO: 818596 - RNA, 22 nt, Mycobacterium avium subsp. paratuberculosis
ccugcagcgccguccgcaccgc

SEQ ID NO: 818597 - RNA, 13 nt, Mycobacterium avium subsp. paratuberculosis
ccugcagcgccuu

SEQ ID NO: 818598 - RNA, 19 nt, Mycobacterium avium subsp. paratuberculosis
ccugcagcgccuugaccgc

SEQ ID NO: 818599 - RNA, 17 nt, Mycobacterium avium subsp. paratuberculosis
ccugccagcgcccgcug

SEQ ID NO: 818600 - RNA, 20 nt, Mycobacterium avium subsp. paratuberculosis
ccugcaucucgacccgggcc

SEQ ID NO: 818601 - RNA, 18 nt, Mycobacterium avium subsp. paratuberculosis
ccugccccacacgcucgg

SEQ ID NO: 818602 - RNA, 20 nt, Mycobacterium avium subsp. paratuberculosis
ccugccccacacgcucggcg

SEQ ID NO: 818603 - RNA, 21 nt, Mycobacterium avium subsp. paratuberculosis
ccugccccccuugagccgguc

SEQ ID NO: 818604 - RNA, 12 nt, Mycobacterium avium subsp. paratuberculosis
ccugcccgccgc

SEQ ID NO: 818605 - RNA, 19 nt, Mycobacterium avium subsp. paratuberculosis
ccugcccgccgcggccgcu

SEQ ID NO: 818606 - RNA, 14 nt, Mycobacterium avium subsp. paratuberculosis
ccugcccgcgggug

SEQ ID NO: 818607 - RNA, 13 nt, Mycobacterium avium subsp. paratuberculosis
ccugcccggcggu

SEQ ID NO: 818608 - RNA, 14 nt, Mycobacterium avium subsp. paratuberculosis
ccugcccggcggug

SEQ ID NO: 818609 - RNA, 18 nt, Mycobacterium avium subsp. paratuberculosis
ccguccacagccggcggc

SEQ ID NO: 818610 - RNA, 20 nt, Mycobacterium avium subsp. paratuberculosis
ccguccacagccggcggcug

SEQ ID NO: 818611 - RNA, 21 nt, Mycobacterium avium subsp. paratuberculosis
ccgucccaggacaucaagugc

SEQ ID NO: 818612 - RNA, 17 nt, Mycobacterium avium subsp. paratuberculosis
ccguccccaccaccgac

SEQ ID NO: 818613 - RNA, 20 nt, Mycobacterium avium subsp. paratuberculosis
ccguccccaccaccgacagc

SEQ ID NO: 818614 - RNA, 23 nt, Mycobacterium avium subsp. paratuberculosis
ccguccccaccaccgacagcacc

SEQ ID NO: 818615 - RNA, 13 nt, Mycobacterium avium subsp. paratuberculosis
ccguccccgcgcg

SEQ ID NO: 818616 - RNA, 16 nt, Mycobacterium avium subsp. paratuberculosis
ccguccccgcgcggcu

SEQ ID NO: 818617 - RNA, 19 nt, Mycobacterium avium subsp. paratuberculosis
ccguccccgcgcggcucgc

SEQ ID NO: 818618 - RNA, 13 nt, Mycobacterium avium subsp. paratuberculosis
ccgucauccccau

SEQ ID NO: 818619 - RNA, 16 nt, Mycobacterium avium subsp. paratuberculosis
ccgucaucgccgacgg

SEQ ID NO: 818620 - RNA, 19 nt, Mycobacterium avium subsp. paratuberculosis
ccgucaucgccgacgguga

SEQ ID NO: 818621 - RNA, 21 nt, Mycobacterium avium subsp. paratuberculosis
ccgucaucgccgacggugagc

SEQ ID NO: 818622 - RNA, 17 nt, Mycobacterium avium subsp. paratuberculosis
ccgucaguucguagauc

SEQ ID NO: 818623 - RNA, 23 nt, Mycobacterium avium subsp. paratuberculosis
ccgucagugcgcauucggcgacg

SEQ ID NO: 818624 - RNA, 24 nt, Mycobacterium avium subsp. paratuberculosis
ccgucagugcgcauucggcgacgc

SEQ ID NO: 818625 - RNA, 14 nt, Mycobacterium avium subsp. paratuberculosis
ccgucaucaccgcc

SEQ ID NO: 818626 - RNA, 16 nt, Mycobacterium avium subsp. paratuberculosis
ccgucaucaccgccga

SEQ ID NO: 818627 - RNA, 22 nt, Mycobacterium avium subsp. paratuberculosis
ccgucaucaccgccgagggccc

SEQ ID NO: 818628 - RNA, 21 nt, Mycobacterium avium subsp. paratuberculosis
ccgucaucaucaccgggaugg

SEQ ID NO: 818629 - RNA, 18 nt, Mycobacterium avium subsp. paratuberculosis
ccgucaucgugugggcgc

SEQ ID NO: 818630 - RNA, 21 nt, Mycobacterium avium subsp. paratuberculosis
ccgucaucgugugggcgcccg

SEQ ID NO: 818631 - RNA, 22 nt, Mycobacterium avium subsp. paratuberculosis
ccgucaucgugugggcgcccgc

SEQ ID NO: 818632 - RNA, 14 nt, Mycobacterium avium subsp. paratuberculosis
ccgucagcgccgcc

SEQ ID NO: 818633 - RNA, 16 nt, Mycobacterium avium subsp. paratuberculosis
ccgucagcgccgcccg

SEQ ID NO: 818634 - RNA, 18 nt, Mycobacterium avium subsp. paratuberculosis
ccgucagcgucagcacgu

SEQ ID NO: 818635 - RNA, 21 nt, Mycobacterium avium subsp. paratuberculosis
ccgucagggugacguggcggc

SEQ ID NO: 818636 - RNA, 16 nt, Mycobacterium avium subsp. paratuberculosis
ccgucaggaacgccgg

SEQ ID NO: 818637 - RNA, 17 nt, Mycobacterium avium subsp. paratuberculosis
ccgucaggaacgccggc

SEQ ID NO: 818638 - RNA, 21 nt, Mycobacterium avium subsp. paratuberculosis
ccgucaggaacgccggcuugc

SEQ ID NO: 818639 - RNA, 18 nt, Mycobacterium avium subsp. paratuberculosis
ccgucaggagugcucggc

SEQ ID NO: 818640 - RNA, 17 nt, Mycobacterium avium subsp. paratuberculosis
ccgucacaccgcggcca

SEQ ID NO: 818641 - RNA, 18 nt, Mycobacterium avium subsp. paratuberculosis
ccgucacaccgcggccag

SEQ ID NO: 818642 - RNA, 18 nt, Mycobacterium avium subsp. paratuberculosis
ccgucagcagggccucgc

SEQ ID NO: 818643 - RNA, 18 nt, Mycobacterium avium subsp. paratuberculosis
ccguacucgaugccguug

SEQ ID NO: 818644 - RNA, 20 nt, Mycobacterium avium subsp. paratuberculosis
ccguacgcgguucgugcgca

SEQ ID NO: 818645 - RNA, 17 nt, Mycobacterium avium subsp. paratuberculosis
ccguaccgauccgcggg

SEQ ID NO: 818646 - RNA, 20 nt, Mycobacterium avium subsp. paratuberculosis
ccguaccgcaacaccgaaag

SEQ ID NO: 818647 - RNA, 20 nt, Mycobacterium avium subsp. paratuberculosis
ccguacagcugguccggccg

SEQ ID NO: 818648 - RNA, 19 nt, Mycobacterium avium subsp. paratuberculosis
ccguacauggugaccagcg

SEQ ID NO: 818649 - RNA, 22 nt, Mycobacterium avium subsp. paratuberculosis
ccguacauggugaccagcguga

SEQ ID NO: 818650 - RNA, 15 nt, Mycobacterium avium subsp. paratuberculosis
ccgguuugcgccggc

SEQ ID NO: 818651 - RNA, 16 nt, Mycobacterium avium subsp. paratuberculosis
ccgguuugcgccggcu

SEQ ID NO: 818652 - RNA, 18 nt, Mycobacterium avium subsp. paratuberculosis
ccgguuuccaguccggcg

SEQ ID NO: 818653 - RNA, 15 nt, Mycobacterium avium subsp. paratuberculosis
ccguaacgaugccgc

SEQ ID NO: 818654 - RNA, 23 nt, Mycobacterium avium subsp. paratuberculosis
ccguaaguggcgccgcggucgca

SEQ ID NO: 818655 - RNA, 23 nt, Mycobacterium avium subsp. paratuberculosis
ccggugaugccggcauccucggc

SEQ ID NO: 818656 - RNA, 19 nt, Mycobacterium avium subsp. paratuberculosis
ccggugauccacuccagca

SEQ ID NO: 818657 - RNA, 23 nt, Mycobacterium avium subsp. paratuberculosis
ccggugauccacuccagcaccgg

SEQ ID NO: 818658 - RNA, 15 nt, Mycobacterium avium subsp. paratuberculosis
ccggugaucgccgcc

SEQ ID NO: 818659 - RNA, 15 nt, Mycobacterium avium subsp. paratuberculosis
ccggugaucgcggcg

SEQ ID NO: 818660 - RNA, 18 nt, Mycobacterium avium subsp. paratuberculosis
ccggugaugaacgcgccg

SEQ ID NO: 818661 - RNA, 20 nt, Mycobacterium avium subsp. paratuberculosis
ccggugaugaacgcgccguc

SEQ ID NO: 818662 - RNA, 22 nt, Mycobacterium avium subsp. paratuberculosis
ccggugaugaacgcgccgucgu

SEQ ID NO: 818663 - RNA, 19 nt, Mycobacterium avium subsp. paratuberculosis
ccggugaugacgucgccca

SEQ ID NO: 818664 - RNA, 15 nt, Mycobacterium avium subsp. paratuberculosis
ccggugcccacgccg

SEQ ID NO: 818665 - RNA, 22 nt, Mycobacterium avium subsp. paratuberculosis
ccgguggacgaggugaccggcg

SEQ ID NO: 818666 - RNA, 23 nt, Mycobacterium avium subsp. paratuberculosis
ccgguggagauggccagcaccac

SEQ ID NO: 818667 - RNA, 21 nt, Mycobacterium avium subsp. paratuberculosis
ccgguggauauuucgcggccg

SEQ ID NO: 818668 - RNA, 19 nt, Mycobacterium avium subsp. paratuberculosis
ccgguggaugggcucgacc

SEQ ID NO: 818669 - RNA, 16 nt, Mycobacterium avium subsp. paratuberculosis
ccggugccacgcggcu

SEQ ID NO: 818670 - RNA, 20 nt, Mycobacterium avium subsp. paratuberculosis
ccggugccacggucaggcgc

SEQ ID NO: 818671 - RNA, 16 nt, Mycobacterium avium subsp. paratuberculosis
ccggugcagaucgucc

SEQ ID NO: 818672 - RNA, 19 nt, Mycobacterium avium subsp. paratuberculosis
ccggugcagcaccucgauc

SEQ ID NO: 818673 - RNA, 14 nt, Mycobacterium avium subsp. paratuberculosis
ccggugcagcacgu

SEQ ID NO: 818674 - RNA, 12 nt, Mycobacterium avium subsp. paratuberculosis
ccggugcaccac

SEQ ID NO: 818675 - RNA, 20 nt, Mycobacterium avium subsp. paratuberculosis
ccggugcaccacgaugaagc

SEQ ID NO: 818676 - RNA, 12 nt, Mycobacterium avium subsp. paratuberculosis
ccggugcaccgc

SEQ ID NO: 818677 - RNA, 20 nt, Mycobacterium avium subsp. paratuberculosis
ccggugcacgagcgucgugc

SEQ ID NO: 818678 - RNA, 23 nt, Mycobacterium avium subsp. paratuberculosis
ccgggugauggucucccgggcgg

SEQ ID NO: 818679 - RNA, 16 nt, Mycobacterium avium subsp. paratuberculosis
ccgggugaugucgccg

SEQ ID NO: 818680 - RNA, 12 nt, Mycobacterium avium subsp. paratuberculosis
ccgggugcaggc

SEQ ID NO: 818681 - RNA, 19 nt, Mycobacterium avium subsp. paratuberculosis
ccgggugcccaucugcaca

SEQ ID NO: 818682 - RNA, 12 nt, Mycobacterium avium subsp. paratuberculosis
ccgggugcccgc

SEQ ID NO: 818683 - RNA, 13 nt, Mycobacterium avium subsp. paratuberculosis
ccgggugcccgcg

SEQ ID NO: 818684 - RNA, 13 nt, Mycobacterium avium subsp. paratuberculosis
ccgggugcccggc

SEQ ID NO: 818685 - RNA, 20 nt, Mycobacterium avium subsp. paratuberculosis
ccgggugcgaacagccacgg

SEQ ID NO: 818686 - RNA, 15 nt, Mycobacterium avium subsp. paratuberculosis
ccgggugcgcgucgc

SEQ ID NO: 818687 - RNA, 21 nt, Mycobacterium avium subsp. paratuberculosis
ccgggugcgcuugucggcgug

SEQ ID NO: 818688 - RNA, 22 nt, Mycobacterium avium subsp. paratuberculosis
ccgggugcgcuugucggcgugg

SEQ ID NO: 818689 - RNA, 18 nt, Mycobacterium avium subsp. paratuberculosis
ccgggugcgggccagcag

SEQ ID NO: 818690 - RNA, 13 nt, Mycobacterium avium subsp. paratuberculosis
ccgggugcgucca

SEQ ID NO: 818691 - RNA, 20 nt, Mycobacterium avium subsp. paratuberculosis
ccgggugcguccagaccggc

SEQ ID NO: 818692 - RNA, 23 nt, Mycobacterium avium subsp. paratuberculosis
ccgggugcguccagaccggccgg

SEQ ID NO: 818693 - RNA, 19 nt, Mycobacterium avium subsp. paratuberculosis
ccggguggaacuggacgcc

SEQ ID NO: 818694 - RNA, 16 nt, Mycobacterium avium subsp. paratuberculosis
ccggguggacaccgcg

SEQ ID NO: 818695 - RNA, 19 nt, Mycobacterium avium subsp. paratuberculosis
ccggguggacaccgcgauc

SEQ ID NO: 818696 - RNA, 22 nt, Mycobacterium avium subsp. paratuberculosis
ccggguggacaccgcgaucacc

SEQ ID NO: 818697 - RNA, 15 nt, Mycobacterium avium subsp. paratuberculosis
ccggugaccgcgacg

SEQ ID NO: 818698 - RNA, 15 nt, Mycobacterium avium subsp. paratuberculosis
ccggugaccgcgccg

SEQ ID NO: 818699 - RNA, 14 nt, Mycobacterium avium subsp. paratuberculosis
ccggugaccugcag

SEQ ID NO: 818700 - RNA, 20 nt, Mycobacterium avium subsp. paratuberculosis
ccggugaccugcagcgccuu

SEQ ID NO: 818701 - RNA, 15 nt, Mycobacterium avium subsp. paratuberculosis
ccggugacgaccggc

SEQ ID NO: 818702 - RNA, 22 nt, Mycobacterium avium subsp. paratuberculosis
ccgggugcgauggcaacgccgg

SEQ ID NO: 818703 - RNA, 15 nt, Mycobacterium avium subsp. paratuberculosis
ccggugacggucagg

SEQ ID NO: 818704 - RNA, 21 nt, Mycobacterium avium subsp. paratuberculosis
ccggugacuccuccucggcca

SEQ ID NO: 818705 - RNA, 22 nt, Mycobacterium avium subsp. paratuberculosis
ccggugacuccuccucggccag

SEQ ID NO: 818706 - RNA, 23 nt, Mycobacterium avium subsp. paratuberculosis
ccggugagcaccgggaacagcca

SEQ ID NO: 818707 - RNA, 15 nt, Mycobacterium avium subsp. paratuberculosis
ccggugagcacgacc

SEQ ID NO: 818708 - RNA, 22 nt, Mycobacterium avium subsp. paratuberculosis
ccggugagcacgaccgccagca

SEQ ID NO: 818709 - RNA, 23 nt, Mycobacterium avium subsp. paratuberculosis
ccggugagcacgaccgccagcag

SEQ ID NO: 818710 - RNA, 16 nt, Mycobacterium avium subsp. paratuberculosis
ccggugagcacgguga

SEQ ID NO: 818711 - RNA, 19 nt, Mycobacterium avium subsp. paratuberculosis
ccggugagccucagggcgc

SEQ ID NO: 818712 - RNA, 13 nt, Mycobacterium avium subsp. paratuberculosis
ccggugagcggau

SEQ ID NO: 818713 - RNA, 22 nt, Mycobacterium avium subsp. paratuberculosis
ccggugagcggauuggucgggc

SEQ ID NO: 818714 - RNA, 15 nt, Mycobacterium avium subsp. paratuberculosis
ccgguguagaucggc

SEQ ID NO: 818715 - RNA, 20 nt, Mycobacterium avium subsp. paratuberculosis
ccgguguaucccaucagugc

SEQ ID NO: 818716 - RNA, 21 nt, Mycobacterium avium subsp. paratuberculosis
ccgguggcgaaguugaucggu

SEQ ID NO: 818717 - RNA, 16 nt, Mycobacterium avium subsp. paratuberculosis
ccgguguccacgucgc

SEQ ID NO: 818718 - RNA, 18 nt, Mycobacterium avium subsp. paratuberculosis
ccgguguccacgucgccc

SEQ ID NO: 818719 - RNA, 14 nt, Mycobacterium avium subsp. paratuberculosis
ccggugucacgcug

SEQ ID NO: 818720 - RNA, 14 nt, Mycobacterium avium subsp. paratuberculosis
ccggugucgccguc

SEQ ID NO: 818721 - RNA, 17 nt, Mycobacterium avium subsp. paratuberculosis
ccggugucgccgucgcc

SEQ ID NO: 818722 - RNA, 19 nt, Mycobacterium avium subsp. paratuberculosis
ccggugucgccgucgccgc

SEQ ID NO: 818723 - RNA, 14 nt, Mycobacterium avium subsp. paratuberculosis
ccggugucggcgac

SEQ ID NO: 818724 - RNA, 15 nt, Mycobacterium avium subsp. paratuberculosis
ccgguggacuccagc

SEQ ID NO: 818725 - RNA, 16 nt, Mycobacterium avium subsp. paratuberculosis
ccgguggacuccagca

SEQ ID NO: 818726 - RNA, 11 nt, Mycobacterium avium subsp. paratuberculosis
ccgguggcagc

SEQ ID NO: 818727 - RNA, 19 nt, Mycobacterium avium subsp. paratuberculosis
ccgguggcagcccggcuaa

SEQ ID NO: 818728 - RNA, 19 nt, Mycobacterium avium subsp. paratuberculosis
ccgguggcccggucgucga

SEQ ID NO: 818729 - RNA, 22 nt, Mycobacterium avium subsp. paratuberculosis
ccgguggcccggucgucgagca

SEQ ID NO: 818730 - RNA, 13 nt, Mycobacterium avium subsp. paratuberculosis
ccgguggccgcga

SEQ ID NO: 818731 - RNA, 13 nt, Mycobacterium avium subsp. paratuberculosis
ccgguggccgcgc

SEQ ID NO: 818732 - RNA, 19 nt, Mycobacterium avium subsp. paratuberculosis
ccgguggccgcgucgacca

SEQ ID NO: 818733 - RNA, 13 nt, Mycobacterium avium subsp. paratuberculosis
ccgguggcggcca

SEQ ID NO: 818734 - RNA, 22 nt, Mycobacterium avium subsp. paratuberculosis
ccgguggcggccacgaucgcga

SEQ ID NO: 818735 - RNA, 15 nt, Mycobacterium avium subsp. paratuberculosis
ccgguggcggcgaca

SEQ ID NO: 818736 - RNA, 15 nt, Mycobacterium avium subsp. paratuberculosis
ccgguugagcaccgc

SEQ ID NO: 818737 - RNA, 17 nt, Mycobacterium avium subsp. paratuberculosis
ccgguugagugcgccgu

SEQ ID NO: 818738 - RNA, 23 nt, Mycobacterium avium subsp. paratuberculosis
ccgguugagugcgccgugcagca

SEQ ID NO: 818739 - RNA, 17 nt, Mycobacterium avium subsp. paratuberculosis
ccgguugaaggccgcgc

SEQ ID NO: 818740 - RNA, 20 nt, Mycobacterium avium subsp. paratuberculosis
ccgguugaccccggccccgg

SEQ ID NO: 818741 - RNA, 21 nt, Mycobacterium avium subsp. paratuberculosis
ccgguugaccccggccccggc

SEQ ID NO: 818742 - RNA, 13 nt, Mycobacterium avium subsp. paratuberculosis
ccgguugcaccgc

SEQ ID NO: 818743 - RNA, 15 nt, Mycobacterium avium subsp. paratuberculosis
ccgguugcgggccga

SEQ ID NO: 818744 - RNA, 20 nt, Mycobacterium avium subsp. paratuberculosis
ccgguuggccagguggccgc

SEQ ID NO: 818745 - RNA, 22 nt, Mycobacterium avium subsp. paratuberculosis
ccggugucggggucgucgacgg

SEQ ID NO: 818746 - RNA, 15 nt, Mycobacterium avium subsp. paratuberculosis
ccggugugcagccac

SEQ ID NO: 818747 - RNA, 22 nt, Mycobacterium avium subsp. paratuberculosis
ccggugugcagccacccgucgg

SEQ ID NO: 818748 - RNA, 16 nt, Mycobacterium avium subsp. paratuberculosis
ccggugugccuggcuc

SEQ ID NO: 818749 - RNA, 23 nt, Mycobacterium avium subsp. paratuberculosis
ccggugugccuggcuccccggcg

SEQ ID NO: 818750 - RNA, 21 nt, Mycobacterium avium subsp. paratuberculosis
ccgguucgucaacgccccggu

SEQ ID NO: 818751 - RNA, 22 nt, Mycobacterium avium subsp. paratuberculosis
ccgguucgucaacgccccgguc

SEQ ID NO: 818752 - RNA, 15 nt, Mycobacterium avium subsp. paratuberculosis
ccgguucgucccgcg

SEQ ID NO: 818753 - RNA, 17 nt, Mycobacterium avium subsp. paratuberculosis
ccgguucgucccgcgcg

SEQ ID NO: 818754 - RNA, 18 nt, Mycobacterium avium subsp. paratuberculosis
ccgguucgucccgcgcgg

SEQ ID NO: 818755 - RNA, 15 nt, Mycobacterium avium subsp. paratuberculosis
ccgguucgucguguc

SEQ ID NO: 818756 - RNA, 20 nt, Mycobacterium avium subsp. paratuberculosis
ccgguucgucgugucguguu

SEQ ID NO: 818757 - RNA, 16 nt, Mycobacterium avium subsp. paratuberculosis
ccgguucggacacggc

SEQ ID NO: 818758 - RNA, 13 nt, Mycobacterium avium subsp. paratuberculosis
ccgguucggcggc

SEQ ID NO: 818759 - RNA, 15 nt, Mycobacterium avium subsp. paratuberculosis
ccgguucggcggcau

SEQ ID NO: 818760 - RNA, 19 nt, Mycobacterium avium subsp. paratuberculosis
ccgguguucaagccggcgu

SEQ ID NO: 818761 - RNA, 21 nt, Mycobacterium avium subsp. paratuberculosis
ccgguguucaagccggcgugg

SEQ ID NO: 818762 - RNA, 15 nt, Mycobacterium avium subsp. paratuberculosis
ccgucugcgccguca

SEQ ID NO: 818763 - RNA, 16 nt, Mycobacterium avium subsp. paratuberculosis
ccgucugcgccgucac

SEQ ID NO: 818764 - RNA, 20 nt, Mycobacterium avium subsp. paratuberculosis
ccgucugcgccgucaccggc

SEQ ID NO: 818765 - RNA, 23 nt, Mycobacterium avium subsp. paratuberculosis
ccgucugcgccgucaccggcugc

SEQ ID NO: 818766 - RNA, 12 nt, Mycobacterium avium subsp. paratuberculosis
ccgucucgccgu

SEQ ID NO: 818767 - RNA, 21 nt, Mycobacterium avium subsp. paratuberculosis
ccgucgucguuguuggcggcg

SEQ ID NO: 818768 - RNA, 16 nt, Mycobacterium avium subsp. paratuberculosis
ccgucucgagccggcg

SEQ ID NO: 818769 - RNA, 17 nt, Mycobacterium avium subsp. paratuberculosis
ccgucucgagccggcgc

SEQ ID NO: 818770 - RNA, 18 nt, Mycobacterium avium subsp. paratuberculosis
ccgucucgagccggcgca

SEQ ID NO: 818771 - RNA, 21 nt, Mycobacterium avium subsp. paratuberculosis
ccgucgucgucggccgggccg

SEQ ID NO: 818772 - RNA, 22 nt, Mycobacterium avium subsp. paratuberculosis
ccgucgucgucggccgggccgg

SEQ ID NO: 818773 - RNA, 18 nt, Mycobacterium avium subsp. paratuberculosis
ccgucgucgugcaccacg

SEQ ID NO: 818774 - RNA, 20 nt, Mycobacterium avium subsp. paratuberculosis
ccgucgucgugcaccacgac

SEQ ID NO: 818775 - RNA, 21 nt, Mycobacterium avium subsp. paratuberculosis
ccgucgucgugcaccacgacg

SEQ ID NO: 818776 - RNA, 18 nt, Mycobacterium avium subsp. paratuberculosis
ccgucuuccgggccaccg

SEQ ID NO: 818777 - RNA, 15 nt, Mycobacterium avium subsp. paratuberculosis
ccgucuuggucucgc

SEQ ID NO: 818778 - RNA, 17 nt, Mycobacterium avium subsp. paratuberculosis
ccgucuuggucucgccg

SEQ ID NO: 818779 - RNA, 15 nt, Mycobacterium avium subsp. paratuberculosis
ccgucuugcccggcg

SEQ ID NO: 818780 - RNA, 18 nt, Mycobacterium avium subsp. paratuberculosis
ccgucuugcccggcgagc

SEQ ID NO: 818781 - RNA, 15 nt, Mycobacterium avium subsp. paratuberculosis
ccgucuucgaccgca

SEQ ID NO: 818782 - RNA, 17 nt, Mycobacterium avium subsp. paratuberculosis
ccgucuucggggccgcc

SEQ ID NO: 818783 - RNA, 18 nt, Mycobacterium avium subsp. paratuberculosis
ccgucuucuucagccgca

SEQ ID NO: 818784 - RNA, 18 nt, Mycobacterium avium subsp. paratuberculosis
ccgucggccuugcgccac

SEQ ID NO: 818785 - RNA, 12 nt, Mycobacterium avium subsp. paratuberculosis
ccgucggcgauc

SEQ ID NO: 818786 - RNA, 17 nt, Mycobacterium avium subsp. paratuberculosis
ccgucggcgccgccgag

SEQ ID NO: 818787 - RNA, 17 nt, Mycobacterium avium subsp. paratuberculosis
ccgucggcgcgaggcgg

SEQ ID NO: 818788 - RNA, 20 nt, Mycobacterium avium subsp. paratuberculosis
ccgucggcgcgaggcgggua

SEQ ID NO: 818789 - RNA, 13 nt, Mycobacterium avium subsp. paratuberculosis
ccgucggcgcggc

SEQ ID NO: 818790 - RNA, 14 nt, Mycobacterium avium subsp. paratuberculosis
ccgucggcgcggcc

SEQ ID NO: 818791 - RNA, 15 nt, Mycobacterium avium subsp. paratuberculosis
ccgucggcgcggccg

SEQ ID NO: 818792 - RNA, 16 nt, Mycobacterium avium subsp. paratuberculosis
ccgucggcgcggccgg

SEQ ID NO: 818793 - RNA, 17 nt, Mycobacterium avium subsp. paratuberculosis
ccgucggccuccagccg

SEQ ID NO: 818794 - RNA, 19 nt, Mycobacterium avium subsp. paratuberculosis
ccgucggccucggcggugg

SEQ ID NO: 818795 - RNA, 17 nt, Mycobacterium avium subsp. paratuberculosis
ccgucggccugcgcugc

SEQ ID NO: 818796 - RNA, 22 nt, Mycobacterium avium subsp. paratuberculosis
ccgucggccugcgcugcggcca

SEQ ID NO: 818797 - RNA, 16 nt, Mycobacterium avium subsp. paratuberculosis
ccgucggcgaugcggu

SEQ ID NO: 818798 - RNA, 21 nt, Mycobacterium avium subsp. paratuberculosis
ccgucggcgaugcgguggucg

SEQ ID NO: 818799 - RNA, 16 nt, Mycobacterium avium subsp. paratuberculosis
ccgucggcgaugguga

SEQ ID NO: 818800 - RNA, 14 nt, Mycobacterium avium subsp. paratuberculosis
ccgucggcgcccgg

SEQ ID NO: 818801 - RNA, 15 nt, Mycobacterium avium subsp. paratuberculosis
ccgucggcgcccggc

SEQ ID NO: 818802 - RNA, 16 nt, Mycobacterium avium subsp. paratuberculosis
ccgucggcgcccggca

SEQ ID NO: 818803 - RNA, 18 nt, Mycobacterium avium subsp. paratuberculosis
ccgucggcgcccggcacc

SEQ ID NO: 818804 - RNA, 18 nt, Mycobacterium avium subsp. paratuberculosis
ccgucguaggcgcggaca

SEQ ID NO: 818805 - RNA, 18 nt, Mycobacterium avium subsp. paratuberculosis
ccgucguauucgacggcg

SEQ ID NO: 818806 - RNA, 22 nt, Mycobacterium avium subsp. paratuberculosis
ccgucguccacgcccagcgccc

SEQ ID NO: 818807 - RNA, 18 nt, Mycobacterium avium subsp. paratuberculosis
ccgucgucccggugauga

SEQ ID NO: 818808 - RNA, 17 nt, Mycobacterium avium subsp. paratuberculosis
ccgucgucgagcaccac

SEQ ID NO: 818809 - RNA, 20 nt, Mycobacterium avium subsp. paratuberculosis
ccgucgucgagcaccacccg

SEQ ID NO: 818810 - RNA, 18 nt, Mycobacterium avium subsp. paratuberculosis
ccgucgucgagcgcucgc

SEQ ID NO: 818811 - RNA, 14 nt, Mycobacterium avium subsp. paratuberculosis
ccgucgucgaggcc

SEQ ID NO: 818812 - RNA, 15 nt, Mycobacterium avium subsp. paratuberculosis
ccgucgucgaggccg

SEQ ID NO: 818813 - RNA, 12 nt, Mycobacterium avium subsp. paratuberculosis
ccgucgucgaug

SEQ ID NO: 818814 - RNA, 18 nt, Mycobacterium avium subsp. paratuberculosis
ccgucgucgaugcgcagc

SEQ ID NO: 818815 - RNA, 13 nt, Mycobacterium avium subsp. paratuberculosis
ccgucgucgcacc

SEQ ID NO: 818816 - RNA, 14 nt, Mycobacterium avium subsp. paratuberculosis
ccgucgucgcaccg

SEQ ID NO: 818817 - RNA, 14 nt, Mycobacterium avium subsp. paratuberculosis
ccgucgucgccgau

SEQ ID NO: 818818 - RNA, 19 nt, Mycobacterium avium subsp. paratuberculosis
ccgucgucggacaccagca

SEQ ID NO: 818819 - RNA, 22 nt, Mycobacterium avium subsp. paratuberculosis
ccgucgucggacaccagcaugg

SEQ ID NO: 818820 - RNA, 20 nt, Mycobacterium avium subsp. paratuberculosis
ccgucgucggcgccgcgccg

SEQ ID NO: 818821 - RNA, 22 nt, Mycobacterium avium subsp. paratuberculosis
ccgucgucgucgcuccacaucu

SEQ ID NO: 818822 - RNA, 13 nt, Mycobacterium avium subsp. paratuberculosis
ccgucgucgucgg

SEQ ID NO: 818823 - RNA, 13 nt, Mycobacterium avium subsp. paratuberculosis
ccgucggccauca

SEQ ID NO: 818824 - RNA, 16 nt, Mycobacterium avium subsp. paratuberculosis
ccgucggccaucagcc

SEQ ID NO: 818825 - RNA, 22 nt, Mycobacterium avium subsp. paratuberculosis
ccgucggccaucagccgccguc

SEQ ID NO: 818826 - RNA, 14 nt, Mycobacterium avium subsp. paratuberculosis
ccgucggcccacgg

SEQ ID NO: 818827 - RNA, 20 nt, Mycobacterium avium subsp. paratuberculosis
ccgucggccaguucgccggu

SEQ ID NO: 818828 - RNA, 18 nt, Mycobacterium avium subsp. paratuberculosis
ccgucgagcagccgcaac

SEQ ID NO: 818829 - RNA, 14 nt, Mycobacterium avium subsp. paratuberculosis
ccgucggccagcag

SEQ ID NO: 818830 - RNA, 15 nt, Mycobacterium avium subsp. paratuberculosis
ccgucggccagcagc

SEQ ID NO: 818831 - RNA, 17 nt, Mycobacterium avium subsp. paratuberculosis
ccgucggccagcagcgc

SEQ ID NO: 818832 - RNA, 22 nt, Mycobacterium avium subsp. paratuberculosis
ccgucgagcggcuugccgccgc

SEQ ID NO: 818833 - RNA, 24 nt, Mycobacterium avium subsp. paratuberculosis
ccgucgagcggcuugccgccgcag

SEQ ID NO: 818834 - RNA, 14 nt, Mycobacterium avium subsp. paratuberculosis
ccgucgagcgucac

SEQ ID NO: 818835 - RNA, 18 nt, Mycobacterium avium subsp. paratuberculosis
ccgucgagcgucacgccg

SEQ ID NO: 818836 - RNA, 20 nt, Mycobacterium avium subsp. paratuberculosis
ccgucgagcgucacgccgcg

SEQ ID NO: 818837 - RNA, 21 nt, Mycobacterium avium subsp. paratuberculosis
ccgucgagcgucacgccgcgc

SEQ ID NO: 818838 - RNA, 19 nt, Mycobacterium avium subsp. paratuberculosis
ccgucgagcgucacgcugg

SEQ ID NO: 818839 - RNA, 14 nt, Mycobacterium avium subsp. paratuberculosis
ccgucgagcgucau

SEQ ID NO: 818840 - RNA, 21 nt, Mycobacterium avium subsp. paratuberculosis
ccgucgagcgucauuccgccg

SEQ ID NO: 818841 - RNA, 22 nt, Mycobacterium avium subsp. paratuberculosis
ccgucgagcgucauuccgccgc

SEQ ID NO: 818842 - RNA, 23 nt, Mycobacterium avium subsp. paratuberculosis
ccgucgagcgucauuccgccgcg

SEQ ID NO: 818843 - RNA, 13 nt, Mycobacterium avium subsp. paratuberculosis
ccgucggcaguug

SEQ ID NO: 818844 - RNA, 16 nt, Mycobacterium avium subsp. paratuberculosis
ccgucggcauccaccc

SEQ ID NO: 818845 - RNA, 13 nt, Mycobacterium avium subsp. paratuberculosis
ccgucgaccgggu

SEQ ID NO: 818846 - RNA, 21 nt, Mycobacterium avium subsp. paratuberculosis
ccgucgaccuccucgaccccg

SEQ ID NO: 818847 - RNA, 19 nt, Mycobacterium avium subsp. paratuberculosis
ccgucgaccagcuugucga

SEQ ID NO: 818848 - RNA, 22 nt, Mycobacterium avium subsp. paratuberculosis
ccgucgaccagcuugucgaucu

SEQ ID NO: 818849 - RNA, 19 nt, Mycobacterium avium subsp. paratuberculosis
ccgucgaccaggacgucgg

SEQ ID NO: 818850 - RNA, 18 nt, Mycobacterium avium subsp. paratuberculosis
ccgucgaccccgccggcc

SEQ ID NO: 818851 - RNA, 19 nt, Mycobacterium avium subsp. paratuberculosis
ccgucgaccccgccggccc

SEQ ID NO: 818852 - RNA, 12 nt, Mycobacterium avium subsp. paratuberculosis
ccgucgacgaac

SEQ ID NO: 818853 - RNA, 14 nt, Mycobacterium avium subsp. paratuberculosis
ccgucgacgacgaa

SEQ ID NO: 818854 - RNA, 13 nt, Mycobacterium avium subsp. paratuberculosis
ccgucgacgacgg

SEQ ID NO: 818855 - RNA, 22 nt, Mycobacterium avium subsp. paratuberculosis
ccgucgacccguuccccggccg

SEQ ID NO: 818856 - RNA, 23 nt, Mycobacterium avium subsp. paratuberculosis
ccgucgacgcgugcgucaucgcg

SEQ ID NO: 818857 - RNA, 16 nt, Mycobacterium avium subsp. paratuberculosis
ccgucgacucggcggu

SEQ ID NO: 818858 - RNA, 19 nt, Mycobacterium avium subsp. paratuberculosis
ccgucgacucggcggugcc

SEQ ID NO: 818859 - RNA, 20 nt, Mycobacterium avium subsp. paratuberculosis
ccguccuuguaggugaucgu

SEQ ID NO: 818860 - RNA, 15 nt, Mycobacterium avium subsp. paratuberculosis
ccguccuugucgcgc

SEQ ID NO: 818861 - RNA, 22 nt, Mycobacterium avium subsp. paratuberculosis
ccguccuugucgcgcaccgcgg

SEQ ID NO: 818862 - RNA, 21 nt, Mycobacterium avium subsp. paratuberculosis
ccgucgaaaaacccggugccg

SEQ ID NO: 818863 - RNA, 13 nt, Mycobacterium avium subsp. paratuberculosis
ccguccgcggcgg

SEQ ID NO: 818864 - RNA, 14 nt, Mycobacterium avium subsp. paratuberculosis
ccguccgcggcggc

SEQ ID NO: 818865 - RNA, 15 nt, Mycobacterium avium subsp. paratuberculosis
ccguccgcgcccacc

SEQ ID NO: 818866 - RNA, 16 nt, Mycobacterium avium subsp. paratuberculosis
ccguccgccccgcugc

SEQ ID NO: 818867 - RNA, 15 nt, Mycobacterium avium subsp. paratuberculosis
ccguccgcaccgcga

SEQ ID NO: 818868 - RNA, 14 nt, Mycobacterium avium subsp. paratuberculosis
ccgucaucggcgga

SEQ ID NO: 818869 - RNA, 12 nt, Mycobacterium avium subsp. paratuberculosis
ccguccgacggc

SEQ ID NO: 818870 - RNA, 18 nt, Mycobacterium avium subsp. paratuberculosis
ccguccgaaucguugagc

SEQ ID NO: 818871 - RNA, 21 nt, Mycobacterium avium subsp. paratuberculosis
ccguccgaaucguugagcacc

SEQ ID NO: 818872 - RNA, 22 nt, Mycobacterium avium subsp. paratuberculosis
ccguccgaaucguugagcacca

SEQ ID NO: 818873 - RNA, 12 nt, Mycobacterium avium subsp. paratuberculosis
ccgucccggacg

SEQ ID NO: 818874 - RNA, 13 nt, Mycobacterium avium subsp. paratuberculosis
ccgucccggacgc

SEQ ID NO: 818875 - RNA, 21 nt, Mycobacterium avium subsp. paratuberculosis
ccgucccggugucgccgucgc

SEQ ID NO: 818876 - RNA, 18 nt, Mycobacterium avium subsp. paratuberculosis
ccgucccgucacggcugc

SEQ ID NO: 818877 - RNA, 16 nt, Mycobacterium avium subsp. paratuberculosis
ccgucgaacacguugc

SEQ ID NO: 818878 - RNA, 18 nt, Mycobacterium avium subsp. paratuberculosis
ccguccuuggccgccagc

SEQ ID NO: 818879 - RNA, 23 nt, Mycobacterium avium subsp. paratuberculosis
ccguccuuggccgccagcaccuc

SEQ ID NO: 818880 - RNA, 19 nt, Mycobacterium avium subsp. paratuberculosis
ccgucgaacgagaaggcgg

SEQ ID NO: 818881 - RNA, 21 nt, Mycobacterium avium subsp. paratuberculosis
ccgucgaacgagaaggcggcg

SEQ ID NO: 818882 - RNA, 17 nt, Mycobacterium avium subsp. paratuberculosis
ccgucgaacugcagccg

SEQ ID NO: 818883 - RNA, 21 nt, Mycobacterium avium subsp. paratuberculosis
ccgucgaacugcagccggcca

SEQ ID NO: 818884 - RNA, 16 nt, Mycobacterium avium subsp. paratuberculosis
ccgucgaagagugcga

SEQ ID NO: 818885 - RNA, 17 nt, Mycobacterium avium subsp. paratuberculosis
ccgucgaagagugcgau

SEQ ID NO: 818886 - RNA, 17 nt, Mycobacterium avium subsp. paratuberculosis
ccgucgaagaugaccug

SEQ ID NO: 818887 - RNA, 21 nt, Mycobacterium avium subsp. paratuberculosis
ccgucgaauaggugaugucac

SEQ ID NO: 818888 - RNA, 18 nt, Mycobacterium avium subsp. paratuberculosis
ccgucgaccaaugcgauc

SEQ ID NO: 818889 - RNA, 12 nt, Mycobacterium avium subsp. paratuberculosis
ccgugcccacca

SEQ ID NO: 818890 - RNA, 16 nt, Mycobacterium avium subsp. paratuberculosis
ccgugcccaccagccg

SEQ ID NO: 818891 - RNA, 20 nt, Mycobacterium avium subsp. paratuberculosis
ccgugccagccggccgcuga

SEQ ID NO: 818892 - RNA, 16 nt, Mycobacterium avium subsp. paratuberculosis
ccgugccccaggucgg

SEQ ID NO: 818893 - RNA, 14 nt, Mycobacterium avium subsp. paratuberculosis
ccgugccgcccguc

SEQ ID NO: 818894 - RNA, 13 nt, Mycobacterium avium subsp. paratuberculosis
ccgugcccggcgc

SEQ ID NO: 818895 - RNA, 16 nt, Mycobacterium avium subsp. paratuberculosis
ccgugcccggcgcccu

SEQ ID NO: 818896 - RNA, 17 nt, Mycobacterium avium subsp. paratuberculosis
ccgugcccggcgcccug

SEQ ID NO: 818897 - RNA, 13 nt, Mycobacterium avium subsp. paratuberculosis
ccgugaccccgga

SEQ ID NO: 818898 - RNA, 13 nt, Mycobacterium avium subsp. paratuberculosis
ccgugaaccggcg

SEQ ID NO: 818899 - RNA, 17 nt, Mycobacterium avium subsp. paratuberculosis
ccgucuuguuggucagc

SEQ ID NO: 818900 - RNA, 17 nt, Mycobacterium avium subsp. paratuberculosis
ccgugaagggcccgccg

SEQ ID NO: 818901 - RNA, 23 nt, Mycobacterium avium subsp. paratuberculosis
ccgugaagggcccgccgguggcc

SEQ ID NO: 818902 - RNA, 15 nt, Mycobacterium avium subsp. paratuberculosis
ccgugcuguacgaca

SEQ ID NO: 818903 - RNA, 22 nt, Mycobacterium avium subsp. paratuberculosis
ccgugcugugcugccugccguu

SEQ ID NO: 818904 - RNA, 19 nt, Mycobacterium avium subsp. paratuberculosis
ccgugcuugcccgacgagu

SEQ ID NO: 818905 - RNA, 24 nt, Mycobacterium avium subsp. paratuberculosis
ccgugcuugcccgacgagucgccg

SEQ ID NO: 818906 - RNA, 21 nt, Mycobacterium avium subsp. paratuberculosis
ccgugcugccggaacgagccg

SEQ ID NO: 818907 - RNA, 17 nt, Mycobacterium avium subsp. paratuberculosis
ccgugcugccggccggc

SEQ ID NO: 818908 - RNA, 15 nt, Mycobacterium avium subsp. paratuberculosis
ccgugcuggccacca

SEQ ID NO: 818909 - RNA, 19 nt, Mycobacterium avium subsp. paratuberculosis
ccgugcuuccauucacggu

SEQ ID NO: 818910 - RNA, 15 nt, Mycobacterium avium subsp. paratuberculosis
ccguggaagucgccg

SEQ ID NO: 818911 - RNA, 23 nt, Mycobacterium avium subsp. paratuberculosis
ccguggaagucgccguccggggc

SEQ ID NO: 818912 - RNA, 19 nt, Mycobacterium avium subsp. paratuberculosis
ccguggaagauguugccgc

SEQ ID NO: 818913 - RNA, 21 nt, Mycobacterium avium subsp. paratuberculosis
ccguggaagauguugccgcca

SEQ ID NO: 818914 - RNA, 22 nt, Mycobacterium avium subsp. paratuberculosis
ccguggacggcgagcggcccug

SEQ ID NO: 818915 - RNA, 14 nt, Mycobacterium avium subsp. paratuberculosis
ccguggagacgucc

SEQ ID NO: 818916 - RNA, 13 nt, Mycobacterium avium subsp. paratuberculosis
ccgugcuggccgg

SEQ ID NO: 818917 - RNA, 21 nt, Mycobacterium avium subsp. paratuberculosis
ccgugcugauccacgcccgga

SEQ ID NO: 818918 - RNA, 12 nt, Mycobacterium avium subsp. paratuberculosis
ccgugcucggcg

SEQ ID NO: 818919 - RNA, 23 nt, Mycobacterium avium subsp. paratuberculosis
ccgugcgguccaccaauggcggc

SEQ ID NO: 818920 - RNA, 21 nt, Mycobacterium avium subsp. paratuberculosis
ccgugccgauggccaccgggc

SEQ ID NO: 818921 - RNA, 14 nt, Mycobacterium avium subsp. paratuberculosis
ccgugccguccggc

SEQ ID NO: 818922 - RNA, 17 nt, Mycobacterium avium subsp. paratuberculosis
ccgugccguccggccgg

SEQ ID NO: 818923 - RNA, 16 nt, Mycobacterium avium subsp. paratuberculosis
ccgugccgucggcguc

SEQ ID NO: 818924 - RNA, 14 nt, Mycobacterium avium subsp. paratuberculosis
ccgugccguggucg

SEQ ID NO: 818925 - RNA, 16 nt, Mycobacterium avium subsp. paratuberculosis
ccgugccggaccgcgc

SEQ ID NO: 818926 - RNA, 17 nt, Mycobacterium avium subsp. paratuberculosis
ccgugccggaccgcgcg

SEQ ID NO: 818927 - RNA, 14 nt, Mycobacterium avium subsp. paratuberculosis
ccgugccgcgcggc

SEQ ID NO: 818928 - RNA, 16 nt, Mycobacterium avium subsp. paratuberculosis
ccgugccgcgcggcga

SEQ ID NO: 818929 - RNA, 22 nt, Mycobacterium avium subsp. paratuberculosis
ccgugccgcgcggcgauggccg

SEQ ID NO: 818930 - RNA, 16 nt, Mycobacterium avium subsp. paratuberculosis
ccgugccggcucggcg

SEQ ID NO: 818931 - RNA, 13 nt, Mycobacterium avium subsp. paratuberculosis
ccgugucggcggg

SEQ ID NO: 818932 - RNA, 14 nt, Mycobacterium avium subsp. paratuberculosis
ccgugucggcgggc

SEQ ID NO: 818933 - RNA, 17 nt, Mycobacterium avium subsp. paratuberculosis
ccgugucggcgggcggg

SEQ ID NO: 818934 - RNA, 16 nt, Mycobacterium avium subsp. paratuberculosis
ccgugucgucgcugac

SEQ ID NO: 818935 - RNA, 20 nt, Mycobacterium avium subsp. paratuberculosis
ccgugucgucgcugacgccg

SEQ ID NO: 818936 - RNA, 12 nt, Mycobacterium avium subsp. paratuberculosis
ccguggcggcgg

SEQ ID NO: 818937 - RNA, 18 nt, Mycobacterium avium subsp. paratuberculosis
ccguggccgucacgcugg

SEQ ID NO: 818938 - RNA, 13 nt, Mycobacterium avium subsp. paratuberculosis
ccguggccagcgc

SEQ ID NO: 818939 - RNA, 15 nt, Mycobacterium avium subsp. paratuberculosis
ccguggcccggucgg

SEQ ID NO: 818940 - RNA, 14 nt, Mycobacterium avium subsp. paratuberculosis
ccguggccccacgg

SEQ ID NO: 818941 - RNA, 18 nt, Mycobacterium avium subsp. paratuberculosis
ccguggccccacgggcca

SEQ ID NO: 818942 - RNA, 17 nt, Mycobacterium avium subsp. paratuberculosis
ccguggccccagccacc

SEQ ID NO: 818943 - RNA, 16 nt, Mycobacterium avium subsp. paratuberculosis
ccguggcaccgggugg

SEQ ID NO: 818944 - RNA, 19 nt, Mycobacterium avium subsp. paratuberculosis
ccguggcaggcacgagcga

SEQ ID NO: 818945 - RNA, 17 nt, Mycobacterium avium subsp. paratuberculosis
ccguggaucaucccgac

SEQ ID NO: 818946 - RNA, 20 nt, Mycobacterium avium subsp. paratuberculosis
ccguguugaucucgucgaug

SEQ ID NO: 818947 - RNA, 15 nt, Mycobacterium avium subsp. paratuberculosis
ccguguucaccagcg

SEQ ID NO: 818948 - RNA, 21 nt, Mycobacterium avium subsp. paratuberculosis
ccguguucaccagcggggugu

SEQ ID NO: 818949 - RNA, 20 nt, Mycobacterium avium subsp. paratuberculosis
ccgugugcgcaucggcgacg

SEQ ID NO: 818950 - RNA, 16 nt, Mycobacterium avium subsp. paratuberculosis
ccguucagcgcggcca

SEQ ID NO: 818951 - RNA, 21 nt, Mycobacterium avium subsp. paratuberculosis
ccguucaccucuucgggcagc

SEQ ID NO: 818952 - RNA, 15 nt, Mycobacterium avium subsp. paratuberculosis
cggaucaaccacacc

SEQ ID NO: 818953 - RNA, 18 nt, Mycobacterium avium subsp. paratuberculosis
cggaucaaccacaccagc

SEQ ID NO: 818954 - RNA, 19 nt, Mycobacterium avium subsp. paratuberculosis
cggaucaaccacaccagca

SEQ ID NO: 818955 - RNA, 21 nt, Mycobacterium avium subsp. paratuberculosis
cggaucaaccacaccagcaug

SEQ ID NO: 818956 - RNA, 19 nt, Mycobacterium avium subsp. paratuberculosis
cggaucagcguuccggcgg

SEQ ID NO: 818957 - RNA, 20 nt, Mycobacterium avium subsp. paratuberculosis
cggaucagcguuccggcggc

SEQ ID NO: 818958 - RNA, 22 nt, Mycobacterium avium subsp. paratuberculosis
cggaucagcguuccggcggccg

SEQ ID NO: 818959 - RNA, 15 nt, Mycobacterium avium subsp. paratuberculosis
cggaucagcaccgac

SEQ ID NO: 818960 - RNA, 16 nt, Mycobacterium avium subsp. paratuberculosis
cggaucagcaccgacg

SEQ ID NO: 818961 - RNA, 20 nt, Mycobacterium avium subsp. paratuberculosis
cggaucagcaccgacgcggc

SEQ ID NO: 818962 - RNA, 19 nt, Mycobacterium avium subsp. paratuberculosis
cggaucagcaggaccggga

SEQ ID NO: 818963 - RNA, 19 nt, Mycobacterium avium subsp. paratuberculosis
cggaucgagucccgcgcgg

SEQ ID NO: 818964 - RNA, 20 nt, Mycobacterium avium subsp. paratuberculosis
cggaucgagucccgcgcggc

SEQ ID NO: 818965 - RNA, 22 nt, Mycobacterium avium subsp. paratuberculosis
cggaucgagucccgcgcggcgc

SEQ ID NO: 818966 - RNA, 18 nt, Mycobacterium avium subsp. paratuberculosis
cggaucgagcgcaccgcc

SEQ ID NO: 818967 - RNA, 18 nt, Mycobacterium avium subsp. paratuberculosis
cggaucgagcucgcaguc

SEQ ID NO: 818968 - RNA, 23 nt, Mycobacterium avium subsp. paratuberculosis
cggaucgagcucgcagucgauca

SEQ ID NO: 818969 - RNA, 20 nt, Mycobacterium avium subsp. paratuberculosis
cggaucgcaucgggcgacau

SEQ ID NO: 818970 - RNA, 20 nt, Mycobacterium avium subsp. paratuberculosis
cggaucgagcacccggcggg

SEQ ID NO: 818971 - RNA, 18 nt, Mycobacterium avium subsp. paratuberculosis
cggaucgaauccggcggc

SEQ ID NO: 818972 - RNA, 19 nt, Mycobacterium avium subsp. paratuberculosis
cggaucgaauccggcggcg

SEQ ID NO: 818973 - RNA, 20 nt, Mycobacterium avium subsp. paratuberculosis
cggaucgaaggcgugcucga

SEQ ID NO: 818974 - RNA, 19 nt, Mycobacterium avium subsp. paratuberculosis
cggaucagcugaccggcga

SEQ ID NO: 818975 - RNA, 18 nt, Mycobacterium avium subsp. paratuberculosis
cggaucgugucccggcgc

SEQ ID NO: 818976 - RNA, 21 nt, Mycobacterium avium subsp. paratuberculosis
cggaucgugucccggcgcccu

SEQ ID NO: 818977 - RNA, 13 nt, Mycobacterium avium subsp. paratuberculosis
cggaucucggugc

SEQ ID NO: 818978 - RNA, 16 nt, Mycobacterium avium subsp. paratuberculosis
cggaucucggugccgg

SEQ ID NO: 818979 - RNA, 18 nt, Mycobacterium avium subsp. paratuberculosis
cggaucuucucgcugcuc

SEQ ID NO: 818980 - RNA, 18 nt, Mycobacterium avium subsp. paratuberculosis
cggaugccggaggcgccg

SEQ ID NO: 818981 - RNA, 19 nt, Mycobacterium avium subsp. paratuberculosis
cggaugccggaggcgccgu

SEQ ID NO: 818982 - RNA, 14 nt, Mycobacterium avium subsp. paratuberculosis
cggaucucgucggg

SEQ ID NO: 818983 - RNA, 18 nt, Mycobacterium avium subsp. paratuberculosis
cggaucucgucgggccac

SEQ ID NO: 818984 - RNA, 12 nt, Mycobacterium avium subsp. paratuberculosis
cggaucuggccc

SEQ ID NO: 818985 - RNA, 15 nt, Mycobacterium avium subsp. paratuberculosis
cggaucgccggacag

SEQ ID NO: 818986 - RNA, 16 nt, Mycobacterium avium subsp. paratuberculosis
cggaucgccggacagc

SEQ ID NO: 818987 - RNA, 24 nt, Mycobacterium avium subsp. paratuberculosis
cggaucgccggacagcgggccgac

SEQ ID NO: 818988 - RNA, 16 nt, Mycobacterium avium subsp. paratuberculosis
cggaucgcccacccgc

SEQ ID NO: 818989 - RNA, 19 nt, Mycobacterium avium subsp. paratuberculosis
cggaucgccgaacgccucg

SEQ ID NO: 818990 - RNA, 21 nt, Mycobacterium avium subsp. paratuberculosis
cggaucgccgagguagccgcg

SEQ ID NO: 818991 - RNA, 15 nt, Mycobacterium avium subsp. paratuberculosis
cggaucgucaccgac

SEQ ID NO: 818992 - RNA, 18 nt, Mycobacterium avium subsp. paratuberculosis
cggaucggugcaggccgc

SEQ ID NO: 818993 - RNA, 22 nt, Mycobacterium avium subsp. paratuberculosis
cggaucggugcaggccgcgacg

SEQ ID NO: 818994 - RNA, 22 nt, Mycobacterium avium subsp. paratuberculosis
cggaucgguggacgcggucgcc

SEQ ID NO: 818995 - RNA, 14 nt, Mycobacterium avium subsp. paratuberculosis
cggagguucgccgg

SEQ ID NO: 818996 - RNA, 14 nt, Mycobacterium avium subsp. paratuberculosis
cggaggucagcagg

SEQ ID NO: 818997 - RNA, 17 nt, Mycobacterium avium subsp. paratuberculosis
cggaggucagcggcccg

SEQ ID NO: 818998 - RNA, 16 nt, Mycobacterium avium subsp. paratuberculosis
cggaggugccgcgcgg

SEQ ID NO: 818999 - RNA, 20 nt, Mycobacterium avium subsp. paratuberculosis
cggaggugccgcgcggcagg

SEQ ID NO: 819000 - RNA, 16 nt, Mycobacterium avium subsp. paratuberculosis
cggaggugccggccgg

SEQ ID NO: 819001 - RNA, 17 nt, Mycobacterium avium subsp. paratuberculosis
cggaggggcgacgggcc

SEQ ID NO: 819002 - RNA, 23 nt, Mycobacterium avium subsp. paratuberculosis
cggaggcggcguagucggcgcag

SEQ ID NO: 819003 - RNA, 16 nt, Mycobacterium avium subsp. paratuberculosis
cggaggcgucgacgcg

SEQ ID NO: 819004 - RNA, 20 nt, Mycobacterium avium subsp. paratuberculosis
cggaggcgucgacgcgcugc

SEQ ID NO: 819005 - RNA, 16 nt, Mycobacterium avium subsp. paratuberculosis
cggaggccugcgcggc

SEQ ID NO: 819006 - RNA, 12 nt, Mycobacterium avium subsp. paratuberculosis
cggaggcgagca

SEQ ID NO: 819007 - RNA, 18 nt, Mycobacterium avium subsp. paratuberculosis
cggaggcgaugcggguca

SEQ ID NO: 819008 - RNA, 22 nt, Mycobacterium avium subsp. paratuberculosis
cggaggcgaugcgggucacggu

SEQ ID NO: 819009 - RNA, 15 nt, Mycobacterium avium subsp. paratuberculosis
cggaggccaccgcgc

SEQ ID NO: 819010 - RNA, 20 nt, Mycobacterium avium subsp. paratuberculosis
cggaggccaccgcgccgucu

SEQ ID NO: 819011 - RNA, 22 nt, Mycobacterium avium subsp. paratuberculosis
cggaggccagcucgaccgcggc

SEQ ID NO: 819012 - RNA, 17 nt, Mycobacterium avium subsp. paratuberculosis
cggaggaugccggccag

SEQ ID NO: 819013 - RNA, 18 nt, Mycobacterium avium subsp. paratuberculosis
cggaggccuuggugaugg

SEQ ID NO: 819014 - RNA, 17 nt, Mycobacterium avium subsp. paratuberculosis
cggaggcgaaugcggcc

SEQ ID NO: 819015 - RNA, 18 nt, Mycobacterium avium subsp. paratuberculosis
cggaggcgaaugcggcca

SEQ ID NO: 819016 - RNA, 21 nt, Mycobacterium avium subsp. paratuberculosis
cggaggaguuuuucggggugg

SEQ ID NO: 819017 - RNA, 23 nt, Mycobacterium avium subsp. paratuberculosis
cggaggacaacgcgucgaacagc

SEQ ID NO: 819018 - RNA, 17 nt, Mycobacterium avium subsp. paratuberculosis
cggagcguucuccaccc

SEQ ID NO: 819019 - RNA, 20 nt, Mycobacterium avium subsp. paratuberculosis
cggagcguucuccacccgcc

SEQ ID NO: 819020 - RNA, 18 nt, Mycobacterium avium subsp. paratuberculosis
cggagcggugcggcucgg

SEQ ID NO: 819021 - RNA, 15 nt, Mycobacterium avium subsp. paratuberculosis
cggagcugcgcgccc

SEQ ID NO: 819022 - RNA, 18 nt, Mycobacterium avium subsp. paratuberculosis
cggagcugcgcgccccgg

SEQ ID NO: 819023 - RNA, 21 nt, Mycobacterium avium subsp. paratuberculosis
cggacuugaugcugcccggcg

SEQ ID NO: 819024 - RNA, 23 nt, Mycobacterium avium subsp. paratuberculosis
cggacuugaugcugcccggcgcc

SEQ ID NO: 819025 - RNA, 13 nt, Mycobacterium avium subsp. paratuberculosis
cggacuugggcgu

SEQ ID NO: 819026 - RNA, 15 nt, Mycobacterium avium subsp. paratuberculosis
cggacuugggcgucu

SEQ ID NO: 819027 - RNA, 17 nt, Mycobacterium avium subsp. paratuberculosis
cggacuugucgccguug

SEQ ID NO: 819028 - RNA, 20 nt, Mycobacterium avium subsp. paratuberculosis
cggacugcuugggcgccucg

SEQ ID NO: 819029 - RNA, 17 nt, Mycobacterium avium subsp. paratuberculosis
cggagaaaccgucggcc

SEQ ID NO: 819030 - RNA, 19 nt, Mycobacterium avium subsp. paratuberculosis
cggagaaaccgucggcccg

SEQ ID NO: 819031 - RNA, 22 nt, Mycobacterium avium subsp. paratuberculosis
cggagaaaccgucggcccgcca

SEQ ID NO: 819032 - RNA, 15 nt, Mycobacterium avium subsp. paratuberculosis
cggagaaggugucgc

SEQ ID NO: 819033 - RNA, 17 nt, Mycobacterium avium subsp. paratuberculosis
cggagaaggcgaacggg

SEQ ID NO: 819034 - RNA, 15 nt, Mycobacterium avium subsp. paratuberculosis
cggagaccaggucgg

SEQ ID NO: 819035 - RNA, 15 nt, Mycobacterium avium subsp. paratuberculosis
cggagacccgcccgg

SEQ ID NO: 819036 - RNA, 18 nt, Mycobacterium avium subsp. paratuberculosis
cggagacguggcggcggu

SEQ ID NO: 819037 - RNA, 20 nt, Mycobacterium avium subsp. paratuberculosis
cggagacgaccagguccacc

SEQ ID NO: 819038 - RNA, 18 nt, Mycobacterium avium subsp. paratuberculosis
cggagagcaacaccucgg

SEQ ID NO: 819039 - RNA, 17 nt, Mycobacterium avium subsp. paratuberculosis
cggacuggugggcgucg

SEQ ID NO: 819040 - RNA, 15 nt, Mycobacterium avium subsp. paratuberculosis
cggacuggcugagca

SEQ ID NO: 819041 - RNA, 21 nt, Mycobacterium avium subsp. paratuberculosis
cggacuggcugagcagcaccc

SEQ ID NO: 819042 - RNA, 16 nt, Mycobacterium avium subsp. paratuberculosis
cggacuggccaccgcg

SEQ ID NO: 819043 - RNA, 17 nt, Mycobacterium avium subsp. paratuberculosis
cggacuggccaccgcga

SEQ ID NO: 819044 - RNA, 14 nt, Mycobacterium avium subsp. paratuberculosis
cggacucgcgccgg

SEQ ID NO: 819045 - RNA, 13 nt, Mycobacterium avium subsp. paratuberculosis
cggacugcccgac

SEQ ID NO: 819046 - RNA, 14 nt, Mycobacterium avium subsp. paratuberculosis
cggacugcccgacc

SEQ ID NO: 819047 - RNA, 19 nt, Mycobacterium avium subsp. paratuberculosis
cggacuauacacgccugga

SEQ ID NO: 819048 - RNA, 19 nt, Mycobacterium avium subsp. paratuberculosis
cggacucaggagugguagg

SEQ ID NO: 819049 - RNA, 16 nt, Mycobacterium avium subsp. paratuberculosis
cggacggucccgacgc

SEQ ID NO: 819050 - RNA, 22 nt, Mycobacterium avium subsp. paratuberculosis
cggacggucccgacgcugacga

SEQ ID NO: 819051 - RNA, 16 nt, Mycobacterium avium subsp. paratuberculosis
cggacggucgccgacg

SEQ ID NO: 819052 - RNA, 21 nt, Mycobacterium avium subsp. paratuberculosis
cggacggaucgagucccgcgc

SEQ ID NO: 819053 - RNA, 21 nt, Mycobacterium avium subsp. paratuberculosis
cggacggguugggcgccagca

SEQ ID NO: 819054 - RNA, 16 nt, Mycobacterium avium subsp. paratuberculosis
cggagccggccgccga

SEQ ID NO: 819055 - RNA, 19 nt, Mycobacterium avium subsp. paratuberculosis
cggagccggccgccgaagc

SEQ ID NO: 819056 - RNA, 18 nt, Mycobacterium avium subsp. paratuberculosis
cggagccggccucgccgg

SEQ ID NO: 819057 - RNA, 20 nt, Mycobacterium avium subsp. paratuberculosis
cggagccggccucgccggcg

SEQ ID NO: 819058 - RNA, 21 nt, Mycobacterium avium subsp. paratuberculosis
cggagccggccucgccggcgc

SEQ ID NO: 819059 - RNA, 16 nt, Mycobacterium avium subsp. paratuberculosis
cggagccgucgguguc

SEQ ID NO: 819060 - RNA, 13 nt, Mycobacterium avium subsp. paratuberculosis
cggagccgugccc

SEQ ID NO: 819061 - RNA, 20 nt, Mycobacterium avium subsp. paratuberculosis
cggagcccagcuuggcgccc

SEQ ID NO: 819062 - RNA, 17 nt, Mycobacterium avium subsp. paratuberculosis
cggagcgaaggugccgc

SEQ ID NO: 819063 - RNA, 15 nt, Mycobacterium avium subsp. paratuberculosis
cggagccuucuucgc

SEQ ID NO: 819064 - RNA, 19 nt, Mycobacterium avium subsp. paratuberculosis
cggagccuucuucgccgca

SEQ ID NO: 819065 - RNA, 21 nt, Mycobacterium avium subsp. paratuberculosis
cggagccuucuucgccgcagc

SEQ ID NO: 819066 - RNA, 19 nt, Mycobacterium avium subsp. paratuberculosis
cggagccuucuugaccgca

SEQ ID NO: 819067 - RNA, 23 nt, Mycobacterium avium subsp. paratuberculosis
cggagccuucuugaccgcagccu

SEQ ID NO: 819068 - RNA, 20 nt, Mycobacterium avium subsp. paratuberculosis
cggagccuugcuggcggccu

SEQ ID NO: 819069 - RNA, 18 nt, Mycobacterium avium subsp. paratuberculosis
cggagccuuggucgcggc

SEQ ID NO: 819070 - RNA, 19 nt, Mycobacterium avium subsp. paratuberculosis
cggagccuuggucgcggcc

SEQ ID NO: 819071 - RNA, 13 nt, Mycobacterium avium subsp. paratuberculosis
cggagcgccccag

SEQ ID NO: 819072 - RNA, 21 nt, Mycobacterium avium subsp. paratuberculosis
cggagcgccccagggccucgg

SEQ ID NO: 819073 - RNA, 17 nt, Mycobacterium avium subsp. paratuberculosis
cggagcgcccggccagc

SEQ ID NO: 819074 - RNA, 20 nt, Mycobacterium avium subsp. paratuberculosis
cggagcgcccggccagccgg

SEQ ID NO: 819075 - RNA, 14 nt, Mycobacterium avium subsp. paratuberculosis
cggagcgcggucca

SEQ ID NO: 819076 - RNA, 15 nt, Mycobacterium avium subsp. paratuberculosis
cggagcgcuccacca

SEQ ID NO: 819077 - RNA, 19 nt, Mycobacterium avium subsp. paratuberculosis
cggagcgggucagcgugcu

SEQ ID NO: 819078 - RNA, 15 nt, Mycobacterium avium subsp. paratuberculosis
cggagccgaccucgg

SEQ ID NO: 819079 - RNA, 19 nt, Mycobacterium avium subsp. paratuberculosis
cggagccgaccucggcgac

SEQ ID NO: 819080 - RNA, 17 nt, Mycobacterium avium subsp. paratuberculosis
cggagccgagcaccagg

SEQ ID NO: 819081 - RNA, 17 nt, Mycobacterium avium subsp. paratuberculosis
cggagagcccgucgucg

SEQ ID NO: 819082 - RNA, 18 nt, Mycobacterium avium subsp. paratuberculosis
cggagagcccgucgucgg

SEQ ID NO: 819083 - RNA, 14 nt, Mycobacterium avium subsp. paratuberculosis
cggagaucaccggc

SEQ ID NO: 819084 - RNA, 15 nt, Mycobacterium avium subsp. paratuberculosis
cggagaucaccggca

SEQ ID NO: 819085 - RNA, 16 nt, Mycobacterium avium subsp. paratuberculosis
cggagaucaccggcac

SEQ ID NO: 819086 - RNA, 18 nt, Mycobacterium avium subsp. paratuberculosis
cggagaucaccggcaccc

SEQ ID NO: 819087 - RNA, 13 nt, Mycobacterium avium subsp. paratuberculosis
cggagaucccgua

SEQ ID NO: 819088 - RNA, 22 nt, Mycobacterium avium subsp. paratuberculosis
cggagaucccguaggucgccuc

SEQ ID NO: 819089 - RNA, 23 nt, Mycobacterium avium subsp. paratuberculosis
cggagaucccguaggucgccucc

SEQ ID NO: 819090 - RNA, 17 nt, Mycobacterium avium subsp. paratuberculosis
cggagauccggccgcug

SEQ ID NO: 819091 - RNA, 13 nt, Mycobacterium avium subsp. paratuberculosis
cggagaucgcccc

SEQ ID NO: 819092 - RNA, 18 nt, Mycobacterium avium subsp. paratuberculosis
cggagaucgccccggggg

SEQ ID NO: 819093 - RNA, 15 nt, Mycobacterium avium subsp. paratuberculosis
cggagaucggcgagu

SEQ ID NO: 819094 - RNA, 20 nt, Mycobacterium avium subsp. paratuberculosis
cggagaugaauucggcgauc

SEQ ID NO: 819095 - RNA, 17 nt, Mycobacterium avium subsp. paratuberculosis
cggagaugacguggauc

SEQ ID NO: 819096 - RNA, 20 nt, Mycobacterium avium subsp. paratuberculosis
cggagaugauggccgcgccg

SEQ ID NO: 819097 - RNA, 20 nt, Mycobacterium avium subsp. paratuberculosis
cggagaugcuggugacgccg

SEQ ID NO: 819098 - RNA, 18 nt, Mycobacterium avium subsp. paratuberculosis
cggagaugguggucacca

SEQ ID NO: 819099 - RNA, 22 nt, Mycobacterium avium subsp. paratuberculosis
cggagcaaagguaguccagcac

SEQ ID NO: 819100 - RNA, 18 nt, Mycobacterium avium subsp. paratuberculosis
cggagcaaauccggcagc

SEQ ID NO: 819101 - RNA, 14 nt, Mycobacterium avium subsp. paratuberculosis
cggaauucgcgggu

SEQ ID NO: 819102 - RNA, 20 nt, Mycobacterium avium subsp. paratuberculosis
cggaauucgggugcggcgug

SEQ ID NO: 819103 - RNA, 13 nt, Mycobacterium avium subsp. paratuberculosis
cggaaugcucgac

SEQ ID NO: 819104 - RNA, 18 nt, Mycobacterium avium subsp. paratuberculosis
cggaauuuucgccgucac

SEQ ID NO: 819105 - RNA, 23 nt, Mycobacterium avium subsp. paratuberculosis
cggaaugugcuugaucagcgggc

SEQ ID NO: 819106 - RNA, 20 nt, Mycobacterium avium subsp. paratuberculosis
cgcuguaggccagcccggcg

SEQ ID NO: 819107 - RNA, 16 nt, Mycobacterium avium subsp. paratuberculosis
cgcuguaggccagccg

SEQ ID NO: 819108 - RNA, 16 nt, Mycobacterium avium subsp. paratuberculosis
cgcuguaggcggcgug

SEQ ID NO: 819109 - RNA, 23 nt, Mycobacterium avium subsp. paratuberculosis
cgcuguaggcggcgugccagggc

SEQ ID NO: 819110 - RNA, 14 nt, Mycobacterium avium subsp. paratuberculosis
cgcuguaggucgcg

SEQ ID NO: 819111 - RNA, 17 nt, Mycobacterium avium subsp. paratuberculosis
cgcuguaguagccgggg

SEQ ID NO: 819112 - RNA, 13 nt, Mycobacterium avium subsp. paratuberculosis
cggaaugaacgcg

SEQ ID NO: 819113 - RNA, 19 nt, Mycobacterium avium subsp. paratuberculosis
cggaaugaacgcggccagg

SEQ ID NO: 819114 - RNA, 21 nt, Mycobacterium avium subsp. paratuberculosis
cggaaugaacugccgcggcac

SEQ ID NO: 819115 - RNA, 20 nt, Mycobacterium avium subsp. paratuberculosis
cggaaucgucggccacgcuc

SEQ ID NO: 819116 - RNA, 20 nt, Mycobacterium avium subsp. paratuberculosis
cggaauggcaaggccagcaa

SEQ ID NO: 819117 - RNA, 16 nt, Mycobacterium avium subsp. paratuberculosis
cggaauggcagcagcc

SEQ ID NO: 819118 - RNA, 14 nt, Mycobacterium avium subsp. paratuberculosis
cgcuggugacgugc

SEQ ID NO: 819119 - RNA, 17 nt, Mycobacterium avium subsp. paratuberculosis
cgcuggugaacucgccg

SEQ ID NO: 819120 - RNA, 20 nt, Mycobacterium avium subsp. paratuberculosis
cgcuggugaacucgccgauc

SEQ ID NO: 819121 - RNA, 15 nt, Mycobacterium avium subsp. paratuberculosis
cgcugguggccgacg

SEQ ID NO: 819122 - RNA, 18 nt, Mycobacterium avium subsp. paratuberculosis
cgcugguggugaucaccc

SEQ ID NO: 819123 - RNA, 16 nt, Mycobacterium avium subsp. paratuberculosis
cgcuggugugacgcuc

SEQ ID NO: 819124 - RNA, 19 nt, Mycobacterium avium subsp. paratuberculosis
cgcuggugugacgcucgcg

SEQ ID NO: 819125 - RNA, 16 nt, Mycobacterium avium subsp. paratuberculosis
cgcuggugcgcgccgg

SEQ ID NO: 819126 - RNA, 20 nt, Mycobacterium avium subsp. paratuberculosis
cgcuggugcgcgccggcguc

SEQ ID NO: 819127 - RNA, 12 nt, Mycobacterium avium subsp. paratuberculosis
cgcuggugcggg

SEQ ID NO: 819128 - RNA, 16 nt, Mycobacterium avium subsp. paratuberculosis
cgcuggugcgggccag

SEQ ID NO: 819129 - RNA, 19 nt, Mycobacterium avium subsp. paratuberculosis
cgcuggugcgggccagcac

SEQ ID NO: 819130 - RNA, 15 nt, Mycobacterium avium subsp. paratuberculosis
cgcuggugcugcugc

SEQ ID NO: 819131 - RNA, 17 nt, Mycobacterium avium subsp. paratuberculosis
cgcugguugucgacgcu

SEQ ID NO: 819132 - RNA, 18 nt, Mycobacterium avium subsp. paratuberculosis
cgcugguugucgacgcug

SEQ ID NO: 819133 - RNA, 19 nt, Mycobacterium avium subsp. paratuberculosis
cgcugguugucgacgcugc

SEQ ID NO: 819134 - RNA, 20 nt, Mycobacterium avium subsp. paratuberculosis
cgcugguugucgacgcugca

SEQ ID NO: 819135 - RNA, 21 nt, Mycobacterium avium subsp. paratuberculosis
cgcugguugucgacgcugcag

SEQ ID NO: 819136 - RNA, 23 nt, Mycobacterium avium subsp. paratuberculosis
cgcugguugucgacgcugcaggu

SEQ ID NO: 819137 - RNA, 22 nt, Mycobacterium avium subsp. paratuberculosis
cggacagaucgcccaucaccgc

SEQ ID NO: 819138 - RNA, 16 nt, Mycobacterium avium subsp. paratuberculosis
cggacagcagcaccgg

SEQ ID NO: 819139 - RNA, 17 nt, Mycobacterium avium subsp. paratuberculosis
cggacagcagcaccggc

SEQ ID NO: 819140 - RNA, 18 nt, Mycobacterium avium subsp. paratuberculosis
cggacagcagcaccggca

SEQ ID NO: 819141 - RNA, 21 nt, Mycobacterium avium subsp. paratuberculosis
cggacagcgcgacgcacgccg

SEQ ID NO: 819142 - RNA, 12 nt, Mycobacterium avium subsp. paratuberculosis
cggacagcgcgg

SEQ ID NO: 819143 - RNA, 15 nt, Mycobacterium avium subsp. paratuberculosis
cggacagcgcgguga

SEQ ID NO: 819144 - RNA, 12 nt, Mycobacterium avium subsp. paratuberculosis
cggacagcgggc

SEQ ID NO: 819145 - RNA, 14 nt, Mycobacterium avium subsp. paratuberculosis
cggacagcgggccg

SEQ ID NO: 819146 - RNA, 21 nt, Mycobacterium avium subsp. paratuberculosis
cggacagcgggccgacccggc

SEQ ID NO: 819147 - RNA, 17 nt, Mycobacterium avium subsp. paratuberculosis
cggacagcucaccgggc

SEQ ID NO: 819148 - RNA, 22 nt, Mycobacterium avium subsp. paratuberculosis
cggacagcucgccggccgcggg

SEQ ID NO: 819149 - RNA, 24 nt, Mycobacterium avium subsp. paratuberculosis
cggacagcucgccggccgcgggcg

SEQ ID NO: 819150 - RNA, 17 nt, Mycobacterium avium subsp. paratuberculosis
cggacagcugcgcgggc

SEQ ID NO: 819151 - RNA, 15 nt, Mycobacterium avium subsp. paratuberculosis
cggacagcugggcgu

SEQ ID NO: 819152 - RNA, 17 nt, Mycobacterium avium subsp. paratuberculosis
cggacaccccggccagu

SEQ ID NO: 819153 - RNA, 19 nt, Mycobacterium avium subsp. paratuberculosis
cggacaccccggccagucc

SEQ ID NO: 819154 - RNA, 20 nt, Mycobacterium avium subsp. paratuberculosis
cggacaccccggccaguccg

SEQ ID NO: 819155 - RNA, 15 nt, Mycobacterium avium subsp. paratuberculosis
cggacaccccguagg

SEQ ID NO: 819156 - RNA, 12 nt, Mycobacterium avium subsp. paratuberculosis
cggacacccgcg

SEQ ID NO: 819157 - RNA, 16 nt, Mycobacterium avium subsp. paratuberculosis
cggacacccgcgcggu

SEQ ID NO: 819158 - RNA, 18 nt, Mycobacterium avium subsp. paratuberculosis
cggacacccgcgcggugc

SEQ ID NO: 819159 - RNA, 13 nt, Mycobacterium avium subsp. paratuberculosis
cggacaccgaacc

SEQ ID NO: 819160 - RNA, 13 nt, Mycobacterium avium subsp. paratuberculosis
cggacaccggcac

SEQ ID NO: 819161 - RNA, 16 nt, Mycobacterium avium subsp. paratuberculosis
cggacaccggcacguc

SEQ ID NO: 819162 - RNA, 17 nt, Mycobacterium avium subsp. paratuberculosis
cggacaccucggccagc

SEQ ID NO: 819163 - RNA, 21 nt, Mycobacterium avium subsp. paratuberculosis
cggacaccucggccagcgccg

SEQ ID NO: 819164 - RNA, 22 nt, Mycobacterium avium subsp. paratuberculosis
cggacaccuggagucguaccga

SEQ ID NO: 819165 - RNA, 22 nt, Mycobacterium avium subsp. paratuberculosis
cggacacgaacgacgcggcacg

SEQ ID NO: 819166 - RNA, 14 nt, Mycobacterium avium subsp. paratuberculosis
cggacaccagguug

SEQ ID NO: 819167 - RNA, 13 nt, Mycobacterium avium subsp. paratuberculosis
cggacacggccag

SEQ ID NO: 819168 - RNA, 14 nt, Mycobacterium avium subsp. paratuberculosis
cggacacggccagc

SEQ ID NO: 819169 - RNA, 18 nt, Mycobacterium avium subsp. paratuberculosis
cggacacggccagcgccg

SEQ ID NO: 819170 - RNA, 20 nt, Mycobacterium avium subsp. paratuberculosis
cggacacggccagcgccguc

SEQ ID NO: 819171 - RNA, 21 nt, Mycobacterium avium subsp. paratuberculosis
cggacacggccagcgccguca

SEQ ID NO: 819172 - RNA, 13 nt, Mycobacterium avium subsp. paratuberculosis
cggacacggccgg

SEQ ID NO: 819173 - RNA, 14 nt, Mycobacterium avium subsp. paratuberculosis
cggacacggcgccg

SEQ ID NO: 819174 - RNA, 17 nt, Mycobacterium avium subsp. paratuberculosis
cggacaucgccucggcg

SEQ ID NO: 819175 - RNA, 24 nt, Mycobacterium avium subsp. paratuberculosis
cggacaucucccgcacccguucgg

SEQ ID NO: 819176 - RNA, 17 nt, Mycobacterium avium subsp. paratuberculosis
cggacaugccggcgccg

SEQ ID NO: 819177 - RNA, 18 nt, Mycobacterium avium subsp. paratuberculosis
cggacaugccggcgccga

SEQ ID NO: 819178 - RNA, 18 nt, Mycobacterium avium subsp. paratuberculosis
cggacauaggcgucgcgg

SEQ ID NO: 819179 - RNA, 21 nt, Mycobacterium avium subsp. paratuberculosis
cggacauaggcgucgcggucg

SEQ ID NO: 819180 - RNA, 22 nt, Mycobacterium avium subsp. paratuberculosis
cggacauaggcgucgcggucgg

SEQ ID NO: 819181 - RNA, 14 nt, Mycobacterium avium subsp. paratuberculosis
cggacaggucgagg

SEQ ID NO: 819182 - RNA, 19 nt, Mycobacterium avium subsp. paratuberculosis
cggacauccauugggccgc

SEQ ID NO: 819183 - RNA, 13 nt, Mycobacterium avium subsp. paratuberculosis
cggacagguggcc

SEQ ID NO: 819184 - RNA, 14 nt, Mycobacterium avium subsp. paratuberculosis
cggacagguguggg

SEQ ID NO: 819185 - RNA, 17 nt, Mycobacterium avium subsp. paratuberculosis
cggacagggcggcgacc

SEQ ID NO: 819186 - RNA, 13 nt, Mycobacterium avium subsp. paratuberculosis
cggacagccgggg

SEQ ID NO: 819187 - RNA, 14 nt, Mycobacterium avium subsp. paratuberculosis
cggacagggcggcg

SEQ ID NO: 819188 - RNA, 15 nt, Mycobacterium avium subsp. paratuberculosis
cggacagggcggcga

SEQ ID NO: 819189 - RNA, 17 nt, Mycobacterium avium subsp. paratuberculosis
cggacauucggacggcc

SEQ ID NO: 819190 - RNA, 20 nt, Mycobacterium avium subsp. paratuberculosis
cggaccaggguggccccagc

SEQ ID NO: 819191 - RNA, 23 nt, Mycobacterium avium subsp. paratuberculosis
cggaccaggguggccccagcccg

SEQ ID NO: 819192 - RNA, 23 nt, Mycobacterium avium subsp. paratuberculosis
cggaccagguauucaucgcggcc

SEQ ID NO: 819193 - RNA, 19 nt, Mycobacterium avium subsp. paratuberculosis
cggaccagugcagguuccg

SEQ ID NO: 819194 - RNA, 16 nt, Mycobacterium avium subsp. paratuberculosis
cggacgggaccacccg

SEQ ID NO: 819195 - RNA, 15 nt, Mycobacterium avium subsp. paratuberculosis
cggacgggaucggcg

SEQ ID NO: 819196 - RNA, 20 nt, Mycobacterium avium subsp. paratuberculosis
cggacgggaucggcgcgucg

SEQ ID NO: 819197 - RNA, 21 nt, Mycobacterium avium subsp. paratuberculosis
cggacgggaucggcgcgucgg

SEQ ID NO: 819198 - RNA, 22 nt, Mycobacterium avium subsp. paratuberculosis
cggacgggaucggcgcgucggc

SEQ ID NO: 819199 - RNA, 23 nt, Mycobacterium avium subsp. paratuberculosis
cggacgggaucggcgcgucggcg

SEQ ID NO: 819200 - RNA, 14 nt, Mycobacterium avium subsp. paratuberculosis
cggacgggccgcau

SEQ ID NO: 819201 - RNA, 15 nt, Mycobacterium avium subsp. paratuberculosis
cggacgggccgcauc

SEQ ID NO: 819202 - RNA, 13 nt, Mycobacterium avium subsp. paratuberculosis
cggacggcgaacu

SEQ ID NO: 819203 - RNA, 12 nt, Mycobacterium avium subsp. paratuberculosis
cggacggcgacg

SEQ ID NO: 819204 - RNA, 14 nt, Mycobacterium avium subsp. paratuberculosis
cggacggcgacggc

SEQ ID NO: 819205 - RNA, 19 nt, Mycobacterium avium subsp. paratuberculosis
cggacggcgacggcagcgc

SEQ ID NO: 819206 - RNA, 12 nt, Mycobacterium avium subsp. paratuberculosis
cggacggccagc

SEQ ID NO: 819207 - RNA, 15 nt, Mycobacterium avium subsp. paratuberculosis
cggacggccagcccg

SEQ ID NO: 819208 - RNA, 14 nt, Mycobacterium avium subsp. paratuberculosis
cggacggccgaaac

SEQ ID NO: 819209 - RNA, 21 nt, Mycobacterium avium subsp. paratuberculosis
cggacggccgaaacgcccggc

SEQ ID NO: 819210 - RNA, 12 nt, Mycobacterium avium subsp. paratuberculosis
cggacgcggcgg

SEQ ID NO: 819211 - RNA, 16 nt, Mycobacterium avium subsp. paratuberculosis
cggacgcggcggacga

SEQ ID NO: 819212 - RNA, 13 nt, Mycobacterium avium subsp. paratuberculosis
cggacgcggccag

SEQ ID NO: 819213 - RNA, 17 nt, Mycobacterium avium subsp. paratuberculosis
cggacgcggccagcgcc

SEQ ID NO: 819214 - RNA, 19 nt, Mycobacterium avium subsp. paratuberculosis
cggacgcggccagcgcccg

SEQ ID NO: 819215 - RNA, 13 nt, Mycobacterium avium subsp. paratuberculosis
cggacgcggccga

SEQ ID NO: 819216 - RNA, 17 nt, Mycobacterium avium subsp. paratuberculosis
cggacgcggccgagccg

SEQ ID NO: 819217 - RNA, 22 nt, Mycobacterium avium subsp. paratuberculosis
cggacgcuaagcgcugaaccgg

SEQ ID NO: 819218 - RNA, 14 nt, Mycobacterium avium subsp. paratuberculosis
cggacggagccgug

SEQ ID NO: 819219 - RNA, 13 nt, Mycobacterium avium subsp. paratuberculosis
cggacggcaccga

SEQ ID NO: 819220 - RNA, 21 nt, Mycobacterium avium subsp. paratuberculosis
cggacggcaccgacggagccg

SEQ ID NO: 819221 - RNA, 14 nt, Mycobacterium avium subsp. paratuberculosis
cggacgagccgucg

SEQ ID NO: 819222 - RNA, 19 nt, Mycobacterium avium subsp. paratuberculosis
cggacgaugacccagccca

SEQ ID NO: 819223 - RNA, 17 nt, Mycobacterium avium subsp. paratuberculosis
cggacgaugccgcggcg

SEQ ID NO: 819224 - RNA, 18 nt, Mycobacterium avium subsp. paratuberculosis
cggacgaugccgcggcgu

SEQ ID NO: 819225 - RNA, 15 nt, Mycobacterium avium subsp. paratuberculosis
cggacgaugcgcacc

SEQ ID NO: 819226 - RNA, 18 nt, Mycobacterium avium subsp. paratuberculosis
cggacgaugcgcaccccc

SEQ ID NO: 819227 - RNA, 21 nt, Mycobacterium avium subsp. paratuberculosis
cggacgaacgaguugccccgu

SEQ ID NO: 819228 - RNA, 18 nt, Mycobacterium avium subsp. paratuberculosis
cggacgaccugggcgccg

SEQ ID NO: 819229 - RNA, 19 nt, Mycobacterium avium subsp. paratuberculosis
cggacgaccugggcgccgu

SEQ ID NO: 819230 - RNA, 20 nt, Mycobacterium avium subsp. paratuberculosis
cggacgaccugggcgccguc

SEQ ID NO: 819231 - RNA, 15 nt, Mycobacterium avium subsp. paratuberculosis
cggacgacggccagc

SEQ ID NO: 819232 - RNA, 16 nt, Mycobacterium avium subsp. paratuberculosis
cggacgacggccagcu

SEQ ID NO: 819233 - RNA, 20 nt, Mycobacterium avium subsp. paratuberculosis
cggacgacucguucgacgcc

SEQ ID NO: 819234 - RNA, 22 nt, Mycobacterium avium subsp. paratuberculosis
cggacgacucguucgacgccgg

SEQ ID NO: 819235 - RNA, 13 nt, Mycobacterium avium subsp. paratuberculosis
cggacgccggcag

SEQ ID NO: 819236 - RNA, 14 nt, Mycobacterium avium subsp. paratuberculosis
cggacgccggcagc

SEQ ID NO: 819237 - RNA, 16 nt, Mycobacterium avium subsp. paratuberculosis
cggacgccggcagccg

SEQ ID NO: 819238 - RNA, 14 nt, Mycobacterium avium subsp. paratuberculosis
cggacgcccgucgc

SEQ ID NO: 819239 - RNA, 15 nt, Mycobacterium avium subsp. paratuberculosis
cggacgcccgucgcg

SEQ ID NO: 819240 - RNA, 17 nt, Mycobacterium avium subsp. paratuberculosis
cggacgcagcgaucggc

SEQ ID NO: 819241 - RNA, 21 nt, Mycobacterium avium subsp. paratuberculosis
cggacgcagcgaucggcggcu

SEQ ID NO: 819242 - RNA, 19 nt, Mycobacterium avium subsp. paratuberculosis
cggacgauguccgccggcc

SEQ ID NO: 819243 - RNA, 21 nt, Mycobacterium avium subsp. paratuberculosis
cggacgauguccgccggccgg

SEQ ID NO: 819244 - RNA, 22 nt, Mycobacterium avium subsp. paratuberculosis
cggaccuuggugucggcgagcu

SEQ ID NO: 819245 - RNA, 13 nt, Mycobacterium avium subsp. paratuberculosis
cggaccugggugc

SEQ ID NO: 819246 - RNA, 16 nt, Mycobacterium avium subsp. paratuberculosis
cggacgaacaucgagc

SEQ ID NO: 819247 - RNA, 17 nt, Mycobacterium avium subsp. paratuberculosis
cggacgaacaucgagcc

SEQ ID NO: 819248 - RNA, 23 nt, Mycobacterium avium subsp. paratuberculosis
cggacgaacaucgagcccaccgc

SEQ ID NO: 819249 - RNA, 14 nt, Mycobacterium avium subsp. paratuberculosis
cggaccugccggcg

SEQ ID NO: 819250 - RNA, 15 nt, Mycobacterium avium subsp. paratuberculosis
cggaccugccggcga

SEQ ID NO: 819251 - RNA, 18 nt, Mycobacterium avium subsp. paratuberculosis
cggaccugccggcgauca

SEQ ID NO: 819252 - RNA, 16 nt, Mycobacterium avium subsp. paratuberculosis
cggaccguucgguccg

SEQ ID NO: 819253 - RNA, 16 nt, Mycobacterium avium subsp. paratuberculosis
cggaccgcggucgggu

SEQ ID NO: 819254 - RNA, 14 nt, Mycobacterium avium subsp. paratuberculosis
cggaccgcgcgggc

SEQ ID NO: 819255 - RNA, 15 nt, Mycobacterium avium subsp. paratuberculosis
cggaccgcggaaccg

SEQ ID NO: 819256 - RNA, 18 nt, Mycobacterium avium subsp. paratuberculosis
cggaccgcuugacgccgc

SEQ ID NO: 819257 - RNA, 19 nt, Mycobacterium avium subsp. paratuberculosis
cggaccgcuugacgccgcc

SEQ ID NO: 819258 - RNA, 20 nt, Mycobacterium avium subsp. paratuberculosis
cggaccgcuugacgccgccg

SEQ ID NO: 819259 - RNA, 23 nt, Mycobacterium avium subsp. paratuberculosis
cggaccgcuugacgccgccgaac

SEQ ID NO: 819260 - RNA, 13 nt, Mycobacterium avium subsp. paratuberculosis
cggaccggccagc

SEQ ID NO: 819261 - RNA, 12 nt, Mycobacterium avium subsp. paratuberculosis
cggaccggcgau

SEQ ID NO: 819262 - RNA, 20 nt, Mycobacterium avium subsp. paratuberculosis
cggaccgggcgggcugcggg

SEQ ID NO: 819263 - RNA, 21 nt, Mycobacterium avium subsp. paratuberculosis
cggaccgggcgggcugcgggc

SEQ ID NO: 819264 - RNA, 17 nt, Mycobacterium avium subsp. paratuberculosis
cggaccgggugaccggc

SEQ ID NO: 819265 - RNA, 21 nt, Mycobacterium avium subsp. paratuberculosis
cggaccgggugaccggcgcgc

SEQ ID NO: 819266 - RNA, 22 nt, Mycobacterium avium subsp. paratuberculosis
cggaccgggugaccggcgcgca

SEQ ID NO: 819267 - RNA, 20 nt, Mycobacterium avium subsp. paratuberculosis
cggaccgguaggcgcaccgc

SEQ ID NO: 819268 - RNA, 22 nt, Mycobacterium avium subsp. paratuberculosis
cggaccgguaggcgcaccgccg

SEQ ID NO: 819269 - RNA, 23 nt, Mycobacterium avium subsp. paratuberculosis
cggaccgguaggcgcaccgccgg

SEQ ID NO: 819270 - RNA, 18 nt, Mycobacterium avium subsp. paratuberculosis
cggaccggcggccgccau

SEQ ID NO: 819271 - RNA, 14 nt, Mycobacterium avium subsp. paratuberculosis
cggaccgucggugu

SEQ ID NO: 819272 - RNA, 15 nt, Mycobacterium avium subsp. paratuberculosis
cggacccgcucccgg

SEQ ID NO: 819273 - RNA, 20 nt, Mycobacterium avium subsp. paratuberculosis
cggacccgacggucgggccc

SEQ ID NO: 819274 - RNA, 19 nt, Mycobacterium avium subsp. paratuberculosis
cggacccauucgucggcgg

SEQ ID NO: 819275 - RNA, 20 nt, Mycobacterium avium subsp. paratuberculosis
cggacccauucgucggcggu

SEQ ID NO: 819276 - RNA, 21 nt, Mycobacterium avium subsp. paratuberculosis
cggaccccacagcgcgcccca

SEQ ID NO: 819277 - RNA, 16 nt, Mycobacterium avium subsp. paratuberculosis
cggacccagcccggcg

SEQ ID NO: 819278 - RNA, 18 nt, Mycobacterium avium subsp. paratuberculosis
cggacccagcccggcgac

SEQ ID NO: 819279 - RNA, 20 nt, Mycobacterium avium subsp. paratuberculosis
cggacccagcuccucggcca

SEQ ID NO: 819280 - RNA, 21 nt, Mycobacterium avium subsp. paratuberculosis
cggacccagcuccucggccag

SEQ ID NO: 819281 - RNA, 22 nt, Mycobacterium avium subsp. paratuberculosis
cggacccagcuccucggccagc

SEQ ID NO: 819282 - RNA, 15 nt, Mycobacterium avium subsp. paratuberculosis
cggaccccagcguga

SEQ ID NO: 819283 - RNA, 20 nt, Mycobacterium avium subsp. paratuberculosis
cggaccccagcgugacgucg

SEQ ID NO: 819284 - RNA, 23 nt, Mycobacterium avium subsp. paratuberculosis
cggaccccagcgugacgucgacg

SEQ ID NO: 819285 - RNA, 23 nt, Mycobacterium avium subsp. paratuberculosis
cggacccccucggggcucaccac

SEQ ID NO: 819286 - RNA, 14 nt, Mycobacterium avium subsp. paratuberculosis
cggaccccgaugcg

SEQ ID NO: 819287 - RNA, 17 nt, Mycobacterium avium subsp. paratuberculosis
cggaccccgaugcgcuc

SEQ ID NO: 819288 - RNA, 20 nt, Mycobacterium avium subsp. paratuberculosis
cggacccggaggcggcgggg

SEQ ID NO: 819289 - RNA, 14 nt, Mycobacterium avium subsp. paratuberculosis
cggacccuggccag

SEQ ID NO: 819290 - RNA, 15 nt, Mycobacterium avium subsp. paratuberculosis
cggacccuggccagc

SEQ ID NO: 819291 - RNA, 18 nt, Mycobacterium avium subsp. paratuberculosis
cggacccuucagccagau

SEQ ID NO: 819292 - RNA, 14 nt, Mycobacterium avium subsp. paratuberculosis
cggaccgauccggc

SEQ ID NO: 819293 - RNA, 16 nt, Mycobacterium avium subsp. paratuberculosis
cggaccgauccggcgc

SEQ ID NO: 819294 - RNA, 13 nt, Mycobacterium avium subsp. paratuberculosis
cggaccgcaccac

SEQ ID NO: 819295 - RNA, 21 nt, Mycobacterium avium subsp. paratuberculosis
cggaccgcacccccagcucga

SEQ ID NO: 819296 - RNA, 12 nt, Mycobacterium avium subsp. paratuberculosis
cggaccgccgcg

SEQ ID NO: 819297 - RNA, 15 nt, Mycobacterium avium subsp. paratuberculosis
cggaccgccgcggcg

SEQ ID NO: 819298 - RNA, 17 nt, Mycobacterium avium subsp. paratuberculosis
cggaccgccgcggcgcc

SEQ ID NO: 819299 - RNA, 22 nt, Mycobacterium avium subsp. paratuberculosis
cggaccgccgcggcgcccggcg

SEQ ID NO: 819300 - RNA, 16 nt, Mycobacterium avium subsp. paratuberculosis
cggaccgccgcggcgg

SEQ ID NO: 819301 - RNA, 13 nt, Mycobacterium avium subsp. paratuberculosis
cggcagccggggu

SEQ ID NO: 819302 - RNA, 15 nt, Mycobacterium avium subsp. paratuberculosis
cggcagccggggugc

SEQ ID NO: 819303 - RNA, 16 nt, Mycobacterium avium subsp. paratuberculosis
cggcagccgcucggau

SEQ ID NO: 819304 - RNA, 15 nt, Mycobacterium avium subsp. paratuberculosis
cggcagccggccacc

SEQ ID NO: 819305 - RNA, 14 nt, Mycobacterium avium subsp. paratuberculosis
cggcagccggcgcg

SEQ ID NO: 819306 - RNA, 14 nt, Mycobacterium avium subsp. paratuberculosis
cggcagccggcgua

SEQ ID NO: 819307 - RNA, 14 nt, Mycobacterium avium subsp. paratuberculosis
cggcagccgcagcg

SEQ ID NO: 819308 - RNA, 18 nt, Mycobacterium avium subsp. paratuberculosis
cggcagcgaacugccggc

SEQ ID NO: 819309 - RNA, 17 nt, Mycobacterium avium subsp. paratuberculosis
cggcagcgacagcgcgu

SEQ ID NO: 819310 - RNA, 19 nt, Mycobacterium avium subsp. paratuberculosis
cggcagccuuuccacaucu

SEQ ID NO: 819311 - RNA, 14 nt, Mycobacterium avium subsp. paratuberculosis
cggcagcgacgcgg

SEQ ID NO: 819312 - RNA, 16 nt, Mycobacterium avium subsp. paratuberculosis
cggcagcgacgcggug

SEQ ID NO: 819313 - RNA, 12 nt, Mycobacterium avium subsp. paratuberculosis
cggcagcgcguu

SEQ ID NO: 819314 - RNA, 20 nt, Mycobacterium avium subsp. paratuberculosis
cggcagcgcuaaccgcgggc

SEQ ID NO: 819315 - RNA, 21 nt, Mycobacterium avium subsp. paratuberculosis
cggcagcgcuaaccgcgggca

SEQ ID NO: 819316 - RNA, 14 nt, Mycobacterium avium subsp. paratuberculosis
cggcagcgcucguc

SEQ ID NO: 819317 - RNA, 15 nt, Mycobacterium avium subsp. paratuberculosis
cggcagcgcucgucg

SEQ ID NO: 819318 - RNA, 18 nt, Mycobacterium avium subsp. paratuberculosis
cggcagcgcucgucgucg

SEQ ID NO: 819319 - RNA, 19 nt, Mycobacterium avium subsp. paratuberculosis
cggcagcaccgccgagccg

SEQ ID NO: 819320 - RNA, 14 nt, Mycobacterium avium subsp. paratuberculosis
cggcagcaccggca

SEQ ID NO: 819321 - RNA, 15 nt, Mycobacterium avium subsp. paratuberculosis
cggcagcaccggcag

SEQ ID NO: 819322 - RNA, 16 nt, Mycobacterium avium subsp. paratuberculosis
cggcagcaccggcagc

SEQ ID NO: 819323 - RNA, 17 nt, Mycobacterium avium subsp. paratuberculosis
cggcacucgccucggag

SEQ ID NO: 819324 - RNA, 15 nt, Mycobacterium avium subsp. paratuberculosis
cggcacucgucgugg

SEQ ID NO: 819325 - RNA, 20 nt, Mycobacterium avium subsp. paratuberculosis
cggcacucgucguggcggug

SEQ ID NO: 819326 - RNA, 18 nt, Mycobacterium avium subsp. paratuberculosis
cggcacugaaggcgcggg

SEQ ID NO: 819327 - RNA, 19 nt, Mycobacterium avium subsp. paratuberculosis
cggcacugaaggcgcgggc

SEQ ID NO: 819328 - RNA, 18 nt, Mycobacterium avium subsp. paratuberculosis
cggcagcaggugcaccac

SEQ ID NO: 819329 - RNA, 19 nt, Mycobacterium avium subsp. paratuberculosis
cggcagcaggugcaccacc

SEQ ID NO: 819330 - RNA, 16 nt, Mycobacterium avium subsp. paratuberculosis
cggcagcagcgcgucg

SEQ ID NO: 819331 - RNA, 15 nt, Mycobacterium avium subsp. paratuberculosis
cggcagcagcaccag

SEQ ID NO: 819332 - RNA, 17 nt, Mycobacterium avium subsp. paratuberculosis
cggcagcagcaccagcg

SEQ ID NO: 819333 - RNA, 16 nt, Mycobacterium avium subsp. paratuberculosis
cggcagcagcgagucg

SEQ ID NO: 819334 - RNA, 13 nt, Mycobacterium avium subsp. paratuberculosis
cggcagcagcccg

SEQ ID NO: 819335 - RNA, 14 nt, Mycobacterium avium subsp. paratuberculosis
cggcacugcccgca

SEQ ID NO: 819336 - RNA, 16 nt, Mycobacterium avium subsp. paratuberculosis
cggcacgaacgcgacg

SEQ ID NO: 819337 - RNA, 14 nt, Mycobacterium avium subsp. paratuberculosis
cggcacgaagccga

SEQ ID NO: 819338 - RNA, 17 nt, Mycobacterium avium subsp. paratuberculosis
cggcacgaagccgaacg

SEQ ID NO: 819339 - RNA, 20 nt, Mycobacterium avium subsp. paratuberculosis
cggcaccuuggugagcaccg

SEQ ID NO: 819340 - RNA, 21 nt, Mycobacterium avium subsp. paratuberculosis
cggcaccuuggugagcaccgc

SEQ ID NO: 819341 - RNA, 23 nt, Mycobacterium avium subsp. paratuberculosis
cggcaccuuggugagcaccgcga

SEQ ID NO: 819342 - RNA, 21 nt, Mycobacterium avium subsp. paratuberculosis
cggcaccuucaccgaccagcu

SEQ ID NO: 819343 - RNA, 22 nt, Mycobacterium avium subsp. paratuberculosis
cggcaccuucaccgaccagcug

SEQ ID NO: 819344 - RNA, 14 nt, Mycobacterium avium subsp. paratuberculosis
cggcaccgcugccg

SEQ ID NO: 819345 - RNA, 16 nt, Mycobacterium avium subsp. paratuberculosis
cggcaccgcgagcacc

SEQ ID NO: 819346 - RNA, 17 nt, Mycobacterium avium subsp. paratuberculosis
cggcaccgcugccggcc

SEQ ID NO: 819347 - RNA, 13 nt, Mycobacterium avium subsp. paratuberculosis
cggcacgaucguc

SEQ ID NO: 819348 - RNA, 17 nt, Mycobacterium avium subsp. paratuberculosis
cggcacgaucgucgccg

SEQ ID NO: 819349 - RNA, 20 nt, Mycobacterium avium subsp. paratuberculosis
cggcacgaucgucgccgcca

SEQ ID NO: 819350 - RNA, 22 nt, Mycobacterium avium subsp. paratuberculosis
cggcacgaucgucgccgccaac

SEQ ID NO: 819351 - RNA, 20 nt, Mycobacterium avium subsp. paratuberculosis
cggcacgaucucgaccaggc

SEQ ID NO: 819352 - RNA, 17 nt, Mycobacterium avium subsp. paratuberculosis
cggcacgauggacgccc

SEQ ID NO: 819353 - RNA, 18 nt, Mycobacterium avium subsp. paratuberculosis
cggcacgauggcgcggcg

SEQ ID NO: 819354 - RNA, 19 nt, Mycobacterium avium subsp. paratuberculosis
cggcacgauggcgcggcgc

SEQ ID NO: 819355 - RNA, 13 nt, Mycobacterium avium subsp. paratuberculosis
cggcacgaucggc

SEQ ID NO: 819356 - RNA, 18 nt, Mycobacterium avium subsp. paratuberculosis
cggcacgaucggcagcgc

SEQ ID NO: 819357 - RNA, 18 nt, Mycobacterium avium subsp. paratuberculosis
cggcacggcaccgcgagc

SEQ ID NO: 819358 - RNA, 16 nt, Mycobacterium avium subsp. paratuberculosis
cggcacggcauggcga

SEQ ID NO: 819359 - RNA, 23 nt, Mycobacterium avium subsp. paratuberculosis
cggcacgugcggguuggcgccgg

SEQ ID NO: 819360 - RNA, 18 nt, Mycobacterium avium subsp. paratuberculosis
cggcacguguccgacgcc

SEQ ID NO: 819361 - RNA, 20 nt, Mycobacterium avium subsp. paratuberculosis
cggcacguguccgacgccgu

SEQ ID NO: 819362 - RNA, 23 nt, Mycobacterium avium subsp. paratuberculosis
cggcacguguccgacgccgucga

SEQ ID NO: 819363 - RNA, 20 nt, Mycobacterium avium subsp. paratuberculosis
cggcacuaccgccucgccag

SEQ ID NO: 819364 - RNA, 21 nt, Mycobacterium avium subsp. paratuberculosis
cggcacuaccgccucgccagc

SEQ ID NO: 819365 - RNA, 22 nt, Mycobacterium avium subsp. paratuberculosis
cggcacuaccgccucgccagcc

SEQ ID NO: 819366 - RNA, 15 nt, Mycobacterium avium subsp. paratuberculosis
cggcacgucgccguu

SEQ ID NO: 819367 - RNA, 14 nt, Mycobacterium avium subsp. paratuberculosis
cggcacgucggcca

SEQ ID NO: 819368 - RNA, 16 nt, Mycobacterium avium subsp. paratuberculosis
cggcacgucggccacg

SEQ ID NO: 819369 - RNA, 20 nt, Mycobacterium avium subsp. paratuberculosis
cggcacgucggccacgccgg

SEQ ID NO: 819370 - RNA, 19 nt, Mycobacterium avium subsp. paratuberculosis
cggcacgucgagcuccucg

SEQ ID NO: 819371 - RNA, 13 nt, Mycobacterium avium subsp. paratuberculosis
cggcacgucgagg

SEQ ID NO: 819372 - RNA, 20 nt, Mycobacterium avium subsp. paratuberculosis
cggcacgucgagggugaugu

SEQ ID NO: 819373 - RNA, 18 nt, Mycobacterium avium subsp. paratuberculosis
cggcacgguuggccggcc

SEQ ID NO: 819374 - RNA, 22 nt, Mycobacterium avium subsp. paratuberculosis
cggcacgguuggccggcccgcc

SEQ ID NO: 819375 - RNA, 17 nt, Mycobacterium avium subsp. paratuberculosis
cggcacggugcacacgc

SEQ ID NO: 819376 - RNA, 18 nt, Mycobacterium avium subsp. paratuberculosis
cggcacggugcacacgcc

SEQ ID NO: 819377 - RNA, 19 nt, Mycobacterium avium subsp. paratuberculosis
cggcacggugcacacgccg

SEQ ID NO: 819378 - RNA, 23 nt, Mycobacterium avium subsp. paratuberculosis
cggcacggugcacacgccgaggc

SEQ ID NO: 819379 - RNA, 23 nt, Mycobacterium avium subsp. paratuberculosis
cggcacggugcgggugccgaaca

SEQ ID NO: 819380 - RNA, 14 nt, Mycobacterium avium subsp. paratuberculosis
cggcacgguggcca

SEQ ID NO: 819381 - RNA, 15 nt, Mycobacterium avium subsp. paratuberculosis
cggcacggccggccg

SEQ ID NO: 819382 - RNA, 16 nt, Mycobacterium avium subsp. paratuberculosis
cggcacgggcaccgac

SEQ ID NO: 819383 - RNA, 17 nt, Mycobacterium avium subsp. paratuberculosis
cggcacgggcaccgacg

SEQ ID NO: 819384 - RNA, 18 nt, Mycobacterium avium subsp. paratuberculosis
cggcacgggcaccgacga

SEQ ID NO: 819385 - RNA, 17 nt, Mycobacterium avium subsp. paratuberculosis
cggcacgggccguucgu

SEQ ID NO: 819386 - RNA, 11 nt, Mycobacterium avium subsp. paratuberculosis
cggcacggcga

SEQ ID NO: 819387 - RNA, 15 nt, Mycobacterium avium subsp. paratuberculosis
cggcacggcgagguc

SEQ ID NO: 819388 - RNA, 17 nt, Mycobacterium avium subsp. paratuberculosis
cggcacggcgaggucgg

SEQ ID NO: 819389 - RNA, 13 nt, Mycobacterium avium subsp. paratuberculosis
cggcacggccggc

SEQ ID NO: 819390 - RNA, 16 nt, Mycobacterium avium subsp. paratuberculosis
cggcaccgccgcggug

SEQ ID NO: 819391 - RNA, 17 nt, Mycobacterium avium subsp. paratuberculosis
cggcaccgcccccgcgg

SEQ ID NO: 819392 - RNA, 22 nt, Mycobacterium avium subsp. paratuberculosis
cggcaccgcccccgcggcggcc

SEQ ID NO: 819393 - RNA, 23 nt, Mycobacterium avium subsp. paratuberculosis
cggcaccgcccggguugucgacg

SEQ ID NO: 819394 - RNA, 18 nt, Mycobacterium avium subsp. paratuberculosis
cggcacccaggucaccga

SEQ ID NO: 819395 - RNA, 16 nt, Mycobacterium avium subsp. paratuberculosis
cggcaccgccggcggc

SEQ ID NO: 819396 - RNA, 21 nt, Mycobacterium avium subsp. paratuberculosis
cggcaccgccggcggccuccg

SEQ ID NO: 819397 - RNA, 13 nt, Mycobacterium avium subsp. paratuberculosis
cggcaccgcggcg

SEQ ID NO: 819398 - RNA, 14 nt, Mycobacterium avium subsp. paratuberculosis
cggcaccgcggcga

SEQ ID NO: 819399 - RNA, 15 nt, Mycobacterium avium subsp. paratuberculosis
cggcaccgcggcgau

SEQ ID NO: 819400 - RNA, 14 nt, Mycobacterium avium subsp. paratuberculosis
cggcaccgcggcgg

SEQ ID NO: 819401 - RNA, 15 nt, Mycobacterium avium subsp. paratuberculosis
cggcaccgcggcggu

SEQ ID NO: 819402 - RNA, 17 nt, Mycobacterium avium subsp. paratuberculosis
cggcaccgcggcggugu

SEQ ID NO: 819403 - RNA, 15 nt, Mycobacterium avium subsp. paratuberculosis
cggcaccgcggucug

SEQ ID NO: 819404 - RNA, 19 nt, Mycobacterium avium subsp. paratuberculosis
cggcaccgcggucugcgcc

SEQ ID NO: 819405 - RNA, 22 nt, Mycobacterium avium subsp. paratuberculosis
cggcaccgcggucugcgccagc

SEQ ID NO: 819406 - RNA, 21 nt, Mycobacterium avium subsp. paratuberculosis
cggcaccagguucacgucggg

SEQ ID NO: 819407 - RNA, 22 nt, Mycobacterium avium subsp. paratuberculosis
cggcaccagucgcgcagcguca

SEQ ID NO: 819408 - RNA, 15 nt, Mycobacterium avium subsp. paratuberculosis
cggcaccagcagccg

SEQ ID NO: 819409 - RNA, 23 nt, Mycobacterium avium subsp. paratuberculosis
cggcaccagcagccgcagcgcgc

SEQ ID NO: 819410 - RNA, 14 nt, Mycobacterium avium subsp. paratuberculosis
cggcaccagcaggc

SEQ ID NO: 819411 - RNA, 20 nt, Mycobacterium avium subsp. paratuberculosis
cggcaccagcccgccgucgg

SEQ ID NO: 819412 - RNA, 16 nt, Mycobacterium avium subsp. paratuberculosis
cggcaccagcggaucg

SEQ ID NO: 819413 - RNA, 13 nt, Mycobacterium avium subsp. paratuberculosis
cggcaccagcggc

SEQ ID NO: 819414 - RNA, 22 nt, Mycobacterium avium subsp. paratuberculosis
cggcaccagcggcaucgccgcc

SEQ ID NO: 819415 - RNA, 13 nt, Mycobacterium avium subsp. paratuberculosis
cggcaaucgggac

SEQ ID NO: 819416 - RNA, 21 nt, Mycobacterium avium subsp. paratuberculosis
cggcaaucgggacgccacggc

SEQ ID NO: 819417 - RNA, 16 nt, Mycobacterium avium subsp. paratuberculosis
cggcaauccggccccg

SEQ ID NO: 819418 - RNA, 19 nt, Mycobacterium avium subsp. paratuberculosis
cggaugccggcuugggcga

SEQ ID NO: 819419 - RNA, 15 nt, Mycobacterium avium subsp. paratuberculosis
cggaugccguagcgc

SEQ ID NO: 819420 - RNA, 14 nt, Mycobacterium avium subsp. paratuberculosis
cggaugcgcuggug

SEQ ID NO: 819421 - RNA, 12 nt, Mycobacterium avium subsp. paratuberculosis
cggaugcggccg

SEQ ID NO: 819422 - RNA, 13 nt, Mycobacterium avium subsp. paratuberculosis
cggaugcggccga

SEQ ID NO: 819423 - RNA, 14 nt, Mycobacterium avium subsp. paratuberculosis
cggaugcggccgaa

SEQ ID NO: 819424 - RNA, 16 nt, Mycobacterium avium subsp. paratuberculosis
cggaugcggcucccac

SEQ ID NO: 819425 - RNA, 16 nt, Mycobacterium avium subsp. paratuberculosis
cggaugcgggcgcugc

SEQ ID NO: 819426 - RNA, 18 nt, Mycobacterium avium subsp. paratuberculosis
cggaugcgggcgcugccg

SEQ ID NO: 819427 - RNA, 20 nt, Mycobacterium avium subsp. paratuberculosis
cggaugcgggcgcugccguc

SEQ ID NO: 819428 - RNA, 13 nt, Mycobacterium avium subsp. paratuberculosis
cggaugcugcggg

SEQ ID NO: 819429 - RNA, 19 nt, Mycobacterium avium subsp. paratuberculosis
cggaugcucaccggucagc

SEQ ID NO: 819430 - RNA, 15 nt, Mycobacterium avium subsp. paratuberculosis
cggcaacuggccgcc

SEQ ID NO: 819431 - RNA, 18 nt, Mycobacterium avium subsp. paratuberculosis
cggcaacugggcggccug

SEQ ID NO: 819432 - RNA, 22 nt, Mycobacterium avium subsp. paratuberculosis
cggcaacugggcggccugcacc

SEQ ID NO: 819433 - RNA, 21 nt, Mycobacterium avium subsp. paratuberculosis
cggcaagcaguaugcccgccg

SEQ ID NO: 819434 - RNA, 22 nt, Mycobacterium avium subsp. paratuberculosis
cggcaagcaguaugcccgccgc

SEQ ID NO: 819435 - RNA, 15 nt, Mycobacterium avium subsp. paratuberculosis
cggcaaggcgcagaa

SEQ ID NO: 819436 - RNA, 17 nt, Mycobacterium avium subsp. paratuberculosis
cggcaaggugccguccg

SEQ ID NO: 819437 - RNA, 16 nt, Mycobacterium avium subsp. paratuberculosis
cggcauccagcacggc

SEQ ID NO: 819438 - RNA, 18 nt, Mycobacterium avium subsp. paratuberculosis
cggcauccagcacggccg

SEQ ID NO: 819439 - RNA, 14 nt, Mycobacterium avium subsp. paratuberculosis
cggcaucagcgaga

SEQ ID NO: 819440 - RNA, 17 nt, Mycobacterium avium subsp. paratuberculosis
cggcaucccuggugacc

SEQ ID NO: 819441 - RNA, 19 nt, Mycobacterium avium subsp. paratuberculosis
cggcaucccuggugaccga

SEQ ID NO: 819442 - RNA, 23 nt, Mycobacterium avium subsp. paratuberculosis
cggcaucccuggugaccgacgac

SEQ ID NO: 819443 - RNA, 18 nt, Mycobacterium avium subsp. paratuberculosis
cggcauccccagcugggc

SEQ ID NO: 819444 - RNA, 20 nt, Mycobacterium avium subsp. paratuberculosis
cggcauccccagcugggccg

SEQ ID NO: 819445 - RNA, 21 nt, Mycobacterium avium subsp. paratuberculosis
cggcauccccagcugggccgc

SEQ ID NO: 819446 - RNA, 22 nt, Mycobacterium avium subsp. paratuberculosis
cggcauccccagcugggccgcc

SEQ ID NO: 819447 - RNA, 14 nt, Mycobacterium avium subsp. paratuberculosis
cggcauccucggcg

SEQ ID NO: 819448 - RNA, 15 nt, Mycobacterium avium subsp. paratuberculosis
cggcauccucggcgc

SEQ ID NO: 819449 - RNA, 19 nt, Mycobacterium avium subsp. paratuberculosis
cggcaucgacaugcccggc

SEQ ID NO: 819450 - RNA, 20 nt, Mycobacterium avium subsp. paratuberculosis
cggcaucgacaugcccggcg

SEQ ID NO: 819451 - RNA, 14 nt, Mycobacterium avium subsp. paratuberculosis
cggcaucgaccgcc

SEQ ID NO: 819452 - RNA, 17 nt, Mycobacterium avium subsp. paratuberculosis
cggcaucgaccgcccgc

SEQ ID NO: 819453 - RNA, 21 nt, Mycobacterium avium subsp. paratuberculosis
cggcaucgaccgcccgcugaa

SEQ ID NO: 819454 - RNA, 17 nt, Mycobacterium avium subsp. paratuberculosis
cggcauucguguggcgc

SEQ ID NO: 819455 - RNA, 23 nt, Mycobacterium avium subsp. paratuberculosis
cggcauugcagcggaugccggag

SEQ ID NO: 819456 - RNA, 16 nt, Mycobacterium avium subsp. paratuberculosis
cggcauggcgaugacc

SEQ ID NO: 819457 - RNA, 20 nt, Mycobacterium avium subsp. paratuberculosis
cggcauggcgaugaccagcg

SEQ ID NO: 819458 - RNA, 21 nt, Mycobacterium avium subsp. paratuberculosis
cggcauggcgaugaccagcgc

SEQ ID NO: 819459 - RNA, 22 nt, Mycobacterium avium subsp. paratuberculosis
cggcauggcgaugaccagcgcg

SEQ ID NO: 819460 - RNA, 14 nt, Mycobacterium avium subsp. paratuberculosis
cggcaugccgcccg

SEQ ID NO: 819461 - RNA, 15 nt, Mycobacterium avium subsp. paratuberculosis
cggcaugccgcccgg

SEQ ID NO: 819462 - RNA, 17 nt, Mycobacterium avium subsp. paratuberculosis
cggcaugccgcccgggc

SEQ ID NO: 819463 - RNA, 19 nt, Mycobacterium avium subsp. paratuberculosis
cggcaugccgcccgggccg

SEQ ID NO: 819464 - RNA, 19 nt, Mycobacterium avium subsp. paratuberculosis
cggcaugccgggccagccg

SEQ ID NO: 819465 - RNA, 21 nt, Mycobacterium avium subsp. paratuberculosis
cggcaugccgggccagccggc

SEQ ID NO: 819466 - RNA, 22 nt, Mycobacterium avium subsp. paratuberculosis
cggcaugccgggccagccggcc

SEQ ID NO: 819467 - RNA, 16 nt, Mycobacterium avium subsp. paratuberculosis
cggccaccagcgcccg

SEQ ID NO: 819468 - RNA, 15 nt, Mycobacterium avium subsp. paratuberculosis
cggccaccagggcga

SEQ ID NO: 819469 - RNA, 16 nt, Mycobacterium avium subsp. paratuberculosis
cggccaccagggcgac

SEQ ID NO: 819470 - RNA, 21 nt, Mycobacterium avium subsp. paratuberculosis
cggccaccagggcgaccgccg

SEQ ID NO: 819471 - RNA, 22 nt, Mycobacterium avium subsp. paratuberculosis
cggccaccagggcgaccgccgc

SEQ ID NO: 819472 - RNA, 23 nt, Mycobacterium avium subsp. paratuberculosis
cggccaccagggucucgcgcagc

SEQ ID NO: 819473 - RNA, 16 nt, Mycobacterium avium subsp. paratuberculosis
cggccaccaucuccgc

SEQ ID NO: 819474 - RNA, 21 nt, Mycobacterium avium subsp. paratuberculosis
cggccaccaucuccgcggcgc

SEQ ID NO: 819475 - RNA, 16 nt, Mycobacterium avium subsp. paratuberculosis
cggccaccaugccggc

SEQ ID NO: 819476 - RNA, 17 nt, Mycobacterium avium subsp. paratuberculosis
cggccaccaugccggcg

SEQ ID NO: 819477 - RNA, 16 nt, Mycobacterium avium subsp. paratuberculosis
cggccaaggcaagucg

SEQ ID NO: 819478 - RNA, 22 nt, Mycobacterium avium subsp. paratuberculosis
cggccaaggcaagucgucggug

SEQ ID NO: 819479 - RNA, 19 nt, Mycobacterium avium subsp. paratuberculosis
cggccaccagcgcccgccc

SEQ ID NO: 819480 - RNA, 20 nt, Mycobacterium avium subsp. paratuberculosis
cggccaccagcgcccgcccg

SEQ ID NO: 819481 - RNA, 14 nt, Mycobacterium avium subsp. paratuberculosis
cggccaccagcgcg

SEQ ID NO: 819482 - RNA, 15 nt, Mycobacterium avium subsp. paratuberculosis
cggccaccagcgcgg

SEQ ID NO: 819483 - RNA, 21 nt, Mycobacterium avium subsp. paratuberculosis
cggccaccagcgcggccacca

SEQ ID NO: 819484 - RNA, 13 nt, Mycobacterium avium subsp. paratuberculosis
cggccaccagcgg

SEQ ID NO: 819485 - RNA, 18 nt, Mycobacterium avium subsp. paratuberculosis
cggccaccagcggccgga

SEQ ID NO: 819486 - RNA, 17 nt, Mycobacterium avium subsp. paratuberculosis
cggccaccccgcagaac

SEQ ID NO: 819487 - RNA, 17 nt, Mycobacterium avium subsp. paratuberculosis
cggccaccccggugacc

SEQ ID NO: 819488 - RNA, 16 nt, Mycobacterium avium subsp. paratuberculosis
cggccaccuccagccc

SEQ ID NO: 819489 - RNA, 17 nt, Mycobacterium avium subsp. paratuberculosis
cggccaccuccagcccg

SEQ ID NO: 819490 - RNA, 15 nt, Mycobacterium avium subsp. paratuberculosis
cggccaccucgccgc

SEQ ID NO: 819491 - RNA, 23 nt, Mycobacterium avium subsp. paratuberculosis
cggccaccucgccgcaggcgucc

SEQ ID NO: 819492 - RNA, 17 nt, Mycobacterium avium subsp. paratuberculosis
cggccaccucggcggca

SEQ ID NO: 819493 - RNA, 22 nt, Mycobacterium avium subsp. paratuberculosis
cggccaccucggcggcaccgcc

SEQ ID NO: 819494 - RNA, 19 nt, Mycobacterium avium subsp. paratuberculosis
cggccaccucgucccagcg

SEQ ID NO: 819495 - RNA, 21 nt, Mycobacterium avium subsp. paratuberculosis
cggccaccucgucccagcgca

SEQ ID NO: 819496 - RNA, 17 nt, Mycobacterium avium subsp. paratuberculosis
cggccaccucgucggcg

SEQ ID NO: 819497 - RNA, 18 nt, Mycobacterium avium subsp. paratuberculosis
cggccaccucgucggcgg

SEQ ID NO: 819498 - RNA, 21 nt, Mycobacterium avium subsp. paratuberculosis
cggccaccucgucggcgguca

SEQ ID NO: 819499 - RNA, 14 nt, Mycobacterium avium subsp. paratuberculosis
cggccaccaugggc

SEQ ID NO: 819500 - RNA, 18 nt, Mycobacterium avium subsp. paratuberculosis
cggccaccaugggcggga

SEQ ID NO: 819501 - RNA, 17 nt, Mycobacterium avium subsp. paratuberculosis
cggccaccaugucggcg

SEQ ID NO: 819502 - RNA, 18 nt, Mycobacterium avium subsp. paratuberculosis
cggccaccaugucggcgu

SEQ ID NO: 819503 - RNA, 20 nt, Mycobacterium avium subsp. paratuberculosis
cggccaccaugucggcgucg

SEQ ID NO: 819504 - RNA, 20 nt, Mycobacterium avium subsp. paratuberculosis
cggccaacugcaucgccagc

SEQ ID NO: 819505 - RNA, 23 nt, Mycobacterium avium subsp. paratuberculosis
cggccaacgggaagagcggcgug

SEQ ID NO: 819506 - RNA, 19 nt, Mycobacterium avium subsp. paratuberculosis
cggccaacggauagcgucc

SEQ ID NO: 819507 - RNA, 22 nt, Mycobacterium avium subsp. paratuberculosis
cggccaacggauagcguccgcc

SEQ ID NO: 819508 - RNA, 16 nt, Mycobacterium avium subsp. paratuberculosis
cggccaacgcccacca

SEQ ID NO: 819509 - RNA, 14 nt, Mycobacterium avium subsp. paratuberculosis
cggccaaccgcccg

SEQ ID NO: 819510 - RNA, 15 nt, Mycobacterium avium subsp. paratuberculosis
cggccaaccgcccgg

SEQ ID NO: 819511 - RNA, 16 nt, Mycobacterium avium subsp. paratuberculosis
cggccaaccgcccggc

SEQ ID NO: 819512 - RNA, 18 nt, Mycobacterium avium subsp. paratuberculosis
cggccaaccgcccggcgc

SEQ ID NO: 819513 - RNA, 20 nt, Mycobacterium avium subsp. paratuberculosis
cggccaaccgcccggcgccg

SEQ ID NO: 819514 - RNA, 13 nt, Mycobacterium avium subsp. paratuberculosis
cggccaaccgggc

SEQ ID NO: 819515 - RNA, 21 nt, Mycobacterium avium subsp. paratuberculosis
cggccaaccgggcaggcacgg

SEQ ID NO: 819516 - RNA, 15 nt, Mycobacterium avium subsp. paratuberculosis
cggccaacccgggcg

SEQ ID NO: 819517 - RNA, 16 nt, Mycobacterium avium subsp. paratuberculosis
cggccaacccgggcgc

SEQ ID NO: 819518 - RNA, 14 nt, Mycobacterium avium subsp. paratuberculosis
cggccaacgccucg

SEQ ID NO: 819519 - RNA, 18 nt, Mycobacterium avium subsp. paratuberculosis
cggccaacgccucgucga

SEQ ID NO: 819520 - RNA, 22 nt, Mycobacterium avium subsp. paratuberculosis
cggccaacgccucgucgaccgc

SEQ ID NO: 819521 - RNA, 18 nt, Mycobacterium avium subsp. paratuberculosis
cggccaacgcgacgaagc

SEQ ID NO: 819522 - RNA, 21 nt, Mycobacterium avium subsp. paratuberculosis
cggccaacagugcgcaggcgg

SEQ ID NO: 819523 - RNA, 21 nt, Mycobacterium avium subsp. paratuberculosis
cggccaacagcagcgccgcgg

SEQ ID NO: 819524 - RNA, 14 nt, Mycobacterium avium subsp. paratuberculosis
cggccaacccgggc

SEQ ID NO: 819525 - RNA, 22 nt, Mycobacterium avium subsp. paratuberculosis
cggccaaacccguugcagcaca

SEQ ID NO: 819526 - RNA, 17 nt, Mycobacterium avium subsp. paratuberculosis
cggcaggaaccggguca

SEQ ID NO: 819527 - RNA, 14 nt, Mycobacterium avium subsp. paratuberculosis
cggcaggaaagcgc

SEQ ID NO: 819528 - RNA, 20 nt, Mycobacterium avium subsp. paratuberculosis
cggcaggucgaggccggcca

SEQ ID NO: 819529 - RNA, 16 nt, Mycobacterium avium subsp. paratuberculosis
cggcagguaggcgccg

SEQ ID NO: 819530 - RNA, 19 nt, Mycobacterium avium subsp. paratuberculosis
cggcagguaggcgccgcuc

SEQ ID NO: 819531 - RNA, 22 nt, Mycobacterium avium subsp. paratuberculosis
cggcagguaggcgccgcucgac

SEQ ID NO: 819532 - RNA, 17 nt, Mycobacterium avium subsp. paratuberculosis
cggcaggucggccagcg

SEQ ID NO: 819533 - RNA, 23 nt, Mycobacterium avium subsp. paratuberculosis
cggcaggucggccagcgccgccc

SEQ ID NO: 819534 - RNA, 15 nt, Mycobacterium avium subsp. paratuberculosis
cggcaggucggcggg

SEQ ID NO: 819535 - RNA, 16 nt, Mycobacterium avium subsp. paratuberculosis
cggcaggucggcggga

SEQ ID NO: 819536 - RNA, 22 nt, Mycobacterium avium subsp. paratuberculosis
cggcaggucggugcgcggggug

SEQ ID NO: 819537 - RNA, 13 nt, Mycobacterium avium subsp. paratuberculosis
cggcaggucgucg

SEQ ID NO: 819538 - RNA, 14 nt, Mycobacterium avium subsp. paratuberculosis
cggcaggucgucga

SEQ ID NO: 819539 - RNA, 15 nt, Mycobacterium avium subsp. paratuberculosis
cggcaggucgucgac

SEQ ID NO: 819540 - RNA, 16 nt, Mycobacterium avium subsp. paratuberculosis
cggcaggucgucgacg

SEQ ID NO: 819541 - RNA, 20 nt, Mycobacterium avium subsp. paratuberculosis
cggcaggucgucgacgucgc

SEQ ID NO: 819542 - RNA, 18 nt, Mycobacterium avium subsp. paratuberculosis
cggcaggucgucgucgcc

SEQ ID NO: 819543 - RNA, 21 nt, Mycobacterium avium subsp. paratuberculosis
cggcaggucgucgucgccgcg

SEQ ID NO: 819544 - RNA, 14 nt, Mycobacterium avium subsp. paratuberculosis
cggcaggugaaggu

SEQ ID NO: 819545 - RNA, 22 nt, Mycobacterium avium subsp. paratuberculosis
cggcaggugaaggugccccacg

SEQ ID NO: 819546 - RNA, 13 nt, Mycobacterium avium subsp. paratuberculosis
cggcagcgucgcc

SEQ ID NO: 819547 - RNA, 16 nt, Mycobacterium avium subsp. paratuberculosis
cggcagcgucgccagc

SEQ ID NO: 819548 - RNA, 21 nt, Mycobacterium avium subsp. paratuberculosis
cggcagcgucgccagccgccg

SEQ ID NO: 819549 - RNA, 22 nt, Mycobacterium avium subsp. paratuberculosis
cggcagcgucgccagccgccgg

SEQ ID NO: 819550 - RNA, 15 nt, Mycobacterium avium subsp. paratuberculosis
cggcagcgucuugga

SEQ ID NO: 819551 - RNA, 22 nt, Mycobacterium avium subsp. paratuberculosis
cggcagcgucuuggacgcccgg

SEQ ID NO: 819552 - RNA, 14 nt, Mycobacterium avium subsp. paratuberculosis
cggcagcugcagcg

SEQ ID NO: 819553 - RNA, 18 nt, Mycobacterium avium subsp. paratuberculosis
cggcagcucgucgacguc

SEQ ID NO: 819554 - RNA, 15 nt, Mycobacterium avium subsp. paratuberculosis
cggcagcucggcggc

SEQ ID NO: 819555 - RNA, 16 nt, Mycobacterium avium subsp. paratuberculosis
cggcagcucggcggcc

SEQ ID NO: 819556 - RNA, 17 nt, Mycobacterium avium subsp. paratuberculosis
cggcagcucggcggccc

SEQ ID NO: 819557 - RNA, 13 nt, Mycobacterium avium subsp. paratuberculosis
cggcagcucggcg

SEQ ID NO: 819558 - RNA, 13 nt, Mycobacterium avium subsp. paratuberculosis
cggcagcggcugc

SEQ ID NO: 819559 - RNA, 14 nt, Mycobacterium avium subsp. paratuberculosis
cggcagcggcgucg

SEQ ID NO: 819560 - RNA, 23 nt, Mycobacterium avium subsp. paratuberculosis
cggcagcgcggcguucagcagcg

SEQ ID NO: 819561 - RNA, 13 nt, Mycobacterium avium subsp. paratuberculosis
cggcagcggcacc

SEQ ID NO: 819562 - RNA, 13 nt, Mycobacterium avium subsp. paratuberculosis
cggcagcggugcc

SEQ ID NO: 819563 - RNA, 14 nt, Mycobacterium avium subsp. paratuberculosis
cggcagcggugccg

SEQ ID NO: 819564 - RNA, 15 nt, Mycobacterium avium subsp. paratuberculosis
cggcagcggugccgc

SEQ ID NO: 819565 - RNA, 15 nt, Mycobacterium avium subsp. paratuberculosis
cggcaguacgcgccg

SEQ ID NO: 819566 - RNA, 17 nt, Mycobacterium avium subsp. paratuberculosis
cggcaguacgcgccggc

SEQ ID NO: 819567 - RNA, 19 nt, Mycobacterium avium subsp. paratuberculosis
cggcaguacgcgccggccu

SEQ ID NO: 819568 - RNA, 20 nt, Mycobacterium avium subsp. paratuberculosis
cggcaguagcacuuucgcgg

SEQ ID NO: 819569 - RNA, 16 nt, Mycobacterium avium subsp. paratuberculosis
cggcaguagcgcaccg

SEQ ID NO: 819570 - RNA, 17 nt, Mycobacterium avium subsp. paratuberculosis
cggcaguagcgcaccgg

SEQ ID NO: 819571 - RNA, 14 nt, Mycobacterium avium subsp. paratuberculosis
cggcaguccgccgg

SEQ ID NO: 819572 - RNA, 14 nt, Mycobacterium avium subsp. paratuberculosis
cggcaguccgcgcc

SEQ ID NO: 819573 - RNA, 19 nt, Mycobacterium avium subsp. paratuberculosis
cggcaguccgcgccggucc

SEQ ID NO: 819574 - RNA, 18 nt, Mycobacterium avium subsp. paratuberculosis
cggcaguccggacacggc

SEQ ID NO: 819575 - RNA, 17 nt, Mycobacterium avium subsp. paratuberculosis
cggcagguugcgcugga

SEQ ID NO: 819576 - RNA, 19 nt, Mycobacterium avium subsp. paratuberculosis
cggcagguugcgcuggaug

SEQ ID NO: 819577 - RNA, 14 nt, Mycobacterium avium subsp. paratuberculosis
cggcagguugggga

SEQ ID NO: 819578 - RNA, 22 nt, Mycobacterium avium subsp. paratuberculosis
cggcagguggggcagcaccucg

SEQ ID NO: 819579 - RNA, 21 nt, Mycobacterium avium subsp. paratuberculosis
cggcagguggauugucggccg

SEQ ID NO: 819580 - RNA, 23 nt, Mycobacterium avium subsp. paratuberculosis
cggcagguggauugucggccgcc

SEQ ID NO: 819581 - RNA, 20 nt, Mycobacterium avium subsp. paratuberculosis
cggcagugaucggcggaacc

SEQ ID NO: 819582 - RNA, 17 nt, Mycobacterium avium subsp. paratuberculosis
cggcagugcgccguccc

SEQ ID NO: 819583 - RNA, 18 nt, Mycobacterium avium subsp. paratuberculosis
cggcagugcgccgucccg

SEQ ID NO: 819584 - RNA, 20 nt, Mycobacterium avium subsp. paratuberculosis
cggcagugugauucggguca

SEQ ID NO: 819585 - RNA, 16 nt, Mycobacterium avium subsp. paratuberculosis
cggcaguuccucgccg

SEQ ID NO: 819586 - RNA, 20 nt, Mycobacterium avium subsp. paratuberculosis
cggcaguugcacuuucgcgu

SEQ ID NO: 819587 - RNA, 22 nt, Mycobacterium avium subsp. paratuberculosis
cggcaguugcacuuucgcgugg

SEQ ID NO: 819588 - RNA, 12 nt, Mycobacterium avium subsp. paratuberculosis
cggcaguugcgg

SEQ ID NO: 819589 - RNA, 14 nt, Mycobacterium avium subsp. paratuberculosis
cggcaguugcggcc

SEQ ID NO: 819590 - RNA, 15 nt, Mycobacterium avium subsp. paratuberculosis
cggcaguugcggccg

SEQ ID NO: 819591 - RNA, 14 nt, Mycobacterium avium subsp. paratuberculosis
cggcagucgcagca

SEQ ID NO: 819592 - RNA, 17 nt, Mycobacterium avium subsp. paratuberculosis
cggcauaguccagcucg

SEQ ID NO: 819593 - RNA, 13 nt, Mycobacterium avium subsp. paratuberculosis
cggcauagcgccg

SEQ ID NO: 819594 - RNA, 14 nt, Mycobacterium avium subsp. paratuberculosis
cggcauagcgccgc

SEQ ID NO: 819595 - RNA, 17 nt, Mycobacterium avium subsp. paratuberculosis
cggcauagcgccgcucg

SEQ ID NO: 819596 - RNA, 19 nt, Mycobacterium avium subsp. paratuberculosis
cggcauagcgccgcucggc

SEQ ID NO: 819597 - RNA, 15 nt, Mycobacterium avium subsp. paratuberculosis
cggcauaggccagca

SEQ ID NO: 819598 - RNA, 16 nt, Mycobacterium avium subsp. paratuberculosis
cggcauaggccagcac

SEQ ID NO: 819599 - RNA, 17 nt, Mycobacterium avium subsp. paratuberculosis
cggcauaggccagcacc

SEQ ID NO: 819600 - RNA, 20 nt, Mycobacterium avium subsp. paratuberculosis
cggcauaggccagcaccagc

SEQ ID NO: 819601 - RNA, 22 nt, Mycobacterium avium subsp. paratuberculosis
cggcauaggccagcaccagcgu

SEQ ID NO: 819602 - RNA, 17 nt, Mycobacterium avium subsp. paratuberculosis
cggcauagauaccggcc

SEQ ID NO: 819603 - RNA, 21 nt, Mycobacterium avium subsp. paratuberculosis
cggcauagauaccggccagca

SEQ ID NO: 819604 - RNA, 22 nt, Mycobacterium avium subsp. paratuberculosis
cggcauagauaccggccagcac

SEQ ID NO: 819605 - RNA, 22 nt, Mycobacterium avium subsp. paratuberculosis
cggcgagaucccugcgcucagc

SEQ ID NO: 819606 - RNA, 19 nt, Mycobacterium avium subsp. paratuberculosis
cggcgacgaaauugggcug

SEQ ID NO: 819607 - RNA, 16 nt, Mycobacterium avium subsp. paratuberculosis
cggcgacuccagcagc

SEQ ID NO: 819608 - RNA, 17 nt, Mycobacterium avium subsp. paratuberculosis
cggcgacuccagcagcg

SEQ ID NO: 819609 - RNA, 18 nt, Mycobacterium avium subsp. paratuberculosis
cggcgacuccagcagcgc

SEQ ID NO: 819610 - RNA, 20 nt, Mycobacterium avium subsp. paratuberculosis
cggcgacuccagcagcgcca

SEQ ID NO: 819611 - RNA, 22 nt, Mycobacterium avium subsp. paratuberculosis
cggcgacuccagcagcgccagc

SEQ ID NO: 819612 - RNA, 23 nt, Mycobacterium avium subsp. paratuberculosis
cggcgacuccagcagcgccagca

SEQ ID NO: 819613 - RNA, 20 nt, Mycobacterium avium subsp. paratuberculosis
cggcgagcaaggcgagcacg

SEQ ID NO: 819614 - RNA, 23 nt, Mycobacterium avium subsp. paratuberculosis
cggcgagcacaggaacgcgacgg

SEQ ID NO: 819615 - RNA, 19 nt, Mycobacterium avium subsp. paratuberculosis
cggcgagcaccgugccguc

SEQ ID NO: 819616 - RNA, 21 nt, Mycobacterium avium subsp. paratuberculosis
cggcgagcaccgugccgucgg

SEQ ID NO: 819617 - RNA, 13 nt, Mycobacterium avium subsp. paratuberculosis
cggcgagcacgcc

SEQ ID NO: 819618 - RNA, 14 nt, Mycobacterium avium subsp. paratuberculosis
cggcgagcacgccg

SEQ ID NO: 819619 - RNA, 15 nt, Mycobacterium avium subsp. paratuberculosis
cggcgagcacgccgc

SEQ ID NO: 819620 - RNA, 17 nt, Mycobacterium avium subsp. paratuberculosis
cggcgagcacgccgccg

SEQ ID NO: 819621 - RNA, 21 nt, Mycobacterium avium subsp. paratuberculosis
cggcgagcagcagcgcggugc

SEQ ID NO: 819622 - RNA, 23 nt, Mycobacterium avium subsp. paratuberculosis
cggcgagcagcagcgcggugccg

SEQ ID NO: 819623 - RNA, 15 nt, Mycobacterium avium subsp. paratuberculosis
cggcgagcagcccgg

SEQ ID NO: 819624 - RNA, 18 nt, Mycobacterium avium subsp. paratuberculosis
cggcgagcagcccggcga

SEQ ID NO: 819625 - RNA, 20 nt, Mycobacterium avium subsp. paratuberculosis
cggcgagcagcccggcgaac

SEQ ID NO: 819626 - RNA, 13 nt, Mycobacterium avium subsp. paratuberculosis
cggcgagcagccg

SEQ ID NO: 819627 - RNA, 18 nt, Mycobacterium avium subsp. paratuberculosis
cggcgagcagccgcgccg

SEQ ID NO: 819628 - RNA, 20 nt, Mycobacterium avium subsp. paratuberculosis
cggcgagcagccgcgccggg

SEQ ID NO: 819629 - RNA, 15 nt, Mycobacterium avium subsp. paratuberculosis
cggcgagcagcgcga

SEQ ID NO: 819630 - RNA, 17 nt, Mycobacterium avium subsp. paratuberculosis
cggcgagcagcgcgaug

SEQ ID NO: 819631 - RNA, 20 nt, Mycobacterium avium subsp. paratuberculosis
cggcgagcagcgcgaugccg

SEQ ID NO: 819632 - RNA, 23 nt, Mycobacterium avium subsp. paratuberculosis
cggcgaccuguuuggccagccag

SEQ ID NO: 819633 - RNA, 16 nt, Mycobacterium avium subsp. paratuberculosis
cggcgacgaccaccag

SEQ ID NO: 819634 - RNA, 13 nt, Mycobacterium avium subsp. paratuberculosis
cggcgacgaccgc

SEQ ID NO: 819635 - RNA, 14 nt, Mycobacterium avium subsp. paratuberculosis
cggcgacgaccgca

SEQ ID NO: 819636 - RNA, 16 nt, Mycobacterium avium subsp. paratuberculosis
cggcgacgaccgcacc

SEQ ID NO: 819637 - RNA, 17 nt, Mycobacterium avium subsp. paratuberculosis
cggcgacgaccgcaccg

SEQ ID NO: 819638 - RNA, 23 nt, Mycobacterium avium subsp. paratuberculosis
cggcgacgaccgcaccgaccagc

SEQ ID NO: 819639 - RNA, 14 nt, Mycobacterium avium subsp. paratuberculosis
cggcgacgaccguc

SEQ ID NO: 819640 - RNA, 14 nt, Mycobacterium avium subsp. paratuberculosis
cggcgaccugcggc

SEQ ID NO: 819641 - RNA, 14 nt, Mycobacterium avium subsp. paratuberculosis
cggcgaagcaggcc

SEQ ID NO: 819642 - RNA, 18 nt, Mycobacterium avium subsp. paratuberculosis
cggcgaccuugcggcgcg

SEQ ID NO: 819643 - RNA, 22 nt, Mycobacterium avium subsp. paratuberculosis
cggcgaccuugcggcgcgaugc

SEQ ID NO: 819644 - RNA, 17 nt, Mycobacterium avium subsp. paratuberculosis
cggcgacgaacgccggc

SEQ ID NO: 819645 - RNA, 20 nt, Mycobacterium avium subsp. paratuberculosis
cggcgacgaacgccggcauc

SEQ ID NO: 819646 - RNA, 23 nt, Mycobacterium avium subsp. paratuberculosis
cggcgacgaacgcuuccagcacc

SEQ ID NO: 819647 - RNA, 13 nt, Mycobacterium avium subsp. paratuberculosis
cggcgacgaagca

SEQ ID NO: 819648 - RNA, 15 nt, Mycobacterium avium subsp. paratuberculosis
cggcgacgaagcagc

SEQ ID NO: 819649 - RNA, 18 nt, Mycobacterium avium subsp. paratuberculosis
cggcgacgaagcagcucg

SEQ ID NO: 819650 - RNA, 13 nt, Mycobacterium avium subsp. paratuberculosis
cggcgaccgccgg

SEQ ID NO: 819651 - RNA, 17 nt, Mycobacterium avium subsp. paratuberculosis
cggcgaccgcgcgcggc

SEQ ID NO: 819652 - RNA, 19 nt, Mycobacterium avium subsp. paratuberculosis
cggcgaccgcgcgcggcgc

SEQ ID NO: 819653 - RNA, 13 nt, Mycobacterium avium subsp. paratuberculosis
cggcgaccgcgac

SEQ ID NO: 819654 - RNA, 14 nt, Mycobacterium avium subsp. paratuberculosis
cggcgaccgcgcgc

SEQ ID NO: 819655 - RNA, 17 nt, Mycobacterium avium subsp. paratuberculosis
cggcgaccgugcccacc

SEQ ID NO: 819656 - RNA, 18 nt, Mycobacterium avium subsp. paratuberculosis
cggcgaccgugcccacca

SEQ ID NO: 819657 - RNA, 19 nt, Mycobacterium avium subsp. paratuberculosis
cggcgaccgugcccaccag

SEQ ID NO: 819658 - RNA, 23 nt, Mycobacterium avium subsp. paratuberculosis
cggcgaccgugcccaccagccgg

SEQ ID NO: 819659 - RNA, 12 nt, Mycobacterium avium subsp. paratuberculosis
cggcgaccucgg

SEQ ID NO: 819660 - RNA, 18 nt, Mycobacterium avium subsp. paratuberculosis
cggcgaccugcggcucgu

SEQ ID NO: 819661 - RNA, 21 nt, Mycobacterium avium subsp. paratuberculosis
cggcgaccugcggcucgucgg

SEQ ID NO: 819662 - RNA, 18 nt, Mycobacterium avium subsp. paratuberculosis
cggcgauacccgggagca

SEQ ID NO: 819663 - RNA, 14 nt, Mycobacterium avium subsp. paratuberculosis
cggcgaguucggcg

SEQ ID NO: 819664 - RNA, 15 nt, Mycobacterium avium subsp. paratuberculosis
cggcgaguucggcgg

SEQ ID NO: 819665 - RNA, 16 nt, Mycobacterium avium subsp. paratuberculosis
cggcgaguucggcggc

SEQ ID NO: 819666 - RNA, 20 nt, Mycobacterium avium subsp. paratuberculosis
cggcgaguucggcggcccgc

SEQ ID NO: 819667 - RNA, 17 nt, Mycobacterium avium subsp. paratuberculosis
cggcgagcucgcggccg

SEQ ID NO: 819668 - RNA, 23 nt, Mycobacterium avium subsp. paratuberculosis
cggcgaguacccgccgcaccucg

SEQ ID NO: 819669 - RNA, 22 nt, Mycobacterium avium subsp. paratuberculosis
cggcgagucccggcgcaccagg

SEQ ID NO: 819670 - RNA, 16 nt, Mycobacterium avium subsp. paratuberculosis
cggcgaguccgcggag

SEQ ID NO: 819671 - RNA, 23 nt, Mycobacterium avium subsp. paratuberculosis
cggcgaguccggccaggucgccg

SEQ ID NO: 819672 - RNA, 16 nt, Mycobacterium avium subsp. paratuberculosis
cggcgagugaggccga

SEQ ID NO: 819673 - RNA, 17 nt, Mycobacterium avium subsp. paratuberculosis
cggcgagugaggccgag

SEQ ID NO: 819674 - RNA, 19 nt, Mycobacterium avium subsp. paratuberculosis
cggcgagugaggccgaggc

SEQ ID NO: 819675 - RNA, 14 nt, Mycobacterium avium subsp. paratuberculosis
cggcgagugcgaaa

SEQ ID NO: 819676 - RNA, 23 nt, Mycobacterium avium subsp. paratuberculosis
cggcgagugcgaaacucaccgcg

SEQ ID NO: 819677 - RNA, 20 nt, Mycobacterium avium subsp. paratuberculosis
cggcgagugcgaaucaucgu

SEQ ID NO: 819678 - RNA, 20 nt, Mycobacterium avium subsp. paratuberculosis
cggcgaguggaagucagcgc

SEQ ID NO: 819679 - RNA, 22 nt, Mycobacterium avium subsp. paratuberculosis
cggcgaguggaagucagcgcgu

SEQ ID NO: 819680 - RNA, 23 nt, Mycobacterium avium subsp. paratuberculosis
cggcgaguggaagucagcgcgug

SEQ ID NO: 819681 - RNA, 17 nt, Mycobacterium avium subsp. paratuberculosis
cggcgaguucgaccucc

SEQ ID NO: 819682 - RNA, 17 nt, Mycobacterium avium subsp. paratuberculosis
cggcgaguucgaugacg

SEQ ID NO: 819683 - RNA, 21 nt, Mycobacterium avium subsp. paratuberculosis
cggcgaguucgaugacgucgc

SEQ ID NO: 819684 - RNA, 18 nt, Mycobacterium avium subsp. paratuberculosis
cggcgaggcggucggcgg

SEQ ID NO: 819685 - RNA, 20 nt, Mycobacterium avium subsp. paratuberculosis
cggcgagguagaccgccgag

SEQ ID NO: 819686 - RNA, 22 nt, Mycobacterium avium subsp. paratuberculosis
cggcgagguagaccgccgaguc

SEQ ID NO: 819687 - RNA, 14 nt, Mycobacterium avium subsp. paratuberculosis
cggcgaggucgucg

SEQ ID NO: 819688 - RNA, 17 nt, Mycobacterium avium subsp. paratuberculosis
cggcgaggucgucgagg

SEQ ID NO: 819689 - RNA, 20 nt, Mycobacterium avium subsp. paratuberculosis
cggcgagcuuggcgggcguc

SEQ ID NO: 819690 - RNA, 20 nt, Mycobacterium avium subsp. paratuberculosis
cggcgagcuuguccugcacc

SEQ ID NO: 819691 - RNA, 23 nt, Mycobacterium avium subsp. paratuberculosis
cggcgagcuuguccugcaccgac

SEQ ID NO: 819692 - RNA, 15 nt, Mycobacterium avium subsp. paratuberculosis
cggcgaggauggcga

SEQ ID NO: 819693 - RNA, 20 nt, Mycobacterium avium subsp. paratuberculosis
cggcgaggauggcgaucauc

SEQ ID NO: 819694 - RNA, 16 nt, Mycobacterium avium subsp. paratuberculosis
cggcgaggccaggcgu

SEQ ID NO: 819695 - RNA, 23 nt, Mycobacterium avium subsp. paratuberculosis
cggcgaggccaggcguuucgugu

SEQ ID NO: 819696 - RNA, 18 nt, Mycobacterium avium subsp. paratuberculosis
cggcgagcugaucggcgu

SEQ ID NO: 819697 - RNA, 14 nt, Mycobacterium avium subsp. paratuberculosis
cggcgagcugcggg

SEQ ID NO: 819698 - RNA, 15 nt, Mycobacterium avium subsp. paratuberculosis
cggcgagcugcgggu

SEQ ID NO: 819699 - RNA, 16 nt, Mycobacterium avium subsp. paratuberculosis
cggcgagcugcgggug

SEQ ID NO: 819700 - RNA, 17 nt, Mycobacterium avium subsp. paratuberculosis
cggcgaggacgucgucg

SEQ ID NO: 819701 - RNA, 18 nt, Mycobacterium avium subsp. paratuberculosis
cggcgaggacgucgucga

SEQ ID NO: 819702 - RNA, 20 nt, Mycobacterium avium subsp. paratuberculosis
cggcgaggacgucgucgacg

SEQ ID NO: 819703 - RNA, 22 nt, Mycobacterium avium subsp. paratuberculosis
cggcgaggacgucgucgacguc

SEQ ID NO: 819704 - RNA, 19 nt, Mycobacterium avium subsp. paratuberculosis
cggcgagcgcguucuccac

SEQ ID NO: 819705 - RNA, 13 nt, Mycobacterium avium subsp. paratuberculosis
cggcgagcggcac

SEQ ID NO: 819706 - RNA, 14 nt, Mycobacterium avium subsp. paratuberculosis
cggcgagcggcacc

SEQ ID NO: 819707 - RNA, 15 nt, Mycobacterium avium subsp. paratuberculosis
cggcgagcggcaccu

SEQ ID NO: 819708 - RNA, 13 nt, Mycobacterium avium subsp. paratuberculosis
cggcgagcggccc

SEQ ID NO: 819709 - RNA, 16 nt, Mycobacterium avium subsp. paratuberculosis
cggcgagcggcccugc

SEQ ID NO: 819710 - RNA, 21 nt, Mycobacterium avium subsp. paratuberculosis
cggcgagcggcccugcgcggc

SEQ ID NO: 819711 - RNA, 20 nt, Mycobacterium avium subsp. paratuberculosis
cggcgagcgcgcugaucgcc

SEQ ID NO: 819712 - RNA, 22 nt, Mycobacterium avium subsp. paratuberculosis
cggcgagcgcgcugaucgccgc

SEQ ID NO: 819713 - RNA, 14 nt, Mycobacterium avium subsp. paratuberculosis
cggcgagcgacgcc

SEQ ID NO: 819714 - RNA, 16 nt, Mycobacterium avium subsp. paratuberculosis
cggcgagccgggccgg

SEQ ID NO: 819715 - RNA, 20 nt, Mycobacterium avium subsp. paratuberculosis
cggcgauguaggacgccgca

SEQ ID NO: 819716 - RNA, 22 nt, Mycobacterium avium subsp. paratuberculosis
cggcgauguaggacgccgcacc

SEQ ID NO: 819717 - RNA, 23 nt, Mycobacterium avium subsp. paratuberculosis
cggcgauguaggacgccgcaccg

SEQ ID NO: 819718 - RNA, 20 nt, Mycobacterium avium subsp. paratuberculosis
cggcgauguccuugucgcuc

SEQ ID NO: 819719 - RNA, 15 nt, Mycobacterium avium subsp. paratuberculosis
cggcgaugucgaagc

SEQ ID NO: 819720 - RNA, 16 nt, Mycobacterium avium subsp. paratuberculosis
cggcgaugucgaagcc

SEQ ID NO: 819721 - RNA, 15 nt, Mycobacterium avium subsp. paratuberculosis
cggcgauggugaacu

SEQ ID NO: 819722 - RNA, 16 nt, Mycobacterium avium subsp. paratuberculosis
cggcgauggugaacuc

SEQ ID NO: 819723 - RNA, 16 nt, Mycobacterium avium subsp. paratuberculosis
cggcgaugguggcgcu

SEQ ID NO: 819724 - RNA, 17 nt, Mycobacterium avium subsp. paratuberculosis
cggcgaugguggcgcug

SEQ ID NO: 819725 - RNA, 18 nt, Mycobacterium avium subsp. paratuberculosis
cggcgaugguggcgcugc

SEQ ID NO: 819726 - RNA, 21 nt, Mycobacterium avium subsp. paratuberculosis
cggcgauggugggcagccggc

SEQ ID NO: 819727 - RNA, 14 nt, Mycobacterium avium subsp. paratuberculosis
cggcgaugcgcgcc

SEQ ID NO: 819728 - RNA, 17 nt, Mycobacterium avium subsp. paratuberculosis
cggcgaugcgccgucuc

SEQ ID NO: 819729 - RNA, 21 nt, Mycobacterium avium subsp. paratuberculosis
cggcgaugccguugaucaccg

SEQ ID NO: 819730 - RNA, 20 nt, Mycobacterium avium subsp. paratuberculosis
cggcgaugccuuccucggcg

SEQ ID NO: 819731 - RNA, 16 nt, Mycobacterium avium subsp. paratuberculosis
cggcgaugcgcaccau

SEQ ID NO: 819732 - RNA, 20 nt, Mycobacterium avium subsp. paratuberculosis
cggcgaugcgcaccaucacc

SEQ ID NO: 819733 - RNA, 22 nt, Mycobacterium avium subsp. paratuberculosis
cggcgaugcgcaccaucaccug

SEQ ID NO: 819734 - RNA, 20 nt, Mycobacterium avium subsp. paratuberculosis
cggcgaugcgcacgucggcc

SEQ ID NO: 819735 - RNA, 21 nt, Mycobacterium avium subsp. paratuberculosis
cggcgaugcgcacgucggccg

SEQ ID NO: 819736 - RNA, 18 nt, Mycobacterium avium subsp. paratuberculosis
cggcgaugccagcgcacc

SEQ ID NO: 819737 - RNA, 20 nt, Mycobacterium avium subsp. paratuberculosis
cggcgaugccagcgcaccgg

SEQ ID NO: 819738 - RNA, 17 nt, Mycobacterium avium subsp. paratuberculosis
cggcgaugcccacagcc

SEQ ID NO: 819739 - RNA, 20 nt, Mycobacterium avium subsp. paratuberculosis
cggcgaugcccacagccagg

SEQ ID NO: 819740 - RNA, 14 nt, Mycobacterium avium subsp. paratuberculosis
cggcgaugcccgug

SEQ ID NO: 819741 - RNA, 22 nt, Mycobacterium avium subsp. paratuberculosis
cggcgaugcccgugaucgccac

SEQ ID NO: 819742 - RNA, 15 nt, Mycobacterium avium subsp. paratuberculosis
cggcgaugccgagcc

SEQ ID NO: 819743 - RNA, 15 nt, Mycobacterium avium subsp. paratuberculosis
cggcgaugcagauca

SEQ ID NO: 819744 - RNA, 18 nt, Mycobacterium avium subsp. paratuberculosis
cggcgaugcagaucacca

SEQ ID NO: 819745 - RNA, 21 nt, Mycobacterium avium subsp. paratuberculosis
cggcgaugcagaucaccacgg

SEQ ID NO: 819746 - RNA, 22 nt, Mycobacterium avium subsp. paratuberculosis
cggcgaugaucaggccggaccg

SEQ ID NO: 819747 - RNA, 17 nt, Mycobacterium avium subsp. paratuberculosis
cggcgaugauccgcggc

SEQ ID NO: 819748 - RNA, 22 nt, Mycobacterium avium subsp. paratuberculosis
cggcgaugauccgcggcgccgg

SEQ ID NO: 819749 - RNA, 16 nt, Mycobacterium avium subsp. paratuberculosis
cggcgaucggccgcug

SEQ ID NO: 819750 - RNA, 20 nt, Mycobacterium avium subsp. paratuberculosis
cggcgaucggccgcugcggg

SEQ ID NO: 819751 - RNA, 15 nt, Mycobacterium avium subsp. paratuberculosis
cggcgaucggcgcgg

SEQ ID NO: 819752 - RNA, 17 nt, Mycobacterium avium subsp. paratuberculosis
cggcgaucggcgcggcg

SEQ ID NO: 819753 - RNA, 15 nt, Mycobacterium avium subsp. paratuberculosis
cggcgaucggcgguc

SEQ ID NO: 819754 - RNA, 17 nt, Mycobacterium avium subsp. paratuberculosis
cggcgaucggcgguccg

SEQ ID NO: 819755 - RNA, 15 nt, Mycobacterium avium subsp. paratuberculosis
cggcgaucggcgugc

SEQ ID NO: 819756 - RNA, 18 nt, Mycobacterium avium subsp. paratuberculosis
cggcgaucggcgugccgg

SEQ ID NO: 819757 - RNA, 19 nt, Mycobacterium avium subsp. paratuberculosis
cggcgaucgggucaccggc

SEQ ID NO: 819758 - RNA, 22 nt, Mycobacterium avium subsp. paratuberculosis
cggcgaucgggucaccggccga

SEQ ID NO: 819759 - RNA, 13 nt, Mycobacterium avium subsp. paratuberculosis
cggcgaucgucgc

SEQ ID NO: 819760 - RNA, 16 nt, Mycobacterium avium subsp. paratuberculosis
cggcgaucgucgccgu

SEQ ID NO: 819761 - RNA, 18 nt, Mycobacterium avium subsp. paratuberculosis
cggcgaucgucgccguca

SEQ ID NO: 819762 - RNA, 15 nt, Mycobacterium avium subsp. paratuberculosis
cggcgaucgcgagca

SEQ ID NO: 819763 - RNA, 14 nt, Mycobacterium avium subsp. paratuberculosis
cggcgaucgcgcgc

SEQ ID NO: 819764 - RNA, 17 nt, Mycobacterium avium subsp. paratuberculosis
cggcgaucgccggggau

SEQ ID NO: 819765 - RNA, 16 nt, Mycobacterium avium subsp. paratuberculosis
cggcgaucgccguggu

SEQ ID NO: 819766 - RNA, 13 nt, Mycobacterium avium subsp. paratuberculosis
cggcgaucgccgg

SEQ ID NO: 819767 - RNA, 17 nt, Mycobacterium avium subsp. paratuberculosis
cggcgauaggcggccag

SEQ ID NO: 819768 - RNA, 18 nt, Mycobacterium avium subsp. paratuberculosis
cggcgauaggcggccagc

SEQ ID NO: 819769 - RNA, 21 nt, Mycobacterium avium subsp. paratuberculosis
cggcgauaggcggccagcucc

SEQ ID NO: 819770 - RNA, 15 nt, Mycobacterium avium subsp. paratuberculosis
cggcgaucaccgccg

SEQ ID NO: 819771 - RNA, 20 nt, Mycobacterium avium subsp. paratuberculosis
cggcgaucaccgccgcggcg

SEQ ID NO: 819772 - RNA, 22 nt, Mycobacterium avium subsp. paratuberculosis
cggcgaucaccgccgcggcgac

SEQ ID NO: 819773 - RNA, 23 nt, Mycobacterium avium subsp. paratuberculosis
cggcgaucaccgccgcggcgacc

SEQ ID NO: 819774 - RNA, 13 nt, Mycobacterium avium subsp. paratuberculosis
cggcgaucaccgg

SEQ ID NO: 819775 - RNA, 14 nt, Mycobacterium avium subsp. paratuberculosis
cggcgaucgacguc

SEQ ID NO: 819776 - RNA, 22 nt, Mycobacterium avium subsp. paratuberculosis
cggcgaucgacgucaccaccgg

SEQ ID NO: 819777 - RNA, 14 nt, Mycobacterium avium subsp. paratuberculosis
cggcgaucgagggg

SEQ ID NO: 819778 - RNA, 14 nt, Mycobacterium avium subsp. paratuberculosis
cggcgaucgccagc

SEQ ID NO: 819779 - RNA, 15 nt, Mycobacterium avium subsp. paratuberculosis
cggcgaucgccagca

SEQ ID NO: 819780 - RNA, 16 nt, Mycobacterium avium subsp. paratuberculosis
cggcgaucgccagcac

SEQ ID NO: 819781 - RNA, 17 nt, Mycobacterium avium subsp. paratuberculosis
cggcgaucgccagcacg

SEQ ID NO: 819782 - RNA, 18 nt, Mycobacterium avium subsp. paratuberculosis
cggcgaucgccagcacgg

SEQ ID NO: 819783 - RNA, 17 nt, Mycobacterium avium subsp. paratuberculosis
cggcgcagaugaccggc

SEQ ID NO: 819784 - RNA, 22 nt, Mycobacterium avium subsp. paratuberculosis
cggcgcacgcuuuuucgcgaac

SEQ ID NO: 819785 - RNA, 15 nt, Mycobacterium avium subsp. paratuberculosis
cggcgcacggugccc

SEQ ID NO: 819786 - RNA, 12 nt, Mycobacterium avium subsp. paratuberculosis
cggcgcacgugg

SEQ ID NO: 819787 - RNA, 23 nt, Mycobacterium avium subsp. paratuberculosis
cggcgcacguggcugaccgacgg

SEQ ID NO: 819788 - RNA, 22 nt, Mycobacterium avium subsp. paratuberculosis
cggcgcacuccaucacgaccuc

SEQ ID NO: 819789 - RNA, 22 nt, Mycobacterium avium subsp. paratuberculosis
cggcgcagaaaccauuccgcca

SEQ ID NO: 819790 - RNA, 15 nt, Mycobacterium avium subsp. paratuberculosis
cggcgcaggccgguc

SEQ ID NO: 819791 - RNA, 16 nt, Mycobacterium avium subsp. paratuberculosis
cggcgcaggccgguca

SEQ ID NO: 819792 - RNA, 19 nt, Mycobacterium avium subsp. paratuberculosis
cggcgcaggcauuuccagg

SEQ ID NO: 819793 - RNA, 13 nt, Mycobacterium avium subsp. paratuberculosis
cggcgcagcucgc

SEQ ID NO: 819794 - RNA, 15 nt, Mycobacterium avium subsp. paratuberculosis
cggcgcagcucgcgc

SEQ ID NO: 819795 - RNA, 21 nt, Mycobacterium avium subsp. paratuberculosis
cggcgcagcucgcgcagcugg

SEQ ID NO: 819796 - RNA, 20 nt, Mycobacterium avium subsp. paratuberculosis
cggcgcaguucgaccggcac

SEQ ID NO: 819797 - RNA, 16 nt, Mycobacterium avium subsp. paratuberculosis
cggcgcagggcggccg

SEQ ID NO: 819798 - RNA, 18 nt, Mycobacterium avium subsp. paratuberculosis
cggcgcagguccggcagc

SEQ ID NO: 819799 - RNA, 16 nt, Mycobacterium avium subsp. paratuberculosis
cggcgcaggcgcgcac

SEQ ID NO: 819800 - RNA, 18 nt, Mycobacterium avium subsp. paratuberculosis
cggcgcaggcgcgcacca

SEQ ID NO: 819801 - RNA, 20 nt, Mycobacterium avium subsp. paratuberculosis
cggcgcaggcgcgcaccauc

SEQ ID NO: 819802 - RNA, 16 nt, Mycobacterium avium subsp. paratuberculosis
cggcgcacgcagugcc

SEQ ID NO: 819803 - RNA, 18 nt, Mycobacterium avium subsp. paratuberculosis
cggcgcacgcagugccgc

SEQ ID NO: 819804 - RNA, 17 nt, Mycobacterium avium subsp. paratuberculosis
cggcgcacccgggcagc

SEQ ID NO: 819805 - RNA, 13 nt, Mycobacterium avium subsp. paratuberculosis
cggcgcaccgccc

SEQ ID NO: 819806 - RNA, 15 nt, Mycobacterium avium subsp. paratuberculosis
cggcgcaccgcccgc

SEQ ID NO: 819807 - RNA, 16 nt, Mycobacterium avium subsp. paratuberculosis
cggcgcaccgcccgcg

SEQ ID NO: 819808 - RNA, 19 nt, Mycobacterium avium subsp. paratuberculosis
cggcgcaccgcccgcggug

SEQ ID NO: 819809 - RNA, 13 nt, Mycobacterium avium subsp. paratuberculosis
cggcgcaccgcgu

SEQ ID NO: 819810 - RNA, 19 nt, Mycobacterium avium subsp. paratuberculosis
cggcgcaccgcgucgacca

SEQ ID NO: 819811 - RNA, 18 nt, Mycobacterium avium subsp. paratuberculosis
cggcgcaccgcgucgaug

SEQ ID NO: 819812 - RNA, 13 nt, Mycobacterium avium subsp. paratuberculosis
cggcgcaccgugu

SEQ ID NO: 819813 - RNA, 15 nt, Mycobacterium avium subsp. paratuberculosis
cggcgcaccgugucg

SEQ ID NO: 819814 - RNA, 13 nt, Mycobacterium avium subsp. paratuberculosis
cggcgcaccuggc

SEQ ID NO: 819815 - RNA, 19 nt, Mycobacterium avium subsp. paratuberculosis
cggcgcaccuggcgcagca

SEQ ID NO: 819816 - RNA, 13 nt, Mycobacterium avium subsp. paratuberculosis
cggcgcaccccga

SEQ ID NO: 819817 - RNA, 12 nt, Mycobacterium avium subsp. paratuberculosis
cggcgcacccgc

SEQ ID NO: 819818 - RNA, 23 nt, Mycobacterium avium subsp. paratuberculosis
cggcgaugucgaagcccuucacc

SEQ ID NO: 819819 - RNA, 14 nt, Mycobacterium avium subsp. paratuberculosis
cggcgaugucgucg

SEQ ID NO: 819820 - RNA, 16 nt, Mycobacterium avium subsp. paratuberculosis
cggcgaugucgucgac

SEQ ID NO: 819821 - RNA, 20 nt, Mycobacterium avium subsp. paratuberculosis
cggcgauguugaccacccgc

SEQ ID NO: 819822 - RNA, 22 nt, Mycobacterium avium subsp. paratuberculosis
cggcgauguugaccacccgcag

SEQ ID NO: 819823 - RNA, 16 nt, Mycobacterium avium subsp. paratuberculosis
cggcgauguggcguuc

SEQ ID NO: 819824 - RNA, 23 nt, Mycobacterium avium subsp. paratuberculosis
cggcgauguggcguucgaugccc

SEQ ID NO: 819825 - RNA, 19 nt, Mycobacterium avium subsp. paratuberculosis
cggccguugcgggugucgc

SEQ ID NO: 819826 - RNA, 15 nt, Mycobacterium avium subsp. paratuberculosis
cggccuaggacgccg

SEQ ID NO: 819827 - RNA, 17 nt, Mycobacterium avium subsp. paratuberculosis
cggccguugggccagcg

SEQ ID NO: 819828 - RNA, 18 nt, Mycobacterium avium subsp. paratuberculosis
cggccguugggccagcgg

SEQ ID NO: 819829 - RNA, 20 nt, Mycobacterium avium subsp. paratuberculosis
cggccguugggccagcggcg

SEQ ID NO: 819830 - RNA, 21 nt, Mycobacterium avium subsp. paratuberculosis
cggccguugggccagcggcgc

SEQ ID NO: 819831 - RNA, 22 nt, Mycobacterium avium subsp. paratuberculosis
cggccguugggccagcggcgcc

SEQ ID NO: 819832 - RNA, 23 nt, Mycobacterium avium subsp. paratuberculosis
cggccguugggccagcggcgccg

SEQ ID NO: 819833 - RNA, 22 nt, Mycobacterium avium subsp. paratuberculosis
cggccuaacgaguaggcggcuc

SEQ ID NO: 819834 - RNA, 19 nt, Mycobacterium avium subsp. paratuberculosis
cggccguguacagcagggu

SEQ ID NO: 819835 - RNA, 13 nt, Mycobacterium avium subsp. paratuberculosis
cggccuccagcug

SEQ ID NO: 819836 - RNA, 19 nt, Mycobacterium avium subsp. paratuberculosis
cggccuccagcuguugacg

SEQ ID NO: 819837 - RNA, 17 nt, Mycobacterium avium subsp. paratuberculosis
cggccucccacucgucg

SEQ ID NO: 819838 - RNA, 18 nt, Mycobacterium avium subsp. paratuberculosis
cggccucccacucgucga

SEQ ID NO: 819839 - RNA, 13 nt, Mycobacterium avium subsp. paratuberculosis
cggccuccagccg

SEQ ID NO: 819840 - RNA, 22 nt, Mycobacterium avium subsp. paratuberculosis
cggccuccagccgcgcggccgc

SEQ ID NO: 819841 - RNA, 16 nt, Mycobacterium avium subsp. paratuberculosis
cggccuccagccggcg

SEQ ID NO: 819842 - RNA, 18 nt, Mycobacterium avium subsp. paratuberculosis
cggccuccagccggcgga

SEQ ID NO: 819843 - RNA, 21 nt, Mycobacterium avium subsp. paratuberculosis
cggccucaggcgucggucagc

SEQ ID NO: 819844 - RNA, 23 nt, Mycobacterium avium subsp. paratuberculosis
cggccucaggcgucggucagcag

SEQ ID NO: 819845 - RNA, 21 nt, Mycobacterium avium subsp. paratuberculosis
cggccucaguccgacgcgacg

SEQ ID NO: 819846 - RNA, 15 nt, Mycobacterium avium subsp. paratuberculosis
cggccuaugcgcccg

SEQ ID NO: 819847 - RNA, 20 nt, Mycobacterium avium subsp. paratuberculosis
cggccuaugcgcccgggaag

SEQ ID NO: 819848 - RNA, 14 nt, Mycobacterium avium subsp. paratuberculosis
cggccucaccgcgg

SEQ ID NO: 819849 - RNA, 16 nt, Mycobacterium avium subsp. paratuberculosis
cggccucaccgcgggc

SEQ ID NO: 819850 - RNA, 13 nt, Mycobacterium avium subsp. paratuberculosis
cggccguucgccg

SEQ ID NO: 819851 - RNA, 15 nt, Mycobacterium avium subsp. paratuberculosis
cggccguucgccggc

SEQ ID NO: 819852 - RNA, 17 nt, Mycobacterium avium subsp. paratuberculosis
cggccguucgccggcca

SEQ ID NO: 819853 - RNA, 19 nt, Mycobacterium avium subsp. paratuberculosis
cggccguucgccggccagc

SEQ ID NO: 819854 - RNA, 20 nt, Mycobacterium avium subsp. paratuberculosis
cggccgggaaacccucgacg

SEQ ID NO: 819855 - RNA, 13 nt, Mycobacterium avium subsp. paratuberculosis
cggccguggucga

SEQ ID NO: 819856 - RNA, 15 nt, Mycobacterium avium subsp. paratuberculosis
cggccguggucgaug

SEQ ID NO: 819857 - RNA, 15 nt, Mycobacterium avium subsp. paratuberculosis
cggccguggccguca

SEQ ID NO: 819858 - RNA, 17 nt, Mycobacterium avium subsp. paratuberculosis
cggccguggccgucacg

SEQ ID NO: 819859 - RNA, 19 nt, Mycobacterium avium subsp. paratuberculosis
cggccguggccgucacgcu

SEQ ID NO: 819860 - RNA, 21 nt, Mycobacterium avium subsp. paratuberculosis
cggccguggccgucacgcugg

SEQ ID NO: 819861 - RNA, 15 nt, Mycobacterium avium subsp. paratuberculosis
cggccgugcgcgucg

SEQ ID NO: 819862 - RNA, 16 nt, Mycobacterium avium subsp. paratuberculosis
cggccgugcgcgucga

SEQ ID NO: 819863 - RNA, 15 nt, Mycobacterium avium subsp. paratuberculosis
cggccguggacccgc

SEQ ID NO: 819864 - RNA, 20 nt, Mycobacterium avium subsp. paratuberculosis
cggccguggacccgccccga

SEQ ID NO: 819865 - RNA, 13 nt, Mycobacterium avium subsp. paratuberculosis
cggccgugccgug

SEQ ID NO: 819866 - RNA, 16 nt, Mycobacterium avium subsp. paratuberculosis
cggccgugccgugguc

SEQ ID NO: 819867 - RNA, 23 nt, Mycobacterium avium subsp. paratuberculosis
cggccgugccguggucggugccc

SEQ ID NO: 819868 - RNA, 19 nt, Mycobacterium avium subsp. paratuberculosis
cggccggcugcagccgggc

SEQ ID NO: 819869 - RNA, 20 nt, Mycobacterium avium subsp. paratuberculosis
cggccggcugcagccgggcg

SEQ ID NO: 819870 - RNA, 13 nt, Mycobacterium avium subsp. paratuberculosis
cggccggcguugu

SEQ ID NO: 819871 - RNA, 23 nt, Mycobacterium avium subsp. paratuberculosis
cggccgcuugccaugucgaaggu

SEQ ID NO: 819872 - RNA, 13 nt, Mycobacterium avium subsp. paratuberculosis
cggccggcggcgg

SEQ ID NO: 819873 - RNA, 13 nt, Mycobacterium avium subsp. paratuberculosis
cggccggcggcgu

SEQ ID NO: 819874 - RNA, 14 nt, Mycobacterium avium subsp. paratuberculosis
cggccggcggcguc

SEQ ID NO: 819875 - RNA, 15 nt, Mycobacterium avium subsp. paratuberculosis
cggccggcggcgucg

SEQ ID NO: 819876 - RNA, 11 nt, Mycobacterium avium subsp. paratuberculosis
cggccggcggg

SEQ ID NO: 819877 - RNA, 13 nt, Mycobacterium avium subsp. paratuberculosis
cggccggcgggca

SEQ ID NO: 819878 - RNA, 15 nt, Mycobacterium avium subsp. paratuberculosis
cggccggcgggcagc

SEQ ID NO: 819879 - RNA, 22 nt, Mycobacterium avium subsp. paratuberculosis
cggccggcggggcgggggcguu

SEQ ID NO: 819880 - RNA, 23 nt, Mycobacterium avium subsp. paratuberculosis
cggccggcggggcgggggcguug

SEQ ID NO: 819881 - RNA, 12 nt, Mycobacterium avium subsp. paratuberculosis
cggccggcgggu

SEQ ID NO: 819882 - RNA, 13 nt, Mycobacterium avium subsp. paratuberculosis
cggccggcggguu

SEQ ID NO: 819883 - RNA, 16 nt, Mycobacterium avium subsp. paratuberculosis
cggccggcggguucug

SEQ ID NO: 819884 - RNA, 12 nt, Mycobacterium avium subsp. paratuberculosis
cggccggcgguc

SEQ ID NO: 819885 - RNA, 13 nt, Mycobacterium avium subsp. paratuberculosis
cggccggcgguca

SEQ ID NO: 819886 - RNA, 15 nt, Mycobacterium avium subsp. paratuberculosis
cggccggcgcgugcg

SEQ ID NO: 819887 - RNA, 11 nt, Mycobacterium avium subsp. paratuberculosis
cggccggcgga

SEQ ID NO: 819888 - RNA, 22 nt, Mycobacterium avium subsp. paratuberculosis
cggccggcggcagugcgccguc

SEQ ID NO: 819889 - RNA, 23 nt, Mycobacterium avium subsp. paratuberculosis
cggccggcggcagugcgccgucc

SEQ ID NO: 819890 - RNA, 14 nt, Mycobacterium avium subsp. paratuberculosis
cggccggcgccggc

SEQ ID NO: 819891 - RNA, 19 nt, Mycobacterium avium subsp. paratuberculosis
cggccggcgccggcgguca

SEQ ID NO: 819892 - RNA, 20 nt, Mycobacterium avium subsp. paratuberculosis
cggccggcgcgaccagcggc

SEQ ID NO: 819893 - RNA, 13 nt, Mycobacterium avium subsp. paratuberculosis
cggccggcgcggc

SEQ ID NO: 819894 - RNA, 15 nt, Mycobacterium avium subsp. paratuberculosis
cggccggcgcggcgg

SEQ ID NO: 819895 - RNA, 23 nt, Mycobacterium avium subsp. paratuberculosis
cggccggcgcggcggcgacgucg

SEQ ID NO: 819896 - RNA, 14 nt, Mycobacterium avium subsp. paratuberculosis
cggccugccggaug

SEQ ID NO: 819897 - RNA, 16 nt, Mycobacterium avium subsp. paratuberculosis
cggccugccggaugcc

SEQ ID NO: 819898 - RNA, 15 nt, Mycobacterium avium subsp. paratuberculosis
cggccugccggccgc

SEQ ID NO: 819899 - RNA, 17 nt, Mycobacterium avium subsp. paratuberculosis
cggccugccggccgccg

SEQ ID NO: 819900 - RNA, 18 nt, Mycobacterium avium subsp. paratuberculosis
cggccugccggccgccgc

SEQ ID NO: 819901 - RNA, 15 nt, Mycobacterium avium subsp. paratuberculosis
cggccugcccgccgc

SEQ ID NO: 819902 - RNA, 16 nt, Mycobacterium avium subsp. paratuberculosis
cggccugcccgccgcg

SEQ ID NO: 819903 - RNA, 17 nt, Mycobacterium avium subsp. paratuberculosis
cggccugcccgccgcgg

SEQ ID NO: 819904 - RNA, 18 nt, Mycobacterium avium subsp. paratuberculosis
cggccugcccgccgcggc

SEQ ID NO: 819905 - RNA, 20 nt, Mycobacterium avium subsp. paratuberculosis
cggccugcccgccgcggccg

SEQ ID NO: 819906 - RNA, 21 nt, Mycobacterium avium subsp. paratuberculosis
cggccugcccgccgcggccgc

SEQ ID NO: 819907 - RNA, 15 nt, Mycobacterium avium subsp. paratuberculosis
cggccugcccgcggg

SEQ ID NO: 819908 - RNA, 13 nt, Mycobacterium avium subsp. paratuberculosis
cggccugccaccg

SEQ ID NO: 819909 - RNA, 16 nt, Mycobacterium avium subsp. paratuberculosis
cggccugccaccgcga

SEQ ID NO: 819910 - RNA, 18 nt, Mycobacterium avium subsp. paratuberculosis
cggccugccaccgcgaau

SEQ ID NO: 819911 - RNA, 15 nt, Mycobacterium avium subsp. paratuberculosis
cggccugcagcaccg

SEQ ID NO: 819912 - RNA, 15 nt, Mycobacterium avium subsp. paratuberculosis
cggccugcagcgcgg

SEQ ID NO: 819913 - RNA, 14 nt, Mycobacterium avium subsp. paratuberculosis
cggccugcagcucg

SEQ ID NO: 819914 - RNA, 13 nt, Mycobacterium avium subsp. paratuberculosis
cggccugcaccac

SEQ ID NO: 819915 - RNA, 23 nt, Mycobacterium avium subsp. paratuberculosis
cggccugcaccaccacacccagc

SEQ ID NO: 819916 - RNA, 13 nt, Mycobacterium avium subsp. paratuberculosis
cggccugcaccca

SEQ ID NO: 819917 - RNA, 14 nt, Mycobacterium avium subsp. paratuberculosis
cggccugcacccag

SEQ ID NO: 819918 - RNA, 18 nt, Mycobacterium avium subsp. paratuberculosis
cggccugcacccagguca

SEQ ID NO: 819919 - RNA, 14 nt, Mycobacterium avium subsp. paratuberculosis
cggccugcacgucc

SEQ ID NO: 819920 - RNA, 17 nt, Mycobacterium avium subsp. paratuberculosis
cggccugcacgucggcg

SEQ ID NO: 819921 - RNA, 22 nt, Mycobacterium avium subsp. paratuberculosis
cggccugacugagucaagccgg

SEQ ID NO: 819922 - RNA, 16 nt, Mycobacterium avium subsp. paratuberculosis
cggccugagacgacgc

SEQ ID NO: 819923 - RNA, 15 nt, Mycobacterium avium subsp. paratuberculosis
cggccugagccgccg

SEQ ID NO: 819924 - RNA, 16 nt, Mycobacterium avium subsp. paratuberculosis
cggccugagccgccgg

SEQ ID NO: 819925 - RNA, 21 nt, Mycobacterium avium subsp. paratuberculosis
cggccugagccgccggggcgc

SEQ ID NO: 819926 - RNA, 16 nt, Mycobacterium avium subsp. paratuberculosis
cggccucucgucgacg

SEQ ID NO: 819927 - RNA, 19 nt, Mycobacterium avium subsp. paratuberculosis
cggccucucgucgacgaug

SEQ ID NO: 819928 - RNA, 17 nt, Mycobacterium avium subsp. paratuberculosis
cggccucgccggcgccg

SEQ ID NO: 819929 - RNA, 20 nt, Mycobacterium avium subsp. paratuberculosis
cggccucgaugucgucgaug

SEQ ID NO: 819930 - RNA, 14 nt, Mycobacterium avium subsp. paratuberculosis
cggccucgccgucg

SEQ ID NO: 819931 - RNA, 15 nt, Mycobacterium avium subsp. paratuberculosis
cggccucgccgucga

SEQ ID NO: 819932 - RNA, 17 nt, Mycobacterium avium subsp. paratuberculosis
cggccucgccgucgaag

SEQ ID NO: 819933 - RNA, 21 nt, Mycobacterium avium subsp. paratuberculosis
cggccucgccgucgaaggccg

SEQ ID NO: 819934 - RNA, 23 nt, Mycobacterium avium subsp. paratuberculosis
cggccucguggaaaucgagcgcg

SEQ ID NO: 819935 - RNA, 23 nt, Mycobacterium avium subsp. paratuberculosis
cggccucguugaccgggucgccg

SEQ ID NO: 819936 - RNA, 17 nt, Mycobacterium avium subsp. paratuberculosis
cggccucgcccagcgcc

SEQ ID NO: 819937 - RNA, 18 nt, Mycobacterium avium subsp. paratuberculosis
cggccucgcccagcgccg

SEQ ID NO: 819938 - RNA, 20 nt, Mycobacterium avium subsp. paratuberculosis
cggccucgcccagcgccgcg

SEQ ID NO: 819939 - RNA, 13 nt, Mycobacterium avium subsp. paratuberculosis
cggccucgauguc

SEQ ID NO: 819940 - RNA, 12 nt, Mycobacterium avium subsp. paratuberculosis
cggccucgauca

SEQ ID NO: 819941 - RNA, 15 nt, Mycobacterium avium subsp. paratuberculosis
cggccucgaucauca

SEQ ID NO: 819942 - RNA, 21 nt, Mycobacterium avium subsp. paratuberculosis
cggccucgaucaucaccaccg

SEQ ID NO: 819943 - RNA, 23 nt, Mycobacterium avium subsp. paratuberculosis
cggccucgaucaucaccaccgcc

SEQ ID NO: 819944 - RNA, 21 nt, Mycobacterium avium subsp. paratuberculosis
cggccuccgccaccuccuccg

SEQ ID NO: 819945 - RNA, 19 nt, Mycobacterium avium subsp. paratuberculosis
cggccuccuccucgcugcc

SEQ ID NO: 819946 - RNA, 22 nt, Mycobacterium avium subsp. paratuberculosis
cggccuccuccucgcugccggc

SEQ ID NO: 819947 - RNA, 17 nt, Mycobacterium avium subsp. paratuberculosis
cggcgaagccggccccg

SEQ ID NO: 819948 - RNA, 18 nt, Mycobacterium avium subsp. paratuberculosis
cggcgaagccggccccgc

SEQ ID NO: 819949 - RNA, 21 nt, Mycobacterium avium subsp. paratuberculosis
cggcgaagccggccccgcccg

SEQ ID NO: 819950 - RNA, 22 nt, Mycobacterium avium subsp. paratuberculosis
cggcgaagccggccccgcccgg

SEQ ID NO: 819951 - RNA, 15 nt, Mycobacterium avium subsp. paratuberculosis
cggcgaagccggcgu

SEQ ID NO: 819952 - RNA, 15 nt, Mycobacterium avium subsp. paratuberculosis
cggcgaacgcgcggu

SEQ ID NO: 819953 - RNA, 17 nt, Mycobacterium avium subsp. paratuberculosis
cggcgaacgcgcggucg

SEQ ID NO: 819954 - RNA, 18 nt, Mycobacterium avium subsp. paratuberculosis
cggcgaacgcgcggucgu

SEQ ID NO: 819955 - RNA, 19 nt, Mycobacterium avium subsp. paratuberculosis
cggcgaacgcgcggucguc

SEQ ID NO: 819956 - RNA, 22 nt, Mycobacterium avium subsp. paratuberculosis
cggcgaacgcgcggucgucgcc

SEQ ID NO: 819957 - RNA, 18 nt, Mycobacterium avium subsp. paratuberculosis
cggcgaacggccagucca

SEQ ID NO: 819958 - RNA, 15 nt, Mycobacterium avium subsp. paratuberculosis
cggcgaacggccgcg

SEQ ID NO: 819959 - RNA, 14 nt, Mycobacterium avium subsp. paratuberculosis
cggcgaacgguucg

SEQ ID NO: 819960 - RNA, 23 nt, Mycobacterium avium subsp. paratuberculosis
cggcgaacgguucgggaaccugg

SEQ ID NO: 819961 - RNA, 13 nt, Mycobacterium avium subsp. paratuberculosis
cggcgaacgucga

SEQ ID NO: 819962 - RNA, 17 nt, Mycobacterium avium subsp. paratuberculosis
cggcgaacgucgauguc

SEQ ID NO: 819963 - RNA, 14 nt, Mycobacterium avium subsp. paratuberculosis
cggcgaacuccacc

SEQ ID NO: 819964 - RNA, 18 nt, Mycobacterium avium subsp. paratuberculosis
cggcgaacuccagaucgc

SEQ ID NO: 819965 - RNA, 23 nt, Mycobacterium avium subsp. paratuberculosis
cggcgaacuccagaucgccgccc

SEQ ID NO: 819966 - RNA, 14 nt, Mycobacterium avium subsp. paratuberculosis
cggcgaacucgcgg

SEQ ID NO: 819967 - RNA, 17 nt, Mycobacterium avium subsp. paratuberculosis
cggcgaacucgcggcgg

SEQ ID NO: 819968 - RNA, 18 nt, Mycobacterium avium subsp. paratuberculosis
cggcgaacucgcggcggg

SEQ ID NO: 819969 - RNA, 15 nt, Mycobacterium avium subsp. paratuberculosis
cggcgaacuuggccg

SEQ ID NO: 819970 - RNA, 17 nt, Mycobacterium avium subsp. paratuberculosis
cggcgaacuuggccgac

SEQ ID NO: 819971 - RNA, 18 nt, Mycobacterium avium subsp. paratuberculosis
cggcgaacuuggccgaca

SEQ ID NO: 819972 - RNA, 19 nt, Mycobacterium avium subsp. paratuberculosis
cggcgaacuuggccgacac

SEQ ID NO: 819973 - RNA, 20 nt, Mycobacterium avium subsp. paratuberculosis
cggcgaacuuggccgacacg

SEQ ID NO: 819974 - RNA, 12 nt, Mycobacterium avium subsp. paratuberculosis
cggcgacaccca

SEQ ID NO: 819975 - RNA, 16 nt, Mycobacterium avium subsp. paratuberculosis
cggcgacacccagcgg

SEQ ID NO: 819976 - RNA, 20 nt, Mycobacterium avium subsp. paratuberculosis
cggcgacacccagcggcgcg

SEQ ID NO: 819977 - RNA, 19 nt, Mycobacterium avium subsp. paratuberculosis
cggcgaaucgguccggcga

SEQ ID NO: 819978 - RNA, 15 nt, Mycobacterium avium subsp. paratuberculosis
cggcgacaacagcgc

SEQ ID NO: 819979 - RNA, 16 nt, Mycobacterium avium subsp. paratuberculosis
cggcgacaacagcgcc

SEQ ID NO: 819980 - RNA, 21 nt, Mycobacterium avium subsp. paratuberculosis
cggcgacaacagcgccgagac

SEQ ID NO: 819981 - RNA, 15 nt, Mycobacterium avium subsp. paratuberculosis
cggcgacacgccgac

SEQ ID NO: 819982 - RNA, 16 nt, Mycobacterium avium subsp. paratuberculosis
cggcgacacgccgacg

SEQ ID NO: 819983 - RNA, 18 nt, Mycobacterium avium subsp. paratuberculosis
cggcgacacguccagcuc

SEQ ID NO: 819984 - RNA, 21 nt, Mycobacterium avium subsp. paratuberculosis
cggcgaccccguucgccgaca

SEQ ID NO: 819985 - RNA, 21 nt, Mycobacterium avium subsp. paratuberculosis
cggcgacccgcacgaugccgc

SEQ ID NO: 819986 - RNA, 21 nt, Mycobacterium avium subsp. paratuberculosis
cggcgacccgcuucgcccggc

SEQ ID NO: 819987 - RNA, 22 nt, Mycobacterium avium subsp. paratuberculosis
cggcgacccgcuucgcccggcu

SEQ ID NO: 819988 - RNA, 17 nt, Mycobacterium avium subsp. paratuberculosis
cggcgaccgccaccucg

SEQ ID NO: 819989 - RNA, 20 nt, Mycobacterium avium subsp. paratuberculosis
cggcgaccgccaccucgagc

SEQ ID NO: 819990 - RNA, 20 nt, Mycobacterium avium subsp. paratuberculosis
cggcgaccgcccggggcgcg

SEQ ID NO: 819991 - RNA, 21 nt, Mycobacterium avium subsp. paratuberculosis
cggcgaccgcccggggcgcgg

SEQ ID NO: 819992 - RNA, 12 nt, Mycobacterium avium subsp. paratuberculosis
cggcgaccgccg

SEQ ID NO: 819993 - RNA, 15 nt, Mycobacterium avium subsp. paratuberculosis
cggcgaaacacagca

SEQ ID NO: 819994 - RNA, 18 nt, Mycobacterium avium subsp. paratuberculosis
cggcgaaacacagcagca

SEQ ID NO: 819995 - RNA, 19 nt, Mycobacterium avium subsp. paratuberculosis
cggcgaaacacagcagcac

SEQ ID NO: 819996 - RNA, 20 nt, Mycobacterium avium subsp. paratuberculosis
cggcgaaaacgccugcgccg

SEQ ID NO: 819997 - RNA, 22 nt, Mycobacterium avium subsp. paratuberculosis
cggcgaaaacgccugcgccgcc

SEQ ID NO: 819998 - RNA, 14 nt, Mycobacterium avium subsp. paratuberculosis
cggccuuuuccggc

SEQ ID NO: 819999 - RNA, 18 nt, Mycobacterium avium subsp. paratuberculosis
cggccuuuuccggcgaca

SEQ ID NO: 820000 - RNA, 20 nt, Mycobacterium avium subsp. paratuberculosis
cggccuuuuccggcgacacc

SEQ ID NO: 820001 - RNA, 23 nt, Mycobacterium avium subsp. paratuberculosis
cggccuuuuccggcgacaccgca

SEQ ID NO: 820002 - RNA, 14 nt, Mycobacterium avium subsp. paratuberculosis
cggcgaacgcccgg

SEQ ID NO: 820003 - RNA, 15 nt, Mycobacterium avium subsp. paratuberculosis
cggcgaacgcccggu

SEQ ID NO: 820004 - RNA, 20 nt, Mycobacterium avium subsp. paratuberculosis
cggcgaacgcccggucgaug

SEQ ID NO: 820005 - RNA, 12 nt, Mycobacterium avium subsp. paratuberculosis
cggcgaaccggg

SEQ ID NO: 820006 - RNA, 14 nt, Mycobacterium avium subsp. paratuberculosis
cggcgaaccgggac

SEQ ID NO: 820007 - RNA, 15 nt, Mycobacterium avium subsp. paratuberculosis
cggcgaaccgggccc

SEQ ID NO: 820008 - RNA, 17 nt, Mycobacterium avium subsp. paratuberculosis
cggcgaaccgggcccgu

SEQ ID NO: 820009 - RNA, 21 nt, Mycobacterium avium subsp. paratuberculosis
cggcgaaccagggcagccagc

SEQ ID NO: 820010 - RNA, 20 nt, Mycobacterium avium subsp. paratuberculosis
cggcgaacccugaccgugcu

SEQ ID NO: 820011 - RNA, 13 nt, Mycobacterium avium subsp. paratuberculosis
cggcgaaccgccg

SEQ ID NO: 820012 - RNA, 14 nt, Mycobacterium avium subsp. paratuberculosis
cggcgaaccgccgc

SEQ ID NO: 820013 - RNA, 18 nt, Mycobacterium avium subsp. paratuberculosis
cggcgaaccgccgcaccc

SEQ ID NO: 820014 - RNA, 21 nt, Mycobacterium avium subsp. paratuberculosis
cggcgaaccgccgcacccagc

SEQ ID NO: 820015 - RNA, 15 nt, Mycobacterium avium subsp. paratuberculosis
cggccuggccgucgc

SEQ ID NO: 820016 - RNA, 16 nt, Mycobacterium avium subsp. paratuberculosis
cggccuggccgucgcg

SEQ ID NO: 820017 - RNA, 13 nt, Mycobacterium avium subsp. paratuberculosis
cggccuggcccag

SEQ ID NO: 820018 - RNA, 14 nt, Mycobacterium avium subsp. paratuberculosis
cggccuggcccagc

SEQ ID NO: 820019 - RNA, 16 nt, Mycobacterium avium subsp. paratuberculosis
cggccuggcccagccg

SEQ ID NO: 820020 - RNA, 20 nt, Mycobacterium avium subsp. paratuberculosis
cggccuggcccagccgcguc

SEQ ID NO: 820021 - RNA, 21 nt, Mycobacterium avium subsp. paratuberculosis
cggccuggcccagccgcguca

SEQ ID NO: 820022 - RNA, 17 nt, Mycobacterium avium subsp. paratuberculosis
cggccugcuucucgccg

SEQ ID NO: 820023 - RNA, 20 nt, Mycobacterium avium subsp. paratuberculosis
cggccugcuucucgccgucg

SEQ ID NO: 820024 - RNA, 18 nt, Mycobacterium avium subsp. paratuberculosis
cggccugcuugaccgcca

SEQ ID NO: 820025 - RNA, 21 nt, Mycobacterium avium subsp. paratuberculosis
cggcccagguucuccggcccg

SEQ ID NO: 820026 - RNA, 17 nt, Mycobacterium avium subsp. paratuberculosis
cggcccaccgcgacccg

SEQ ID NO: 820027 - RNA, 21 nt, Mycobacterium avium subsp. paratuberculosis
cggcccaccgcgacccggccg

SEQ ID NO: 820028 - RNA, 15 nt, Mycobacterium avium subsp. paratuberculosis
cggcccaccgcgucg

SEQ ID NO: 820029 - RNA, 21 nt, Mycobacterium avium subsp. paratuberculosis
cggcccaguccagucgcgccg

SEQ ID NO: 820030 - RNA, 23 nt, Mycobacterium avium subsp. paratuberculosis
cggcccaguccagucgcgccgag

SEQ ID NO: 820031 - RNA, 16 nt, Mycobacterium avium subsp. paratuberculosis
cggcccaguggaucgg

SEQ ID NO: 820032 - RNA, 20 nt, Mycobacterium avium subsp. paratuberculosis
cggcccaguggaucggcccg

SEQ ID NO: 820033 - RNA, 23 nt, Mycobacterium avium subsp. paratuberculosis
cggcccaguggaucggcccgacg

SEQ ID NO: 820034 - RNA, 15 nt, Mycobacterium avium subsp. paratuberculosis
cggcccaucaccagc

SEQ ID NO: 820035 - RNA, 17 nt, Mycobacterium avium subsp. paratuberculosis
cggcccaucaccagcgg

SEQ ID NO: 820036 - RNA, 18 nt, Mycobacterium avium subsp. paratuberculosis
cggcccaucaccggaccg

SEQ ID NO: 820037 - RNA, 21 nt, Mycobacterium avium subsp. paratuberculosis
cggcccaucaccggaccggcc

SEQ ID NO: 820038 - RNA, 23 nt, Mycobacterium avium subsp. paratuberculosis
cggcccaucaccggaccggccag

SEQ ID NO: 820039 - RNA, 24 nt, Mycobacterium avium subsp. paratuberculosis
cggcccaucaccggaccggccagc

SEQ ID NO: 820040 - RNA, 17 nt, Mycobacterium avium subsp. paratuberculosis
cggccccaacggcgugc

SEQ ID NO: 820041 - RNA, 23 nt, Mycobacterium avium subsp. paratuberculosis
cggccccaacggcgugcagccga

SEQ ID NO: 820042 - RNA, 14 nt, Mycobacterium avium subsp. paratuberculosis
cggccccggcucgg

SEQ ID NO: 820043 - RNA, 16 nt, Mycobacterium avium subsp. paratuberculosis
cggccccggcucgggc

SEQ ID NO: 820044 - RNA, 13 nt, Mycobacterium avium subsp. paratuberculosis
cggccccgggcgc

SEQ ID NO: 820045 - RNA, 16 nt, Mycobacterium avium subsp. paratuberculosis
cggccccgggcgcugg

SEQ ID NO: 820046 - RNA, 17 nt, Mycobacterium avium subsp. paratuberculosis
cggccccgggcgcuggc

SEQ ID NO: 820047 - RNA, 18 nt, Mycobacterium avium subsp. paratuberculosis
cggccccgggcgcuggcg

SEQ ID NO: 820048 - RNA, 19 nt, Mycobacterium avium subsp. paratuberculosis
cggccccgggggaccagcg

SEQ ID NO: 820049 - RNA, 21 nt, Mycobacterium avium subsp. paratuberculosis
cggccccgggggaccagcgca

SEQ ID NO: 820050 - RNA, 13 nt, Mycobacterium avium subsp. paratuberculosis
cggccccgguagc

SEQ ID NO: 820051 - RNA, 19 nt, Mycobacterium avium subsp. paratuberculosis
cggccccgguagccagcac

SEQ ID NO: 820052 - RNA, 20 nt, Mycobacterium avium subsp. paratuberculosis
cggccccgguagccagcacc

SEQ ID NO: 820053 - RNA, 22 nt, Mycobacterium avium subsp. paratuberculosis
cggccccgguagccagcaccgc

SEQ ID NO: 820054 - RNA, 23 nt, Mycobacterium avium subsp. paratuberculosis
cggccccgguagccagcaccgcc

SEQ ID NO: 820055 - RNA, 22 nt, Mycobacterium avium subsp. paratuberculosis
cggccccuucgaugucgccggc

SEQ ID NO: 820056 - RNA, 23 nt, Mycobacterium avium subsp. paratuberculosis
cggccccuuggcguauucggcgc

SEQ ID NO: 820057 - RNA, 18 nt, Mycobacterium avium subsp. paratuberculosis
cggcccgaaaacgcccgg

SEQ ID NO: 820058 - RNA, 21 nt, Mycobacterium avium subsp. paratuberculosis
cggcccgaaaacgcccgggug

SEQ ID NO: 820059 - RNA, 20 nt, Mycobacterium avium subsp. paratuberculosis
cggcccgaacaccuccucgg

SEQ ID NO: 820060 - RNA, 16 nt, Mycobacterium avium subsp. paratuberculosis
cggccccuaccgccga

SEQ ID NO: 820061 - RNA, 18 nt, Mycobacterium avium subsp. paratuberculosis
cggccccuaccgccgagc

SEQ ID NO: 820062 - RNA, 18 nt, Mycobacterium avium subsp. paratuberculosis
cggccccggcgacggcgg

SEQ ID NO: 820063 - RNA, 14 nt, Mycobacterium avium subsp. paratuberculosis
cggcccgaccagcg

SEQ ID NO: 820064 - RNA, 17 nt, Mycobacterium avium subsp. paratuberculosis
cggcccgaccagcgggc

SEQ ID NO: 820065 - RNA, 19 nt, Mycobacterium avium subsp. paratuberculosis
cggcccgaccagcgggccg

SEQ ID NO: 820066 - RNA, 23 nt, Mycobacterium avium subsp. paratuberculosis
cggcccgaccagcgggccgacag

SEQ ID NO: 820067 - RNA, 16 nt, Mycobacterium avium subsp. paratuberculosis
cggcccgacccgguca

SEQ ID NO: 820068 - RNA, 18 nt, Mycobacterium avium subsp. paratuberculosis
cggcccgacccggucagc

SEQ ID NO: 820069 - RNA, 15 nt, Mycobacterium avium subsp. paratuberculosis
cggcccgaccggagc

SEQ ID NO: 820070 - RNA, 20 nt, Mycobacterium avium subsp. paratuberculosis
cggcccgaccggagccgucu

SEQ ID NO: 820071 - RNA, 19 nt, Mycobacterium avium subsp. paratuberculosis
cggcccgacgacgccguca

SEQ ID NO: 820072 - RNA, 15 nt, Mycobacterium avium subsp. paratuberculosis
cggcccgagcccugc

SEQ ID NO: 820073 - RNA, 19 nt, Mycobacterium avium subsp. paratuberculosis
cggcccgagcccugcgcca

SEQ ID NO: 820074 - RNA, 20 nt, Mycobacterium avium subsp. paratuberculosis
cggcccgagcccugcgccag

SEQ ID NO: 820075 - RNA, 23 nt, Mycobacterium avium subsp. paratuberculosis
cggcccgagcccugcgccagcag

SEQ ID NO: 820076 - RNA, 13 nt, Mycobacterium avium subsp. paratuberculosis
cggcccgacccgg

SEQ ID NO: 820077 - RNA, 21 nt, Mycobacterium avium subsp. paratuberculosis
cggcccgagugugcauccugg

SEQ ID NO: 820078 - RNA, 16 nt, Mycobacterium avium subsp. paratuberculosis
cggcccgauaggccga

SEQ ID NO: 820079 - RNA, 18 nt, Mycobacterium avium subsp. paratuberculosis
cggcccgauaggccgacu

SEQ ID NO: 820080 - RNA, 21 nt, Mycobacterium avium subsp. paratuberculosis
cggcccgauaggccgacuggu

SEQ ID NO: 820081 - RNA, 13 nt, Mycobacterium avium subsp. paratuberculosis
cggcccgaucacc

SEQ ID NO: 820082 - RNA, 14 nt, Mycobacterium avium subsp. paratuberculosis
cggcccgaucaccg

SEQ ID NO: 820083 - RNA, 16 nt, Mycobacterium avium subsp. paratuberculosis
cggcccgaucaccgcc

SEQ ID NO: 820084 - RNA, 17 nt, Mycobacterium avium subsp. paratuberculosis
cggcccgaucaccgccg

SEQ ID NO: 820085 - RNA, 14 nt, Mycobacterium avium subsp. paratuberculosis
cggcccgaucucgc

SEQ ID NO: 820086 - RNA, 16 nt, Mycobacterium avium subsp. paratuberculosis
cggcccgaucucgcgc

SEQ ID NO: 820087 - RNA, 18 nt, Mycobacterium avium subsp. paratuberculosis
cggcccgaucucgcgcgg

SEQ ID NO: 820088 - RNA, 20 nt, Mycobacterium avium subsp. paratuberculosis
cggcccgaucucgcgcgggu

SEQ ID NO: 820089 - RNA, 23 nt, Mycobacterium avium subsp. paratuberculosis
cggcccgaucucgcgcgggucga

SEQ ID NO: 820090 - RNA, 11 nt, Mycobacterium avium subsp. paratuberculosis
cggcccgcgcc

SEQ ID NO: 820091 - RNA, 16 nt, Mycobacterium avium subsp. paratuberculosis
cggcccgccuucuccg

SEQ ID NO: 820092 - RNA, 19 nt, Mycobacterium avium subsp. paratuberculosis
cggcccgccgggccggauc

SEQ ID NO: 820093 - RNA, 21 nt, Mycobacterium avium subsp. paratuberculosis
cggcccgccgggcgucgcgcu

SEQ ID NO: 820094 - RNA, 19 nt, Mycobacterium avium subsp. paratuberculosis
cggcccgccucggcggccg

SEQ ID NO: 820095 - RNA, 14 nt, Mycobacterium avium subsp. paratuberculosis
cggcccgcgccccg

SEQ ID NO: 820096 - RNA, 15 nt, Mycobacterium avium subsp. paratuberculosis
cggcccgcgccccgg

SEQ ID NO: 820097 - RNA, 16 nt, Mycobacterium avium subsp. paratuberculosis
cggcccgcgccccggc

SEQ ID NO: 820098 - RNA, 18 nt, Mycobacterium avium subsp. paratuberculosis
cggcccgcgccccggcgg

SEQ ID NO: 820099 - RNA, 19 nt, Mycobacterium avium subsp. paratuberculosis
cggcccgcgccccggcggc

SEQ ID NO: 820100 - RNA, 13 nt, Mycobacterium avium subsp. paratuberculosis
cggcccgccgcgc

SEQ ID NO: 820101 - RNA, 14 nt, Mycobacterium avium subsp. paratuberculosis
cggcccgccgcgcc

SEQ ID NO: 820102 - RNA, 15 nt, Mycobacterium avium subsp. paratuberculosis
cggcccgccgcgccc

SEQ ID NO: 820103 - RNA, 16 nt, Mycobacterium avium subsp. paratuberculosis
cggcccgccgcgcccg

SEQ ID NO: 820104 - RNA, 20 nt, Mycobacterium avium subsp. paratuberculosis
cggcccgccgcucaccgccg

SEQ ID NO: 820105 - RNA, 21 nt, Mycobacterium avium subsp. paratuberculosis
cggcccgccgcucaccgccga

SEQ ID NO: 820106 - RNA, 11 nt, Mycobacterium avium subsp. paratuberculosis
cggcccgccgg

SEQ ID NO: 820107 - RNA, 14 nt, Mycobacterium avium subsp. paratuberculosis
cggcccgccggaac

SEQ ID NO: 820108 - RNA, 13 nt, Mycobacterium avium subsp. paratuberculosis
cggcccgccgccg

SEQ ID NO: 820109 - RNA, 17 nt, Mycobacterium avium subsp. paratuberculosis
cggcccgccgccggcgg

SEQ ID NO: 820110 - RNA, 18 nt, Mycobacterium avium subsp. paratuberculosis
cggcccgccgccggcggc

SEQ ID NO: 820111 - RNA, 19 nt, Mycobacterium avium subsp. paratuberculosis
cggcccgccgccggcggcg

SEQ ID NO: 820112 - RNA, 20 nt, Mycobacterium avium subsp. paratuberculosis
cggcccgccgccggcggcgu

SEQ ID NO: 820113 - RNA, 22 nt, Mycobacterium avium subsp. paratuberculosis
cggcccgccgccggcggcgucc

SEQ ID NO: 820114 - RNA, 12 nt, Mycobacterium avium subsp. paratuberculosis
cggcccgccucg

SEQ ID NO: 820115 - RNA, 14 nt, Mycobacterium avium subsp. paratuberculosis
cggcccgccucggc

SEQ ID NO: 820116 - RNA, 16 nt, Mycobacterium avium subsp. paratuberculosis
cggcccgccucggcgg

SEQ ID NO: 820117 - RNA, 16 nt, Mycobacterium avium subsp. paratuberculosis
cggcccgcccggcggc

SEQ ID NO: 820118 - RNA, 15 nt, Mycobacterium avium subsp. paratuberculosis
cggcccgcccguaga

SEQ ID NO: 820119 - RNA, 12 nt, Mycobacterium avium subsp. paratuberculosis
cggcccgccgaa

SEQ ID NO: 820120 - RNA, 17 nt, Mycobacterium avium subsp. paratuberculosis
cggcccgaugcggaccg

SEQ ID NO: 820121 - RNA, 13 nt, Mycobacterium avium subsp. paratuberculosis
cggcccgcagcca

SEQ ID NO: 820122 - RNA, 14 nt, Mycobacterium avium subsp. paratuberculosis
cggcccgcaugcac

SEQ ID NO: 820123 - RNA, 19 nt, Mycobacterium avium subsp. paratuberculosis
cggcccgcaugcaccggug

SEQ ID NO: 820124 - RNA, 18 nt, Mycobacterium avium subsp. paratuberculosis
cggcccgccacccgaggc

SEQ ID NO: 820125 - RNA, 20 nt, Mycobacterium avium subsp. paratuberculosis
cggcccgccacccgaggccg

SEQ ID NO: 820126 - RNA, 13 nt, Mycobacterium avium subsp. paratuberculosis
cggcccgaucgcg

SEQ ID NO: 820127 - RNA, 17 nt, Mycobacterium avium subsp. paratuberculosis
cggcccgaucgcggcga

SEQ ID NO: 820128 - RNA, 16 nt, Mycobacterium avium subsp. paratuberculosis
cggcccgaucgcgucg

SEQ ID NO: 820129 - RNA, 23 nt, Mycobacterium avium subsp. paratuberculosis
cggcccgaucgcgucgacgaugg

SEQ ID NO: 820130 - RNA, 14 nt, Mycobacterium avium subsp. paratuberculosis
cggcccgcacggcc

SEQ ID NO: 820131 - RNA, 18 nt, Mycobacterium avium subsp. paratuberculosis
cggcccgcacggccgcca

SEQ ID NO: 820132 - RNA, 15 nt, Mycobacterium avium subsp. paratuberculosis
cggcccgcagccagc

SEQ ID NO: 820133 - RNA, 16 nt, Mycobacterium avium subsp. paratuberculosis
cggcccgcagccagcg

SEQ ID NO: 820134 - RNA, 17 nt, Mycobacterium avium subsp. paratuberculosis
cggcccgcagccagcgc

SEQ ID NO: 820135 - RNA, 18 nt, Mycobacterium avium subsp. paratuberculosis
cggcccgcagcgccucgg

SEQ ID NO: 820136 - RNA, 20 nt, Mycobacterium avium subsp. paratuberculosis
cggcccgcagcgccucggcg

SEQ ID NO: 820137 - RNA, 23 nt, Mycobacterium avium subsp. paratuberculosis
cggcccgcagcgccucggcgugg

SEQ ID NO: 820138 - RNA, 20 nt, Mycobacterium avium subsp. paratuberculosis
cggcccgcaggaucgagccg

SEQ ID NO: 820139 - RNA, 22 nt, Mycobacterium avium subsp. paratuberculosis
cggcccgcaggaucgagccggc

SEQ ID NO: 820140 - RNA, 22 nt, Mycobacterium avium subsp. paratuberculosis
cggcccgcaucgaauccacgaa

SEQ ID NO: 820141 - RNA, 18 nt, Mycobacterium avium subsp. paratuberculosis
cggcccgcaucgcggcga

SEQ ID NO: 820142 - RNA, 13 nt, Mycobacterium avium subsp. paratuberculosis
cggcccggcggcc

SEQ ID NO: 820143 - RNA, 15 nt, Mycobacterium avium subsp. paratuberculosis
cggcccggcggccgg

SEQ ID NO: 820144 - RNA, 18 nt, Mycobacterium avium subsp. paratuberculosis
cggcccggcggccggccg

SEQ ID NO: 820145 - RNA, 19 nt, Mycobacterium avium subsp. paratuberculosis
cggcccggcggccggccgc

SEQ ID NO: 820146 - RNA, 12 nt, Mycobacterium avium subsp. paratuberculosis
cggcccggcggg

SEQ ID NO: 820147 - RNA, 13 nt, Mycobacterium avium subsp. paratuberculosis
cggcccggcgggc

SEQ ID NO: 820148 - RNA, 15 nt, Mycobacterium avium subsp. paratuberculosis
cggcccggcgggcau

SEQ ID NO: 820149 - RNA, 14 nt, Mycobacterium avium subsp. paratuberculosis
cggcccggccggcg

SEQ ID NO: 820150 - RNA, 15 nt, Mycobacterium avium subsp. paratuberculosis
cggcccggccggcgc

SEQ ID NO: 820151 - RNA, 16 nt, Mycobacterium avium subsp. paratuberculosis
cggcccggcgaugccg

SEQ ID NO: 820152 - RNA, 13 nt, Mycobacterium avium subsp. paratuberculosis
cggcccggccaac

SEQ ID NO: 820153 - RNA, 16 nt, Mycobacterium avium subsp. paratuberculosis
cggcccggccaacggg

SEQ ID NO: 820154 - RNA, 15 nt, Mycobacterium avium subsp. paratuberculosis
cggcccggcccgcug

SEQ ID NO: 820155 - RNA, 14 nt, Mycobacterium avium subsp. paratuberculosis
cggcccggccacca

SEQ ID NO: 820156 - RNA, 15 nt, Mycobacterium avium subsp. paratuberculosis
cggcccggccaccag

SEQ ID NO: 820157 - RNA, 21 nt, Mycobacterium avium subsp. paratuberculosis
cggcccggccacucgccgcga

SEQ ID NO: 820158 - RNA, 12 nt, Mycobacterium avium subsp. paratuberculosis
cggcccggcacu

SEQ ID NO: 820159 - RNA, 16 nt, Mycobacterium avium subsp. paratuberculosis
cggcccgcucggcggg

SEQ ID NO: 820160 - RNA, 17 nt, Mycobacterium avium subsp. paratuberculosis
cggcccgcucggcgggu

SEQ ID NO: 820161 - RNA, 17 nt, Mycobacterium avium subsp. paratuberculosis
cggcccgcucgggccau

SEQ ID NO: 820162 - RNA, 17 nt, Mycobacterium avium subsp. paratuberculosis
cggcccgcgccggcgug

SEQ ID NO: 820163 - RNA, 18 nt, Mycobacterium avium subsp. paratuberculosis
cggcccgcgccggcgugu

SEQ ID NO: 820164 - RNA, 12 nt, Mycobacterium avium subsp. paratuberculosis
cggcccgcgcgg

SEQ ID NO: 820165 - RNA, 14 nt, Mycobacterium avium subsp. paratuberculosis
cggcccgcggcacg

SEQ ID NO: 820166 - RNA, 19 nt, Mycobacterium avium subsp. paratuberculosis
cggcccgcggcacgcugcg

SEQ ID NO: 820167 - RNA, 18 nt, Mycobacterium avium subsp. paratuberculosis
cggcccgcggcaucgucg

SEQ ID NO: 820168 - RNA, 19 nt, Mycobacterium avium subsp. paratuberculosis
cggcccgcggcaucgucgg

SEQ ID NO: 820169 - RNA, 12 nt, Mycobacterium avium subsp. paratuberculosis
cggcccgcggcg

SEQ ID NO: 820170 - RNA, 14 nt, Mycobacterium avium subsp. paratuberculosis
cggcccgcggcguc

SEQ ID NO: 820171 - RNA, 18 nt, Mycobacterium avium subsp. paratuberculosis
cggcccgcugcgcggccg

SEQ ID NO: 820172 - RNA, 21 nt, Mycobacterium avium subsp. paratuberculosis
cggcccgcugcgcggccgaac

SEQ ID NO: 820173 - RNA, 18 nt, Mycobacterium avium subsp. paratuberculosis
cggcccgcugcggcuggg

SEQ ID NO: 820174 - RNA, 14 nt, Mycobacterium avium subsp. paratuberculosis
cggcccgcuggccg

SEQ ID NO: 820175 - RNA, 16 nt, Mycobacterium avium subsp. paratuberculosis
cggcccgcuggccgcc

SEQ ID NO: 820176 - RNA, 18 nt, Mycobacterium avium subsp. paratuberculosis
cggcccgcuggccgccgc

SEQ ID NO: 820177 - RNA, 24 nt, Mycobacterium avium subsp. paratuberculosis
cggcccgcuucaggcagcgcacga

SEQ ID NO: 820178 - RNA, 18 nt, Mycobacterium avium subsp. paratuberculosis
cggcccgcuugccgacgu

SEQ ID NO: 820179 - RNA, 17 nt, Mycobacterium avium subsp. paratuberculosis
cggcccggaacgcgucg

SEQ ID NO: 820180 - RNA, 20 nt, Mycobacterium avium subsp. paratuberculosis
cggcccggaacgcgucgccc

SEQ ID NO: 820181 - RNA, 15 nt, Mycobacterium avium subsp. paratuberculosis
cggccaguccgcgug

SEQ ID NO: 820182 - RNA, 16 nt, Mycobacterium avium subsp. paratuberculosis
cggccaguccggcagc

SEQ ID NO: 820183 - RNA, 18 nt, Mycobacterium avium subsp. paratuberculosis
cggccaguccggcagcag

SEQ ID NO: 820184 - RNA, 21 nt, Mycobacterium avium subsp. paratuberculosis
cggccaguccggcagcagcga

SEQ ID NO: 820185 - RNA, 14 nt, Mycobacterium avium subsp. paratuberculosis
cggccaguccagcg

SEQ ID NO: 820186 - RNA, 16 nt, Mycobacterium avium subsp. paratuberculosis
cggccaguccagcgaa

SEQ ID NO: 820187 - RNA, 20 nt, Mycobacterium avium subsp. paratuberculosis
cggccaguccagcgaaucga

SEQ ID NO: 820188 - RNA, 18 nt, Mycobacterium avium subsp. paratuberculosis
cggccaguccaggccgcc

SEQ ID NO: 820189 - RNA, 19 nt, Mycobacterium avium subsp. paratuberculosis
cggccaguccaggccgccg

SEQ ID NO: 820190 - RNA, 23 nt, Mycobacterium avium subsp. paratuberculosis
cggccaguccaggccgccgugga

SEQ ID NO: 820191 - RNA, 21 nt, Mycobacterium avium subsp. paratuberculosis
cggccaguccugggccagauc

SEQ ID NO: 820192 - RNA, 16 nt, Mycobacterium avium subsp. paratuberculosis
cggccaguucaccgcg

SEQ ID NO: 820193 - RNA, 18 nt, Mycobacterium avium subsp. paratuberculosis
cggccaguucaccgcgcu

SEQ ID NO: 820194 - RNA, 16 nt, Mycobacterium avium subsp. paratuberculosis
cggccaguucccgggc

SEQ ID NO: 820195 - RNA, 18 nt, Mycobacterium avium subsp. paratuberculosis
cggccaguucccgggcga

SEQ ID NO: 820196 - RNA, 17 nt, Mycobacterium avium subsp. paratuberculosis
cggccagguuccaccgg

SEQ ID NO: 820197 - RNA, 20 nt, Mycobacterium avium subsp. paratuberculosis
cggccagguuccaccgggcg

SEQ ID NO: 820198 - RNA, 17 nt, Mycobacterium avium subsp. paratuberculosis
cggccagguugaccacc

SEQ ID NO: 820199 - RNA, 19 nt, Mycobacterium avium subsp. paratuberculosis
cggccagguugaccaccag

SEQ ID NO: 820200 - RNA, 18 nt, Mycobacterium avium subsp. paratuberculosis
cggccagguugucgucgg

SEQ ID NO: 820201 - RNA, 20 nt, Mycobacterium avium subsp. paratuberculosis
cggccagguuuugcagcgga

SEQ ID NO: 820202 - RNA, 15 nt, Mycobacterium avium subsp. paratuberculosis
cggccaggucgccgc

SEQ ID NO: 820203 - RNA, 19 nt, Mycobacterium avium subsp. paratuberculosis
cggccaggucgccgcgcag

SEQ ID NO: 820204 - RNA, 18 nt, Mycobacterium avium subsp. paratuberculosis
cggccagguccacaccgu

SEQ ID NO: 820205 - RNA, 19 nt, Mycobacterium avium subsp. paratuberculosis
cggccagguccacaccgug

SEQ ID NO: 820206 - RNA, 20 nt, Mycobacterium avium subsp. paratuberculosis
cggccaggucgacggggucg

SEQ ID NO: 820207 - RNA, 22 nt, Mycobacterium avium subsp. paratuberculosis
cggccaggguagaggcggcgac

SEQ ID NO: 820208 - RNA, 21 nt, Mycobacterium avium subsp. paratuberculosis
cggccagggugacggucaugc

SEQ ID NO: 820209 - RNA, 21 nt, Mycobacterium avium subsp. paratuberculosis
cggccagguacugaucaccgc

SEQ ID NO: 820210 - RNA, 22 nt, Mycobacterium avium subsp. paratuberculosis
cggccagguacugaucaccgcg

SEQ ID NO: 820211 - RNA, 23 nt, Mycobacterium avium subsp. paratuberculosis
cggccagguacugaucaccgcgc

SEQ ID NO: 820212 - RNA, 18 nt, Mycobacterium avium subsp. paratuberculosis
cggccagggugccgacga

SEQ ID NO: 820213 - RNA, 20 nt, Mycobacterium avium subsp. paratuberculosis
cggccagggugccgacgacc

SEQ ID NO: 820214 - RNA, 20 nt, Mycobacterium avium subsp. paratuberculosis
cggccagggugucccagcgc

SEQ ID NO: 820215 - RNA, 21 nt, Mycobacterium avium subsp. paratuberculosis
cggccagggugucccagcgcc

SEQ ID NO: 820216 - RNA, 22 nt, Mycobacterium avium subsp. paratuberculosis
cggccacgcccuggccgccggc

SEQ ID NO: 820217 - RNA, 21 nt, Mycobacterium avium subsp. paratuberculosis
cggccacgccgggcauccgcc

SEQ ID NO: 820218 - RNA, 21 nt, Mycobacterium avium subsp. paratuberculosis
cggccagggcucgugcagccg

SEQ ID NO: 820219 - RNA, 23 nt, Mycobacterium avium subsp. paratuberculosis
cggccagggcucgugcagccggc

SEQ ID NO: 820220 - RNA, 17 nt, Mycobacterium avium subsp. paratuberculosis
cggccacgcaggcgucc

SEQ ID NO: 820221 - RNA, 16 nt, Mycobacterium avium subsp. paratuberculosis
cggccaccuugcgcgg

SEQ ID NO: 820222 - RNA, 19 nt, Mycobacterium avium subsp. paratuberculosis
cggccaccuugcgcggguc

SEQ ID NO: 820223 - RNA, 21 nt, Mycobacterium avium subsp. paratuberculosis
cggccaccuugcgcgggucgc

SEQ ID NO: 820224 - RNA, 21 nt, Mycobacterium avium subsp. paratuberculosis
cggccaccuugucggcgccca

SEQ ID NO: 820225 - RNA, 16 nt, Mycobacterium avium subsp. paratuberculosis
cggccacgacgcggcg

SEQ ID NO: 820226 - RNA, 21 nt, Mycobacterium avium subsp. paratuberculosis
cggccacgacgcggcgcgcga

SEQ ID NO: 820227 - RNA, 13 nt, Mycobacterium avium subsp. paratuberculosis
cggccacgacggc

SEQ ID NO: 820228 - RNA, 15 nt, Mycobacterium avium subsp. paratuberculosis
cggccacgacggcgc

SEQ ID NO: 820229 - RNA, 17 nt, Mycobacterium avium subsp. paratuberculosis
cggccacgacggcgcug

SEQ ID NO: 820230 - RNA, 17 nt, Mycobacterium avium subsp. paratuberculosis
cggccacgaucgcggcc

SEQ ID NO: 820231 - RNA, 19 nt, Mycobacterium avium subsp. paratuberculosis
cggccacgaucgcggccag

SEQ ID NO: 820232 - RNA, 21 nt, Mycobacterium avium subsp. paratuberculosis
cggccacgaucgcggccagcg

SEQ ID NO: 820233 - RNA, 23 nt, Mycobacterium avium subsp. paratuberculosis
cggccacgaucgcggccagcgug

SEQ ID NO: 820234 - RNA, 21 nt, Mycobacterium avium subsp. paratuberculosis
cggccacgauggggacgucga

SEQ ID NO: 820235 - RNA, 23 nt, Mycobacterium avium subsp. paratuberculosis
cggccacgauggggacgucgacg

SEQ ID NO: 820236 - RNA, 20 nt, Mycobacterium avium subsp. paratuberculosis
cggccaccugggcggggcug

SEQ ID NO: 820237 - RNA, 21 nt, Mycobacterium avium subsp. paratuberculosis
cggccauauaggggugggcga

SEQ ID NO: 820238 - RNA, 21 nt, Mycobacterium avium subsp. paratuberculosis
cggccaucuccugcacgcgcg

SEQ ID NO: 820239 - RNA, 22 nt, Mycobacterium avium subsp. paratuberculosis
cggccaucuccugcacgcgcgg

SEQ ID NO: 820240 - RNA, 14 nt, Mycobacterium avium subsp. paratuberculosis
cggccaucucggcg

SEQ ID NO: 820241 - RNA, 20 nt, Mycobacterium avium subsp. paratuberculosis
cggccaucucgugcccgggc

SEQ ID NO: 820242 - RNA, 13 nt, Mycobacterium avium subsp. paratuberculosis
cggccaucgccgc

SEQ ID NO: 820243 - RNA, 17 nt, Mycobacterium avium subsp. paratuberculosis
cggccaucgccgccauc

SEQ ID NO: 820244 - RNA, 14 nt, Mycobacterium avium subsp. paratuberculosis
cggccaucgccgcg

SEQ ID NO: 820245 - RNA, 16 nt, Mycobacterium avium subsp. paratuberculosis
cggccaucgccgcggu

SEQ ID NO: 820246 - RNA, 17 nt, Mycobacterium avium subsp. paratuberculosis
cggccaucgccgcggug

SEQ ID NO: 820247 - RNA, 18 nt, Mycobacterium avium subsp. paratuberculosis
cggccaucgccgcggugg

SEQ ID NO: 820248 - RNA, 12 nt, Mycobacterium avium subsp. paratuberculosis
cggccaucgccu

SEQ ID NO: 820249 - RNA, 23 nt, Mycobacterium avium subsp. paratuberculosis
cggccaucuucaguucggccggc

SEQ ID NO: 820250 - RNA, 17 nt, Mycobacterium avium subsp. paratuberculosis
cggccaugaccaugucg

SEQ ID NO: 820251 - RNA, 18 nt, Mycobacterium avium subsp. paratuberculosis
cggccaugaccaugucga

SEQ ID NO: 820252 - RNA, 23 nt, Mycobacterium avium subsp. paratuberculosis
cggccaugaccaugucgacgcug

SEQ ID NO: 820253 - RNA, 15 nt, Mycobacterium avium subsp. paratuberculosis
cggccaugcagacca

SEQ ID NO: 820254 - RNA, 17 nt, Mycobacterium avium subsp. paratuberculosis
cggccaugcagaccagc

SEQ ID NO: 820255 - RNA, 18 nt, Mycobacterium avium subsp. paratuberculosis
cggccaugcagaccagcc

SEQ ID NO: 820256 - RNA, 19 nt, Mycobacterium avium subsp. paratuberculosis
cggccaugcagaccagccc

SEQ ID NO: 820257 - RNA, 20 nt, Mycobacterium avium subsp. paratuberculosis
cggccaguugacguugaucg

SEQ ID NO: 820258 - RNA, 17 nt, Mycobacterium avium subsp. paratuberculosis
cggccaguucgagcgcc

SEQ ID NO: 820259 - RNA, 18 nt, Mycobacterium avium subsp. paratuberculosis
cggccaguucgagcgccg

SEQ ID NO: 820260 - RNA, 20 nt, Mycobacterium avium subsp. paratuberculosis
cggccaguucgagcgccgcg

SEQ ID NO: 820261 - RNA, 18 nt, Mycobacterium avium subsp. paratuberculosis
cggccaguucgccgguga

SEQ ID NO: 820262 - RNA, 19 nt, Mycobacterium avium subsp. paratuberculosis
cggccaguucgccggugac

SEQ ID NO: 820263 - RNA, 16 nt, Mycobacterium avium subsp. paratuberculosis
cggcccaacacgcccu

SEQ ID NO: 820264 - RNA, 17 nt, Mycobacterium avium subsp. paratuberculosis
cggcccaacacgcccug

SEQ ID NO: 820265 - RNA, 19 nt, Mycobacterium avium subsp. paratuberculosis
cggcccaagacccgcguca

SEQ ID NO: 820266 - RNA, 18 nt, Mycobacterium avium subsp. paratuberculosis
cggccaugcccucgaucg

SEQ ID NO: 820267 - RNA, 14 nt, Mycobacterium avium subsp. paratuberculosis
cggcccacccgcag

SEQ ID NO: 820268 - RNA, 12 nt, Mycobacterium avium subsp. paratuberculosis
cggcccacccgg

SEQ ID NO: 820269 - RNA, 13 nt, Mycobacterium avium subsp. paratuberculosis
cggcccacccgga

SEQ ID NO: 820270 - RNA, 13 nt, Mycobacterium avium subsp. paratuberculosis
cggcccaccggcc

SEQ ID NO: 820271 - RNA, 15 nt, Mycobacterium avium subsp. paratuberculosis
cggcccaccggcccg

SEQ ID NO: 820272 - RNA, 17 nt, Mycobacterium avium subsp. paratuberculosis
cggcccaccggcccggc

SEQ ID NO: 820273 - RNA, 18 nt, Mycobacterium avium subsp. paratuberculosis
cggcccaccggcccggcg

SEQ ID NO: 820274 - RNA, 19 nt, Mycobacterium avium subsp. paratuberculosis
cggcccaccggcccggcgg

SEQ ID NO: 820275 - RNA, 18 nt, Mycobacterium avium subsp. paratuberculosis
cggcccacgccgucgucg

SEQ ID NO: 820276 - RNA, 21 nt, Mycobacterium avium subsp. paratuberculosis
cggcccaccaccgccucgacg

SEQ ID NO: 820277 - RNA, 22 nt, Mycobacterium avium subsp. paratuberculosis
cggcccaccaccgccucgacgg

SEQ ID NO: 820278 - RNA, 18 nt, Mycobacterium avium subsp. paratuberculosis
cggcccaauucguaggcg

SEQ ID NO: 820279 - RNA, 14 nt, Mycobacterium avium subsp. paratuberculosis
cggcccggucgacu

SEQ ID NO: 820280 - RNA, 15 nt, Mycobacterium avium subsp. paratuberculosis
cggcccggucgacuu

SEQ ID NO: 820281 - RNA, 21 nt, Mycobacterium avium subsp. paratuberculosis
cggcccggguggacgcccgcg

SEQ ID NO: 820282 - RNA, 18 nt, Mycobacterium avium subsp. paratuberculosis
cggcccgguacaucgacg

SEQ ID NO: 820283 - RNA, 21 nt, Mycobacterium avium subsp. paratuberculosis
cggcccgguacaucgacgcga

SEQ ID NO: 820284 - RNA, 18 nt, Mycobacterium avium subsp. paratuberculosis
cggcccggucuugccggc

SEQ ID NO: 820285 - RNA, 13 nt, Mycobacterium avium subsp. paratuberculosis
cggcccgucgagc

SEQ ID NO: 820286 - RNA, 20 nt, Mycobacterium avium subsp. paratuberculosis
cggcccgucgagcggcuugc

SEQ ID NO: 820287 - RNA, 15 nt, Mycobacterium avium subsp. paratuberculosis
cggcccgucgccacc

SEQ ID NO: 820288 - RNA, 22 nt, Mycobacterium avium subsp. paratuberculosis
cggcccgucgccaccacggcgc

SEQ ID NO: 820289 - RNA, 13 nt, Mycobacterium avium subsp. paratuberculosis
cggcccgucgccg

SEQ ID NO: 820290 - RNA, 14 nt, Mycobacterium avium subsp. paratuberculosis
cggcccgucgccga

SEQ ID NO: 820291 - RNA, 17 nt, Mycobacterium avium subsp. paratuberculosis
cggcccgucgccgauca

SEQ ID NO: 820292 - RNA, 18 nt, Mycobacterium avium subsp. paratuberculosis
cggcccgucaggccucga

SEQ ID NO: 820293 - RNA, 21 nt, Mycobacterium avium subsp. paratuberculosis
cggcccguccagaucggccag

SEQ ID NO: 820294 - RNA, 23 nt, Mycobacterium avium subsp. paratuberculosis
cggcccguccgccccgcugccgg

SEQ ID NO: 820295 - RNA, 13 nt, Mycobacterium avium subsp. paratuberculosis
cggcccgugcaug

SEQ ID NO: 820296 - RNA, 13 nt, Mycobacterium avium subsp. paratuberculosis
cggcccggggugu

SEQ ID NO: 820297 - RNA, 14 nt, Mycobacterium avium subsp. paratuberculosis
cggcccggggugug

SEQ ID NO: 820298 - RNA, 21 nt, Mycobacterium avium subsp. paratuberculosis
cggcccggggugugcccgaac

SEQ ID NO: 820299 - RNA, 20 nt, Mycobacterium avium subsp. paratuberculosis
cggcccgggcgauucgucgu

SEQ ID NO: 820300 - RNA, 22 nt, Mycobacterium avium subsp. paratuberculosis
cggcccgggcgauucgucgucg

SEQ ID NO: 820301 - RNA, 15 nt, Mycobacterium avium subsp. paratuberculosis
cggcccggggacacc

SEQ ID NO: 820302 - RNA, 20 nt, Mycobacterium avium subsp. paratuberculosis
cggcccggggacacccucgg

SEQ ID NO: 820303 - RNA, 13 nt, Mycobacterium avium subsp. paratuberculosis
cggcccggcgcgg

SEQ ID NO: 820304 - RNA, 15 nt, Mycobacterium avium subsp. paratuberculosis
cggcccggcgcggcc

SEQ ID NO: 820305 - RNA, 19 nt, Mycobacterium avium subsp. paratuberculosis
cggcccgggaagccgcagc

SEQ ID NO: 820306 - RNA, 20 nt, Mycobacterium avium subsp. paratuberculosis
cggcccgggaagccgcagca

SEQ ID NO: 820307 - RNA, 13 nt, Mycobacterium avium subsp. paratuberculosis
cggcccggcucgg

SEQ ID NO: 820308 - RNA, 15 nt, Mycobacterium avium subsp. paratuberculosis
cggcccggcgucacg

SEQ ID NO: 820309 - RNA, 13 nt, Mycobacterium avium subsp. paratuberculosis
cggcccggcgucc

SEQ ID NO: 820310 - RNA, 16 nt, Mycobacterium avium subsp. paratuberculosis
cggcccggcguccgcg

SEQ ID NO: 820311 - RNA, 22 nt, Mycobacterium avium subsp. paratuberculosis
cggcccuguuugcaggcgaucu

SEQ ID NO: 820312 - RNA, 17 nt, Mycobacterium avium subsp. paratuberculosis
cggcccuggcgggcggc

SEQ ID NO: 820313 - RNA, 24 nt, Mycobacterium avium subsp. paratuberculosis
cggcccuggcgggcggcccgcacg

SEQ ID NO: 820314 - RNA, 22 nt, Mycobacterium avium subsp. paratuberculosis
cggcccugguugagcaccgcga

SEQ ID NO: 820315 - RNA, 15 nt, Mycobacterium avium subsp. paratuberculosis
cggcccuggucggcc

SEQ ID NO: 820316 - RNA, 17 nt, Mycobacterium avium subsp. paratuberculosis
cggcccuggucggccag

SEQ ID NO: 820317 - RNA, 22 nt, Mycobacterium avium subsp. paratuberculosis
cggcccuggucggccagggcgu

SEQ ID NO: 820318 - RNA, 17 nt, Mycobacterium avium subsp. paratuberculosis
cggcccuggaugucacg

SEQ ID NO: 820319 - RNA, 19 nt, Mycobacterium avium subsp. paratuberculosis
cggcccuggaugucacggu

SEQ ID NO: 820320 - RNA, 20 nt, Mycobacterium avium subsp. paratuberculosis
cggcccugcgcggccugcag

SEQ ID NO: 820321 - RNA, 21 nt, Mycobacterium avium subsp. paratuberculosis
cggcccugcgcggccugcagc

SEQ ID NO: 820322 - RNA, 22 nt, Mycobacterium avium subsp. paratuberculosis
cggcccugcgcggccugcagca

SEQ ID NO: 820323 - RNA, 15 nt, Mycobacterium avium subsp. paratuberculosis
cggcccugcggccag

SEQ ID NO: 820324 - RNA, 22 nt, Mycobacterium avium subsp. paratuberculosis
cggcccugcggccagugccggg

SEQ ID NO: 820325 - RNA, 21 nt, Mycobacterium avium subsp. paratuberculosis
cggcccugcaggucgcggugg

SEQ ID NO: 820326 - RNA, 14 nt, Mycobacterium avium subsp. paratuberculosis
cggcccuccagcac

SEQ ID NO: 820327 - RNA, 15 nt, Mycobacterium avium subsp. paratuberculosis
cggcccuccagcacc

SEQ ID NO: 820328 - RNA, 17 nt, Mycobacterium avium subsp. paratuberculosis
cggcccguugagcaccg

SEQ ID NO: 820329 - RNA, 20 nt, Mycobacterium avium subsp. paratuberculosis
cggcccguugagcaccgcga

SEQ ID NO: 820330 - RNA, 18 nt, Mycobacterium avium subsp. paratuberculosis
cggcccuauggcaucgcc

SEQ ID NO: 820331 - RNA, 23 nt, Mycobacterium avium subsp. paratuberculosis
cggcccucagguggacagaugcc

SEQ ID NO: 820332 - RNA, 20 nt, Mycobacterium avium subsp. paratuberculosis
cggccgagggcuucccacgc

SEQ ID NO: 820333 - RNA, 17 nt, Mycobacterium avium subsp. paratuberculosis
cggccgaggucaccacc

SEQ ID NO: 820334 - RNA, 21 nt, Mycobacterium avium subsp. paratuberculosis
cggccgaggucaccaccgagc

SEQ ID NO: 820335 - RNA, 16 nt, Mycobacterium avium subsp. paratuberculosis
cggccgagcgcagcgg

SEQ ID NO: 820336 - RNA, 18 nt, Mycobacterium avium subsp. paratuberculosis
cggccgagcgcagcgggg

SEQ ID NO: 820337 - RNA, 20 nt, Mycobacterium avium subsp. paratuberculosis
cggccgagcgcagcggggag

SEQ ID NO: 820338 - RNA, 15 nt, Mycobacterium avium subsp. paratuberculosis
cggccgagcgcgccg

SEQ ID NO: 820339 - RNA, 18 nt, Mycobacterium avium subsp. paratuberculosis
cggccgagcgcgccgagc

SEQ ID NO: 820340 - RNA, 20 nt, Mycobacterium avium subsp. paratuberculosis
cggccgagccgagccgaccc

SEQ ID NO: 820341 - RNA, 22 nt, Mycobacterium avium subsp. paratuberculosis
cggccgagccgagccgacccgg

SEQ ID NO: 820342 - RNA, 21 nt, Mycobacterium avium subsp. paratuberculosis
cggccgagccgaggccgaugg

SEQ ID NO: 820343 - RNA, 17 nt, Mycobacterium avium subsp. paratuberculosis
cggccgagccgaugccc

SEQ ID NO: 820344 - RNA, 22 nt, Mycobacterium avium subsp. paratuberculosis
cggccgagccgaugcccagcag

SEQ ID NO: 820345 - RNA, 19 nt, Mycobacterium avium subsp. paratuberculosis
cggccgagcgcaccgcgga

SEQ ID NO: 820346 - RNA, 22 nt, Mycobacterium avium subsp. paratuberculosis
cggccgagcgcaccgcggagcg

SEQ ID NO: 820347 - RNA, 17 nt, Mycobacterium avium subsp. paratuberculosis
cggccgacuuggucagc

SEQ ID NO: 820348 - RNA, 19 nt, Mycobacterium avium subsp. paratuberculosis
cggccgacuuggucagccc

SEQ ID NO: 820349 - RNA, 23 nt, Mycobacterium avium subsp. paratuberculosis
cggccgacuuggucagcccgcgc

SEQ ID NO: 820350 - RNA, 17 nt, Mycobacterium avium subsp. paratuberculosis
cggccgacucgaugcgc

SEQ ID NO: 820351 - RNA, 21 nt, Mycobacterium avium subsp. paratuberculosis
cggccgacucgaugcgcguga

SEQ ID NO: 820352 - RNA, 13 nt, Mycobacterium avium subsp. paratuberculosis
cggccgacgaaca

SEQ ID NO: 820353 - RNA, 19 nt, Mycobacterium avium subsp. paratuberculosis
cggccgacgaacaagggcg

SEQ ID NO: 820354 - RNA, 18 nt, Mycobacterium avium subsp. paratuberculosis
cggccgacugauccacca

SEQ ID NO: 820355 - RNA, 16 nt, Mycobacterium avium subsp. paratuberculosis
cggccgacgggcgugu

SEQ ID NO: 820356 - RNA, 20 nt, Mycobacterium avium subsp. paratuberculosis
cggccgaccggucucgaccg

SEQ ID NO: 820357 - RNA, 14 nt, Mycobacterium avium subsp. paratuberculosis
cggccgacgcccag

SEQ ID NO: 820358 - RNA, 15 nt, Mycobacterium avium subsp. paratuberculosis
cggccgacgcccagc

SEQ ID NO: 820359 - RNA, 16 nt, Mycobacterium avium subsp. paratuberculosis
cggccgacgcccagca

SEQ ID NO: 820360 - RNA, 19 nt, Mycobacterium avium subsp. paratuberculosis
cggccgacgcccagcaccg

SEQ ID NO: 820361 - RNA, 14 nt, Mycobacterium avium subsp. paratuberculosis
cggccgacgcgccg

SEQ ID NO: 820362 - RNA, 17 nt, Mycobacterium avium subsp. paratuberculosis
cggccgacgcgccgucg

SEQ ID NO: 820363 - RNA, 15 nt, Mycobacterium avium subsp. paratuberculosis
cggccgacagcgcgu

SEQ ID NO: 820364 - RNA, 14 nt, Mycobacterium avium subsp. paratuberculosis
cggccgacagggug

SEQ ID NO: 820365 - RNA, 19 nt, Mycobacterium avium subsp. paratuberculosis
cggccgacauggacgcggc

SEQ ID NO: 820366 - RNA, 20 nt, Mycobacterium avium subsp. paratuberculosis
cggccgacccugcguccggc

SEQ ID NO: 820367 - RNA, 23 nt, Mycobacterium avium subsp. paratuberculosis
cggccgacccugcguccggcccg

SEQ ID NO: 820368 - RNA, 15 nt, Mycobacterium avium subsp. paratuberculosis
cggccgaccgccucg

SEQ ID NO: 820369 - RNA, 19 nt, Mycobacterium avium subsp. paratuberculosis
cggccgaagcguuccgccg

SEQ ID NO: 820370 - RNA, 21 nt, Mycobacterium avium subsp. paratuberculosis
cggccgacaacgacagcaccc

SEQ ID NO: 820371 - RNA, 23 nt, Mycobacterium avium subsp. paratuberculosis
cggccgacaacgacagcacccag

SEQ ID NO: 820372 - RNA, 19 nt, Mycobacterium avium subsp. paratuberculosis
cggccgacaccccgaugcc

SEQ ID NO: 820373 - RNA, 20 nt, Mycobacterium avium subsp. paratuberculosis
cggccgaaaacccucagacc

SEQ ID NO: 820374 - RNA, 18 nt, Mycobacterium avium subsp. paratuberculosis
cggccgaagaccgccgaa

SEQ ID NO: 820375 - RNA, 16 nt, Mycobacterium avium subsp. paratuberculosis
cggccgaaacgcccgg

SEQ ID NO: 820376 - RNA, 18 nt, Mycobacterium avium subsp. paratuberculosis
cggccgaaacgcccggcu

SEQ ID NO: 820377 - RNA, 16 nt, Mycobacterium avium subsp. paratuberculosis
cggccgaaaucaacgc

SEQ ID NO: 820378 - RNA, 20 nt, Mycobacterium avium subsp. paratuberculosis
cggccgaaaucaacgcgccg

SEQ ID NO: 820379 - RNA, 15 nt, Mycobacterium avium subsp. paratuberculosis
cggcccuugcggccg

SEQ ID NO: 820380 - RNA, 20 nt, Mycobacterium avium subsp. paratuberculosis
cggcccuugcggccgaucac

SEQ ID NO: 820381 - RNA, 21 nt, Mycobacterium avium subsp. paratuberculosis
cggcccuugcggccgaucacc

SEQ ID NO: 820382 - RNA, 19 nt, Mycobacterium avium subsp. paratuberculosis
cggcccuguucgccgucgc

SEQ ID NO: 820383 - RNA, 21 nt, Mycobacterium avium subsp. paratuberculosis
cggcccuguucgccgucgcgg

SEQ ID NO: 820384 - RNA, 17 nt, Mycobacterium avium subsp. paratuberculosis
cggcccuucucggacgc

SEQ ID NO: 820385 - RNA, 12 nt, Mycobacterium avium subsp. paratuberculosis
cggccgccgggc

SEQ ID NO: 820386 - RNA, 15 nt, Mycobacterium avium subsp. paratuberculosis
cggccgccggcggcc

SEQ ID NO: 820387 - RNA, 16 nt, Mycobacterium avium subsp. paratuberculosis
cggccgccggcggcca

SEQ ID NO: 820388 - RNA, 22 nt, Mycobacterium avium subsp. paratuberculosis
cggccgccggcggccaauccca

SEQ ID NO: 820389 - RNA, 21 nt, Mycobacterium avium subsp. paratuberculosis
cggccgccguaucccugccag

SEQ ID NO: 820390 - RNA, 18 nt, Mycobacterium avium subsp. paratuberculosis
cggccgccgggccggcgg

SEQ ID NO: 820391 - RNA, 19 nt, Mycobacterium avium subsp. paratuberculosis
cggccgccgggccggcggc

SEQ ID NO: 820392 - RNA, 21 nt, Mycobacterium avium subsp. paratuberculosis
cggccgccggggccccaaccc

SEQ ID NO: 820393 - RNA, 20 nt, Mycobacterium avium subsp. paratuberculosis
cggccgccucccgcagcgcc

SEQ ID NO: 820394 - RNA, 22 nt, Mycobacterium avium subsp. paratuberculosis
cggccgccuccgguuugcgccg

SEQ ID NO: 820395 - RNA, 23 nt, Mycobacterium avium subsp. paratuberculosis
cggccgccuccgguuugcgccgg

SEQ ID NO: 820396 - RNA, 14 nt, Mycobacterium avium subsp. paratuberculosis
cggccgccuccagc

SEQ ID NO: 820397 - RNA, 16 nt, Mycobacterium avium subsp. paratuberculosis
cggccgccuccagcac

SEQ ID NO: 820398 - RNA, 20 nt, Mycobacterium avium subsp. paratuberculosis
cggccgccuccagcacgucg

SEQ ID NO: 820399 - RNA, 21 nt, Mycobacterium avium subsp. paratuberculosis
cggccgccuccagcacgucgg

SEQ ID NO: 820400 - RNA, 22 nt, Mycobacterium avium subsp. paratuberculosis
cggccgccuccagcacgucggg

SEQ ID NO: 820401 - RNA, 12 nt, Mycobacterium avium subsp. paratuberculosis
cggccgccucgu

SEQ ID NO: 820402 - RNA, 20 nt, Mycobacterium avium subsp. paratuberculosis
cggccgcggaauucgcgggu

SEQ ID NO: 820403 - RNA, 14 nt, Mycobacterium avium subsp. paratuberculosis
cggccgcgcgcggc

SEQ ID NO: 820404 - RNA, 17 nt, Mycobacterium avium subsp. paratuberculosis
cggccgcgcgcggcgcg

SEQ ID NO: 820405 - RNA, 15 nt, Mycobacterium avium subsp. paratuberculosis
cggccgcgccggccg

SEQ ID NO: 820406 - RNA, 13 nt, Mycobacterium avium subsp. paratuberculosis
cggccgccuggac

SEQ ID NO: 820407 - RNA, 16 nt, Mycobacterium avium subsp. paratuberculosis
cggccgccuggacgac

SEQ ID NO: 820408 - RNA, 17 nt, Mycobacterium avium subsp. paratuberculosis
cggccgccuggacgacg

SEQ ID NO: 820409 - RNA, 18 nt, Mycobacterium avium subsp. paratuberculosis
cggccgccuucacgaccg

SEQ ID NO: 820410 - RNA, 20 nt, Mycobacterium avium subsp. paratuberculosis
cggccgccuucacgaccggc

SEQ ID NO: 820411 - RNA, 23 nt, Mycobacterium avium subsp. paratuberculosis
cggccgccuucacgaccggcagc

SEQ ID NO: 820412 - RNA, 15 nt, Mycobacterium avium subsp. paratuberculosis
cggccgcccgggcgg

SEQ ID NO: 820413 - RNA, 18 nt, Mycobacterium avium subsp. paratuberculosis
cggccgcccgggcggccc

SEQ ID NO: 820414 - RNA, 19 nt, Mycobacterium avium subsp. paratuberculosis
cggccgcccgggcggcccg

SEQ ID NO: 820415 - RNA, 17 nt, Mycobacterium avium subsp. paratuberculosis
cggccgcccguccgggc

SEQ ID NO: 820416 - RNA, 19 nt, Mycobacterium avium subsp. paratuberculosis
cggccgcccguccgggccg

SEQ ID NO: 820417 - RNA, 14 nt, Mycobacterium avium subsp. paratuberculosis
cggccgcccgucgg

SEQ ID NO: 820418 - RNA, 19 nt, Mycobacterium avium subsp. paratuberculosis
cggccgcccgcaccagcag

SEQ ID NO: 820419 - RNA, 20 nt, Mycobacterium avium subsp. paratuberculosis
cggccgcccgcaccagcagg

SEQ ID NO: 820420 - RNA, 15 nt, Mycobacterium avium subsp. paratuberculosis
cggccgcccagucgc

SEQ ID NO: 820421 - RNA, 16 nt, Mycobacterium avium subsp. paratuberculosis
cggccgcccagucgcc

SEQ ID NO: 820422 - RNA, 18 nt, Mycobacterium avium subsp. paratuberculosis
cggccgcccagucgccgc

SEQ ID NO: 820423 - RNA, 21 nt, Mycobacterium avium subsp. paratuberculosis
cggccgcccagcccgcgccga

SEQ ID NO: 820424 - RNA, 22 nt, Mycobacterium avium subsp. paratuberculosis
cggccgcccagcccgcgccgag

SEQ ID NO: 820425 - RNA, 15 nt, Mycobacterium avium subsp. paratuberculosis
cggccgccagcgcgg

SEQ ID NO: 820426 - RNA, 18 nt, Mycobacterium avium subsp. paratuberculosis
cggccgccagcgcggcga

SEQ ID NO: 820427 - RNA, 21 nt, Mycobacterium avium subsp. paratuberculosis
cggccgccagcgcggcgauca

SEQ ID NO: 820428 - RNA, 14 nt, Mycobacterium avium subsp. paratuberculosis
cggccgccagggcc

SEQ ID NO: 820429 - RNA, 15 nt, Mycobacterium avium subsp. paratuberculosis
cggccgccagggcca

SEQ ID NO: 820430 - RNA, 15 nt, Mycobacterium avium subsp. paratuberculosis
cggccgccagcgccc

SEQ ID NO: 820431 - RNA, 19 nt, Mycobacterium avium subsp. paratuberculosis
cggccgccagcgcccgcgc

SEQ ID NO: 820432 - RNA, 22 nt, Mycobacterium avium subsp. paratuberculosis
cggccgccagcgcccgcgcgug

SEQ ID NO: 820433 - RNA, 16 nt, Mycobacterium avium subsp. paratuberculosis
cggccgccagcgcacc

SEQ ID NO: 820434 - RNA, 20 nt, Mycobacterium avium subsp. paratuberculosis
cggccgccagcgcaccgagc

SEQ ID NO: 820435 - RNA, 17 nt, Mycobacterium avium subsp. paratuberculosis
cggccgaugagccucag

SEQ ID NO: 820436 - RNA, 14 nt, Mycobacterium avium subsp. paratuberculosis
cggccgccagcgca

SEQ ID NO: 820437 - RNA, 17 nt, Mycobacterium avium subsp. paratuberculosis
cggccgaucauggucgg

SEQ ID NO: 820438 - RNA, 17 nt, Mycobacterium avium subsp. paratuberculosis
cggccgagucgacgugc

SEQ ID NO: 820439 - RNA, 12 nt, Mycobacterium avium subsp. paratuberculosis
cggccggcgcgc

SEQ ID NO: 820440 - RNA, 13 nt, Mycobacterium avium subsp. paratuberculosis
cggccggcgcgca

SEQ ID NO: 820441 - RNA, 15 nt, Mycobacterium avium subsp. paratuberculosis
cggccggcgcgcacg

SEQ ID NO: 820442 - RNA, 15 nt, Mycobacterium avium subsp. paratuberculosis
cggccggcccagcgc

SEQ ID NO: 820443 - RNA, 13 nt, Mycobacterium avium subsp. paratuberculosis
cggccggccccgc

SEQ ID NO: 820444 - RNA, 16 nt, Mycobacterium avium subsp. paratuberculosis
cggccggccccgcccg

SEQ ID NO: 820445 - RNA, 18 nt, Mycobacterium avium subsp. paratuberculosis
cggccggccccgcccggc

SEQ ID NO: 820446 - RNA, 14 nt, Mycobacterium avium subsp. paratuberculosis
cggccggccccggc

SEQ ID NO: 820447 - RNA, 23 nt, Mycobacterium avium subsp. paratuberculosis
cggccggccccgggggaccagcg

SEQ ID NO: 820448 - RNA, 22 nt, Mycobacterium avium subsp. paratuberculosis
cggccggccccuaccgccgagc

SEQ ID NO: 820449 - RNA, 23 nt, Mycobacterium avium subsp. paratuberculosis
cggccggccccuaccgccgagcg

SEQ ID NO: 820450 - RNA, 14 nt, Mycobacterium avium subsp. paratuberculosis
cggccggcccgccc

SEQ ID NO: 820451 - RNA, 16 nt, Mycobacterium avium subsp. paratuberculosis
cggccggcccgcccgg

SEQ ID NO: 820452 - RNA, 16 nt, Mycobacterium avium subsp. paratuberculosis
cggccggcccggcccg

SEQ ID NO: 820453 - RNA, 17 nt, Mycobacterium avium subsp. paratuberculosis
cggccggcccggcccga

SEQ ID NO: 820454 - RNA, 11 nt, Mycobacterium avium subsp. paratuberculosis
cggccggccag

SEQ ID NO: 820455 - RNA, 14 nt, Mycobacterium avium subsp. paratuberculosis
cggccggccagcag

SEQ ID NO: 820456 - RNA, 15 nt, Mycobacterium avium subsp. paratuberculosis
cggccggccagcagc

SEQ ID NO: 820457 - RNA, 16 nt, Mycobacterium avium subsp. paratuberculosis
cggccggccagcagcc

SEQ ID NO: 820458 - RNA, 17 nt, Mycobacterium avium subsp. paratuberculosis
cggccggccagcagccg

SEQ ID NO: 820459 - RNA, 21 nt, Mycobacterium avium subsp. paratuberculosis
cggccggcaguuccucgccgg

SEQ ID NO: 820460 - RNA, 23 nt, Mycobacterium avium subsp. paratuberculosis
cggccggcaguugcggccgcuuc

SEQ ID NO: 820461 - RNA, 17 nt, Mycobacterium avium subsp. paratuberculosis
cggccggcacuaccgcc

SEQ ID NO: 820462 - RNA, 23 nt, Mycobacterium avium subsp. paratuberculosis
cggccggcacuaccgccucgcca

SEQ ID NO: 820463 - RNA, 15 nt, Mycobacterium avium subsp. paratuberculosis
cggccggcagcaucg

SEQ ID NO: 820464 - RNA, 20 nt, Mycobacterium avium subsp. paratuberculosis
cggccggcagcaucgggacg

SEQ ID NO: 820465 - RNA, 16 nt, Mycobacterium avium subsp. paratuberculosis
cggccggcagcggugc

SEQ ID NO: 820466 - RNA, 14 nt, Mycobacterium avium subsp. paratuberculosis
cggccggacaccga

SEQ ID NO: 820467 - RNA, 16 nt, Mycobacterium avium subsp. paratuberculosis
cggccggacagaucgc

SEQ ID NO: 820468 - RNA, 22 nt, Mycobacterium avium subsp. paratuberculosis
cggccggacagaucgcccauca

SEQ ID NO: 820469 - RNA, 14 nt, Mycobacterium avium subsp. paratuberculosis
cggccgcuggcguu

SEQ ID NO: 820470 - RNA, 18 nt, Mycobacterium avium subsp. paratuberculosis
cggccgcuggcguugagc

SEQ ID NO: 820471 - RNA, 21 nt, Mycobacterium avium subsp. paratuberculosis
cggccgcuggcguugagcacg

SEQ ID NO: 820472 - RNA, 19 nt, Mycobacterium avium subsp. paratuberculosis
cggccgcugguggugauca

SEQ ID NO: 820473 - RNA, 17 nt, Mycobacterium avium subsp. paratuberculosis
cggccgcuucccacccg

SEQ ID NO: 820474 - RNA, 21 nt, Mycobacterium avium subsp. paratuberculosis
cggccgcucgggugucgccga

SEQ ID NO: 820475 - RNA, 16 nt, Mycobacterium avium subsp. paratuberculosis
cggccgcugcccgggc

SEQ ID NO: 820476 - RNA, 18 nt, Mycobacterium avium subsp. paratuberculosis
cggccgcugcccgggcau

SEQ ID NO: 820477 - RNA, 15 nt, Mycobacterium avium subsp. paratuberculosis
cggccgcugcgccca

SEQ ID NO: 820478 - RNA, 21 nt, Mycobacterium avium subsp. paratuberculosis
cggccgcugcgcccagcgcgc

SEQ ID NO: 820479 - RNA, 16 nt, Mycobacterium avium subsp. paratuberculosis
cggccgcugcgggcgg

SEQ ID NO: 820480 - RNA, 20 nt, Mycobacterium avium subsp. paratuberculosis
cggccgcugcgggcgggccg

SEQ ID NO: 820481 - RNA, 15 nt, Mycobacterium avium subsp. paratuberculosis
cggccgcucgcgggc

SEQ ID NO: 820482 - RNA, 20 nt, Mycobacterium avium subsp. paratuberculosis
cggccgcucgcgggccacag

SEQ ID NO: 820483 - RNA, 18 nt, Mycobacterium avium subsp. paratuberculosis
cggccgcucagcgggcgg

SEQ ID NO: 820484 - RNA, 20 nt, Mycobacterium avium subsp. paratuberculosis
cggccgcucagcgggcggcc

SEQ ID NO: 820485 - RNA, 21 nt, Mycobacterium avium subsp. paratuberculosis
cggccgcucagcgggcggcca

SEQ ID NO: 820486 - RNA, 21 nt, Mycobacterium avium subsp. paratuberculosis
cggccgcguugucgaccacca

SEQ ID NO: 820487 - RNA, 15 nt, Mycobacterium avium subsp. paratuberculosis
cggccgcuacccggc

SEQ ID NO: 820488 - RNA, 19 nt, Mycobacterium avium subsp. paratuberculosis
cggccgcuacccggcgaac

SEQ ID NO: 820489 - RNA, 15 nt, Mycobacterium avium subsp. paratuberculosis
cggccgcggcgugca

SEQ ID NO: 820490 - RNA, 23 nt, Mycobacterium avium subsp. paratuberculosis
cggccgcggcgugcaacugcgug

SEQ ID NO: 820491 - RNA, 14 nt, Mycobacterium avium subsp. paratuberculosis
cggccgcggcgcgc

SEQ ID NO: 820492 - RNA, 17 nt, Mycobacterium avium subsp. paratuberculosis
cggccgcggcgcgcauc

SEQ ID NO: 820493 - RNA, 18 nt, Mycobacterium avium subsp. paratuberculosis
cggccgcggcgcggcccg

SEQ ID NO: 820494 - RNA, 20 nt, Mycobacterium avium subsp. paratuberculosis
cggccgcggcgcggcccggc

SEQ ID NO: 820495 - RNA, 16 nt, Mycobacterium avium subsp. paratuberculosis
cggccgcggcgggcgc

SEQ ID NO: 820496 - RNA, 20 nt, Mycobacterium avium subsp. paratuberculosis
cggccgcggcggugccggug

SEQ ID NO: 820497 - RNA, 15 nt, Mycobacterium avium subsp. paratuberculosis
cggccgcggccggcg

SEQ ID NO: 820498 - RNA, 12 nt, Mycobacterium avium subsp. paratuberculosis
cggccgcggcca

SEQ ID NO: 820499 - RNA, 13 nt, Mycobacterium avium subsp. paratuberculosis
cggccgcggcccg

SEQ ID NO: 820500 - RNA, 17 nt, Mycobacterium avium subsp. paratuberculosis
cggccgcggcccggcca

SEQ ID NO: 820501 - RNA, 20 nt, Mycobacterium avium subsp. paratuberculosis
cggccgcggcccggccacca

SEQ ID NO: 820502 - RNA, 12 nt, Mycobacterium avium subsp. paratuberculosis
cggccgcggccg

SEQ ID NO: 820503 - RNA, 14 nt, Mycobacterium avium subsp. paratuberculosis
cggccgcggccggc

SEQ ID NO: 820504 - RNA, 18 nt, Mycobacterium avium subsp. paratuberculosis
cggccgcgcgugcccgcg

SEQ ID NO: 820505 - RNA, 20 nt, Mycobacterium avium subsp. paratuberculosis
cggccgcgcgugcccgcggu

SEQ ID NO: 820506 - RNA, 17 nt, Mycobacterium avium subsp. paratuberculosis
cggccgcgcgugcgcaa

SEQ ID NO: 820507 - RNA, 17 nt, Mycobacterium avium subsp. paratuberculosis
cggccgcggacccgacg

SEQ ID NO: 820508 - RNA, 15 nt, Mycobacterium avium subsp. paratuberculosis
cggccgcggaugacc

SEQ ID NO: 820509 - RNA, 21 nt, Mycobacterium avium subsp. paratuberculosis
cggccgcggauuccggcaucg

SEQ ID NO: 820510 - RNA, 17 nt, Mycobacterium avium subsp. paratuberculosis
cggcuuggugggcgccg

SEQ ID NO: 820511 - RNA, 20 nt, Mycobacterium avium subsp. paratuberculosis
cggcuuggugggcgccggcg

SEQ ID NO: 820512 - RNA, 21 nt, Mycobacterium avium subsp. paratuberculosis
cggcuuggugggcgccggcgu

SEQ ID NO: 820513 - RNA, 18 nt, Mycobacterium avium subsp. paratuberculosis
cggcuuggucaccagcuc

SEQ ID NO: 820514 - RNA, 16 nt, Mycobacterium avium subsp. paratuberculosis
cggcuucagucccgcg

SEQ ID NO: 820515 - RNA, 17 nt, Mycobacterium avium subsp. paratuberculosis
cggcuucagucccgcga

SEQ ID NO: 820516 - RNA, 20 nt, Mycobacterium avium subsp. paratuberculosis
cggcuucauaugacgccggc

SEQ ID NO: 820517 - RNA, 22 nt, Mycobacterium avium subsp. paratuberculosis
cggcuucauaugacgccggccu

SEQ ID NO: 820518 - RNA, 17 nt, Mycobacterium avium subsp. paratuberculosis
cggcuuccgagccggug

SEQ ID NO: 820519 - RNA, 18 nt, Mycobacterium avium subsp. paratuberculosis
cggcuuccuccucggcgc

SEQ ID NO: 820520 - RNA, 21 nt, Mycobacterium avium subsp. paratuberculosis
cggcuuccuccucggcgcgga

SEQ ID NO: 820521 - RNA, 13 nt, Mycobacterium avium subsp. paratuberculosis
cggcuucgccgcc

SEQ ID NO: 820522 - RNA, 18 nt, Mycobacterium avium subsp. paratuberculosis
cggcuucgccgccgcacc

SEQ ID NO: 820523 - RNA, 21 nt, Mycobacterium avium subsp. paratuberculosis
cggcuuggggaagccggccag

SEQ ID NO: 820524 - RNA, 20 nt, Mycobacterium avium subsp. paratuberculosis
cgggaaacccucgacgccgg

SEQ ID NO: 820525 - RNA, 19 nt, Mycobacterium avium subsp. paratuberculosis
cgggaaagcgggugaccga

SEQ ID NO: 820526 - RNA, 15 nt, Mycobacterium avium subsp. paratuberculosis
cgggaacaccacguc

SEQ ID NO: 820527 - RNA, 19 nt, Mycobacterium avium subsp. paratuberculosis
cgggaacacguagcgaucg

SEQ ID NO: 820528 - RNA, 16 nt, Mycobacterium avium subsp. paratuberculosis
cgggaaaugcgucgcc

SEQ ID NO: 820529 - RNA, 19 nt, Mycobacterium avium subsp. paratuberculosis
cgggaaaugcgucggcagu

SEQ ID NO: 820530 - RNA, 21 nt, Mycobacterium avium subsp. paratuberculosis
cgggaaaguuguagcgcagca

SEQ ID NO: 820531 - RNA, 23 nt, Mycobacterium avium subsp. paratuberculosis
cgggaaaguuguagcgcagcauc

SEQ ID NO: 820532 - RNA, 19 nt, Mycobacterium avium subsp. paratuberculosis
cggcuggcgggcgaucgcc

SEQ ID NO: 820533 - RNA, 22 nt, Mycobacterium avium subsp. paratuberculosis
cggcuggcgggcgaucgccucg

SEQ ID NO: 820534 - RNA, 15 nt, Mycobacterium avium subsp. paratuberculosis
cggcuggccgucguc

SEQ ID NO: 820535 - RNA, 19 nt, Mycobacterium avium subsp. paratuberculosis
cggcuggccgucgucgagg

SEQ ID NO: 820536 - RNA, 12 nt, Mycobacterium avium subsp. paratuberculosis
cggcuggccgca

SEQ ID NO: 820537 - RNA, 14 nt, Mycobacterium avium subsp. paratuberculosis
cggcuggccgcaca

SEQ ID NO: 820538 - RNA, 15 nt, Mycobacterium avium subsp. paratuberculosis
cggcuggccgcggcg

SEQ ID NO: 820539 - RNA, 18 nt, Mycobacterium avium subsp. paratuberculosis
cggcuggccgcggcgauc

SEQ ID NO: 820540 - RNA, 19 nt, Mycobacterium avium subsp. paratuberculosis
cggcuggccgcggcgaucg

SEQ ID NO: 820541 - RNA, 21 nt, Mycobacterium avium subsp. paratuberculosis
cggcuggccgcggcgaucggc

SEQ ID NO: 820542 - RNA, 13 nt, Mycobacterium avium subsp. paratuberculosis
cggcuggccgucg

SEQ ID NO: 820543 - RNA, 18 nt, Mycobacterium avium subsp. paratuberculosis
cggcuggcgugcggcgcg

SEQ ID NO: 820544 - RNA, 16 nt, Mycobacterium avium subsp. paratuberculosis
cggcugggccgcggcg

SEQ ID NO: 820545 - RNA, 18 nt, Mycobacterium avium subsp. paratuberculosis
cggcugggccgcggcgcc

SEQ ID NO: 820546 - RNA, 19 nt, Mycobacterium avium subsp. paratuberculosis
cggcugucguagcggccca

SEQ ID NO: 820547 - RNA, 22 nt, Mycobacterium avium subsp. paratuberculosis
cggcuuaccgaccucgaggccg

SEQ ID NO: 820548 - RNA, 20 nt, Mycobacterium avium subsp. paratuberculosis
cggcuuaccggcgggcggcg

SEQ ID NO: 820549 - RNA, 16 nt, Mycobacterium avium subsp. paratuberculosis
cggcuguagcacccgg

SEQ ID NO: 820550 - RNA, 20 nt, Mycobacterium avium subsp. paratuberculosis
cggcuguagcacccggccgg

SEQ ID NO: 820551 - RNA, 23 nt, Mycobacterium avium subsp. paratuberculosis
cggcuguagcacccggccggcga

SEQ ID NO: 820552 - RNA, 16 nt, Mycobacterium avium subsp. paratuberculosis
cggcuggugccgccgg

SEQ ID NO: 820553 - RNA, 13 nt, Mycobacterium avium subsp. paratuberculosis
cggcuggucggcc

SEQ ID NO: 820554 - RNA, 14 nt, Mycobacterium avium subsp. paratuberculosis
cggcuggucggccu

SEQ ID NO: 820555 - RNA, 15 nt, Mycobacterium avium subsp. paratuberculosis
cggcuggucggcggg

SEQ ID NO: 820556 - RNA, 16 nt, Mycobacterium avium subsp. paratuberculosis
cggcuggucggcgggu

SEQ ID NO: 820557 - RNA, 18 nt, Mycobacterium avium subsp. paratuberculosis
cggcuccccgaccacacc

SEQ ID NO: 820558 - RNA, 22 nt, Mycobacterium avium subsp. paratuberculosis
cggcuccccgaccacaccggcg

SEQ ID NO: 820559 - RNA, 19 nt, Mycobacterium avium subsp. paratuberculosis
cggcuccauguccggagcg

SEQ ID NO: 820560 - RNA, 13 nt, Mycobacterium avium subsp. paratuberculosis
cggcucccaggcc

SEQ ID NO: 820561 - RNA, 22 nt, Mycobacterium avium subsp. paratuberculosis
cggcucggugcgccagaucagc

SEQ ID NO: 820562 - RNA, 15 nt, Mycobacterium avium subsp. paratuberculosis
cggcucguagcgggc

SEQ ID NO: 820563 - RNA, 17 nt, Mycobacterium avium subsp. paratuberculosis
cggcucguagcuggugc

SEQ ID NO: 820564 - RNA, 19 nt, Mycobacterium avium subsp. paratuberculosis
cggcuccgagcggaugccg

SEQ ID NO: 820565 - RNA, 17 nt, Mycobacterium avium subsp. paratuberculosis
cggcucgggggugucgu

SEQ ID NO: 820566 - RNA, 14 nt, Mycobacterium avium subsp. paratuberculosis
cggcucggggucgg

SEQ ID NO: 820567 - RNA, 16 nt, Mycobacterium avium subsp. paratuberculosis
cggcucggggucggcc

SEQ ID NO: 820568 - RNA, 18 nt, Mycobacterium avium subsp. paratuberculosis
cggcucggggucggccga

SEQ ID NO: 820569 - RNA, 19 nt, Mycobacterium avium subsp. paratuberculosis
cggcucgguaugcggcgac

SEQ ID NO: 820570 - RNA, 20 nt, Mycobacterium avium subsp. paratuberculosis
cggcucgguaugcggcgacg

SEQ ID NO: 820571 - RNA, 17 nt, Mycobacterium avium subsp. paratuberculosis
cggcucggucaagccgg

SEQ ID NO: 820572 - RNA, 19 nt, Mycobacterium avium subsp. paratuberculosis
cggcucggucaagccggcc

SEQ ID NO: 820573 - RNA, 22 nt, Mycobacterium avium subsp. paratuberculosis
cggcucggucaagccggccagc

SEQ ID NO: 820574 - RNA, 23 nt, Mycobacterium avium subsp. paratuberculosis
cggcucggucaagccggccagca

SEQ ID NO: 820575 - RNA, 15 nt, Mycobacterium avium subsp. paratuberculosis
cggcucggucgcgaa

SEQ ID NO: 820576 - RNA, 16 nt, Mycobacterium avium subsp. paratuberculosis
cggcucguccagcccg

SEQ ID NO: 820577 - RNA, 19 nt, Mycobacterium avium subsp. paratuberculosis
cggcucguccagcccgguc

SEQ ID NO: 820578 - RNA, 20 nt, Mycobacterium avium subsp. paratuberculosis
cggcucguccagcccgguca

SEQ ID NO: 820579 - RNA, 13 nt, Mycobacterium avium subsp. paratuberculosis
cggcucgucggcg

SEQ ID NO: 820580 - RNA, 14 nt, Mycobacterium avium subsp. paratuberculosis
cggcucgucggcga

SEQ ID NO: 820581 - RNA, 17 nt, Mycobacterium avium subsp. paratuberculosis
cggcucgucggcgaaca

SEQ ID NO: 820582 - RNA, 20 nt, Mycobacterium avium subsp. paratuberculosis
cggcucgucggcgaacagug

SEQ ID NO: 820583 - RNA, 19 nt, Mycobacterium avium subsp. paratuberculosis
cggcucguggaacgacgcc

SEQ ID NO: 820584 - RNA, 20 nt, Mycobacterium avium subsp. paratuberculosis
cggcucguggaacgacgcca

SEQ ID NO: 820585 - RNA, 15 nt, Mycobacterium avium subsp. paratuberculosis
cggcucguggguggu

SEQ ID NO: 820586 - RNA, 18 nt, Mycobacterium avium subsp. paratuberculosis
cggcucguggguggucug

SEQ ID NO: 820587 - RNA, 20 nt, Mycobacterium avium subsp. paratuberculosis
cggcucguguccgaugacga

SEQ ID NO: 820588 - RNA, 18 nt, Mycobacterium avium subsp. paratuberculosis
cggcucguugagcacaca

SEQ ID NO: 820589 - RNA, 21 nt, Mycobacterium avium subsp. paratuberculosis
cggcucuccaucuucggcacg

SEQ ID NO: 820590 - RNA, 16 nt, Mycobacterium avium subsp. paratuberculosis
cggcucuucgcggcgg

SEQ ID NO: 820591 - RNA, 20 nt, Mycobacterium avium subsp. paratuberculosis
cggcucuucgcggcggggca

SEQ ID NO: 820592 - RNA, 15 nt, Mycobacterium avium subsp. paratuberculosis
cggcucuucggcgcc

SEQ ID NO: 820593 - RNA, 17 nt, Mycobacterium avium subsp. paratuberculosis
cggcucuucggcgccga

SEQ ID NO: 820594 - RNA, 18 nt, Mycobacterium avium subsp. paratuberculosis
cggcucuucggcgccgag

SEQ ID NO: 820595 - RNA, 21 nt, Mycobacterium avium subsp. paratuberculosis
cggcucuucggcgccgagcgu

SEQ ID NO: 820596 - RNA, 15 nt, Mycobacterium avium subsp. paratuberculosis
cggcugacccgcccg

SEQ ID NO: 820597 - RNA, 15 nt, Mycobacterium avium subsp. paratuberculosis
cggcugaccgagcgg

SEQ ID NO: 820598 - RNA, 20 nt, Mycobacterium avium subsp. paratuberculosis
cggcugaccgagcggcgcug

SEQ ID NO: 820599 - RNA, 18 nt, Mycobacterium avium subsp. paratuberculosis
cggcugaagcgcugggac

SEQ ID NO: 820600 - RNA, 22 nt, Mycobacterium avium subsp. paratuberculosis
cggcugaagcgcugggacagcg

SEQ ID NO: 820601 - RNA, 19 nt, Mycobacterium avium subsp. paratuberculosis
cggcucuuggcgaccucgu

SEQ ID NO: 820602 - RNA, 14 nt, Mycobacterium avium subsp. paratuberculosis
cggcugaaccaccg

SEQ ID NO: 820603 - RNA, 17 nt, Mycobacterium avium subsp. paratuberculosis
cggcugaaccaccgcgc

SEQ ID NO: 820604 - RNA, 20 nt, Mycobacterium avium subsp. paratuberculosis
cggcugaaccaccgcgccca

SEQ ID NO: 820605 - RNA, 16 nt, Mycobacterium avium subsp. paratuberculosis
cggcugaaccugcugg

SEQ ID NO: 820606 - RNA, 17 nt, Mycobacterium avium subsp. paratuberculosis
cggcugaacgccagcag

SEQ ID NO: 820607 - RNA, 20 nt, Mycobacterium avium subsp. paratuberculosis
cggcugaacgccagcagccg

SEQ ID NO: 820608 - RNA, 16 nt, Mycobacterium avium subsp. paratuberculosis
cggcugcaucaugccg

SEQ ID NO: 820609 - RNA, 19 nt, Mycobacterium avium subsp. paratuberculosis
cggcugcaucaugccgccc

SEQ ID NO: 820610 - RNA, 20 nt, Mycobacterium avium subsp. paratuberculosis
cggcugcaucaugccgccca

SEQ ID NO: 820611 - RNA, 23 nt, Mycobacterium avium subsp. paratuberculosis
cggcugcaucaugccgcccauca

SEQ ID NO: 820612 - RNA, 22 nt, Mycobacterium avium subsp. paratuberculosis
cggcugcacccucugccacggc

SEQ ID NO: 820613 - RNA, 15 nt, Mycobacterium avium subsp. paratuberculosis
cggcugaccggcggu

SEQ ID NO: 820614 - RNA, 17 nt, Mycobacterium avium subsp. paratuberculosis
cggcugaccggcggugc

SEQ ID NO: 820615 - RNA, 21 nt, Mycobacterium avium subsp. paratuberculosis
cggcugaccggcggugccggc

SEQ ID NO: 820616 - RNA, 12 nt, Mycobacterium avium subsp. paratuberculosis
cggcugcagcag

SEQ ID NO: 820617 - RNA, 17 nt, Mycobacterium avium subsp. paratuberculosis
cggcugcagccgggcgg

SEQ ID NO: 820618 - RNA, 17 nt, Mycobacterium avium subsp. paratuberculosis
cggcugcgggccagcgc

SEQ ID NO: 820619 - RNA, 18 nt, Mycobacterium avium subsp. paratuberculosis
cggcugcgggccagcgca

SEQ ID NO: 820620 - RNA, 21 nt, Mycobacterium avium subsp. paratuberculosis
cggcugcgguuggccggccgg

SEQ ID NO: 820621 - RNA, 14 nt, Mycobacterium avium subsp. paratuberculosis
cggcugcugcacga

SEQ ID NO: 820622 - RNA, 23 nt, Mycobacterium avium subsp. paratuberculosis
cggcugcugcacgacgaccgcga

SEQ ID NO: 820623 - RNA, 21 nt, Mycobacterium avium subsp. paratuberculosis
cggcugcugcagcgcccgggc

SEQ ID NO: 820624 - RNA, 22 nt, Mycobacterium avium subsp. paratuberculosis
cggcugcugcagcgcccgggcc

SEQ ID NO: 820625 - RNA, 12 nt, Mycobacterium avium subsp. paratuberculosis
cggcugcucgaa

SEQ ID NO: 820626 - RNA, 14 nt, Mycobacterium avium subsp. paratuberculosis
cggcugcugcgcgg

SEQ ID NO: 820627 - RNA, 17 nt, Mycobacterium avium subsp. paratuberculosis
cggcugcugcgcggcac

SEQ ID NO: 820628 - RNA, 18 nt, Mycobacterium avium subsp. paratuberculosis
cggcugcugcgcggcacg

SEQ ID NO: 820629 - RNA, 19 nt, Mycobacterium avium subsp. paratuberculosis
cggcugcugcgcggcacgg

SEQ ID NO: 820630 - RNA, 16 nt, Mycobacterium avium subsp. paratuberculosis
cggcuggcccggcgcg

SEQ ID NO: 820631 - RNA, 20 nt, Mycobacterium avium subsp. paratuberculosis
cggcuggcccggcgcggcgg

SEQ ID NO: 820632 - RNA, 23 nt, Mycobacterium avium subsp. paratuberculosis
cggcuggcccggcgcggcggcgc

SEQ ID NO: 820633 - RNA, 13 nt, Mycobacterium avium subsp. paratuberculosis
cggcuggccgagc

SEQ ID NO: 820634 - RNA, 16 nt, Mycobacterium avium subsp. paratuberculosis
cggcuggccgagcggc

SEQ ID NO: 820635 - RNA, 21 nt, Mycobacterium avium subsp. paratuberculosis
cggcuggccgagcggcugcug

SEQ ID NO: 820636 - RNA, 15 nt, Mycobacterium avium subsp. paratuberculosis
cggcugcuggucgac

SEQ ID NO: 820637 - RNA, 16 nt, Mycobacterium avium subsp. paratuberculosis
cggcugcuggucgacg

SEQ ID NO: 820638 - RNA, 21 nt, Mycobacterium avium subsp. paratuberculosis
cggcugcuggucgacgucauc

SEQ ID NO: 820639 - RNA, 23 nt, Mycobacterium avium subsp. paratuberculosis
cggcugcuguucguccgugcugc

SEQ ID NO: 820640 - RNA, 20 nt, Mycobacterium avium subsp. paratuberculosis
cggcuggaacaucccggagc

SEQ ID NO: 820641 - RNA, 22 nt, Mycobacterium avium subsp. paratuberculosis
cggcuggaacaucccggagccg

SEQ ID NO: 820642 - RNA, 20 nt, Mycobacterium avium subsp. paratuberculosis
cggcuggaaucccgccucgg

SEQ ID NO: 820643 - RNA, 17 nt, Mycobacterium avium subsp. paratuberculosis
cggcuggacacccccga

SEQ ID NO: 820644 - RNA, 18 nt, Mycobacterium avium subsp. paratuberculosis
cggcugcgcguucggcgc

SEQ ID NO: 820645 - RNA, 19 nt, Mycobacterium avium subsp. paratuberculosis
cggcugcgcguucggcgcc

SEQ ID NO: 820646 - RNA, 16 nt, Mycobacterium avium subsp. paratuberculosis
cggcugcgccgcgcuu

SEQ ID NO: 820647 - RNA, 20 nt, Mycobacterium avium subsp. paratuberculosis
cggcugcgcagcgcagcacc

SEQ ID NO: 820648 - RNA, 21 nt, Mycobacterium avium subsp. paratuberculosis
cggcugcgcagcgcagcacca

SEQ ID NO: 820649 - RNA, 17 nt, Mycobacterium avium subsp. paratuberculosis
cggcugccggccaaggc

SEQ ID NO: 820650 - RNA, 15 nt, Mycobacterium avium subsp. paratuberculosis
cggcugccgaccucg

SEQ ID NO: 820651 - RNA, 19 nt, Mycobacterium avium subsp. paratuberculosis
cggcugccgaccucgaugg

SEQ ID NO: 820652 - RNA, 21 nt, Mycobacterium avium subsp. paratuberculosis
cggcugccgaccucgauggcg

SEQ ID NO: 820653 - RNA, 16 nt, Mycobacterium avium subsp. paratuberculosis
cggcugcccgacccgc

SEQ ID NO: 820654 - RNA, 18 nt, Mycobacterium avium subsp. paratuberculosis
cggcugcccgacccgcac

SEQ ID NO: 820655 - RNA, 23 nt, Mycobacterium avium subsp. paratuberculosis
cggcugcccgacccgcaccaccg

SEQ ID NO: 820656 - RNA, 14 nt, Mycobacterium avium subsp. paratuberculosis
cggcugcccgcgac

SEQ ID NO: 820657 - RNA, 15 nt, Mycobacterium avium subsp. paratuberculosis
cggcugcccgcgacu

SEQ ID NO: 820658 - RNA, 21 nt, Mycobacterium avium subsp. paratuberculosis
cggcugcccgcgacugucggc

SEQ ID NO: 820659 - RNA, 21 nt, Mycobacterium avium subsp. paratuberculosis
cggcugcccgcgcggcucaca

SEQ ID NO: 820660 - RNA, 15 nt, Mycobacterium avium subsp. paratuberculosis
cggcugcccggcccg

SEQ ID NO: 820661 - RNA, 18 nt, Mycobacterium avium subsp. paratuberculosis
cggcugcccggcccgccg

SEQ ID NO: 820662 - RNA, 14 nt, Mycobacterium avium subsp. paratuberculosis
cggcguuguggcca

SEQ ID NO: 820663 - RNA, 16 nt, Mycobacterium avium subsp. paratuberculosis
cggcguuguggccacc

SEQ ID NO: 820664 - RNA, 18 nt, Mycobacterium avium subsp. paratuberculosis
cggcguuggcggcgucga

SEQ ID NO: 820665 - RNA, 13 nt, Mycobacterium avium subsp. paratuberculosis
cggcguuggcgua

SEQ ID NO: 820666 - RNA, 18 nt, Mycobacterium avium subsp. paratuberculosis
cggcguugguccacacgu

SEQ ID NO: 820667 - RNA, 13 nt, Mycobacterium avium subsp. paratuberculosis
cggcuaagccggc

SEQ ID NO: 820668 - RNA, 14 nt, Mycobacterium avium subsp. paratuberculosis
cggcuaagccggcg

SEQ ID NO: 820669 - RNA, 18 nt, Mycobacterium avium subsp. paratuberculosis
cggcuaagccggcgucgg

SEQ ID NO: 820670 - RNA, 18 nt, Mycobacterium avium subsp. paratuberculosis
cggcucaaaccguugacc

SEQ ID NO: 820671 - RNA, 22 nt, Mycobacterium avium subsp. paratuberculosis
cggcucaaaccguugaccacca

SEQ ID NO: 820672 - RNA, 23 nt, Mycobacterium avium subsp. paratuberculosis
cggcucaaaccguugaccaccag

SEQ ID NO: 820673 - RNA, 12 nt, Mycobacterium avium subsp. paratuberculosis
cggcucaacggc

SEQ ID NO: 820674 - RNA, 14 nt, Mycobacterium avium subsp. paratuberculosis
cggcucaacggccg

SEQ ID NO: 820675 - RNA, 15 nt, Mycobacterium avium subsp. paratuberculosis
cggcucaacggccgg

SEQ ID NO: 820676 - RNA, 16 nt, Mycobacterium avium subsp. paratuberculosis
cggcucaacggccggc

SEQ ID NO: 820677 - RNA, 17 nt, Mycobacterium avium subsp. paratuberculosis
cggcucaacggccggcg

SEQ ID NO: 820678 - RNA, 18 nt, Mycobacterium avium subsp. paratuberculosis
cggcucaacggccggcgc

SEQ ID NO: 820679 - RNA, 20 nt, Mycobacterium avium subsp. paratuberculosis
cggcucaacggccggcgccg

SEQ ID NO: 820680 - RNA, 13 nt, Mycobacterium avium subsp. paratuberculosis
cggcuccacagca

SEQ ID NO: 820681 - RNA, 21 nt, Mycobacterium avium subsp. paratuberculosis
cggcuccacagcaguuccgac

SEQ ID NO: 820682 - RNA, 13 nt, Mycobacterium avium subsp. paratuberculosis
cggcuccaccgcg

SEQ ID NO: 820683 - RNA, 15 nt, Mycobacterium avium subsp. paratuberculosis
cggcuccaccgcgcc

SEQ ID NO: 820684 - RNA, 21 nt, Mycobacterium avium subsp. paratuberculosis
cggcuccaccgcgccggcggc

SEQ ID NO: 820685 - RNA, 14 nt, Mycobacterium avium subsp. paratuberculosis
cggcuccagcgccc

SEQ ID NO: 820686 - RNA, 16 nt, Mycobacterium avium subsp. paratuberculosis
cggcuccagcgcccgc

SEQ ID NO: 820687 - RNA, 18 nt, Mycobacterium avium subsp. paratuberculosis
cggcuccagcgcccgccg

SEQ ID NO: 820688 - RNA, 19 nt, Mycobacterium avium subsp. paratuberculosis
cggcguugaccaacgccgc

SEQ ID NO: 820689 - RNA, 17 nt, Mycobacterium avium subsp. paratuberculosis
cggcguugaccgggccg

SEQ ID NO: 820690 - RNA, 20 nt, Mycobacterium avium subsp. paratuberculosis
cggcguugaccgggccgcug

SEQ ID NO: 820691 - RNA, 21 nt, Mycobacterium avium subsp. paratuberculosis
cggcguugaccgggccgcugg

SEQ ID NO: 820692 - RNA, 21 nt, Mycobacterium avium subsp. paratuberculosis
cggcguguuccuugcggccgc

SEQ ID NO: 820693 - RNA, 23 nt, Mycobacterium avium subsp. paratuberculosis
cggcguguuccuugcggccgccg

SEQ ID NO: 820694 - RNA, 21 nt, Mycobacterium avium subsp. paratuberculosis
cggcguguuguagucagaccc

SEQ ID NO: 820695 - RNA, 20 nt, Mycobacterium avium subsp. paratuberculosis
cggcgugucggcgccaccgg

SEQ ID NO: 820696 - RNA, 14 nt, Mycobacterium avium subsp. paratuberculosis
cggcgugucgggug

SEQ ID NO: 820697 - RNA, 17 nt, Mycobacterium avium subsp. paratuberculosis
cggcgugucgggugcuu

SEQ ID NO: 820698 - RNA, 13 nt, Mycobacterium avium subsp. paratuberculosis
cggcguuggccgc

SEQ ID NO: 820699 - RNA, 15 nt, Mycobacterium avium subsp. paratuberculosis
cggcguuggccgccg

SEQ ID NO: 820700 - RNA, 17 nt, Mycobacterium avium subsp. paratuberculosis
cggcguuggccgccgcc

SEQ ID NO: 820701 - RNA, 15 nt, Mycobacterium avium subsp. paratuberculosis
cggcguugcuggcgc

SEQ ID NO: 820702 - RNA, 17 nt, Mycobacterium avium subsp. paratuberculosis
cggcguugcuggcgcga

SEQ ID NO: 820703 - RNA, 22 nt, Mycobacterium avium subsp. paratuberculosis
cggcguugcuggcgcgauagcc

SEQ ID NO: 820704 - RNA, 15 nt, Mycobacterium avium subsp. paratuberculosis
cggcguuggacagcu

SEQ ID NO: 820705 - RNA, 17 nt, Mycobacterium avium subsp. paratuberculosis
cggcguuggacagcucg

SEQ ID NO: 820706 - RNA, 18 nt, Mycobacterium avium subsp. paratuberculosis
cggcguugccgccggcgc

SEQ ID NO: 820707 - RNA, 21 nt, Mycobacterium avium subsp. paratuberculosis
cggcguugccgccggcgcggu

SEQ ID NO: 820708 - RNA, 21 nt, Mycobacterium avium subsp. paratuberculosis
cggcguugcgcaacacguuga

SEQ ID NO: 820709 - RNA, 15 nt, Mycobacterium avium subsp. paratuberculosis
cggcguugacgauga

SEQ ID NO: 820710 - RNA, 20 nt, Mycobacterium avium subsp. paratuberculosis
cggcguugacgaugacgcgg

SEQ ID NO: 820711 - RNA, 17 nt, Mycobacterium avium subsp. paratuberculosis
cggcguugagccggcgc

SEQ ID NO: 820712 - RNA, 18 nt, Mycobacterium avium subsp. paratuberculosis
cggcguugagccggcgca

SEQ ID NO: 820713 - RNA, 19 nt, Mycobacterium avium subsp. paratuberculosis
cggcguugagccggcgcac

SEQ ID NO: 820714 - RNA, 20 nt, Mycobacterium avium subsp. paratuberculosis
cggcguugagccggcgcacc

SEQ ID NO: 820715 - RNA, 20 nt, Mycobacterium avium subsp. paratuberculosis
cggcguugaggcguugcgga

SEQ ID NO: 820716 - RNA, 21 nt, Mycobacterium avium subsp. paratuberculosis
cggcguugaggcguugcggau

SEQ ID NO: 820717 - RNA, 19 nt, Mycobacterium avium subsp. paratuberculosis
cggcguugcauuucggcgu

SEQ ID NO: 820718 - RNA, 15 nt, Mycobacterium avium subsp. paratuberculosis
cggcguugcccgcug

SEQ ID NO: 820719 - RNA, 16 nt, Mycobacterium avium subsp. paratuberculosis
cggcguugcccgcugc

SEQ ID NO: 820720 - RNA, 14 nt, Mycobacterium avium subsp. paratuberculosis
cggcguugccgccg

SEQ ID NO: 820721 - RNA, 18 nt, Mycobacterium avium subsp. paratuberculosis
cggcgugauaggccucgu

SEQ ID NO: 820722 - RNA, 19 nt, Mycobacterium avium subsp. paratuberculosis
cggcgugauaggccucgug

SEQ ID NO: 820723 - RNA, 21 nt, Mycobacterium avium subsp. paratuberculosis
cggcgugauaggccucgugga

SEQ ID NO: 820724 - RNA, 22 nt, Mycobacterium avium subsp. paratuberculosis
cggcgugaucccgauccucgcc

SEQ ID NO: 820725 - RNA, 17 nt, Mycobacterium avium subsp. paratuberculosis
cggcgugagcgagccgg

SEQ ID NO: 820726 - RNA, 21 nt, Mycobacterium avium subsp. paratuberculosis
cggcgugagcgagccggcacg

SEQ ID NO: 820727 - RNA, 20 nt, Mycobacterium avium subsp. paratuberculosis
cggcgugcacaggccgccgc

SEQ ID NO: 820728 - RNA, 18 nt, Mycobacterium avium subsp. paratuberculosis
cggcgugcagcacgggga

SEQ ID NO: 820729 - RNA, 20 nt, Mycobacterium avium subsp. paratuberculosis
cggcgugcagcacggggacg

SEQ ID NO: 820730 - RNA, 16 nt, Mycobacterium avium subsp. paratuberculosis
cggcgugaugacggcg

SEQ ID NO: 820731 - RNA, 20 nt, Mycobacterium avium subsp. paratuberculosis
cggcgugaugacggcggcgg

SEQ ID NO: 820732 - RNA, 14 nt, Mycobacterium avium subsp. paratuberculosis
cggcgugcaccgcc

SEQ ID NO: 820733 - RNA, 16 nt, Mycobacterium avium subsp. paratuberculosis
cggcgugcaccgcccg

SEQ ID NO: 820734 - RNA, 13 nt, Mycobacterium avium subsp. paratuberculosis
cggcgugcagccg

SEQ ID NO: 820735 - RNA, 20 nt, Mycobacterium avium subsp. paratuberculosis
cggcguguagccguaacgau

SEQ ID NO: 820736 - RNA, 16 nt, Mycobacterium avium subsp. paratuberculosis
cggcguguaguacugc

SEQ ID NO: 820737 - RNA, 23 nt, Mycobacterium avium subsp. paratuberculosis
cggcguguaguacugcucgacgu

SEQ ID NO: 820738 - RNA, 20 nt, Mycobacterium avium subsp. paratuberculosis
cggcgugaauccucagcacg

SEQ ID NO: 820739 - RNA, 14 nt, Mycobacterium avium subsp. paratuberculosis
cggcgucgggaccg

SEQ ID NO: 820740 - RNA, 21 nt, Mycobacterium avium subsp. paratuberculosis
cggcgucgggaccgucgcgca

SEQ ID NO: 820741 - RNA, 14 nt, Mycobacterium avium subsp. paratuberculosis
cggcgucgggaugg

SEQ ID NO: 820742 - RNA, 20 nt, Mycobacterium avium subsp. paratuberculosis
cggcgucgggauggucgauc

SEQ ID NO: 820743 - RNA, 13 nt, Mycobacterium avium subsp. paratuberculosis
cggcgucgggccg

SEQ ID NO: 820744 - RNA, 21 nt, Mycobacterium avium subsp. paratuberculosis
cggcgucgggccgggggcggc

SEQ ID NO: 820745 - RNA, 22 nt, Mycobacterium avium subsp. paratuberculosis
cggcgucgggccgggggcggcg

SEQ ID NO: 820746 - RNA, 23 nt, Mycobacterium avium subsp. paratuberculosis
cggcgucgggccgggggcggcgg

SEQ ID NO: 820747 - RNA, 16 nt, Mycobacterium avium subsp. paratuberculosis
cggcgucggcggccug

SEQ ID NO: 820748 - RNA, 22 nt, Mycobacterium avium subsp. paratuberculosis
cggcgucggcguagggcagccc

SEQ ID NO: 820749 - RNA, 14 nt, Mycobacterium avium subsp. paratuberculosis
cggcgucggcgucc

SEQ ID NO: 820750 - RNA, 15 nt, Mycobacterium avium subsp. paratuberculosis
cggcgucggcgagcg

SEQ ID NO: 820751 - RNA, 24 nt, Mycobacterium avium subsp. paratuberculosis
cggcgucggcgaucucggucaccg

SEQ ID NO: 820752 - RNA, 14 nt, Mycobacterium avium subsp. paratuberculosis
cggcgucggccacc

SEQ ID NO: 820753 - RNA, 13 nt, Mycobacterium avium subsp. paratuberculosis
cggcgucggcgac

SEQ ID NO: 820754 - RNA, 16 nt, Mycobacterium avium subsp. paratuberculosis
cggcgucggcgacggc

SEQ ID NO: 820755 - RNA, 22 nt, Mycobacterium avium subsp. paratuberculosis
cggcgucggagaugcgggccac

SEQ ID NO: 820756 - RNA, 14 nt, Mycobacterium avium subsp. paratuberculosis
cggcgucggaggcg

SEQ ID NO: 820757 - RNA, 22 nt, Mycobacterium avium subsp. paratuberculosis
cggcgucggagucgcuguuggc

SEQ ID NO: 820758 - RNA, 17 nt, Mycobacterium avium subsp. paratuberculosis
cggcgucgcugaacgcg

SEQ ID NO: 820759 - RNA, 15 nt, Mycobacterium avium subsp. paratuberculosis
cggcgucggccaccg

SEQ ID NO: 820760 - RNA, 19 nt, Mycobacterium avium subsp. paratuberculosis
cggcgucggccaccgcgcc

SEQ ID NO: 820761 - RNA, 18 nt, Mycobacterium avium subsp. paratuberculosis
cggcgucggccgggcugc

SEQ ID NO: 820762 - RNA, 12 nt, Mycobacterium avium subsp. paratuberculosis
cggcgucgccgc

SEQ ID NO: 820763 - RNA, 14 nt, Mycobacterium avium subsp. paratuberculosis
cggcgucgcggcgc

SEQ ID NO: 820764 - RNA, 17 nt, Mycobacterium avium subsp. paratuberculosis
cggcgucgcggcgcacc

SEQ ID NO: 820765 - RNA, 20 nt, Mycobacterium avium subsp. paratuberculosis
cggcgucgcggcgcacccgg

SEQ ID NO: 820766 - RNA, 14 nt, Mycobacterium avium subsp. paratuberculosis
cggcgucgcgguga

SEQ ID NO: 820767 - RNA, 20 nt, Mycobacterium avium subsp. paratuberculosis
cggcgucgcucauguugugc

SEQ ID NO: 820768 - RNA, 17 nt, Mycobacterium avium subsp. paratuberculosis
cggcgucgaugaccucg

SEQ ID NO: 820769 - RNA, 21 nt, Mycobacterium avium subsp. paratuberculosis
cggcgucgaugaugccggcgg

SEQ ID NO: 820770 - RNA, 22 nt, Mycobacterium avium subsp. paratuberculosis
cggcgucgaugaugccggcgga

SEQ ID NO: 820771 - RNA, 15 nt, Mycobacterium avium subsp. paratuberculosis
cggcgucgaguucgc

SEQ ID NO: 820772 - RNA, 19 nt, Mycobacterium avium subsp. paratuberculosis
cggcgucgaguucgccguc

SEQ ID NO: 820773 - RNA, 22 nt, Mycobacterium avium subsp. paratuberculosis
cggcgucgaguucgccgucgac

SEQ ID NO: 820774 - RNA, 20 nt, Mycobacterium avium subsp. paratuberculosis
cggcgucgaugucgcccggc

SEQ ID NO: 820775 - RNA, 18 nt, Mycobacterium avium subsp. paratuberculosis
cggcgucgaugucgucgu

SEQ ID NO: 820776 - RNA, 21 nt, Mycobacterium avium subsp. paratuberculosis
cggcgucgaugucgucgucga

SEQ ID NO: 820777 - RNA, 22 nt, Mycobacterium avium subsp. paratuberculosis
cggcgucgaugucgucgucgac

SEQ ID NO: 820778 - RNA, 15 nt, Mycobacterium avium subsp. paratuberculosis
cggcgucgcacgugg

SEQ ID NO: 820779 - RNA, 18 nt, Mycobacterium avium subsp. paratuberculosis
cggcgucgcacguggugu

SEQ ID NO: 820780 - RNA, 21 nt, Mycobacterium avium subsp. paratuberculosis
cggcgucgacgucgggacccu

SEQ ID NO: 820781 - RNA, 12 nt, Mycobacterium avium subsp. paratuberculosis
cggcgucgagca

SEQ ID NO: 820782 - RNA, 14 nt, Mycobacterium avium subsp. paratuberculosis
cggcgucgagcacc

SEQ ID NO: 820783 - RNA, 16 nt, Mycobacterium avium subsp. paratuberculosis
cggcgucgagcaccuc

SEQ ID NO: 820784 - RNA, 20 nt, Mycobacterium avium subsp. paratuberculosis
cggcgucgaagcgcaugccg

SEQ ID NO: 820785 - RNA, 12 nt, Mycobacterium avium subsp. paratuberculosis
cggcgucgacga

SEQ ID NO: 820786 - RNA, 14 nt, Mycobacterium avium subsp. paratuberculosis
cggcgucgacgacg

SEQ ID NO: 820787 - RNA, 16 nt, Mycobacterium avium subsp. paratuberculosis
cggcgucgacgacggc

SEQ ID NO: 820788 - RNA, 18 nt, Mycobacterium avium subsp. paratuberculosis
cggcgucgacgacggcgc

SEQ ID NO: 820789 - RNA, 19 nt, Mycobacterium avium subsp. paratuberculosis
cggcgucgacgacggcgcc

SEQ ID NO: 820790 - RNA, 21 nt, Mycobacterium avium subsp. paratuberculosis
cggcgucgacgacggcgccgc

SEQ ID NO: 820791 - RNA, 13 nt, Mycobacterium avium subsp. paratuberculosis
cggcgucgaacgg

SEQ ID NO: 820792 - RNA, 19 nt, Mycobacterium avium subsp. paratuberculosis
cggcgucgaacggcgucug

SEQ ID NO: 820793 - RNA, 14 nt, Mycobacterium avium subsp. paratuberculosis
cggcgucgaccgcc

SEQ ID NO: 820794 - RNA, 18 nt, Mycobacterium avium subsp. paratuberculosis
cggcgucgaccgccccgc

SEQ ID NO: 820795 - RNA, 21 nt, Mycobacterium avium subsp. paratuberculosis
cggcgucgaccgccccgccgg

SEQ ID NO: 820796 - RNA, 17 nt, Mycobacterium avium subsp. paratuberculosis
cggcguccuugcccgag

SEQ ID NO: 820797 - RNA, 20 nt, Mycobacterium avium subsp. paratuberculosis
cggcguccuugcccgagguc

SEQ ID NO: 820798 - RNA, 22 nt, Mycobacterium avium subsp. paratuberculosis
cggcgucgaaauagcggcgcac

SEQ ID NO: 820799 - RNA, 22 nt, Mycobacterium avium subsp. paratuberculosis
cggcgucgaaauccacgaugcc

SEQ ID NO: 820800 - RNA, 23 nt, Mycobacterium avium subsp. paratuberculosis
cggcgucgaaauccacgaugccg

SEQ ID NO: 820801 - RNA, 15 nt, Mycobacterium avium subsp. paratuberculosis
cggcgucgacagccg

SEQ ID NO: 820802 - RNA, 19 nt, Mycobacterium avium subsp. paratuberculosis
cggcgucgacagccggucg

SEQ ID NO: 820803 - RNA, 15 nt, Mycobacterium avium subsp. paratuberculosis
cggcguccccggcgg

SEQ ID NO: 820804 - RNA, 17 nt, Mycobacterium avium subsp. paratuberculosis
cggcguccccggcgguu

SEQ ID NO: 820805 - RNA, 13 nt, Mycobacterium avium subsp. paratuberculosis
cggcgucccgcgc

SEQ ID NO: 820806 - RNA, 13 nt, Mycobacterium avium subsp. paratuberculosis
cggcgucccggcg

SEQ ID NO: 820807 - RNA, 15 nt, Mycobacterium avium subsp. paratuberculosis
cggcgucccggcguc

SEQ ID NO: 820808 - RNA, 23 nt, Mycobacterium avium subsp. paratuberculosis
cggcgucccacguggugaucagc

SEQ ID NO: 820809 - RNA, 16 nt, Mycobacterium avium subsp. paratuberculosis
cggcguccacgccgug

SEQ ID NO: 820810 - RNA, 16 nt, Mycobacterium avium subsp. paratuberculosis
cggcguccagcgccgc

SEQ ID NO: 820811 - RNA, 15 nt, Mycobacterium avium subsp. paratuberculosis
cggcguccagcgcgg

SEQ ID NO: 820812 - RNA, 18 nt, Mycobacterium avium subsp. paratuberculosis
cggcguccagcgcgguga

SEQ ID NO: 820813 - RNA, 16 nt, Mycobacterium avium subsp. paratuberculosis
cggcguccagcugcgc

SEQ ID NO: 820814 - RNA, 19 nt, Mycobacterium avium subsp. paratuberculosis
cggcguccagcugcgcgcc

SEQ ID NO: 820815 - RNA, 20 nt, Mycobacterium avium subsp. paratuberculosis
cggcguccagcugcgcgccg

SEQ ID NO: 820816 - RNA, 17 nt, Mycobacterium avium subsp. paratuberculosis
cggcguccaggcgcacc

SEQ ID NO: 820817 - RNA, 18 nt, Mycobacterium avium subsp. paratuberculosis
cggcguccaggcgcaccg

SEQ ID NO: 820818 - RNA, 19 nt, Mycobacterium avium subsp. paratuberculosis
cggcguccaggcgcaccgc

SEQ ID NO: 820819 - RNA, 23 nt, Mycobacterium avium subsp. paratuberculosis
cggcguccaggcgcaccgccacc

SEQ ID NO: 820820 - RNA, 19 nt, Mycobacterium avium subsp. paratuberculosis
cggcguccaguagccgccg

SEQ ID NO: 820821 - RNA, 21 nt, Mycobacterium avium subsp. paratuberculosis
cggcguccaguagccgccggg

SEQ ID NO: 820822 - RNA, 22 nt, Mycobacterium avium subsp. paratuberculosis
cggcguccaguagccgccgggc

SEQ ID NO: 820823 - RNA, 19 nt, Mycobacterium avium subsp. paratuberculosis
cggcguccaguucggccag

SEQ ID NO: 820824 - RNA, 17 nt, Mycobacterium avium subsp. paratuberculosis
cggcguccaguugcggc

SEQ ID NO: 820825 - RNA, 18 nt, Mycobacterium avium subsp. paratuberculosis
cggcguccaguugcggca

SEQ ID NO: 820826 - RNA, 19 nt, Mycobacterium avium subsp. paratuberculosis
cggcguccaguugcggcac

SEQ ID NO: 820827 - RNA, 23 nt, Mycobacterium avium subsp. paratuberculosis
cggcguccaguugcggcacgccg

SEQ ID NO: 820828 - RNA, 16 nt, Mycobacterium avium subsp. paratuberculosis
cggcguccgugccguc

SEQ ID NO: 820829 - RNA, 22 nt, Mycobacterium avium subsp. paratuberculosis
cggcguccgugccguccggccg

SEQ ID NO: 820830 - RNA, 17 nt, Mycobacterium avium subsp. paratuberculosis
cggcguccugcagcagc

SEQ ID NO: 820831 - RNA, 20 nt, Mycobacterium avium subsp. paratuberculosis
cggcguccugcagcagccgg

SEQ ID NO: 820832 - RNA, 22 nt, Mycobacterium avium subsp. paratuberculosis
cggcguccugcagcagccggac

SEQ ID NO: 820833 - RNA, 20 nt, Mycobacterium avium subsp. paratuberculosis
cggcguccgcgaacgggugc

SEQ ID NO: 820834 - RNA, 23 nt, Mycobacterium avium subsp. paratuberculosis
cggcguccgcgaacgggugcggc

SEQ ID NO: 820835 - RNA, 17 nt, Mycobacterium avium subsp. paratuberculosis
cggcgucccagugcucg

SEQ ID NO: 820836 - RNA, 15 nt, Mycobacterium avium subsp. paratuberculosis
cggcguccucgacca

SEQ ID NO: 820837 - RNA, 20 nt, Mycobacterium avium subsp. paratuberculosis
cggcguccucgaccacccgc

SEQ ID NO: 820838 - RNA, 23 nt, Mycobacterium avium subsp. paratuberculosis
cggcguccucgaccacccgcugg

SEQ ID NO: 820839 - RNA, 14 nt, Mycobacterium avium subsp. paratuberculosis
cggcguccucgacg

SEQ ID NO: 820840 - RNA, 13 nt, Mycobacterium avium subsp. paratuberculosis
cggcguccgcggc

SEQ ID NO: 820841 - RNA, 14 nt, Mycobacterium avium subsp. paratuberculosis
cggcguccgcggcc

SEQ ID NO: 820842 - RNA, 15 nt, Mycobacterium avium subsp. paratuberculosis
cggcguccgcggccg

SEQ ID NO: 820843 - RNA, 16 nt, Mycobacterium avium subsp. paratuberculosis
cggcguccgcggccgc

SEQ ID NO: 820844 - RNA, 19 nt, Mycobacterium avium subsp. paratuberculosis
cggcguccgcggccgcggc

SEQ ID NO: 820845 - RNA, 23 nt, Mycobacterium avium subsp. paratuberculosis
cggcguccgcggccgcggcgcgc

SEQ ID NO: 820846 - RNA, 16 nt, Mycobacterium avium subsp. paratuberculosis
cggcguccgcggcgga

SEQ ID NO: 820847 - RNA, 21 nt, Mycobacterium avium subsp. paratuberculosis
cggcguccgggcgcugcgcgg

SEQ ID NO: 820848 - RNA, 22 nt, Mycobacterium avium subsp. paratuberculosis
cggcgucaggggugccagccgu

SEQ ID NO: 820849 - RNA, 13 nt, Mycobacterium avium subsp. paratuberculosis
cggcgucaggucc

SEQ ID NO: 820850 - RNA, 14 nt, Mycobacterium avium subsp. paratuberculosis
cggcgucaggaugg

SEQ ID NO: 820851 - RNA, 15 nt, Mycobacterium avium subsp. paratuberculosis
cggcgucaucccccg

SEQ ID NO: 820852 - RNA, 16 nt, Mycobacterium avium subsp. paratuberculosis
cggcgucaucccccgc

SEQ ID NO: 820853 - RNA, 14 nt, Mycobacterium avium subsp. paratuberculosis
cggcgucaucuugg

SEQ ID NO: 820854 - RNA, 13 nt, Mycobacterium avium subsp. paratuberculosis
cggcgucauggug

SEQ ID NO: 820855 - RNA, 16 nt, Mycobacterium avium subsp. paratuberculosis
cggcguccaccagcac

SEQ ID NO: 820856 - RNA, 21 nt, Mycobacterium avium subsp. paratuberculosis
cggcguccaccagcacgccgu

SEQ ID NO: 820857 - RNA, 19 nt, Mycobacterium avium subsp. paratuberculosis
cggcguccaccggucgacg

SEQ ID NO: 820858 - RNA, 22 nt, Mycobacterium avium subsp. paratuberculosis
cggcggguaugucggcgacccg

SEQ ID NO: 820859 - RNA, 18 nt, Mycobacterium avium subsp. paratuberculosis
cggcgggucagcacccgc

SEQ ID NO: 820860 - RNA, 15 nt, Mycobacterium avium subsp. paratuberculosis
cggcgggucagcagc

SEQ ID NO: 820861 - RNA, 20 nt, Mycobacterium avium subsp. paratuberculosis
cggcgggucugugaccacgg

SEQ ID NO: 820862 - RNA, 23 nt, Mycobacterium avium subsp. paratuberculosis
cggcgggucugugaccacgguca

SEQ ID NO: 820863 - RNA, 22 nt, Mycobacterium avium subsp. paratuberculosis
cggcgggugagccggucgaacg

SEQ ID NO: 820864 - RNA, 16 nt, Mycobacterium avium subsp. paratuberculosis
cggcgggucguagccg

SEQ ID NO: 820865 - RNA, 18 nt, Mycobacterium avium subsp. paratuberculosis
cggcgggucguagccguc

SEQ ID NO: 820866 - RNA, 15 nt, Mycobacterium avium subsp. paratuberculosis
cggcgggugcgacgg

SEQ ID NO: 820867 - RNA, 13 nt, Mycobacterium avium subsp. paratuberculosis
cggcggggguucg

SEQ ID NO: 820868 - RNA, 17 nt, Mycobacterium avium subsp. paratuberculosis
cggcggggguucgacgu

SEQ ID NO: 820869 - RNA, 20 nt, Mycobacterium avium subsp. paratuberculosis
cggcggggucaagcggcaga

SEQ ID NO: 820870 - RNA, 15 nt, Mycobacterium avium subsp. paratuberculosis
cggcggggucguugc

SEQ ID NO: 820871 - RNA, 16 nt, Mycobacterium avium subsp. paratuberculosis
cggcggggugcgcggc

SEQ ID NO: 820872 - RNA, 20 nt, Mycobacterium avium subsp. paratuberculosis
cggcggggugggcaccuggc

SEQ ID NO: 820873 - RNA, 19 nt, Mycobacterium avium subsp. paratuberculosis
cggcgggguuccgucgaac

SEQ ID NO: 820874 - RNA, 15 nt, Mycobacterium avium subsp. paratuberculosis
cggcggggcgucgcc

SEQ ID NO: 820875 - RNA, 17 nt, Mycobacterium avium subsp. paratuberculosis
cggcggggcgucgcccg

SEQ ID NO: 820876 - RNA, 18 nt, Mycobacterium avium subsp. paratuberculosis
cggcggggggagaggcgc

SEQ ID NO: 820877 - RNA, 20 nt, Mycobacterium avium subsp. paratuberculosis
cggcggguagaaccagcccg

SEQ ID NO: 820878 - RNA, 22 nt, Mycobacterium avium subsp. paratuberculosis
cggcggguagaaccagcccggc

SEQ ID NO: 820879 - RNA, 13 nt, Mycobacterium avium subsp. paratuberculosis
cggcggcagcacc

SEQ ID NO: 820880 - RNA, 14 nt, Mycobacterium avium subsp. paratuberculosis
cggcggcagcaccc

SEQ ID NO: 820881 - RNA, 17 nt, Mycobacterium avium subsp. paratuberculosis
cggcggcagcagcccgu

SEQ ID NO: 820882 - RNA, 14 nt, Mycobacterium avium subsp. paratuberculosis
cggcggcaccgcgg

SEQ ID NO: 820883 - RNA, 15 nt, Mycobacterium avium subsp. paratuberculosis
cggcggcaccgcggc

SEQ ID NO: 820884 - RNA, 19 nt, Mycobacterium avium subsp. paratuberculosis
cggcggcaccgcggcucgg

SEQ ID NO: 820885 - RNA, 13 nt, Mycobacterium avium subsp. paratuberculosis
cggcggcaccgau

SEQ ID NO: 820886 - RNA, 12 nt, Mycobacterium avium subsp. paratuberculosis
cggcggcaccgc

SEQ ID NO: 820887 - RNA, 15 nt, Mycobacterium avium subsp. paratuberculosis
cggcggcaccgcccg

SEQ ID NO: 820888 - RNA, 16 nt, Mycobacterium avium subsp. paratuberculosis
cggcggcaccgcccgg

SEQ ID NO: 820889 - RNA, 17 nt, Mycobacterium avium subsp. paratuberculosis
cggcggcaccgccgcgg

SEQ ID NO: 820890 - RNA, 20 nt, Mycobacterium avium subsp. paratuberculosis
cggcggcaccgccgcggugg

SEQ ID NO: 820891 - RNA, 21 nt, Mycobacterium avium subsp. paratuberculosis
cggcggcacccaggucaccga

SEQ ID NO: 820892 - RNA, 22 nt, Mycobacterium avium subsp. paratuberculosis
cggcggcacccaggucaccgag

SEQ ID NO: 820893 - RNA, 13 nt, Mycobacterium avium subsp. paratuberculosis
cggcggcaccacc

SEQ ID NO: 820894 - RNA, 16 nt, Mycobacterium avium subsp. paratuberculosis
cggcggcaccacccgc

SEQ ID NO: 820895 - RNA, 18 nt, Mycobacterium avium subsp. paratuberculosis
cggcggcaccacccgcgg

SEQ ID NO: 820896 - RNA, 19 nt, Mycobacterium avium subsp. paratuberculosis
cggcggcaccacccgcggc

SEQ ID NO: 820897 - RNA, 13 nt, Mycobacterium avium subsp. paratuberculosis
cggcggcaacggg

SEQ ID NO: 820898 - RNA, 18 nt, Mycobacterium avium subsp. paratuberculosis
cggcggcaaguccggguc

SEQ ID NO: 820899 - RNA, 18 nt, Mycobacterium avium subsp. paratuberculosis
cggcggcaaaacgcuggg

SEQ ID NO: 820900 - RNA, 21 nt, Mycobacterium avium subsp. paratuberculosis
cggcggcaaaacgcugggcgc

SEQ ID NO: 820901 - RNA, 15 nt, Mycobacterium avium subsp. paratuberculosis
cggcggaugggugcg

SEQ ID NO: 820902 - RNA, 18 nt, Mycobacterium avium subsp. paratuberculosis
cggcggaugggugcgguu

SEQ ID NO: 820903 - RNA, 20 nt, Mycobacterium avium subsp. paratuberculosis
cggcggaugggugcgguuga

SEQ ID NO: 820904 - RNA, 18 nt, Mycobacterium avium subsp. paratuberculosis
cggcggauguccugguga

SEQ ID NO: 820905 - RNA, 14 nt, Mycobacterium avium subsp. paratuberculosis
cggcggcaaccagc

SEQ ID NO: 820906 - RNA, 23 nt, Mycobacterium avium subsp. paratuberculosis
cggcggcaaccagcuccggcaac

SEQ ID NO: 820907 - RNA, 16 nt, Mycobacterium avium subsp. paratuberculosis
cggcggccacgaucgc

SEQ ID NO: 820908 - RNA, 17 nt, Mycobacterium avium subsp. paratuberculosis
cggcggccacgaucgcg

SEQ ID NO: 820909 - RNA, 23 nt, Mycobacterium avium subsp. paratuberculosis
cggcggccacgaucgcggccagc

SEQ ID NO: 820910 - RNA, 19 nt, Mycobacterium avium subsp. paratuberculosis
cggcggccacgcaggcguc

SEQ ID NO: 820911 - RNA, 16 nt, Mycobacterium avium subsp. paratuberculosis
cggcggccaacgcgac

SEQ ID NO: 820912 - RNA, 20 nt, Mycobacterium avium subsp. paratuberculosis
cggcggccaacgcgacgaag

SEQ ID NO: 820913 - RNA, 22 nt, Mycobacterium avium subsp. paratuberculosis
cggcggccaacgcgacgaagcc

SEQ ID NO: 820914 - RNA, 19 nt, Mycobacterium avium subsp. paratuberculosis
cggcggccaaucgcugugc

SEQ ID NO: 820915 - RNA, 12 nt, Mycobacterium avium subsp. paratuberculosis
cggcggccacca

SEQ ID NO: 820916 - RNA, 15 nt, Mycobacterium avium subsp. paratuberculosis
cggcggccaccagcc

SEQ ID NO: 820917 - RNA, 16 nt, Mycobacterium avium subsp. paratuberculosis
cggcggccaccagccg

SEQ ID NO: 820918 - RNA, 17 nt, Mycobacterium avium subsp. paratuberculosis
cggcggccaccagccgg

SEQ ID NO: 820919 - RNA, 21 nt, Mycobacterium avium subsp. paratuberculosis
cggcggccaccagccggccgg

SEQ ID NO: 820920 - RNA, 22 nt, Mycobacterium avium subsp. paratuberculosis
cggcggccaccagccggccggc

SEQ ID NO: 820921 - RNA, 24 nt, Mycobacterium avium subsp. paratuberculosis
cggcggccaccagccggccggccg

SEQ ID NO: 820922 - RNA, 14 nt, Mycobacterium avium subsp. paratuberculosis
cggcggccaccgcg

SEQ ID NO: 820923 - RNA, 19 nt, Mycobacterium avium subsp. paratuberculosis
cggcggccaccgcgccgug

SEQ ID NO: 820924 - RNA, 12 nt, Mycobacterium avium subsp. paratuberculosis
cggcggccaccu

SEQ ID NO: 820925 - RNA, 15 nt, Mycobacterium avium subsp. paratuberculosis
cggcggccaccucgc

SEQ ID NO: 820926 - RNA, 17 nt, Mycobacterium avium subsp. paratuberculosis
cggcggccaccucgccg

SEQ ID NO: 820927 - RNA, 18 nt, Mycobacterium avium subsp. paratuberculosis
cggcggccaccucggcgg

SEQ ID NO: 820928 - RNA, 19 nt, Mycobacterium avium subsp. paratuberculosis
cggcggccaccucggcggc

SEQ ID NO: 820929 - RNA, 20 nt, Mycobacterium avium subsp. paratuberculosis
cggcggccaccucggcggca

SEQ ID NO: 820930 - RNA, 21 nt, Mycobacterium avium subsp. paratuberculosis
cggcggccaccucggcggcac

SEQ ID NO: 820931 - RNA, 13 nt, Mycobacterium avium subsp. paratuberculosis
cggcggcaggugg

SEQ ID NO: 820932 - RNA, 17 nt, Mycobacterium avium subsp. paratuberculosis
cggcggcagguggucgg

SEQ ID NO: 820933 - RNA, 22 nt, Mycobacterium avium subsp. paratuberculosis
cggcggcagguggucggugaag

SEQ ID NO: 820934 - RNA, 13 nt, Mycobacterium avium subsp. paratuberculosis
cggcggcaguccg

SEQ ID NO: 820935 - RNA, 19 nt, Mycobacterium avium subsp. paratuberculosis
cggcggcagugcgccgucc

SEQ ID NO: 820936 - RNA, 20 nt, Mycobacterium avium subsp. paratuberculosis
cggcggcagugcgccguccc

SEQ ID NO: 820937 - RNA, 20 nt, Mycobacterium avium subsp. paratuberculosis
cggcggcauaguccagcucg

SEQ ID NO: 820938 - RNA, 21 nt, Mycobacterium avium subsp. paratuberculosis
cggcggcagcgacucgggcag

SEQ ID NO: 820939 - RNA, 15 nt, Mycobacterium avium subsp. paratuberculosis
cggcggcagcgaggc

SEQ ID NO: 820940 - RNA, 21 nt, Mycobacterium avium subsp. paratuberculosis
cggcggcagcgaggcgcgcag

SEQ ID NO: 820941 - RNA, 14 nt, Mycobacterium avium subsp. paratuberculosis
cggcggcagcgcgg

SEQ ID NO: 820942 - RNA, 23 nt, Mycobacterium avium subsp. paratuberculosis
cggcggcagcgcggcguucagca

SEQ ID NO: 820943 - RNA, 14 nt, Mycobacterium avium subsp. paratuberculosis
cggcggccaucucg

SEQ ID NO: 820944 - RNA, 18 nt, Mycobacterium avium subsp. paratuberculosis
cggcggccaucucgugcc

SEQ ID NO: 820945 - RNA, 22 nt, Mycobacterium avium subsp. paratuberculosis
cggcggccagcucggcccgcug

SEQ ID NO: 820946 - RNA, 23 nt, Mycobacterium avium subsp. paratuberculosis
cggcggccagcucggcccgcugc

SEQ ID NO: 820947 - RNA, 19 nt, Mycobacterium avium subsp. paratuberculosis
cggcggccauggucgcggc

SEQ ID NO: 820948 - RNA, 21 nt, Mycobacterium avium subsp. paratuberculosis
cggcggccauggucgcggccg

SEQ ID NO: 820949 - RNA, 14 nt, Mycobacterium avium subsp. paratuberculosis
cggcggccaugucg

SEQ ID NO: 820950 - RNA, 21 nt, Mycobacterium avium subsp. paratuberculosis
cggcggccauucaucgcgcac

SEQ ID NO: 820951 - RNA, 22 nt, Mycobacterium avium subsp. paratuberculosis
cggcggccauucaucgcgcacc

SEQ ID NO: 820952 - RNA, 14 nt, Mycobacterium avium subsp. paratuberculosis
cggcggccagggug

SEQ ID NO: 820953 - RNA, 18 nt, Mycobacterium avium subsp. paratuberculosis
cggcggccaguucgagcg

SEQ ID NO: 820954 - RNA, 20 nt, Mycobacterium avium subsp. paratuberculosis
cggcggccaguucgagcgcc

SEQ ID NO: 820955 - RNA, 22 nt, Mycobacterium avium subsp. paratuberculosis
cggcggccaguucgagcgccgc

SEQ ID NO: 820956 - RNA, 15 nt, Mycobacterium avium subsp. paratuberculosis
cggcggccagcgcga

SEQ ID NO: 820957 - RNA, 17 nt, Mycobacterium avium subsp. paratuberculosis
cggcggccagcgcgacg

SEQ ID NO: 820958 - RNA, 19 nt, Mycobacterium avium subsp. paratuberculosis
cggcggccagcgcgacgcg

SEQ ID NO: 820959 - RNA, 21 nt, Mycobacterium avium subsp. paratuberculosis
cggcggccagcgcgacgcgca

SEQ ID NO: 820960 - RNA, 22 nt, Mycobacterium avium subsp. paratuberculosis
cggcggccagcgcgacgcgcau

SEQ ID NO: 820961 - RNA, 14 nt, Mycobacterium avium subsp. paratuberculosis
cggcggccagcgag

SEQ ID NO: 820962 - RNA, 17 nt, Mycobacterium avium subsp. paratuberculosis
cggcggccagcgagucg

SEQ ID NO: 820963 - RNA, 18 nt, Mycobacterium avium subsp. paratuberculosis
cggcggccagcgagucga

SEQ ID NO: 820964 - RNA, 20 nt, Mycobacterium avium subsp. paratuberculosis
cggcggccagcgagucgaug

SEQ ID NO: 820965 - RNA, 14 nt, Mycobacterium avium subsp. paratuberculosis
cggcggccagcauc

SEQ ID NO: 820966 - RNA, 15 nt, Mycobacterium avium subsp. paratuberculosis
cggcggccagcaucg

SEQ ID NO: 820967 - RNA, 16 nt, Mycobacterium avium subsp. paratuberculosis
cggcggccagcaucgg

SEQ ID NO: 820968 - RNA, 22 nt, Mycobacterium avium subsp. paratuberculosis
cggcggccagcaucggaugccg

SEQ ID NO: 820969 - RNA, 16 nt, Mycobacterium avium subsp. paratuberculosis
cggcggcagccaggcg

SEQ ID NO: 820970 - RNA, 19 nt, Mycobacterium avium subsp. paratuberculosis
cggcggcauguucgaugcg

SEQ ID NO: 820971 - RNA, 18 nt, Mycobacterium avium subsp. paratuberculosis
cggcggccacgcuagcgu

SEQ ID NO: 820972 - RNA, 12 nt, Mycobacterium avium subsp. paratuberculosis
cggcggccccgg

SEQ ID NO: 820973 - RNA, 22 nt, Mycobacterium avium subsp. paratuberculosis
cggcggccccgguagccagcac

SEQ ID NO: 820974 - RNA, 20 nt, Mycobacterium avium subsp. paratuberculosis
cggcggccccuucgaugucg

SEQ ID NO: 820975 - RNA, 13 nt, Mycobacterium avium subsp. paratuberculosis
cggcggcccgcag

SEQ ID NO: 820976 - RNA, 18 nt, Mycobacterium avium subsp. paratuberculosis
cggcggcccgcaggaucg

SEQ ID NO: 820977 - RNA, 16 nt, Mycobacterium avium subsp. paratuberculosis
cggcggcccgccgcgc

SEQ ID NO: 820978 - RNA, 20 nt, Mycobacterium avium subsp. paratuberculosis
cggcggcccgccgcgcccgg

SEQ ID NO: 820979 - RNA, 21 nt, Mycobacterium avium subsp. paratuberculosis
cggcggcccgccgcgcccggc

SEQ ID NO: 820980 - RNA, 14 nt, Mycobacterium avium subsp. paratuberculosis
cggcggcccgccgg

SEQ ID NO: 820981 - RNA, 16 nt, Mycobacterium avium subsp. paratuberculosis
cggcggcccgccggaa

SEQ ID NO: 820982 - RNA, 20 nt, Mycobacterium avium subsp. paratuberculosis
cggcggcccgcgcggggucc

SEQ ID NO: 820983 - RNA, 16 nt, Mycobacterium avium subsp. paratuberculosis
cggcggcccggcguca

SEQ ID NO: 820984 - RNA, 13 nt, Mycobacterium avium subsp. paratuberculosis
cggcggcccgucc

SEQ ID NO: 820985 - RNA, 14 nt, Mycobacterium avium subsp. paratuberculosis
cggcggcccguccg

SEQ ID NO: 820986 - RNA, 17 nt, Mycobacterium avium subsp. paratuberculosis
cggcggcccguccgccc

SEQ ID NO: 820987 - RNA, 18 nt, Mycobacterium avium subsp. paratuberculosis
cggcggcccguccgcccc

SEQ ID NO: 820988 - RNA, 21 nt, Mycobacterium avium subsp. paratuberculosis
cggcggcccguccgccccgcu

SEQ ID NO: 820989 - RNA, 23 nt, Mycobacterium avium subsp. paratuberculosis
cggcggcccguccgccccgcugc

SEQ ID NO: 820990 - RNA, 14 nt, Mycobacterium avium subsp. paratuberculosis
cggcggcccgucgc

SEQ ID NO: 820991 - RNA, 15 nt, Mycobacterium avium subsp. paratuberculosis
cggcggcccgucgcc

SEQ ID NO: 820992 - RNA, 18 nt, Mycobacterium avium subsp. paratuberculosis
cggcggcccgucgccacc

SEQ ID NO: 820993 - RNA, 19 nt, Mycobacterium avium subsp. paratuberculosis
cggcggcccgucgccacca

SEQ ID NO: 820994 - RNA, 23 nt, Mycobacterium avium subsp. paratuberculosis
cggcggcccgucgccaccacggc

SEQ ID NO: 820995 - RNA, 22 nt, Mycobacterium avium subsp. paratuberculosis
cggcggcccuucucggacgccc

SEQ ID NO: 820996 - RNA, 19 nt, Mycobacterium avium subsp. paratuberculosis
cggcggccgaauccggccg

SEQ ID NO: 820997 - RNA, 18 nt, Mycobacterium avium subsp. paratuberculosis
cggcggccgacagcgcgu

SEQ ID NO: 820998 - RNA, 21 nt, Mycobacterium avium subsp. paratuberculosis
cggcggccgacagcgcgucgg

SEQ ID NO: 820999 - RNA, 20 nt, Mycobacterium avium subsp. paratuberculosis
cggcggccgacagggugcca

SEQ ID NO: 821000 - RNA, 16 nt, Mycobacterium avium subsp. paratuberculosis
cggcggccgacccugc

SEQ ID NO: 821001 - RNA, 20 nt, Mycobacterium avium subsp. paratuberculosis
cggcggccgacgcgccgucg

SEQ ID NO: 821002 - RNA, 12 nt, Mycobacterium avium subsp. paratuberculosis
cggcggccgagc

SEQ ID NO: 821003 - RNA, 14 nt, Mycobacterium avium subsp. paratuberculosis
cggcggccgagcgc

SEQ ID NO: 821004 - RNA, 14 nt, Mycobacterium avium subsp. paratuberculosis
cggcggcccgcuug

SEQ ID NO: 821005 - RNA, 18 nt, Mycobacterium avium subsp. paratuberculosis
cggcggcccgcuugccga

SEQ ID NO: 821006 - RNA, 12 nt, Mycobacterium avium subsp. paratuberculosis
cggcggcccggc

SEQ ID NO: 821007 - RNA, 17 nt, Mycobacterium avium subsp. paratuberculosis
cggcggccgcagcgugg

SEQ ID NO: 821008 - RNA, 14 nt, Mycobacterium avium subsp. paratuberculosis
cggcggccgccacg

SEQ ID NO: 821009 - RNA, 15 nt, Mycobacterium avium subsp. paratuberculosis
cggcggccgccacgc

SEQ ID NO: 821010 - RNA, 18 nt, Mycobacterium avium subsp. paratuberculosis
cggcggccgccacgcugg

SEQ ID NO: 821011 - RNA, 23 nt, Mycobacterium avium subsp. paratuberculosis
cggcggccgccacgcugguguga

SEQ ID NO: 821012 - RNA, 13 nt, Mycobacterium avium subsp. paratuberculosis
cggcggccgcccg

SEQ ID NO: 821013 - RNA, 14 nt, Mycobacterium avium subsp. paratuberculosis
cggcggccgcccgg

SEQ ID NO: 821014 - RNA, 19 nt, Mycobacterium avium subsp. paratuberculosis
cggcggccgcccgggcggc

SEQ ID NO: 821015 - RNA, 19 nt, Mycobacterium avium subsp. paratuberculosis
cggcggccgccgcccgcgc

SEQ ID NO: 821016 - RNA, 22 nt, Mycobacterium avium subsp. paratuberculosis
cggcggccgccgcccgcgcggc

SEQ ID NO: 821017 - RNA, 13 nt, Mycobacterium avium subsp. paratuberculosis
cggcggccgccgg

SEQ ID NO: 821018 - RNA, 14 nt, Mycobacterium avium subsp. paratuberculosis
cggcggccgccggc

SEQ ID NO: 821019 - RNA, 17 nt, Mycobacterium avium subsp. paratuberculosis
cggcggccgccggcacc

SEQ ID NO: 821020 - RNA, 24 nt, Mycobacterium avium subsp. paratuberculosis
cggcggcugggcagccgcgcgugc

SEQ ID NO: 821021 - RNA, 21 nt, Mycobacterium avium subsp. paratuberculosis
cggcggcugccucgacgaugg

SEQ ID NO: 821022 - RNA, 14 nt, Mycobacterium avium subsp. paratuberculosis
cggcgggcgcgcgc

SEQ ID NO: 821023 - RNA, 14 nt, Mycobacterium avium subsp. paratuberculosis
cggcgggcgccgaa

SEQ ID NO: 821024 - RNA, 18 nt, Mycobacterium avium subsp. paratuberculosis
cggcgggcgccggucggc

SEQ ID NO: 821025 - RNA, 14 nt, Mycobacterium avium subsp. paratuberculosis
cggcgggcgugccg

SEQ ID NO: 821026 - RNA, 15 nt, Mycobacterium avium subsp. paratuberculosis
cggcgggcucgccgg

SEQ ID NO: 821027 - RNA, 20 nt, Mycobacterium avium subsp. paratuberculosis
cggcgggcucgccggcccga

SEQ ID NO: 821028 - RNA, 17 nt, Mycobacterium avium subsp. paratuberculosis
cggcgggcucgcgcugg

SEQ ID NO: 821029 - RNA, 19 nt, Mycobacterium avium subsp. paratuberculosis
cggcgggcucgcgcuggcg

SEQ ID NO: 821030 - RNA, 13 nt, Mycobacterium avium subsp. paratuberculosis
cggcgggcggccg

SEQ ID NO: 821031 - RNA, 20 nt, Mycobacterium avium subsp. paratuberculosis
cggcggcugugaucgcugac

SEQ ID NO: 821032 - RNA, 21 nt, Mycobacterium avium subsp. paratuberculosis
cggcggcugugaucgcugacg

SEQ ID NO: 821033 - RNA, 16 nt, Mycobacterium avium subsp. paratuberculosis
cggcgggcgcgucgag

SEQ ID NO: 821034 - RNA, 13 nt, Mycobacterium avium subsp. paratuberculosis
cggcgggcgcucg

SEQ ID NO: 821035 - RNA, 14 nt, Mycobacterium avium subsp. paratuberculosis
cggcgggcgcucga

SEQ ID NO: 821036 - RNA, 14 nt, Mycobacterium avium subsp. paratuberculosis
cggcggggccucca

SEQ ID NO: 821037 - RNA, 18 nt, Mycobacterium avium subsp. paratuberculosis
cggcggggccuccaccag

SEQ ID NO: 821038 - RNA, 20 nt, Mycobacterium avium subsp. paratuberculosis
cggcggggccuccaccagcg

SEQ ID NO: 821039 - RNA, 18 nt, Mycobacterium avium subsp. paratuberculosis
cggcggggccucgaugcg

SEQ ID NO: 821040 - RNA, 21 nt, Mycobacterium avium subsp. paratuberculosis
cggcggggccucgaugcggcc

SEQ ID NO: 821041 - RNA, 17 nt, Mycobacterium avium subsp. paratuberculosis
cggcggggcgcguucgg

SEQ ID NO: 821042 - RNA, 19 nt, Mycobacterium avium subsp. paratuberculosis
cggcgggggauccgccugc

SEQ ID NO: 821043 - RNA, 22 nt, Mycobacterium avium subsp. paratuberculosis
cggcgggggauccgccugcgcg

SEQ ID NO: 821044 - RNA, 16 nt, Mycobacterium avium subsp. paratuberculosis
cggcgggggcgagacc

SEQ ID NO: 821045 - RNA, 15 nt, Mycobacterium avium subsp. paratuberculosis
cggcgggggcggcgg

SEQ ID NO: 821046 - RNA, 14 nt, Mycobacterium avium subsp. paratuberculosis
cggcgggggcgggc

SEQ ID NO: 821047 - RNA, 21 nt, Mycobacterium avium subsp. paratuberculosis
cggcgggggcgggccccacgc

SEQ ID NO: 821048 - RNA, 17 nt, Mycobacterium avium subsp. paratuberculosis
cggcggcguuggccgcc

SEQ ID NO: 821049 - RNA, 18 nt, Mycobacterium avium subsp. paratuberculosis
cggcggcguuggccgccg

SEQ ID NO: 821050 - RNA, 12 nt, Mycobacterium avium subsp. paratuberculosis
cggcggcgugca

SEQ ID NO: 821051 - RNA, 18 nt, Mycobacterium avium subsp. paratuberculosis
cggcggcgucggcgucca

SEQ ID NO: 821052 - RNA, 14 nt, Mycobacterium avium subsp. paratuberculosis
cggcggcgucguga

SEQ ID NO: 821053 - RNA, 14 nt, Mycobacterium avium subsp. paratuberculosis
cggcggcgucggcg

SEQ ID NO: 821054 - RNA, 14 nt, Mycobacterium avium subsp. paratuberculosis
cggcggcgugccgc

SEQ ID NO: 821055 - RNA, 17 nt, Mycobacterium avium subsp. paratuberculosis
cggcggcgugccgcccg

SEQ ID NO: 821056 - RNA, 19 nt, Mycobacterium avium subsp. paratuberculosis
cggcggcgugccgcccgga

SEQ ID NO: 821057 - RNA, 14 nt, Mycobacterium avium subsp. paratuberculosis
cggcggcucgccgg

SEQ ID NO: 821058 - RNA, 12 nt, Mycobacterium avium subsp. paratuberculosis
cggcggcucggc

SEQ ID NO: 821059 - RNA, 18 nt, Mycobacterium avium subsp. paratuberculosis
cggcggcucggcggcguc

SEQ ID NO: 821060 - RNA, 19 nt, Mycobacterium avium subsp. paratuberculosis
cggcggcucgggggugucg

SEQ ID NO: 821061 - RNA, 21 nt, Mycobacterium avium subsp. paratuberculosis
cggcggcucguccagcccggu

SEQ ID NO: 821062 - RNA, 18 nt, Mycobacterium avium subsp. paratuberculosis
cggcggcugaaccaccgc

SEQ ID NO: 821063 - RNA, 19 nt, Mycobacterium avium subsp. paratuberculosis
cggcggcugaaccaccgcg

SEQ ID NO: 821064 - RNA, 16 nt, Mycobacterium avium subsp. paratuberculosis
cggcggcugaagcgcu

SEQ ID NO: 821065 - RNA, 20 nt, Mycobacterium avium subsp. paratuberculosis
cggcggcugaagcgcuggga

SEQ ID NO: 821066 - RNA, 13 nt, Mycobacterium avium subsp. paratuberculosis
cggcggcggcacc

SEQ ID NO: 821067 - RNA, 13 nt, Mycobacterium avium subsp. paratuberculosis
cggcggcgcuggu

SEQ ID NO: 821068 - RNA, 14 nt, Mycobacterium avium subsp. paratuberculosis
cggcggcgcugguc

SEQ ID NO: 821069 - RNA, 15 nt, Mycobacterium avium subsp. paratuberculosis
cggcggcgcuggucg

SEQ ID NO: 821070 - RNA, 16 nt, Mycobacterium avium subsp. paratuberculosis
cggcggcgcuggucgg

SEQ ID NO: 821071 - RNA, 22 nt, Mycobacterium avium subsp. paratuberculosis
cggcggcggaccgucggugucg

SEQ ID NO: 821072 - RNA, 15 nt, Mycobacterium avium subsp. paratuberculosis
cggcggcgcggccca

SEQ ID NO: 821073 - RNA, 19 nt, Mycobacterium avium subsp. paratuberculosis
cggcggcgcugaugccguc

SEQ ID NO: 821074 - RNA, 20 nt, Mycobacterium avium subsp. paratuberculosis
cggcggcgcucagcgcggcg

SEQ ID NO: 821075 - RNA, 21 nt, Mycobacterium avium subsp. paratuberculosis
cggcggcgcucagcgcggcgg

SEQ ID NO: 821076 - RNA, 13 nt, Mycobacterium avium subsp. paratuberculosis
cggcggcgcgggc

SEQ ID NO: 821077 - RNA, 14 nt, Mycobacterium avium subsp. paratuberculosis
cggcggcgcgggcg

SEQ ID NO: 821078 - RNA, 15 nt, Mycobacterium avium subsp. paratuberculosis
cggcggcgcgggcgg

SEQ ID NO: 821079 - RNA, 13 nt, Mycobacterium avium subsp. paratuberculosis
cggcggcgcgugc

SEQ ID NO: 821080 - RNA, 14 nt, Mycobacterium avium subsp. paratuberculosis
cggcggcgcgugcg

SEQ ID NO: 821081 - RNA, 17 nt, Mycobacterium avium subsp. paratuberculosis
cggcggcgcgugcgccg

SEQ ID NO: 821082 - RNA, 20 nt, Mycobacterium avium subsp. paratuberculosis
cggcggcgcgugcgccgcgg

SEQ ID NO: 821083 - RNA, 14 nt, Mycobacterium avium subsp. paratuberculosis
cggcggcgcgcugc

SEQ ID NO: 821084 - RNA, 12 nt, Mycobacterium avium subsp. paratuberculosis
cggcggcgcggc

SEQ ID NO: 821085 - RNA, 22 nt, Mycobacterium avium subsp. paratuberculosis
cggcggcgcgccggccggagcg

SEQ ID NO: 821086 - RNA, 14 nt, Mycobacterium avium subsp. paratuberculosis
cggcggcgcgcacg

SEQ ID NO: 821087 - RNA, 22 nt, Mycobacterium avium subsp. paratuberculosis
cggcggcgcgcacgucaccgcg

SEQ ID NO: 821088 - RNA, 13 nt, Mycobacterium avium subsp. paratuberculosis
cggcggcgacggc

SEQ ID NO: 821089 - RNA, 17 nt, Mycobacterium avium subsp. paratuberculosis
cggcggcgacggcaccg

SEQ ID NO: 821090 - RNA, 15 nt, Mycobacterium avium subsp. paratuberculosis
cggcggcgccgucgu

SEQ ID NO: 821091 - RNA, 17 nt, Mycobacterium avium subsp. paratuberculosis
cggcggcgccgucgucg

SEQ ID NO: 821092 - RNA, 18 nt, Mycobacterium avium subsp. paratuberculosis
cggcggcgccuugccggu

SEQ ID NO: 821093 - RNA, 14 nt, Mycobacterium avium subsp. paratuberculosis
cggcggccggcggc

SEQ ID NO: 821094 - RNA, 16 nt, Mycobacterium avium subsp. paratuberculosis
cggcggcgacgguguc

SEQ ID NO: 821095 - RNA, 22 nt, Mycobacterium avium subsp. paratuberculosis
cggcggcgacgguguccgcggc

SEQ ID NO: 821096 - RNA, 13 nt, Mycobacterium avium subsp. paratuberculosis
cggcggcgacguc

SEQ ID NO: 821097 - RNA, 14 nt, Mycobacterium avium subsp. paratuberculosis
cggcggcgacgucg

SEQ ID NO: 821098 - RNA, 15 nt, Mycobacterium avium subsp. paratuberculosis
cggcggcgacgucga

SEQ ID NO: 821099 - RNA, 18 nt, Mycobacterium avium subsp. paratuberculosis
cggcggcgacgucgacgg

SEQ ID NO: 821100 - RNA, 22 nt, Mycobacterium avium subsp. paratuberculosis
cggcggcgacgucgacggcagc

SEQ ID NO: 821101 - RNA, 18 nt, Mycobacterium avium subsp. paratuberculosis
cggcggcgacgugaucgg

SEQ ID NO: 821102 - RNA, 20 nt, Mycobacterium avium subsp. paratuberculosis
cggcggcgacgugaucggcg

SEQ ID NO: 821103 - RNA, 14 nt, Mycobacterium avium subsp. paratuberculosis
cggcggcgacgugc

SEQ ID NO: 821104 - RNA, 21 nt, Mycobacterium avium subsp. paratuberculosis
cggcggcgacgugccggcggc

SEQ ID NO: 821105 - RNA, 20 nt, Mycobacterium avium subsp. paratuberculosis
cggcggccugcuucucgccg

SEQ ID NO: 821106 - RNA, 18 nt, Mycobacterium avium subsp. paratuberculosis
cggcggccugcuugaccg

SEQ ID NO: 821107 - RNA, 22 nt, Mycobacterium avium subsp. paratuberculosis
cggcggccugcgcgucgucgcc

SEQ ID NO: 821108 - RNA, 23 nt, Mycobacterium avium subsp. paratuberculosis
cggcggccugcgcgucgucgccc

SEQ ID NO: 821109 - RNA, 14 nt, Mycobacterium avium subsp. paratuberculosis
cggcggccugcggc

SEQ ID NO: 821110 - RNA, 18 nt, Mycobacterium avium subsp. paratuberculosis
cggcggccugcggcggca

SEQ ID NO: 821111 - RNA, 17 nt, Mycobacterium avium subsp. paratuberculosis
cggcggccugcuccagc

SEQ ID NO: 821112 - RNA, 20 nt, Mycobacterium avium subsp. paratuberculosis
cggcggccuucuuggccgga

SEQ ID NO: 821113 - RNA, 22 nt, Mycobacterium avium subsp. paratuberculosis
cggcggccuucuuggccggagc

SEQ ID NO: 821114 - RNA, 21 nt, Mycobacterium avium subsp. paratuberculosis
cggcggccuugaacgcguccg

SEQ ID NO: 821115 - RNA, 23 nt, Mycobacterium avium subsp. paratuberculosis
cggcggccuugaacgcguccgac

SEQ ID NO: 821116 - RNA, 21 nt, Mycobacterium avium subsp. paratuberculosis
cggcggccuuuuccggcgaca

SEQ ID NO: 821117 - RNA, 21 nt, Mycobacterium avium subsp. paratuberculosis
cggcggccuuuuucugcgccc

SEQ ID NO: 821118 - RNA, 20 nt, Mycobacterium avium subsp. paratuberculosis
cggcggcgaacaggcccugc

SEQ ID NO: 821119 - RNA, 14 nt, Mycobacterium avium subsp. paratuberculosis
cggcggcgaagacg

SEQ ID NO: 821120 - RNA, 14 nt, Mycobacterium avium subsp. paratuberculosis
cggcggcgaagccg

SEQ ID NO: 821121 - RNA, 19 nt, Mycobacterium avium subsp. paratuberculosis
cggcggcgaagccggcccc

SEQ ID NO: 821122 - RNA, 21 nt, Mycobacterium avium subsp. paratuberculosis
cggcggcgaagccggccccgc

SEQ ID NO: 821123 - RNA, 12 nt, Mycobacterium avium subsp. paratuberculosis
cggcggccuccg

SEQ ID NO: 821124 - RNA, 17 nt, Mycobacterium avium subsp. paratuberculosis
cggcggccgucggaucg

SEQ ID NO: 821125 - RNA, 21 nt, Mycobacterium avium subsp. paratuberculosis
cggcggccucgguggucgcgu

SEQ ID NO: 821126 - RNA, 14 nt, Mycobacterium avium subsp. paratuberculosis
cggcggccuccgga

SEQ ID NO: 821127 - RNA, 19 nt, Mycobacterium avium subsp. paratuberculosis
cggcggccuccggauggcg

SEQ ID NO: 821128 - RNA, 14 nt, Mycobacterium avium subsp. paratuberculosis
cggcggccucgccg

SEQ ID NO: 821129 - RNA, 17 nt, Mycobacterium avium subsp. paratuberculosis
cggcggccucgccgucg

SEQ ID NO: 821130 - RNA, 17 nt, Mycobacterium avium subsp. paratuberculosis
cggcggccgggaugccg

SEQ ID NO: 821131 - RNA, 12 nt, Mycobacterium avium subsp. paratuberculosis
cggcggccgggg

SEQ ID NO: 821132 - RNA, 15 nt, Mycobacterium avium subsp. paratuberculosis
cggcggccgcgucgg

SEQ ID NO: 821133 - RNA, 17 nt, Mycobacterium avium subsp. paratuberculosis
cggcggccgcgucggcg

SEQ ID NO: 821134 - RNA, 20 nt, Mycobacterium avium subsp. paratuberculosis
cggcggccgcguccucgccg

SEQ ID NO: 821135 - RNA, 12 nt, Mycobacterium avium subsp. paratuberculosis
cggcggccgcgu

SEQ ID NO: 821136 - RNA, 13 nt, Mycobacterium avium subsp. paratuberculosis
cggcggccgcguc

SEQ ID NO: 821137 - RNA, 14 nt, Mycobacterium avium subsp. paratuberculosis
cggcggccgcggac

SEQ ID NO: 821138 - RNA, 17 nt, Mycobacterium avium subsp. paratuberculosis
cggcggccgcggacccg

SEQ ID NO: 821139 - RNA, 15 nt, Mycobacterium avium subsp. paratuberculosis
cggcggccgccuugg

SEQ ID NO: 821140 - RNA, 12 nt, Mycobacterium avium subsp. paratuberculosis
cggcggccgcga

SEQ ID NO: 821141 - RNA, 24 nt, Mycobacterium avium subsp. paratuberculosis
cggcggccgcgaaggcggcgucga

SEQ ID NO: 821142 - RNA, 13 nt, Mycobacterium avium subsp. paratuberculosis
cggcggccggcca

SEQ ID NO: 821143 - RNA, 14 nt, Mycobacterium avium subsp. paratuberculosis
cggcggccggccag

SEQ ID NO: 821144 - RNA, 15 nt, Mycobacterium avium subsp. paratuberculosis
cggcggccggccagc

SEQ ID NO: 821145 - RNA, 19 nt, Mycobacterium avium subsp. paratuberculosis
cggcggccggccagcgcgc

SEQ ID NO: 821146 - RNA, 13 nt, Mycobacterium avium subsp. paratuberculosis
cggcggccggccc

SEQ ID NO: 821147 - RNA, 14 nt, Mycobacterium avium subsp. paratuberculosis
cggcggccggcccc

SEQ ID NO: 821148 - RNA, 15 nt, Mycobacterium avium subsp. paratuberculosis
cggcggccggccccg

SEQ ID NO: 821149 - RNA, 17 nt, Mycobacterium avium subsp. paratuberculosis
cggcggccggccccggc

SEQ ID NO: 821150 - RNA, 19 nt, Mycobacterium avium subsp. paratuberculosis
cggcggccggccccggccg

SEQ ID NO: 821151 - RNA, 22 nt, Mycobacterium avium subsp. paratuberculosis
cggcggccggccccggccgggc

SEQ ID NO: 821152 - RNA, 18 nt, Mycobacterium avium subsp. paratuberculosis
cggcggccggccgcgcgc

SEQ ID NO: 821153 - RNA, 21 nt, Mycobacterium avium subsp. paratuberculosis
cggcggccggccgcgcgcggc

SEQ ID NO: 821154 - RNA, 12 nt, Mycobacterium avium subsp. paratuberculosis
cggcggccggcg

SEQ ID NO: 821155 - RNA, 14 nt, Mycobacterium avium subsp. paratuberculosis
cggcggccggcgau

SEQ ID NO: 821156 - RNA, 15 nt, Mycobacterium avium subsp. paratuberculosis
cggcggccggcgaug

SEQ ID NO: 821157 - RNA, 16 nt, Mycobacterium avium subsp. paratuberculosis
cggcggccggcgauga

SEQ ID NO: 821158 - RNA, 16 nt, Mycobacterium avium subsp. paratuberculosis
cggcggccggcgccga

SEQ ID NO: 821159 - RNA, 17 nt, Mycobacterium avium subsp. paratuberculosis
cggcggccggcgccgac

SEQ ID NO: 821160 - RNA, 19 nt, Mycobacterium avium subsp. paratuberculosis
cggcggccggcgccgaccg

SEQ ID NO: 821161 - RNA, 17 nt, Mycobacterium avium subsp. paratuberculosis
cggcgcguccauggucg

SEQ ID NO: 821162 - RNA, 14 nt, Mycobacterium avium subsp. paratuberculosis
cggcgcgucgcugg

SEQ ID NO: 821163 - RNA, 21 nt, Mycobacterium avium subsp. paratuberculosis
cggcgcgucgcugggcagccg

SEQ ID NO: 821164 - RNA, 24 nt, Mycobacterium avium subsp. paratuberculosis
cggcgcgucgcugggcagccgucc

SEQ ID NO: 821165 - RNA, 14 nt, Mycobacterium avium subsp. paratuberculosis
cggcgcgugcgccg

SEQ ID NO: 821166 - RNA, 15 nt, Mycobacterium avium subsp. paratuberculosis
cggcgcgugcgccgc

SEQ ID NO: 821167 - RNA, 19 nt, Mycobacterium avium subsp. paratuberculosis
cggcgcgugcgccgcggcg

SEQ ID NO: 821168 - RNA, 20 nt, Mycobacterium avium subsp. paratuberculosis
cggcgcgugcgccgcggcgg

SEQ ID NO: 821169 - RNA, 17 nt, Mycobacterium avium subsp. paratuberculosis
cggcgcgugcgcgacga

SEQ ID NO: 821170 - RNA, 12 nt, Mycobacterium avium subsp. paratuberculosis
cggcgcgucgua

SEQ ID NO: 821171 - RNA, 23 nt, Mycobacterium avium subsp. paratuberculosis
cggcgcgucguagucgcucggcg

SEQ ID NO: 821172 - RNA, 14 nt, Mycobacterium avium subsp. paratuberculosis
cggcgcgucguccg

SEQ ID NO: 821173 - RNA, 16 nt, Mycobacterium avium subsp. paratuberculosis
cggcgcgucguccgac

SEQ ID NO: 821174 - RNA, 20 nt, Mycobacterium avium subsp. paratuberculosis
cggcgcgucguccgacacca

SEQ ID NO: 821175 - RNA, 22 nt, Mycobacterium avium subsp. paratuberculosis
cggcgcgguggcgugcagcgcg

SEQ ID NO: 821176 - RNA, 23 nt, Mycobacterium avium subsp. paratuberculosis
cggcgcgguggcgugcagcgcgg

SEQ ID NO: 821177 - RNA, 17 nt, Mycobacterium avium subsp. paratuberculosis
cggcgcggugggcggcg

SEQ ID NO: 821178 - RNA, 20 nt, Mycobacterium avium subsp. paratuberculosis
cggcgcggugggcggcggga

SEQ ID NO: 821179 - RNA, 18 nt, Mycobacterium avium subsp. paratuberculosis
cggcgcgguugaccgccg

SEQ ID NO: 821180 - RNA, 22 nt, Mycobacterium avium subsp. paratuberculosis
cggcgcgguugaccgccgacac

SEQ ID NO: 821181 - RNA, 23 nt, Mycobacterium avium subsp. paratuberculosis
cggcgcgguugaccgccgacacc

SEQ ID NO: 821182 - RNA, 19 nt, Mycobacterium avium subsp. paratuberculosis
cggcgcgguugcccgcacc

SEQ ID NO: 821183 - RNA, 18 nt, Mycobacterium avium subsp. paratuberculosis
cggcgcgguuucggcguc

SEQ ID NO: 821184 - RNA, 16 nt, Mycobacterium avium subsp. paratuberculosis
cggcgcgggcggcguc

SEQ ID NO: 821185 - RNA, 16 nt, Mycobacterium avium subsp. paratuberculosis
cggcgcggugcucggc

SEQ ID NO: 821186 - RNA, 15 nt, Mycobacterium avium subsp. paratuberculosis
cggcgcggugcgccg

SEQ ID NO: 821187 - RNA, 16 nt, Mycobacterium avium subsp. paratuberculosis
cggcgcggugcgccga

SEQ ID NO: 821188 - RNA, 17 nt, Mycobacterium avium subsp. paratuberculosis
cggcgcggugcgccgac

SEQ ID NO: 821189 - RNA, 18 nt, Mycobacterium avium subsp. paratuberculosis
cggcgcggugcgccgaca

SEQ ID NO: 821190 - RNA, 20 nt, Mycobacterium avium subsp. paratuberculosis
cggcgcggugcgccgacagc

SEQ ID NO: 821191 - RNA, 22 nt, Mycobacterium avium subsp. paratuberculosis
cggcgcggugcgccgacagcug

SEQ ID NO: 821192 - RNA, 23 nt, Mycobacterium avium subsp. paratuberculosis
cggcgcggugcgccgacagcuga

SEQ ID NO: 821193 - RNA, 17 nt, Mycobacterium avium subsp. paratuberculosis
cggcgcucaccgcgaug

SEQ ID NO: 821194 - RNA, 21 nt, Mycobacterium avium subsp. paratuberculosis
cggcgcucaccggcguggugg

SEQ ID NO: 821195 - RNA, 15 nt, Mycobacterium avium subsp. paratuberculosis
cggcgcucagcgcgg

SEQ ID NO: 821196 - RNA, 16 nt, Mycobacterium avium subsp. paratuberculosis
cggcgcucagcgcggc

SEQ ID NO: 821197 - RNA, 13 nt, Mycobacterium avium subsp. paratuberculosis
cggcgcucaccgc

SEQ ID NO: 821198 - RNA, 13 nt, Mycobacterium avium subsp. paratuberculosis
cggcgcuccagcg

SEQ ID NO: 821199 - RNA, 14 nt, Mycobacterium avium subsp. paratuberculosis
cggcgcuccagcgg

SEQ ID NO: 821200 - RNA, 15 nt, Mycobacterium avium subsp. paratuberculosis
cggcgcuccagcggg

SEQ ID NO: 821201 - RNA, 17 nt, Mycobacterium avium subsp. paratuberculosis
cggcgcuccagcgggcg

SEQ ID NO: 821202 - RNA, 21 nt, Mycobacterium avium subsp. paratuberculosis
cggcgcuccagcgggcggcgg

SEQ ID NO: 821203 - RNA, 23 nt, Mycobacterium avium subsp. paratuberculosis
cggcgcuccagcgggcggcggug

SEQ ID NO: 821204 - RNA, 16 nt, Mycobacterium avium subsp. paratuberculosis
cggcgcuacgccggcu

SEQ ID NO: 821205 - RNA, 19 nt, Mycobacterium avium subsp. paratuberculosis
cggcgcuaaagccaccagc

SEQ ID NO: 821206 - RNA, 21 nt, Mycobacterium avium subsp. paratuberculosis
cggcgcuaaagccaccagcgu

SEQ ID NO: 821207 - RNA, 17 nt, Mycobacterium avium subsp. paratuberculosis
cggcgcuaaagccgacc

SEQ ID NO: 821208 - RNA, 18 nt, Mycobacterium avium subsp. paratuberculosis
cggcgcuaaagccgaccg

SEQ ID NO: 821209 - RNA, 19 nt, Mycobacterium avium subsp. paratuberculosis
cggcgcuaaagccgaccgc

SEQ ID NO: 821210 - RNA, 20 nt, Mycobacterium avium subsp. paratuberculosis
cggcgcuaaagccgaccgcc

SEQ ID NO: 821211 - RNA, 22 nt, Mycobacterium avium subsp. paratuberculosis
cggcgcgugcuguugcaggugc

SEQ ID NO: 821212 - RNA, 20 nt, Mycobacterium avium subsp. paratuberculosis
cggcgcguuggcccgugucg

SEQ ID NO: 821213 - RNA, 14 nt, Mycobacterium avium subsp. paratuberculosis
cggcgcguuggccg

SEQ ID NO: 821214 - RNA, 20 nt, Mycobacterium avium subsp. paratuberculosis
cggcgcguuccaucagcgcc

SEQ ID NO: 821215 - RNA, 15 nt, Mycobacterium avium subsp. paratuberculosis
cggcgcgucggcguc

SEQ ID NO: 821216 - RNA, 18 nt, Mycobacterium avium subsp. paratuberculosis
cggcgcguccggaggugc

SEQ ID NO: 821217 - RNA, 17 nt, Mycobacterium avium subsp. paratuberculosis
cggcgcgugccaaccac

SEQ ID NO: 821218 - RNA, 16 nt, Mycobacterium avium subsp. paratuberculosis
cggcgcaugaccgauc

SEQ ID NO: 821219 - RNA, 21 nt, Mycobacterium avium subsp. paratuberculosis
cggcgcaugaccgauccgccg

SEQ ID NO: 821220 - RNA, 23 nt, Mycobacterium avium subsp. paratuberculosis
cggcgcaugaccgauccgccggc

SEQ ID NO: 821221 - RNA, 21 nt, Mycobacterium avium subsp. paratuberculosis
cggcgccaacaacucgacgcu

SEQ ID NO: 821222 - RNA, 12 nt, Mycobacterium avium subsp. paratuberculosis
cggcgccaaccu

SEQ ID NO: 821223 - RNA, 12 nt, Mycobacterium avium subsp. paratuberculosis
cggcgccaccag

SEQ ID NO: 821224 - RNA, 19 nt, Mycobacterium avium subsp. paratuberculosis
cggcgccaccagccacacc

SEQ ID NO: 821225 - RNA, 20 nt, Mycobacterium avium subsp. paratuberculosis
cggcgccaccagccacaccg

SEQ ID NO: 821226 - RNA, 16 nt, Mycobacterium avium subsp. paratuberculosis
cggcgcaucaucucgg

SEQ ID NO: 821227 - RNA, 19 nt, Mycobacterium avium subsp. paratuberculosis
cggcgcaucaucucggcga

SEQ ID NO: 821228 - RNA, 21 nt, Mycobacterium avium subsp. paratuberculosis
cggcgcaucaucucggcgaag

SEQ ID NO: 821229 - RNA, 13 nt, Mycobacterium avium subsp. paratuberculosis
cggcgccagcggc

SEQ ID NO: 821230 - RNA, 16 nt, Mycobacterium avium subsp. paratuberculosis
cggcgccagcggccga

SEQ ID NO: 821231 - RNA, 18 nt, Mycobacterium avium subsp. paratuberculosis
cggcgccagcggccgauc

SEQ ID NO: 821232 - RNA, 20 nt, Mycobacterium avium subsp. paratuberculosis
cggcgccagcggccgaucau

SEQ ID NO: 821233 - RNA, 14 nt, Mycobacterium avium subsp. paratuberculosis
cggcgccaccccgg

SEQ ID NO: 821234 - RNA, 12 nt, Mycobacterium avium subsp. paratuberculosis
cggcgcggucca

SEQ ID NO: 821235 - RNA, 14 nt, Mycobacterium avium subsp. paratuberculosis
cggcgcgguccacg

SEQ ID NO: 821236 - RNA, 15 nt, Mycobacterium avium subsp. paratuberculosis
cggcgcgguccacgg

SEQ ID NO: 821237 - RNA, 18 nt, Mycobacterium avium subsp. paratuberculosis
cggcgcgguccacgguca

SEQ ID NO: 821238 - RNA, 12 nt, Mycobacterium avium subsp. paratuberculosis
cggcgcggucgc

SEQ ID NO: 821239 - RNA, 21 nt, Mycobacterium avium subsp. paratuberculosis
cggcgcggucgcaggccgccc

SEQ ID NO: 821240 - RNA, 17 nt, Mycobacterium avium subsp. paratuberculosis
cggcgcggggccaccag

SEQ ID NO: 821241 - RNA, 21 nt, Mycobacterium avium subsp. paratuberculosis
cggcgcggggccaccaggcgc

SEQ ID NO: 821242 - RNA, 16 nt, Mycobacterium avium subsp. paratuberculosis
cggcgcgggggcggcc

SEQ ID NO: 821243 - RNA, 13 nt, Mycobacterium avium subsp. paratuberculosis
cggcgcgggucgc

SEQ ID NO: 821244 - RNA, 15 nt, Mycobacterium avium subsp. paratuberculosis
cggcgcgggucgcgg

SEQ ID NO: 821245 - RNA, 19 nt, Mycobacterium avium subsp. paratuberculosis
cggcgcgggucgcgguucg

SEQ ID NO: 821246 - RNA, 19 nt, Mycobacterium avium subsp. paratuberculosis
cggcgcgggucgcuggccg

SEQ ID NO: 821247 - RNA, 22 nt, Mycobacterium avium subsp. paratuberculosis
cggcgcgggucgcuggccgcga

SEQ ID NO: 821248 - RNA, 14 nt, Mycobacterium avium subsp. paratuberculosis
cggcgcgggcgccc

SEQ ID NO: 821249 - RNA, 15 nt, Mycobacterium avium subsp. paratuberculosis
cggcgcgggccagca

SEQ ID NO: 821250 - RNA, 16 nt, Mycobacterium avium subsp. paratuberculosis
cggcgcgggccgcagc

SEQ ID NO: 821251 - RNA, 16 nt, Mycobacterium avium subsp. paratuberculosis
cggcgcgggcgauuuc

SEQ ID NO: 821252 - RNA, 23 nt, Mycobacterium avium subsp. paratuberculosis
cggcgcgggcgauuucgucggcg

SEQ ID NO: 821253 - RNA, 13 nt, Mycobacterium avium subsp. paratuberculosis
cggcgccaggucg

SEQ ID NO: 821254 - RNA, 17 nt, Mycobacterium avium subsp. paratuberculosis
cggcgccaggucggggu

SEQ ID NO: 821255 - RNA, 15 nt, Mycobacterium avium subsp. paratuberculosis
cggcgccaggccggc

SEQ ID NO: 821256 - RNA, 16 nt, Mycobacterium avium subsp. paratuberculosis
cggcgccaggccggcg

SEQ ID NO: 821257 - RNA, 19 nt, Mycobacterium avium subsp. paratuberculosis
cggcgccaggccggcgacg

SEQ ID NO: 821258 - RNA, 22 nt, Mycobacterium avium subsp. paratuberculosis
cggcgccaggccggcgacgccg

SEQ ID NO: 821259 - RNA, 22 nt, Mycobacterium avium subsp. paratuberculosis
cggcgcggcucacgacuccugg

SEQ ID NO: 821260 - RNA, 15 nt, Mycobacterium avium subsp. paratuberculosis
cggcgcugccggcgc

SEQ ID NO: 821261 - RNA, 17 nt, Mycobacterium avium subsp. paratuberculosis
cggcgcugcgcccgguc

SEQ ID NO: 821262 - RNA, 20 nt, Mycobacterium avium subsp. paratuberculosis
cggcgcugcgcccggucagg

SEQ ID NO: 821263 - RNA, 15 nt, Mycobacterium avium subsp. paratuberculosis
cggcgcugcgccguu

SEQ ID NO: 821264 - RNA, 13 nt, Mycobacterium avium subsp. paratuberculosis
cggcgcuggccgc

SEQ ID NO: 821265 - RNA, 15 nt, Mycobacterium avium subsp. paratuberculosis
cggcgcuggccagcg

SEQ ID NO: 821266 - RNA, 18 nt, Mycobacterium avium subsp. paratuberculosis
cggcgcuggccagcgcga

SEQ ID NO: 821267 - RNA, 21 nt, Mycobacterium avium subsp. paratuberculosis
cggcgcuggccagcgcgacgg

SEQ ID NO: 821268 - RNA, 18 nt, Mycobacterium avium subsp. paratuberculosis
cggcgcuggucggcgggc

SEQ ID NO: 821269 - RNA, 21 nt, Mycobacterium avium subsp. paratuberculosis
cggcgcuggucggcgggcagc

SEQ ID NO: 821270 - RNA, 15 nt, Mycobacterium avium subsp. paratuberculosis
cggcgcuggcgugcu

SEQ ID NO: 821271 - RNA, 16 nt, Mycobacterium avium subsp. paratuberculosis
cggcgcugucggcggg

SEQ ID NO: 821272 - RNA, 18 nt, Mycobacterium avium subsp. paratuberculosis
cggcgcugucggcgggga

SEQ ID NO: 821273 - RNA, 21 nt, Mycobacterium avium subsp. paratuberculosis
cggcgcuggcgcgccguaccg

SEQ ID NO: 821274 - RNA, 15 nt, Mycobacterium avium subsp. paratuberculosis
cggcgcuggcgacca

SEQ ID NO: 821275 - RNA, 16 nt, Mycobacterium avium subsp. paratuberculosis
cggcgcuggccgcggc

SEQ ID NO: 821276 - RNA, 19 nt, Mycobacterium avium subsp. paratuberculosis
cggcgcuggccgcggccag

SEQ ID NO: 821277 - RNA, 22 nt, Mycobacterium avium subsp. paratuberculosis
cggcgcuggccgcggccagcug

SEQ ID NO: 821278 - RNA, 13 nt, Mycobacterium avium subsp. paratuberculosis
cggcgcugccggu

SEQ ID NO: 821279 - RNA, 13 nt, Mycobacterium avium subsp. paratuberculosis
cggcgcugccgcc

SEQ ID NO: 821280 - RNA, 15 nt, Mycobacterium avium subsp. paratuberculosis
cggcgcugcccgucg

SEQ ID NO: 821281 - RNA, 17 nt, Mycobacterium avium subsp. paratuberculosis
cggcgcugcccgucgac

SEQ ID NO: 821282 - RNA, 20 nt, Mycobacterium avium subsp. paratuberculosis
cggcgcugcagcagcccgau

SEQ ID NO: 821283 - RNA, 13 nt, Mycobacterium avium subsp. paratuberculosis
cggcgcugcccca

SEQ ID NO: 821284 - RNA, 14 nt, Mycobacterium avium subsp. paratuberculosis
cggcgcugccccag

SEQ ID NO: 821285 - RNA, 14 nt, Mycobacterium avium subsp. paratuberculosis
cggcgcugcccgcc

SEQ ID NO: 821286 - RNA, 15 nt, Mycobacterium avium subsp. paratuberculosis
cggcgcugcccgccg

SEQ ID NO: 821287 - RNA, 16 nt, Mycobacterium avium subsp. paratuberculosis
cggcgcugcccgccgc

SEQ ID NO: 821288 - RNA, 18 nt, Mycobacterium avium subsp. paratuberculosis
cggcgcugcccgccgcgg

SEQ ID NO: 821289 - RNA, 15 nt, Mycobacterium avium subsp. paratuberculosis
cggcgcugcccgcga

SEQ ID NO: 821290 - RNA, 18 nt, Mycobacterium avium subsp. paratuberculosis
cggcgcugcccgcgaucg

SEQ ID NO: 821291 - RNA, 19 nt, Mycobacterium avium subsp. paratuberculosis
cggcgcugcccgcgaucgc

SEQ ID NO: 821292 - RNA, 20 nt, Mycobacterium avium subsp. paratuberculosis
cggcgcugcccgcgaucgcc

SEQ ID NO: 821293 - RNA, 15 nt, Mycobacterium avium subsp. paratuberculosis
cggcgcucgucgucg

SEQ ID NO: 821294 - RNA, 22 nt, Mycobacterium avium subsp. paratuberculosis
cggcgcugaacugcucgaccag

SEQ ID NO: 821295 - RNA, 23 nt, Mycobacterium avium subsp. paratuberculosis
cggcgcugaacugcucgaccagc

SEQ ID NO: 821296 - RNA, 20 nt, Mycobacterium avium subsp. paratuberculosis
cggcgcugaagugcagcgca

SEQ ID NO: 821297 - RNA, 12 nt, Mycobacterium avium subsp. paratuberculosis
cggcgcucgccg

SEQ ID NO: 821298 - RNA, 13 nt, Mycobacterium avium subsp. paratuberculosis
cggcgcucgccgc

SEQ ID NO: 821299 - RNA, 18 nt, Mycobacterium avium subsp. paratuberculosis
cggcgcucgccgcgcggc

SEQ ID NO: 821300 - RNA, 16 nt, Mycobacterium avium subsp. paratuberculosis
cggcgcucgcgggugc

SEQ ID NO: 821301 - RNA, 19 nt, Mycobacterium avium subsp. paratuberculosis
cggcgcucggugugcgguu

SEQ ID NO: 821302 - RNA, 17 nt, Mycobacterium avium subsp. paratuberculosis
cggcggaacccgggugg

SEQ ID NO: 821303 - RNA, 20 nt, Mycobacterium avium subsp. paratuberculosis
cggcggaacccggguggccc

SEQ ID NO: 821304 - RNA, 22 nt, Mycobacterium avium subsp. paratuberculosis
cggcggaacccggguggcccgc

SEQ ID NO: 821305 - RNA, 18 nt, Mycobacterium avium subsp. paratuberculosis
cggcggaaccgggccgcu

SEQ ID NO: 821306 - RNA, 18 nt, Mycobacterium avium subsp. paratuberculosis
cggcgcuuuccaccucga

SEQ ID NO: 821307 - RNA, 21 nt, Mycobacterium avium subsp. paratuberculosis
cggcgcuuucgaagugacgcc

SEQ ID NO: 821308 - RNA, 23 nt, Mycobacterium avium subsp. paratuberculosis
cggcgcuuucgaagugacgccgc

SEQ ID NO: 821309 - RNA, 21 nt, Mycobacterium avium subsp. paratuberculosis
cggcgcuucgggugcgggugc

SEQ ID NO: 821310 - RNA, 16 nt, Mycobacterium avium subsp. paratuberculosis
cggcgcuucugcgccg

SEQ ID NO: 821311 - RNA, 20 nt, Mycobacterium avium subsp. paratuberculosis
cggcgcuugaccucgccgag

SEQ ID NO: 821312 - RNA, 21 nt, Mycobacterium avium subsp. paratuberculosis
cggcgcuugaccucgccgagc

SEQ ID NO: 821313 - RNA, 22 nt, Mycobacterium avium subsp. paratuberculosis
cggcgcuugaccucgccgagca

SEQ ID NO: 821314 - RNA, 24 nt, Mycobacterium avium subsp. paratuberculosis
cggcgcuugaccucgccgagcagc

SEQ ID NO: 821315 - RNA, 23 nt, Mycobacterium avium subsp. paratuberculosis
cggcggacagcacguuguucagg

SEQ ID NO: 821316 - RNA, 22 nt, Mycobacterium avium subsp. paratuberculosis
cggcggaaguagcccggaguga

SEQ ID NO: 821317 - RNA, 13 nt, Mycobacterium avium subsp. paratuberculosis
cggcggacaucgc

SEQ ID NO: 821318 - RNA, 18 nt, Mycobacterium avium subsp. paratuberculosis
cggcggacaucgccucgg

SEQ ID NO: 821319 - RNA, 22 nt, Mycobacterium avium subsp. paratuberculosis
cggcggacaucgccucggcguc

SEQ ID NO: 821320 - RNA, 23 nt, Mycobacterium avium subsp. paratuberculosis
cggcggacccggaggcggcgggg

SEQ ID NO: 821321 - RNA, 15 nt, Mycobacterium avium subsp. paratuberculosis
cggcggaucgcgugc

SEQ ID NO: 821322 - RNA, 19 nt, Mycobacterium avium subsp. paratuberculosis
cggcggauauagccgacgg

SEQ ID NO: 821323 - RNA, 14 nt, Mycobacterium avium subsp. paratuberculosis
cggcggaucagcac

SEQ ID NO: 821324 - RNA, 22 nt, Mycobacterium avium subsp. paratuberculosis
cggcggaucagcaccgacgcgg

SEQ ID NO: 821325 - RNA, 20 nt, Mycobacterium avium subsp. paratuberculosis
cggcggaucaguaccggcga

SEQ ID NO: 821326 - RNA, 15 nt, Mycobacterium avium subsp. paratuberculosis
cggcggauccagcac

SEQ ID NO: 821327 - RNA, 18 nt, Mycobacterium avium subsp. paratuberculosis
cggcggauccagcaccgc

SEQ ID NO: 821328 - RNA, 20 nt, Mycobacterium avium subsp. paratuberculosis
cggcggauccagcaccgcca

SEQ ID NO: 821329 - RNA, 21 nt, Mycobacterium avium subsp. paratuberculosis
cggcggauccagcaccgccac

SEQ ID NO: 821330 - RNA, 22 nt, Mycobacterium avium subsp. paratuberculosis
cggcggauccagcaccgccacg

SEQ ID NO: 821331 - RNA, 13 nt, Mycobacterium avium subsp. paratuberculosis
cggcggacuggcu

SEQ ID NO: 821332 - RNA, 23 nt, Mycobacterium avium subsp. paratuberculosis
cggcggacuggcugagcagcacc

SEQ ID NO: 821333 - RNA, 16 nt, Mycobacterium avium subsp. paratuberculosis
cggcggaggccugcgc

SEQ ID NO: 821334 - RNA, 22 nt, Mycobacterium avium subsp. paratuberculosis
cggcggaggccugcgcggccgc

SEQ ID NO: 821335 - RNA, 17 nt, Mycobacterium avium subsp. paratuberculosis
cggcggaggucagcggc

SEQ ID NO: 821336 - RNA, 18 nt, Mycobacterium avium subsp. paratuberculosis
cggcggaggucauggcga

SEQ ID NO: 821337 - RNA, 16 nt, Mycobacterium avium subsp. paratuberculosis
cggcggacucggcgaa

SEQ ID NO: 821338 - RNA, 14 nt, Mycobacterium avium subsp. paratuberculosis
cggcggaccggcgg

SEQ ID NO: 821339 - RNA, 19 nt, Mycobacterium avium subsp. paratuberculosis
cggcggaccggcggccgcc

SEQ ID NO: 821340 - RNA, 19 nt, Mycobacterium avium subsp. paratuberculosis
cggcggacgauguccgccg

SEQ ID NO: 821341 - RNA, 21 nt, Mycobacterium avium subsp. paratuberculosis
cggcggacgauguccgccggc

SEQ ID NO: 821342 - RNA, 13 nt, Mycobacterium avium subsp. paratuberculosis
cggcggacgcggc

SEQ ID NO: 821343 - RNA, 21 nt, Mycobacterium avium subsp. paratuberculosis
cggucaaacccauugucgccg

SEQ ID NO: 821344 - RNA, 20 nt, Mycobacterium avium subsp. paratuberculosis
cggucaacggcucggucaag

SEQ ID NO: 821345 - RNA, 23 nt, Mycobacterium avium subsp. paratuberculosis
cggucaagaacgaaucgucgccg

SEQ ID NO: 821346 - RNA, 23 nt, Mycobacterium avium subsp. paratuberculosis
cggucaagaacgcaaucgcccag

SEQ ID NO: 821347 - RNA, 15 nt, Mycobacterium avium subsp. paratuberculosis
cggucaagccggcca

SEQ ID NO: 821348 - RNA, 17 nt, Mycobacterium avium subsp. paratuberculosis
cggucaagccggccagc

SEQ ID NO: 821349 - RNA, 18 nt, Mycobacterium avium subsp. paratuberculosis
cggucaagccggccagca

SEQ ID NO: 821350 - RNA, 23 nt, Mycobacterium avium subsp. paratuberculosis
cggucaagccggccagcagcggc

SEQ ID NO: 821351 - RNA, 20 nt, Mycobacterium avium subsp. paratuberculosis
cggucaagcgcuuucgccga

SEQ ID NO: 821352 - RNA, 16 nt, Mycobacterium avium subsp. paratuberculosis
cggucaacgccgcgcg

SEQ ID NO: 821353 - RNA, 20 nt, Mycobacterium avium subsp. paratuberculosis
cggucaccagcggcccgcug

SEQ ID NO: 821354 - RNA, 14 nt, Mycobacterium avium subsp. paratuberculosis
cggucaccagcucc

SEQ ID NO: 821355 - RNA, 20 nt, Mycobacterium avium subsp. paratuberculosis
cggucaccaucagcaccgcc

SEQ ID NO: 821356 - RNA, 19 nt, Mycobacterium avium subsp. paratuberculosis
cggucacggucuggcuggu

SEQ ID NO: 821357 - RNA, 20 nt, Mycobacterium avium subsp. paratuberculosis
cggucacggucuggcuggug

SEQ ID NO: 821358 - RNA, 22 nt, Mycobacterium avium subsp. paratuberculosis
cggucagacgaugggccgcccg

SEQ ID NO: 821359 - RNA, 23 nt, Mycobacterium avium subsp. paratuberculosis
cggucagacgaugggccgcccgc

SEQ ID NO: 821360 - RNA, 14 nt, Mycobacterium avium subsp. paratuberculosis
cggucacgcuggcg

SEQ ID NO: 821361 - RNA, 17 nt, Mycobacterium avium subsp. paratuberculosis
cggucacggacagccgg

SEQ ID NO: 821362 - RNA, 14 nt, Mycobacterium avium subsp. paratuberculosis
cggucacggccgcc

SEQ ID NO: 821363 - RNA, 15 nt, Mycobacterium avium subsp. paratuberculosis
cggucacggccgcca

SEQ ID NO: 821364 - RNA, 14 nt, Mycobacterium avium subsp. paratuberculosis
cggucacggcgucg

SEQ ID NO: 821365 - RNA, 16 nt, Mycobacterium avium subsp. paratuberculosis
cggucacggcgucggc

SEQ ID NO: 821366 - RNA, 17 nt, Mycobacterium avium subsp. paratuberculosis
cggucacggcgucggcg

SEQ ID NO: 821367 - RNA, 14 nt, Mycobacterium avium subsp. paratuberculosis
cggucacgcccggg

SEQ ID NO: 821368 - RNA, 20 nt, Mycobacterium avium subsp. paratuberculosis
cggucacccgguugagcacc

SEQ ID NO: 821369 - RNA, 19 nt, Mycobacterium avium subsp. paratuberculosis
cggucacccgugggccgac

SEQ ID NO: 821370 - RNA, 21 nt, Mycobacterium avium subsp. paratuberculosis
cggucacccgugggccgaccg

SEQ ID NO: 821371 - RNA, 21 nt, Mycobacterium avium subsp. paratuberculosis
cggucaccgagcggccgucca

SEQ ID NO: 821372 - RNA, 21 nt, Mycobacterium avium subsp. paratuberculosis
cggucaccccgaguucggcca

SEQ ID NO: 821373 - RNA, 17 nt, Mycobacterium avium subsp. paratuberculosis
cggucaccggucgcguu

SEQ ID NO: 821374 - RNA, 19 nt, Mycobacterium avium subsp. paratuberculosis
cggucaccggucggugccc

SEQ ID NO: 821375 - RNA, 22 nt, Mycobacterium avium subsp. paratuberculosis
cggucaccggucggugcccagc

SEQ ID NO: 821376 - RNA, 14 nt, Mycobacterium avium subsp. paratuberculosis
cggucaccggcagg

SEQ ID NO: 821377 - RNA, 15 nt, Mycobacterium avium subsp. paratuberculosis
cggucaccucgucga

SEQ ID NO: 821378 - RNA, 16 nt, Mycobacterium avium subsp. paratuberculosis
cggucaccuugaccau

SEQ ID NO: 821379 - RNA, 19 nt, Mycobacterium avium subsp. paratuberculosis
cggucaccuugaccaugag

SEQ ID NO: 821380 - RNA, 18 nt, Mycobacterium avium subsp. paratuberculosis
cgguaggccggccgcagc

SEQ ID NO: 821381 - RNA, 18 nt, Mycobacterium avium subsp. paratuberculosis
cgguaggcgcaccgccgg

SEQ ID NO: 821382 - RNA, 18 nt, Mycobacterium avium subsp. paratuberculosis
cgguagaugucggguccg

SEQ ID NO: 821383 - RNA, 15 nt, Mycobacterium avium subsp. paratuberculosis
cgguagccagcaccg

SEQ ID NO: 821384 - RNA, 18 nt, Mycobacterium avium subsp. paratuberculosis
cgguagccagcaccgccc

SEQ ID NO: 821385 - RNA, 21 nt, Mycobacterium avium subsp. paratuberculosis
cgguagccagcaccgccccgg

SEQ ID NO: 821386 - RNA, 23 nt, Mycobacterium avium subsp. paratuberculosis
cgguagggucgggugcggcggug

SEQ ID NO: 821387 - RNA, 19 nt, Mycobacterium avium subsp. paratuberculosis
cgguagggccggucaccgg

SEQ ID NO: 821388 - RNA, 15 nt, Mycobacterium avium subsp. paratuberculosis
cgguaggcgcggucg

SEQ ID NO: 821389 - RNA, 18 nt, Mycobacterium avium subsp. paratuberculosis
cgguaggcgcggucggug

SEQ ID NO: 821390 - RNA, 13 nt, Mycobacterium avium subsp. paratuberculosis
cgguaggcggcca

SEQ ID NO: 821391 - RNA, 17 nt, Mycobacterium avium subsp. paratuberculosis
cgguaggcggccagcgc

SEQ ID NO: 821392 - RNA, 19 nt, Mycobacterium avium subsp. paratuberculosis
cgguaggcggccagcgccc

SEQ ID NO: 821393 - RNA, 18 nt, Mycobacterium avium subsp. paratuberculosis
cgguaggugaucgccucg

SEQ ID NO: 821394 - RNA, 17 nt, Mycobacterium avium subsp. paratuberculosis
cgguaggugccggccgc

SEQ ID NO: 821395 - RNA, 18 nt, Mycobacterium avium subsp. paratuberculosis
cgguaggugccggccgcg

SEQ ID NO: 821396 - RNA, 15 nt, Mycobacterium avium subsp. paratuberculosis
cgguaggugucgaug

SEQ ID NO: 821397 - RNA, 15 nt, Mycobacterium avium subsp. paratuberculosis
cgguagucgucgagg

SEQ ID NO: 821398 - RNA, 17 nt, Mycobacterium avium subsp. paratuberculosis
cgguagugcuugcccug

SEQ ID NO: 821399 - RNA, 18 nt, Mycobacterium avium subsp. paratuberculosis
cgguaugcggcgacgauc

SEQ ID NO: 821400 - RNA, 15 nt, Mycobacterium avium subsp. paratuberculosis
cgguaucgggucacc

SEQ ID NO: 821401 - RNA, 21 nt, Mycobacterium avium subsp. paratuberculosis
cgguaucgguggauccgguga

SEQ ID NO: 821402 - RNA, 13 nt, Mycobacterium avium subsp. paratuberculosis
cgguaucgagcac

SEQ ID NO: 821403 - RNA, 21 nt, Mycobacterium avium subsp. paratuberculosis
cgguacuguuacgcccgaucc

SEQ ID NO: 821404 - RNA, 17 nt, Mycobacterium avium subsp. paratuberculosis
cgguagacaccgccguu

SEQ ID NO: 821405 - RNA, 15 nt, Mycobacterium avium subsp. paratuberculosis
cgguagagcggcacc

SEQ ID NO: 821406 - RNA, 18 nt, Mycobacterium avium subsp. paratuberculosis
cgguagagcggcaccagg

SEQ ID NO: 821407 - RNA, 16 nt, Mycobacterium avium subsp. paratuberculosis
cgguagaucagcgccu

SEQ ID NO: 821408 - RNA, 17 nt, Mycobacterium avium subsp. paratuberculosis
cgguagaucagcgccug

SEQ ID NO: 821409 - RNA, 23 nt, Mycobacterium avium subsp. paratuberculosis
cgguagaucgccggaucgagcac

SEQ ID NO: 821410 - RNA, 15 nt, Mycobacterium avium subsp. paratuberculosis
cgguacgugcgccgg

SEQ ID NO: 821411 - RNA, 16 nt, Mycobacterium avium subsp. paratuberculosis
cgguacgugcgccggc

SEQ ID NO: 821412 - RNA, 19 nt, Mycobacterium avium subsp. paratuberculosis
cgguacgcgccgcgcgccc

SEQ ID NO: 821413 - RNA, 16 nt, Mycobacterium avium subsp. paratuberculosis
cgguacggaucgccgg

SEQ ID NO: 821414 - RNA, 21 nt, Mycobacterium avium subsp. paratuberculosis
cgguacggaucgccggacagc

SEQ ID NO: 821415 - RNA, 17 nt, Mycobacterium avium subsp. paratuberculosis
cgguacggccgacgccc

SEQ ID NO: 821416 - RNA, 18 nt, Mycobacterium avium subsp. paratuberculosis
cgguacggccgacgccca

SEQ ID NO: 821417 - RNA, 14 nt, Mycobacterium avium subsp. paratuberculosis
cgguaccgaugacc

SEQ ID NO: 821418 - RNA, 14 nt, Mycobacterium avium subsp. paratuberculosis
cgguaccgccgauc

SEQ ID NO: 821419 - RNA, 20 nt, Mycobacterium avium subsp. paratuberculosis
cgguaccgccggccaggcga

SEQ ID NO: 821420 - RNA, 12 nt, Mycobacterium avium subsp. paratuberculosis
cgguaccgccgg

SEQ ID NO: 821421 - RNA, 18 nt, Mycobacterium avium subsp. paratuberculosis
cggguugcugagccgccg

SEQ ID NO: 821422 - RNA, 19 nt, Mycobacterium avium subsp. paratuberculosis
cggguugcugagccgccga

SEQ ID NO: 821423 - RNA, 21 nt, Mycobacterium avium subsp. paratuberculosis
cggguugcugagccgccgagc

SEQ ID NO: 821424 - RNA, 13 nt, Mycobacterium avium subsp. paratuberculosis
cggguuggccagg

SEQ ID NO: 821425 - RNA, 23 nt, Mycobacterium avium subsp. paratuberculosis
cggguugcggaucggugcaggcc

SEQ ID NO: 821426 - RNA, 15 nt, Mycobacterium avium subsp. paratuberculosis
cggguugcgggccag

SEQ ID NO: 821427 - RNA, 15 nt, Mycobacterium avium subsp. paratuberculosis
cggguuggccgucga

SEQ ID NO: 821428 - RNA, 14 nt, Mycobacterium avium subsp. paratuberculosis
cggguuggcgcgca

SEQ ID NO: 821429 - RNA, 17 nt, Mycobacterium avium subsp. paratuberculosis
cggguuggcgcgcacca

SEQ ID NO: 821430 - RNA, 22 nt, Mycobacterium avium subsp. paratuberculosis
cggguuggcgcgcaccagcucg

SEQ ID NO: 821431 - RNA, 17 nt, Mycobacterium avium subsp. paratuberculosis
cggguugggcgccagca

SEQ ID NO: 821432 - RNA, 19 nt, Mycobacterium avium subsp. paratuberculosis
cggguugggcgccagcagc

SEQ ID NO: 821433 - RNA, 21 nt, Mycobacterium avium subsp. paratuberculosis
cgguacccccgccggggccgg

SEQ ID NO: 821434 - RNA, 23 nt, Mycobacterium avium subsp. paratuberculosis
cggguucuucagggcggugcggu

SEQ ID NO: 821435 - RNA, 17 nt, Mycobacterium avium subsp. paratuberculosis
cggguugcaggccacgc

SEQ ID NO: 821436 - RNA, 16 nt, Mycobacterium avium subsp. paratuberculosis
cggguugagcagguca

SEQ ID NO: 821437 - RNA, 22 nt, Mycobacterium avium subsp. paratuberculosis
cggguugagcaggucagccagg

SEQ ID NO: 821438 - RNA, 15 nt, Mycobacterium avium subsp. paratuberculosis
cggguugccggcggc

SEQ ID NO: 821439 - RNA, 17 nt, Mycobacterium avium subsp. paratuberculosis
cggguugccggcggcca

SEQ ID NO: 821440 - RNA, 16 nt, Mycobacterium avium subsp. paratuberculosis
cggguugccgucgacg

SEQ ID NO: 821441 - RNA, 18 nt, Mycobacterium avium subsp. paratuberculosis
cggguugccgucgacgaa

SEQ ID NO: 821442 - RNA, 23 nt, Mycobacterium avium subsp. paratuberculosis
cggguugcgaaagcccaggcccg

SEQ ID NO: 821443 - RNA, 12 nt, Mycobacterium avium subsp. paratuberculosis
cggguugcgcgg

SEQ ID NO: 821444 - RNA, 14 nt, Mycobacterium avium subsp. paratuberculosis
cggguugcgguccc

SEQ ID NO: 821445 - RNA, 18 nt, Mycobacterium avium subsp. paratuberculosis
cggguugcgguccccgga

SEQ ID NO: 821446 - RNA, 20 nt, Mycobacterium avium subsp. paratuberculosis
cggguugcgguccccggaga

SEQ ID NO: 821447 - RNA, 14 nt, Mycobacterium avium subsp. paratuberculosis
cggguguccgagcg

SEQ ID NO: 821448 - RNA, 19 nt, Mycobacterium avium subsp. paratuberculosis
cggguguccgagcgggccg

SEQ ID NO: 821449 - RNA, 14 nt, Mycobacterium avium subsp. paratuberculosis
cgggugucgacgcc

SEQ ID NO: 821450 - RNA, 16 nt, Mycobacterium avium subsp. paratuberculosis
cgggugucgacgccgg

SEQ ID NO: 821451 - RNA, 14 nt, Mycobacterium avium subsp. paratuberculosis
cgggugucgagcca

SEQ ID NO: 821452 - RNA, 13 nt, Mycobacterium avium subsp. paratuberculosis
cgggugucgcccu

SEQ ID NO: 821453 - RNA, 15 nt, Mycobacterium avium subsp. paratuberculosis
cgggugucgccgagc

SEQ ID NO: 821454 - RNA, 21 nt, Mycobacterium avium subsp. paratuberculosis
cgggugguguggcgucggccg

SEQ ID NO: 821455 - RNA, 22 nt, Mycobacterium avium subsp. paratuberculosis
cgggugguguggcgucggccgg

SEQ ID NO: 821456 - RNA, 15 nt, Mycobacterium avium subsp. paratuberculosis
cgggugggccgaccu

SEQ ID NO: 821457 - RNA, 14 nt, Mycobacterium avium subsp. paratuberculosis
cgggugggcggcac

SEQ ID NO: 821458 - RNA, 21 nt, Mycobacterium avium subsp. paratuberculosis
cgggugggcggcacaccgcgc

SEQ ID NO: 821459 - RNA, 16 nt, Mycobacterium avium subsp. paratuberculosis
cgggugggcagcgcga

SEQ ID NO: 821460 - RNA, 17 nt, Mycobacterium avium subsp. paratuberculosis
cggguucggucucggcg

SEQ ID NO: 821461 - RNA, 19 nt, Mycobacterium avium subsp. paratuberculosis
cggguucggucucggcggc

SEQ ID NO: 821462 - RNA, 20 nt, Mycobacterium avium subsp. paratuberculosis
cggguucgacgccucggugc

SEQ ID NO: 821463 - RNA, 22 nt, Mycobacterium avium subsp. paratuberculosis
cggguucgccggugaccgcgcc

SEQ ID NO: 821464 - RNA, 23 nt, Mycobacterium avium subsp. paratuberculosis
cggguucgccggugaccgcgccg

SEQ ID NO: 821465 - RNA, 16 nt, Mycobacterium avium subsp. paratuberculosis
cggguucgcgcagcca

SEQ ID NO: 821466 - RNA, 21 nt, Mycobacterium avium subsp. paratuberculosis
cggguucgcgcagccaccgcc

SEQ ID NO: 821467 - RNA, 15 nt, Mycobacterium avium subsp. paratuberculosis
cggguguaggcccga

SEQ ID NO: 821468 - RNA, 19 nt, Mycobacterium avium subsp. paratuberculosis
cggguguauucgcccaccc

SEQ ID NO: 821469 - RNA, 18 nt, Mycobacterium avium subsp. paratuberculosis
cgggugucaggucggcga

SEQ ID NO: 821470 - RNA, 20 nt, Mycobacterium avium subsp. paratuberculosis
cgggugucaggucggcgaug

SEQ ID NO: 821471 - RNA, 15 nt, Mycobacterium avium subsp. paratuberculosis
cgggugguuggccgc

SEQ ID NO: 821472 - RNA, 17 nt, Mycobacterium avium subsp. paratuberculosis
cgggugguuggccgcca

SEQ ID NO: 821473 - RNA, 20 nt, Mycobacterium avium subsp. paratuberculosis
cggguuccgguuggccaggu

SEQ ID NO: 821474 - RNA, 21 nt, Mycobacterium avium subsp. paratuberculosis
cgggucugcucacgcaacgag

SEQ ID NO: 821475 - RNA, 14 nt, Mycobacterium avium subsp. paratuberculosis
cgggucuggcucgg

SEQ ID NO: 821476 - RNA, 15 nt, Mycobacterium avium subsp. paratuberculosis
cgggucuggcucggc

SEQ ID NO: 821477 - RNA, 21 nt, Mycobacterium avium subsp. paratuberculosis
cgggucuggcucggcaccaga

SEQ ID NO: 821478 - RNA, 16 nt, Mycobacterium avium subsp. paratuberculosis
cgggucuuccacgccg

SEQ ID NO: 821479 - RNA, 17 nt, Mycobacterium avium subsp. paratuberculosis
cgggugaacgaggccgc

SEQ ID NO: 821480 - RNA, 18 nt, Mycobacterium avium subsp. paratuberculosis
cgggugaacgaggccgcg

SEQ ID NO: 821481 - RNA, 19 nt, Mycobacterium avium subsp. paratuberculosis
cgggugaacgaggccgcgc

SEQ ID NO: 821482 - RNA, 19 nt, Mycobacterium avium subsp. paratuberculosis
cgggugaacccgacguugc

SEQ ID NO: 821483 - RNA, 21 nt, Mycobacterium avium subsp. paratuberculosis
cgggugaccgccuuggcgcgc

SEQ ID NO: 821484 - RNA, 22 nt, Mycobacterium avium subsp. paratuberculosis
cgggugaccgccuuggcgcgcu

SEQ ID NO: 821485 - RNA, 13 nt, Mycobacterium avium subsp. paratuberculosis
cgggugaccggcg

SEQ ID NO: 821486 - RNA, 15 nt, Mycobacterium avium subsp. paratuberculosis
cgggugaccggcgcg

SEQ ID NO: 821487 - RNA, 18 nt, Mycobacterium avium subsp. paratuberculosis
cgggugaccggcgcgcag

SEQ ID NO: 821488 - RNA, 15 nt, Mycobacterium avium subsp. paratuberculosis
cgggugaccggcggc

SEQ ID NO: 821489 - RNA, 15 nt, Mycobacterium avium subsp. paratuberculosis
cgggugacgaucacc

SEQ ID NO: 821490 - RNA, 18 nt, Mycobacterium avium subsp. paratuberculosis
cgggugacgaucaccgcu

SEQ ID NO: 821491 - RNA, 21 nt, Mycobacterium avium subsp. paratuberculosis
cgggugacgaucaccgcugcc

SEQ ID NO: 821492 - RNA, 19 nt, Mycobacterium avium subsp. paratuberculosis
cgggugacgccucaggcga

SEQ ID NO: 821493 - RNA, 24 nt, Mycobacterium avium subsp. paratuberculosis
cgggugacgccucaggcgagcacc

SEQ ID NO: 821494 - RNA, 13 nt, Mycobacterium avium subsp. paratuberculosis
cgggugacgcuga

SEQ ID NO: 821495 - RNA, 16 nt, Mycobacterium avium subsp. paratuberculosis
cgggugacgcugaccu

SEQ ID NO: 821496 - RNA, 13 nt, Mycobacterium avium subsp. paratuberculosis
cgggugacggcag

SEQ ID NO: 821497 - RNA, 17 nt, Mycobacterium avium subsp. paratuberculosis
cgggugaaucgacaccg

SEQ ID NO: 821498 - RNA, 18 nt, Mycobacterium avium subsp. paratuberculosis
cgggugaaucgacaccgc

SEQ ID NO: 821499 - RNA, 15 nt, Mycobacterium avium subsp. paratuberculosis
cgggugagacggcca

SEQ ID NO: 821500 - RNA, 22 nt, Mycobacterium avium subsp. paratuberculosis
cgggugagacggccagcagcac

SEQ ID NO: 821501 - RNA, 21 nt, Mycobacterium avium subsp. paratuberculosis
cgggugagccggucgaacgcc

SEQ ID NO: 821502 - RNA, 17 nt, Mycobacterium avium subsp. paratuberculosis
cgggugaggacgcccgg

SEQ ID NO: 821503 - RNA, 13 nt, Mycobacterium avium subsp. paratuberculosis
cgggugaggccag

SEQ ID NO: 821504 - RNA, 15 nt, Mycobacterium avium subsp. paratuberculosis
cgggugaggggcgcg

SEQ ID NO: 821505 - RNA, 16 nt, Mycobacterium avium subsp. paratuberculosis
cgggugaggggcgcgc

SEQ ID NO: 821506 - RNA, 15 nt, Mycobacterium avium subsp. paratuberculosis
cgggugauaccggcc

SEQ ID NO: 821507 - RNA, 23 nt, Mycobacterium avium subsp. paratuberculosis
cgggugauaccggcccagcgcgg

SEQ ID NO: 821508 - RNA, 23 nt, Mycobacterium avium subsp. paratuberculosis
cgggugaucaacgcggacacggc

SEQ ID NO: 821509 - RNA, 19 nt, Mycobacterium avium subsp. paratuberculosis
cggguggcgucgccgccgg

SEQ ID NO: 821510 - RNA, 20 nt, Mycobacterium avium subsp. paratuberculosis
cgggugaaucgacaccgcac

SEQ ID NO: 821511 - RNA, 14 nt, Mycobacterium avium subsp. paratuberculosis
cgggcugcccacca

SEQ ID NO: 821512 - RNA, 16 nt, Mycobacterium avium subsp. paratuberculosis
cgggcugcccaccacc

SEQ ID NO: 821513 - RNA, 17 nt, Mycobacterium avium subsp. paratuberculosis
cgggcugcgggcaucgc

SEQ ID NO: 821514 - RNA, 21 nt, Mycobacterium avium subsp. paratuberculosis
cgggcugcgggcaucgcuggu

SEQ ID NO: 821515 - RNA, 17 nt, Mycobacterium avium subsp. paratuberculosis
cgggcugcgguuccggg

SEQ ID NO: 821516 - RNA, 19 nt, Mycobacterium avium subsp. paratuberculosis
cgggcugcgguuccgggcg

SEQ ID NO: 821517 - RNA, 22 nt, Mycobacterium avium subsp. paratuberculosis
cgggcugauccgcgacgccaac

SEQ ID NO: 821518 - RNA, 12 nt, Mycobacterium avium subsp. paratuberculosis
cgggcugcacca

SEQ ID NO: 821519 - RNA, 22 nt, Mycobacterium avium subsp. paratuberculosis
cgggcugcaccagggcgucgag

SEQ ID NO: 821520 - RNA, 14 nt, Mycobacterium avium subsp. paratuberculosis
cgggcugcacgcug

SEQ ID NO: 821521 - RNA, 19 nt, Mycobacterium avium subsp. paratuberculosis
cgggcugcagggccggguc

SEQ ID NO: 821522 - RNA, 17 nt, Mycobacterium avium subsp. paratuberculosis
cggggccggugauggug

SEQ ID NO: 821523 - RNA, 23 nt, Mycobacterium avium subsp. paratuberculosis
cggggccggugcguccgccggcg

SEQ ID NO: 821524 - RNA, 23 nt, Mycobacterium avium subsp. paratuberculosis
cggggccgguuggugcgccguca

SEQ ID NO: 821525 - RNA, 14 nt, Mycobacterium avium subsp. paratuberculosis
cggggccguccggg

SEQ ID NO: 821526 - RNA, 15 nt, Mycobacterium avium subsp. paratuberculosis
cggggccguccggga

SEQ ID NO: 821527 - RNA, 16 nt, Mycobacterium avium subsp. paratuberculosis
cgggcuggccaggcuc

SEQ ID NO: 821528 - RNA, 16 nt, Mycobacterium avium subsp. paratuberculosis
cggggccggcgcggug

SEQ ID NO: 821529 - RNA, 17 nt, Mycobacterium avium subsp. paratuberculosis
cggggccggcgcggugc

SEQ ID NO: 821530 - RNA, 13 nt, Mycobacterium avium subsp. paratuberculosis
cggggccggcgcu

SEQ ID NO: 821531 - RNA, 13 nt, Mycobacterium avium subsp. paratuberculosis
cggggccggcggc

SEQ ID NO: 821532 - RNA, 18 nt, Mycobacterium avium subsp. paratuberculosis
cggggccggcggcggcca

SEQ ID NO: 821533 - RNA, 19 nt, Mycobacterium avium subsp. paratuberculosis
cgggcugcugcacgucgcc

SEQ ID NO: 821534 - RNA, 20 nt, Mycobacterium avium subsp. paratuberculosis
cgggcugcgcuugcggcgca

SEQ ID NO: 821535 - RNA, 21 nt, Mycobacterium avium subsp. paratuberculosis
cgggcugcgcuugcggcgcag

SEQ ID NO: 821536 - RNA, 22 nt, Mycobacterium avium subsp. paratuberculosis
cgggcugcggcgagucccggcg

SEQ ID NO: 821537 - RNA, 18 nt, Mycobacterium avium subsp. paratuberculosis
cgggcugcgcagcaccgu

SEQ ID NO: 821538 - RNA, 21 nt, Mycobacterium avium subsp. paratuberculosis
cggggcguacgcgcugccgac

SEQ ID NO: 821539 - RNA, 16 nt, Mycobacterium avium subsp. paratuberculosis
cggggccuccaccagc

SEQ ID NO: 821540 - RNA, 21 nt, Mycobacterium avium subsp. paratuberculosis
cggggccuccagccagcgcgc

SEQ ID NO: 821541 - RNA, 22 nt, Mycobacterium avium subsp. paratuberculosis
cggggccucgaugcggccgucg

SEQ ID NO: 821542 - RNA, 23 nt, Mycobacterium avium subsp. paratuberculosis
cggggccucgaugcggccgucgg

SEQ ID NO: 821543 - RNA, 15 nt, Mycobacterium avium subsp. paratuberculosis
cggggccucgucgcc

SEQ ID NO: 821544 - RNA, 19 nt, Mycobacterium avium subsp. paratuberculosis
cggggccucgucgccgcgg

SEQ ID NO: 821545 - RNA, 21 nt, Mycobacterium avium subsp. paratuberculosis
cggggccuucuuggcggcggc

SEQ ID NO: 821546 - RNA, 17 nt, Mycobacterium avium subsp. paratuberculosis
cggggcgaacccggcgc

SEQ ID NO: 821547 - RNA, 16 nt, Mycobacterium avium subsp. paratuberculosis
cggggcgaccuggacg

SEQ ID NO: 821548 - RNA, 21 nt, Mycobacterium avium subsp. paratuberculosis
cggggcgaccuugcgcagccg

SEQ ID NO: 821549 - RNA, 22 nt, Mycobacterium avium subsp. paratuberculosis
cggggcgaccuugcgcagccgg

SEQ ID NO: 821550 - RNA, 18 nt, Mycobacterium avium subsp. paratuberculosis
cggggcgagcuggccgcc

SEQ ID NO: 821551 - RNA, 11 nt, Mycobacterium avium subsp. paratuberculosis
cggggcgucga

SEQ ID NO: 821552 - RNA, 22 nt, Mycobacterium avium subsp. paratuberculosis
cggggcgucggacgccaguggc

SEQ ID NO: 821553 - RNA, 14 nt, Mycobacterium avium subsp. paratuberculosis
cggggcgucggcgg

SEQ ID NO: 821554 - RNA, 17 nt, Mycobacterium avium subsp. paratuberculosis
cggggcgucggcggccu

SEQ ID NO: 821555 - RNA, 19 nt, Mycobacterium avium subsp. paratuberculosis
cggggcgugcccggcgccg

SEQ ID NO: 821556 - RNA, 23 nt, Mycobacterium avium subsp. paratuberculosis
cggggcgugcccggcgccgacca

SEQ ID NO: 821557 - RNA, 15 nt, Mycobacterium avium subsp. paratuberculosis
cggggcguggcggaa

SEQ ID NO: 821558 - RNA, 17 nt, Mycobacterium avium subsp. paratuberculosis
cggggcguugcccgucg

SEQ ID NO: 821559 - RNA, 19 nt, Mycobacterium avium subsp. paratuberculosis
cggggcgucgcccgccgac

SEQ ID NO: 821560 - RNA, 15 nt, Mycobacterium avium subsp. paratuberculosis
cggggcucauacggc

SEQ ID NO: 821561 - RNA, 19 nt, Mycobacterium avium subsp. paratuberculosis
cggggcucauacggcggcu

SEQ ID NO: 821562 - RNA, 21 nt, Mycobacterium avium subsp. paratuberculosis
cggggcucauacggcggcucg

SEQ ID NO: 821563 - RNA, 18 nt, Mycobacterium avium subsp. paratuberculosis
cggggcucgacaggcagc

SEQ ID NO: 821564 - RNA, 21 nt, Mycobacterium avium subsp. paratuberculosis
cggggugguugaucacgggca

SEQ ID NO: 821565 - RNA, 20 nt, Mycobacterium avium subsp. paratuberculosis
cggggugugcucggcggcgc

SEQ ID NO: 821566 - RNA, 22 nt, Mycobacterium avium subsp. paratuberculosis
cggggugugcucggcggcgcag

SEQ ID NO: 821567 - RNA, 20 nt, Mycobacterium avium subsp. paratuberculosis
cgggguguggcugucgggga

SEQ ID NO: 821568 - RNA, 13 nt, Mycobacterium avium subsp. paratuberculosis
cgggguguucacc

SEQ ID NO: 821569 - RNA, 15 nt, Mycobacterium avium subsp. paratuberculosis
cgggguguucaccgc

SEQ ID NO: 821570 - RNA, 16 nt, Mycobacterium avium subsp. paratuberculosis
cgggguguucaccgcg

SEQ ID NO: 821571 - RNA, 22 nt, Mycobacterium avium subsp. paratuberculosis
cgggguguucaccgcgccgggc

SEQ ID NO: 821572 - RNA, 23 nt, Mycobacterium avium subsp. paratuberculosis
cgggguguucaccgcgccgggca

SEQ ID NO: 821573 - RNA, 21 nt, Mycobacterium avium subsp. paratuberculosis
cggggugaugccggcgguacc

SEQ ID NO: 821574 - RNA, 17 nt, Mycobacterium avium subsp. paratuberculosis
cggggugggccaucggc

SEQ ID NO: 821575 - RNA, 16 nt, Mycobacterium avium subsp. paratuberculosis
cgggguggggacgacg

SEQ ID NO: 821576 - RNA, 17 nt, Mycobacterium avium subsp. paratuberculosis
cgggguggggacgacgc

SEQ ID NO: 821577 - RNA, 13 nt, Mycobacterium avium subsp. paratuberculosis
cgggguguccagc

SEQ ID NO: 821578 - RNA, 14 nt, Mycobacterium avium subsp. paratuberculosis
cgggguguccagcg

SEQ ID NO: 821579 - RNA, 21 nt, Mycobacterium avium subsp. paratuberculosis
cggggugucgacccaggucga

SEQ ID NO: 821580 - RNA, 14 nt, Mycobacterium avium subsp. paratuberculosis
cggggugucgcggc

SEQ ID NO: 821581 - RNA, 19 nt, Mycobacterium avium subsp. paratuberculosis
cggggugucgcggcugcgc

SEQ ID NO: 821582 - RNA, 13 nt, Mycobacterium avium subsp. paratuberculosis
cggggugugcagc

SEQ ID NO: 821583 - RNA, 14 nt, Mycobacterium avium subsp. paratuberculosis
cggggugugcaggc

SEQ ID NO: 821584 - RNA, 16 nt, Mycobacterium avium subsp. paratuberculosis
cggggugugcaggccg

SEQ ID NO: 821585 - RNA, 14 nt, Mycobacterium avium subsp. paratuberculosis
cggggugugcggca

SEQ ID NO: 821586 - RNA, 15 nt, Mycobacterium avium subsp. paratuberculosis
cggggugugcggcac

SEQ ID NO: 821587 - RNA, 16 nt, Mycobacterium avium subsp. paratuberculosis
cggggugugcggcacg

SEQ ID NO: 821588 - RNA, 17 nt, Mycobacterium avium subsp. paratuberculosis
cggggugugcggcacgg

SEQ ID NO: 821589 - RNA, 20 nt, Mycobacterium avium subsp. paratuberculosis
cggggugugcggcacggcga

SEQ ID NO: 821590 - RNA, 14 nt, Mycobacterium avium subsp. paratuberculosis
cggggucgucgacg

SEQ ID NO: 821591 - RNA, 22 nt, Mycobacterium avium subsp. paratuberculosis
cggggucgucgacggccgcgcc

SEQ ID NO: 821592 - RNA, 13 nt, Mycobacterium avium subsp. paratuberculosis
cggggucgucgcg

SEQ ID NO: 821593 - RNA, 14 nt, Mycobacterium avium subsp. paratuberculosis
cggggucgggccgg

SEQ ID NO: 821594 - RNA, 19 nt, Mycobacterium avium subsp. paratuberculosis
cggggucgggccggacagc

SEQ ID NO: 821595 - RNA, 22 nt, Mycobacterium avium subsp. paratuberculosis
cggggucguugcacaccaccag

SEQ ID NO: 821596 - RNA, 14 nt, Mycobacterium avium subsp. paratuberculosis
cggggucugcacga

SEQ ID NO: 821597 - RNA, 12 nt, Mycobacterium avium subsp. paratuberculosis
cggggugaccgu

SEQ ID NO: 821598 - RNA, 18 nt, Mycobacterium avium subsp. paratuberculosis
cggggugacuucgagccg

SEQ ID NO: 821599 - RNA, 19 nt, Mycobacterium avium subsp. paratuberculosis
cggggugacuucgagccgg

SEQ ID NO: 821600 - RNA, 16 nt, Mycobacterium avium subsp. paratuberculosis
cggggugagcaccgcg

SEQ ID NO: 821601 - RNA, 19 nt, Mycobacterium avium subsp. paratuberculosis
cggggugagcaccgcgacc

SEQ ID NO: 821602 - RNA, 22 nt, Mycobacterium avium subsp. paratuberculosis
cggggugagcaccgcgaccagc

SEQ ID NO: 821603 - RNA, 23 nt, Mycobacterium avium subsp. paratuberculosis
cggggugagcaccgcgaccagcu

SEQ ID NO: 821604 - RNA, 21 nt, Mycobacterium avium subsp. paratuberculosis
cggggugagcagggccagcgg

SEQ ID NO: 821605 - RNA, 19 nt, Mycobacterium avium subsp. paratuberculosis
cggggguucguugcgccgc

SEQ ID NO: 821606 - RNA, 21 nt, Mycobacterium avium subsp. paratuberculosis
cggggguucguugcgccgcca

SEQ ID NO: 821607 - RNA, 15 nt, Mycobacterium avium subsp. paratuberculosis
cggggguggccagcu

SEQ ID NO: 821608 - RNA, 13 nt, Mycobacterium avium subsp. paratuberculosis
cggggguggcggu

SEQ ID NO: 821609 - RNA, 19 nt, Mycobacterium avium subsp. paratuberculosis
cgggggugucguagcggcu

SEQ ID NO: 821610 - RNA, 22 nt, Mycobacterium avium subsp. paratuberculosis
cgggggugaaggcggccaccgc

SEQ ID NO: 821611 - RNA, 12 nt, Mycobacterium avium subsp. paratuberculosis
cgggggugccga

SEQ ID NO: 821612 - RNA, 15 nt, Mycobacterium avium subsp. paratuberculosis
cgggggugccgaccg

SEQ ID NO: 821613 - RNA, 16 nt, Mycobacterium avium subsp. paratuberculosis
cgggggugccgcuccg

SEQ ID NO: 821614 - RNA, 18 nt, Mycobacterium avium subsp. paratuberculosis
cgggguacucggcggcgg

SEQ ID NO: 821615 - RNA, 15 nt, Mycobacterium avium subsp. paratuberculosis
cgggguagaggccgc

SEQ ID NO: 821616 - RNA, 20 nt, Mycobacterium avium subsp. paratuberculosis
cgggguagaggccgcggauc

SEQ ID NO: 821617 - RNA, 16 nt, Mycobacterium avium subsp. paratuberculosis
cgggguagccggcccg

SEQ ID NO: 821618 - RNA, 15 nt, Mycobacterium avium subsp. paratuberculosis
cggggucggccgagg

SEQ ID NO: 821619 - RNA, 21 nt, Mycobacterium avium subsp. paratuberculosis
cggggucggccgagguccgcg

SEQ ID NO: 821620 - RNA, 13 nt, Mycobacterium avium subsp. paratuberculosis
cggggucggcgcc

SEQ ID NO: 821621 - RNA, 14 nt, Mycobacterium avium subsp. paratuberculosis
cggggucggcgccg

SEQ ID NO: 821622 - RNA, 17 nt, Mycobacterium avium subsp. paratuberculosis
cggggucggcgccgcgc

SEQ ID NO: 821623 - RNA, 13 nt, Mycobacterium avium subsp. paratuberculosis
cggggcuggcggc

SEQ ID NO: 821624 - RNA, 18 nt, Mycobacterium avium subsp. paratuberculosis
cggggcuggcggcgaaug

SEQ ID NO: 821625 - RNA, 18 nt, Mycobacterium avium subsp. paratuberculosis
cggggcugggcgccaugg

SEQ ID NO: 821626 - RNA, 20 nt, Mycobacterium avium subsp. paratuberculosis
cggggcugggcuuccacagc

SEQ ID NO: 821627 - RNA, 17 nt, Mycobacterium avium subsp. paratuberculosis
cgggggcggugcagccg

SEQ ID NO: 821628 - RNA, 19 nt, Mycobacterium avium subsp. paratuberculosis
cggggcugcgggccaggcg

SEQ ID NO: 821629 - RNA, 14 nt, Mycobacterium avium subsp. paratuberculosis
cggggggagaggcg

SEQ ID NO: 821630 - RNA, 17 nt, Mycobacterium avium subsp. paratuberculosis
cggggggagaggcgcgg

SEQ ID NO: 821631 - RNA, 14 nt, Mycobacterium avium subsp. paratuberculosis
cggggggcgagccg

SEQ ID NO: 821632 - RNA, 15 nt, Mycobacterium avium subsp. paratuberculosis
cggggggcgagccgg

SEQ ID NO: 821633 - RNA, 20 nt, Mycobacterium avium subsp. paratuberculosis
cggggggcgagccggcccgg

SEQ ID NO: 821634 - RNA, 19 nt, Mycobacterium avium subsp. paratuberculosis
cgggguucaguagcagcgu

SEQ ID NO: 821635 - RNA, 17 nt, Mycobacterium avium subsp. paratuberculosis
cggguaacccuccggcg

SEQ ID NO: 821636 - RNA, 14 nt, Mycobacterium avium subsp. paratuberculosis
cggguaaccgcagc

SEQ ID NO: 821637 - RNA, 15 nt, Mycobacterium avium subsp. paratuberculosis
cggguaaccgcagcc

SEQ ID NO: 821638 - RNA, 19 nt, Mycobacterium avium subsp. paratuberculosis
cgggguuccgucgaacagc

SEQ ID NO: 821639 - RNA, 23 nt, Mycobacterium avium subsp. paratuberculosis
cgggguugacccggccggucgcc

SEQ ID NO: 821640 - RNA, 16 nt, Mycobacterium avium subsp. paratuberculosis
cgggguugguuucggu

SEQ ID NO: 821641 - RNA, 21 nt, Mycobacterium avium subsp. paratuberculosis
cgggguugguuucgguccagg

SEQ ID NO: 821642 - RNA, 14 nt, Mycobacterium avium subsp. paratuberculosis
cggguagcgccgcc

SEQ ID NO: 821643 - RNA, 19 nt, Mycobacterium avium subsp. paratuberculosis
cggguagcgccgccggggc

SEQ ID NO: 821644 - RNA, 21 nt, Mycobacterium avium subsp. paratuberculosis
cggguagcgccgccggggcgg

SEQ ID NO: 821645 - RNA, 16 nt, Mycobacterium avium subsp. paratuberculosis
cggguaggacaccguc

SEQ ID NO: 821646 - RNA, 18 nt, Mycobacterium avium subsp. paratuberculosis
cggguaggcgccgaugcc

SEQ ID NO: 821647 - RNA, 20 nt, Mycobacterium avium subsp. paratuberculosis
cggguaggcgucgcgcagca

SEQ ID NO: 821648 - RNA, 15 nt, Mycobacterium avium subsp. paratuberculosis
cggguagggcagcca

SEQ ID NO: 821649 - RNA, 18 nt, Mycobacterium avium subsp. paratuberculosis
cggguagggcgccgucgg

SEQ ID NO: 821650 - RNA, 13 nt, Mycobacterium avium subsp. paratuberculosis
cggguacggcggc

SEQ ID NO: 821651 - RNA, 16 nt, Mycobacterium avium subsp. paratuberculosis
cggguacggcggccgc

SEQ ID NO: 821652 - RNA, 15 nt, Mycobacterium avium subsp. paratuberculosis
cggguacaccgagcc

SEQ ID NO: 821653 - RNA, 13 nt, Mycobacterium avium subsp. paratuberculosis
cggguacaccggc

SEQ ID NO: 821654 - RNA, 23 nt, Mycobacterium avium subsp. paratuberculosis
cggguaccacuugaaggaggcgg

SEQ ID NO: 821655 - RNA, 16 nt, Mycobacterium avium subsp. paratuberculosis
cggguagaaccagccc

SEQ ID NO: 821656 - RNA, 17 nt, Mycobacterium avium subsp. paratuberculosis
cggguagaaccagcccg

SEQ ID NO: 821657 - RNA, 22 nt, Mycobacterium avium subsp. paratuberculosis
cggguagacguucuccccgccg

SEQ ID NO: 821658 - RNA, 22 nt, Mycobacterium avium subsp. paratuberculosis
cggguagaucuccucggacccg

SEQ ID NO: 821659 - RNA, 22 nt, Mycobacterium avium subsp. paratuberculosis
cggguagccaugggucucggcg

SEQ ID NO: 821660 - RNA, 14 nt, Mycobacterium avium subsp. paratuberculosis
cggguagcccgcgu

SEQ ID NO: 821661 - RNA, 19 nt, Mycobacterium avium subsp. paratuberculosis
cggguagcccgcgugcaca

SEQ ID NO: 821662 - RNA, 14 nt, Mycobacterium avium subsp. paratuberculosis
cggguagcccgucg

SEQ ID NO: 821663 - RNA, 18 nt, Mycobacterium avium subsp. paratuberculosis
cggguagcccgucgacgg

SEQ ID NO: 821664 - RNA, 15 nt, Mycobacterium avium subsp. paratuberculosis
cggguaugucggcga

SEQ ID NO: 821665 - RNA, 17 nt, Mycobacterium avium subsp. paratuberculosis
cggguaugucggcgacc

SEQ ID NO: 821666 - RNA, 15 nt, Mycobacterium avium subsp. paratuberculosis
cgggucacacccucg

SEQ ID NO: 821667 - RNA, 16 nt, Mycobacterium avium subsp. paratuberculosis
cgggucacacccucgg

SEQ ID NO: 821668 - RNA, 20 nt, Mycobacterium avium subsp. paratuberculosis
cgggucacacccucggcccg

SEQ ID NO: 821669 - RNA, 23 nt, Mycobacterium avium subsp. paratuberculosis
cgggucacacccucggcccgcca

SEQ ID NO: 821670 - RNA, 18 nt, Mycobacterium avium subsp. paratuberculosis
cgggucaguucgcggcgc

SEQ ID NO: 821671 - RNA, 20 nt, Mycobacterium avium subsp. paratuberculosis
cgggucaguucgcggcgcac

SEQ ID NO: 821672 - RNA, 18 nt, Mycobacterium avium subsp. paratuberculosis
cgggucauccagccgugg

SEQ ID NO: 821673 - RNA, 15 nt, Mycobacterium avium subsp. paratuberculosis
cgggucccccgccga

SEQ ID NO: 821674 - RNA, 17 nt, Mycobacterium avium subsp. paratuberculosis
cgggucccccgccgacc

SEQ ID NO: 821675 - RNA, 22 nt, Mycobacterium avium subsp. paratuberculosis
cgggucccccgccgaccggucc

SEQ ID NO: 821676 - RNA, 14 nt, Mycobacterium avium subsp. paratuberculosis
cggguccccgccgc

SEQ ID NO: 821677 - RNA, 17 nt, Mycobacterium avium subsp. paratuberculosis
cggguccccgccgccgu

SEQ ID NO: 821678 - RNA, 16 nt, Mycobacterium avium subsp. paratuberculosis
cggguccaucgccucg

SEQ ID NO: 821679 - RNA, 17 nt, Mycobacterium avium subsp. paratuberculosis
cggguccaucgccucga

SEQ ID NO: 821680 - RNA, 21 nt, Mycobacterium avium subsp. paratuberculosis
cgggucccagaugcgcgacgg

SEQ ID NO: 821681 - RNA, 16 nt, Mycobacterium avium subsp. paratuberculosis
cggguccagccgccgg

SEQ ID NO: 821682 - RNA, 18 nt, Mycobacterium avium subsp. paratuberculosis
cggguccagccgccggcg

SEQ ID NO: 821683 - RNA, 19 nt, Mycobacterium avium subsp. paratuberculosis
cggguccagccgccggcgg

SEQ ID NO: 821684 - RNA, 16 nt, Mycobacterium avium subsp. paratuberculosis
cggguccagccgcggu

SEQ ID NO: 821685 - RNA, 17 nt, Mycobacterium avium subsp. paratuberculosis
cggguccagccgcgguu

SEQ ID NO: 821686 - RNA, 13 nt, Mycobacterium avium subsp. paratuberculosis
cggguccagcgcc

SEQ ID NO: 821687 - RNA, 15 nt, Mycobacterium avium subsp. paratuberculosis
cgggucgcuggccgc

SEQ ID NO: 821688 - RNA, 16 nt, Mycobacterium avium subsp. paratuberculosis
cgggucgcuggccgcg

SEQ ID NO: 821689 - RNA, 18 nt, Mycobacterium avium subsp. paratuberculosis
cgggucgcuggccgcgac

SEQ ID NO: 821690 - RNA, 19 nt, Mycobacterium avium subsp. paratuberculosis
cgggucgcuggccgcgacg

SEQ ID NO: 821691 - RNA, 13 nt, Mycobacterium avium subsp. paratuberculosis
cgggucgcugugc

SEQ ID NO: 821692 - RNA, 15 nt, Mycobacterium avium subsp. paratuberculosis
cgggucgcugugcag

SEQ ID NO: 821693 - RNA, 16 nt, Mycobacterium avium subsp. paratuberculosis
cgggucgcugugcagc

SEQ ID NO: 821694 - RNA, 19 nt, Mycobacterium avium subsp. paratuberculosis
cgggucgcugugcagcggg

SEQ ID NO: 821695 - RNA, 13 nt, Mycobacterium avium subsp. paratuberculosis
cgggucgcggccc

SEQ ID NO: 821696 - RNA, 15 nt, Mycobacterium avium subsp. paratuberculosis
cgggucgcggcccac

SEQ ID NO: 821697 - RNA, 24 nt, Mycobacterium avium subsp. paratuberculosis
cgggucgcggcccaccgcgucgca

SEQ ID NO: 821698 - RNA, 20 nt, Mycobacterium avium subsp. paratuberculosis
cgggucgcggcuggugccgc

SEQ ID NO: 821699 - RNA, 21 nt, Mycobacterium avium subsp. paratuberculosis
cgggucgcggcuggugccgcc

SEQ ID NO: 821700 - RNA, 23 nt, Mycobacterium avium subsp. paratuberculosis
cgggucgcggcuggugccgccgg

SEQ ID NO: 821701 - RNA, 15 nt, Mycobacterium avium subsp. paratuberculosis
cgggucgcgcugcgg

SEQ ID NO: 821702 - RNA, 15 nt, Mycobacterium avium subsp. paratuberculosis
cgggucgccgucgag

SEQ ID NO: 821703 - RNA, 11 nt, Mycobacterium avium subsp. paratuberculosis
cgggucgcggu

SEQ ID NO: 821704 - RNA, 13 nt, Mycobacterium avium subsp. paratuberculosis
cgggucgcggugg

SEQ ID NO: 821705 - RNA, 18 nt, Mycobacterium avium subsp. paratuberculosis
cgggucgcggugggcucg

SEQ ID NO: 821706 - RNA, 23 nt, Mycobacterium avium subsp. paratuberculosis
cgggucgcggugggcucggcgcc

SEQ ID NO: 821707 - RNA, 16 nt, Mycobacterium avium subsp. paratuberculosis
cgggucucgaaccggg

SEQ ID NO: 821708 - RNA, 22 nt, Mycobacterium avium subsp. paratuberculosis
cgggucucgaaccgggcgguga

SEQ ID NO: 821709 - RNA, 18 nt, Mycobacterium avium subsp. paratuberculosis
cgggucguuugguggugg

SEQ ID NO: 821710 - RNA, 23 nt, Mycobacterium avium subsp. paratuberculosis
cgggucguuuggugguggcgugg

SEQ ID NO: 821711 - RNA, 21 nt, Mycobacterium avium subsp. paratuberculosis
cgggucuagaucuccaggcuc

SEQ ID NO: 821712 - RNA, 22 nt, Mycobacterium avium subsp. paratuberculosis
cgggucucagcgcccgcccggc

SEQ ID NO: 821713 - RNA, 21 nt, Mycobacterium avium subsp. paratuberculosis
cgggucgugcggcggcggugc

SEQ ID NO: 821714 - RNA, 16 nt, Mycobacterium avium subsp. paratuberculosis
cgggucguuggcggcg

SEQ ID NO: 821715 - RNA, 17 nt, Mycobacterium avium subsp. paratuberculosis
cgggucguuggcggcgg

SEQ ID NO: 821716 - RNA, 18 nt, Mycobacterium avium subsp. paratuberculosis
cgggucguuggcggcggu

SEQ ID NO: 821717 - RNA, 15 nt, Mycobacterium avium subsp. paratuberculosis
cgggucggccggcgg

SEQ ID NO: 821718 - RNA, 16 nt, Mycobacterium avium subsp. paratuberculosis
cgggucggccggcggg

SEQ ID NO: 821719 - RNA, 19 nt, Mycobacterium avium subsp. paratuberculosis
cgggucgucgggcggcagg

SEQ ID NO: 821720 - RNA, 16 nt, Mycobacterium avium subsp. paratuberculosis
cgggucgucggugccg

SEQ ID NO: 821721 - RNA, 17 nt, Mycobacterium avium subsp. paratuberculosis
cgggucgucggugccga

SEQ ID NO: 821722 - RNA, 16 nt, Mycobacterium avium subsp. paratuberculosis
cgggucgugcaucggc

SEQ ID NO: 821723 - RNA, 12 nt, Mycobacterium avium subsp. paratuberculosis
cgggcgcaccac

SEQ ID NO: 821724 - RNA, 14 nt, Mycobacterium avium subsp. paratuberculosis
cgggcgcaccacga

SEQ ID NO: 821725 - RNA, 12 nt, Mycobacterium avium subsp. paratuberculosis
cgggcgcaccgc

SEQ ID NO: 821726 - RNA, 13 nt, Mycobacterium avium subsp. paratuberculosis
cgggcgcaccgcg

SEQ ID NO: 821727 - RNA, 19 nt, Mycobacterium avium subsp. paratuberculosis
cgggcgcaccgcgcgccag

SEQ ID NO: 821728 - RNA, 21 nt, Mycobacterium avium subsp. paratuberculosis
cgggcgcaccgcgcgccaggu

SEQ ID NO: 821729 - RNA, 20 nt, Mycobacterium avium subsp. paratuberculosis
cgggcgaucucuucgaugcc

SEQ ID NO: 821730 - RNA, 17 nt, Mycobacterium avium subsp. paratuberculosis
cgggcgauucgucgucg

SEQ ID NO: 821731 - RNA, 21 nt, Mycobacterium avium subsp. paratuberculosis
cgggcgauucgucgucguugg

SEQ ID NO: 821732 - RNA, 17 nt, Mycobacterium avium subsp. paratuberculosis
cgggcgauggcgggccg

SEQ ID NO: 821733 - RNA, 16 nt, Mycobacterium avium subsp. paratuberculosis
cgggcgauggugccgc

SEQ ID NO: 821734 - RNA, 17 nt, Mycobacterium avium subsp. paratuberculosis
cgggcgauggugccgcc

SEQ ID NO: 821735 - RNA, 18 nt, Mycobacterium avium subsp. paratuberculosis
cgggcgauggugccgccg

SEQ ID NO: 821736 - RNA, 15 nt, Mycobacterium avium subsp. paratuberculosis
cgggcgaugcggccc

SEQ ID NO: 821737 - RNA, 16 nt, Mycobacterium avium subsp. paratuberculosis
cgggcgaugcggcccg

SEQ ID NO: 821738 - RNA, 17 nt, Mycobacterium avium subsp. paratuberculosis
cgggcgaugcggcccgg

SEQ ID NO: 821739 - RNA, 18 nt, Mycobacterium avium subsp. paratuberculosis
cgggcgaugcggcccggc

SEQ ID NO: 821740 - RNA, 15 nt, Mycobacterium avium subsp. paratuberculosis
cgggcgaucagcccg

SEQ ID NO: 821741 - RNA, 16 nt, Mycobacterium avium subsp. paratuberculosis
cgggcgaucagcccgc

SEQ ID NO: 821742 - RNA, 18 nt, Mycobacterium avium subsp. paratuberculosis
cgggcgaucagcccgccc

SEQ ID NO: 821743 - RNA, 22 nt, Mycobacterium avium subsp. paratuberculosis
cgggcgaucagcccgcccacca

SEQ ID NO: 821744 - RNA, 11 nt, Mycobacterium avium subsp. paratuberculosis
cgggcgaucgc

SEQ ID NO: 821745 - RNA, 16 nt, Mycobacterium avium subsp. paratuberculosis
cgggcgaucuccagcg

SEQ ID NO: 821746 - RNA, 18 nt, Mycobacterium avium subsp. paratuberculosis
cgggcgaucuccagcggc

SEQ ID NO: 821747 - RNA, 19 nt, Mycobacterium avium subsp. paratuberculosis
cgggcgaucuccagcggcc

SEQ ID NO: 821748 - RNA, 21 nt, Mycobacterium avium subsp. paratuberculosis
cgggcgaucuccagcggccgg

SEQ ID NO: 821749 - RNA, 13 nt, Mycobacterium avium subsp. paratuberculosis
cgggcgaucucga

SEQ ID NO: 821750 - RNA, 16 nt, Mycobacterium avium subsp. paratuberculosis
cgggcgaucucgaugg

SEQ ID NO: 821751 - RNA, 22 nt, Mycobacterium avium subsp. paratuberculosis
cgggcgaucucgauggccacgc

SEQ ID NO: 821752 - RNA, 14 nt, Mycobacterium avium subsp. paratuberculosis
cgggcgccggcugc

SEQ ID NO: 821753 - RNA, 20 nt, Mycobacterium avium subsp. paratuberculosis
cgggcgccggcugcccgcga

SEQ ID NO: 821754 - RNA, 12 nt, Mycobacterium avium subsp. paratuberculosis
cgggcgccggua

SEQ ID NO: 821755 - RNA, 12 nt, Mycobacterium avium subsp. paratuberculosis
cgggcgccgguc

SEQ ID NO: 821756 - RNA, 13 nt, Mycobacterium avium subsp. paratuberculosis
cgggcgccggucg

SEQ ID NO: 821757 - RNA, 15 nt, Mycobacterium avium subsp. paratuberculosis
cgggcgccggucggc

SEQ ID NO: 821758 - RNA, 12 nt, Mycobacterium avium subsp. paratuberculosis
cgggcgccgguu

SEQ ID NO: 821759 - RNA, 13 nt, Mycobacterium avium subsp. paratuberculosis
cgggcgccgguuc

SEQ ID NO: 821760 - RNA, 22 nt, Mycobacterium avium subsp. paratuberculosis
cgggcgccguaggccgcgcuga

SEQ ID NO: 821761 - RNA, 13 nt, Mycobacterium avium subsp. paratuberculosis
cgggcgccgucgg

SEQ ID NO: 821762 - RNA, 14 nt, Mycobacterium avium subsp. paratuberculosis
cgggcgccggccgg

SEQ ID NO: 821763 - RNA, 21 nt, Mycobacterium avium subsp. paratuberculosis
cgggcgccggccggcgcgugc

SEQ ID NO: 821764 - RNA, 12 nt, Mycobacterium avium subsp. paratuberculosis
cgggcgccggcg

SEQ ID NO: 821765 - RNA, 13 nt, Mycobacterium avium subsp. paratuberculosis
cgggcgccggcga

SEQ ID NO: 821766 - RNA, 14 nt, Mycobacterium avium subsp. paratuberculosis
cgggcgccggcgau

SEQ ID NO: 821767 - RNA, 17 nt, Mycobacterium avium subsp. paratuberculosis
cgggcgccggcgaugaa

SEQ ID NO: 821768 - RNA, 14 nt, Mycobacterium avium subsp. paratuberculosis
cgggcgccggcgcg

SEQ ID NO: 821769 - RNA, 15 nt, Mycobacterium avium subsp. paratuberculosis
cgggcgccggcgcgu

SEQ ID NO: 821770 - RNA, 17 nt, Mycobacterium avium subsp. paratuberculosis
cgggcgccggcgcgucc

SEQ ID NO: 821771 - RNA, 16 nt, Mycobacterium avium subsp. paratuberculosis
cgggcgcccuugaucg

SEQ ID NO: 821772 - RNA, 13 nt, Mycobacterium avium subsp. paratuberculosis
cgggcgcccgcgg

SEQ ID NO: 821773 - RNA, 18 nt, Mycobacterium avium subsp. paratuberculosis
cgggcgcccguagaacag

SEQ ID NO: 821774 - RNA, 15 nt, Mycobacterium avium subsp. paratuberculosis
cgggcgcccgagccg

SEQ ID NO: 821775 - RNA, 14 nt, Mycobacterium avium subsp. paratuberculosis
cgggcgccccgaca

SEQ ID NO: 821776 - RNA, 21 nt, Mycobacterium avium subsp. paratuberculosis
cgggcgcccagaagccccggu

SEQ ID NO: 821777 - RNA, 17 nt, Mycobacterium avium subsp. paratuberculosis
cgggcgcccagcaaacc

SEQ ID NO: 821778 - RNA, 19 nt, Mycobacterium avium subsp. paratuberculosis
cgggcgccauccgcagccc

SEQ ID NO: 821779 - RNA, 18 nt, Mycobacterium avium subsp. paratuberculosis
cgggcgccauccgccacc

SEQ ID NO: 821780 - RNA, 13 nt, Mycobacterium avium subsp. paratuberculosis
cgggcgccagccc

SEQ ID NO: 821781 - RNA, 14 nt, Mycobacterium avium subsp. paratuberculosis
cgggcgccagcccg

SEQ ID NO: 821782 - RNA, 23 nt, Mycobacterium avium subsp. paratuberculosis
cgggcgccagcccgcccagcgcc

SEQ ID NO: 821783 - RNA, 13 nt, Mycobacterium avium subsp. paratuberculosis
cgggcgcaggucc

SEQ ID NO: 821784 - RNA, 20 nt, Mycobacterium avium subsp. paratuberculosis
cgggcgcaggugggcggugc

SEQ ID NO: 821785 - RNA, 21 nt, Mycobacterium avium subsp. paratuberculosis
cgggcgcaggugggcggugcg

SEQ ID NO: 821786 - RNA, 16 nt, Mycobacterium avium subsp. paratuberculosis
cgggcgcauaccagcg

SEQ ID NO: 821787 - RNA, 17 nt, Mycobacterium avium subsp. paratuberculosis
cgggcgcauaccagcgc

SEQ ID NO: 821788 - RNA, 16 nt, Mycobacterium avium subsp. paratuberculosis
cgggcgcagcgccguc

SEQ ID NO: 821789 - RNA, 17 nt, Mycobacterium avium subsp. paratuberculosis
cgggcgcagcgccgucu

SEQ ID NO: 821790 - RNA, 20 nt, Mycobacterium avium subsp. paratuberculosis
cgggcgcagcgccgucucga

SEQ ID NO: 821791 - RNA, 20 nt, Mycobacterium avium subsp. paratuberculosis
cgggcgauuucgucggcggu

SEQ ID NO: 821792 - RNA, 23 nt, Mycobacterium avium subsp. paratuberculosis
cgggcgcagaaaaaggccgccgc

SEQ ID NO: 821793 - RNA, 14 nt, Mycobacterium avium subsp. paratuberculosis
cgggcgccacgcug

SEQ ID NO: 821794 - RNA, 22 nt, Mycobacterium avium subsp. paratuberculosis
cgggcgccacgcuggcgugacg

SEQ ID NO: 821795 - RNA, 15 nt, Mycobacterium avium subsp. paratuberculosis
cgggcggacggcacc

SEQ ID NO: 821796 - RNA, 14 nt, Mycobacterium avium subsp. paratuberculosis
cgggcggcaccgcu

SEQ ID NO: 821797 - RNA, 20 nt, Mycobacterium avium subsp. paratuberculosis
cgggcggcaccgcugccggc

SEQ ID NO: 821798 - RNA, 23 nt, Mycobacterium avium subsp. paratuberculosis
cgggcggcaccgcugccggccga

SEQ ID NO: 821799 - RNA, 16 nt, Mycobacterium avium subsp. paratuberculosis
cgggcggcagcacguc

SEQ ID NO: 821800 - RNA, 13 nt, Mycobacterium avium subsp. paratuberculosis
cgggcggcagcag

SEQ ID NO: 821801 - RNA, 23 nt, Mycobacterium avium subsp. paratuberculosis
cgggcggcagcagcugcgucggc

SEQ ID NO: 821802 - RNA, 15 nt, Mycobacterium avium subsp. paratuberculosis
cgggcgcugccgucc

SEQ ID NO: 821803 - RNA, 12 nt, Mycobacterium avium subsp. paratuberculosis
cgggcgcuggcg

SEQ ID NO: 821804 - RNA, 14 nt, Mycobacterium avium subsp. paratuberculosis
cgggcgcugcgcgg

SEQ ID NO: 821805 - RNA, 17 nt, Mycobacterium avium subsp. paratuberculosis
cgggcgcugcgcggugg

SEQ ID NO: 821806 - RNA, 17 nt, Mycobacterium avium subsp. paratuberculosis
cgggcgcguugaugccg

SEQ ID NO: 821807 - RNA, 12 nt, Mycobacterium avium subsp. paratuberculosis
cgggcgcucggc

SEQ ID NO: 821808 - RNA, 14 nt, Mycobacterium avium subsp. paratuberculosis
cgggcgcucggcca

SEQ ID NO: 821809 - RNA, 19 nt, Mycobacterium avium subsp. paratuberculosis
cgggcgcucggccagcagu

SEQ ID NO: 821810 - RNA, 14 nt, Mycobacterium avium subsp. paratuberculosis
cgggcgcucuucgg

SEQ ID NO: 821811 - RNA, 16 nt, Mycobacterium avium subsp. paratuberculosis
cgggcgcucuucgggc

SEQ ID NO: 821812 - RNA, 14 nt, Mycobacterium avium subsp. paratuberculosis
cgggcgcgugcaca

SEQ ID NO: 821813 - RNA, 14 nt, Mycobacterium avium subsp. paratuberculosis
cgggcgcgucgagg

SEQ ID NO: 821814 - RNA, 18 nt, Mycobacterium avium subsp. paratuberculosis
cgggcgcgucgaggucgu

SEQ ID NO: 821815 - RNA, 15 nt, Mycobacterium avium subsp. paratuberculosis
cgggcgcgguguggg

SEQ ID NO: 821816 - RNA, 20 nt, Mycobacterium avium subsp. paratuberculosis
cgggcgcggugugggcgaug

SEQ ID NO: 821817 - RNA, 16 nt, Mycobacterium avium subsp. paratuberculosis
cgggcgcgggcgccgu

SEQ ID NO: 821818 - RNA, 23 nt, Mycobacterium avium subsp. paratuberculosis
cgggcgcggauggguggcgauca

SEQ ID NO: 821819 - RNA, 14 nt, Mycobacterium avium subsp. paratuberculosis
cgggcgcggccagc

SEQ ID NO: 821820 - RNA, 15 nt, Mycobacterium avium subsp. paratuberculosis
cgggcgcggccagcg

SEQ ID NO: 821821 - RNA, 16 nt, Mycobacterium avium subsp. paratuberculosis
cgggcgcggccagcgc

SEQ ID NO: 821822 - RNA, 14 nt, Mycobacterium avium subsp. paratuberculosis
cgggcgcggcggca

SEQ ID NO: 821823 - RNA, 16 nt, Mycobacterium avium subsp. paratuberculosis
cgggcgcggcggcaac

SEQ ID NO: 821824 - RNA, 13 nt, Mycobacterium avium subsp. paratuberculosis
cgggcgcgcgccu

SEQ ID NO: 821825 - RNA, 13 nt, Mycobacterium avium subsp. paratuberculosis
cgggcgcgcgccg

SEQ ID NO: 821826 - RNA, 14 nt, Mycobacterium avium subsp. paratuberculosis
cgggcgcgcgccgc

SEQ ID NO: 821827 - RNA, 22 nt, Mycobacterium avium subsp. paratuberculosis
cgggcgcgcgccgcccccgcgg

SEQ ID NO: 821828 - RNA, 18 nt, Mycobacterium avium subsp. paratuberculosis
cgggcgcgcagaucgucg

SEQ ID NO: 821829 - RNA, 21 nt, Mycobacterium avium subsp. paratuberculosis
cgggcgcgcagaucgucgacc

SEQ ID NO: 821830 - RNA, 13 nt, Mycobacterium avium subsp. paratuberculosis
cgggcgcgcagcc

SEQ ID NO: 821831 - RNA, 16 nt, Mycobacterium avium subsp. paratuberculosis
cgggcgcgccggcgcg

SEQ ID NO: 821832 - RNA, 14 nt, Mycobacterium avium subsp. paratuberculosis
cgggcgcgccgucc

SEQ ID NO: 821833 - RNA, 18 nt, Mycobacterium avium subsp. paratuberculosis
cgggcgcgccgucccagc

SEQ ID NO: 821834 - RNA, 11 nt, Mycobacterium avium subsp. paratuberculosis
cgggcgcgccg

SEQ ID NO: 821835 - RNA, 13 nt, Mycobacterium avium subsp. paratuberculosis
cgggcgcgccggc

SEQ ID NO: 821836 - RNA, 13 nt, Mycobacterium avium subsp. paratuberculosis
cgggcgcgcccac

SEQ ID NO: 821837 - RNA, 17 nt, Mycobacterium avium subsp. paratuberculosis
cgggcgcgcccacccgc

SEQ ID NO: 821838 - RNA, 19 nt, Mycobacterium avium subsp. paratuberculosis
cgggcgcgcccacccgcgc

SEQ ID NO: 821839 - RNA, 19 nt, Mycobacterium avium subsp. paratuberculosis
cgggcgcgaacagcgccga

SEQ ID NO: 821840 - RNA, 20 nt, Mycobacterium avium subsp. paratuberculosis
cgggcgcgaacagcgccgac

SEQ ID NO: 821841 - RNA, 15 nt, Mycobacterium avium subsp. paratuberculosis
cgggcgcgacgguca

SEQ ID NO: 821842 - RNA, 19 nt, Mycobacterium avium subsp. paratuberculosis
cgggcgcgacggucacgcu

SEQ ID NO: 821843 - RNA, 20 nt, Mycobacterium avium subsp. paratuberculosis
cgggcgcgacggucacgcug

SEQ ID NO: 821844 - RNA, 21 nt, Mycobacterium avium subsp. paratuberculosis
cgggcgcgacggucacgcugg

SEQ ID NO: 821845 - RNA, 12 nt, Mycobacterium avium subsp. paratuberculosis
cgggcgcccgcg

SEQ ID NO: 821846 - RNA, 21 nt, Mycobacterium avium subsp. paratuberculosis
cgggcgccuucuuggccgcgc

SEQ ID NO: 821847 - RNA, 23 nt, Mycobacterium avium subsp. paratuberculosis
cgggcgccuucuuggcggcgguc

SEQ ID NO: 821848 - RNA, 19 nt, Mycobacterium avium subsp. paratuberculosis
cgggcucgagggcggcgac

SEQ ID NO: 821849 - RNA, 20 nt, Mycobacterium avium subsp. paratuberculosis
cgggcucgagggcggcgacc

SEQ ID NO: 821850 - RNA, 14 nt, Mycobacterium avium subsp. paratuberculosis
cgggcucgaacaac

SEQ ID NO: 821851 - RNA, 21 nt, Mycobacterium avium subsp. paratuberculosis
cgggcucgaacaacccggccg

SEQ ID NO: 821852 - RNA, 14 nt, Mycobacterium avium subsp. paratuberculosis
cgggcucgagcacc

SEQ ID NO: 821853 - RNA, 16 nt, Mycobacterium avium subsp. paratuberculosis
cgggcucgagcaccga

SEQ ID NO: 821854 - RNA, 17 nt, Mycobacterium avium subsp. paratuberculosis
cgggcucgagcaccgaa

SEQ ID NO: 821855 - RNA, 18 nt, Mycobacterium avium subsp. paratuberculosis
cgggcuccgcacgaccug

SEQ ID NO: 821856 - RNA, 19 nt, Mycobacterium avium subsp. paratuberculosis
cgggcuccgcacgaccuga

SEQ ID NO: 821857 - RNA, 15 nt, Mycobacterium avium subsp. paratuberculosis
cgggcucagcaccac

SEQ ID NO: 821858 - RNA, 13 nt, Mycobacterium avium subsp. paratuberculosis
cgggcuccagcgg

SEQ ID NO: 821859 - RNA, 14 nt, Mycobacterium avium subsp. paratuberculosis
cgggcuccagcggg

SEQ ID NO: 821860 - RNA, 17 nt, Mycobacterium avium subsp. paratuberculosis
cgggcuccagcgggucc

SEQ ID NO: 821861 - RNA, 14 nt, Mycobacterium avium subsp. paratuberculosis
cgggcgugccggac

SEQ ID NO: 821862 - RNA, 18 nt, Mycobacterium avium subsp. paratuberculosis
cgggcgugccggacaccg

SEQ ID NO: 821863 - RNA, 20 nt, Mycobacterium avium subsp. paratuberculosis
cgggcgugccggacaccggc

SEQ ID NO: 821864 - RNA, 22 nt, Mycobacterium avium subsp. paratuberculosis
cgggcgugccggacaccggcac

SEQ ID NO: 821865 - RNA, 14 nt, Mycobacterium avium subsp. paratuberculosis
cgggcgugccggcg

SEQ ID NO: 821866 - RNA, 16 nt, Mycobacterium avium subsp. paratuberculosis
cgggcgugccggcggc

SEQ ID NO: 821867 - RNA, 18 nt, Mycobacterium avium subsp. paratuberculosis
cgggcgugccggcggcgg

SEQ ID NO: 821868 - RNA, 12 nt, Mycobacterium avium subsp. paratuberculosis
cgggcgugcggu

SEQ ID NO: 821869 - RNA, 23 nt, Mycobacterium avium subsp. paratuberculosis
cgggcgugcgguuggcccgcggc

SEQ ID NO: 821870 - RNA, 14 nt, Mycobacterium avium subsp. paratuberculosis
cgggcgugcccggc

SEQ ID NO: 821871 - RNA, 19 nt, Mycobacterium avium subsp. paratuberculosis
cgggcgucgggcagcagcu

SEQ ID NO: 821872 - RNA, 15 nt, Mycobacterium avium subsp. paratuberculosis
cgggcgucgacgaug

SEQ ID NO: 821873 - RNA, 21 nt, Mycobacterium avium subsp. paratuberculosis
cgggcgucgcagaucccgccg

SEQ ID NO: 821874 - RNA, 23 nt, Mycobacterium avium subsp. paratuberculosis
cgggcgucgcagaucccgccggc

SEQ ID NO: 821875 - RNA, 13 nt, Mycobacterium avium subsp. paratuberculosis
cgggcgucgcgcu

SEQ ID NO: 821876 - RNA, 14 nt, Mycobacterium avium subsp. paratuberculosis
cgggcgucgcgcuc

SEQ ID NO: 821877 - RNA, 16 nt, Mycobacterium avium subsp. paratuberculosis
cgggcgucgcgcucau

SEQ ID NO: 821878 - RNA, 12 nt, Mycobacterium avium subsp. paratuberculosis
cgggcgucggcg

SEQ ID NO: 821879 - RNA, 13 nt, Mycobacterium avium subsp. paratuberculosis
cgggcgucggcgg

SEQ ID NO: 821880 - RNA, 14 nt, Mycobacterium avium subsp. paratuberculosis
cgggcgucggcggg

SEQ ID NO: 821881 - RNA, 13 nt, Mycobacterium avium subsp. paratuberculosis
cgggcgguggcgc

SEQ ID NO: 821882 - RNA, 21 nt, Mycobacterium avium subsp. paratuberculosis
cgggcgguggcgccggggcgg

SEQ ID NO: 821883 - RNA, 23 nt, Mycobacterium avium subsp. paratuberculosis
cgggcgguugccugguucgacgu

SEQ ID NO: 821884 - RNA, 22 nt, Mycobacterium avium subsp. paratuberculosis
cgggcgguuuccacgaugacgg

SEQ ID NO: 821885 - RNA, 22 nt, Mycobacterium avium subsp. paratuberculosis
cgggcggugauggucaccgugu

SEQ ID NO: 821886 - RNA, 22 nt, Mycobacterium avium subsp. paratuberculosis
cgggcguagucgauggccucgu

SEQ ID NO: 821887 - RNA, 18 nt, Mycobacterium avium subsp. paratuberculosis
cgggcgucacgccagcgu

SEQ ID NO: 821888 - RNA, 19 nt, Mycobacterium avium subsp. paratuberculosis
cgggcgucacgccagcgug

SEQ ID NO: 821889 - RNA, 20 nt, Mycobacterium avium subsp. paratuberculosis
cgggcgucacgccagcguga

SEQ ID NO: 821890 - RNA, 15 nt, Mycobacterium avium subsp. paratuberculosis
cgggcguccucgucg

SEQ ID NO: 821891 - RNA, 18 nt, Mycobacterium avium subsp. paratuberculosis
cgggcguccucgucggcg

SEQ ID NO: 821892 - RNA, 19 nt, Mycobacterium avium subsp. paratuberculosis
cgggcguccucgucggcga

SEQ ID NO: 821893 - RNA, 13 nt, Mycobacterium avium subsp. paratuberculosis
cgggcguccugcg

SEQ ID NO: 821894 - RNA, 20 nt, Mycobacterium avium subsp. paratuberculosis
cgggcguccuugaccagcug

SEQ ID NO: 821895 - RNA, 23 nt, Mycobacterium avium subsp. paratuberculosis
cgggcguccuugaccagcugcga

SEQ ID NO: 821896 - RNA, 17 nt, Mycobacterium avium subsp. paratuberculosis
cgggcggugaccacgcc

SEQ ID NO: 821897 - RNA, 21 nt, Mycobacterium avium subsp. paratuberculosis
cgggcggugaccacgccgugc

SEQ ID NO: 821898 - RNA, 22 nt, Mycobacterium avium subsp. paratuberculosis
cgggcggucagcauggcgauga

SEQ ID NO: 821899 - RNA, 16 nt, Mycobacterium avium subsp. paratuberculosis
cgggcggucgcgucgu

SEQ ID NO: 821900 - RNA, 17 nt, Mycobacterium avium subsp. paratuberculosis
cgggcggucggacgcgg

SEQ ID NO: 821901 - RNA, 17 nt, Mycobacterium avium subsp. paratuberculosis
cgggcgguacgcgccgc

SEQ ID NO: 821902 - RNA, 19 nt, Mycobacterium avium subsp. paratuberculosis
cgggcgguacgcgccgcgc

SEQ ID NO: 821903 - RNA, 15 nt, Mycobacterium avium subsp. paratuberculosis
cgggcgguccaccga

SEQ ID NO: 821904 - RNA, 21 nt, Mycobacterium avium subsp. paratuberculosis
cgggcggggugguggacguca

SEQ ID NO: 821905 - RNA, 23 nt, Mycobacterium avium subsp. paratuberculosis
cgggcggggugugcggcacggcg

SEQ ID NO: 821906 - RNA, 14 nt, Mycobacterium avium subsp. paratuberculosis
cgggcgggccgcag

SEQ ID NO: 821907 - RNA, 14 nt, Mycobacterium avium subsp. paratuberculosis
cgggcgggccgcca

SEQ ID NO: 821908 - RNA, 16 nt, Mycobacterium avium subsp. paratuberculosis
cgggcggggcccgggc

SEQ ID NO: 821909 - RNA, 18 nt, Mycobacterium avium subsp. paratuberculosis
cgggcggggcccgggccg

SEQ ID NO: 821910 - RNA, 15 nt, Mycobacterium avium subsp. paratuberculosis
cgggcggggccugcg

SEQ ID NO: 821911 - RNA, 16 nt, Mycobacterium avium subsp. paratuberculosis
cgggcggggcgccgac

SEQ ID NO: 821912 - RNA, 17 nt, Mycobacterium avium subsp. paratuberculosis
cgggcggggcgccgaca

SEQ ID NO: 821913 - RNA, 17 nt, Mycobacterium avium subsp. paratuberculosis
cgggcgggggaucggcg

SEQ ID NO: 821914 - RNA, 18 nt, Mycobacterium avium subsp. paratuberculosis
cgggcggggggcgagccg

SEQ ID NO: 821915 - RNA, 19 nt, Mycobacterium avium subsp. paratuberculosis
cgggcggggggcgagccgg

SEQ ID NO: 821916 - RNA, 22 nt, Mycobacterium avium subsp. paratuberculosis
cgggcggcgucguagacgcugc

SEQ ID NO: 821917 - RNA, 20 nt, Mycobacterium avium subsp. paratuberculosis
cgggcggcgucggcgacggc

SEQ ID NO: 821918 - RNA, 21 nt, Mycobacterium avium subsp. paratuberculosis
cgggcggcggcguuggccgcc

SEQ ID NO: 821919 - RNA, 23 nt, Mycobacterium avium subsp. paratuberculosis
cgggcggcggcguuggccgccgc

SEQ ID NO: 821920 - RNA, 13 nt, Mycobacterium avium subsp. paratuberculosis
cgggcggcggcug

SEQ ID NO: 821921 - RNA, 17 nt, Mycobacterium avium subsp. paratuberculosis
cgggcggcgguggccug

SEQ ID NO: 821922 - RNA, 14 nt, Mycobacterium avium subsp. paratuberculosis
cgggcggcgcggcg

SEQ ID NO: 821923 - RNA, 15 nt, Mycobacterium avium subsp. paratuberculosis
cgggcggcgcggcgc

SEQ ID NO: 821924 - RNA, 12 nt, Mycobacterium avium subsp. paratuberculosis
cgggcggcgcgg

SEQ ID NO: 821925 - RNA, 13 nt, Mycobacterium avium subsp. paratuberculosis
cgggcggcgcggc

SEQ ID NO: 821926 - RNA, 11 nt, Mycobacterium avium subsp. paratuberculosis
cgggcggcgcg

SEQ ID NO: 821927 - RNA, 16 nt, Mycobacterium avium subsp. paratuberculosis
cgggcggcgcggcgca

SEQ ID NO: 821928 - RNA, 19 nt, Mycobacterium avium subsp. paratuberculosis
cgggcggcgcggcgcagcg

SEQ ID NO: 821929 - RNA, 22 nt, Mycobacterium avium subsp. paratuberculosis
cgggcggcgcggcgcagcgcga

SEQ ID NO: 821930 - RNA, 22 nt, Mycobacterium avium subsp. paratuberculosis
cgggcggcggaucagcaccgac

SEQ ID NO: 821931 - RNA, 13 nt, Mycobacterium avium subsp. paratuberculosis
cgggcggcggccu

SEQ ID NO: 821932 - RNA, 14 nt, Mycobacterium avium subsp. paratuberculosis
cgggcggcgccgaa

SEQ ID NO: 821933 - RNA, 15 nt, Mycobacterium avium subsp. paratuberculosis
cgggcggcgccgaac

SEQ ID NO: 821934 - RNA, 22 nt, Mycobacterium avium subsp. paratuberculosis
cgggcggcgccgaacucggcgc

SEQ ID NO: 821935 - RNA, 23 nt, Mycobacterium avium subsp. paratuberculosis
cgggcggcgccgaacucggcgcc

SEQ ID NO: 821936 - RNA, 14 nt, Mycobacterium avium subsp. paratuberculosis
cgggcggccucggc

SEQ ID NO: 821937 - RNA, 14 nt, Mycobacterium avium subsp. paratuberculosis
cgggcggccugccg

SEQ ID NO: 821938 - RNA, 15 nt, Mycobacterium avium subsp. paratuberculosis
cgggcggccugccgg

SEQ ID NO: 821939 - RNA, 20 nt, Mycobacterium avium subsp. paratuberculosis
cgggcggccugccggccgcc

SEQ ID NO: 821940 - RNA, 19 nt, Mycobacterium avium subsp. paratuberculosis
cgggcggcgacgucguggc

SEQ ID NO: 821941 - RNA, 20 nt, Mycobacterium avium subsp. paratuberculosis
cgggcggcgcagucggccgg

SEQ ID NO: 821942 - RNA, 14 nt, Mycobacterium avium subsp. paratuberculosis
cgggcggccgggcc

SEQ ID NO: 821943 - RNA, 15 nt, Mycobacterium avium subsp. paratuberculosis
cgggcggccgugguc

SEQ ID NO: 821944 - RNA, 13 nt, Mycobacterium avium subsp. paratuberculosis
cgggcggccgauc

SEQ ID NO: 821945 - RNA, 14 nt, Mycobacterium avium subsp. paratuberculosis
cgggcggccgcgga

SEQ ID NO: 821946 - RNA, 14 nt, Mycobacterium avium subsp. paratuberculosis
cgggcggccggagc

SEQ ID NO: 821947 - RNA, 17 nt, Mycobacterium avium subsp. paratuberculosis
cgggcggccggagccga

SEQ ID NO: 821948 - RNA, 16 nt, Mycobacterium avium subsp. paratuberculosis
cgggcggccccgggcg

SEQ ID NO: 821949 - RNA, 18 nt, Mycobacterium avium subsp. paratuberculosis
cgggcggcccgccucggc

SEQ ID NO: 821950 - RNA, 23 nt, Mycobacterium avium subsp. paratuberculosis
cgggcggcccgccucggcggccg

SEQ ID NO: 821951 - RNA, 14 nt, Mycobacterium avium subsp. paratuberculosis
cgggcggccagccg

SEQ ID NO: 821952 - RNA, 20 nt, Mycobacterium avium subsp. paratuberculosis
cgggcggccagccgcgcggc

SEQ ID NO: 821953 - RNA, 16 nt, Mycobacterium avium subsp. paratuberculosis
cgggcggccagccgcu

SEQ ID NO: 821954 - RNA, 13 nt, Mycobacterium avium subsp. paratuberculosis
cgggcggccagcg

SEQ ID NO: 821955 - RNA, 14 nt, Mycobacterium avium subsp. paratuberculosis
cgggcggccagcgu

SEQ ID NO: 821956 - RNA, 15 nt, Mycobacterium avium subsp. paratuberculosis
cgggcggccagcgug

SEQ ID NO: 821957 - RNA, 11 nt, Mycobacterium avium subsp. paratuberculosis
cgggcggcacc

SEQ ID NO: 821958 - RNA, 12 nt, Mycobacterium avium subsp. paratuberculosis
cgggcggcaccg

SEQ ID NO: 821959 - RNA, 15 nt, Mycobacterium avium subsp. paratuberculosis
cgggcggcaucgcgc

SEQ ID NO: 821960 - RNA, 17 nt, Mycobacterium avium subsp. paratuberculosis
cgggcggcaucgcgccg

SEQ ID NO: 821961 - RNA, 17 nt, Mycobacterium avium subsp. paratuberculosis
cgggcggcaucgcgcgc

SEQ ID NO: 821962 - RNA, 20 nt, Mycobacterium avium subsp. paratuberculosis
cgggcggcaucgcgcgcggc

SEQ ID NO: 821963 - RNA, 14 nt, Mycobacterium avium subsp. paratuberculosis
cgggcggcaggucg

SEQ ID NO: 821964 - RNA, 15 nt, Mycobacterium avium subsp. paratuberculosis
cgggcggcaggucgg

SEQ ID NO: 821965 - RNA, 16 nt, Mycobacterium avium subsp. paratuberculosis
cgggcggcaggucggc

SEQ ID NO: 821966 - RNA, 18 nt, Mycobacterium avium subsp. paratuberculosis
cgggcggcaggucggcgg

SEQ ID NO: 821967 - RNA, 16 nt, Mycobacterium avium subsp. paratuberculosis
cgggccaacugggugg

SEQ ID NO: 821968 - RNA, 15 nt, Mycobacterium avium subsp. paratuberculosis
cgggccaagcaccgg

SEQ ID NO: 821969 - RNA, 19 nt, Mycobacterium avium subsp. paratuberculosis
cgggccaagcaccgggaug

SEQ ID NO: 821970 - RNA, 23 nt, Mycobacterium avium subsp. paratuberculosis
cgggccaauuacgcugcggcgcc

SEQ ID NO: 821971 - RNA, 15 nt, Mycobacterium avium subsp. paratuberculosis
cgggccacacccguc

SEQ ID NO: 821972 - RNA, 14 nt, Mycobacterium avium subsp. paratuberculosis
cgggccacagcggc

SEQ ID NO: 821973 - RNA, 18 nt, Mycobacterium avium subsp. paratuberculosis
cgggccacagcggcgaca

SEQ ID NO: 821974 - RNA, 17 nt, Mycobacterium avium subsp. paratuberculosis
cgggcauuggcagcucg

SEQ ID NO: 821975 - RNA, 18 nt, Mycobacterium avium subsp. paratuberculosis
cgggcauuggcagcucgg

SEQ ID NO: 821976 - RNA, 19 nt, Mycobacterium avium subsp. paratuberculosis
cgggcaugaaccaggccgc

SEQ ID NO: 821977 - RNA, 21 nt, Mycobacterium avium subsp. paratuberculosis
cgggcaucucguugucgucgg

SEQ ID NO: 821978 - RNA, 15 nt, Mycobacterium avium subsp. paratuberculosis
cgggcaucggcuggu

SEQ ID NO: 821979 - RNA, 21 nt, Mycobacterium avium subsp. paratuberculosis
cgggcaucggcuggucggcgg

SEQ ID NO: 821980 - RNA, 14 nt, Mycobacterium avium subsp. paratuberculosis
cgggcaucgccguc

SEQ ID NO: 821981 - RNA, 22 nt, Mycobacterium avium subsp. paratuberculosis
cgggcaucgccgucaugguguc

SEQ ID NO: 821982 - RNA, 15 nt, Mycobacterium avium subsp. paratuberculosis
cgggcaugccggccg

SEQ ID NO: 821983 - RNA, 16 nt, Mycobacterium avium subsp. paratuberculosis
cgggcaugccggccgg

SEQ ID NO: 821984 - RNA, 17 nt, Mycobacterium avium subsp. paratuberculosis
cgggcaugccgucggcg

SEQ ID NO: 821985 - RNA, 21 nt, Mycobacterium avium subsp. paratuberculosis
cgggcaugccgucggcgcccg

SEQ ID NO: 821986 - RNA, 18 nt, Mycobacterium avium subsp. paratuberculosis
cgggcaugccguucagcg

SEQ ID NO: 821987 - RNA, 21 nt, Mycobacterium avium subsp. paratuberculosis
cgggcaugccguucagcgcgg

SEQ ID NO: 821988 - RNA, 23 nt, Mycobacterium avium subsp. paratuberculosis
cgggcaggcucagguaggcgcgg

SEQ ID NO: 821989 - RNA, 18 nt, Mycobacterium avium subsp. paratuberculosis
cgggcaggcccgagcccg

SEQ ID NO: 821990 - RNA, 19 nt, Mycobacterium avium subsp. paratuberculosis
cgggcaggcccgagcccga

SEQ ID NO: 821991 - RNA, 23 nt, Mycobacterium avium subsp. paratuberculosis
cgggcaggcccgagcccgacggc

SEQ ID NO: 821992 - RNA, 15 nt, Mycobacterium avium subsp. paratuberculosis
cgggcaggccgaaga

SEQ ID NO: 821993 - RNA, 21 nt, Mycobacterium avium subsp. paratuberculosis
cgggcagcuuccgccucggcg

SEQ ID NO: 821994 - RNA, 14 nt, Mycobacterium avium subsp. paratuberculosis
cgggcaggccggug

SEQ ID NO: 821995 - RNA, 14 nt, Mycobacterium avium subsp. paratuberculosis
cgggcaggcggcgc

SEQ ID NO: 821996 - RNA, 15 nt, Mycobacterium avium subsp. paratuberculosis
cgggcaggcggcgcg

SEQ ID NO: 821997 - RNA, 13 nt, Mycobacterium avium subsp. paratuberculosis
cgggcaucccgcc

SEQ ID NO: 821998 - RNA, 14 nt, Mycobacterium avium subsp. paratuberculosis
cgggcaucccgccg

SEQ ID NO: 821999 - RNA, 17 nt, Mycobacterium avium subsp. paratuberculosis
cgggcauccgggccgcc

SEQ ID NO: 822000 - RNA, 19 nt, Mycobacterium avium subsp. paratuberculosis
cgggcauccgggccgccgc

SEQ ID NO: 822001 - RNA, 20 nt, Mycobacterium avium subsp. paratuberculosis
cgggcauccgggccgccgcg

SEQ ID NO: 822002 - RNA, 14 nt, Mycobacterium avium subsp. paratuberculosis
cgggcaucgcuggu

SEQ ID NO: 822003 - RNA, 15 nt, Mycobacterium avium subsp. paratuberculosis
cgggcaucgcuggug

SEQ ID NO: 822004 - RNA, 21 nt, Mycobacterium avium subsp. paratuberculosis
cgggcaucgcugguggccgac

SEQ ID NO: 822005 - RNA, 21 nt, Mycobacterium avium subsp. paratuberculosis
cgggcaggauggucagcgagu

SEQ ID NO: 822006 - RNA, 12 nt, Mycobacterium avium subsp. paratuberculosis
cgggcagcgugu

SEQ ID NO: 822007 - RNA, 18 nt, Mycobacterium avium subsp. paratuberculosis
cgggcagcgugucccggu

SEQ ID NO: 822008 - RNA, 12 nt, Mycobacterium avium subsp. paratuberculosis
cgggcagcgcgu

SEQ ID NO: 822009 - RNA, 14 nt, Mycobacterium avium subsp. paratuberculosis
cgggcagcgcgugc

SEQ ID NO: 822010 - RNA, 13 nt, Mycobacterium avium subsp. paratuberculosis
cgggcagcggccc

SEQ ID NO: 822011 - RNA, 16 nt, Mycobacterium avium subsp. paratuberculosis
cgggcagcggccccac

SEQ ID NO: 822012 - RNA, 14 nt, Mycobacterium avium subsp. paratuberculosis
cgggcagcaccagc

SEQ ID NO: 822013 - RNA, 18 nt, Mycobacterium avium subsp. paratuberculosis
cgggcaaugaugucggcg

SEQ ID NO: 822014 - RNA, 19 nt, Mycobacterium avium subsp. paratuberculosis
cgggcaaugaugucggcgg

SEQ ID NO: 822015 - RNA, 19 nt, Mycobacterium avium subsp. paratuberculosis
cgggaaguagggcagcccg

SEQ ID NO: 822016 - RNA, 13 nt, Mycobacterium avium subsp. paratuberculosis
cgggaagucgucg

SEQ ID NO: 822017 - RNA, 15 nt, Mycobacterium avium subsp. paratuberculosis
cgggaaucacgcccc

SEQ ID NO: 822018 - RNA, 22 nt, Mycobacterium avium subsp. paratuberculosis
cgggaaucacgccccaggcgcc

SEQ ID NO: 822019 - RNA, 17 nt, Mycobacterium avium subsp. paratuberculosis
cgggcaaucggacccag

SEQ ID NO: 822020 - RNA, 18 nt, Mycobacterium avium subsp. paratuberculosis
cgggcaaucggacccagc

SEQ ID NO: 822021 - RNA, 20 nt, Mycobacterium avium subsp. paratuberculosis
cgggcaaucggacccagccc

SEQ ID NO: 822022 - RNA, 22 nt, Mycobacterium avium subsp. paratuberculosis
cgggaaguccuccgucgagucg

SEQ ID NO: 822023 - RNA, 21 nt, Mycobacterium avium subsp. paratuberculosis
cgggaaggugguccuggcggu

SEQ ID NO: 822024 - RNA, 18 nt, Mycobacterium avium subsp. paratuberculosis
cgggaaggugucggccgg

SEQ ID NO: 822025 - RNA, 19 nt, Mycobacterium avium subsp. paratuberculosis
cgggaaggugucggccggg

SEQ ID NO: 822026 - RNA, 18 nt, Mycobacterium avium subsp. paratuberculosis
cgggaagggcccgggaug

SEQ ID NO: 822027 - RNA, 15 nt, Mycobacterium avium subsp. paratuberculosis
cgggaagcccaccgc

SEQ ID NO: 822028 - RNA, 23 nt, Mycobacterium avium subsp. paratuberculosis
cgggaagccgaggucgccgacgc

SEQ ID NO: 822029 - RNA, 13 nt, Mycobacterium avium subsp. paratuberculosis
cgggaagccgccg

SEQ ID NO: 822030 - RNA, 15 nt, Mycobacterium avium subsp. paratuberculosis
cgggaagccgccgcc

SEQ ID NO: 822031 - RNA, 16 nt, Mycobacterium avium subsp. paratuberculosis
cgggaagccgccgccc

SEQ ID NO: 822032 - RNA, 14 nt, Mycobacterium avium subsp. paratuberculosis
cgggaaggcggccg

SEQ ID NO: 822033 - RNA, 16 nt, Mycobacterium avium subsp. paratuberculosis
cgggaaggcggccgcg

SEQ ID NO: 822034 - RNA, 17 nt, Mycobacterium avium subsp. paratuberculosis
cgggaaggcggccgcga

SEQ ID NO: 822035 - RNA, 23 nt, Mycobacterium avium subsp. paratuberculosis
cgggaagcugcuggcuucgcgga

SEQ ID NO: 822036 - RNA, 19 nt, Mycobacterium avium subsp. paratuberculosis
cgggaagcgaagcgggacu

SEQ ID NO: 822037 - RNA, 19 nt, Mycobacterium avium subsp. paratuberculosis
cgggcagauggucgccgac

SEQ ID NO: 822038 - RNA, 22 nt, Mycobacterium avium subsp. paratuberculosis
cgggcacucccuuguugccgag

SEQ ID NO: 822039 - RNA, 18 nt, Mycobacterium avium subsp. paratuberculosis
cgggcacucgagcguccg

SEQ ID NO: 822040 - RNA, 19 nt, Mycobacterium avium subsp. paratuberculosis
cgggcacucgagcguccgg

SEQ ID NO: 822041 - RNA, 21 nt, Mycobacterium avium subsp. paratuberculosis
cgggcacuuaacaccucgccu

SEQ ID NO: 822042 - RNA, 21 nt, Mycobacterium avium subsp. paratuberculosis
cgggcacuucguccaucgucc

SEQ ID NO: 822043 - RNA, 13 nt, Mycobacterium avium subsp. paratuberculosis
cgggcacggcgau

SEQ ID NO: 822044 - RNA, 15 nt, Mycobacterium avium subsp. paratuberculosis
cgggcacggcgaugu

SEQ ID NO: 822045 - RNA, 15 nt, Mycobacterium avium subsp. paratuberculosis
cgggcacgccgccgc

SEQ ID NO: 822046 - RNA, 16 nt, Mycobacterium avium subsp. paratuberculosis
cgggcacgccgccgcg

SEQ ID NO: 822047 - RNA, 14 nt, Mycobacterium avium subsp. paratuberculosis
cgggcacgcgagac

SEQ ID NO: 822048 - RNA, 15 nt, Mycobacterium avium subsp. paratuberculosis
cgggcacgcgagacg

SEQ ID NO: 822049 - RNA, 21 nt, Mycobacterium avium subsp. paratuberculosis
cgggcacgcgagacgagccgc

SEQ ID NO: 822050 - RNA, 22 nt, Mycobacterium avium subsp. paratuberculosis
cgggcacguccagcccgcgcca

SEQ ID NO: 822051 - RNA, 16 nt, Mycobacterium avium subsp. paratuberculosis
cgggcacgucgacgcc

SEQ ID NO: 822052 - RNA, 13 nt, Mycobacterium avium subsp. paratuberculosis
cgggcacgucgcg

SEQ ID NO: 822053 - RNA, 23 nt, Mycobacterium avium subsp. paratuberculosis
cgggcacgcagcggcgucacgcc

SEQ ID NO: 822054 - RNA, 13 nt, Mycobacterium avium subsp. paratuberculosis
cgggcacgccgcc

SEQ ID NO: 822055 - RNA, 21 nt, Mycobacterium avium subsp. paratuberculosis
cgggcaccaguaggucacccg

SEQ ID NO: 822056 - RNA, 17 nt, Mycobacterium avium subsp. paratuberculosis
cgggcaccagcgcgacg

SEQ ID NO: 822057 - RNA, 20 nt, Mycobacterium avium subsp. paratuberculosis
cgggcaccagcgcgacggug

SEQ ID NO: 822058 - RNA, 17 nt, Mycobacterium avium subsp. paratuberculosis
cgggcacacgcggucca

SEQ ID NO: 822059 - RNA, 14 nt, Mycobacterium avium subsp. paratuberculosis
cgggcacagccagc

SEQ ID NO: 822060 - RNA, 14 nt, Mycobacterium avium subsp. paratuberculosis
cgggcaccaccacc

SEQ ID NO: 822061 - RNA, 16 nt, Mycobacterium avium subsp. paratuberculosis
cgggcaccaccaccga

SEQ ID NO: 822062 - RNA, 18 nt, Mycobacterium avium subsp. paratuberculosis
cgggcaccaccaccgaca

SEQ ID NO: 822063 - RNA, 23 nt, Mycobacterium avium subsp. paratuberculosis
cgggcaccaccaccgacaccccg

SEQ ID NO: 822064 - RNA, 18 nt, Mycobacterium avium subsp. paratuberculosis
cgggcaccacgccgacgu

SEQ ID NO: 822065 - RNA, 15 nt, Mycobacterium avium subsp. paratuberculosis
cgggcaccacggcgg

SEQ ID NO: 822066 - RNA, 16 nt, Mycobacterium avium subsp. paratuberculosis
cgggcaccacggcggc

SEQ ID NO: 822067 - RNA, 18 nt, Mycobacterium avium subsp. paratuberculosis
cgggcaccacggcggcau

SEQ ID NO: 822068 - RNA, 11 nt, Mycobacterium avium subsp. paratuberculosis
cgggcaccagc

SEQ ID NO: 822069 - RNA, 18 nt, Mycobacterium avium subsp. paratuberculosis
cgggcaccagcaccgaga

SEQ ID NO: 822070 - RNA, 19 nt, Mycobacterium avium subsp. paratuberculosis
cgggccaacgguucggccg

SEQ ID NO: 822071 - RNA, 21 nt, Mycobacterium avium subsp. paratuberculosis
cgggccaacgguucggccgcu

SEQ ID NO: 822072 - RNA, 22 nt, Mycobacterium avium subsp. paratuberculosis
cgggccaacgguucggccgcuc

SEQ ID NO: 822073 - RNA, 21 nt, Mycobacterium avium subsp. paratuberculosis
cgggccaccacaguggccgcc

SEQ ID NO: 822074 - RNA, 22 nt, Mycobacterium avium subsp. paratuberculosis
cgggccaccacaguggccgcca

SEQ ID NO: 822075 - RNA, 16 nt, Mycobacterium avium subsp. paratuberculosis
cgggccaccaccacgg

SEQ ID NO: 822076 - RNA, 23 nt, Mycobacterium avium subsp. paratuberculosis
cgggccaccaccacggccgccga

SEQ ID NO: 822077 - RNA, 14 nt, Mycobacterium avium subsp. paratuberculosis
cgggcccaccgcgc

SEQ ID NO: 822078 - RNA, 15 nt, Mycobacterium avium subsp. paratuberculosis
cgggcccaccgcgcg

SEQ ID NO: 822079 - RNA, 18 nt, Mycobacterium avium subsp. paratuberculosis
cgggcccaccgcgcgcug

SEQ ID NO: 822080 - RNA, 12 nt, Mycobacterium avium subsp. paratuberculosis
cgggcccagcac

SEQ ID NO: 822081 - RNA, 13 nt, Mycobacterium avium subsp. paratuberculosis
cgggcccagcacc

SEQ ID NO: 822082 - RNA, 14 nt, Mycobacterium avium subsp. paratuberculosis
cgggcccagcacca

SEQ ID NO: 822083 - RNA, 20 nt, Mycobacterium avium subsp. paratuberculosis
cgggcccagcaccaccacgu

SEQ ID NO: 822084 - RNA, 16 nt, Mycobacterium avium subsp. paratuberculosis
cgggcccagcagccug

SEQ ID NO: 822085 - RNA, 14 nt, Mycobacterium avium subsp. paratuberculosis
cgggcccagcucgg

SEQ ID NO: 822086 - RNA, 16 nt, Mycobacterium avium subsp. paratuberculosis
cgggcccagcucggug

SEQ ID NO: 822087 - RNA, 13 nt, Mycobacterium avium subsp. paratuberculosis
cgggccccacgcc

SEQ ID NO: 822088 - RNA, 17 nt, Mycobacterium avium subsp. paratuberculosis
cgggccccacgccaguc

SEQ ID NO: 822089 - RNA, 13 nt, Mycobacterium avium subsp. paratuberculosis
cgggccgacccgg

SEQ ID NO: 822090 - RNA, 14 nt, Mycobacterium avium subsp. paratuberculosis
cgggccgacccggc

SEQ ID NO: 822091 - RNA, 16 nt, Mycobacterium avium subsp. paratuberculosis
cgggccgacccggccg

SEQ ID NO: 822092 - RNA, 22 nt, Mycobacterium avium subsp. paratuberculosis
cgggccgacccggccgauggug

SEQ ID NO: 822093 - RNA, 12 nt, Mycobacterium avium subsp. paratuberculosis
cgggccgaccug

SEQ ID NO: 822094 - RNA, 14 nt, Mycobacterium avium subsp. paratuberculosis
cgggccgaccuggc

SEQ ID NO: 822095 - RNA, 16 nt, Mycobacterium avium subsp. paratuberculosis
cgggccgaccuggcgg

SEQ ID NO: 822096 - RNA, 19 nt, Mycobacterium avium subsp. paratuberculosis
cgggccgaccuggcggccg

SEQ ID NO: 822097 - RNA, 20 nt, Mycobacterium avium subsp. paratuberculosis
cgggccgaccuggcggccgg

SEQ ID NO: 822098 - RNA, 12 nt, Mycobacterium avium subsp. paratuberculosis
cgggcccgcgca

SEQ ID NO: 822099 - RNA, 15 nt, Mycobacterium avium subsp. paratuberculosis
cgggcccgcgccgcg

SEQ ID NO: 822100 - RNA, 14 nt, Mycobacterium avium subsp. paratuberculosis
cgggcccgcgcggc

SEQ ID NO: 822101 - RNA, 17 nt, Mycobacterium avium subsp. paratuberculosis
cgggcccgcgcggcggu

SEQ ID NO: 822102 - RNA, 12 nt, Mycobacterium avium subsp. paratuberculosis
cgggcccgcggg

SEQ ID NO: 822103 - RNA, 14 nt, Mycobacterium avium subsp. paratuberculosis
cgggcccgcgggau

SEQ ID NO: 822104 - RNA, 18 nt, Mycobacterium avium subsp. paratuberculosis
cgggccgaaggcggcgcc

SEQ ID NO: 822105 - RNA, 19 nt, Mycobacterium avium subsp. paratuberculosis
cgggccgaaggcggcgccg

SEQ ID NO: 822106 - RNA, 22 nt, Mycobacterium avium subsp. paratuberculosis
cgggccgaaggcggcgccggcc

SEQ ID NO: 822107 - RNA, 23 nt, Mycobacterium avium subsp. paratuberculosis
cgggcccagcgcgacgucgaccg

SEQ ID NO: 822108 - RNA, 15 nt, Mycobacterium avium subsp. paratuberculosis
cgggcccgacgacga

SEQ ID NO: 822109 - RNA, 14 nt, Mycobacterium avium subsp. paratuberculosis
cgggcccgaggucc

SEQ ID NO: 822110 - RNA, 23 nt, Mycobacterium avium subsp. paratuberculosis
cgggcccgauggcggccugcagg

SEQ ID NO: 822111 - RNA, 15 nt, Mycobacterium avium subsp. paratuberculosis
cgggcccgcagcucg

SEQ ID NO: 822112 - RNA, 20 nt, Mycobacterium avium subsp. paratuberculosis
cgggcccgcccgcagcggcg

SEQ ID NO: 822113 - RNA, 13 nt, Mycobacterium avium subsp. paratuberculosis
cgggccggcaccc

SEQ ID NO: 822114 - RNA, 15 nt, Mycobacterium avium subsp. paratuberculosis
cgggccggcagccgg

SEQ ID NO: 822115 - RNA, 18 nt, Mycobacterium avium subsp. paratuberculosis
cgggccggcagccggcca

SEQ ID NO: 822116 - RNA, 16 nt, Mycobacterium avium subsp. paratuberculosis
cgggccggaucagcag

SEQ ID NO: 822117 - RNA, 16 nt, Mycobacterium avium subsp. paratuberculosis
cgggccggacacggcu

SEQ ID NO: 822118 - RNA, 18 nt, Mycobacterium avium subsp. paratuberculosis
cgggccggacacggcugc

SEQ ID NO: 822119 - RNA, 21 nt, Mycobacterium avium subsp. paratuberculosis
cgggccggacacggcugcacc

SEQ ID NO: 822120 - RNA, 15 nt, Mycobacterium avium subsp. paratuberculosis
cgggccggacagcgg

SEQ ID NO: 822121 - RNA, 16 nt, Mycobacterium avium subsp. paratuberculosis
cgggccggacagcggc

SEQ ID NO: 822122 - RNA, 17 nt, Mycobacterium avium subsp. paratuberculosis
cgggccggacagcggcc

SEQ ID NO: 822123 - RNA, 16 nt, Mycobacterium avium subsp. paratuberculosis
cgggccgcgucggcca

SEQ ID NO: 822124 - RNA, 15 nt, Mycobacterium avium subsp. paratuberculosis
cgggccgcuggccgc

SEQ ID NO: 822125 - RNA, 16 nt, Mycobacterium avium subsp. paratuberculosis
cgggccgcuggccgcc

SEQ ID NO: 822126 - RNA, 17 nt, Mycobacterium avium subsp. paratuberculosis
cgggccgcuggugaggu

SEQ ID NO: 822127 - RNA, 15 nt, Mycobacterium avium subsp. paratuberculosis
cgggccgcggcggua

SEQ ID NO: 822128 - RNA, 21 nt, Mycobacterium avium subsp. paratuberculosis
cgggccgcggcgguagcgggc

SEQ ID NO: 822129 - RNA, 14 nt, Mycobacterium avium subsp. paratuberculosis
cgggccgcgggccc

SEQ ID NO: 822130 - RNA, 22 nt, Mycobacterium avium subsp. paratuberculosis
cgggccgcaauacggugcccgc

SEQ ID NO: 822131 - RNA, 13 nt, Mycobacterium avium subsp. paratuberculosis
cgggccgcggcca

SEQ ID NO: 822132 - RNA, 14 nt, Mycobacterium avium subsp. paratuberculosis
cgggccgcggccag

SEQ ID NO: 822133 - RNA, 15 nt, Mycobacterium avium subsp. paratuberculosis
cgggccgcggccagc

SEQ ID NO: 822134 - RNA, 18 nt, Mycobacterium avium subsp. paratuberculosis
cgggccgcagccgcgcgg

SEQ ID NO: 822135 - RNA, 19 nt, Mycobacterium avium subsp. paratuberculosis
cgggccgcagccgcgcggc

SEQ ID NO: 822136 - RNA, 21 nt, Mycobacterium avium subsp. paratuberculosis
cgggccgcagccgcgcggccg

SEQ ID NO: 822137 - RNA, 15 nt, Mycobacterium avium subsp. paratuberculosis
cgggccgcagcgcgc

SEQ ID NO: 822138 - RNA, 23 nt, Mycobacterium avium subsp. paratuberculosis
cgggccaaaucgcuugcgccgca

SEQ ID NO: 822139 - RNA, 15 nt, Mycobacterium avium subsp. paratuberculosis
cgggcccgccguagc

SEQ ID NO: 822140 - RNA, 16 nt, Mycobacterium avium subsp. paratuberculosis
cgggccgagcgcgccg

SEQ ID NO: 822141 - RNA, 20 nt, Mycobacterium avium subsp. paratuberculosis
cgggccgagcgcgccgccgc

SEQ ID NO: 822142 - RNA, 21 nt, Mycobacterium avium subsp. paratuberculosis
cgggccgagcguucggcgcgg

SEQ ID NO: 822143 - RNA, 22 nt, Mycobacterium avium subsp. paratuberculosis
cgggccgagcguucggcgcgga

SEQ ID NO: 822144 - RNA, 12 nt, Mycobacterium avium subsp. paratuberculosis
cgggccgaucac

SEQ ID NO: 822145 - RNA, 13 nt, Mycobacterium avium subsp. paratuberculosis
cgggccgaucacg

SEQ ID NO: 822146 - RNA, 14 nt, Mycobacterium avium subsp. paratuberculosis
cgggccgaucacgc

SEQ ID NO: 822147 - RNA, 20 nt, Mycobacterium avium subsp. paratuberculosis
cgggccgcacccccuccaca

SEQ ID NO: 822148 - RNA, 17 nt, Mycobacterium avium subsp. paratuberculosis
cgggccgcacuccgucg

SEQ ID NO: 822149 - RNA, 19 nt, Mycobacterium avium subsp. paratuberculosis
cgggccgcacuccgucgcg

SEQ ID NO: 822150 - RNA, 20 nt, Mycobacterium avium subsp. paratuberculosis
cgggccgcacugcaucucga

SEQ ID NO: 822151 - RNA, 17 nt, Mycobacterium avium subsp. paratuberculosis
cgggccgcagcaccacc

SEQ ID NO: 822152 - RNA, 18 nt, Mycobacterium avium subsp. paratuberculosis
cgggccgcagcaccaccu

SEQ ID NO: 822153 - RNA, 15 nt, Mycobacterium avium subsp. paratuberculosis
cgggccgcagcacgg

SEQ ID NO: 822154 - RNA, 13 nt, Mycobacterium avium subsp. paratuberculosis
cgggcgagccgac

SEQ ID NO: 822155 - RNA, 14 nt, Mycobacterium avium subsp. paratuberculosis
cgggcgagccgaca

SEQ ID NO: 822156 - RNA, 15 nt, Mycobacterium avium subsp. paratuberculosis
cgggcgagccgacag

SEQ ID NO: 822157 - RNA, 14 nt, Mycobacterium avium subsp. paratuberculosis
cgggcgagcagcgc

SEQ ID NO: 822158 - RNA, 15 nt, Mycobacterium avium subsp. paratuberculosis
cgggcgagcagcgcc

SEQ ID NO: 822159 - RNA, 17 nt, Mycobacterium avium subsp. paratuberculosis
cgggcgagcgucgccgc

SEQ ID NO: 822160 - RNA, 20 nt, Mycobacterium avium subsp. paratuberculosis
cgggcgagcgucgccgcgug

SEQ ID NO: 822161 - RNA, 22 nt, Mycobacterium avium subsp. paratuberculosis
cgggcgaccugcgggcccaccg

SEQ ID NO: 822162 - RNA, 15 nt, Mycobacterium avium subsp. paratuberculosis
cgggcgaccuggugc

SEQ ID NO: 822163 - RNA, 15 nt, Mycobacterium avium subsp. paratuberculosis
cgggcgacgacgcgg

SEQ ID NO: 822164 - RNA, 16 nt, Mycobacterium avium subsp. paratuberculosis
cgggcgacgacgcggu

SEQ ID NO: 822165 - RNA, 17 nt, Mycobacterium avium subsp. paratuberculosis
cgggcgacgacgcgguc

SEQ ID NO: 822166 - RNA, 18 nt, Mycobacterium avium subsp. paratuberculosis
cgggcgacgacgcggucg

SEQ ID NO: 822167 - RNA, 15 nt, Mycobacterium avium subsp. paratuberculosis
cgggcgacgucaacu

SEQ ID NO: 822168 - RNA, 14 nt, Mycobacterium avium subsp. paratuberculosis
cgggcgacgucggg

SEQ ID NO: 822169 - RNA, 18 nt, Mycobacterium avium subsp. paratuberculosis
cgggcgacuucguuggug

SEQ ID NO: 822170 - RNA, 23 nt, Mycobacterium avium subsp. paratuberculosis
cgggcgacuucguugguggucga

SEQ ID NO: 822171 - RNA, 15 nt, Mycobacterium avium subsp. paratuberculosis
cgggcgacuucuucg

SEQ ID NO: 822172 - RNA, 18 nt, Mycobacterium avium subsp. paratuberculosis
cgggcgacuucuucgccg

SEQ ID NO: 822173 - RNA, 20 nt, Mycobacterium avium subsp. paratuberculosis
cgggcgacuucuucgccggc

SEQ ID NO: 822174 - RNA, 21 nt, Mycobacterium avium subsp. paratuberculosis
cgggcgacuucuucgccggcg

SEQ ID NO: 822175 - RNA, 22 nt, Mycobacterium avium subsp. paratuberculosis
cgggcgacuucuucgccggcgc

SEQ ID NO: 822176 - RNA, 18 nt, Mycobacterium avium subsp. paratuberculosis
cgggcgacaucucgguga

SEQ ID NO: 822177 - RNA, 18 nt, Mycobacterium avium subsp. paratuberculosis
cgggcgacaugcccgcgg

SEQ ID NO: 822178 - RNA, 21 nt, Mycobacterium avium subsp. paratuberculosis
cgggcgacaugcccgcggugc

SEQ ID NO: 822179 - RNA, 19 nt, Mycobacterium avium subsp. paratuberculosis
cgggcgaagucgccggcca

SEQ ID NO: 822180 - RNA, 20 nt, Mycobacterium avium subsp. paratuberculosis
cgggcgaagucgccggccag

SEQ ID NO: 822181 - RNA, 16 nt, Mycobacterium avium subsp. paratuberculosis
cgggcgaaccacgggu

SEQ ID NO: 822182 - RNA, 13 nt, Mycobacterium avium subsp. paratuberculosis
cgggcgaccccgg

SEQ ID NO: 822183 - RNA, 14 nt, Mycobacterium avium subsp. paratuberculosis
cgggcgaccccggc

SEQ ID NO: 822184 - RNA, 17 nt, Mycobacterium avium subsp. paratuberculosis
cgggcgaccccggccag

SEQ ID NO: 822185 - RNA, 15 nt, Mycobacterium avium subsp. paratuberculosis
cgggcgacccgcugg

SEQ ID NO: 822186 - RNA, 18 nt, Mycobacterium avium subsp. paratuberculosis
cgggcgaaguagccggcg

SEQ ID NO: 822187 - RNA, 19 nt, Mycobacterium avium subsp. paratuberculosis
cgggcgaaguagccggcga

SEQ ID NO: 822188 - RNA, 22 nt, Mycobacterium avium subsp. paratuberculosis
cgggcgaaguagccggcgaucg

SEQ ID NO: 822189 - RNA, 15 nt, Mycobacterium avium subsp. paratuberculosis
cgggcgaacgaccgg

SEQ ID NO: 822190 - RNA, 16 nt, Mycobacterium avium subsp. paratuberculosis
cgggcgaacgaccggg

SEQ ID NO: 822191 - RNA, 23 nt, Mycobacterium avium subsp. paratuberculosis
cgggcgaacgaccgggugaacga

SEQ ID NO: 822192 - RNA, 14 nt, Mycobacterium avium subsp. paratuberculosis
cgggcgaacgucgg

SEQ ID NO: 822193 - RNA, 15 nt, Mycobacterium avium subsp. paratuberculosis
cgggcgaacgucggg

SEQ ID NO: 822194 - RNA, 22 nt, Mycobacterium avium subsp. paratuberculosis
cgggcgaacgucgggucgaagu

SEQ ID NO: 822195 - RNA, 14 nt, Mycobacterium avium subsp. paratuberculosis
cgggccgucaucgc

SEQ ID NO: 822196 - RNA, 16 nt, Mycobacterium avium subsp. paratuberculosis
cgggccgucaucgccg

SEQ ID NO: 822197 - RNA, 19 nt, Mycobacterium avium subsp. paratuberculosis
cgggccgucaucgccgacg

SEQ ID NO: 822198 - RNA, 14 nt, Mycobacterium avium subsp. paratuberculosis
cgggccguccgccg

SEQ ID NO: 822199 - RNA, 20 nt, Mycobacterium avium subsp. paratuberculosis
cgggccguaucggccccggc

SEQ ID NO: 822200 - RNA, 15 nt, Mycobacterium avium subsp. paratuberculosis
cgggcgaaaucucga

SEQ ID NO: 822201 - RNA, 15 nt, Mycobacterium avium subsp. paratuberculosis
cgggccggucgguca

SEQ ID NO: 822202 - RNA, 17 nt, Mycobacterium avium subsp. paratuberculosis
cgggccgggcgggcacc

SEQ ID NO: 822203 - RNA, 20 nt, Mycobacterium avium subsp. paratuberculosis
cgggccgggcgggcacccca

SEQ ID NO: 822204 - RNA, 13 nt, Mycobacterium avium subsp. paratuberculosis
cgggccggucagc

SEQ ID NO: 822205 - RNA, 15 nt, Mycobacterium avium subsp. paratuberculosis
cgggccggucagcgc

SEQ ID NO: 822206 - RNA, 17 nt, Mycobacterium avium subsp. paratuberculosis
cgggccggucagcgcga

SEQ ID NO: 822207 - RNA, 19 nt, Mycobacterium avium subsp. paratuberculosis
cgggccggucagcgcgaca

SEQ ID NO: 822208 - RNA, 19 nt, Mycobacterium avium subsp. paratuberculosis
cgggccgguccccggcgac

SEQ ID NO: 822209 - RNA, 13 nt, Mycobacterium avium subsp. paratuberculosis
cgggccgggcacc

SEQ ID NO: 822210 - RNA, 17 nt, Mycobacterium avium subsp. paratuberculosis
cgggccgggcaccgcgc

SEQ ID NO: 822211 - RNA, 18 nt, Mycobacterium avium subsp. paratuberculosis
cgggccggcggggugggc

SEQ ID NO: 822212 - RNA, 13 nt, Mycobacterium avium subsp. paratuberculosis
cgggccggcgucg

SEQ ID NO: 822213 - RNA, 15 nt, Mycobacterium avium subsp. paratuberculosis
cgggccggcgucgcg

SEQ ID NO: 822214 - RNA, 16 nt, Mycobacterium avium subsp. paratuberculosis
cgggccggcgucgcgg

SEQ ID NO: 822215 - RNA, 17 nt, Mycobacterium avium subsp. paratuberculosis
cgggccggcgucgcggu

SEQ ID NO: 822216 - RNA, 18 nt, Mycobacterium avium subsp. paratuberculosis
cgggccggcgucgcggug

SEQ ID NO: 822217 - RNA, 13 nt, Mycobacterium avium subsp. paratuberculosis
cgggccggcggcc

SEQ ID NO: 822218 - RNA, 14 nt, Mycobacterium avium subsp. paratuberculosis
cgggccggcggcca

SEQ ID NO: 822219 - RNA, 13 nt, Mycobacterium avium subsp. paratuberculosis
cgggccggcgccg

SEQ ID NO: 822220 - RNA, 23 nt, Mycobacterium avium subsp. paratuberculosis
cgggccggcgccgacgacgucgc

SEQ ID NO: 822221 - RNA, 17 nt, Mycobacterium avium subsp. paratuberculosis
cgggccggcgccggugc

SEQ ID NO: 822222 - RNA, 21 nt, Mycobacterium avium subsp. paratuberculosis
cgggccggcgccggugccgca

SEQ ID NO: 822223 - RNA, 13 nt, Mycobacterium avium subsp. paratuberculosis
cgggccggccaga

SEQ ID NO: 822224 - RNA, 15 nt, Mycobacterium avium subsp. paratuberculosis
cgggccggccagacc

SEQ ID NO: 822225 - RNA, 12 nt, Mycobacterium avium subsp. paratuberculosis
cgggccggccga

SEQ ID NO: 822226 - RNA, 15 nt, Mycobacterium avium subsp. paratuberculosis
cgggccggccgauga

SEQ ID NO: 822227 - RNA, 21 nt, Mycobacterium avium subsp. paratuberculosis
cgcccagaucgacgccgaccg

SEQ ID NO: 822228 - RNA, 22 nt, Mycobacterium avium subsp. paratuberculosis
cgcccagaucgacgccgaccgc

SEQ ID NO: 822229 - RNA, 16 nt, Mycobacterium avium subsp. paratuberculosis
cgcccagaacgacgcg

SEQ ID NO: 822230 - RNA, 23 nt, Mycobacterium avium subsp. paratuberculosis
cgcccagaacugggccgccgucg

SEQ ID NO: 822231 - RNA, 21 nt, Mycobacterium avium subsp. paratuberculosis
cgcccagcaaacccagcacca

SEQ ID NO: 822232 - RNA, 15 nt, Mycobacterium avium subsp. paratuberculosis
cgcccagaucgccga

SEQ ID NO: 822233 - RNA, 17 nt, Mycobacterium avium subsp. paratuberculosis
cgcccagaucgccgacc

SEQ ID NO: 822234 - RNA, 18 nt, Mycobacterium avium subsp. paratuberculosis
cgcccagaucgccgaccc

SEQ ID NO: 822235 - RNA, 16 nt, Mycobacterium avium subsp. paratuberculosis
cgcccagaucggccag

SEQ ID NO: 822236 - RNA, 17 nt, Mycobacterium avium subsp. paratuberculosis
cgcccagaucggccagc

SEQ ID NO: 822237 - RNA, 14 nt, Mycobacterium avium subsp. paratuberculosis
cgcccagaugcagg

SEQ ID NO: 822238 - RNA, 16 nt, Mycobacterium avium subsp. paratuberculosis
cgcccagaugccgccg

SEQ ID NO: 822239 - RNA, 22 nt, Mycobacterium avium subsp. paratuberculosis
cgcccagaugccgccgccagcg

SEQ ID NO: 822240 - RNA, 15 nt, Mycobacterium avium subsp. paratuberculosis
cgcccagaugccggc

SEQ ID NO: 822241 - RNA, 16 nt, Mycobacterium avium subsp. paratuberculosis
cgcccagaugccggcg

SEQ ID NO: 822242 - RNA, 20 nt, Mycobacterium avium subsp. paratuberculosis
cgcccagaugccggcguagc

SEQ ID NO: 822243 - RNA, 16 nt, Mycobacterium avium subsp. paratuberculosis
cgcccaccuggaggcc

SEQ ID NO: 822244 - RNA, 24 nt, Mycobacterium avium subsp. paratuberculosis
cgcccaccuggaggccaacgagcg

SEQ ID NO: 822245 - RNA, 22 nt, Mycobacterium avium subsp. paratuberculosis
cgcccaccugguucucccgucg

SEQ ID NO: 822246 - RNA, 20 nt, Mycobacterium avium subsp. paratuberculosis
cgcccaccugguuggcccgc

SEQ ID NO: 822247 - RNA, 21 nt, Mycobacterium avium subsp. paratuberculosis
cgcccaccugguuggcccgca

SEQ ID NO: 822248 - RNA, 22 nt, Mycobacterium avium subsp. paratuberculosis
cgcccaccugguuggcccgcac

SEQ ID NO: 822249 - RNA, 23 nt, Mycobacterium avium subsp. paratuberculosis
cgcccaccugguuggcccgcacc

SEQ ID NO: 822250 - RNA, 18 nt, Mycobacterium avium subsp. paratuberculosis
cgcccaccuucccaaccc

SEQ ID NO: 822251 - RNA, 14 nt, Mycobacterium avium subsp. paratuberculosis
cgcccaccuuggcg

SEQ ID NO: 822252 - RNA, 17 nt, Mycobacterium avium subsp. paratuberculosis
cgcccaccuuggcgucg

SEQ ID NO: 822253 - RNA, 19 nt, Mycobacterium avium subsp. paratuberculosis
cgcccaccuuggcgucgau

SEQ ID NO: 822254 - RNA, 16 nt, Mycobacterium avium subsp. paratuberculosis
cgcccacgccgcccag

SEQ ID NO: 822255 - RNA, 15 nt, Mycobacterium avium subsp. paratuberculosis
cgcccacggccacca

SEQ ID NO: 822256 - RNA, 14 nt, Mycobacterium avium subsp. paratuberculosis
cgcccacuggucgu

SEQ ID NO: 822257 - RNA, 13 nt, Mycobacterium avium subsp. paratuberculosis
cgcccacgggucg

SEQ ID NO: 822258 - RNA, 22 nt, Mycobacterium avium subsp. paratuberculosis
cgcccacguaggggcccggguu

SEQ ID NO: 822259 - RNA, 14 nt, Mycobacterium avium subsp. paratuberculosis
cgcccacgccggug

SEQ ID NO: 822260 - RNA, 13 nt, Mycobacterium avium subsp. paratuberculosis
cgcccacaggucc

SEQ ID NO: 822261 - RNA, 21 nt, Mycobacterium avium subsp. paratuberculosis
cgcccacagguccagcguccg

SEQ ID NO: 822262 - RNA, 18 nt, Mycobacterium avium subsp. paratuberculosis
cgcccacaguccgcccag

SEQ ID NO: 822263 - RNA, 16 nt, Mycobacterium avium subsp. paratuberculosis
cgcccacaccgacacc

SEQ ID NO: 822264 - RNA, 19 nt, Mycobacterium avium subsp. paratuberculosis
cgcccacaccgacaccggc

SEQ ID NO: 822265 - RNA, 22 nt, Mycobacterium avium subsp. paratuberculosis
cgcccacagcugacgggccggc

SEQ ID NO: 822266 - RNA, 19 nt, Mycobacterium avium subsp. paratuberculosis
cgcccaccagcacaccgga

SEQ ID NO: 822267 - RNA, 14 nt, Mycobacterium avium subsp. paratuberculosis
cgcccaccacgaac

SEQ ID NO: 822268 - RNA, 22 nt, Mycobacterium avium subsp. paratuberculosis
cgcccaccacgaaccaggcgcc

SEQ ID NO: 822269 - RNA, 23 nt, Mycobacterium avium subsp. paratuberculosis
cgcccaccacgaacgcgccgccg

SEQ ID NO: 822270 - RNA, 13 nt, Mycobacterium avium subsp. paratuberculosis
cgcccaccacgac

SEQ ID NO: 822271 - RNA, 14 nt, Mycobacterium avium subsp. paratuberculosis
cgcccaccgcggcg

SEQ ID NO: 822272 - RNA, 15 nt, Mycobacterium avium subsp. paratuberculosis
cgcccaccgcggcgc

SEQ ID NO: 822273 - RNA, 16 nt, Mycobacterium avium subsp. paratuberculosis
cgcccaccgcggcgcg

SEQ ID NO: 822274 - RNA, 14 nt, Mycobacterium avium subsp. paratuberculosis
cgcccaccgacgcg

SEQ ID NO: 822275 - RNA, 16 nt, Mycobacterium avium subsp. paratuberculosis
cgcccaccgacgcggc

SEQ ID NO: 822276 - RNA, 17 nt, Mycobacterium avium subsp. paratuberculosis
cgcccaccgacgcggcg

SEQ ID NO: 822277 - RNA, 21 nt, Mycobacterium avium subsp. paratuberculosis
cgcccaccgacgcggcggccg

SEQ ID NO: 822278 - RNA, 12 nt, Mycobacterium avium subsp. paratuberculosis
cgcccaccccgg

SEQ ID NO: 822279 - RNA, 13 nt, Mycobacterium avium subsp. paratuberculosis
cgcccaccccggc

SEQ ID NO: 822280 - RNA, 16 nt, Mycobacterium avium subsp. paratuberculosis
cgcccacccggggccg

SEQ ID NO: 822281 - RNA, 20 nt, Mycobacterium avium subsp. paratuberculosis
cgcccacccggggccguccg

SEQ ID NO: 822282 - RNA, 16 nt, Mycobacterium avium subsp. paratuberculosis
cgcccaccccggcguc

SEQ ID NO: 822283 - RNA, 23 nt, Mycobacterium avium subsp. paratuberculosis
cgcccaccccggcguccacgccg

SEQ ID NO: 822284 - RNA, 13 nt, Mycobacterium avium subsp. paratuberculosis
cgcccacccgaug

SEQ ID NO: 822285 - RNA, 19 nt, Mycobacterium avium subsp. paratuberculosis
cgcccacccgaugaccggc

SEQ ID NO: 822286 - RNA, 22 nt, Mycobacterium avium subsp. paratuberculosis
cgcccacccgaugaccggcccg

SEQ ID NO: 822287 - RNA, 14 nt, Mycobacterium avium subsp. paratuberculosis
cgcccacccgccag

SEQ ID NO: 822288 - RNA, 18 nt, Mycobacterium avium subsp. paratuberculosis
cgcccacccgccagcccg

SEQ ID NO: 822289 - RNA, 18 nt, Mycobacterium avium subsp. paratuberculosis
cgcccacccgcgccggca

SEQ ID NO: 822290 - RNA, 20 nt, Mycobacterium avium subsp. paratuberculosis
cgcccacccgcgccggcaga

SEQ ID NO: 822291 - RNA, 16 nt, Mycobacterium avium subsp. paratuberculosis
cgcccaggccgccagc

SEQ ID NO: 822292 - RNA, 19 nt, Mycobacterium avium subsp. paratuberculosis
cgcccaggccgccagcucg

SEQ ID NO: 822293 - RNA, 13 nt, Mycobacterium avium subsp. paratuberculosis
cgcccaggccccg

SEQ ID NO: 822294 - RNA, 18 nt, Mycobacterium avium subsp. paratuberculosis
cgcccaggccccggccga

SEQ ID NO: 822295 - RNA, 19 nt, Mycobacterium avium subsp. paratuberculosis
cgcccaggccccggccgag

SEQ ID NO: 822296 - RNA, 13 nt, Mycobacterium avium subsp. paratuberculosis
cgcccaggcccga

SEQ ID NO: 822297 - RNA, 20 nt, Mycobacterium avium subsp. paratuberculosis
cgcccagcggccccggcucg

SEQ ID NO: 822298 - RNA, 21 nt, Mycobacterium avium subsp. paratuberculosis
cgcccagcggccccggcucgg

SEQ ID NO: 822299 - RNA, 17 nt, Mycobacterium avium subsp. paratuberculosis
cgcccaggaacgcgccg

SEQ ID NO: 822300 - RNA, 18 nt, Mycobacterium avium subsp. paratuberculosis
cgcccaggaacgcgccgg

SEQ ID NO: 822301 - RNA, 18 nt, Mycobacterium avium subsp. paratuberculosis
cgcccaggaacuggucga

SEQ ID NO: 822302 - RNA, 18 nt, Mycobacterium avium subsp. paratuberculosis
cgcccagcugggccagcg

SEQ ID NO: 822303 - RNA, 14 nt, Mycobacterium avium subsp. paratuberculosis
cgcccagcgcgcga

SEQ ID NO: 822304 - RNA, 12 nt, Mycobacterium avium subsp. paratuberculosis
cgcccagcgcgg

SEQ ID NO: 822305 - RNA, 14 nt, Mycobacterium avium subsp. paratuberculosis
cgcccagcgcggcg

SEQ ID NO: 822306 - RNA, 15 nt, Mycobacterium avium subsp. paratuberculosis
cgcccagcgcggcgg

SEQ ID NO: 822307 - RNA, 17 nt, Mycobacterium avium subsp. paratuberculosis
cgcccagcgcggcggcc

SEQ ID NO: 822308 - RNA, 19 nt, Mycobacterium avium subsp. paratuberculosis
cgcccagcgcggcggccac

SEQ ID NO: 822309 - RNA, 15 nt, Mycobacterium avium subsp. paratuberculosis
cgcccagcggcuuga

SEQ ID NO: 822310 - RNA, 17 nt, Mycobacterium avium subsp. paratuberculosis
cgcccagcgucucggcg

SEQ ID NO: 822311 - RNA, 18 nt, Mycobacterium avium subsp. paratuberculosis
cgcccagcgucucggcgg

SEQ ID NO: 822312 - RNA, 23 nt, Mycobacterium avium subsp. paratuberculosis
cgcccagcgucucggcggccgag

SEQ ID NO: 822313 - RNA, 13 nt, Mycobacterium avium subsp. paratuberculosis
cgcccagcguggu

SEQ ID NO: 822314 - RNA, 22 nt, Mycobacterium avium subsp. paratuberculosis
cgcccagcguggucacccgcag

SEQ ID NO: 822315 - RNA, 16 nt, Mycobacterium avium subsp. paratuberculosis
cgcccagcgugucggc

SEQ ID NO: 822316 - RNA, 13 nt, Mycobacterium avium subsp. paratuberculosis
cgcccagcgccgc

SEQ ID NO: 822317 - RNA, 15 nt, Mycobacterium avium subsp. paratuberculosis
cgcccagcgccgcgg

SEQ ID NO: 822318 - RNA, 16 nt, Mycobacterium avium subsp. paratuberculosis
cgcccagcgccgcggc

SEQ ID NO: 822319 - RNA, 17 nt, Mycobacterium avium subsp. paratuberculosis
cgcccagcgccgcggcg

SEQ ID NO: 822320 - RNA, 12 nt, Mycobacterium avium subsp. paratuberculosis
cgcccagcgccg

SEQ ID NO: 822321 - RNA, 16 nt, Mycobacterium avium subsp. paratuberculosis
cgcccagcgccacggu

SEQ ID NO: 822322 - RNA, 19 nt, Mycobacterium avium subsp. paratuberculosis
cgcccagcgagcugccggc

SEQ ID NO: 822323 - RNA, 23 nt, Mycobacterium avium subsp. paratuberculosis
cgcccagcgagcugccggcggcc

SEQ ID NO: 822324 - RNA, 15 nt, Mycobacterium avium subsp. paratuberculosis
cgcccagcgagucga

SEQ ID NO: 822325 - RNA, 17 nt, Mycobacterium avium subsp. paratuberculosis
cgcccagcgcagcaucg

SEQ ID NO: 822326 - RNA, 20 nt, Mycobacterium avium subsp. paratuberculosis
cgcccagcgcagcaucggca

SEQ ID NO: 822327 - RNA, 22 nt, Mycobacterium avium subsp. paratuberculosis
cgcccagcgcagcgccucggcg

SEQ ID NO: 822328 - RNA, 16 nt, Mycobacterium avium subsp. paratuberculosis
cgcccagcgacucggc

SEQ ID NO: 822329 - RNA, 23 nt, Mycobacterium avium subsp. paratuberculosis
cgcccagcgacucggccaggaug

SEQ ID NO: 822330 - RNA, 14 nt, Mycobacterium avium subsp. paratuberculosis
cgcccagccggcgg

SEQ ID NO: 822331 - RNA, 14 nt, Mycobacterium avium subsp. paratuberculosis
cgcccagccgagcc

SEQ ID NO: 822332 - RNA, 15 nt, Mycobacterium avium subsp. paratuberculosis
cgcccagccgagccg

SEQ ID NO: 822333 - RNA, 16 nt, Mycobacterium avium subsp. paratuberculosis
cgcccagccgagccgg

SEQ ID NO: 822334 - RNA, 14 nt, Mycobacterium avium subsp. paratuberculosis
cgcccagccccagc

SEQ ID NO: 822335 - RNA, 19 nt, Mycobacterium avium subsp. paratuberculosis
cgcccagccccagcacgau

SEQ ID NO: 822336 - RNA, 23 nt, Mycobacterium avium subsp. paratuberculosis
cgcccagccccagcacgaugacg

SEQ ID NO: 822337 - RNA, 11 nt, Mycobacterium avium subsp. paratuberculosis
cgcccagcccg

SEQ ID NO: 822338 - RNA, 16 nt, Mycobacterium avium subsp. paratuberculosis
cgcccagcccgagcac

SEQ ID NO: 822339 - RNA, 17 nt, Mycobacterium avium subsp. paratuberculosis
cgcccagcccgagcacc

SEQ ID NO: 822340 - RNA, 22 nt, Mycobacterium avium subsp. paratuberculosis
cgcccagcccgagcaccagcgg

SEQ ID NO: 822341 - RNA, 16 nt, Mycobacterium avium subsp. paratuberculosis
cgcccagcccgcgccg

SEQ ID NO: 822342 - RNA, 17 nt, Mycobacterium avium subsp. paratuberculosis
cgcccagcccgcgccga

SEQ ID NO: 822343 - RNA, 18 nt, Mycobacterium avium subsp. paratuberculosis
cgcccagcccgcgccgag

SEQ ID NO: 822344 - RNA, 17 nt, Mycobacterium avium subsp. paratuberculosis
cgcccagcccgcgggcg

SEQ ID NO: 822345 - RNA, 18 nt, Mycobacterium avium subsp. paratuberculosis
cgcccagcccgcgggcgg

SEQ ID NO: 822346 - RNA, 19 nt, Mycobacterium avium subsp. paratuberculosis
cgcccagcccgcgggcggc

SEQ ID NO: 822347 - RNA, 14 nt, Mycobacterium avium subsp. paratuberculosis
cgcccagcaucgcc

SEQ ID NO: 822348 - RNA, 20 nt, Mycobacterium avium subsp. paratuberculosis
cgcccagcaucgccgcgacc

SEQ ID NO: 822349 - RNA, 21 nt, Mycobacterium avium subsp. paratuberculosis
cgcccagcaucgccgcgaccc

SEQ ID NO: 822350 - RNA, 21 nt, Mycobacterium avium subsp. paratuberculosis
cgcccagcacccgguuccacc

SEQ ID NO: 822351 - RNA, 13 nt, Mycobacterium avium subsp. paratuberculosis
cgcccagcaccgc

SEQ ID NO: 822352 - RNA, 14 nt, Mycobacterium avium subsp. paratuberculosis
cgcccagcaccgcg

SEQ ID NO: 822353 - RNA, 17 nt, Mycobacterium avium subsp. paratuberculosis
cgcccagcaccgcgacg

SEQ ID NO: 822354 - RNA, 20 nt, Mycobacterium avium subsp. paratuberculosis
cgcccagcaccgucugcgcc

SEQ ID NO: 822355 - RNA, 19 nt, Mycobacterium avium subsp. paratuberculosis
cgcccagcacgucaccgcu

SEQ ID NO: 822356 - RNA, 17 nt, Mycobacterium avium subsp. paratuberculosis
cgcccagcagcccggcc

SEQ ID NO: 822357 - RNA, 18 nt, Mycobacterium avium subsp. paratuberculosis
cgcccagcagcccggcca

SEQ ID NO: 822358 - RNA, 20 nt, Mycobacterium avium subsp. paratuberculosis
cgcccagcagcccggccagc

SEQ ID NO: 822359 - RNA, 13 nt, Mycobacterium avium subsp. paratuberculosis
cgccaggaccacc

SEQ ID NO: 822360 - RNA, 15 nt, Mycobacterium avium subsp. paratuberculosis
cgccaggaccagcgg

SEQ ID NO: 822361 - RNA, 18 nt, Mycobacterium avium subsp. paratuberculosis
cgccaggaccagcggguc

SEQ ID NO: 822362 - RNA, 19 nt, Mycobacterium avium subsp. paratuberculosis
cgccaggaccagcgggucg

SEQ ID NO: 822363 - RNA, 22 nt, Mycobacterium avium subsp. paratuberculosis
cgccaggaagacguaggcggcc

SEQ ID NO: 822364 - RNA, 20 nt, Mycobacterium avium subsp. paratuberculosis
cgccaggaauaacgccggcc

SEQ ID NO: 822365 - RNA, 19 nt, Mycobacterium avium subsp. paratuberculosis
cgccaggauguacccgcag

SEQ ID NO: 822366 - RNA, 22 nt, Mycobacterium avium subsp. paratuberculosis
cgccaggauguacccgcaggcc

SEQ ID NO: 822367 - RNA, 17 nt, Mycobacterium avium subsp. paratuberculosis
cgccaggcaggcggcca

SEQ ID NO: 822368 - RNA, 23 nt, Mycobacterium avium subsp. paratuberculosis
cgccaggcaggcggccagggcgg

SEQ ID NO: 822369 - RNA, 16 nt, Mycobacterium avium subsp. paratuberculosis
cgccaggauccgcccg

SEQ ID NO: 822370 - RNA, 19 nt, Mycobacterium avium subsp. paratuberculosis
cgccaggaucugcucggcg

SEQ ID NO: 822371 - RNA, 17 nt, Mycobacterium avium subsp. paratuberculosis
cgccaugucgaugucga

SEQ ID NO: 822372 - RNA, 15 nt, Mycobacterium avium subsp. paratuberculosis
cgccauguccggcag

SEQ ID NO: 822373 - RNA, 16 nt, Mycobacterium avium subsp. paratuberculosis
cgccauguccggcagg

SEQ ID NO: 822374 - RNA, 13 nt, Mycobacterium avium subsp. paratuberculosis
cgccauggcggca

SEQ ID NO: 822375 - RNA, 15 nt, Mycobacterium avium subsp. paratuberculosis
cgccauggcggcauc

SEQ ID NO: 822376 - RNA, 16 nt, Mycobacterium avium subsp. paratuberculosis
cgccauggcggcaucc

SEQ ID NO: 822377 - RNA, 15 nt, Mycobacterium avium subsp. paratuberculosis
cgccaugggcaucgu

SEQ ID NO: 822378 - RNA, 19 nt, Mycobacterium avium subsp. paratuberculosis
cgccaugggcaucgucucg

SEQ ID NO: 822379 - RNA, 14 nt, Mycobacterium avium subsp. paratuberculosis
cgccaugcugcccu

SEQ ID NO: 822380 - RNA, 14 nt, Mycobacterium avium subsp. paratuberculosis
cgccaugcgccgcg

SEQ ID NO: 822381 - RNA, 13 nt, Mycobacterium avium subsp. paratuberculosis
cgccaggccaccg

SEQ ID NO: 822382 - RNA, 21 nt, Mycobacterium avium subsp. paratuberculosis
cgcccaacaacucgacguucg

SEQ ID NO: 822383 - RNA, 22 nt, Mycobacterium avium subsp. paratuberculosis
cgcccaacaacucgacguucgg

SEQ ID NO: 822384 - RNA, 15 nt, Mycobacterium avium subsp. paratuberculosis
cgcccaacgacgucg

SEQ ID NO: 822385 - RNA, 18 nt, Mycobacterium avium subsp. paratuberculosis
cgcccaacgacgucggcg

SEQ ID NO: 822386 - RNA, 21 nt, Mycobacterium avium subsp. paratuberculosis
cgcccaacgacgucggcguca

SEQ ID NO: 822387 - RNA, 17 nt, Mycobacterium avium subsp. paratuberculosis
cgcccaacuacccgccg

SEQ ID NO: 822388 - RNA, 22 nt, Mycobacterium avium subsp. paratuberculosis
cgcccaacuacccgccgacgcc

SEQ ID NO: 822389 - RNA, 13 nt, Mycobacterium avium subsp. paratuberculosis
cgcccacagcgcc

SEQ ID NO: 822390 - RNA, 14 nt, Mycobacterium avium subsp. paratuberculosis
cgcccacagcgcca

SEQ ID NO: 822391 - RNA, 18 nt, Mycobacterium avium subsp. paratuberculosis
cgcccacagcgccagcac

SEQ ID NO: 822392 - RNA, 15 nt, Mycobacterium avium subsp. paratuberculosis
cgcccacagcugacg

SEQ ID NO: 822393 - RNA, 17 nt, Mycobacterium avium subsp. paratuberculosis
cgccaugugccggcgcu

SEQ ID NO: 822394 - RNA, 18 nt, Mycobacterium avium subsp. paratuberculosis
cgccaugugccggcgcuc

SEQ ID NO: 822395 - RNA, 15 nt, Mycobacterium avium subsp. paratuberculosis
cgccccuggcgucgg

SEQ ID NO: 822396 - RNA, 16 nt, Mycobacterium avium subsp. paratuberculosis
cgccccuccaggcaug

SEQ ID NO: 822397 - RNA, 20 nt, Mycobacterium avium subsp. paratuberculosis
cgccccugagggugucggcg

SEQ ID NO: 822398 - RNA, 20 nt, Mycobacterium avium subsp. paratuberculosis
cgccccugcuggguuccgcg

SEQ ID NO: 822399 - RNA, 17 nt, Mycobacterium avium subsp. paratuberculosis
cgcccgcagcgcaucgg

SEQ ID NO: 822400 - RNA, 15 nt, Mycobacterium avium subsp. paratuberculosis
cgcccgcagcggcgg

SEQ ID NO: 822401 - RNA, 18 nt, Mycobacterium avium subsp. paratuberculosis
cgcccgcaguucggccgc

SEQ ID NO: 822402 - RNA, 20 nt, Mycobacterium avium subsp. paratuberculosis
cgcccgcaguucggccgccg

SEQ ID NO: 822403 - RNA, 13 nt, Mycobacterium avium subsp. paratuberculosis
cgcccgcaggccg

SEQ ID NO: 822404 - RNA, 13 nt, Mycobacterium avium subsp. paratuberculosis
cgcccgcgccacc

SEQ ID NO: 822405 - RNA, 15 nt, Mycobacterium avium subsp. paratuberculosis
cgcccgcgccacccc

SEQ ID NO: 822406 - RNA, 19 nt, Mycobacterium avium subsp. paratuberculosis
cgcccgcgaacacgcgaug

SEQ ID NO: 822407 - RNA, 14 nt, Mycobacterium avium subsp. paratuberculosis
cgcccgcgacccga

SEQ ID NO: 822408 - RNA, 18 nt, Mycobacterium avium subsp. paratuberculosis
cgcccgcgaucaacaccg

SEQ ID NO: 822409 - RNA, 16 nt, Mycobacterium avium subsp. paratuberculosis
cgcccgcgcgcucggg

SEQ ID NO: 822410 - RNA, 14 nt, Mycobacterium avium subsp. paratuberculosis
cgcccgcgcggcgg

SEQ ID NO: 822411 - RNA, 14 nt, Mycobacterium avium subsp. paratuberculosis
cgcccgcgcgaucg

SEQ ID NO: 822412 - RNA, 18 nt, Mycobacterium avium subsp. paratuberculosis
cgcccgcgcgaucggcga

SEQ ID NO: 822413 - RNA, 22 nt, Mycobacterium avium subsp. paratuberculosis
cgcccgcgcgaucggcgagccg

SEQ ID NO: 822414 - RNA, 20 nt, Mycobacterium avium subsp. paratuberculosis
cgcccgcgacugucggcucg

SEQ ID NO: 822415 - RNA, 23 nt, Mycobacterium avium subsp. paratuberculosis
cgcccgcgaaaucuucgccguca

SEQ ID NO: 822416 - RNA, 14 nt, Mycobacterium avium subsp. paratuberculosis
cgcccgcccgagcg

SEQ ID NO: 822417 - RNA, 17 nt, Mycobacterium avium subsp. paratuberculosis
cgcccgcccgagcguca

SEQ ID NO: 822418 - RNA, 14 nt, Mycobacterium avium subsp. paratuberculosis
cgcccgccccgacg

SEQ ID NO: 822419 - RNA, 17 nt, Mycobacterium avium subsp. paratuberculosis
cgcccgccccgacgugc

SEQ ID NO: 822420 - RNA, 14 nt, Mycobacterium avium subsp. paratuberculosis
cgcccgcccaggcc

SEQ ID NO: 822421 - RNA, 15 nt, Mycobacterium avium subsp. paratuberculosis
cgcccgcccaggccg

SEQ ID NO: 822422 - RNA, 16 nt, Mycobacterium avium subsp. paratuberculosis
cgcccggcagcgguca

SEQ ID NO: 822423 - RNA, 14 nt, Mycobacterium avium subsp. paratuberculosis
cgcccggccagccg

SEQ ID NO: 822424 - RNA, 13 nt, Mycobacterium avium subsp. paratuberculosis
cgcccggcagccg

SEQ ID NO: 822425 - RNA, 15 nt, Mycobacterium avium subsp. paratuberculosis
cgcccggcagccgcu

SEQ ID NO: 822426 - RNA, 23 nt, Mycobacterium avium subsp. paratuberculosis
cgcccggcagccgcuccggcccg

SEQ ID NO: 822427 - RNA, 13 nt, Mycobacterium avium subsp. paratuberculosis
cgcccgcugcggc

SEQ ID NO: 822428 - RNA, 14 nt, Mycobacterium avium subsp. paratuberculosis
cgcccgcugcggcg

SEQ ID NO: 822429 - RNA, 15 nt, Mycobacterium avium subsp. paratuberculosis
cgcccgcugcggcgc

SEQ ID NO: 822430 - RNA, 19 nt, Mycobacterium avium subsp. paratuberculosis
cgcccgcuggggcgcaccg

SEQ ID NO: 822431 - RNA, 21 nt, Mycobacterium avium subsp. paratuberculosis
cgcccgcuggggcgcaccgcc

SEQ ID NO: 822432 - RNA, 18 nt, Mycobacterium avium subsp. paratuberculosis
cgcccgcugaccgccgcg

SEQ ID NO: 822433 - RNA, 16 nt, Mycobacterium avium subsp. paratuberculosis
cgcccgcugcgcgggu

SEQ ID NO: 822434 - RNA, 17 nt, Mycobacterium avium subsp. paratuberculosis
cgcccgcugcgcggguc

SEQ ID NO: 822435 - RNA, 14 nt, Mycobacterium avium subsp. paratuberculosis
cgcccgcuccgcgg

SEQ ID NO: 822436 - RNA, 17 nt, Mycobacterium avium subsp. paratuberculosis
cgcccgcuccgcgggca

SEQ ID NO: 822437 - RNA, 15 nt, Mycobacterium avium subsp. paratuberculosis
cgcccgcuccggcgg

SEQ ID NO: 822438 - RNA, 17 nt, Mycobacterium avium subsp. paratuberculosis
cgcccgcuccggcggac

SEQ ID NO: 822439 - RNA, 22 nt, Mycobacterium avium subsp. paratuberculosis
cgcccgcuccugcaggccgagc

SEQ ID NO: 822440 - RNA, 23 nt, Mycobacterium avium subsp. paratuberculosis
cgcccgcuccugcaggccgagcc

SEQ ID NO: 822441 - RNA, 16 nt, Mycobacterium avium subsp. paratuberculosis
cgcccgcucgacggcc

SEQ ID NO: 822442 - RNA, 16 nt, Mycobacterium avium subsp. paratuberculosis
cgcccggcggcgcugc

SEQ ID NO: 822443 - RNA, 16 nt, Mycobacterium avium subsp. paratuberculosis
cgcccggcgggccacg

SEQ ID NO: 822444 - RNA, 12 nt, Mycobacterium avium subsp. paratuberculosis
cgcccggcggcg

SEQ ID NO: 822445 - RNA, 13 nt, Mycobacterium avium subsp. paratuberculosis
cgcccggcggcgc

SEQ ID NO: 822446 - RNA, 14 nt, Mycobacterium avium subsp. paratuberculosis
cgcccggcgcgcag

SEQ ID NO: 822447 - RNA, 17 nt, Mycobacterium avium subsp. paratuberculosis
cgcccggcgcgcagccc

SEQ ID NO: 822448 - RNA, 16 nt, Mycobacterium avium subsp. paratuberculosis
cgcccggcgcgccgca

SEQ ID NO: 822449 - RNA, 12 nt, Mycobacterium avium subsp. paratuberculosis
cgcccggcgcgg

SEQ ID NO: 822450 - RNA, 14 nt, Mycobacterium avium subsp. paratuberculosis
cgcccggcgcggca

SEQ ID NO: 822451 - RNA, 16 nt, Mycobacterium avium subsp. paratuberculosis
cgcccggcgcggcauc

SEQ ID NO: 822452 - RNA, 11 nt, Mycobacterium avium subsp. paratuberculosis
cgcccggcggc

SEQ ID NO: 822453 - RNA, 12 nt, Mycobacterium avium subsp. paratuberculosis
cgcccggcggca

SEQ ID NO: 822454 - RNA, 15 nt, Mycobacterium avium subsp. paratuberculosis
cgcccggcggcaccg

SEQ ID NO: 822455 - RNA, 13 nt, Mycobacterium avium subsp. paratuberculosis
cgcccggcggcca

SEQ ID NO: 822456 - RNA, 16 nt, Mycobacterium avium subsp. paratuberculosis
cgcccggcggccacca

SEQ ID NO: 822457 - RNA, 15 nt, Mycobacterium avium subsp. paratuberculosis
cgcccggcgaccacc

SEQ ID NO: 822458 - RNA, 14 nt, Mycobacterium avium subsp. paratuberculosis
cgcccggcgacgcg

SEQ ID NO: 822459 - RNA, 16 nt, Mycobacterium avium subsp. paratuberculosis
cgcccggcgacgcggc

SEQ ID NO: 822460 - RNA, 17 nt, Mycobacterium avium subsp. paratuberculosis
cgcccggcgacgcggcg

SEQ ID NO: 822461 - RNA, 12 nt, Mycobacterium avium subsp. paratuberculosis
cgcccggcgauc

SEQ ID NO: 822462 - RNA, 19 nt, Mycobacterium avium subsp. paratuberculosis
cgcccggcgcccggcgcgc

SEQ ID NO: 822463 - RNA, 13 nt, Mycobacterium avium subsp. paratuberculosis
cgcccggcgccgg

SEQ ID NO: 822464 - RNA, 17 nt, Mycobacterium avium subsp. paratuberculosis
cgcccggcgccggcccg

SEQ ID NO: 822465 - RNA, 16 nt, Mycobacterium avium subsp. paratuberculosis
cgcccggcgccggccg

SEQ ID NO: 822466 - RNA, 17 nt, Mycobacterium avium subsp. paratuberculosis
cgcccggcgccggccga

SEQ ID NO: 822467 - RNA, 18 nt, Mycobacterium avium subsp. paratuberculosis
cgcccggcgccggcggcc

SEQ ID NO: 822468 - RNA, 11 nt, Mycobacterium avium subsp. paratuberculosis
cgcccggcgcg

SEQ ID NO: 822469 - RNA, 15 nt, Mycobacterium avium subsp. paratuberculosis
cgcccggcccgcaug

SEQ ID NO: 822470 - RNA, 13 nt, Mycobacterium avium subsp. paratuberculosis
cgcccggcccggc

SEQ ID NO: 822471 - RNA, 15 nt, Mycobacterium avium subsp. paratuberculosis
cgcccggcccggcgc

SEQ ID NO: 822472 - RNA, 21 nt, Mycobacterium avium subsp. paratuberculosis
cgcccggcccggcgcggccgg

SEQ ID NO: 822473 - RNA, 12 nt, Mycobacterium avium subsp. paratuberculosis
cgcccggccggu

SEQ ID NO: 822474 - RNA, 13 nt, Mycobacterium avium subsp. paratuberculosis
cgcccggccggug

SEQ ID NO: 822475 - RNA, 20 nt, Mycobacterium avium subsp. paratuberculosis
cgcccggccguaucggccaa

SEQ ID NO: 822476 - RNA, 20 nt, Mycobacterium avium subsp. paratuberculosis
cgcccggccaucugcgcgac

SEQ ID NO: 822477 - RNA, 13 nt, Mycobacterium avium subsp. paratuberculosis
cgcccggcccagc

SEQ ID NO: 822478 - RNA, 17 nt, Mycobacterium avium subsp. paratuberculosis
cgcccggcccagccgcu

SEQ ID NO: 822479 - RNA, 19 nt, Mycobacterium avium subsp. paratuberculosis
cgcccggcccagccgcugc

SEQ ID NO: 822480 - RNA, 18 nt, Mycobacterium avium subsp. paratuberculosis
cgcccaugaacgcgucgc

SEQ ID NO: 822481 - RNA, 20 nt, Mycobacterium avium subsp. paratuberculosis
cgcccaugaacgcgucgccg

SEQ ID NO: 822482 - RNA, 21 nt, Mycobacterium avium subsp. paratuberculosis
cgcccaugaacgcgucgccgu

SEQ ID NO: 822483 - RNA, 15 nt, Mycobacterium avium subsp. paratuberculosis
cgcccaucgcggccg

SEQ ID NO: 822484 - RNA, 16 nt, Mycobacterium avium subsp. paratuberculosis
cgcccaucgcggccgc

SEQ ID NO: 822485 - RNA, 19 nt, Mycobacterium avium subsp. paratuberculosis
cgcccaucgcggccgcccg

SEQ ID NO: 822486 - RNA, 13 nt, Mycobacterium avium subsp. paratuberculosis
cgcccaugcacga

SEQ ID NO: 822487 - RNA, 18 nt, Mycobacterium avium subsp. paratuberculosis
cgcccaugcacgaucucc

SEQ ID NO: 822488 - RNA, 23 nt, Mycobacterium avium subsp. paratuberculosis
cgcccaugcccaugucgaucggc

SEQ ID NO: 822489 - RNA, 18 nt, Mycobacterium avium subsp. paratuberculosis
cgcccaguugcacggugu

SEQ ID NO: 822490 - RNA, 20 nt, Mycobacterium avium subsp. paratuberculosis
cgcccaguugcacgguguag

SEQ ID NO: 822491 - RNA, 15 nt, Mycobacterium avium subsp. paratuberculosis
cgcccaucaccagca

SEQ ID NO: 822492 - RNA, 20 nt, Mycobacterium avium subsp. paratuberculosis
cgcccaucaccagcagaccc

SEQ ID NO: 822493 - RNA, 14 nt, Mycobacterium avium subsp. paratuberculosis
cgcccaucaccgca

SEQ ID NO: 822494 - RNA, 13 nt, Mycobacterium avium subsp. paratuberculosis
cgcccaucagcag

SEQ ID NO: 822495 - RNA, 15 nt, Mycobacterium avium subsp. paratuberculosis
cgcccauccggcgcc

SEQ ID NO: 822496 - RNA, 15 nt, Mycobacterium avium subsp. paratuberculosis
cgcccaucgaccgga

SEQ ID NO: 822497 - RNA, 14 nt, Mycobacterium avium subsp. paratuberculosis
cgcccagucgccgc

SEQ ID NO: 822498 - RNA, 15 nt, Mycobacterium avium subsp. paratuberculosis
cgcccagucgccgcc

SEQ ID NO: 822499 - RNA, 21 nt, Mycobacterium avium subsp. paratuberculosis
cgcccagucgccgccgcgcac

SEQ ID NO: 822500 - RNA, 18 nt, Mycobacterium avium subsp. paratuberculosis
cgcccagugcgcgccgug

SEQ ID NO: 822501 - RNA, 19 nt, Mycobacterium avium subsp. paratuberculosis
cgcccagugcgcgccgugu

SEQ ID NO: 822502 - RNA, 19 nt, Mycobacterium avium subsp. paratuberculosis
cgcccaggugcacccgaug

SEQ ID NO: 822503 - RNA, 16 nt, Mycobacterium avium subsp. paratuberculosis
cgcccaggcgggccag

SEQ ID NO: 822504 - RNA, 20 nt, Mycobacterium avium subsp. paratuberculosis
cgcccaggcgggccagcucg

SEQ ID NO: 822505 - RNA, 14 nt, Mycobacterium avium subsp. paratuberculosis
cgcccaggcgugcg

SEQ ID NO: 822506 - RNA, 20 nt, Mycobacterium avium subsp. paratuberculosis
cgcccaggcucaggaucagc

SEQ ID NO: 822507 - RNA, 17 nt, Mycobacterium avium subsp. paratuberculosis
cgcccaggcugaacacc

SEQ ID NO: 822508 - RNA, 14 nt, Mycobacterium avium subsp. paratuberculosis
cgccccacggcgcg

SEQ ID NO: 822509 - RNA, 23 nt, Mycobacterium avium subsp. paratuberculosis
cgccccacggucuuugccggcca

SEQ ID NO: 822510 - RNA, 22 nt, Mycobacterium avium subsp. paratuberculosis
cgccccagccccucgccgggcg

SEQ ID NO: 822511 - RNA, 12 nt, Mycobacterium avium subsp. paratuberculosis
cgccccagcccg

SEQ ID NO: 822512 - RNA, 14 nt, Mycobacterium avium subsp. paratuberculosis
cgccccagccgacc

SEQ ID NO: 822513 - RNA, 16 nt, Mycobacterium avium subsp. paratuberculosis
cgccccagcuccucgg

SEQ ID NO: 822514 - RNA, 21 nt, Mycobacterium avium subsp. paratuberculosis
cgccccagcacgaucccgccg

SEQ ID NO: 822515 - RNA, 12 nt, Mycobacterium avium subsp. paratuberculosis
cgccccaggcgc

SEQ ID NO: 822516 - RNA, 17 nt, Mycobacterium avium subsp. paratuberculosis
cgcccauuugccggugu

SEQ ID NO: 822517 - RNA, 23 nt, Mycobacterium avium subsp. paratuberculosis
cgccccagacguuuccguccggc

SEQ ID NO: 822518 - RNA, 19 nt, Mycobacterium avium subsp. paratuberculosis
cgccccaguuggcgucguc

SEQ ID NO: 822519 - RNA, 21 nt, Mycobacterium avium subsp. paratuberculosis
cgccccaguuggcgucgucgg

SEQ ID NO: 822520 - RNA, 23 nt, Mycobacterium avium subsp. paratuberculosis
cgccccaguuggcgucgucggcg

SEQ ID NO: 822521 - RNA, 24 nt, Mycobacterium avium subsp. paratuberculosis
cgccccaguuggcgucgucggcgg

SEQ ID NO: 822522 - RNA, 17 nt, Mycobacterium avium subsp. paratuberculosis
cgccccaggcgcccugc

SEQ ID NO: 822523 - RNA, 15 nt, Mycobacterium avium subsp. paratuberculosis
cgccccagggccucg

SEQ ID NO: 822524 - RNA, 18 nt, Mycobacterium avium subsp. paratuberculosis
cgccccauugccgcgccg

SEQ ID NO: 822525 - RNA, 20 nt, Mycobacterium avium subsp. paratuberculosis
cgccccauugccgcgccggg

SEQ ID NO: 822526 - RNA, 23 nt, Mycobacterium avium subsp. paratuberculosis
cgccccauugccgcgccggggug

SEQ ID NO: 822527 - RNA, 20 nt, Mycobacterium avium subsp. paratuberculosis
cgccccagguuccggugucg

SEQ ID NO: 822528 - RNA, 20 nt, Mycobacterium avium subsp. paratuberculosis
cgcccccgaggagacgucgg

SEQ ID NO: 822529 - RNA, 17 nt, Mycobacterium avium subsp. paratuberculosis
cgccccggcgggcggcc

SEQ ID NO: 822530 - RNA, 13 nt, Mycobacterium avium subsp. paratuberculosis
cgccccggcgggu

SEQ ID NO: 822531 - RNA, 12 nt, Mycobacterium avium subsp. paratuberculosis
cgccccggcguc

SEQ ID NO: 822532 - RNA, 23 nt, Mycobacterium avium subsp. paratuberculosis
cgccccggucaccccggccauca

SEQ ID NO: 822533 - RNA, 15 nt, Mycobacterium avium subsp. paratuberculosis
cgccccgguccggcu

SEQ ID NO: 822534 - RNA, 14 nt, Mycobacterium avium subsp. paratuberculosis
cgcccggcuccacg

SEQ ID NO: 822535 - RNA, 14 nt, Mycobacterium avium subsp. paratuberculosis
cgcccggcguccag

SEQ ID NO: 822536 - RNA, 18 nt, Mycobacterium avium subsp. paratuberculosis
cgcccggcuccccgacca

SEQ ID NO: 822537 - RNA, 19 nt, Mycobacterium avium subsp. paratuberculosis
cgcccggcuccccgaccac

SEQ ID NO: 822538 - RNA, 20 nt, Mycobacterium avium subsp. paratuberculosis
cgcccggggcgcggaccgca

SEQ ID NO: 822539 - RNA, 23 nt, Mycobacterium avium subsp. paratuberculosis
cgcccggggcgcggaccgcaccc

SEQ ID NO: 822540 - RNA, 19 nt, Mycobacterium avium subsp. paratuberculosis
cgcccggggcggcgaugcg

SEQ ID NO: 822541 - RNA, 16 nt, Mycobacterium avium subsp. paratuberculosis
cgcccgggucgucggu

SEQ ID NO: 822542 - RNA, 20 nt, Mycobacterium avium subsp. paratuberculosis
cgcccgggugacaacggugg

SEQ ID NO: 822543 - RNA, 23 nt, Mycobacterium avium subsp. paratuberculosis
cgcccgggugacaacgguggugg

SEQ ID NO: 822544 - RNA, 17 nt, Mycobacterium avium subsp. paratuberculosis
cgcccgggugcaggccc

SEQ ID NO: 822545 - RNA, 23 nt, Mycobacterium avium subsp. paratuberculosis
cgcccgggugcgcuugucggcgu

SEQ ID NO: 822546 - RNA, 21 nt, Mycobacterium avium subsp. paratuberculosis
cgcccgggugugggcgccguc

SEQ ID NO: 822547 - RNA, 22 nt, Mycobacterium avium subsp. paratuberculosis
cgcccgggugugggcgccguca

SEQ ID NO: 822548 - RNA, 21 nt, Mycobacterium avium subsp. paratuberculosis
cgcccggguugcacaggucga

SEQ ID NO: 822549 - RNA, 20 nt, Mycobacterium avium subsp. paratuberculosis
cgcccggguugucgacgugg

SEQ ID NO: 822550 - RNA, 21 nt, Mycobacterium avium subsp. paratuberculosis
cgcccggguugucgacguggu

SEQ ID NO: 822551 - RNA, 15 nt, Mycobacterium avium subsp. paratuberculosis
cgcccggguagggca

SEQ ID NO: 822552 - RNA, 21 nt, Mycobacterium avium subsp. paratuberculosis
cgcccggguagggcagccaca

SEQ ID NO: 822553 - RNA, 17 nt, Mycobacterium avium subsp. paratuberculosis
cgcccgguaggccgccg

SEQ ID NO: 822554 - RNA, 19 nt, Mycobacterium avium subsp. paratuberculosis
cgcccgguaggccgccgcg

SEQ ID NO: 822555 - RNA, 20 nt, Mycobacterium avium subsp. paratuberculosis
cgcccgguaggccgccgcga

SEQ ID NO: 822556 - RNA, 22 nt, Mycobacterium avium subsp. paratuberculosis
cgcccugcgaauacccgcccag

SEQ ID NO: 822557 - RNA, 14 nt, Mycobacterium avium subsp. paratuberculosis
cgcccugcgagccc

SEQ ID NO: 822558 - RNA, 20 nt, Mycobacterium avium subsp. paratuberculosis
cgcccugcccgucgggcgcg

SEQ ID NO: 822559 - RNA, 16 nt, Mycobacterium avium subsp. paratuberculosis
cgcccggugcgccagc

SEQ ID NO: 822560 - RNA, 19 nt, Mycobacterium avium subsp. paratuberculosis
cgcccggugcgccagcgug

SEQ ID NO: 822561 - RNA, 21 nt, Mycobacterium avium subsp. paratuberculosis
cgcccggucaggaacccggcc

SEQ ID NO: 822562 - RNA, 23 nt, Mycobacterium avium subsp. paratuberculosis
cgcccggucaggaacccggcccg

SEQ ID NO: 822563 - RNA, 16 nt, Mycobacterium avium subsp. paratuberculosis
cgcccgguccgggucg

SEQ ID NO: 822564 - RNA, 16 nt, Mycobacterium avium subsp. paratuberculosis
cgcccggucgaccagg

SEQ ID NO: 822565 - RNA, 14 nt, Mycobacterium avium subsp. paratuberculosis
cgcccuggaucgcg

SEQ ID NO: 822566 - RNA, 15 nt, Mycobacterium avium subsp. paratuberculosis
cgcccuggcauccgu

SEQ ID NO: 822567 - RNA, 19 nt, Mycobacterium avium subsp. paratuberculosis
cgcccugcugggagcggcc

SEQ ID NO: 822568 - RNA, 20 nt, Mycobacterium avium subsp. paratuberculosis
cgcccugcuugaacagcacc

SEQ ID NO: 822569 - RNA, 14 nt, Mycobacterium avium subsp. paratuberculosis
cgcccuggaaggcg

SEQ ID NO: 822570 - RNA, 18 nt, Mycobacterium avium subsp. paratuberculosis
cgcccuggaaggcgauca

SEQ ID NO: 822571 - RNA, 14 nt, Mycobacterium avium subsp. paratuberculosis
cgcccuugagcacg

SEQ ID NO: 822572 - RNA, 22 nt, Mycobacterium avium subsp. paratuberculosis
cgcccuugagcacggugaucag

SEQ ID NO: 822573 - RNA, 17 nt, Mycobacterium avium subsp. paratuberculosis
cgcccuugagcucggcc

SEQ ID NO: 822574 - RNA, 15 nt, Mycobacterium avium subsp. paratuberculosis
cgcccuugccgaugc

SEQ ID NO: 822575 - RNA, 21 nt, Mycobacterium avium subsp. paratuberculosis
cgcccuuccagcaccccgucg

SEQ ID NO: 822576 - RNA, 13 nt, Mycobacterium avium subsp. paratuberculosis
cgcccuucggcgc

SEQ ID NO: 822577 - RNA, 23 nt, Mycobacterium avium subsp. paratuberculosis
cgcccuucggcgcccgcuccggc

SEQ ID NO: 822578 - RNA, 17 nt, Mycobacterium avium subsp. paratuberculosis
cgcccuugaacggcacc

SEQ ID NO: 822579 - RNA, 21 nt, Mycobacterium avium subsp. paratuberculosis
cgccgaaagccuccgcgauca

SEQ ID NO: 822580 - RNA, 23 nt, Mycobacterium avium subsp. paratuberculosis
cgccgaaagccuccgcgaucagc

SEQ ID NO: 822581 - RNA, 22 nt, Mycobacterium avium subsp. paratuberculosis
cgccgaaagguuuucccggccg

SEQ ID NO: 822582 - RNA, 15 nt, Mycobacterium avium subsp. paratuberculosis
cgccgaaacccgcug

SEQ ID NO: 822583 - RNA, 16 nt, Mycobacterium avium subsp. paratuberculosis
cgccgaacaacggcgg

SEQ ID NO: 822584 - RNA, 22 nt, Mycobacterium avium subsp. paratuberculosis
cgccgaacaacggcggaccggc

SEQ ID NO: 822585 - RNA, 22 nt, Mycobacterium avium subsp. paratuberculosis
cgccgaaaugccgugccagccg

SEQ ID NO: 822586 - RNA, 19 nt, Mycobacterium avium subsp. paratuberculosis
cgccgaacaccacgccgag

SEQ ID NO: 822587 - RNA, 15 nt, Mycobacterium avium subsp. paratuberculosis
cgccgaacaccggca

SEQ ID NO: 822588 - RNA, 16 nt, Mycobacterium avium subsp. paratuberculosis
cgccgaacaccggcag

SEQ ID NO: 822589 - RNA, 17 nt, Mycobacterium avium subsp. paratuberculosis
cgccgaacaccggcagc

SEQ ID NO: 822590 - RNA, 18 nt, Mycobacterium avium subsp. paratuberculosis
cgcccuugcucgcggcgu

SEQ ID NO: 822591 - RNA, 12 nt, Mycobacterium avium subsp. paratuberculosis
cgcccuuguuga

SEQ ID NO: 822592 - RNA, 16 nt, Mycobacterium avium subsp. paratuberculosis
cgcccuugcucgcggc

SEQ ID NO: 822593 - RNA, 15 nt, Mycobacterium avium subsp. paratuberculosis
cgcccuuggccgcgg

SEQ ID NO: 822594 - RNA, 18 nt, Mycobacterium avium subsp. paratuberculosis
cgccgaaaaacgcgacgg

SEQ ID NO: 822595 - RNA, 20 nt, Mycobacterium avium subsp. paratuberculosis
cgccgaaaaacgcgacggcc

SEQ ID NO: 822596 - RNA, 21 nt, Mycobacterium avium subsp. paratuberculosis
cgccgaaaaacgcgacggccc

SEQ ID NO: 822597 - RNA, 14 nt, Mycobacterium avium subsp. paratuberculosis
cgccgaagaucagc

SEQ ID NO: 822598 - RNA, 15 nt, Mycobacterium avium subsp. paratuberculosis
cgccgaagaucagcg

SEQ ID NO: 822599 - RNA, 18 nt, Mycobacterium avium subsp. paratuberculosis
cgccgaagaucagcgcgu

SEQ ID NO: 822600 - RNA, 20 nt, Mycobacterium avium subsp. paratuberculosis
cgccgaagauggccagcgcg

SEQ ID NO: 822601 - RNA, 22 nt, Mycobacterium avium subsp. paratuberculosis
cgccgaagauggccagcgcggc

SEQ ID NO: 822602 - RNA, 16 nt, Mycobacterium avium subsp. paratuberculosis
cgccgaagcccgacau

SEQ ID NO: 822603 - RNA, 15 nt, Mycobacterium avium subsp. paratuberculosis
cgccgaagcccgcag

SEQ ID NO: 822604 - RNA, 16 nt, Mycobacterium avium subsp. paratuberculosis
cgccgaagcccgcagc

SEQ ID NO: 822605 - RNA, 16 nt, Mycobacterium avium subsp. paratuberculosis
cgccgaagccggcucg

SEQ ID NO: 822606 - RNA, 20 nt, Mycobacterium avium subsp. paratuberculosis
cgccgaagccggcucgaaau

SEQ ID NO: 822607 - RNA, 14 nt, Mycobacterium avium subsp. paratuberculosis
cgccgaagccgucg

SEQ ID NO: 822608 - RNA, 15 nt, Mycobacterium avium subsp. paratuberculosis
cgccgaagccgucga

SEQ ID NO: 822609 - RNA, 17 nt, Mycobacterium avium subsp. paratuberculosis
cgccgaagccgucgacc

SEQ ID NO: 822610 - RNA, 23 nt, Mycobacterium avium subsp. paratuberculosis
cgccgacaccaccacgaacuggg

SEQ ID NO: 822611 - RNA, 14 nt, Mycobacterium avium subsp. paratuberculosis
cgccgacaccaccg

SEQ ID NO: 822612 - RNA, 16 nt, Mycobacterium avium subsp. paratuberculosis
cgccgacaccagcgcg

SEQ ID NO: 822613 - RNA, 15 nt, Mycobacterium avium subsp. paratuberculosis
cgccgacaccagggu

SEQ ID NO: 822614 - RNA, 16 nt, Mycobacterium avium subsp. paratuberculosis
cgccgacaccagggug

SEQ ID NO: 822615 - RNA, 15 nt, Mycobacterium avium subsp. paratuberculosis
cgccgaaggccgggu

SEQ ID NO: 822616 - RNA, 16 nt, Mycobacterium avium subsp. paratuberculosis
cgccgaaggccggguc

SEQ ID NO: 822617 - RNA, 17 nt, Mycobacterium avium subsp. paratuberculosis
cgccgaaggccgggucg

SEQ ID NO: 822618 - RNA, 16 nt, Mycobacterium avium subsp. paratuberculosis
cgccgaauuguucggc

SEQ ID NO: 822619 - RNA, 18 nt, Mycobacterium avium subsp. paratuberculosis
cgccgaauuguucggcca

SEQ ID NO: 822620 - RNA, 19 nt, Mycobacterium avium subsp. paratuberculosis
cgccgaauuguucggccac

SEQ ID NO: 822621 - RNA, 21 nt, Mycobacterium avium subsp. paratuberculosis
cgccgaauuguucggccaccg

SEQ ID NO: 822622 - RNA, 22 nt, Mycobacterium avium subsp. paratuberculosis
cgccgaauuguucggccaccgc

SEQ ID NO: 822623 - RNA, 15 nt, Mycobacterium avium subsp. paratuberculosis
cgccgacgccgucga

SEQ ID NO: 822624 - RNA, 17 nt, Mycobacterium avium subsp. paratuberculosis
cgccgacgccugcgcga

SEQ ID NO: 822625 - RNA, 21 nt, Mycobacterium avium subsp. paratuberculosis
cgccgacgcgcugcgcgccgc

SEQ ID NO: 822626 - RNA, 14 nt, Mycobacterium avium subsp. paratuberculosis
cgccgacgccagca

SEQ ID NO: 822627 - RNA, 16 nt, Mycobacterium avium subsp. paratuberculosis
cgccgacgcccaggcu

SEQ ID NO: 822628 - RNA, 17 nt, Mycobacterium avium subsp. paratuberculosis
cgccgacgcccaggcuc

SEQ ID NO: 822629 - RNA, 18 nt, Mycobacterium avium subsp. paratuberculosis
cgccgacgcccacagcgc

SEQ ID NO: 822630 - RNA, 22 nt, Mycobacterium avium subsp. paratuberculosis
cgccgacgcccacagcgccagc

SEQ ID NO: 822631 - RNA, 17 nt, Mycobacterium avium subsp. paratuberculosis
cgccgacgcccagcgcg

SEQ ID NO: 822632 - RNA, 14 nt, Mycobacterium avium subsp. paratuberculosis
cgccgacuuggugc

SEQ ID NO: 822633 - RNA, 22 nt, Mycobacterium avium subsp. paratuberculosis
cgccgacugugcgaugucggug

SEQ ID NO: 822634 - RNA, 16 nt, Mycobacterium avium subsp. paratuberculosis
cgccgacuugaucgcg

SEQ ID NO: 822635 - RNA, 17 nt, Mycobacterium avium subsp. paratuberculosis
cgccgacuugaucgcgg

SEQ ID NO: 822636 - RNA, 19 nt, Mycobacterium avium subsp. paratuberculosis
cgccgacuugaucgcggcg

SEQ ID NO: 822637 - RNA, 20 nt, Mycobacterium avium subsp. paratuberculosis
cgccgacuugaucgcggcgu

SEQ ID NO: 822638 - RNA, 21 nt, Mycobacterium avium subsp. paratuberculosis
cgccgacuugaucgcggcgua

SEQ ID NO: 822639 - RNA, 15 nt, Mycobacterium avium subsp. paratuberculosis
cgccgacggccagca

SEQ ID NO: 822640 - RNA, 16 nt, Mycobacterium avium subsp. paratuberculosis
cgccgacggagacgac

SEQ ID NO: 822641 - RNA, 16 nt, Mycobacterium avium subsp. paratuberculosis
cgccgacggccagcag

SEQ ID NO: 822642 - RNA, 14 nt, Mycobacterium avium subsp. paratuberculosis
cgccgacggccgcg

SEQ ID NO: 822643 - RNA, 15 nt, Mycobacterium avium subsp. paratuberculosis
cgccgaccgguccgc

SEQ ID NO: 822644 - RNA, 17 nt, Mycobacterium avium subsp. paratuberculosis
cgccgaccgguccgccg

SEQ ID NO: 822645 - RNA, 18 nt, Mycobacterium avium subsp. paratuberculosis
cgccgaccgguccgccgc

SEQ ID NO: 822646 - RNA, 15 nt, Mycobacterium avium subsp. paratuberculosis
cgccgacgauccgcg

SEQ ID NO: 822647 - RNA, 16 nt, Mycobacterium avium subsp. paratuberculosis
cgccgacgauccgcgc

SEQ ID NO: 822648 - RNA, 22 nt, Mycobacterium avium subsp. paratuberculosis
cgccgacgauccgcgcccuggu

SEQ ID NO: 822649 - RNA, 21 nt, Mycobacterium avium subsp. paratuberculosis
cgccgacgauccgcgccgcga

SEQ ID NO: 822650 - RNA, 18 nt, Mycobacterium avium subsp. paratuberculosis
cgccgaccgcggucgcgg

SEQ ID NO: 822651 - RNA, 20 nt, Mycobacterium avium subsp. paratuberculosis
cgccgaccgcggucgcggcg

SEQ ID NO: 822652 - RNA, 22 nt, Mycobacterium avium subsp. paratuberculosis
cgccgacccccgccgcgucggu

SEQ ID NO: 822653 - RNA, 13 nt, Mycobacterium avium subsp. paratuberculosis
cgccgaccgcccg

SEQ ID NO: 822654 - RNA, 14 nt, Mycobacterium avium subsp. paratuberculosis
cgccgaccgcccgc

SEQ ID NO: 822655 - RNA, 15 nt, Mycobacterium avium subsp. paratuberculosis
cgccgaccgcccgcu

SEQ ID NO: 822656 - RNA, 13 nt, Mycobacterium avium subsp. paratuberculosis
cgccgaccgccga

SEQ ID NO: 822657 - RNA, 16 nt, Mycobacterium avium subsp. paratuberculosis
cgccgaccgccgagcg

SEQ ID NO: 822658 - RNA, 18 nt, Mycobacterium avium subsp. paratuberculosis
cgccgaccgccgagcggg

SEQ ID NO: 822659 - RNA, 13 nt, Mycobacterium avium subsp. paratuberculosis
cgccgaccgcgag

SEQ ID NO: 822660 - RNA, 14 nt, Mycobacterium avium subsp. paratuberculosis
cgccgaccgcgagc

SEQ ID NO: 822661 - RNA, 15 nt, Mycobacterium avium subsp. paratuberculosis
cgccgaccgcgagca

SEQ ID NO: 822662 - RNA, 14 nt, Mycobacterium avium subsp. paratuberculosis
cgccgaccgcgauc

SEQ ID NO: 822663 - RNA, 16 nt, Mycobacterium avium subsp. paratuberculosis
cgccgacagaugcggc

SEQ ID NO: 822664 - RNA, 22 nt, Mycobacterium avium subsp. paratuberculosis
cgccgacagaugcggcaccagc

SEQ ID NO: 822665 - RNA, 17 nt, Mycobacterium avium subsp. paratuberculosis
cgccgacagcgacaauc

SEQ ID NO: 822666 - RNA, 16 nt, Mycobacterium avium subsp. paratuberculosis
cgccgacagcgggaug

SEQ ID NO: 822667 - RNA, 20 nt, Mycobacterium avium subsp. paratuberculosis
cgccgacagcgucguccaug

SEQ ID NO: 822668 - RNA, 24 nt, Mycobacterium avium subsp. paratuberculosis
cgccgacagcgucguccaugcccg

SEQ ID NO: 822669 - RNA, 14 nt, Mycobacterium avium subsp. paratuberculosis
cgccgacagcagcu

SEQ ID NO: 822670 - RNA, 15 nt, Mycobacterium avium subsp. paratuberculosis
cgccgacagcaccuc

SEQ ID NO: 822671 - RNA, 14 nt, Mycobacterium avium subsp. paratuberculosis
cgccgacccgcccg

SEQ ID NO: 822672 - RNA, 15 nt, Mycobacterium avium subsp. paratuberculosis
cgccgacccgcccgc

SEQ ID NO: 822673 - RNA, 16 nt, Mycobacterium avium subsp. paratuberculosis
cgccgacccgcccgcc

SEQ ID NO: 822674 - RNA, 17 nt, Mycobacterium avium subsp. paratuberculosis
cgccgacccgcccgccg

SEQ ID NO: 822675 - RNA, 18 nt, Mycobacterium avium subsp. paratuberculosis
cgccgacccgcccgccgg

SEQ ID NO: 822676 - RNA, 19 nt, Mycobacterium avium subsp. paratuberculosis
cgccgacccgcccgccggg

SEQ ID NO: 822677 - RNA, 13 nt, Mycobacterium avium subsp. paratuberculosis
cgccgagccgucg

SEQ ID NO: 822678 - RNA, 16 nt, Mycobacterium avium subsp. paratuberculosis
cgccgagccgucgucg

SEQ ID NO: 822679 - RNA, 20 nt, Mycobacterium avium subsp. paratuberculosis
cgccgagccgucgucgcugc

SEQ ID NO: 822680 - RNA, 16 nt, Mycobacterium avium subsp. paratuberculosis
cgccgaggacacguug

SEQ ID NO: 822681 - RNA, 17 nt, Mycobacterium avium subsp. paratuberculosis
cgccgaggaggccgcgg

SEQ ID NO: 822682 - RNA, 18 nt, Mycobacterium avium subsp. paratuberculosis
cgccgaggaggccgcggc

SEQ ID NO: 822683 - RNA, 19 nt, Mycobacterium avium subsp. paratuberculosis
cgccgaggaggccgcggcg

SEQ ID NO: 822684 - RNA, 20 nt, Mycobacterium avium subsp. paratuberculosis
cgccgaggaggccgcggcga

SEQ ID NO: 822685 - RNA, 22 nt, Mycobacterium avium subsp. paratuberculosis
cgccgaggaggccgcggcgaca

SEQ ID NO: 822686 - RNA, 20 nt, Mycobacterium avium subsp. paratuberculosis
cgccgaggaucuugaucgcg

SEQ ID NO: 822687 - RNA, 15 nt, Mycobacterium avium subsp. paratuberculosis
cgccgaggccagcac

SEQ ID NO: 822688 - RNA, 16 nt, Mycobacterium avium subsp. paratuberculosis
cgccgaggccagcacg

SEQ ID NO: 822689 - RNA, 17 nt, Mycobacterium avium subsp. paratuberculosis
cgccgaggccagcacgc

SEQ ID NO: 822690 - RNA, 19 nt, Mycobacterium avium subsp. paratuberculosis
cgccgaggccagcacgccg

SEQ ID NO: 822691 - RNA, 20 nt, Mycobacterium avium subsp. paratuberculosis
cgccgaggccagcacgccgg

SEQ ID NO: 822692 - RNA, 22 nt, Mycobacterium avium subsp. paratuberculosis
cgccgaggccagcacgccgguc

SEQ ID NO: 822693 - RNA, 23 nt, Mycobacterium avium subsp. paratuberculosis
cgccgaggccagcacgccgguca

SEQ ID NO: 822694 - RNA, 14 nt, Mycobacterium avium subsp. paratuberculosis
cgccgaucaccggc

SEQ ID NO: 822695 - RNA, 15 nt, Mycobacterium avium subsp. paratuberculosis
cgccgaucaccggca

SEQ ID NO: 822696 - RNA, 17 nt, Mycobacterium avium subsp. paratuberculosis
cgccgaucaccggcacg

SEQ ID NO: 822697 - RNA, 15 nt, Mycobacterium avium subsp. paratuberculosis
cgccgaucaccugac

SEQ ID NO: 822698 - RNA, 21 nt, Mycobacterium avium subsp. paratuberculosis
cgccgaucaccugacagaccc

SEQ ID NO: 822699 - RNA, 15 nt, Mycobacterium avium subsp. paratuberculosis
cgccgaucacgaaca

SEQ ID NO: 822700 - RNA, 15 nt, Mycobacterium avium subsp. paratuberculosis
cgccgaucacgccgg

SEQ ID NO: 822701 - RNA, 16 nt, Mycobacterium avium subsp. paratuberculosis
cgccgaggcgcucggc

SEQ ID NO: 822702 - RNA, 20 nt, Mycobacterium avium subsp. paratuberculosis
cgccgaggcgcucggcccgc

SEQ ID NO: 822703 - RNA, 15 nt, Mycobacterium avium subsp. paratuberculosis
cgccgagccggcacg

SEQ ID NO: 822704 - RNA, 17 nt, Mycobacterium avium subsp. paratuberculosis
cgccgagccggcacggc

SEQ ID NO: 822705 - RNA, 19 nt, Mycobacterium avium subsp. paratuberculosis
cgccgagccggcacggccg

SEQ ID NO: 822706 - RNA, 20 nt, Mycobacterium avium subsp. paratuberculosis
cgccgagccggcacggccgg

SEQ ID NO: 822707 - RNA, 14 nt, Mycobacterium avium subsp. paratuberculosis
cgccgagccgaggc

SEQ ID NO: 822708 - RNA, 16 nt, Mycobacterium avium subsp. paratuberculosis
cgccgagccgaggcag

SEQ ID NO: 822709 - RNA, 14 nt, Mycobacterium avium subsp. paratuberculosis
cgccgagccgcacc

SEQ ID NO: 822710 - RNA, 15 nt, Mycobacterium avium subsp. paratuberculosis
cgccgagccgcaccg

SEQ ID NO: 822711 - RNA, 18 nt, Mycobacterium avium subsp. paratuberculosis
cgccgagccgcaccgccu

SEQ ID NO: 822712 - RNA, 22 nt, Mycobacterium avium subsp. paratuberculosis
cgccgagccgcgccacgcgcag

SEQ ID NO: 822713 - RNA, 16 nt, Mycobacterium avium subsp. paratuberculosis
cgccgagccgcgggug

SEQ ID NO: 822714 - RNA, 21 nt, Mycobacterium avium subsp. paratuberculosis
cgccgagccgcuccaccgcgu

SEQ ID NO: 822715 - RNA, 18 nt, Mycobacterium avium subsp. paratuberculosis
cgccgagcagaucacguu

SEQ ID NO: 822716 - RNA, 20 nt, Mycobacterium avium subsp. paratuberculosis
cgccgagcagaucacguuga

SEQ ID NO: 822717 - RNA, 15 nt, Mycobacterium avium subsp. paratuberculosis
cgccgagcagcaccg

SEQ ID NO: 822718 - RNA, 18 nt, Mycobacterium avium subsp. paratuberculosis
cgccgagcagcucagccg

SEQ ID NO: 822719 - RNA, 16 nt, Mycobacterium avium subsp. paratuberculosis
cgccgagcagaucggg

SEQ ID NO: 822720 - RNA, 15 nt, Mycobacterium avium subsp. paratuberculosis
cgccgagaccagcca

SEQ ID NO: 822721 - RNA, 15 nt, Mycobacterium avium subsp. paratuberculosis
cgccgagacggcgug

SEQ ID NO: 822722 - RNA, 16 nt, Mycobacterium avium subsp. paratuberculosis
cgccgagacggcgugg

SEQ ID NO: 822723 - RNA, 14 nt, Mycobacterium avium subsp. paratuberculosis
cgccgagacguggu

SEQ ID NO: 822724 - RNA, 16 nt, Mycobacterium avium subsp. paratuberculosis
cgccgagacguggugg

SEQ ID NO: 822725 - RNA, 20 nt, Mycobacterium avium subsp. paratuberculosis
cgccgagacgugguggugcg

SEQ ID NO: 822726 - RNA, 12 nt, Mycobacterium avium subsp. paratuberculosis
cgccgagagcgc

SEQ ID NO: 822727 - RNA, 15 nt, Mycobacterium avium subsp. paratuberculosis
cgccgagagcgcguc

SEQ ID NO: 822728 - RNA, 17 nt, Mycobacterium avium subsp. paratuberculosis
cgccgagagcgcgucga

SEQ ID NO: 822729 - RNA, 19 nt, Mycobacterium avium subsp. paratuberculosis
cgccgagagcgcgucgacg

SEQ ID NO: 822730 - RNA, 22 nt, Mycobacterium avium subsp. paratuberculosis
cgccgccgagcaacagcccgac

SEQ ID NO: 822731 - RNA, 23 nt, Mycobacterium avium subsp. paratuberculosis
cgccgccgaccacaugccguugc

SEQ ID NO: 822732 - RNA, 17 nt, Mycobacterium avium subsp. paratuberculosis
cgccgccgacagcaccu

SEQ ID NO: 822733 - RNA, 20 nt, Mycobacterium avium subsp. paratuberculosis
cgccgccgagccgcggguga

SEQ ID NO: 822734 - RNA, 17 nt, Mycobacterium avium subsp. paratuberculosis
cgccgccgagcucggcc

SEQ ID NO: 822735 - RNA, 16 nt, Mycobacterium avium subsp. paratuberculosis
cgccgcccugcgggaa

SEQ ID NO: 822736 - RNA, 21 nt, Mycobacterium avium subsp. paratuberculosis
cgccgcccuggccccagaacc

SEQ ID NO: 822737 - RNA, 17 nt, Mycobacterium avium subsp. paratuberculosis
cgccgcccccgccgcga

SEQ ID NO: 822738 - RNA, 15 nt, Mycobacterium avium subsp. paratuberculosis
cgccgcccaucggca

SEQ ID NO: 822739 - RNA, 19 nt, Mycobacterium avium subsp. paratuberculosis
cgccgcccaucggcagccc

SEQ ID NO: 822740 - RNA, 20 nt, Mycobacterium avium subsp. paratuberculosis
cgccgcccaucggcagcccg

SEQ ID NO: 822741 - RNA, 16 nt, Mycobacterium avium subsp. paratuberculosis
cgccgcccucgccgaa

SEQ ID NO: 822742 - RNA, 17 nt, Mycobacterium avium subsp. paratuberculosis
cgccgcccucgccgaac

SEQ ID NO: 822743 - RNA, 17 nt, Mycobacterium avium subsp. paratuberculosis
cgccgcccucggugacg

SEQ ID NO: 822744 - RNA, 23 nt, Mycobacterium avium subsp. paratuberculosis
cgccgcccucggugacgaacuca

SEQ ID NO: 822745 - RNA, 18 nt, Mycobacterium avium subsp. paratuberculosis
cgccgcccccgcggcguc

SEQ ID NO: 822746 - RNA, 19 nt, Mycobacterium avium subsp. paratuberculosis
cgccgcccccgcggcgucc

SEQ ID NO: 822747 - RNA, 14 nt, Mycobacterium avium subsp. paratuberculosis
cgccgccgcgucgc

SEQ ID NO: 822748 - RNA, 14 nt, Mycobacterium avium subsp. paratuberculosis
cgccgccgcgaacu

SEQ ID NO: 822749 - RNA, 14 nt, Mycobacterium avium subsp. paratuberculosis
cgccgccgcgacca

SEQ ID NO: 822750 - RNA, 15 nt, Mycobacterium avium subsp. paratuberculosis
cgccgccgccagcac

SEQ ID NO: 822751 - RNA, 16 nt, Mycobacterium avium subsp. paratuberculosis
cgccgccgccagcacc

SEQ ID NO: 822752 - RNA, 17 nt, Mycobacterium avium subsp. paratuberculosis
cgccgccgccagcacca

SEQ ID NO: 822753 - RNA, 14 nt, Mycobacterium avium subsp. paratuberculosis
cgccgccgccgccc

SEQ ID NO: 822754 - RNA, 14 nt, Mycobacterium avium subsp. paratuberculosis
cgccgccgccagcc

SEQ ID NO: 822755 - RNA, 16 nt, Mycobacterium avium subsp. paratuberculosis
cgccgccgccagccag

SEQ ID NO: 822756 - RNA, 12 nt, Mycobacterium avium subsp. paratuberculosis
cgccgccgccag

SEQ ID NO: 822757 - RNA, 24 nt, Mycobacterium avium subsp. paratuberculosis
cgccgccgaucuugagccggaugc

SEQ ID NO: 822758 - RNA, 12 nt, Mycobacterium avium subsp. paratuberculosis
cgccgccgcacc

SEQ ID NO: 822759 - RNA, 13 nt, Mycobacterium avium subsp. paratuberculosis
cgccgccgcaccg

SEQ ID NO: 822760 - RNA, 14 nt, Mycobacterium avium subsp. paratuberculosis
cgccgccgcaccgg

SEQ ID NO: 822761 - RNA, 18 nt, Mycobacterium avium subsp. paratuberculosis
cgccgcagcccaggccca

SEQ ID NO: 822762 - RNA, 22 nt, Mycobacterium avium subsp. paratuberculosis
cgccgcagcccaggcccagcag

SEQ ID NO: 822763 - RNA, 23 nt, Mycobacterium avium subsp. paratuberculosis
cgccgcagcccaggcccagcagc

SEQ ID NO: 822764 - RNA, 16 nt, Mycobacterium avium subsp. paratuberculosis
cgccgcagcccgccag

SEQ ID NO: 822765 - RNA, 18 nt, Mycobacterium avium subsp. paratuberculosis
cgccgcagaucagggcga

SEQ ID NO: 822766 - RNA, 21 nt, Mycobacterium avium subsp. paratuberculosis
cgccgcagaucagggcgaugg

SEQ ID NO: 822767 - RNA, 16 nt, Mycobacterium avium subsp. paratuberculosis
cgccgcagcacgcuga

SEQ ID NO: 822768 - RNA, 21 nt, Mycobacterium avium subsp. paratuberculosis
cgccgcagcacgcugaagccc

SEQ ID NO: 822769 - RNA, 23 nt, Mycobacterium avium subsp. paratuberculosis
cgccgcagcaggugcaucgccac

SEQ ID NO: 822770 - RNA, 12 nt, Mycobacterium avium subsp. paratuberculosis
cgccgcagcgca

SEQ ID NO: 822771 - RNA, 23 nt, Mycobacterium avium subsp. paratuberculosis
cgccgcagcgcagcgucggcgug

SEQ ID NO: 822772 - RNA, 13 nt, Mycobacterium avium subsp. paratuberculosis
cgccgcagcgcgc

SEQ ID NO: 822773 - RNA, 16 nt, Mycobacterium avium subsp. paratuberculosis
cgccgcagcgcgcgcu

SEQ ID NO: 822774 - RNA, 14 nt, Mycobacterium avium subsp. paratuberculosis
cgccgcagcggcgc

SEQ ID NO: 822775 - RNA, 15 nt, Mycobacterium avium subsp. paratuberculosis
cgccgcagcggcgcc

SEQ ID NO: 822776 - RNA, 18 nt, Mycobacterium avium subsp. paratuberculosis
cgccgcagcggcgccgca

SEQ ID NO: 822777 - RNA, 22 nt, Mycobacterium avium subsp. paratuberculosis
cgccgcagcggugaucgcguca

SEQ ID NO: 822778 - RNA, 16 nt, Mycobacterium avium subsp. paratuberculosis
cgccgccagcgcgggg

SEQ ID NO: 822779 - RNA, 13 nt, Mycobacterium avium subsp. paratuberculosis
cgccgccagcgcc

SEQ ID NO: 822780 - RNA, 17 nt, Mycobacterium avium subsp. paratuberculosis
cgccgccagccagccgg

SEQ ID NO: 822781 - RNA, 22 nt, Mycobacterium avium subsp. paratuberculosis
cgccgcaggagaucggcgcgga

SEQ ID NO: 822782 - RNA, 12 nt, Mycobacterium avium subsp. paratuberculosis
cgccgcaggcgu

SEQ ID NO: 822783 - RNA, 16 nt, Mycobacterium avium subsp. paratuberculosis
cgccgccagcgccacc

SEQ ID NO: 822784 - RNA, 14 nt, Mycobacterium avium subsp. paratuberculosis
cgccgccagggcgc

SEQ ID NO: 822785 - RNA, 17 nt, Mycobacterium avium subsp. paratuberculosis
cgccgcccacgccgugc

SEQ ID NO: 822786 - RNA, 18 nt, Mycobacterium avium subsp. paratuberculosis
cgccgcccagcggccccg

SEQ ID NO: 822787 - RNA, 15 nt, Mycobacterium avium subsp. paratuberculosis
cgccgcccagcggug

SEQ ID NO: 822788 - RNA, 15 nt, Mycobacterium avium subsp. paratuberculosis
cgccgcccaggccga

SEQ ID NO: 822789 - RNA, 19 nt, Mycobacterium avium subsp. paratuberculosis
cgccgcccaggccgagcgc

SEQ ID NO: 822790 - RNA, 23 nt, Mycobacterium avium subsp. paratuberculosis
cgccgcccaccagcacaccggau

SEQ ID NO: 822791 - RNA, 21 nt, Mycobacterium avium subsp. paratuberculosis
cgccgcccaccuucccaaccc

SEQ ID NO: 822792 - RNA, 15 nt, Mycobacterium avium subsp. paratuberculosis
cgccgcaacagccgg

SEQ ID NO: 822793 - RNA, 16 nt, Mycobacterium avium subsp. paratuberculosis
cgccgcaacagccggc

SEQ ID NO: 822794 - RNA, 18 nt, Mycobacterium avium subsp. paratuberculosis
cgccgcaacagccggccc

SEQ ID NO: 822795 - RNA, 19 nt, Mycobacterium avium subsp. paratuberculosis
cgccgcaacagccggcccg

SEQ ID NO: 822796 - RNA, 17 nt, Mycobacterium avium subsp. paratuberculosis
cgccgcaacagguuucg

SEQ ID NO: 822797 - RNA, 22 nt, Mycobacterium avium subsp. paratuberculosis
cgccgcaacagguuucgcucgu

SEQ ID NO: 822798 - RNA, 23 nt, Mycobacterium avium subsp. paratuberculosis
cgccgauuccggccggccgccgg

SEQ ID NO: 822799 - RNA, 16 nt, Mycobacterium avium subsp. paratuberculosis
cgccgauuccgucggu

SEQ ID NO: 822800 - RNA, 17 nt, Mycobacterium avium subsp. paratuberculosis
cgccgauuccgucggug

SEQ ID NO: 822801 - RNA, 20 nt, Mycobacterium avium subsp. paratuberculosis
cgccgauuccgucgguggcg

SEQ ID NO: 822802 - RNA, 22 nt, Mycobacterium avium subsp. paratuberculosis
cgccgauuccgucgguggcggu

SEQ ID NO: 822803 - RNA, 18 nt, Mycobacterium avium subsp. paratuberculosis
cgccgauguuuugggugc

SEQ ID NO: 822804 - RNA, 15 nt, Mycobacterium avium subsp. paratuberculosis
cgccgauucaacccc

SEQ ID NO: 822805 - RNA, 23 nt, Mycobacterium avium subsp. paratuberculosis
cgccgcaauacaccgcgaacucg

SEQ ID NO: 822806 - RNA, 20 nt, Mycobacterium avium subsp. paratuberculosis
cgccgcaaccuucuuggccg

SEQ ID NO: 822807 - RNA, 15 nt, Mycobacterium avium subsp. paratuberculosis
cgccgcaacggcgca

SEQ ID NO: 822808 - RNA, 23 nt, Mycobacterium avium subsp. paratuberculosis
cgccgcaacggcucccaggccca

SEQ ID NO: 822809 - RNA, 23 nt, Mycobacterium avium subsp. paratuberculosis
cgccgcaacuugcccgacggcgu

SEQ ID NO: 822810 - RNA, 23 nt, Mycobacterium avium subsp. paratuberculosis
cgccgcacguguucucacggcga

SEQ ID NO: 822811 - RNA, 20 nt, Mycobacterium avium subsp. paratuberculosis
cgccgcacugcacggccucg

SEQ ID NO: 822812 - RNA, 22 nt, Mycobacterium avium subsp. paratuberculosis
cgccgcacugcacggccucggu

SEQ ID NO: 822813 - RNA, 17 nt, Mycobacterium avium subsp. paratuberculosis
cgccgcacgcgaccgcg

SEQ ID NO: 822814 - RNA, 20 nt, Mycobacterium avium subsp. paratuberculosis
cgccgcacgcgaccgcgucg

SEQ ID NO: 822815 - RNA, 13 nt, Mycobacterium avium subsp. paratuberculosis
cgccgcaccggcc

SEQ ID NO: 822816 - RNA, 16 nt, Mycobacterium avium subsp. paratuberculosis
cgccgcaccggccggc

SEQ ID NO: 822817 - RNA, 12 nt, Mycobacterium avium subsp. paratuberculosis
cgccgcaccguc

SEQ ID NO: 822818 - RNA, 14 nt, Mycobacterium avium subsp. paratuberculosis
cgccgcaccgucgu

SEQ ID NO: 822819 - RNA, 17 nt, Mycobacterium avium subsp. paratuberculosis
cgccgcaccgucgugcc

SEQ ID NO: 822820 - RNA, 21 nt, Mycobacterium avium subsp. paratuberculosis
cgccgcaccgucgugccagcg

SEQ ID NO: 822821 - RNA, 21 nt, Mycobacterium avium subsp. paratuberculosis
cgccgcaccucgccgaucucg

SEQ ID NO: 822822 - RNA, 19 nt, Mycobacterium avium subsp. paratuberculosis
cgccgcacgaauugccggu

SEQ ID NO: 822823 - RNA, 15 nt, Mycobacterium avium subsp. paratuberculosis
cgccgcacccagcgg

SEQ ID NO: 822824 - RNA, 19 nt, Mycobacterium avium subsp. paratuberculosis
cgccgcacccagcgggcga

SEQ ID NO: 822825 - RNA, 20 nt, Mycobacterium avium subsp. paratuberculosis
cgccgcacccagcgggcgac

SEQ ID NO: 822826 - RNA, 23 nt, Mycobacterium avium subsp. paratuberculosis
cgccgcacccagcgggcgacguc

SEQ ID NO: 822827 - RNA, 22 nt, Mycobacterium avium subsp. paratuberculosis
cgccgcaccgcaaagcaccgcg

SEQ ID NO: 822828 - RNA, 13 nt, Mycobacterium avium subsp. paratuberculosis
cgccgcacagccg

SEQ ID NO: 822829 - RNA, 15 nt, Mycobacterium avium subsp. paratuberculosis
cgccgcacagccggc

SEQ ID NO: 822830 - RNA, 14 nt, Mycobacterium avium subsp. paratuberculosis
cgccgcaccaguuc

SEQ ID NO: 822831 - RNA, 12 nt, Mycobacterium avium subsp. paratuberculosis
cgccgaugugcu

SEQ ID NO: 822832 - RNA, 18 nt, Mycobacterium avium subsp. paratuberculosis
cgccgaugugcucgguca

SEQ ID NO: 822833 - RNA, 17 nt, Mycobacterium avium subsp. paratuberculosis
cgccgauguggccggcg

SEQ ID NO: 822834 - RNA, 18 nt, Mycobacterium avium subsp. paratuberculosis
cgccgaugugaucggcgg

SEQ ID NO: 822835 - RNA, 20 nt, Mycobacterium avium subsp. paratuberculosis
cgccgaugugaucggcggcc

SEQ ID NO: 822836 - RNA, 22 nt, Mycobacterium avium subsp. paratuberculosis
cgccgaugugaucggcggccac

SEQ ID NO: 822837 - RNA, 23 nt, Mycobacterium avium subsp. paratuberculosis
cgccgaugugaucggcggccacc

SEQ ID NO: 822838 - RNA, 17 nt, Mycobacterium avium subsp. paratuberculosis
cgccgauguccccgcgg

SEQ ID NO: 822839 - RNA, 15 nt, Mycobacterium avium subsp. paratuberculosis
cgccgaugucggccg

SEQ ID NO: 822840 - RNA, 16 nt, Mycobacterium avium subsp. paratuberculosis
cgccgaugucggccgg

SEQ ID NO: 822841 - RNA, 17 nt, Mycobacterium avium subsp. paratuberculosis
cgccgaugucggccggu

SEQ ID NO: 822842 - RNA, 18 nt, Mycobacterium avium subsp. paratuberculosis
cgccgaugucggccgguc

SEQ ID NO: 822843 - RNA, 18 nt, Mycobacterium avium subsp. paratuberculosis
cgccgauguacugggccg

SEQ ID NO: 822844 - RNA, 22 nt, Mycobacterium avium subsp. paratuberculosis
cgccgauguacugggccgucgc

SEQ ID NO: 822845 - RNA, 20 nt, Mycobacterium avium subsp. paratuberculosis
cgccgauguaguccagccca

SEQ ID NO: 822846 - RNA, 16 nt, Mycobacterium avium subsp. paratuberculosis
cgccgauggcguucau

SEQ ID NO: 822847 - RNA, 19 nt, Mycobacterium avium subsp. paratuberculosis
cgccgauggugaccucggu

SEQ ID NO: 822848 - RNA, 21 nt, Mycobacterium avium subsp. paratuberculosis
cgccgauggugaccucggucg

SEQ ID NO: 822849 - RNA, 22 nt, Mycobacterium avium subsp. paratuberculosis
cgccgauggugaccucggucga

SEQ ID NO: 822850 - RNA, 23 nt, Mycobacterium avium subsp. paratuberculosis
cgccgauggugaccucggucgau

SEQ ID NO: 822851 - RNA, 14 nt, Mycobacterium avium subsp. paratuberculosis
cgccgauggugacg

SEQ ID NO: 822852 - RNA, 18 nt, Mycobacterium avium subsp. paratuberculosis
cgccgauggugacggugc

SEQ ID NO: 822853 - RNA, 23 nt, Mycobacterium avium subsp. paratuberculosis
cgccgauggugacggugccgccg

SEQ ID NO: 822854 - RNA, 15 nt, Mycobacterium avium subsp. paratuberculosis
cgccgauggccuggu

SEQ ID NO: 822855 - RNA, 21 nt, Mycobacterium avium subsp. paratuberculosis
cgccgauggccugguggccca

SEQ ID NO: 822856 - RNA, 15 nt, Mycobacterium avium subsp. paratuberculosis
cgccgauggcgacgg

SEQ ID NO: 822857 - RNA, 20 nt, Mycobacterium avium subsp. paratuberculosis
cgccgaugcgguugaucaac

SEQ ID NO: 822858 - RNA, 16 nt, Mycobacterium avium subsp. paratuberculosis
cgccgaugcgccgcac

SEQ ID NO: 822859 - RNA, 17 nt, Mycobacterium avium subsp. paratuberculosis
cgccgaugcgccgcacc

SEQ ID NO: 822860 - RNA, 18 nt, Mycobacterium avium subsp. paratuberculosis
cgccgaugcgccgcacca

SEQ ID NO: 822861 - RNA, 19 nt, Mycobacterium avium subsp. paratuberculosis
cgccgaugcgcccgcugcg

SEQ ID NO: 822862 - RNA, 21 nt, Mycobacterium avium subsp. paratuberculosis
cgccgaugcgcccgcugcggc

SEQ ID NO: 822863 - RNA, 22 nt, Mycobacterium avium subsp. paratuberculosis
cgccgaugcgcccgcugcggcg

SEQ ID NO: 822864 - RNA, 13 nt, Mycobacterium avium subsp. paratuberculosis
cgccgaugcgccg

SEQ ID NO: 822865 - RNA, 14 nt, Mycobacterium avium subsp. paratuberculosis
cgccgaugccgcgc

SEQ ID NO: 822866 - RNA, 15 nt, Mycobacterium avium subsp. paratuberculosis
cgccgaugccgcgcu

SEQ ID NO: 822867 - RNA, 17 nt, Mycobacterium avium subsp. paratuberculosis
cgccgaugccgcgcugc

SEQ ID NO: 822868 - RNA, 22 nt, Mycobacterium avium subsp. paratuberculosis
cgccgaugccgcgcugcgccgg

SEQ ID NO: 822869 - RNA, 18 nt, Mycobacterium avium subsp. paratuberculosis
cgccgaugcccgccccgg

SEQ ID NO: 822870 - RNA, 17 nt, Mycobacterium avium subsp. paratuberculosis
cgccgaugccgaacguc

SEQ ID NO: 822871 - RNA, 21 nt, Mycobacterium avium subsp. paratuberculosis
cgccgaugccgaacgucacca

SEQ ID NO: 822872 - RNA, 12 nt, Mycobacterium avium subsp. paratuberculosis
cgccgaugcagc

SEQ ID NO: 822873 - RNA, 14 nt, Mycobacterium avium subsp. paratuberculosis
cgccgauccgcagc

SEQ ID NO: 822874 - RNA, 20 nt, Mycobacterium avium subsp. paratuberculosis
cgccgauccgcagccgcugc

SEQ ID NO: 822875 - RNA, 15 nt, Mycobacterium avium subsp. paratuberculosis
cgccgauccgcugcg

SEQ ID NO: 822876 - RNA, 20 nt, Mycobacterium avium subsp. paratuberculosis
cgccgaugacguugcgcgcc

SEQ ID NO: 822877 - RNA, 21 nt, Mycobacterium avium subsp. paratuberculosis
cgccgaugacguugcgcgcca

SEQ ID NO: 822878 - RNA, 17 nt, Mycobacterium avium subsp. paratuberculosis
cgccgaugaugguggcg

SEQ ID NO: 822879 - RNA, 18 nt, Mycobacterium avium subsp. paratuberculosis
cgccgauccagccgucgu

SEQ ID NO: 822880 - RNA, 19 nt, Mycobacterium avium subsp. paratuberculosis
cgccgauccagccgucguu

SEQ ID NO: 822881 - RNA, 15 nt, Mycobacterium avium subsp. paratuberculosis
cgccgaucagcacca

SEQ ID NO: 822882 - RNA, 17 nt, Mycobacterium avium subsp. paratuberculosis
cgccgaucagcaccagg

SEQ ID NO: 822883 - RNA, 20 nt, Mycobacterium avium subsp. paratuberculosis
cgccgaucagcaccagguug

SEQ ID NO: 822884 - RNA, 15 nt, Mycobacterium avium subsp. paratuberculosis
cgccgaucaccgcgu

SEQ ID NO: 822885 - RNA, 18 nt, Mycobacterium avium subsp. paratuberculosis
cgccgaucaccgcguugu

SEQ ID NO: 822886 - RNA, 19 nt, Mycobacterium avium subsp. paratuberculosis
cgccgaucaccgcguuguc

SEQ ID NO: 822887 - RNA, 15 nt, Mycobacterium avium subsp. paratuberculosis
cgccgaucacggugu

SEQ ID NO: 822888 - RNA, 16 nt, Mycobacterium avium subsp. paratuberculosis
cgccuucuugcgcggc

SEQ ID NO: 822889 - RNA, 15 nt, Mycobacterium avium subsp. paratuberculosis
cgccuucuugcugcc

SEQ ID NO: 822890 - RNA, 15 nt, Mycobacterium avium subsp. paratuberculosis
cgccuucuuggccgc

SEQ ID NO: 822891 - RNA, 17 nt, Mycobacterium avium subsp. paratuberculosis
cgccuucuuggccgcgc

SEQ ID NO: 822892 - RNA, 16 nt, Mycobacterium avium subsp. paratuberculosis
cgccuugaaccggcug

SEQ ID NO: 822893 - RNA, 13 nt, Mycobacterium avium subsp. paratuberculosis
cgccuugaccgcc

SEQ ID NO: 822894 - RNA, 14 nt, Mycobacterium avium subsp. paratuberculosis
cgccuucggcgcca

SEQ ID NO: 822895 - RNA, 20 nt, Mycobacterium avium subsp. paratuberculosis
cgccuucggcgccagcccgc

SEQ ID NO: 822896 - RNA, 22 nt, Mycobacterium avium subsp. paratuberculosis
cgccuucggcgccagcccgccg

SEQ ID NO: 822897 - RNA, 17 nt, Mycobacterium avium subsp. paratuberculosis
cgccuugacgccgggca

SEQ ID NO: 822898 - RNA, 18 nt, Mycobacterium avium subsp. paratuberculosis
cgccuugcacacggccuu

SEQ ID NO: 822899 - RNA, 22 nt, Mycobacterium avium subsp. paratuberculosis
cgccuugcacacggccuugccg

SEQ ID NO: 822900 - RNA, 16 nt, Mycobacterium avium subsp. paratuberculosis
cgccuugcccggcucg

SEQ ID NO: 822901 - RNA, 16 nt, Mycobacterium avium subsp. paratuberculosis
cgccuugccgucgagc

SEQ ID NO: 822902 - RNA, 13 nt, Mycobacterium avium subsp. paratuberculosis
cgccuugccgacg

SEQ ID NO: 822903 - RNA, 15 nt, Mycobacterium avium subsp. paratuberculosis
cgccuugccgacgac

SEQ ID NO: 822904 - RNA, 19 nt, Mycobacterium avium subsp. paratuberculosis
cgccuugccgacgacgucg

SEQ ID NO: 822905 - RNA, 14 nt, Mycobacterium avium subsp. paratuberculosis
cgcgaacagccgac

SEQ ID NO: 822906 - RNA, 15 nt, Mycobacterium avium subsp. paratuberculosis
cgcgaacagccgacc

SEQ ID NO: 822907 - RNA, 14 nt, Mycobacterium avium subsp. paratuberculosis
cgcgaacagcgccg

SEQ ID NO: 822908 - RNA, 15 nt, Mycobacterium avium subsp. paratuberculosis
cgcgaacagcgccga

SEQ ID NO: 822909 - RNA, 17 nt, Mycobacterium avium subsp. paratuberculosis
cgcgaacagcgccgacu

SEQ ID NO: 822910 - RNA, 18 nt, Mycobacterium avium subsp. paratuberculosis
cgcgaacagcgcggccac

SEQ ID NO: 822911 - RNA, 18 nt, Mycobacterium avium subsp. paratuberculosis
cgcgaacaucgccagcaa

SEQ ID NO: 822912 - RNA, 21 nt, Mycobacterium avium subsp. paratuberculosis
cgcgaacaccagaugccgcuc

SEQ ID NO: 822913 - RNA, 22 nt, Mycobacterium avium subsp. paratuberculosis
cgcgaacagguccuugcccagc

SEQ ID NO: 822914 - RNA, 17 nt, Mycobacterium avium subsp. paratuberculosis
cgcgaagaacgacgcca

SEQ ID NO: 822915 - RNA, 12 nt, Mycobacterium avium subsp. paratuberculosis
cgcgaaccgggc

SEQ ID NO: 822916 - RNA, 21 nt, Mycobacterium avium subsp. paratuberculosis
cgcgaacgacgaccucccccg

SEQ ID NO: 822917 - RNA, 19 nt, Mycobacterium avium subsp. paratuberculosis
cgcgaagaacggugucacg

SEQ ID NO: 822918 - RNA, 14 nt, Mycobacterium avium subsp. paratuberculosis
cgcgaagaccagcg

SEQ ID NO: 822919 - RNA, 17 nt, Mycobacterium avium subsp. paratuberculosis
cgcgaagaccagcgugu

SEQ ID NO: 822920 - RNA, 18 nt, Mycobacterium avium subsp. paratuberculosis
cgcgaagcgcgaugcggc

SEQ ID NO: 822921 - RNA, 18 nt, Mycobacterium avium subsp. paratuberculosis
cgcgaauuccucagcgcc

SEQ ID NO: 822922 - RNA, 21 nt, Mycobacterium avium subsp. paratuberculosis
cgcgaauuccucagcgcccca

SEQ ID NO: 822923 - RNA, 17 nt, Mycobacterium avium subsp. paratuberculosis
cgcgaaggcggcgucga

SEQ ID NO: 822924 - RNA, 19 nt, Mycobacterium avium subsp. paratuberculosis
cgcgaagcguaugccggug

SEQ ID NO: 822925 - RNA, 22 nt, Mycobacterium avium subsp. paratuberculosis
cgcgacaagcagauucgagguc

SEQ ID NO: 822926 - RNA, 16 nt, Mycobacterium avium subsp. paratuberculosis
cgcgacaaggucgacc

SEQ ID NO: 822927 - RNA, 18 nt, Mycobacterium avium subsp. paratuberculosis
cgcgacaccgcggcgacg

SEQ ID NO: 822928 - RNA, 22 nt, Mycobacterium avium subsp. paratuberculosis
cgcgacaccgcggcgacgucgu

SEQ ID NO: 822929 - RNA, 18 nt, Mycobacterium avium subsp. paratuberculosis
cgcgacaccugcucaccg

SEQ ID NO: 822930 - RNA, 20 nt, Mycobacterium avium subsp. paratuberculosis
cgcgacaccugcucaccgag

SEQ ID NO: 822931 - RNA, 22 nt, Mycobacterium avium subsp. paratuberculosis
cgcgaagacgcuggccacgauc

SEQ ID NO: 822932 - RNA, 19 nt, Mycobacterium avium subsp. paratuberculosis
cgcgaauugagguagucgg

SEQ ID NO: 822933 - RNA, 21 nt, Mycobacterium avium subsp. paratuberculosis
cgcgaauugagguagucggcc

SEQ ID NO: 822934 - RNA, 17 nt, Mycobacterium avium subsp. paratuberculosis
cgcgaccaugcccggcg

SEQ ID NO: 822935 - RNA, 19 nt, Mycobacterium avium subsp. paratuberculosis
cgcgaccccggaccgcgga

SEQ ID NO: 822936 - RNA, 22 nt, Mycobacterium avium subsp. paratuberculosis
cgcgacccagacuugggcagca

SEQ ID NO: 822937 - RNA, 14 nt, Mycobacterium avium subsp. paratuberculosis
cgcgacccaggccg

SEQ ID NO: 822938 - RNA, 16 nt, Mycobacterium avium subsp. paratuberculosis
cgcgacccaggccgcc

SEQ ID NO: 822939 - RNA, 18 nt, Mycobacterium avium subsp. paratuberculosis
cgcgacccaggccgccgc

SEQ ID NO: 822940 - RNA, 20 nt, Mycobacterium avium subsp. paratuberculosis
cgcgacccaggccgccgcca

SEQ ID NO: 822941 - RNA, 14 nt, Mycobacterium avium subsp. paratuberculosis
cgcgaccagguucu

SEQ ID NO: 822942 - RNA, 14 nt, Mycobacterium avium subsp. paratuberculosis
cgcgaccaguaccg

SEQ ID NO: 822943 - RNA, 17 nt, Mycobacterium avium subsp. paratuberculosis
cgcgaccaguaccgggc

SEQ ID NO: 822944 - RNA, 19 nt, Mycobacterium avium subsp. paratuberculosis
cgcgaccagugcaccucga

SEQ ID NO: 822945 - RNA, 19 nt, Mycobacterium avium subsp. paratuberculosis
cgcgaccaucagcccggug

SEQ ID NO: 822946 - RNA, 16 nt, Mycobacterium avium subsp. paratuberculosis
cgcgaccacgccgcgg

SEQ ID NO: 822947 - RNA, 19 nt, Mycobacterium avium subsp. paratuberculosis
cgcgaccaggcccagcgga

SEQ ID NO: 822948 - RNA, 18 nt, Mycobacterium avium subsp. paratuberculosis
cgcgaccacagcgccucg

SEQ ID NO: 822949 - RNA, 14 nt, Mycobacterium avium subsp. paratuberculosis
cgcgaccagcccgg

SEQ ID NO: 822950 - RNA, 18 nt, Mycobacterium avium subsp. paratuberculosis
cgcgaccagcccggccgc

SEQ ID NO: 822951 - RNA, 14 nt, Mycobacterium avium subsp. paratuberculosis
cgcgaccagcggca

SEQ ID NO: 822952 - RNA, 19 nt, Mycobacterium avium subsp. paratuberculosis
cgcgaccagcggcagcagc

SEQ ID NO: 822953 - RNA, 16 nt, Mycobacterium avium subsp. paratuberculosis
cgcgaccagcucgggc

SEQ ID NO: 822954 - RNA, 14 nt, Mycobacterium avium subsp. paratuberculosis
cgcgaccaccggcc

SEQ ID NO: 822955 - RNA, 15 nt, Mycobacterium avium subsp. paratuberculosis
cgcgaccaccggccg

SEQ ID NO: 822956 - RNA, 18 nt, Mycobacterium avium subsp. paratuberculosis
cgcgaccaccggccgacc

SEQ ID NO: 822957 - RNA, 14 nt, Mycobacterium avium subsp. paratuberculosis
cgcgacacgccgcg

SEQ ID NO: 822958 - RNA, 15 nt, Mycobacterium avium subsp. paratuberculosis
cgcgacacgccgcgc

SEQ ID NO: 822959 - RNA, 19 nt, Mycobacterium avium subsp. paratuberculosis
cgccugcgcgccgucggcg

SEQ ID NO: 822960 - RNA, 12 nt, Mycobacterium avium subsp. paratuberculosis
cgccugcgcggc

SEQ ID NO: 822961 - RNA, 20 nt, Mycobacterium avium subsp. paratuberculosis
cgccugcggguucuggccgu

SEQ ID NO: 822962 - RNA, 22 nt, Mycobacterium avium subsp. paratuberculosis
cgccugcggguucuggccgugg

SEQ ID NO: 822963 - RNA, 13 nt, Mycobacterium avium subsp. paratuberculosis
cgccugcggugag

SEQ ID NO: 822964 - RNA, 20 nt, Mycobacterium avium subsp. paratuberculosis
cgccuggcggaaggccgcgc

SEQ ID NO: 822965 - RNA, 17 nt, Mycobacterium avium subsp. paratuberculosis
cgccuggcgcagggcgu

SEQ ID NO: 822966 - RNA, 20 nt, Mycobacterium avium subsp. paratuberculosis
cgccuggcgcagggcguucg

SEQ ID NO: 822967 - RNA, 21 nt, Mycobacterium avium subsp. paratuberculosis
cgccuggccaccucgacggcg

SEQ ID NO: 822968 - RNA, 14 nt, Mycobacterium avium subsp. paratuberculosis
cgccuggcagcugc

SEQ ID NO: 822969 - RNA, 15 nt, Mycobacterium avium subsp. paratuberculosis
cgccuggcagcugcc

SEQ ID NO: 822970 - RNA, 20 nt, Mycobacterium avium subsp. paratuberculosis
cgccugguagggguccucca

SEQ ID NO: 822971 - RNA, 15 nt, Mycobacterium avium subsp. paratuberculosis
cgccugguccucccg

SEQ ID NO: 822972 - RNA, 19 nt, Mycobacterium avium subsp. paratuberculosis
cgccugguccucccgggug

SEQ ID NO: 822973 - RNA, 18 nt, Mycobacterium avium subsp. paratuberculosis
cgccugggcguacagcgg

SEQ ID NO: 822974 - RNA, 20 nt, Mycobacterium avium subsp. paratuberculosis
cgccugggcguacagcggcg

SEQ ID NO: 822975 - RNA, 15 nt, Mycobacterium avium subsp. paratuberculosis
cgccuguccgaccag

SEQ ID NO: 822976 - RNA, 16 nt, Mycobacterium avium subsp. paratuberculosis
cgccuguccgaccagc

SEQ ID NO: 822977 - RNA, 17 nt, Mycobacterium avium subsp. paratuberculosis
cgccugugcgacggcgu

SEQ ID NO: 822978 - RNA, 21 nt, Mycobacterium avium subsp. paratuberculosis
cgccugugcgacggcgucggc

SEQ ID NO: 822979 - RNA, 22 nt, Mycobacterium avium subsp. paratuberculosis
cgccuucacgaccggcagcacc

SEQ ID NO: 822980 - RNA, 13 nt, Mycobacterium avium subsp. paratuberculosis
cgccuuccacgac

SEQ ID NO: 822981 - RNA, 14 nt, Mycobacterium avium subsp. paratuberculosis
cgccuucgaugccc

SEQ ID NO: 822982 - RNA, 22 nt, Mycobacterium avium subsp. paratuberculosis
cgccuucgaugcccuccagcac

SEQ ID NO: 822983 - RNA, 17 nt, Mycobacterium avium subsp. paratuberculosis
cgccuucgacggccggc

SEQ ID NO: 822984 - RNA, 19 nt, Mycobacterium avium subsp. paratuberculosis
cgccguggcagggccagca

SEQ ID NO: 822985 - RNA, 20 nt, Mycobacterium avium subsp. paratuberculosis
cgccguggcagggccagcag

SEQ ID NO: 822986 - RNA, 15 nt, Mycobacterium avium subsp. paratuberculosis
cgccguggcccacgc

SEQ ID NO: 822987 - RNA, 13 nt, Mycobacterium avium subsp. paratuberculosis
cgccguggcccgg

SEQ ID NO: 822988 - RNA, 16 nt, Mycobacterium avium subsp. paratuberculosis
cgccguggcccggucg

SEQ ID NO: 822989 - RNA, 20 nt, Mycobacterium avium subsp. paratuberculosis
cgccguggccgaacggcaug

SEQ ID NO: 822990 - RNA, 17 nt, Mycobacterium avium subsp. paratuberculosis
cgccgucguugaucagg

SEQ ID NO: 822991 - RNA, 23 nt, Mycobacterium avium subsp. paratuberculosis
cgccgucguugaucaggugcagc

SEQ ID NO: 822992 - RNA, 16 nt, Mycobacterium avium subsp. paratuberculosis
cgccgucuccggcgua

SEQ ID NO: 822993 - RNA, 20 nt, Mycobacterium avium subsp. paratuberculosis
cgccgucuccucgaccagcg

SEQ ID NO: 822994 - RNA, 20 nt, Mycobacterium avium subsp. paratuberculosis
cgccgucucgaccacccggc

SEQ ID NO: 822995 - RNA, 16 nt, Mycobacterium avium subsp. paratuberculosis
cgccgucucgacccgg

SEQ ID NO: 822996 - RNA, 15 nt, Mycobacterium avium subsp. paratuberculosis
cgccgucggggucgc

SEQ ID NO: 822997 - RNA, 21 nt, Mycobacterium avium subsp. paratuberculosis
cgccgucggggugcggucggc

SEQ ID NO: 822998 - RNA, 20 nt, Mycobacterium avium subsp. paratuberculosis
cgccgucgguaucgaggucc

SEQ ID NO: 822999 - RNA, 13 nt, Mycobacterium avium subsp. paratuberculosis
cgccgucggugau

SEQ ID NO: 823000 - RNA, 21 nt, Mycobacterium avium subsp. paratuberculosis
cgccgucggugggggccaggc

SEQ ID NO: 823001 - RNA, 14 nt, Mycobacterium avium subsp. paratuberculosis
cgccgucgguguag

SEQ ID NO: 823002 - RNA, 23 nt, Mycobacterium avium subsp. paratuberculosis
cgccgucgguguagcgagugccg

SEQ ID NO: 823003 - RNA, 20 nt, Mycobacterium avium subsp. paratuberculosis
cgccgucguagccgcgggug

SEQ ID NO: 823004 - RNA, 21 nt, Mycobacterium avium subsp. paratuberculosis
cgccgucguauucgacggcga

SEQ ID NO: 823005 - RNA, 22 nt, Mycobacterium avium subsp. paratuberculosis
cgccgucguauucgacggcgac

SEQ ID NO: 823006 - RNA, 21 nt, Mycobacterium avium subsp. paratuberculosis
cgccgucgucagccgggccag

SEQ ID NO: 823007 - RNA, 13 nt, Mycobacterium avium subsp. paratuberculosis
cgccgucggcggg

SEQ ID NO: 823008 - RNA, 14 nt, Mycobacterium avium subsp. paratuberculosis
cgccgucggcgggg

SEQ ID NO: 823009 - RNA, 14 nt, Mycobacterium avium subsp. paratuberculosis
cgccgucgagccug

SEQ ID NO: 823010 - RNA, 14 nt, Mycobacterium avium subsp. paratuberculosis
cgccgucgucgagc

SEQ ID NO: 823011 - RNA, 21 nt, Mycobacterium avium subsp. paratuberculosis
cgccgucgucgagcaccaccc

SEQ ID NO: 823012 - RNA, 15 nt, Mycobacterium avium subsp. paratuberculosis
cgccgucgucggaca

SEQ ID NO: 823013 - RNA, 23 nt, Mycobacterium avium subsp. paratuberculosis
cgccgucgucguuguuggcggcg

SEQ ID NO: 823014 - RNA, 16 nt, Mycobacterium avium subsp. paratuberculosis
cgccgucgugcucggc

SEQ ID NO: 823015 - RNA, 17 nt, Mycobacterium avium subsp. paratuberculosis
cgccgucgugcucggcg

SEQ ID NO: 823016 - RNA, 19 nt, Mycobacterium avium subsp. paratuberculosis
cgccgucgugcucggcgag

SEQ ID NO: 823017 - RNA, 22 nt, Mycobacterium avium subsp. paratuberculosis
cgccgucguggguauccgccgc

SEQ ID NO: 823018 - RNA, 20 nt, Mycobacterium avium subsp. paratuberculosis
cgccgucgugguggccgcga

SEQ ID NO: 823019 - RNA, 23 nt, Mycobacterium avium subsp. paratuberculosis
cgccguguaggccgcgcuggcca

SEQ ID NO: 823020 - RNA, 24 nt, Mycobacterium avium subsp. paratuberculosis
cgccguugauugcgcccgccgaac

SEQ ID NO: 823021 - RNA, 13 nt, Mycobacterium avium subsp. paratuberculosis
cgccgugggcguc

SEQ ID NO: 823022 - RNA, 14 nt, Mycobacterium avium subsp. paratuberculosis
cgccgugggcguca

SEQ ID NO: 823023 - RNA, 19 nt, Mycobacterium avium subsp. paratuberculosis
cgccguggucaacggcacc

SEQ ID NO: 823024 - RNA, 20 nt, Mycobacterium avium subsp. paratuberculosis
cgccguggucaacggcaccg

SEQ ID NO: 823025 - RNA, 16 nt, Mycobacterium avium subsp. paratuberculosis
cgccgugguccagccg

SEQ ID NO: 823026 - RNA, 16 nt, Mycobacterium avium subsp. paratuberculosis
cgccguggcggcccga

SEQ ID NO: 823027 - RNA, 17 nt, Mycobacterium avium subsp. paratuberculosis
cgccguggcggcccgac

SEQ ID NO: 823028 - RNA, 18 nt, Mycobacterium avium subsp. paratuberculosis
cgccguggcggcccgacc

SEQ ID NO: 823029 - RNA, 19 nt, Mycobacterium avium subsp. paratuberculosis
cgccguggcggcccgacca

SEQ ID NO: 823030 - RNA, 20 nt, Mycobacterium avium subsp. paratuberculosis
cgccguggcggcccgaccag

SEQ ID NO: 823031 - RNA, 22 nt, Mycobacterium avium subsp. paratuberculosis
cgccguggcggcccgaccagcg

SEQ ID NO: 823032 - RNA, 13 nt, Mycobacterium avium subsp. paratuberculosis
cgccguggcggcg

SEQ ID NO: 823033 - RNA, 16 nt, Mycobacterium avium subsp. paratuberculosis
cgccguggcggcgggc

SEQ ID NO: 823034 - RNA, 14 nt, Mycobacterium avium subsp. paratuberculosis
cgccguugccggcc

SEQ ID NO: 823035 - RNA, 16 nt, Mycobacterium avium subsp. paratuberculosis
cgccguugccggcccg

SEQ ID NO: 823036 - RNA, 19 nt, Mycobacterium avium subsp. paratuberculosis
cgccguugccggcccgcag

SEQ ID NO: 823037 - RNA, 14 nt, Mycobacterium avium subsp. paratuberculosis
cgccgucgccgacg

SEQ ID NO: 823038 - RNA, 18 nt, Mycobacterium avium subsp. paratuberculosis
cgccgucgccgacguugu

SEQ ID NO: 823039 - RNA, 14 nt, Mycobacterium avium subsp. paratuberculosis
cgccgucgccgauc

SEQ ID NO: 823040 - RNA, 13 nt, Mycobacterium avium subsp. paratuberculosis
cgccgucgccgcc

SEQ ID NO: 823041 - RNA, 14 nt, Mycobacterium avium subsp. paratuberculosis
cgccgucgccgccg

SEQ ID NO: 823042 - RNA, 16 nt, Mycobacterium avium subsp. paratuberculosis
cgccgucgccgccgug

SEQ ID NO: 823043 - RNA, 14 nt, Mycobacterium avium subsp. paratuberculosis
cgccgucgcgaucg

SEQ ID NO: 823044 - RNA, 16 nt, Mycobacterium avium subsp. paratuberculosis
cgccgucgcgaucgcg

SEQ ID NO: 823045 - RNA, 19 nt, Mycobacterium avium subsp. paratuberculosis
cgccgucgcgaucgcgguc

SEQ ID NO: 823046 - RNA, 13 nt, Mycobacterium avium subsp. paratuberculosis
cgccgucgcgcca

SEQ ID NO: 823047 - RNA, 15 nt, Mycobacterium avium subsp. paratuberculosis
cgccgucgcgccagg

SEQ ID NO: 823048 - RNA, 13 nt, Mycobacterium avium subsp. paratuberculosis
cgccgucgcgggu

SEQ ID NO: 823049 - RNA, 23 nt, Mycobacterium avium subsp. paratuberculosis
cgccgucgcggguggggaucagg

SEQ ID NO: 823050 - RNA, 12 nt, Mycobacterium avium subsp. paratuberculosis
cgccgucggcau

SEQ ID NO: 823051 - RNA, 16 nt, Mycobacterium avium subsp. paratuberculosis
cgccgucggccagcag

SEQ ID NO: 823052 - RNA, 19 nt, Mycobacterium avium subsp. paratuberculosis
cgccgucggccagcagcgc

SEQ ID NO: 823053 - RNA, 15 nt, Mycobacterium avium subsp. paratuberculosis
cgccgucggcgaugc

SEQ ID NO: 823054 - RNA, 14 nt, Mycobacterium avium subsp. paratuberculosis
cgccgucggcgaug

SEQ ID NO: 823055 - RNA, 12 nt, Mycobacterium avium subsp. paratuberculosis
cgccgucggcgg

SEQ ID NO: 823056 - RNA, 18 nt, Mycobacterium avium subsp. paratuberculosis
cgccgucggggcgucggc

SEQ ID NO: 823057 - RNA, 13 nt, Mycobacterium avium subsp. paratuberculosis
cgccgucggggcu

SEQ ID NO: 823058 - RNA, 14 nt, Mycobacterium avium subsp. paratuberculosis
cgccgucggggcug

SEQ ID NO: 823059 - RNA, 13 nt, Mycobacterium avium subsp. paratuberculosis
cgccgguguucgg

SEQ ID NO: 823060 - RNA, 15 nt, Mycobacterium avium subsp. paratuberculosis
cgccgguguucggcg

SEQ ID NO: 823061 - RNA, 16 nt, Mycobacterium avium subsp. paratuberculosis
cgccgguguucggcgc

SEQ ID NO: 823062 - RNA, 18 nt, Mycobacterium avium subsp. paratuberculosis
cgccgguguucggcgcca

SEQ ID NO: 823063 - RNA, 21 nt, Mycobacterium avium subsp. paratuberculosis
cgccgguguucggcgccagcc

SEQ ID NO: 823064 - RNA, 20 nt, Mycobacterium avium subsp. paratuberculosis
cgccgucgaugacgcgcuug

SEQ ID NO: 823065 - RNA, 15 nt, Mycobacterium avium subsp. paratuberculosis
cgccgucgauggcgc

SEQ ID NO: 823066 - RNA, 11 nt, Mycobacterium avium subsp. paratuberculosis
cgccgucgcca

SEQ ID NO: 823067 - RNA, 14 nt, Mycobacterium avium subsp. paratuberculosis
cgccgucgccacca

SEQ ID NO: 823068 - RNA, 15 nt, Mycobacterium avium subsp. paratuberculosis
cgccgucgccaccac

SEQ ID NO: 823069 - RNA, 16 nt, Mycobacterium avium subsp. paratuberculosis
cgccgucgccaccacc

SEQ ID NO: 823070 - RNA, 20 nt, Mycobacterium avium subsp. paratuberculosis
cgccgucgccaccaccgcgc

SEQ ID NO: 823071 - RNA, 22 nt, Mycobacterium avium subsp. paratuberculosis
cgccgucgccaccaccgcgccg

SEQ ID NO: 823072 - RNA, 23 nt, Mycobacterium avium subsp. paratuberculosis
cgccgucgccaccaccgcgccgu

SEQ ID NO: 823073 - RNA, 19 nt, Mycobacterium avium subsp. paratuberculosis
cgccgucgccaccgagucg

SEQ ID NO: 823074 - RNA, 18 nt, Mycobacterium avium subsp. paratuberculosis
cgccgguguagaucggcu

SEQ ID NO: 823075 - RNA, 14 nt, Mycobacterium avium subsp. paratuberculosis
cgccggugucggcg

SEQ ID NO: 823076 - RNA, 18 nt, Mycobacterium avium subsp. paratuberculosis
cgccggugucggcgacca

SEQ ID NO: 823077 - RNA, 19 nt, Mycobacterium avium subsp. paratuberculosis
cgccggugucggcgaccaa

SEQ ID NO: 823078 - RNA, 21 nt, Mycobacterium avium subsp. paratuberculosis
cgccggugucauaccagccgu

SEQ ID NO: 823079 - RNA, 14 nt, Mycobacterium avium subsp. paratuberculosis
cgccgguggcgucg

SEQ ID NO: 823080 - RNA, 15 nt, Mycobacterium avium subsp. paratuberculosis
cgccgguggcgucgg

SEQ ID NO: 823081 - RNA, 16 nt, Mycobacterium avium subsp. paratuberculosis
cgccgguggcgucggu

SEQ ID NO: 823082 - RNA, 19 nt, Mycobacterium avium subsp. paratuberculosis
cgccgguggcgucggugau

SEQ ID NO: 823083 - RNA, 15 nt, Mycobacterium avium subsp. paratuberculosis
cgccgguggggucgg

SEQ ID NO: 823084 - RNA, 14 nt, Mycobacterium avium subsp. paratuberculosis
cgccuccgggcugc

SEQ ID NO: 823085 - RNA, 17 nt, Mycobacterium avium subsp. paratuberculosis
cgccucggaggccaccg

SEQ ID NO: 823086 - RNA, 19 nt, Mycobacterium avium subsp. paratuberculosis
cgccucggaggccaccgcg

SEQ ID NO: 823087 - RNA, 20 nt, Mycobacterium avium subsp. paratuberculosis
cgccucggaucccggggcgc

SEQ ID NO: 823088 - RNA, 12 nt, Mycobacterium avium subsp. paratuberculosis
cgccucggccac

SEQ ID NO: 823089 - RNA, 16 nt, Mycobacterium avium subsp. paratuberculosis
cgccucggccaccaga

SEQ ID NO: 823090 - RNA, 17 nt, Mycobacterium avium subsp. paratuberculosis
cgccucggccaccagau

SEQ ID NO: 823091 - RNA, 12 nt, Mycobacterium avium subsp. paratuberculosis
cgccucggccgc

SEQ ID NO: 823092 - RNA, 14 nt, Mycobacterium avium subsp. paratuberculosis
cgccucggccucgu

SEQ ID NO: 823093 - RNA, 16 nt, Mycobacterium avium subsp. paratuberculosis
cgccucggccucgucg

SEQ ID NO: 823094 - RNA, 23 nt, Mycobacterium avium subsp. paratuberculosis
cgccucggccuuggccaccgccu

SEQ ID NO: 823095 - RNA, 12 nt, Mycobacterium avium subsp. paratuberculosis
cgccucggcgag

SEQ ID NO: 823096 - RNA, 15 nt, Mycobacterium avium subsp. paratuberculosis
cgccucggcgagccg

SEQ ID NO: 823097 - RNA, 13 nt, Mycobacterium avium subsp. paratuberculosis
cgccucggcgagg

SEQ ID NO: 823098 - RNA, 16 nt, Mycobacterium avium subsp. paratuberculosis
cgccucggcgaggucg

SEQ ID NO: 823099 - RNA, 18 nt, Mycobacterium avium subsp. paratuberculosis
cgccucggcgaggucguc

SEQ ID NO: 823100 - RNA, 19 nt, Mycobacterium avium subsp. paratuberculosis
cgccucggcgaggucgucg

SEQ ID NO: 823101 - RNA, 20 nt, Mycobacterium avium subsp. paratuberculosis
cgccucggcgaggucgucga

SEQ ID NO: 823102 - RNA, 15 nt, Mycobacterium avium subsp. paratuberculosis
cgccucggcgaucgg

SEQ ID NO: 823103 - RNA, 16 nt, Mycobacterium avium subsp. paratuberculosis
cgccucggcgaucggc

SEQ ID NO: 823104 - RNA, 17 nt, Mycobacterium avium subsp. paratuberculosis
cgccucggcgaucggcc

SEQ ID NO: 823105 - RNA, 18 nt, Mycobacterium avium subsp. paratuberculosis
cgccucggcgaucggccg

SEQ ID NO: 823106 - RNA, 17 nt, Mycobacterium avium subsp. paratuberculosis
cgccucggcgccucggc

SEQ ID NO: 823107 - RNA, 21 nt, Mycobacterium avium subsp. paratuberculosis
cgccucggcgccucggcgucc

SEQ ID NO: 823108 - RNA, 15 nt, Mycobacterium avium subsp. paratuberculosis
cgccucgcggucgac

SEQ ID NO: 823109 - RNA, 16 nt, Mycobacterium avium subsp. paratuberculosis
cgccucgcggucgacg

SEQ ID NO: 823110 - RNA, 18 nt, Mycobacterium avium subsp. paratuberculosis
cgccucgcguacccgggc

SEQ ID NO: 823111 - RNA, 17 nt, Mycobacterium avium subsp. paratuberculosis
cgccuccgcccgggugc

SEQ ID NO: 823112 - RNA, 22 nt, Mycobacterium avium subsp. paratuberculosis
cgccuccgcccgggugcaggcc

SEQ ID NO: 823113 - RNA, 12 nt, Mycobacterium avium subsp. paratuberculosis
cgccuccggcag

SEQ ID NO: 823114 - RNA, 20 nt, Mycobacterium avium subsp. paratuberculosis
cgccuccggcaguacgcgcc

SEQ ID NO: 823115 - RNA, 12 nt, Mycobacterium avium subsp. paratuberculosis
cgccuccgggaa

SEQ ID NO: 823116 - RNA, 20 nt, Mycobacterium avium subsp. paratuberculosis
cgccuccgggaaggcggccg

SEQ ID NO: 823117 - RNA, 14 nt, Mycobacterium avium subsp. paratuberculosis
cgccuccgccgccc

SEQ ID NO: 823118 - RNA, 12 nt, Mycobacterium avium subsp. paratuberculosis
cgccucccgcag

SEQ ID NO: 823119 - RNA, 15 nt, Mycobacterium avium subsp. paratuberculosis
cgccucccgcagcgc

SEQ ID NO: 823120 - RNA, 19 nt, Mycobacterium avium subsp. paratuberculosis
cgccuccgacagccgcacc

SEQ ID NO: 823121 - RNA, 14 nt, Mycobacterium avium subsp. paratuberculosis
cgccuccgacgacg

SEQ ID NO: 823122 - RNA, 20 nt, Mycobacterium avium subsp. paratuberculosis
cgccuccgagauggacagca

SEQ ID NO: 823123 - RNA, 23 nt, Mycobacterium avium subsp. paratuberculosis
cgccuccgagauggacagcaccu

SEQ ID NO: 823124 - RNA, 18 nt, Mycobacterium avium subsp. paratuberculosis
cgccucccccacccgcac

SEQ ID NO: 823125 - RNA, 23 nt, Mycobacterium avium subsp. paratuberculosis
cgccuccauucgggccagcgccg

SEQ ID NO: 823126 - RNA, 23 nt, Mycobacterium avium subsp. paratuberculosis
cgccguuucggacgagccgucgc

SEQ ID NO: 823127 - RNA, 21 nt, Mycobacterium avium subsp. paratuberculosis
cgccguuuugccgccgagcgu

SEQ ID NO: 823128 - RNA, 23 nt, Mycobacterium avium subsp. paratuberculosis
cgccguuuugccgccgagcguga

SEQ ID NO: 823129 - RNA, 11 nt, Mycobacterium avium subsp. paratuberculosis
cgccguuggcg

SEQ ID NO: 823130 - RNA, 14 nt, Mycobacterium avium subsp. paratuberculosis
cgccguugcggguc

SEQ ID NO: 823131 - RNA, 21 nt, Mycobacterium avium subsp. paratuberculosis
cgccguugcgggucggcguca

SEQ ID NO: 823132 - RNA, 22 nt, Mycobacterium avium subsp. paratuberculosis
cgccguugcgggucggcgucac

SEQ ID NO: 823133 - RNA, 20 nt, Mycobacterium avium subsp. paratuberculosis
cgccguugcggugcucgucg

SEQ ID NO: 823134 - RNA, 20 nt, Mycobacterium avium subsp. paratuberculosis
cgccguugcgagucaucgcc

SEQ ID NO: 823135 - RNA, 15 nt, Mycobacterium avium subsp. paratuberculosis
cgccguugcggccca

SEQ ID NO: 823136 - RNA, 16 nt, Mycobacterium avium subsp. paratuberculosis
cgccguugcggcccac

SEQ ID NO: 823137 - RNA, 17 nt, Mycobacterium avium subsp. paratuberculosis
cgccguugguggucugc

SEQ ID NO: 823138 - RNA, 18 nt, Mycobacterium avium subsp. paratuberculosis
cgccguuguaggccgcgc

SEQ ID NO: 823139 - RNA, 21 nt, Mycobacterium avium subsp. paratuberculosis
cgccguuguaggccgcgcggu

SEQ ID NO: 823140 - RNA, 23 nt, Mycobacterium avium subsp. paratuberculosis
cgccguuguaggccgcgcggugc

SEQ ID NO: 823141 - RNA, 22 nt, Mycobacterium avium subsp. paratuberculosis
cgccguuggcguggauggccgg

SEQ ID NO: 823142 - RNA, 12 nt, Mycobacterium avium subsp. paratuberculosis
cgccguuucagc

SEQ ID NO: 823143 - RNA, 18 nt, Mycobacterium avium subsp. paratuberculosis
cgccguuucagcagcgcg

SEQ ID NO: 823144 - RNA, 23 nt, Mycobacterium avium subsp. paratuberculosis
cgccguuucagcagcgcguaggu

SEQ ID NO: 823145 - RNA, 15 nt, Mycobacterium avium subsp. paratuberculosis
cgccugcaccggcga

SEQ ID NO: 823146 - RNA, 17 nt, Mycobacterium avium subsp. paratuberculosis
cgccugcaccggcgacg

SEQ ID NO: 823147 - RNA, 16 nt, Mycobacterium avium subsp. paratuberculosis
cgccugcagccgccgc

SEQ ID NO: 823148 - RNA, 23 nt, Mycobacterium avium subsp. paratuberculosis
cgccugcacgaaauaaccgcgcg

SEQ ID NO: 823149 - RNA, 14 nt, Mycobacterium avium subsp. paratuberculosis
cgccugcgccgccg

SEQ ID NO: 823150 - RNA, 17 nt, Mycobacterium avium subsp. paratuberculosis
cgccugcgccgccguag

SEQ ID NO: 823151 - RNA, 13 nt, Mycobacterium avium subsp. paratuberculosis
cgccugcgcgauc

SEQ ID NO: 823152 - RNA, 17 nt, Mycobacterium avium subsp. paratuberculosis
cgccugcgcgaucgccg

SEQ ID NO: 823153 - RNA, 22 nt, Mycobacterium avium subsp. paratuberculosis
cgccugcgcgaucgccggaucg

SEQ ID NO: 823154 - RNA, 15 nt, Mycobacterium avium subsp. paratuberculosis
cgccugcgcggcggc

SEQ ID NO: 823155 - RNA, 17 nt, Mycobacterium avium subsp. paratuberculosis
cgccugcgcggcggcgu

SEQ ID NO: 823156 - RNA, 19 nt, Mycobacterium avium subsp. paratuberculosis
cgccugcgcggcggcgucc

SEQ ID NO: 823157 - RNA, 20 nt, Mycobacterium avium subsp. paratuberculosis
cgccugcgcggcggcguccg

SEQ ID NO: 823158 - RNA, 15 nt, Mycobacterium avium subsp. paratuberculosis
cgccugcgcgggcgc

SEQ ID NO: 823159 - RNA, 18 nt, Mycobacterium avium subsp. paratuberculosis
cgccugcgcgggcgcgga

SEQ ID NO: 823160 - RNA, 14 nt, Mycobacterium avium subsp. paratuberculosis
cgccuccaggugaa

SEQ ID NO: 823161 - RNA, 14 nt, Mycobacterium avium subsp. paratuberculosis
cgccucgucgaccg

SEQ ID NO: 823162 - RNA, 18 nt, Mycobacterium avium subsp. paratuberculosis
cgccucgucgaccgcggc

SEQ ID NO: 823163 - RNA, 13 nt, Mycobacterium avium subsp. paratuberculosis
cgccucgucgagc

SEQ ID NO: 823164 - RNA, 23 nt, Mycobacterium avium subsp. paratuberculosis
cgccucgucgagcagcgcccggc

SEQ ID NO: 823165 - RNA, 19 nt, Mycobacterium avium subsp. paratuberculosis
cgccucgucgagccgggcc

SEQ ID NO: 823166 - RNA, 20 nt, Mycobacterium avium subsp. paratuberculosis
cgccucgucgagccgggccc

SEQ ID NO: 823167 - RNA, 12 nt, Mycobacterium avium subsp. paratuberculosis
cgccucggugcg

SEQ ID NO: 823168 - RNA, 20 nt, Mycobacterium avium subsp. paratuberculosis
cgccucggugcggaacaccg

SEQ ID NO: 823169 - RNA, 17 nt, Mycobacterium avium subsp. paratuberculosis
cgccucgguggucgacg

SEQ ID NO: 823170 - RNA, 20 nt, Mycobacterium avium subsp. paratuberculosis
cgccucgguggucgacgagc

SEQ ID NO: 823171 - RNA, 17 nt, Mycobacterium avium subsp. paratuberculosis
cgccucgggccggcagc

SEQ ID NO: 823172 - RNA, 19 nt, Mycobacterium avium subsp. paratuberculosis
cgccucgggccggcagccg

SEQ ID NO: 823173 - RNA, 21 nt, Mycobacterium avium subsp. paratuberculosis
cgccucgggccggcagccggc

SEQ ID NO: 823174 - RNA, 14 nt, Mycobacterium avium subsp. paratuberculosis
cgccucggcggccg

SEQ ID NO: 823175 - RNA, 21 nt, Mycobacterium avium subsp. paratuberculosis
cgccucggcggccgcccgggc

SEQ ID NO: 823176 - RNA, 15 nt, Mycobacterium avium subsp. paratuberculosis
cgccucggcgggccg

SEQ ID NO: 823177 - RNA, 16 nt, Mycobacterium avium subsp. paratuberculosis
cgccucggcgggccgc

SEQ ID NO: 823178 - RNA, 21 nt, Mycobacterium avium subsp. paratuberculosis
cgccucggcgggccgcccggc

SEQ ID NO: 823179 - RNA, 13 nt, Mycobacterium avium subsp. paratuberculosis
cgccucggcgucc

SEQ ID NO: 823180 - RNA, 14 nt, Mycobacterium avium subsp. paratuberculosis
cgccucggcguccc

SEQ ID NO: 823181 - RNA, 18 nt, Mycobacterium avium subsp. paratuberculosis
cgccucggcgucccggcg

SEQ ID NO: 823182 - RNA, 12 nt, Mycobacterium avium subsp. paratuberculosis
cgccucggcgug

SEQ ID NO: 823183 - RNA, 13 nt, Mycobacterium avium subsp. paratuberculosis
cgccucggcgugg

SEQ ID NO: 823184 - RNA, 15 nt, Mycobacterium avium subsp. paratuberculosis
cgccggaucgagcac

SEQ ID NO: 823185 - RNA, 17 nt, Mycobacterium avium subsp. paratuberculosis
cgccggaucgagcaccc

SEQ ID NO: 823186 - RNA, 17 nt, Mycobacterium avium subsp. paratuberculosis
cgccggaucaugucguu

SEQ ID NO: 823187 - RNA, 21 nt, Mycobacterium avium subsp. paratuberculosis
cgccggaucgugucccggcgc

SEQ ID NO: 823188 - RNA, 22 nt, Mycobacterium avium subsp. paratuberculosis
cgccggaucgugucccggcgcc

SEQ ID NO: 823189 - RNA, 17 nt, Mycobacterium avium subsp. paratuberculosis
cgccggauuacucgccg

SEQ ID NO: 823190 - RNA, 18 nt, Mycobacterium avium subsp. paratuberculosis
cgccggauuacucgccgg

SEQ ID NO: 823191 - RNA, 19 nt, Mycobacterium avium subsp. paratuberculosis
cgccggauuacucgccggc

SEQ ID NO: 823192 - RNA, 22 nt, Mycobacterium avium subsp. paratuberculosis
cgccggauuacucgccggcggc

SEQ ID NO: 823193 - RNA, 23 nt, Mycobacterium avium subsp. paratuberculosis
cgccggauuacucgccggcggcg

SEQ ID NO: 823194 - RNA, 13 nt, Mycobacterium avium subsp. paratuberculosis
cgccggaugcggc

SEQ ID NO: 823195 - RNA, 15 nt, Mycobacterium avium subsp. paratuberculosis
cgccggaugcggcuc

SEQ ID NO: 823196 - RNA, 14 nt, Mycobacterium avium subsp. paratuberculosis
cgccggaucgccga

SEQ ID NO: 823197 - RNA, 15 nt, Mycobacterium avium subsp. paratuberculosis
cgccggaucgccgag

SEQ ID NO: 823198 - RNA, 15 nt, Mycobacterium avium subsp. paratuberculosis
cgccggaucggcccc

SEQ ID NO: 823199 - RNA, 21 nt, Mycobacterium avium subsp. paratuberculosis
cgccggaugccagcagguccg

SEQ ID NO: 823200 - RNA, 23 nt, Mycobacterium avium subsp. paratuberculosis
cgccggccaccagggucucgcgc

SEQ ID NO: 823201 - RNA, 20 nt, Mycobacterium avium subsp. paratuberculosis
cgccggccaccaacaggucg

SEQ ID NO: 823202 - RNA, 13 nt, Mycobacterium avium subsp. paratuberculosis
cgccggccaccag

SEQ ID NO: 823203 - RNA, 16 nt, Mycobacterium avium subsp. paratuberculosis
cgccggauucggcgcg

SEQ ID NO: 823204 - RNA, 13 nt, Mycobacterium avium subsp. paratuberculosis
cgccggcccaggc

SEQ ID NO: 823205 - RNA, 21 nt, Mycobacterium avium subsp. paratuberculosis
cgccggccaggauggagcuga

SEQ ID NO: 823206 - RNA, 13 nt, Mycobacterium avium subsp. paratuberculosis
cgccggcccagac

SEQ ID NO: 823207 - RNA, 23 nt, Mycobacterium avium subsp. paratuberculosis
cgccggcccagacgguuccaccg

SEQ ID NO: 823208 - RNA, 12 nt, Mycobacterium avium subsp. paratuberculosis
cgccggccaggc

SEQ ID NO: 823209 - RNA, 13 nt, Mycobacterium avium subsp. paratuberculosis
cgccggccaggcc

SEQ ID NO: 823210 - RNA, 14 nt, Mycobacterium avium subsp. paratuberculosis
cgccggccaggccg

SEQ ID NO: 823211 - RNA, 15 nt, Mycobacterium avium subsp. paratuberculosis
cgccggccaggccgg

SEQ ID NO: 823212 - RNA, 20 nt, Mycobacterium avium subsp. paratuberculosis
cgccggccaggcgacugucc

SEQ ID NO: 823213 - RNA, 15 nt, Mycobacterium avium subsp. paratuberculosis
cgccggccagcuccg

SEQ ID NO: 823214 - RNA, 21 nt, Mycobacterium avium subsp. paratuberculosis
cgccggccagcuccgccaccc

SEQ ID NO: 823215 - RNA, 22 nt, Mycobacterium avium subsp. paratuberculosis
cgccggccagcuccgccacccu

SEQ ID NO: 823216 - RNA, 13 nt, Mycobacterium avium subsp. paratuberculosis
cgccggccagccg

SEQ ID NO: 823217 - RNA, 14 nt, Mycobacterium avium subsp. paratuberculosis
cgccggccagccgg

SEQ ID NO: 823218 - RNA, 16 nt, Mycobacterium avium subsp. paratuberculosis
cgccggccagccggcu

SEQ ID NO: 823219 - RNA, 16 nt, Mycobacterium avium subsp. paratuberculosis
cgccggccagcacgcc

SEQ ID NO: 823220 - RNA, 17 nt, Mycobacterium avium subsp. paratuberculosis
cgccggccagcacgccg

SEQ ID NO: 823221 - RNA, 18 nt, Mycobacterium avium subsp. paratuberculosis
cgccggccagcacgccgu

SEQ ID NO: 823222 - RNA, 21 nt, Mycobacterium avium subsp. paratuberculosis
cgccggccagcacgccguccu

SEQ ID NO: 823223 - RNA, 15 nt, Mycobacterium avium subsp. paratuberculosis
cgccggccagcacgg

SEQ ID NO: 823224 - RNA, 22 nt, Mycobacterium avium subsp. paratuberculosis
cgccggccagcacggccagcca

SEQ ID NO: 823225 - RNA, 21 nt, Mycobacterium avium subsp. paratuberculosis
cgccggccacguaguccgacg

SEQ ID NO: 823226 - RNA, 12 nt, Mycobacterium avium subsp. paratuberculosis
cgccggccagca

SEQ ID NO: 823227 - RNA, 13 nt, Mycobacterium avium subsp. paratuberculosis
cgccggccagcac

SEQ ID NO: 823228 - RNA, 15 nt, Mycobacterium avium subsp. paratuberculosis
cgccggccagcacca

SEQ ID NO: 823229 - RNA, 16 nt, Mycobacterium avium subsp. paratuberculosis
cgccggccagcaccac

SEQ ID NO: 823230 - RNA, 17 nt, Mycobacterium avium subsp. paratuberculosis
cgccggccuuggcccgc

SEQ ID NO: 823231 - RNA, 18 nt, Mycobacterium avium subsp. paratuberculosis
cgccggccuuggcccgcg

SEQ ID NO: 823232 - RNA, 22 nt, Mycobacterium avium subsp. paratuberculosis
cgccggccuuggcccgcgcccg

SEQ ID NO: 823233 - RNA, 21 nt, Mycobacterium avium subsp. paratuberculosis
cgccggcgaacgacgucgagg

SEQ ID NO: 823234 - RNA, 17 nt, Mycobacterium avium subsp. paratuberculosis
cgccggccucucgucga

SEQ ID NO: 823235 - RNA, 19 nt, Mycobacterium avium subsp. paratuberculosis
cgccggccucucgucgacg

SEQ ID NO: 823236 - RNA, 20 nt, Mycobacterium avium subsp. paratuberculosis
cgccggccugcccgccgcgg

SEQ ID NO: 823237 - RNA, 21 nt, Mycobacterium avium subsp. paratuberculosis
cgccggccugcccgccgcggc

SEQ ID NO: 823238 - RNA, 16 nt, Mycobacterium avium subsp. paratuberculosis
cgccggccuccagcug

SEQ ID NO: 823239 - RNA, 13 nt, Mycobacterium avium subsp. paratuberculosis
cgccggccgccag

SEQ ID NO: 823240 - RNA, 17 nt, Mycobacterium avium subsp. paratuberculosis
cgccggccgggcugcgc

SEQ ID NO: 823241 - RNA, 23 nt, Mycobacterium avium subsp. paratuberculosis
cgccggccgggcugcgcagcacc

SEQ ID NO: 823242 - RNA, 12 nt, Mycobacterium avium subsp. paratuberculosis
cgccggccguca

SEQ ID NO: 823243 - RNA, 18 nt, Mycobacterium avium subsp. paratuberculosis
cgccggccgucacgcugg

SEQ ID NO: 823244 - RNA, 19 nt, Mycobacterium avium subsp. paratuberculosis
cgccggccgucacgcuggc

SEQ ID NO: 823245 - RNA, 16 nt, Mycobacterium avium subsp. paratuberculosis
cgccggccggcgcgug

SEQ ID NO: 823246 - RNA, 23 nt, Mycobacterium avium subsp. paratuberculosis
cgccggccggcgcgugcgcgacg

SEQ ID NO: 823247 - RNA, 17 nt, Mycobacterium avium subsp. paratuberculosis
cgccggccggcggucag

SEQ ID NO: 823248 - RNA, 13 nt, Mycobacterium avium subsp. paratuberculosis
cgccggccggcgu

SEQ ID NO: 823249 - RNA, 15 nt, Mycobacterium avium subsp. paratuberculosis
cgccggccggcgugg

SEQ ID NO: 823250 - RNA, 18 nt, Mycobacterium avium subsp. paratuberculosis
cgccggccggcgugggaa

SEQ ID NO: 823251 - RNA, 14 nt, Mycobacterium avium subsp. paratuberculosis
cgccggccgcgcgu

SEQ ID NO: 823252 - RNA, 13 nt, Mycobacterium avium subsp. paratuberculosis
cgccggccgcggu

SEQ ID NO: 823253 - RNA, 16 nt, Mycobacterium avium subsp. paratuberculosis
cgccggccgcggugug

SEQ ID NO: 823254 - RNA, 22 nt, Mycobacterium avium subsp. paratuberculosis
cgccggccgcggugugcccggc

SEQ ID NO: 823255 - RNA, 12 nt, Mycobacterium avium subsp. paratuberculosis
cgccggccgcuc

SEQ ID NO: 823256 - RNA, 15 nt, Mycobacterium avium subsp. paratuberculosis
cgccggccgcucgcg

SEQ ID NO: 823257 - RNA, 12 nt, Mycobacterium avium subsp. paratuberculosis
cgccggccggac

SEQ ID NO: 823258 - RNA, 23 nt, Mycobacterium avium subsp. paratuberculosis
cgccggccggacagaucgcccau

SEQ ID NO: 823259 - RNA, 16 nt, Mycobacterium avium subsp. paratuberculosis
cgccggccggagcgga

SEQ ID NO: 823260 - RNA, 21 nt, Mycobacterium avium subsp. paratuberculosis
cgccggccggagcggauggcg

SEQ ID NO: 823261 - RNA, 13 nt, Mycobacterium avium subsp. paratuberculosis
cgccggccggcac

SEQ ID NO: 823262 - RNA, 14 nt, Mycobacterium avium subsp. paratuberculosis
cgccggccggcacg

SEQ ID NO: 823263 - RNA, 20 nt, Mycobacterium avium subsp. paratuberculosis
cgccggccggcacgauggcg

SEQ ID NO: 823264 - RNA, 12 nt, Mycobacterium avium subsp. paratuberculosis
cgccggccgcgc

SEQ ID NO: 823265 - RNA, 14 nt, Mycobacterium avium subsp. paratuberculosis
cgccggccgccgga

SEQ ID NO: 823266 - RNA, 14 nt, Mycobacterium avium subsp. paratuberculosis
cgccggccgccagc

SEQ ID NO: 823267 - RNA, 12 nt, Mycobacterium avium subsp. paratuberculosis
cgccggccgcca

SEQ ID NO: 823268 - RNA, 13 nt, Mycobacterium avium subsp. paratuberculosis
cgccggcccagcu

SEQ ID NO: 823269 - RNA, 12 nt, Mycobacterium avium subsp. paratuberculosis
cgccggccgaca

SEQ ID NO: 823270 - RNA, 17 nt, Mycobacterium avium subsp. paratuberculosis
cgccggcccgcggcgga

SEQ ID NO: 823271 - RNA, 14 nt, Mycobacterium avium subsp. paratuberculosis
cgccggcccggcgu

SEQ ID NO: 823272 - RNA, 16 nt, Mycobacterium avium subsp. paratuberculosis
cgccggcccggcguua

SEQ ID NO: 823273 - RNA, 15 nt, Mycobacterium avium subsp. paratuberculosis
cgccggccccggcga

SEQ ID NO: 823274 - RNA, 20 nt, Mycobacterium avium subsp. paratuberculosis
cgccggcccgaccggagccg

SEQ ID NO: 823275 - RNA, 23 nt, Mycobacterium avium subsp. paratuberculosis
cgccggcccgaccggagccgucu

SEQ ID NO: 823276 - RNA, 22 nt, Mycobacterium avium subsp. paratuberculosis
cgccgcgucgugccgagcguga

SEQ ID NO: 823277 - RNA, 15 nt, Mycobacterium avium subsp. paratuberculosis
cgccgcguggccucc

SEQ ID NO: 823278 - RNA, 18 nt, Mycobacterium avium subsp. paratuberculosis
cgccgcguggccucccgg

SEQ ID NO: 823279 - RNA, 19 nt, Mycobacterium avium subsp. paratuberculosis
cgccgcguggccucccggu

SEQ ID NO: 823280 - RNA, 14 nt, Mycobacterium avium subsp. paratuberculosis
cgccgcguucggcg

SEQ ID NO: 823281 - RNA, 15 nt, Mycobacterium avium subsp. paratuberculosis
cgccgcguucggcgg

SEQ ID NO: 823282 - RNA, 16 nt, Mycobacterium avium subsp. paratuberculosis
cgccgcguucggcggc

SEQ ID NO: 823283 - RNA, 17 nt, Mycobacterium avium subsp. paratuberculosis
cgccgcguucggcggcg

SEQ ID NO: 823284 - RNA, 16 nt, Mycobacterium avium subsp. paratuberculosis
cgccgcguugucggcg

SEQ ID NO: 823285 - RNA, 18 nt, Mycobacterium avium subsp. paratuberculosis
cgccgcguugucggcguc

SEQ ID NO: 823286 - RNA, 19 nt, Mycobacterium avium subsp. paratuberculosis
cgccgcuagaccgauggcg

SEQ ID NO: 823287 - RNA, 23 nt, Mycobacterium avium subsp. paratuberculosis
cgccgcuagaccgauggcggcgg

SEQ ID NO: 823288 - RNA, 22 nt, Mycobacterium avium subsp. paratuberculosis
cgccgcucggccagcagcacca

SEQ ID NO: 823289 - RNA, 21 nt, Mycobacterium avium subsp. paratuberculosis
cgccgcucggccagcgcagcg

SEQ ID NO: 823290 - RNA, 22 nt, Mycobacterium avium subsp. paratuberculosis
cgccgcguucacccgcgcccgc

SEQ ID NO: 823291 - RNA, 20 nt, Mycobacterium avium subsp. paratuberculosis
cgccgccguguaggccgcgc

SEQ ID NO: 823292 - RNA, 17 nt, Mycobacterium avium subsp. paratuberculosis
cgccgccguucgccggc

SEQ ID NO: 823293 - RNA, 15 nt, Mycobacterium avium subsp. paratuberculosis
cgccgccggugccga

SEQ ID NO: 823294 - RNA, 16 nt, Mycobacterium avium subsp. paratuberculosis
cgccgccggugccgac

SEQ ID NO: 823295 - RNA, 14 nt, Mycobacterium avium subsp. paratuberculosis
cgccgccgguggag

SEQ ID NO: 823296 - RNA, 22 nt, Mycobacterium avium subsp. paratuberculosis
cgccgccgguggagauggccag

SEQ ID NO: 823297 - RNA, 18 nt, Mycobacterium avium subsp. paratuberculosis
cgccgccgucccaccggc

SEQ ID NO: 823298 - RNA, 14 nt, Mycobacterium avium subsp. paratuberculosis
cgccgccgucggug

SEQ ID NO: 823299 - RNA, 12 nt, Mycobacterium avium subsp. paratuberculosis
cgccgccgucgu

SEQ ID NO: 823300 - RNA, 15 nt, Mycobacterium avium subsp. paratuberculosis
cgccgccgucguagc

SEQ ID NO: 823301 - RNA, 22 nt, Mycobacterium avium subsp. paratuberculosis
cgccgccgucguagccgcgggu

SEQ ID NO: 823302 - RNA, 13 nt, Mycobacterium avium subsp. paratuberculosis
cgccgcuucgucg

SEQ ID NO: 823303 - RNA, 15 nt, Mycobacterium avium subsp. paratuberculosis
cgccgcuucgucgcc

SEQ ID NO: 823304 - RNA, 18 nt, Mycobacterium avium subsp. paratuberculosis
cgccgcuucgucgccggc

SEQ ID NO: 823305 - RNA, 19 nt, Mycobacterium avium subsp. paratuberculosis
cgccgcuucgucgccggcc

SEQ ID NO: 823306 - RNA, 21 nt, Mycobacterium avium subsp. paratuberculosis
cgccgcuucgucgccggccgc

SEQ ID NO: 823307 - RNA, 14 nt, Mycobacterium avium subsp. paratuberculosis
cgccgcugccgggg

SEQ ID NO: 823308 - RNA, 16 nt, Mycobacterium avium subsp. paratuberculosis
cgccgcugccggggug

SEQ ID NO: 823309 - RNA, 23 nt, Mycobacterium avium subsp. paratuberculosis
cgccgcugccggggugcagcacc

SEQ ID NO: 823310 - RNA, 24 nt, Mycobacterium avium subsp. paratuberculosis
cgccgcugacugcgaucgccgacg

SEQ ID NO: 823311 - RNA, 17 nt, Mycobacterium avium subsp. paratuberculosis
cgccgcucuucgacgac

SEQ ID NO: 823312 - RNA, 18 nt, Mycobacterium avium subsp. paratuberculosis
cgccgcucuucgacgacc

SEQ ID NO: 823313 - RNA, 22 nt, Mycobacterium avium subsp. paratuberculosis
cgccgcucuucgacgacccgau

SEQ ID NO: 823314 - RNA, 14 nt, Mycobacterium avium subsp. paratuberculosis
cgccgcucgucggc

SEQ ID NO: 823315 - RNA, 16 nt, Mycobacterium avium subsp. paratuberculosis
cgccgcucgucgggca

SEQ ID NO: 823316 - RNA, 18 nt, Mycobacterium avium subsp. paratuberculosis
cgccgcucgucgggcaca

SEQ ID NO: 823317 - RNA, 17 nt, Mycobacterium avium subsp. paratuberculosis
cgccgcugacgcggcgg

SEQ ID NO: 823318 - RNA, 17 nt, Mycobacterium avium subsp. paratuberculosis
cgccggagagcccgucg

SEQ ID NO: 823319 - RNA, 15 nt, Mycobacterium avium subsp. paratuberculosis
cgccggagaccagca

SEQ ID NO: 823320 - RNA, 16 nt, Mycobacterium avium subsp. paratuberculosis
cgccggagaccagcag

SEQ ID NO: 823321 - RNA, 13 nt, Mycobacterium avium subsp. paratuberculosis
cgccggaacggga

SEQ ID NO: 823322 - RNA, 23 nt, Mycobacterium avium subsp. paratuberculosis
cgccggaacgggaagaucgucgu

SEQ ID NO: 823323 - RNA, 17 nt, Mycobacterium avium subsp. paratuberculosis
cgccggaacucggccgg

SEQ ID NO: 823324 - RNA, 18 nt, Mycobacterium avium subsp. paratuberculosis
cgccggaacucggccggc

SEQ ID NO: 823325 - RNA, 19 nt, Mycobacterium avium subsp. paratuberculosis
cgccggaacucggccggca

SEQ ID NO: 823326 - RNA, 20 nt, Mycobacterium avium subsp. paratuberculosis
cgccggaacucggccggcac

SEQ ID NO: 823327 - RNA, 15 nt, Mycobacterium avium subsp. paratuberculosis
cgccggaggggcgac

SEQ ID NO: 823328 - RNA, 16 nt, Mycobacterium avium subsp. paratuberculosis
cgccggaggggcgacg

SEQ ID NO: 823329 - RNA, 17 nt, Mycobacterium avium subsp. paratuberculosis
cgccggaggggcgacgg

SEQ ID NO: 823330 - RNA, 19 nt, Mycobacterium avium subsp. paratuberculosis
cgccggagcgccccagggc

SEQ ID NO: 823331 - RNA, 20 nt, Mycobacterium avium subsp. paratuberculosis
cgccggagaugaucaugucg

SEQ ID NO: 823332 - RNA, 17 nt, Mycobacterium avium subsp. paratuberculosis
cgccggagccgaucgcc

SEQ ID NO: 823333 - RNA, 15 nt, Mycobacterium avium subsp. paratuberculosis
cgccggaggccagcu

SEQ ID NO: 823334 - RNA, 17 nt, Mycobacterium avium subsp. paratuberculosis
cgccggaggccagcucg

SEQ ID NO: 823335 - RNA, 23 nt, Mycobacterium avium subsp. paratuberculosis
cgccggaggccagcucgaccgcg

SEQ ID NO: 823336 - RNA, 14 nt, Mycobacterium avium subsp. paratuberculosis
cgccggaguucagc

SEQ ID NO: 823337 - RNA, 21 nt, Mycobacterium avium subsp. paratuberculosis
cgccggaguugccgauggcgg

SEQ ID NO: 823338 - RNA, 22 nt, Mycobacterium avium subsp. paratuberculosis
cgccggaguugccgauggcggu

SEQ ID NO: 823339 - RNA, 15 nt, Mycobacterium avium subsp. paratuberculosis
cgccgggcgucgcgc

SEQ ID NO: 823340 - RNA, 19 nt, Mycobacterium avium subsp. paratuberculosis
cgccgggcugaccgucgac

SEQ ID NO: 823341 - RNA, 19 nt, Mycobacterium avium subsp. paratuberculosis
cgccgggcugcacgcugcg

SEQ ID NO: 823342 - RNA, 20 nt, Mycobacterium avium subsp. paratuberculosis
cgccgggcugcacgcugcgc

SEQ ID NO: 823343 - RNA, 14 nt, Mycobacterium avium subsp. paratuberculosis
cgccgggcuggccg

SEQ ID NO: 823344 - RNA, 20 nt, Mycobacterium avium subsp. paratuberculosis
cgccgggcuggccgucggcg

SEQ ID NO: 823345 - RNA, 23 nt, Mycobacterium avium subsp. paratuberculosis
cgccgggcuggccgucggcgaug

SEQ ID NO: 823346 - RNA, 14 nt, Mycobacterium avium subsp. paratuberculosis
cgccgggcgggccg

SEQ ID NO: 823347 - RNA, 16 nt, Mycobacterium avium subsp. paratuberculosis
cgccgggcgggccgca

SEQ ID NO: 823348 - RNA, 18 nt, Mycobacterium avium subsp. paratuberculosis
cgccgggcgggccgcagc

SEQ ID NO: 823349 - RNA, 19 nt, Mycobacterium avium subsp. paratuberculosis
cgccgggcgggcgcaggug

SEQ ID NO: 823350 - RNA, 17 nt, Mycobacterium avium subsp. paratuberculosis
cgccgggcgggguggug

SEQ ID NO: 823351 - RNA, 17 nt, Mycobacterium avium subsp. paratuberculosis
cgccgggcggguacugg

SEQ ID NO: 823352 - RNA, 12 nt, Mycobacterium avium subsp. paratuberculosis
cgccgggcguca

SEQ ID NO: 823353 - RNA, 18 nt, Mycobacterium avium subsp. paratuberculosis
cgccgggcgucacgccag

SEQ ID NO: 823354 - RNA, 20 nt, Mycobacterium avium subsp. paratuberculosis
cgccgggcgucacgccagcg

SEQ ID NO: 823355 - RNA, 22 nt, Mycobacterium avium subsp. paratuberculosis
cgccgggcgucacgccagcgug

SEQ ID NO: 823356 - RNA, 15 nt, Mycobacterium avium subsp. paratuberculosis
cgccgggcgucacuc

SEQ ID NO: 823357 - RNA, 19 nt, Mycobacterium avium subsp. paratuberculosis
cgccgggcguugcccgccg

SEQ ID NO: 823358 - RNA, 20 nt, Mycobacterium avium subsp. paratuberculosis
cgccgggcguugcccgccgc

SEQ ID NO: 823359 - RNA, 23 nt, Mycobacterium avium subsp. paratuberculosis
cgccgggcguugcccgccgcggc

SEQ ID NO: 823360 - RNA, 15 nt, Mycobacterium avium subsp. paratuberculosis
cgccggggaacaccg

SEQ ID NO: 823361 - RNA, 20 nt, Mycobacterium avium subsp. paratuberculosis
cgccggggaacaccggcgag

SEQ ID NO: 823362 - RNA, 20 nt, Mycobacterium avium subsp. paratuberculosis
cgccggggaagaucucggcc

SEQ ID NO: 823363 - RNA, 17 nt, Mycobacterium avium subsp. paratuberculosis
cgccggggacccgcacc

SEQ ID NO: 823364 - RNA, 14 nt, Mycobacterium avium subsp. paratuberculosis
cgccggggacgacg

SEQ ID NO: 823365 - RNA, 15 nt, Mycobacterium avium subsp. paratuberculosis
cgccggggacgacgg

SEQ ID NO: 823366 - RNA, 20 nt, Mycobacterium avium subsp. paratuberculosis
cgccggggacgacggcgggg

SEQ ID NO: 823367 - RNA, 18 nt, Mycobacterium avium subsp. paratuberculosis
cgccggggucgacagccu

SEQ ID NO: 823368 - RNA, 18 nt, Mycobacterium avium subsp. paratuberculosis
cgccggggucgcgcgcga

SEQ ID NO: 823369 - RNA, 16 nt, Mycobacterium avium subsp. paratuberculosis
cgccggggugcaccgu

SEQ ID NO: 823370 - RNA, 18 nt, Mycobacterium avium subsp. paratuberculosis
cgccgggguguccagcgg

SEQ ID NO: 823371 - RNA, 19 nt, Mycobacterium avium subsp. paratuberculosis
cgccgggguuuucgugguc

SEQ ID NO: 823372 - RNA, 13 nt, Mycobacterium avium subsp. paratuberculosis
cgccgggcggcgu

SEQ ID NO: 823373 - RNA, 15 nt, Mycobacterium avium subsp. paratuberculosis
cgccgggcggcgucc

SEQ ID NO: 823374 - RNA, 18 nt, Mycobacterium avium subsp. paratuberculosis
cgccgggcggcguccucg

SEQ ID NO: 823375 - RNA, 20 nt, Mycobacterium avium subsp. paratuberculosis
cgccgggcggaugucggugu

SEQ ID NO: 823376 - RNA, 22 nt, Mycobacterium avium subsp. paratuberculosis
cgccgggcggaugucggugugg

SEQ ID NO: 823377 - RNA, 15 nt, Mycobacterium avium subsp. paratuberculosis
cgccgggcggcccgc

SEQ ID NO: 823378 - RNA, 21 nt, Mycobacterium avium subsp. paratuberculosis
cgccgggcggccucggcgucc

SEQ ID NO: 823379 - RNA, 24 nt, Mycobacterium avium subsp. paratuberculosis
cgccgggacgggcauccggcucag

SEQ ID NO: 823380 - RNA, 13 nt, Mycobacterium avium subsp. paratuberculosis
cgccgggcgccac

SEQ ID NO: 823381 - RNA, 15 nt, Mycobacterium avium subsp. paratuberculosis
cgccgggcgccaccc

SEQ ID NO: 823382 - RNA, 13 nt, Mycobacterium avium subsp. paratuberculosis
cgccgggcgcccg

SEQ ID NO: 823383 - RNA, 14 nt, Mycobacterium avium subsp. paratuberculosis
cgccgggcgcccga

SEQ ID NO: 823384 - RNA, 14 nt, Mycobacterium avium subsp. paratuberculosis
cgccgggcgcccgc

SEQ ID NO: 823385 - RNA, 16 nt, Mycobacterium avium subsp. paratuberculosis
cgccgggcgaagucgc

SEQ ID NO: 823386 - RNA, 19 nt, Mycobacterium avium subsp. paratuberculosis
cgccgggcgaagucgccgg

SEQ ID NO: 823387 - RNA, 23 nt, Mycobacterium avium subsp. paratuberculosis
cgccgggcgaagucgccggccag

SEQ ID NO: 823388 - RNA, 18 nt, Mycobacterium avium subsp. paratuberculosis
cgccgggaaaguuguagc

SEQ ID NO: 823389 - RNA, 23 nt, Mycobacterium avium subsp. paratuberculosis
cgccgggauaacccagcaccacc

SEQ ID NO: 823390 - RNA, 15 nt, Mycobacterium avium subsp. paratuberculosis
cgccgggccugucca

SEQ ID NO: 823391 - RNA, 19 nt, Mycobacterium avium subsp. paratuberculosis
cgccgggccuguccagccg

SEQ ID NO: 823392 - RNA, 21 nt, Mycobacterium avium subsp. paratuberculosis
cgccgggccuguccagccggu

SEQ ID NO: 823393 - RNA, 17 nt, Mycobacterium avium subsp. paratuberculosis
cgccgggaacagcgacg

SEQ ID NO: 823394 - RNA, 22 nt, Mycobacterium avium subsp. paratuberculosis
cgccgggaacagcgacgcccag

SEQ ID NO: 823395 - RNA, 14 nt, Mycobacterium avium subsp. paratuberculosis
cgccgguggcggcg

SEQ ID NO: 823396 - RNA, 17 nt, Mycobacterium avium subsp. paratuberculosis
cgccgguggcggcgaca

SEQ ID NO: 823397 - RNA, 14 nt, Mycobacterium avium subsp. paratuberculosis
cgccggugccguug

SEQ ID NO: 823398 - RNA, 18 nt, Mycobacterium avium subsp. paratuberculosis
cgccggugcgggcuggag

SEQ ID NO: 823399 - RNA, 20 nt, Mycobacterium avium subsp. paratuberculosis
cgccggugcgggcuggagug

SEQ ID NO: 823400 - RNA, 15 nt, Mycobacterium avium subsp. paratuberculosis
cgccggugcugguca

SEQ ID NO: 823401 - RNA, 23 nt, Mycobacterium avium subsp. paratuberculosis
cgccggugcuggucaugccgucg

SEQ ID NO: 823402 - RNA, 23 nt, Mycobacterium avium subsp. paratuberculosis
cgccgguggagauggccagcacc

SEQ ID NO: 823403 - RNA, 22 nt, Mycobacterium avium subsp. paratuberculosis
cgccggucagcaccauggcguc

SEQ ID NO: 823404 - RNA, 14 nt, Mycobacterium avium subsp. paratuberculosis
cgccggucagcacg

SEQ ID NO: 823405 - RNA, 17 nt, Mycobacterium avium subsp. paratuberculosis
cgccggucagcacgucg

SEQ ID NO: 823406 - RNA, 18 nt, Mycobacterium avium subsp. paratuberculosis
cgccggucagcacgucgg

SEQ ID NO: 823407 - RNA, 21 nt, Mycobacterium avium subsp. paratuberculosis
cgccggucagcacgucgguca

SEQ ID NO: 823408 - RNA, 14 nt, Mycobacterium avium subsp. paratuberculosis
cgccggucagcgca

SEQ ID NO: 823409 - RNA, 17 nt, Mycobacterium avium subsp. paratuberculosis
cgccggugccgcagccg

SEQ ID NO: 823410 - RNA, 20 nt, Mycobacterium avium subsp. paratuberculosis
cgccggugccgcagccgucc

SEQ ID NO: 823411 - RNA, 21 nt, Mycobacterium avium subsp. paratuberculosis
cgccggucacggcgucggcgu

SEQ ID NO: 823412 - RNA, 19 nt, Mycobacterium avium subsp. paratuberculosis
cgccgguauauucgcgaug

SEQ ID NO: 823413 - RNA, 16 nt, Mycobacterium avium subsp. paratuberculosis
cgccgguagccgcucg

SEQ ID NO: 823414 - RNA, 18 nt, Mycobacterium avium subsp. paratuberculosis
cgccgguagccgcucgcc

SEQ ID NO: 823415 - RNA, 18 nt, Mycobacterium avium subsp. paratuberculosis
cgccgguagcgacacgga

SEQ ID NO: 823416 - RNA, 22 nt, Mycobacterium avium subsp. paratuberculosis
cgccgguaggcggccagcgccc

SEQ ID NO: 823417 - RNA, 16 nt, Mycobacterium avium subsp. paratuberculosis
cgccgguaucgagcac

SEQ ID NO: 823418 - RNA, 18 nt, Mycobacterium avium subsp. paratuberculosis
cgccgguaucgagcacca

SEQ ID NO: 823419 - RNA, 19 nt, Mycobacterium avium subsp. paratuberculosis
cgccgguaucgagcaccag

SEQ ID NO: 823420 - RNA, 20 nt, Mycobacterium avium subsp. paratuberculosis
cgccgguaucgagcaccagc

SEQ ID NO: 823421 - RNA, 22 nt, Mycobacterium avium subsp. paratuberculosis
cgccgguaucgagcaccagcaa

SEQ ID NO: 823422 - RNA, 16 nt, Mycobacterium avium subsp. paratuberculosis
cgccgguaggccgcgc

SEQ ID NO: 823423 - RNA, 19 nt, Mycobacterium avium subsp. paratuberculosis
cgccgguaggccgcgccga

SEQ ID NO: 823424 - RNA, 21 nt, Mycobacterium avium subsp. paratuberculosis
cgccgguaggccgcgccgauc

SEQ ID NO: 823425 - RNA, 21 nt, Mycobacterium avium subsp. paratuberculosis
cgccgguaggcgcgggugauu

SEQ ID NO: 823426 - RNA, 16 nt, Mycobacterium avium subsp. paratuberculosis
cgccgggucgcggugg

SEQ ID NO: 823427 - RNA, 17 nt, Mycobacterium avium subsp. paratuberculosis
cgccgguaggcggccag

SEQ ID NO: 823428 - RNA, 19 nt, Mycobacterium avium subsp. paratuberculosis
cgccgguaggcggccagcg

SEQ ID NO: 823429 - RNA, 15 nt, Mycobacterium avium subsp. paratuberculosis
cgccgggucaucccc

SEQ ID NO: 823430 - RNA, 16 nt, Mycobacterium avium subsp. paratuberculosis
cgccggguccagccgc

SEQ ID NO: 823431 - RNA, 18 nt, Mycobacterium avium subsp. paratuberculosis
cgccgggucuuccacgcc

SEQ ID NO: 823432 - RNA, 19 nt, Mycobacterium avium subsp. paratuberculosis
cgccgggucuuccacgccg

SEQ ID NO: 823433 - RNA, 21 nt, Mycobacterium avium subsp. paratuberculosis
cgccggguccuugcgccccgg

SEQ ID NO: 823434 - RNA, 20 nt, Mycobacterium avium subsp. paratuberculosis
cgccggguaguucaccccgu

SEQ ID NO: 823435 - RNA, 17 nt, Mycobacterium avium subsp. paratuberculosis
cgccgggucaccggaug

SEQ ID NO: 823436 - RNA, 18 nt, Mycobacterium avium subsp. paratuberculosis
cgccgggucaccggaugc

SEQ ID NO: 823437 - RNA, 20 nt, Mycobacterium avium subsp. paratuberculosis
cgccgggucaccggaugcac

SEQ ID NO: 823438 - RNA, 20 nt, Mycobacterium avium subsp. paratuberculosis
cgccggcuaccggcgcugga

SEQ ID NO: 823439 - RNA, 19 nt, Mycobacterium avium subsp. paratuberculosis
cgccggcuagacgcgcagc

SEQ ID NO: 823440 - RNA, 14 nt, Mycobacterium avium subsp. paratuberculosis
cgccggcgugucgg

SEQ ID NO: 823441 - RNA, 16 nt, Mycobacterium avium subsp. paratuberculosis
cgccggcgugucggcg

SEQ ID NO: 823442 - RNA, 14 nt, Mycobacterium avium subsp. paratuberculosis
cgccggcgguaugc

SEQ ID NO: 823443 - RNA, 16 nt, Mycobacterium avium subsp. paratuberculosis
cgccggcgucgguguc

SEQ ID NO: 823444 - RNA, 14 nt, Mycobacterium avium subsp. paratuberculosis
cgccggcgucgacg

SEQ ID NO: 823445 - RNA, 15 nt, Mycobacterium avium subsp. paratuberculosis
cgccggcgucgacgu

SEQ ID NO: 823446 - RNA, 17 nt, Mycobacterium avium subsp. paratuberculosis
cgccggcgucgacgucg

SEQ ID NO: 823447 - RNA, 12 nt, Mycobacterium avium subsp. paratuberculosis
cgccggcgucgg

SEQ ID NO: 823448 - RNA, 14 nt, Mycobacterium avium subsp. paratuberculosis
cgccggcucagcgg

SEQ ID NO: 823449 - RNA, 16 nt, Mycobacterium avium subsp. paratuberculosis
cgccggcucagcggca

SEQ ID NO: 823450 - RNA, 16 nt, Mycobacterium avium subsp. paratuberculosis
cgccggcuccaccgcg

SEQ ID NO: 823451 - RNA, 17 nt, Mycobacterium avium subsp. paratuberculosis
cgccggcuugccccggu

SEQ ID NO: 823452 - RNA, 17 nt, Mycobacterium avium subsp. paratuberculosis
cgccggcuggcgggcga

SEQ ID NO: 823453 - RNA, 19 nt, Mycobacterium avium subsp. paratuberculosis
cgccggcuggcgggcgauc

SEQ ID NO: 823454 - RNA, 20 nt, Mycobacterium avium subsp. paratuberculosis
cgccggcuggcgggcgaucg

SEQ ID NO: 823455 - RNA, 22 nt, Mycobacterium avium subsp. paratuberculosis
cgccggcuggcgggcgaucgcc

SEQ ID NO: 823456 - RNA, 20 nt, Mycobacterium avium subsp. paratuberculosis
cgccggcucggucuccucca

SEQ ID NO: 823457 - RNA, 18 nt, Mycobacterium avium subsp. paratuberculosis
cgccggcugacugccggc

SEQ ID NO: 823458 - RNA, 20 nt, Mycobacterium avium subsp. paratuberculosis
cgccggcugacugccggcga

SEQ ID NO: 823459 - RNA, 22 nt, Mycobacterium avium subsp. paratuberculosis
cgccggcugacugccggcgacg

SEQ ID NO: 823460 - RNA, 14 nt, Mycobacterium avium subsp. paratuberculosis
cgccggcugcccgc

SEQ ID NO: 823461 - RNA, 15 nt, Mycobacterium avium subsp. paratuberculosis
cgccggcugcccgcg

SEQ ID NO: 823462 - RNA, 17 nt, Mycobacterium avium subsp. paratuberculosis
cgccggcguccagcgcc

SEQ ID NO: 823463 - RNA, 19 nt, Mycobacterium avium subsp. paratuberculosis
cgccggcguccagcgccgc

SEQ ID NO: 823464 - RNA, 20 nt, Mycobacterium avium subsp. paratuberculosis
cgccggcguccagcgccgcc

SEQ ID NO: 823465 - RNA, 12 nt, Mycobacterium avium subsp. paratuberculosis
cgccggcggugc

SEQ ID NO: 823466 - RNA, 13 nt, Mycobacterium avium subsp. paratuberculosis
cgccggcggugcg

SEQ ID NO: 823467 - RNA, 14 nt, Mycobacterium avium subsp. paratuberculosis
cgccggcggugcgg

SEQ ID NO: 823468 - RNA, 16 nt, Mycobacterium avium subsp. paratuberculosis
cgccggcggugcggcg

SEQ ID NO: 823469 - RNA, 17 nt, Mycobacterium avium subsp. paratuberculosis
cgccggcggugcgggug

SEQ ID NO: 823470 - RNA, 13 nt, Mycobacterium avium subsp. paratuberculosis
cgccggcgguguc

SEQ ID NO: 823471 - RNA, 14 nt, Mycobacterium avium subsp. paratuberculosis
cgccggcggugucg

SEQ ID NO: 823472 - RNA, 13 nt, Mycobacterium avium subsp. paratuberculosis
cgccggcguagac

SEQ ID NO: 823473 - RNA, 19 nt, Mycobacterium avium subsp. paratuberculosis
cgccggcguagaccagcga

SEQ ID NO: 823474 - RNA, 13 nt, Mycobacterium avium subsp. paratuberculosis
cgccggcggucag

SEQ ID NO: 823475 - RNA, 12 nt, Mycobacterium avium subsp. paratuberculosis
cgccggcggucg

SEQ ID NO: 823476 - RNA, 13 nt, Mycobacterium avium subsp. paratuberculosis
cgccggcggucga

SEQ ID NO: 823477 - RNA, 14 nt, Mycobacterium avium subsp. paratuberculosis
cgccggcggucgac

SEQ ID NO: 823478 - RNA, 17 nt, Mycobacterium avium subsp. paratuberculosis
cgccggcggucgacacg

SEQ ID NO: 823479 - RNA, 19 nt, Mycobacterium avium subsp. paratuberculosis
cgccggcggucgacacgau

SEQ ID NO: 823480 - RNA, 23 nt, Mycobacterium avium subsp. paratuberculosis
cgccggcggucgacacgaucggc

SEQ ID NO: 823481 - RNA, 11 nt, Mycobacterium avium subsp. paratuberculosis
cgccggcggug

SEQ ID NO: 823482 - RNA, 22 nt, Mycobacterium avium subsp. paratuberculosis
cgccggcggccuccgccaccuc

SEQ ID NO: 823483 - RNA, 15 nt, Mycobacterium avium subsp. paratuberculosis
cgccggcggggcguc

SEQ ID NO: 823484 - RNA, 16 nt, Mycobacterium avium subsp. paratuberculosis
cgccggcggggcgucg

SEQ ID NO: 823485 - RNA, 17 nt, Mycobacterium avium subsp. paratuberculosis
cgccggcggggcgucgc

SEQ ID NO: 823486 - RNA, 12 nt, Mycobacterium avium subsp. paratuberculosis
cgccggcggggg

SEQ ID NO: 823487 - RNA, 21 nt, Mycobacterium avium subsp. paratuberculosis
cgccggcgggugagccggucg

SEQ ID NO: 823488 - RNA, 18 nt, Mycobacterium avium subsp. paratuberculosis
cgccggcggguuggccgu

SEQ ID NO: 823489 - RNA, 20 nt, Mycobacterium avium subsp. paratuberculosis
cgccggcggguuggccgucg

SEQ ID NO: 823490 - RNA, 14 nt, Mycobacterium avium subsp. paratuberculosis
cgccggcggcgccg

SEQ ID NO: 823491 - RNA, 16 nt, Mycobacterium avium subsp. paratuberculosis
cgccggcggcgccgga

SEQ ID NO: 823492 - RNA, 16 nt, Mycobacterium avium subsp. paratuberculosis
cgccggcggcgcccgc

SEQ ID NO: 823493 - RNA, 14 nt, Mycobacterium avium subsp. paratuberculosis
cgccggcggcgauc

SEQ ID NO: 823494 - RNA, 15 nt, Mycobacterium avium subsp. paratuberculosis
cgccggcggcgaucg

SEQ ID NO: 823495 - RNA, 12 nt, Mycobacterium avium subsp. paratuberculosis
cgccggcggcgc

SEQ ID NO: 823496 - RNA, 14 nt, Mycobacterium avium subsp. paratuberculosis
cgccggcggccucc

SEQ ID NO: 823497 - RNA, 16 nt, Mycobacterium avium subsp. paratuberculosis
cgccggcggccgcgac

SEQ ID NO: 823498 - RNA, 13 nt, Mycobacterium avium subsp. paratuberculosis
cgccggcggccuc

SEQ ID NO: 823499 - RNA, 17 nt, Mycobacterium avium subsp. paratuberculosis
cgccggcgcccugcgcg

SEQ ID NO: 823500 - RNA, 20 nt, Mycobacterium avium subsp. paratuberculosis
cgccggcgcccugcgcgccc

SEQ ID NO: 823501 - RNA, 13 nt, Mycobacterium avium subsp. paratuberculosis
cgccggcgcagcg

SEQ ID NO: 823502 - RNA, 19 nt, Mycobacterium avium subsp. paratuberculosis
cgccggcgcagcggcccga

SEQ ID NO: 823503 - RNA, 15 nt, Mycobacterium avium subsp. paratuberculosis
cgccggcgcagucca

SEQ ID NO: 823504 - RNA, 23 nt, Mycobacterium avium subsp. paratuberculosis
cgccggcgcacaucguggcgacg

SEQ ID NO: 823505 - RNA, 12 nt, Mycobacterium avium subsp. paratuberculosis
cgccggcgaucu

SEQ ID NO: 823506 - RNA, 18 nt, Mycobacterium avium subsp. paratuberculosis
cgccggcgaucuccaccg

SEQ ID NO: 823507 - RNA, 20 nt, Mycobacterium avium subsp. paratuberculosis
cgccggcgaucucgucgcgc

SEQ ID NO: 823508 - RNA, 20 nt, Mycobacterium avium subsp. paratuberculosis
cgccggcgaugaacacgccg

SEQ ID NO: 823509 - RNA, 13 nt, Mycobacterium avium subsp. paratuberculosis
cgccggcgaugcg

SEQ ID NO: 823510 - RNA, 21 nt, Mycobacterium avium subsp. paratuberculosis
cgccggcgaggcggucggcgg

SEQ ID NO: 823511 - RNA, 20 nt, Mycobacterium avium subsp. paratuberculosis
cgccggcgauaggcggccag

SEQ ID NO: 823512 - RNA, 21 nt, Mycobacterium avium subsp. paratuberculosis
cgccggcgauaggcggccagc

SEQ ID NO: 823513 - RNA, 12 nt, Mycobacterium avium subsp. paratuberculosis
cgccggcgaccg

SEQ ID NO: 823514 - RNA, 14 nt, Mycobacterium avium subsp. paratuberculosis
cgccggcgaccgcc

SEQ ID NO: 823515 - RNA, 15 nt, Mycobacterium avium subsp. paratuberculosis
cgccggcgaccgcca

SEQ ID NO: 823516 - RNA, 22 nt, Mycobacterium avium subsp. paratuberculosis
cgccggcgaccgccaccucgag

SEQ ID NO: 823517 - RNA, 15 nt, Mycobacterium avium subsp. paratuberculosis
cgccggcgaccgccu

SEQ ID NO: 823518 - RNA, 15 nt, Mycobacterium avium subsp. paratuberculosis
cgccggcgacggcca

SEQ ID NO: 823519 - RNA, 21 nt, Mycobacterium avium subsp. paratuberculosis
cgccggcgacggccagcgcgg

SEQ ID NO: 823520 - RNA, 12 nt, Mycobacterium avium subsp. paratuberculosis
cgccggcggcca

SEQ ID NO: 823521 - RNA, 13 nt, Mycobacterium avium subsp. paratuberculosis
cgccggcggccac

SEQ ID NO: 823522 - RNA, 13 nt, Mycobacterium avium subsp. paratuberculosis
cgccggcgcuggc

SEQ ID NO: 823523 - RNA, 20 nt, Mycobacterium avium subsp. paratuberculosis
cgccggcggccacgaucgcg

SEQ ID NO: 823524 - RNA, 13 nt, Mycobacterium avium subsp. paratuberculosis
cgccggcggccgc

SEQ ID NO: 823525 - RNA, 23 nt, Mycobacterium avium subsp. paratuberculosis
cgccggcggccgccacgcuggug

SEQ ID NO: 823526 - RNA, 17 nt, Mycobacterium avium subsp. paratuberculosis
cgccggcggccgccgcc

SEQ ID NO: 823527 - RNA, 14 nt, Mycobacterium avium subsp. paratuberculosis
cgccggcggccgcg

SEQ ID NO: 823528 - RNA, 15 nt, Mycobacterium avium subsp. paratuberculosis
cgccggcgcguccgg

SEQ ID NO: 823529 - RNA, 20 nt, Mycobacterium avium subsp. paratuberculosis
cgccggcgcguccggaggug

SEQ ID NO: 823530 - RNA, 20 nt, Mycobacterium avium subsp. paratuberculosis
cgccggcgcgcgagcgucac

SEQ ID NO: 823531 - RNA, 12 nt, Mycobacterium avium subsp. paratuberculosis
cgccggcgcguc

SEQ ID NO: 823532 - RNA, 14 nt, Mycobacterium avium subsp. paratuberculosis
cgccggcgcgcuga

SEQ ID NO: 823533 - RNA, 18 nt, Mycobacterium avium subsp. paratuberculosis
cgccggcgcgggccgcag

SEQ ID NO: 823534 - RNA, 16 nt, Mycobacterium avium subsp. paratuberculosis
cgccggcgcgggggcg

SEQ ID NO: 823535 - RNA, 11 nt, Mycobacterium avium subsp. paratuberculosis
cgccggcgcgg

SEQ ID NO: 823536 - RNA, 22 nt, Mycobacterium avium subsp. paratuberculosis
cgccggcgcggaacagcgucgc

SEQ ID NO: 823537 - RNA, 14 nt, Mycobacterium avium subsp. paratuberculosis
cgccggcgcggacg

SEQ ID NO: 823538 - RNA, 20 nt, Mycobacterium avium subsp. paratuberculosis
cgccggcgcggacggaucga

SEQ ID NO: 823539 - RNA, 14 nt, Mycobacterium avium subsp. paratuberculosis
cgccggcgcggcca

SEQ ID NO: 823540 - RNA, 15 nt, Mycobacterium avium subsp. paratuberculosis
cgccggcgcggccag

SEQ ID NO: 823541 - RNA, 23 nt, Mycobacterium avium subsp. paratuberculosis
cgccggcgaccgugcccaccagc

SEQ ID NO: 823542 - RNA, 14 nt, Mycobacterium avium subsp. paratuberculosis
cgccggcgcgcagc

SEQ ID NO: 823543 - RNA, 15 nt, Mycobacterium avium subsp. paratuberculosis
cgccggcgcgcagcc

SEQ ID NO: 823544 - RNA, 20 nt, Mycobacterium avium subsp. paratuberculosis
cgccggcgcgcagccagucg

SEQ ID NO: 823545 - RNA, 13 nt, Mycobacterium avium subsp. paratuberculosis
cgccggcgccggg

SEQ ID NO: 823546 - RNA, 13 nt, Mycobacterium avium subsp. paratuberculosis
cgccggcgccgga

SEQ ID NO: 823547 - RNA, 16 nt, Mycobacterium avium subsp. paratuberculosis
cgcgucuuggacgccc

SEQ ID NO: 823548 - RNA, 20 nt, Mycobacterium avium subsp. paratuberculosis
cgcgucuuggacgcccgcga

SEQ ID NO: 823549 - RNA, 22 nt, Mycobacterium avium subsp. paratuberculosis
cgcgucuuggacgcccgcgacc

SEQ ID NO: 823550 - RNA, 14 nt, Mycobacterium avium subsp. paratuberculosis
cgcgucugcucgcg

SEQ ID NO: 823551 - RNA, 19 nt, Mycobacterium avium subsp. paratuberculosis
cgcgugaaugcccagcggg

SEQ ID NO: 823552 - RNA, 17 nt, Mycobacterium avium subsp. paratuberculosis
cgcgugacaagccggcg

SEQ ID NO: 823553 - RNA, 21 nt, Mycobacterium avium subsp. paratuberculosis
cgcgugacaagccggcgucga

SEQ ID NO: 823554 - RNA, 19 nt, Mycobacterium avium subsp. paratuberculosis
cgcgugacaggggcagcag

SEQ ID NO: 823555 - RNA, 13 nt, Mycobacterium avium subsp. paratuberculosis
cgcgugaccccgg

SEQ ID NO: 823556 - RNA, 18 nt, Mycobacterium avium subsp. paratuberculosis
cgcgugaccccggcgacc

SEQ ID NO: 823557 - RNA, 19 nt, Mycobacterium avium subsp. paratuberculosis
cgcgugaccccggcgacca

SEQ ID NO: 823558 - RNA, 15 nt, Mycobacterium avium subsp. paratuberculosis
cgcgucguguccggg

SEQ ID NO: 823559 - RNA, 21 nt, Mycobacterium avium subsp. paratuberculosis
cgcgucguguccgggcccgaa

SEQ ID NO: 823560 - RNA, 22 nt, Mycobacterium avium subsp. paratuberculosis
cgcgucguugagugcgcugugg

SEQ ID NO: 823561 - RNA, 21 nt, Mycobacterium avium subsp. paratuberculosis
cgcgucguugucgucgccggc

SEQ ID NO: 823562 - RNA, 22 nt, Mycobacterium avium subsp. paratuberculosis
cgcgucguugucgucgccggcc

SEQ ID NO: 823563 - RNA, 15 nt, Mycobacterium avium subsp. paratuberculosis
cgcgucgugccgagc

SEQ ID NO: 823564 - RNA, 13 nt, Mycobacterium avium subsp. paratuberculosis
cgcgucgugcggc

SEQ ID NO: 823565 - RNA, 19 nt, Mycobacterium avium subsp. paratuberculosis
cgcgucguccucuucgcgg

SEQ ID NO: 823566 - RNA, 13 nt, Mycobacterium avium subsp. paratuberculosis
cgcgucgucgaug

SEQ ID NO: 823567 - RNA, 20 nt, Mycobacterium avium subsp. paratuberculosis
cgcgucgucgauggccacca

SEQ ID NO: 823568 - RNA, 13 nt, Mycobacterium avium subsp. paratuberculosis
cgcgucgucggcg

SEQ ID NO: 823569 - RNA, 14 nt, Mycobacterium avium subsp. paratuberculosis
cgcgucgucggcgg

SEQ ID NO: 823570 - RNA, 15 nt, Mycobacterium avium subsp. paratuberculosis
cgcgucgucggucag

SEQ ID NO: 823571 - RNA, 19 nt, Mycobacterium avium subsp. paratuberculosis
cgcgucgucggucaggccg

SEQ ID NO: 823572 - RNA, 13 nt, Mycobacterium avium subsp. paratuberculosis
cgcgucgucgucg

SEQ ID NO: 823573 - RNA, 14 nt, Mycobacterium avium subsp. paratuberculosis
cgcgucgucgucga

SEQ ID NO: 823574 - RNA, 15 nt, Mycobacterium avium subsp. paratuberculosis
cgcgucgucgucgac

SEQ ID NO: 823575 - RNA, 19 nt, Mycobacterium avium subsp. paratuberculosis
cgcgucgucgucgaccguc

SEQ ID NO: 823576 - RNA, 13 nt, Mycobacterium avium subsp. paratuberculosis
cgcgucguccgac

SEQ ID NO: 823577 - RNA, 19 nt, Mycobacterium avium subsp. paratuberculosis
cgcgucguccgacaccacc

SEQ ID NO: 823578 - RNA, 20 nt, Mycobacterium avium subsp. paratuberculosis
cgcgucguccgacaccaccu

SEQ ID NO: 823579 - RNA, 11 nt, Mycobacterium avium subsp. paratuberculosis
cgcgucggugu

SEQ ID NO: 823580 - RNA, 17 nt, Mycobacterium avium subsp. paratuberculosis
cgcgucguagccggcac

SEQ ID NO: 823581 - RNA, 18 nt, Mycobacterium avium subsp. paratuberculosis
cgcgucguagccggcacg

SEQ ID NO: 823582 - RNA, 15 nt, Mycobacterium avium subsp. paratuberculosis
cgcgucgggcucgcg

SEQ ID NO: 823583 - RNA, 18 nt, Mycobacterium avium subsp. paratuberculosis
cgcgucgggcucggccgc

SEQ ID NO: 823584 - RNA, 19 nt, Mycobacterium avium subsp. paratuberculosis
cgcgucgggcucggccgcc

SEQ ID NO: 823585 - RNA, 18 nt, Mycobacterium avium subsp. paratuberculosis
cgcgucgguaaucggcgg

SEQ ID NO: 823586 - RNA, 21 nt, Mycobacterium avium subsp. paratuberculosis
cgcgucgguaaucggcggugg

SEQ ID NO: 823587 - RNA, 22 nt, Mycobacterium avium subsp. paratuberculosis
cgcgucgguaaucggcgguggu

SEQ ID NO: 823588 - RNA, 23 nt, Mycobacterium avium subsp. paratuberculosis
cgcgucgguaggugucgaugaac

SEQ ID NO: 823589 - RNA, 16 nt, Mycobacterium avium subsp. paratuberculosis
cgcgucggucagcgcc

SEQ ID NO: 823590 - RNA, 17 nt, Mycobacterium avium subsp. paratuberculosis
cgcgucggucagcggcg

SEQ ID NO: 823591 - RNA, 19 nt, Mycobacterium avium subsp. paratuberculosis
cgcgucggucagcggcguc

SEQ ID NO: 823592 - RNA, 21 nt, Mycobacterium avium subsp. paratuberculosis
cgcgucggucagcggcgucag

SEQ ID NO: 823593 - RNA, 13 nt, Mycobacterium avium subsp. paratuberculosis
cgcgucggcgccg

SEQ ID NO: 823594 - RNA, 13 nt, Mycobacterium avium subsp. paratuberculosis
cgcgucggcgcug

SEQ ID NO: 823595 - RNA, 15 nt, Mycobacterium avium subsp. paratuberculosis
cgcgucggcgcuggc

SEQ ID NO: 823596 - RNA, 17 nt, Mycobacterium avium subsp. paratuberculosis
cgcgucggcgcuggcca

SEQ ID NO: 823597 - RNA, 14 nt, Mycobacterium avium subsp. paratuberculosis
cgcgucggcggcgg

SEQ ID NO: 823598 - RNA, 15 nt, Mycobacterium avium subsp. paratuberculosis
cgcgucggcggcggc

SEQ ID NO: 823599 - RNA, 13 nt, Mycobacterium avium subsp. paratuberculosis
cgcgucggcgguc

SEQ ID NO: 823600 - RNA, 16 nt, Mycobacterium avium subsp. paratuberculosis
cgcgucggcggucgcc

SEQ ID NO: 823601 - RNA, 13 nt, Mycobacterium avium subsp. paratuberculosis
cgcgucggcgucu

SEQ ID NO: 823602 - RNA, 15 nt, Mycobacterium avium subsp. paratuberculosis
cgcgucggccagcac

SEQ ID NO: 823603 - RNA, 14 nt, Mycobacterium avium subsp. paratuberculosis
cgcgucggcgaugu

SEQ ID NO: 823604 - RNA, 12 nt, Mycobacterium avium subsp. paratuberculosis
cgcgucggcgac

SEQ ID NO: 823605 - RNA, 15 nt, Mycobacterium avium subsp. paratuberculosis
cgcgucggcgaccgc

SEQ ID NO: 823606 - RNA, 16 nt, Mycobacterium avium subsp. paratuberculosis
cgcgucggcgaccgcg

SEQ ID NO: 823607 - RNA, 17 nt, Mycobacterium avium subsp. paratuberculosis
cgcgucggcgaccgcgc

SEQ ID NO: 823608 - RNA, 21 nt, Mycobacterium avium subsp. paratuberculosis
cgcgucggccagcgcgcgggc

SEQ ID NO: 823609 - RNA, 20 nt, Mycobacterium avium subsp. paratuberculosis
cgcgucggcccagacgaugu

SEQ ID NO: 823610 - RNA, 14 nt, Mycobacterium avium subsp. paratuberculosis
cgcgucggccccca

SEQ ID NO: 823611 - RNA, 16 nt, Mycobacterium avium subsp. paratuberculosis
cgcguggucccacacc

SEQ ID NO: 823612 - RNA, 20 nt, Mycobacterium avium subsp. paratuberculosis
cgcguggucccacaccacca

SEQ ID NO: 823613 - RNA, 23 nt, Mycobacterium avium subsp. paratuberculosis
cgcguggucccacaccaccaccg

SEQ ID NO: 823614 - RNA, 16 nt, Mycobacterium avium subsp. paratuberculosis
cgcgugacggccgcgg

SEQ ID NO: 823615 - RNA, 17 nt, Mycobacterium avium subsp. paratuberculosis
cgcgugacggccgcggc

SEQ ID NO: 823616 - RNA, 15 nt, Mycobacterium avium subsp. paratuberculosis
cgcgugacggcgggg

SEQ ID NO: 823617 - RNA, 16 nt, Mycobacterium avium subsp. paratuberculosis
cgcgugacggcggggc

SEQ ID NO: 823618 - RNA, 17 nt, Mycobacterium avium subsp. paratuberculosis
cgcgugaccggcggugc

SEQ ID NO: 823619 - RNA, 18 nt, Mycobacterium avium subsp. paratuberculosis
cgcgugaccggcggugcg

SEQ ID NO: 823620 - RNA, 19 nt, Mycobacterium avium subsp. paratuberculosis
cgcgugaccggcggugcgg

SEQ ID NO: 823621 - RNA, 21 nt, Mycobacterium avium subsp. paratuberculosis
cgcgugugcccagcacgacgc

SEQ ID NO: 823622 - RNA, 22 nt, Mycobacterium avium subsp. paratuberculosis
cgcgugugcccagcacgacgcc

SEQ ID NO: 823623 - RNA, 13 nt, Mycobacterium avium subsp. paratuberculosis
cgcgugacggccg

SEQ ID NO: 823624 - RNA, 19 nt, Mycobacterium avium subsp. paratuberculosis
cgcguucaagccgccgauc

SEQ ID NO: 823625 - RNA, 12 nt, Mycobacterium avium subsp. paratuberculosis
cgcguucacccg

SEQ ID NO: 823626 - RNA, 16 nt, Mycobacterium avium subsp. paratuberculosis
cgcguugagcgucgcc

SEQ ID NO: 823627 - RNA, 20 nt, Mycobacterium avium subsp. paratuberculosis
cgcguugaguggugaaucgc

SEQ ID NO: 823628 - RNA, 19 nt, Mycobacterium avium subsp. paratuberculosis
cgcguugaucagcgccagg

SEQ ID NO: 823629 - RNA, 12 nt, Mycobacterium avium subsp. paratuberculosis
cgcguuccccgg

SEQ ID NO: 823630 - RNA, 17 nt, Mycobacterium avium subsp. paratuberculosis
cgcguuccccggcgugg

SEQ ID NO: 823631 - RNA, 16 nt, Mycobacterium avium subsp. paratuberculosis
cgcguugaccagaccg

SEQ ID NO: 823632 - RNA, 18 nt, Mycobacterium avium subsp. paratuberculosis
cgcguucagggugcaggc

SEQ ID NO: 823633 - RNA, 16 nt, Mycobacterium avium subsp. paratuberculosis
cgcguuccagcacgcc

SEQ ID NO: 823634 - RNA, 19 nt, Mycobacterium avium subsp. paratuberculosis
cgcguuccagcacgcccag

SEQ ID NO: 823635 - RNA, 15 nt, Mycobacterium avium subsp. paratuberculosis
cgcguuccaucagcg

SEQ ID NO: 823636 - RNA, 17 nt, Mycobacterium avium subsp. paratuberculosis
cgcguuccaucagcgcc

SEQ ID NO: 823637 - RNA, 14 nt, Mycobacterium avium subsp. paratuberculosis
cgcguugucgacca

SEQ ID NO: 823638 - RNA, 13 nt, Mycobacterium avium subsp. paratuberculosis
cgcguugucggcg

SEQ ID NO: 823639 - RNA, 14 nt, Mycobacterium avium subsp. paratuberculosis
cgcguugucggcga

SEQ ID NO: 823640 - RNA, 16 nt, Mycobacterium avium subsp. paratuberculosis
cgcguugucggcgacg

SEQ ID NO: 823641 - RNA, 17 nt, Mycobacterium avium subsp. paratuberculosis
cgcguugucggcgacgg

SEQ ID NO: 823642 - RNA, 15 nt, Mycobacterium avium subsp. paratuberculosis
cgcguuguugcucgg

SEQ ID NO: 823643 - RNA, 13 nt, Mycobacterium avium subsp. paratuberculosis
cgcguuggucauc

SEQ ID NO: 823644 - RNA, 16 nt, Mycobacterium avium subsp. paratuberculosis
cgcguuggucaucacc

SEQ ID NO: 823645 - RNA, 16 nt, Mycobacterium avium subsp. paratuberculosis
cgcguuguccagcagc

SEQ ID NO: 823646 - RNA, 19 nt, Mycobacterium avium subsp. paratuberculosis
cgcguuguccagcagcgcc

SEQ ID NO: 823647 - RNA, 21 nt, Mycobacterium avium subsp. paratuberculosis
cgcguuguccagcagcgccgg

SEQ ID NO: 823648 - RNA, 15 nt, Mycobacterium avium subsp. paratuberculosis
cgcguugcggccguc

SEQ ID NO: 823649 - RNA, 14 nt, Mycobacterium avium subsp. paratuberculosis
cgcguugcggcgca

SEQ ID NO: 823650 - RNA, 15 nt, Mycobacterium avium subsp. paratuberculosis
cgcguuggccagcgc

SEQ ID NO: 823651 - RNA, 21 nt, Mycobacterium avium subsp. paratuberculosis
cgcguuggccagguugcgccg

SEQ ID NO: 823652 - RNA, 17 nt, Mycobacterium avium subsp. paratuberculosis
cgcguuggcccgugucg

SEQ ID NO: 823653 - RNA, 16 nt, Mycobacterium avium subsp. paratuberculosis
cgcguuggccggcugg

SEQ ID NO: 823654 - RNA, 19 nt, Mycobacterium avium subsp. paratuberculosis
cgcguugcagcgccgcggc

SEQ ID NO: 823655 - RNA, 13 nt, Mycobacterium avium subsp. paratuberculosis
cgcguugcgcgga

SEQ ID NO: 823656 - RNA, 15 nt, Mycobacterium avium subsp. paratuberculosis
cgcguugcgcggacc

SEQ ID NO: 823657 - RNA, 16 nt, Mycobacterium avium subsp. paratuberculosis
cgcguugcgcggaccg

SEQ ID NO: 823658 - RNA, 17 nt, Mycobacterium avium subsp. paratuberculosis
cgcguugcgcggaccgg

SEQ ID NO: 823659 - RNA, 20 nt, Mycobacterium avium subsp. paratuberculosis
cgcguugcgcggaccggcga

SEQ ID NO: 823660 - RNA, 22 nt, Mycobacterium avium subsp. paratuberculosis
cgcguugcgcggaccggcgauu

SEQ ID NO: 823661 - RNA, 14 nt, Mycobacterium avium subsp. paratuberculosis
cgcgucagccgucg

SEQ ID NO: 823662 - RNA, 17 nt, Mycobacterium avium subsp. paratuberculosis
cgcgucagccgucgucg

SEQ ID NO: 823663 - RNA, 23 nt, Mycobacterium avium subsp. paratuberculosis
cgcgucagccgucgucguccgca

SEQ ID NO: 823664 - RNA, 14 nt, Mycobacterium avium subsp. paratuberculosis
cgcgucagcagcgc

SEQ ID NO: 823665 - RNA, 17 nt, Mycobacterium avium subsp. paratuberculosis
cgcgucagcagcgcgac

SEQ ID NO: 823666 - RNA, 19 nt, Mycobacterium avium subsp. paratuberculosis
cgcgucagcagcgcgacgc

SEQ ID NO: 823667 - RNA, 12 nt, Mycobacterium avium subsp. paratuberculosis
cgcgucacgucg

SEQ ID NO: 823668 - RNA, 13 nt, Mycobacterium avium subsp. paratuberculosis
cgcgucacgucgg

SEQ ID NO: 823669 - RNA, 17 nt, Mycobacterium avium subsp. paratuberculosis
cgcgucagcggcgggca

SEQ ID NO: 823670 - RNA, 13 nt, Mycobacterium avium subsp. paratuberculosis
cgcgucacgcugg

SEQ ID NO: 823671 - RNA, 15 nt, Mycobacterium avium subsp. paratuberculosis
cgcgucacgcuggcg

SEQ ID NO: 823672 - RNA, 18 nt, Mycobacterium avium subsp. paratuberculosis
cgcgucacauccgucacg

SEQ ID NO: 823673 - RNA, 12 nt, Mycobacterium avium subsp. paratuberculosis
cgcgucaccgga

SEQ ID NO: 823674 - RNA, 19 nt, Mycobacterium avium subsp. paratuberculosis
cgcguaggguucgccgaug

SEQ ID NO: 823675 - RNA, 15 nt, Mycobacterium avium subsp. paratuberculosis
cgcgucauggccguc

SEQ ID NO: 823676 - RNA, 17 nt, Mycobacterium avium subsp. paratuberculosis
cgcguccaaccgcggac

SEQ ID NO: 823677 - RNA, 14 nt, Mycobacterium avium subsp. paratuberculosis
cgcgucaucgggcc

SEQ ID NO: 823678 - RNA, 17 nt, Mycobacterium avium subsp. paratuberculosis
cgcgucaucgggcccga

SEQ ID NO: 823679 - RNA, 18 nt, Mycobacterium avium subsp. paratuberculosis
cgcgucaucgggcccgac

SEQ ID NO: 823680 - RNA, 14 nt, Mycobacterium avium subsp. paratuberculosis
cgcgucaggcgucg

SEQ ID NO: 823681 - RNA, 16 nt, Mycobacterium avium subsp. paratuberculosis
cgcgucaggcgucgua

SEQ ID NO: 823682 - RNA, 18 nt, Mycobacterium avium subsp. paratuberculosis
cgcgucccuggcgaugau

SEQ ID NO: 823683 - RNA, 14 nt, Mycobacterium avium subsp. paratuberculosis
cgcguccccgcgcc

SEQ ID NO: 823684 - RNA, 20 nt, Mycobacterium avium subsp. paratuberculosis
cgcguccccgcgccgggcaa

SEQ ID NO: 823685 - RNA, 17 nt, Mycobacterium avium subsp. paratuberculosis
cgcguccgacggcuggg

SEQ ID NO: 823686 - RNA, 17 nt, Mycobacterium avium subsp. paratuberculosis
cgcguccgagcagcagc

SEQ ID NO: 823687 - RNA, 18 nt, Mycobacterium avium subsp. paratuberculosis
cgcguccgagcagcagcc

SEQ ID NO: 823688 - RNA, 19 nt, Mycobacterium avium subsp. paratuberculosis
cgcguccgagcagcagccg

SEQ ID NO: 823689 - RNA, 21 nt, Mycobacterium avium subsp. paratuberculosis
cgcguccgagcagcagccgca

SEQ ID NO: 823690 - RNA, 22 nt, Mycobacterium avium subsp. paratuberculosis
cgcguccgagcagcagccgcag

SEQ ID NO: 823691 - RNA, 16 nt, Mycobacterium avium subsp. paratuberculosis
cgcguccgaggcgguu

SEQ ID NO: 823692 - RNA, 13 nt, Mycobacterium avium subsp. paratuberculosis
cgcguccgcgggc

SEQ ID NO: 823693 - RNA, 15 nt, Mycobacterium avium subsp. paratuberculosis
cgcguccgcgucguc

SEQ ID NO: 823694 - RNA, 16 nt, Mycobacterium avium subsp. paratuberculosis
cgcguccgcgucgucg

SEQ ID NO: 823695 - RNA, 15 nt, Mycobacterium avium subsp. paratuberculosis
cgcguccggaggugc

SEQ ID NO: 823696 - RNA, 19 nt, Mycobacterium avium subsp. paratuberculosis
cgcguccggaggugccggc

SEQ ID NO: 823697 - RNA, 20 nt, Mycobacterium avium subsp. paratuberculosis
cgcguccggaggugccggcc

SEQ ID NO: 823698 - RNA, 21 nt, Mycobacterium avium subsp. paratuberculosis
cgcguccggaggugccggccg

SEQ ID NO: 823699 - RNA, 19 nt, Mycobacterium avium subsp. paratuberculosis
cgcguccaggugcgccgcc

SEQ ID NO: 823700 - RNA, 21 nt, Mycobacterium avium subsp. paratuberculosis
cgcguccacgaccccggcggc

SEQ ID NO: 823701 - RNA, 22 nt, Mycobacterium avium subsp. paratuberculosis
cgcguccacgaccccggcggca

SEQ ID NO: 823702 - RNA, 13 nt, Mycobacterium avium subsp. paratuberculosis
cgcguccagcaug

SEQ ID NO: 823703 - RNA, 15 nt, Mycobacterium avium subsp. paratuberculosis
cgcguccagcaugcc

SEQ ID NO: 823704 - RNA, 21 nt, Mycobacterium avium subsp. paratuberculosis
cgcguccagcaugcccacgcc

SEQ ID NO: 823705 - RNA, 22 nt, Mycobacterium avium subsp. paratuberculosis
cgcguccagcaugcccacgccg

SEQ ID NO: 823706 - RNA, 19 nt, Mycobacterium avium subsp. paratuberculosis
cgcgucggagaucaccggc

SEQ ID NO: 823707 - RNA, 20 nt, Mycobacterium avium subsp. paratuberculosis
cgcgucggagaucaccggca

SEQ ID NO: 823708 - RNA, 22 nt, Mycobacterium avium subsp. paratuberculosis
cgcgucggagaucaccggcacc

SEQ ID NO: 823709 - RNA, 22 nt, Mycobacterium avium subsp. paratuberculosis
cgcgucgcgguggagcacagca

SEQ ID NO: 823710 - RNA, 13 nt, Mycobacterium avium subsp. paratuberculosis
cgcgucgcugggc

SEQ ID NO: 823711 - RNA, 20 nt, Mycobacterium avium subsp. paratuberculosis
cgcgucggaauacagcagcu

SEQ ID NO: 823712 - RNA, 22 nt, Mycobacterium avium subsp. paratuberculosis
cgcgucggaauacagcagcugc

SEQ ID NO: 823713 - RNA, 12 nt, Mycobacterium avium subsp. paratuberculosis
cgcgucgcgugg

SEQ ID NO: 823714 - RNA, 15 nt, Mycobacterium avium subsp. paratuberculosis
cgcgucgcggcgcgg

SEQ ID NO: 823715 - RNA, 13 nt, Mycobacterium avium subsp. paratuberculosis
cgcgucgcgggcc

SEQ ID NO: 823716 - RNA, 14 nt, Mycobacterium avium subsp. paratuberculosis
cgcgucgcgggccc

SEQ ID NO: 823717 - RNA, 23 nt, Mycobacterium avium subsp. paratuberculosis
cgcgucgcgggcccgggccaccc

SEQ ID NO: 823718 - RNA, 18 nt, Mycobacterium avium subsp. paratuberculosis
cgcgucgccgugccggac

SEQ ID NO: 823719 - RNA, 18 nt, Mycobacterium avium subsp. paratuberculosis
cgcgucgcgcagcgaagc

SEQ ID NO: 823720 - RNA, 19 nt, Mycobacterium avium subsp. paratuberculosis
cgcgucgcgcagcgaagcg

SEQ ID NO: 823721 - RNA, 14 nt, Mycobacterium avium subsp. paratuberculosis
cgcgucgcgccagc

SEQ ID NO: 823722 - RNA, 16 nt, Mycobacterium avium subsp. paratuberculosis
cgcgucgcgccagcgg

SEQ ID NO: 823723 - RNA, 20 nt, Mycobacterium avium subsp. paratuberculosis
cgcgucgcgccagcggucca

SEQ ID NO: 823724 - RNA, 15 nt, Mycobacterium avium subsp. paratuberculosis
cgcgucgcgcccggc

SEQ ID NO: 823725 - RNA, 19 nt, Mycobacterium avium subsp. paratuberculosis
cgcgucgcgccgccgcguc

SEQ ID NO: 823726 - RNA, 14 nt, Mycobacterium avium subsp. paratuberculosis
cgcgucgccgccgg

SEQ ID NO: 823727 - RNA, 14 nt, Mycobacterium avium subsp. paratuberculosis
cgcgucgccgacca

SEQ ID NO: 823728 - RNA, 23 nt, Mycobacterium avium subsp. paratuberculosis
cgcgucgccgaccagcaggacgc

SEQ ID NO: 823729 - RNA, 13 nt, Mycobacterium avium subsp. paratuberculosis
cgcgucgccgauc

SEQ ID NO: 823730 - RNA, 16 nt, Mycobacterium avium subsp. paratuberculosis
cgcgucgcccacgccg

SEQ ID NO: 823731 - RNA, 17 nt, Mycobacterium avium subsp. paratuberculosis
cgcgucgcccacgccgg

SEQ ID NO: 823732 - RNA, 16 nt, Mycobacterium avium subsp. paratuberculosis
cgcgucgcacagcgcc

SEQ ID NO: 823733 - RNA, 21 nt, Mycobacterium avium subsp. paratuberculosis
cgcgucgcagugccggugcag

SEQ ID NO: 823734 - RNA, 13 nt, Mycobacterium avium subsp. paratuberculosis
cgcgucgaucgcg

SEQ ID NO: 823735 - RNA, 16 nt, Mycobacterium avium subsp. paratuberculosis
cgcgucgaugccggcg

SEQ ID NO: 823736 - RNA, 17 nt, Mycobacterium avium subsp. paratuberculosis
cgcgucgaugccggcga

SEQ ID NO: 823737 - RNA, 14 nt, Mycobacterium avium subsp. paratuberculosis
cgcgucgaugcggg

SEQ ID NO: 823738 - RNA, 16 nt, Mycobacterium avium subsp. paratuberculosis
cgcgucgaugcgggcc

SEQ ID NO: 823739 - RNA, 19 nt, Mycobacterium avium subsp. paratuberculosis
cgcgucgaugcgggcccgc

SEQ ID NO: 823740 - RNA, 20 nt, Mycobacterium avium subsp. paratuberculosis
cgcgucgaugcgggcccgca

SEQ ID NO: 823741 - RNA, 16 nt, Mycobacterium avium subsp. paratuberculosis
cgcgucgagcgugggc

SEQ ID NO: 823742 - RNA, 16 nt, Mycobacterium avium subsp. paratuberculosis
cgcgucgaggucgcgc

SEQ ID NO: 823743 - RNA, 22 nt, Mycobacterium avium subsp. paratuberculosis
cgcgucgaggucgcgcagcacc

SEQ ID NO: 823744 - RNA, 17 nt, Mycobacterium avium subsp. paratuberculosis
cgcgucgaggucgucgg

SEQ ID NO: 823745 - RNA, 16 nt, Mycobacterium avium subsp. paratuberculosis
cgcgucgacgucgggc

SEQ ID NO: 823746 - RNA, 22 nt, Mycobacterium avium subsp. paratuberculosis
cgcgucgacguucgccgccagc

SEQ ID NO: 823747 - RNA, 14 nt, Mycobacterium avium subsp. paratuberculosis
cgcgucgagcaccu

SEQ ID NO: 823748 - RNA, 15 nt, Mycobacterium avium subsp. paratuberculosis
cgcgucgagcaccug

SEQ ID NO: 823749 - RNA, 13 nt, Mycobacterium avium subsp. paratuberculosis
cgcgucgagcagc

SEQ ID NO: 823750 - RNA, 14 nt, Mycobacterium avium subsp. paratuberculosis
cgcgucgacgaugg

SEQ ID NO: 823751 - RNA, 12 nt, Mycobacterium avium subsp. paratuberculosis
cgcgucgacgcc

SEQ ID NO: 823752 - RNA, 13 nt, Mycobacterium avium subsp. paratuberculosis
cgcgucgacgccg

SEQ ID NO: 823753 - RNA, 14 nt, Mycobacterium avium subsp. paratuberculosis
cgcgucgacggcgc

SEQ ID NO: 823754 - RNA, 15 nt, Mycobacterium avium subsp. paratuberculosis
cgcgucgacggcgcc

SEQ ID NO: 823755 - RNA, 16 nt, Mycobacterium avium subsp. paratuberculosis
cgcgucgacggcgccg

SEQ ID NO: 823756 - RNA, 16 nt, Mycobacterium avium subsp. paratuberculosis
cgcgucgacggcgugg

SEQ ID NO: 823757 - RNA, 16 nt, Mycobacterium avium subsp. paratuberculosis
cgcgucgaacagccgg

SEQ ID NO: 823758 - RNA, 18 nt, Mycobacterium avium subsp. paratuberculosis
cgcgucgaacagccgggc

SEQ ID NO: 823759 - RNA, 22 nt, Mycobacterium avium subsp. paratuberculosis
cgcgucgaacagccgggccgcc

SEQ ID NO: 823760 - RNA, 13 nt, Mycobacterium avium subsp. paratuberculosis
cgcgucgaaugcg

SEQ ID NO: 823761 - RNA, 19 nt, Mycobacterium avium subsp. paratuberculosis
cgcgucgacaccccgcucg

SEQ ID NO: 823762 - RNA, 15 nt, Mycobacterium avium subsp. paratuberculosis
cgcgucgaccaccgc

SEQ ID NO: 823763 - RNA, 16 nt, Mycobacterium avium subsp. paratuberculosis
cgcgucgaccaccgcc

SEQ ID NO: 823764 - RNA, 18 nt, Mycobacterium avium subsp. paratuberculosis
cgcgucgaccaccgccgg

SEQ ID NO: 823765 - RNA, 13 nt, Mycobacterium avium subsp. paratuberculosis
cgcgucgaccagc

SEQ ID NO: 823766 - RNA, 23 nt, Mycobacterium avium subsp. paratuberculosis
cgcgucgaccagccgcaucaccu

SEQ ID NO: 823767 - RNA, 14 nt, Mycobacterium avium subsp. paratuberculosis
cgcgucgaccgccg

SEQ ID NO: 823768 - RNA, 16 nt, Mycobacterium avium subsp. paratuberculosis
cgcgucgaccgccgcg

SEQ ID NO: 823769 - RNA, 19 nt, Mycobacterium avium subsp. paratuberculosis
cgcguccuucuccgccggg

SEQ ID NO: 823770 - RNA, 15 nt, Mycobacterium avium subsp. paratuberculosis
cgcguccucgucgau

SEQ ID NO: 823771 - RNA, 18 nt, Mycobacterium avium subsp. paratuberculosis
cgcguccucgucgaugcc

SEQ ID NO: 823772 - RNA, 19 nt, Mycobacterium avium subsp. paratuberculosis
cgcguccucgucgaugccg

SEQ ID NO: 823773 - RNA, 16 nt, Mycobacterium avium subsp. paratuberculosis
cgcguccugcagcgcc

SEQ ID NO: 823774 - RNA, 19 nt, Mycobacterium avium subsp. paratuberculosis
cgcguccugcagcgccguc

SEQ ID NO: 823775 - RNA, 15 nt, Mycobacterium avium subsp. paratuberculosis
cgcguccugcaggca

SEQ ID NO: 823776 - RNA, 21 nt, Mycobacterium avium subsp. paratuberculosis
cgcguccguagugcucggcgu

SEQ ID NO: 823777 - RNA, 14 nt, Mycobacterium avium subsp. paratuberculosis
cgcguccucgccgu

SEQ ID NO: 823778 - RNA, 15 nt, Mycobacterium avium subsp. paratuberculosis
cgcguccucgccgua

SEQ ID NO: 823779 - RNA, 19 nt, Mycobacterium avium subsp. paratuberculosis
cgcguccucgccguacgcg

SEQ ID NO: 823780 - RNA, 12 nt, Mycobacterium avium subsp. paratuberculosis
cgcguccgcgau

SEQ ID NO: 823781 - RNA, 15 nt, Mycobacterium avium subsp. paratuberculosis
cgcguccggggugcc

SEQ ID NO: 823782 - RNA, 12 nt, Mycobacterium avium subsp. paratuberculosis
cgcggucaccgg

SEQ ID NO: 823783 - RNA, 15 nt, Mycobacterium avium subsp. paratuberculosis
cgcggucaccggcuc

SEQ ID NO: 823784 - RNA, 16 nt, Mycobacterium avium subsp. paratuberculosis
cgcggucaccggcucg

SEQ ID NO: 823785 - RNA, 16 nt, Mycobacterium avium subsp. paratuberculosis
cgcggucaccggucgg

SEQ ID NO: 823786 - RNA, 19 nt, Mycobacterium avium subsp. paratuberculosis
cgcggucaccggucggugc

SEQ ID NO: 823787 - RNA, 17 nt, Mycobacterium avium subsp. paratuberculosis
cgcggucagccggcucg

SEQ ID NO: 823788 - RNA, 18 nt, Mycobacterium avium subsp. paratuberculosis
cgcggucagccggcucgg

SEQ ID NO: 823789 - RNA, 19 nt, Mycobacterium avium subsp. paratuberculosis
cgcggucagcgcguccagg

SEQ ID NO: 823790 - RNA, 16 nt, Mycobacterium avium subsp. paratuberculosis
cgcggucagacgaugg

SEQ ID NO: 823791 - RNA, 22 nt, Mycobacterium avium subsp. paratuberculosis
cgcggucagacgaugggccgcc

SEQ ID NO: 823792 - RNA, 20 nt, Mycobacterium avium subsp. paratuberculosis
cgcggucagcgucuggcggg

SEQ ID NO: 823793 - RNA, 21 nt, Mycobacterium avium subsp. paratuberculosis
cgcggucagcgucuggcgggu

SEQ ID NO: 823794 - RNA, 13 nt, Mycobacterium avium subsp. paratuberculosis
cgcggucagcucg

SEQ ID NO: 823795 - RNA, 16 nt, Mycobacterium avium subsp. paratuberculosis
cgcggucaucgagccg

SEQ ID NO: 823796 - RNA, 22 nt, Mycobacterium avium subsp. paratuberculosis
cgcggucaucgucauccccugg

SEQ ID NO: 823797 - RNA, 19 nt, Mycobacterium avium subsp. paratuberculosis
cgcggucaugcgcgggcaa

SEQ ID NO: 823798 - RNA, 14 nt, Mycobacterium avium subsp. paratuberculosis
cgcgguccaccaga

SEQ ID NO: 823799 - RNA, 16 nt, Mycobacterium avium subsp. paratuberculosis
cgcgguccaccagaag

SEQ ID NO: 823800 - RNA, 22 nt, Mycobacterium avium subsp. paratuberculosis
cgcggucaacaccgggauccgg

SEQ ID NO: 823801 - RNA, 13 nt, Mycobacterium avium subsp. paratuberculosis
cgcgguccaucuc

SEQ ID NO: 823802 - RNA, 19 nt, Mycobacterium avium subsp. paratuberculosis
cgcggucggcaacccgacc

SEQ ID NO: 823803 - RNA, 14 nt, Mycobacterium avium subsp. paratuberculosis
cgcgguccagcuug

SEQ ID NO: 823804 - RNA, 21 nt, Mycobacterium avium subsp. paratuberculosis
cgcgguccagcuugucguagc

SEQ ID NO: 823805 - RNA, 22 nt, Mycobacterium avium subsp. paratuberculosis
cgcgguccaggaucugcagcac

SEQ ID NO: 823806 - RNA, 18 nt, Mycobacterium avium subsp. paratuberculosis
cgcgguccacggucagcg

SEQ ID NO: 823807 - RNA, 23 nt, Mycobacterium avium subsp. paratuberculosis
cgcgguccacggucagcgcgucg

SEQ ID NO: 823808 - RNA, 21 nt, Mycobacterium avium subsp. paratuberculosis
cgcgguccacgguggcgccga

SEQ ID NO: 823809 - RNA, 21 nt, Mycobacterium avium subsp. paratuberculosis
cgcgguccacuuccgcgcagg

SEQ ID NO: 823810 - RNA, 14 nt, Mycobacterium avium subsp. paratuberculosis
cgcgguccacgccg

SEQ ID NO: 823811 - RNA, 15 nt, Mycobacterium avium subsp. paratuberculosis
cgcgguccacgccgg

SEQ ID NO: 823812 - RNA, 17 nt, Mycobacterium avium subsp. paratuberculosis
cgcgguccacgccggcg

SEQ ID NO: 823813 - RNA, 20 nt, Mycobacterium avium subsp. paratuberculosis
cgcgguccacgccggcgauc

SEQ ID NO: 823814 - RNA, 15 nt, Mycobacterium avium subsp. paratuberculosis
cgcgguagcgcucgg

SEQ ID NO: 823815 - RNA, 16 nt, Mycobacterium avium subsp. paratuberculosis
cgcgguagcgcucggu

SEQ ID NO: 823816 - RNA, 16 nt, Mycobacterium avium subsp. paratuberculosis
cgcgggugcgcugcag

SEQ ID NO: 823817 - RNA, 17 nt, Mycobacterium avium subsp. paratuberculosis
cgcgggugcgcugcagc

SEQ ID NO: 823818 - RNA, 17 nt, Mycobacterium avium subsp. paratuberculosis
cgcgggugcggcacggc

SEQ ID NO: 823819 - RNA, 19 nt, Mycobacterium avium subsp. paratuberculosis
cgcgggugcggcgcugccg

SEQ ID NO: 823820 - RNA, 21 nt, Mycobacterium avium subsp. paratuberculosis
cgcgggugcggcgcugccggc

SEQ ID NO: 823821 - RNA, 14 nt, Mycobacterium avium subsp. paratuberculosis
cgcgggucggcgac

SEQ ID NO: 823822 - RNA, 15 nt, Mycobacterium avium subsp. paratuberculosis
cgcgggugaucugcg

SEQ ID NO: 823823 - RNA, 14 nt, Mycobacterium avium subsp. paratuberculosis
cgcgggugcugggc

SEQ ID NO: 823824 - RNA, 14 nt, Mycobacterium avium subsp. paratuberculosis
cgcgggugcagccg

SEQ ID NO: 823825 - RNA, 15 nt, Mycobacterium avium subsp. paratuberculosis
cgcgggugcagccgg

SEQ ID NO: 823826 - RNA, 21 nt, Mycobacterium avium subsp. paratuberculosis
cgcgguagacaccgccguugu

SEQ ID NO: 823827 - RNA, 12 nt, Mycobacterium avium subsp. paratuberculosis
cgcggguccugc

SEQ ID NO: 823828 - RNA, 14 nt, Mycobacterium avium subsp. paratuberculosis
cgcgggucgagcag

SEQ ID NO: 823829 - RNA, 17 nt, Mycobacterium avium subsp. paratuberculosis
cgcgggucgagcagcag

SEQ ID NO: 823830 - RNA, 20 nt, Mycobacterium avium subsp. paratuberculosis
cgcgggucgagcagcagccg

SEQ ID NO: 823831 - RNA, 21 nt, Mycobacterium avium subsp. paratuberculosis
cgcgggucgagcagcagccgc

SEQ ID NO: 823832 - RNA, 14 nt, Mycobacterium avium subsp. paratuberculosis
cgcgggucgccggg

SEQ ID NO: 823833 - RNA, 15 nt, Mycobacterium avium subsp. paratuberculosis
cgcgggucgccgggc

SEQ ID NO: 823834 - RNA, 16 nt, Mycobacterium avium subsp. paratuberculosis
cgcgggucgccgggca

SEQ ID NO: 823835 - RNA, 17 nt, Mycobacterium avium subsp. paratuberculosis
cgcgggucgccgggcag

SEQ ID NO: 823836 - RNA, 13 nt, Mycobacterium avium subsp. paratuberculosis
cgcggguagacgu

SEQ ID NO: 823837 - RNA, 16 nt, Mycobacterium avium subsp. paratuberculosis
cgcggguagcccgucg

SEQ ID NO: 823838 - RNA, 13 nt, Mycobacterium avium subsp. paratuberculosis
cgcggguacggcg

SEQ ID NO: 823839 - RNA, 18 nt, Mycobacterium avium subsp. paratuberculosis
cgcggguacggcggccgc

SEQ ID NO: 823840 - RNA, 20 nt, Mycobacterium avium subsp. paratuberculosis
cgcggguacggcggccgcgg

SEQ ID NO: 823841 - RNA, 21 nt, Mycobacterium avium subsp. paratuberculosis
cgcggguacggcggccgcgga

SEQ ID NO: 823842 - RNA, 18 nt, Mycobacterium avium subsp. paratuberculosis
cgcggguacggucggccg

SEQ ID NO: 823843 - RNA, 22 nt, Mycobacterium avium subsp. paratuberculosis
cgcggguacggucggccguaca

SEQ ID NO: 823844 - RNA, 22 nt, Mycobacterium avium subsp. paratuberculosis
cgcggguauccgugaccccgga

SEQ ID NO: 823845 - RNA, 13 nt, Mycobacterium avium subsp. paratuberculosis
cgcgggucgcugg

SEQ ID NO: 823846 - RNA, 20 nt, Mycobacterium avium subsp. paratuberculosis
cgcgggucggcgccggccag

SEQ ID NO: 823847 - RNA, 15 nt, Mycobacterium avium subsp. paratuberculosis
cgcgggucgucgacg

SEQ ID NO: 823848 - RNA, 19 nt, Mycobacterium avium subsp. paratuberculosis
cgcgggucgucgacgucgg

SEQ ID NO: 823849 - RNA, 14 nt, Mycobacterium avium subsp. paratuberculosis
cgcgggucgucggc

SEQ ID NO: 823850 - RNA, 16 nt, Mycobacterium avium subsp. paratuberculosis
cgcgggucgucgggcg

SEQ ID NO: 823851 - RNA, 18 nt, Mycobacterium avium subsp. paratuberculosis
cgcgggucuggcucggca

SEQ ID NO: 823852 - RNA, 22 nt, Mycobacterium avium subsp. paratuberculosis
cgcgggucuggcucggcaccag

SEQ ID NO: 823853 - RNA, 15 nt, Mycobacterium avium subsp. paratuberculosis
cgcgggugaccggcg

SEQ ID NO: 823854 - RNA, 18 nt, Mycobacterium avium subsp. paratuberculosis
cgcgggugaccggcgccg

SEQ ID NO: 823855 - RNA, 19 nt, Mycobacterium avium subsp. paratuberculosis
cgcgggugaccggcgccgg

SEQ ID NO: 823856 - RNA, 20 nt, Mycobacterium avium subsp. paratuberculosis
cgcgggugaccggcgccggg

SEQ ID NO: 823857 - RNA, 22 nt, Mycobacterium avium subsp. paratuberculosis
cgcgggugacgaucaccgcugc

SEQ ID NO: 823858 - RNA, 16 nt, Mycobacterium avium subsp. paratuberculosis
cgcgggugaggggcgc

SEQ ID NO: 823859 - RNA, 19 nt, Mycobacterium avium subsp. paratuberculosis
cgcgggugaggggcgcgcg

SEQ ID NO: 823860 - RNA, 20 nt, Mycobacterium avium subsp. paratuberculosis
cgcgggugaggggcgcgcgc

SEQ ID NO: 823861 - RNA, 22 nt, Mycobacterium avium subsp. paratuberculosis
cgcgggugauccggugccacgc

SEQ ID NO: 823862 - RNA, 20 nt, Mycobacterium avium subsp. paratuberculosis
cgcggggccaccaggcgccg

SEQ ID NO: 823863 - RNA, 21 nt, Mycobacterium avium subsp. paratuberculosis
cgcggggccaccaggcgccgu

SEQ ID NO: 823864 - RNA, 14 nt, Mycobacterium avium subsp. paratuberculosis
cgcgggcugcggcg

SEQ ID NO: 823865 - RNA, 22 nt, Mycobacterium avium subsp. paratuberculosis
cgcgggcugcagggccgggucg

SEQ ID NO: 823866 - RNA, 23 nt, Mycobacterium avium subsp. paratuberculosis
cgcgggcugcagggccgggucga

SEQ ID NO: 823867 - RNA, 20 nt, Mycobacterium avium subsp. paratuberculosis
cgcgggcguccucgucggcg

SEQ ID NO: 823868 - RNA, 15 nt, Mycobacterium avium subsp. paratuberculosis
cgcgggcgucgggca

SEQ ID NO: 823869 - RNA, 16 nt, Mycobacterium avium subsp. paratuberculosis
cgcgggcgucgggcag

SEQ ID NO: 823870 - RNA, 20 nt, Mycobacterium avium subsp. paratuberculosis
cgcgggcgucgggcagcagc

SEQ ID NO: 823871 - RNA, 15 nt, Mycobacterium avium subsp. paratuberculosis
cgcgggcuaaugcau

SEQ ID NO: 823872 - RNA, 23 nt, Mycobacterium avium subsp. paratuberculosis
cgcgggcuaaugcaucgaugccg

SEQ ID NO: 823873 - RNA, 15 nt, Mycobacterium avium subsp. paratuberculosis
cgcgggcguggcggu

SEQ ID NO: 823874 - RNA, 17 nt, Mycobacterium avium subsp. paratuberculosis
cgcgggcguggcggucg

SEQ ID NO: 823875 - RNA, 22 nt, Mycobacterium avium subsp. paratuberculosis
cgcgggcucgaacaacccggcc

SEQ ID NO: 823876 - RNA, 12 nt, Mycobacterium avium subsp. paratuberculosis
cgcgggcgucca

SEQ ID NO: 823877 - RNA, 14 nt, Mycobacterium avium subsp. paratuberculosis
cgcgggcguccacg

SEQ ID NO: 823878 - RNA, 17 nt, Mycobacterium avium subsp. paratuberculosis
cgcggcggauccagcac

SEQ ID NO: 823879 - RNA, 18 nt, Mycobacterium avium subsp. paratuberculosis
cgcggcggauccagcacc

SEQ ID NO: 823880 - RNA, 19 nt, Mycobacterium avium subsp. paratuberculosis
cgcggcggauccagcaccg

SEQ ID NO: 823881 - RNA, 22 nt, Mycobacterium avium subsp. paratuberculosis
cgcggcggauccagcaccgcca

SEQ ID NO: 823882 - RNA, 19 nt, Mycobacterium avium subsp. paratuberculosis
cgcggcggcaaccagcucc

SEQ ID NO: 823883 - RNA, 23 nt, Mycobacterium avium subsp. paratuberculosis
cgcggcggcaaccagcuccggca

SEQ ID NO: 823884 - RNA, 13 nt, Mycobacterium avium subsp. paratuberculosis
cgcgggcgggccg

SEQ ID NO: 823885 - RNA, 18 nt, Mycobacterium avium subsp. paratuberculosis
cgcgggcggggccugcgg

SEQ ID NO: 823886 - RNA, 23 nt, Mycobacterium avium subsp. paratuberculosis
cgcgggcggggccugcgggacgc

SEQ ID NO: 823887 - RNA, 20 nt, Mycobacterium avium subsp. paratuberculosis
cgcgggcggucgcgcagccg

SEQ ID NO: 823888 - RNA, 19 nt, Mycobacterium avium subsp. paratuberculosis
cgcggcgcuaaagccacca

SEQ ID NO: 823889 - RNA, 14 nt, Mycobacterium avium subsp. paratuberculosis
cgcggcggacagca

SEQ ID NO: 823890 - RNA, 17 nt, Mycobacterium avium subsp. paratuberculosis
cgcggcggacagcacgu

SEQ ID NO: 823891 - RNA, 21 nt, Mycobacterium avium subsp. paratuberculosis
cgcggcggacgauguccgccg

SEQ ID NO: 823892 - RNA, 15 nt, Mycobacterium avium subsp. paratuberculosis
cgcguagccgaccaa

SEQ ID NO: 823893 - RNA, 14 nt, Mycobacterium avium subsp. paratuberculosis
cgcguaggugcggu

SEQ ID NO: 823894 - RNA, 22 nt, Mycobacterium avium subsp. paratuberculosis
cgcguaggccuugcugagccgg

SEQ ID NO: 823895 - RNA, 17 nt, Mycobacterium avium subsp. paratuberculosis
cgcguagcucgccgcgg

SEQ ID NO: 823896 - RNA, 18 nt, Mycobacterium avium subsp. paratuberculosis
cgcguagcucgccgcggc

SEQ ID NO: 823897 - RNA, 20 nt, Mycobacterium avium subsp. paratuberculosis
cgcguagcucgccgcggcca

SEQ ID NO: 823898 - RNA, 15 nt, Mycobacterium avium subsp. paratuberculosis
cgcguagcgcagcuc

SEQ ID NO: 823899 - RNA, 16 nt, Mycobacterium avium subsp. paratuberculosis
cgcguagcgcagcucc

SEQ ID NO: 823900 - RNA, 15 nt, Mycobacterium avium subsp. paratuberculosis
cgcguagcgccgccc

SEQ ID NO: 823901 - RNA, 13 nt, Mycobacterium avium subsp. paratuberculosis
cgcguagcgccgg

SEQ ID NO: 823902 - RNA, 23 nt, Mycobacterium avium subsp. paratuberculosis
cgcguagcgccgguaggccgcgc

SEQ ID NO: 823903 - RNA, 15 nt, Mycobacterium avium subsp. paratuberculosis
cgcgucaaccaccgg

SEQ ID NO: 823904 - RNA, 16 nt, Mycobacterium avium subsp. paratuberculosis
cgcgucaaccaccggc

SEQ ID NO: 823905 - RNA, 20 nt, Mycobacterium avium subsp. paratuberculosis
cgcgucaaccaccggcaucg

SEQ ID NO: 823906 - RNA, 17 nt, Mycobacterium avium subsp. paratuberculosis
cgcguauugcacggcgg

SEQ ID NO: 823907 - RNA, 21 nt, Mycobacterium avium subsp. paratuberculosis
cgcguauugcacggcggcgaa

SEQ ID NO: 823908 - RNA, 20 nt, Mycobacterium avium subsp. paratuberculosis
cgcguaguccagcacggcga

SEQ ID NO: 823909 - RNA, 13 nt, Mycobacterium avium subsp. paratuberculosis
cgcguagucggcg

SEQ ID NO: 823910 - RNA, 16 nt, Mycobacterium avium subsp. paratuberculosis
cgcguagucggcgucg

SEQ ID NO: 823911 - RNA, 17 nt, Mycobacterium avium subsp. paratuberculosis
cgcguagucggcgucgg

SEQ ID NO: 823912 - RNA, 20 nt, Mycobacterium avium subsp. paratuberculosis
cgcguagucggcgucggcca

SEQ ID NO: 823913 - RNA, 17 nt, Mycobacterium avium subsp. paratuberculosis
cgcguacagcgcccgga

SEQ ID NO: 823914 - RNA, 18 nt, Mycobacterium avium subsp. paratuberculosis
cgcguacagcgcccggau

SEQ ID NO: 823915 - RNA, 21 nt, Mycobacterium avium subsp. paratuberculosis
cgcguacagcgcccggauguc

SEQ ID NO: 823916 - RNA, 18 nt, Mycobacterium avium subsp. paratuberculosis
cgcguacagggcgucgga

SEQ ID NO: 823917 - RNA, 15 nt, Mycobacterium avium subsp. paratuberculosis
cgcguaccagcgcca

SEQ ID NO: 823918 - RNA, 16 nt, Mycobacterium avium subsp. paratuberculosis
cgcguacccgcgcggc

SEQ ID NO: 823919 - RNA, 21 nt, Mycobacterium avium subsp. paratuberculosis
cgcguacccgcgcggcgucgg

SEQ ID NO: 823920 - RNA, 16 nt, Mycobacterium avium subsp. paratuberculosis
cgcguacagcgggucg

SEQ ID NO: 823921 - RNA, 13 nt, Mycobacterium avium subsp. paratuberculosis
cgcguacgggaug

SEQ ID NO: 823922 - RNA, 21 nt, Mycobacterium avium subsp. paratuberculosis
cgcguacggguugggcggggc

SEQ ID NO: 823923 - RNA, 20 nt, Mycobacterium avium subsp. paratuberculosis
cgcguacgaccguagccggu

SEQ ID NO: 823924 - RNA, 21 nt, Mycobacterium avium subsp. paratuberculosis
cgcguacgaccguagccgguc

SEQ ID NO: 823925 - RNA, 14 nt, Mycobacterium avium subsp. paratuberculosis
cgcguacgccgccu

SEQ ID NO: 823926 - RNA, 16 nt, Mycobacterium avium subsp. paratuberculosis
cgcguacuccgacaga

SEQ ID NO: 823927 - RNA, 20 nt, Mycobacterium avium subsp. paratuberculosis
cgcguaaaggaugucgccgc

SEQ ID NO: 823928 - RNA, 16 nt, Mycobacterium avium subsp. paratuberculosis
cgcgguuuggucagcg

SEQ ID NO: 823929 - RNA, 21 nt, Mycobacterium avium subsp. paratuberculosis
cgcgguuuugaugccgccggg

SEQ ID NO: 823930 - RNA, 16 nt, Mycobacterium avium subsp. paratuberculosis
cgcguaaccggcggcg

SEQ ID NO: 823931 - RNA, 13 nt, Mycobacterium avium subsp. paratuberculosis
cgcguacaccggc

SEQ ID NO: 823932 - RNA, 15 nt, Mycobacterium avium subsp. paratuberculosis
cgcguacaccggcug

SEQ ID NO: 823933 - RNA, 17 nt, Mycobacterium avium subsp. paratuberculosis
cgcguacaccggcugac

SEQ ID NO: 823934 - RNA, 22 nt, Mycobacterium avium subsp. paratuberculosis
cgcguacaccggcugaccggcg

SEQ ID NO: 823935 - RNA, 17 nt, Mycobacterium avium subsp. paratuberculosis
cgcguacagcagcugcc

SEQ ID NO: 823936 - RNA, 16 nt, Mycobacterium avium subsp. paratuberculosis
cgcguacagccagccc

SEQ ID NO: 823937 - RNA, 18 nt, Mycobacterium avium subsp. paratuberculosis
cgcguacagccagcccgu

SEQ ID NO: 823938 - RNA, 15 nt, Mycobacterium avium subsp. paratuberculosis
cgcgguuggucacca

SEQ ID NO: 823939 - RNA, 21 nt, Mycobacterium avium subsp. paratuberculosis
cgcgguuucaccgugcgcgcg

SEQ ID NO: 823940 - RNA, 23 nt, Mycobacterium avium subsp. paratuberculosis
cgcgguuucaccgugcgcgcgca

SEQ ID NO: 823941 - RNA, 14 nt, Mycobacterium avium subsp. paratuberculosis
cgcgguuuccggcg

SEQ ID NO: 823942 - RNA, 17 nt, Mycobacterium avium subsp. paratuberculosis
cgcgguuuccggcgauu

SEQ ID NO: 823943 - RNA, 15 nt, Mycobacterium avium subsp. paratuberculosis
cgcgguuucggcguc

SEQ ID NO: 823944 - RNA, 18 nt, Mycobacterium avium subsp. paratuberculosis
cgcgguuucggcgucgcc

SEQ ID NO: 823945 - RNA, 19 nt, Mycobacterium avium subsp. paratuberculosis
cgcgguuucggcgucgccu

SEQ ID NO: 823946 - RNA, 16 nt, Mycobacterium avium subsp. paratuberculosis
cgcgguugggccgccg

SEQ ID NO: 823947 - RNA, 21 nt, Mycobacterium avium subsp. paratuberculosis
cgcgguugggccgccggccgc

SEQ ID NO: 823948 - RNA, 21 nt, Mycobacterium avium subsp. paratuberculosis
cgcgguugggccggcgcccgu

SEQ ID NO: 823949 - RNA, 22 nt, Mycobacterium avium subsp. paratuberculosis
cgcgguugaugaucuuggugaa

SEQ ID NO: 823950 - RNA, 15 nt, Mycobacterium avium subsp. paratuberculosis
cgcgguugcccgcac

SEQ ID NO: 823951 - RNA, 16 nt, Mycobacterium avium subsp. paratuberculosis
cgcgguugcccgcacc

SEQ ID NO: 823952 - RNA, 15 nt, Mycobacterium avium subsp. paratuberculosis
cgcgguugcccucgg

SEQ ID NO: 823953 - RNA, 16 nt, Mycobacterium avium subsp. paratuberculosis
cgcgguugcccucggu

SEQ ID NO: 823954 - RNA, 19 nt, Mycobacterium avium subsp. paratuberculosis
cgcgguugcccucggucaa

SEQ ID NO: 823955 - RNA, 17 nt, Mycobacterium avium subsp. paratuberculosis
cgcgguugaacaggcug

SEQ ID NO: 823956 - RNA, 15 nt, Mycobacterium avium subsp. paratuberculosis
cgcgguugaccgccg

SEQ ID NO: 823957 - RNA, 17 nt, Mycobacterium avium subsp. paratuberculosis
cgcgguugaccgccgac

SEQ ID NO: 823958 - RNA, 20 nt, Mycobacterium avium subsp. paratuberculosis
cgcgguugaccgccgacacc

SEQ ID NO: 823959 - RNA, 22 nt, Mycobacterium avium subsp. paratuberculosis
cgcgguugaccgccgacaccac

SEQ ID NO: 823960 - RNA, 23 nt, Mycobacterium avium subsp. paratuberculosis
cgcgguugaccgccgacaccacc

SEQ ID NO: 823961 - RNA, 21 nt, Mycobacterium avium subsp. paratuberculosis
cgcgguugcggguggcggccg

SEQ ID NO: 823962 - RNA, 22 nt, Mycobacterium avium subsp. paratuberculosis
cgcgguugcggguggcggccgg

SEQ ID NO: 823963 - RNA, 23 nt, Mycobacterium avium subsp. paratuberculosis
cgcgguugcggguggcggccggg

SEQ ID NO: 823964 - RNA, 12 nt, Mycobacterium avium subsp. paratuberculosis
cgcggugacgcg

SEQ ID NO: 823965 - RNA, 13 nt, Mycobacterium avium subsp. paratuberculosis
cgcggugagcgcg

SEQ ID NO: 823966 - RNA, 17 nt, Mycobacterium avium subsp. paratuberculosis
cgcggugagcgcgccgg

SEQ ID NO: 823967 - RNA, 22 nt, Mycobacterium avium subsp. paratuberculosis
cgcggugagcgcgccggcccga

SEQ ID NO: 823968 - RNA, 15 nt, Mycobacterium avium subsp. paratuberculosis
cgcggugagcggccg

SEQ ID NO: 823969 - RNA, 19 nt, Mycobacterium avium subsp. paratuberculosis
cgcggugaguucaucgacg

SEQ ID NO: 823970 - RNA, 14 nt, Mycobacterium avium subsp. paratuberculosis
cgcggugauccaga

SEQ ID NO: 823971 - RNA, 13 nt, Mycobacterium avium subsp. paratuberculosis
cgcggugaugccg

SEQ ID NO: 823972 - RNA, 17 nt, Mycobacterium avium subsp. paratuberculosis
cgcggugaugccgaguu

SEQ ID NO: 823973 - RNA, 16 nt, Mycobacterium avium subsp. paratuberculosis
cgcggucggcggcgua

SEQ ID NO: 823974 - RNA, 14 nt, Mycobacterium avium subsp. paratuberculosis
cgcggucggcgucg

SEQ ID NO: 823975 - RNA, 15 nt, Mycobacterium avium subsp. paratuberculosis
cgcggucggcgucgc

SEQ ID NO: 823976 - RNA, 11 nt, Mycobacterium avium subsp. paratuberculosis
cgcggucgggu

SEQ ID NO: 823977 - RNA, 17 nt, Mycobacterium avium subsp. paratuberculosis
cgcggucgggucccggc

SEQ ID NO: 823978 - RNA, 19 nt, Mycobacterium avium subsp. paratuberculosis
cgcggucgggucccggcaa

SEQ ID NO: 823979 - RNA, 17 nt, Mycobacterium avium subsp. paratuberculosis
cgcggucgguggcggug

SEQ ID NO: 823980 - RNA, 23 nt, Mycobacterium avium subsp. paratuberculosis
cgcggucgguggcggugccgcgg

SEQ ID NO: 823981 - RNA, 13 nt, Mycobacterium avium subsp. paratuberculosis
cgcggucucgacc

SEQ ID NO: 823982 - RNA, 21 nt, Mycobacterium avium subsp. paratuberculosis
cgcggucucgaccgacugcga

SEQ ID NO: 823983 - RNA, 20 nt, Mycobacterium avium subsp. paratuberculosis
cgcggucucgaucugcacca

SEQ ID NO: 823984 - RNA, 22 nt, Mycobacterium avium subsp. paratuberculosis
cgcggucucgaucugcaccagc

SEQ ID NO: 823985 - RNA, 23 nt, Mycobacterium avium subsp. paratuberculosis
cgcggucucgaucugcaccagcg

SEQ ID NO: 823986 - RNA, 16 nt, Mycobacterium avium subsp. paratuberculosis
cgcggucgucgcccgu

SEQ ID NO: 823987 - RNA, 20 nt, Mycobacterium avium subsp. paratuberculosis
cgcggucgucgucgucggug

SEQ ID NO: 823988 - RNA, 14 nt, Mycobacterium avium subsp. paratuberculosis
cgcggucugcgcca

SEQ ID NO: 823989 - RNA, 16 nt, Mycobacterium avium subsp. paratuberculosis
cgcggucugcgccagc

SEQ ID NO: 823990 - RNA, 17 nt, Mycobacterium avium subsp. paratuberculosis
cgcggucugcgccagcu

SEQ ID NO: 823991 - RNA, 18 nt, Mycobacterium avium subsp. paratuberculosis
cgcggugaagucggugcc

SEQ ID NO: 823992 - RNA, 20 nt, Mycobacterium avium subsp. paratuberculosis
cgcggugaagucggugccca

SEQ ID NO: 823993 - RNA, 20 nt, Mycobacterium avium subsp. paratuberculosis
cgcggugaaguugccgccgc

SEQ ID NO: 823994 - RNA, 19 nt, Mycobacterium avium subsp. paratuberculosis
cgcggugacaugcccgggc

SEQ ID NO: 823995 - RNA, 12 nt, Mycobacterium avium subsp. paratuberculosis
cgcggugaccgc

SEQ ID NO: 823996 - RNA, 19 nt, Mycobacterium avium subsp. paratuberculosis
cgcggugaccgcccgcucg

SEQ ID NO: 823997 - RNA, 21 nt, Mycobacterium avium subsp. paratuberculosis
cgcggugaccgcccgcucgac

SEQ ID NO: 823998 - RNA, 16 nt, Mycobacterium avium subsp. paratuberculosis
cgcggugaccgccgcc

SEQ ID NO: 823999 - RNA, 21 nt, Mycobacterium avium subsp. paratuberculosis
cgcggugaccgccgccauccg

SEQ ID NO: 824000 - RNA, 13 nt, Mycobacterium avium subsp. paratuberculosis
cgcggugaccgcg

SEQ ID NO: 824001 - RNA, 17 nt, Mycobacterium avium subsp. paratuberculosis
cgcggugaccgcgccgc

SEQ ID NO: 824002 - RNA, 21 nt, Mycobacterium avium subsp. paratuberculosis
cgcggugaccgcgccgcgggu

SEQ ID NO: 824003 - RNA, 19 nt, Mycobacterium avium subsp. paratuberculosis
cgcggugaccgcggccucg

SEQ ID NO: 824004 - RNA, 22 nt, Mycobacterium avium subsp. paratuberculosis
cgcggucugcggugcgcccagg

SEQ ID NO: 824005 - RNA, 15 nt, Mycobacterium avium subsp. paratuberculosis
cgcggucuuuggcgu

SEQ ID NO: 824006 - RNA, 13 nt, Mycobacterium avium subsp. paratuberculosis
cgcggugagcagc

SEQ ID NO: 824007 - RNA, 19 nt, Mycobacterium avium subsp. paratuberculosis
cgcggugagcagcaugccg

SEQ ID NO: 824008 - RNA, 22 nt, Mycobacterium avium subsp. paratuberculosis
cgcggugagcagcaugccgagc

SEQ ID NO: 824009 - RNA, 12 nt, Mycobacterium avium subsp. paratuberculosis
cgcuggaucccc

SEQ ID NO: 824010 - RNA, 15 nt, Mycobacterium avium subsp. paratuberculosis
cgcuggaucccggug

SEQ ID NO: 824011 - RNA, 16 nt, Mycobacterium avium subsp. paratuberculosis
cgcuggaucccgguga

SEQ ID NO: 824012 - RNA, 18 nt, Mycobacterium avium subsp. paratuberculosis
cgcuggauuccaccgugg

SEQ ID NO: 824013 - RNA, 19 nt, Mycobacterium avium subsp. paratuberculosis
cgcuggauuccaccguggu

SEQ ID NO: 824014 - RNA, 12 nt, Mycobacterium avium subsp. paratuberculosis
cgcuggccagcg

SEQ ID NO: 824015 - RNA, 16 nt, Mycobacterium avium subsp. paratuberculosis
cgcuggccagcgcgac

SEQ ID NO: 824016 - RNA, 18 nt, Mycobacterium avium subsp. paratuberculosis
cgcuggccagcgcgacgg

SEQ ID NO: 824017 - RNA, 20 nt, Mycobacterium avium subsp. paratuberculosis
cgcuggccacgauccggggc

SEQ ID NO: 824018 - RNA, 22 nt, Mycobacterium avium subsp. paratuberculosis
cgcuggccacgauccggggcag

SEQ ID NO: 824019 - RNA, 23 nt, Mycobacterium avium subsp. paratuberculosis
cgcuggaagucggucugcggaga

SEQ ID NO: 824020 - RNA, 19 nt, Mycobacterium avium subsp. paratuberculosis
cgcuggaacagcgggccgg

SEQ ID NO: 824021 - RNA, 23 nt, Mycobacterium avium subsp. paratuberculosis
cgcuggaacagcgggccggcguc

SEQ ID NO: 824022 - RNA, 17 nt, Mycobacterium avium subsp. paratuberculosis
cgcuggaacgccgagga

SEQ ID NO: 824023 - RNA, 21 nt, Mycobacterium avium subsp. paratuberculosis
cgcuggacagccacagcucgg

SEQ ID NO: 824024 - RNA, 22 nt, Mycobacterium avium subsp. paratuberculosis
cgcugcuuugucucacgccucg

SEQ ID NO: 824025 - RNA, 22 nt, Mycobacterium avium subsp. paratuberculosis
cgcuggaaaccucuugcggcgc

SEQ ID NO: 824026 - RNA, 17 nt, Mycobacterium avium subsp. paratuberculosis
cgcugcuguugcucggg

SEQ ID NO: 824027 - RNA, 20 nt, Mycobacterium avium subsp. paratuberculosis
cgcugcuuagccccucccac

SEQ ID NO: 824028 - RNA, 22 nt, Mycobacterium avium subsp. paratuberculosis
cgcugcuggucuugccgugcag

SEQ ID NO: 824029 - RNA, 23 nt, Mycobacterium avium subsp. paratuberculosis
cgcugcuggucuugccgugcagc

SEQ ID NO: 824030 - RNA, 19 nt, Mycobacterium avium subsp. paratuberculosis
cgcugcugggugccgcguu

SEQ ID NO: 824031 - RNA, 15 nt, Mycobacterium avium subsp. paratuberculosis
cgcugcugcucggcc

SEQ ID NO: 824032 - RNA, 20 nt, Mycobacterium avium subsp. paratuberculosis
cgcugcugcucggccgcauc

SEQ ID NO: 824033 - RNA, 21 nt, Mycobacterium avium subsp. paratuberculosis
cgcugcugcucggccgcaucg

SEQ ID NO: 824034 - RNA, 16 nt, Mycobacterium avium subsp. paratuberculosis
cgcugcugcugcccgc

SEQ ID NO: 824035 - RNA, 18 nt, Mycobacterium avium subsp. paratuberculosis
cgcugcugcugcccgccc

SEQ ID NO: 824036 - RNA, 17 nt, Mycobacterium avium subsp. paratuberculosis
cgcuggccagcgucagg

SEQ ID NO: 824037 - RNA, 21 nt, Mycobacterium avium subsp. paratuberculosis
cgcuggccagguacaccacca

SEQ ID NO: 824038 - RNA, 13 nt, Mycobacterium avium subsp. paratuberculosis
cgcuggccccggu

SEQ ID NO: 824039 - RNA, 17 nt, Mycobacterium avium subsp. paratuberculosis
cgcuggccgcgccacag

SEQ ID NO: 824040 - RNA, 12 nt, Mycobacterium avium subsp. paratuberculosis
cgcuggcccggc

SEQ ID NO: 824041 - RNA, 13 nt, Mycobacterium avium subsp. paratuberculosis
cgcuggccgaccc

SEQ ID NO: 824042 - RNA, 22 nt, Mycobacterium avium subsp. paratuberculosis
cgcuggccgaucccggccacgu

SEQ ID NO: 824043 - RNA, 16 nt, Mycobacterium avium subsp. paratuberculosis
cgcuggcgaucaccuu

SEQ ID NO: 824044 - RNA, 17 nt, Mycobacterium avium subsp. paratuberculosis
cgcuggcgaucaccuug

SEQ ID NO: 824045 - RNA, 17 nt, Mycobacterium avium subsp. paratuberculosis
cgcuggccguggccgug

SEQ ID NO: 824046 - RNA, 13 nt, Mycobacterium avium subsp. paratuberculosis
cgcuggccggcca

SEQ ID NO: 824047 - RNA, 21 nt, Mycobacterium avium subsp. paratuberculosis
cgcuggccggccaccagcggc

SEQ ID NO: 824048 - RNA, 22 nt, Mycobacterium avium subsp. paratuberculosis
cgcuggccggccaccagcggcc

SEQ ID NO: 824049 - RNA, 22 nt, Mycobacterium avium subsp. paratuberculosis
cgcugggcucgagugccggcag

SEQ ID NO: 824050 - RNA, 18 nt, Mycobacterium avium subsp. paratuberculosis
cgcugggcuggccguccg

SEQ ID NO: 824051 - RNA, 23 nt, Mycobacterium avium subsp. paratuberculosis
cgcugggcggcgacaucgccgag

SEQ ID NO: 824052 - RNA, 15 nt, Mycobacterium avium subsp. paratuberculosis
cgcugggcggcgcgg

SEQ ID NO: 824053 - RNA, 20 nt, Mycobacterium avium subsp. paratuberculosis
cgcugggcggcgcggcgguc

SEQ ID NO: 824054 - RNA, 16 nt, Mycobacterium avium subsp. paratuberculosis
cgcuggucgcgaagcg

SEQ ID NO: 824055 - RNA, 12 nt, Mycobacterium avium subsp. paratuberculosis
cgcuggucggcg

SEQ ID NO: 824056 - RNA, 14 nt, Mycobacterium avium subsp. paratuberculosis
cgcuggucggcgaa

SEQ ID NO: 824057 - RNA, 18 nt, Mycobacterium avium subsp. paratuberculosis
cgcuggucggcgaaccgu

SEQ ID NO: 824058 - RNA, 17 nt, Mycobacterium avium subsp. paratuberculosis
cgcuggucggcgggcag

SEQ ID NO: 824059 - RNA, 20 nt, Mycobacterium avium subsp. paratuberculosis
cgcuggucggcgggcagcga

SEQ ID NO: 824060 - RNA, 17 nt, Mycobacterium avium subsp. paratuberculosis
cgcugggacugaaguag

SEQ ID NO: 824061 - RNA, 19 nt, Mycobacterium avium subsp. paratuberculosis
cgcugggagcgggccacgc

SEQ ID NO: 824062 - RNA, 13 nt, Mycobacterium avium subsp. paratuberculosis
cgcugcgacaggu

SEQ ID NO: 824063 - RNA, 15 nt, Mycobacterium avium subsp. paratuberculosis
cgcugcgacaggucg

SEQ ID NO: 824064 - RNA, 18 nt, Mycobacterium avium subsp. paratuberculosis
cgcugcgacaggucggcg

SEQ ID NO: 824065 - RNA, 13 nt, Mycobacterium avium subsp. paratuberculosis
cgcugcgccguug

SEQ ID NO: 824066 - RNA, 14 nt, Mycobacterium avium subsp. paratuberculosis
cgcugcgcgacacc

SEQ ID NO: 824067 - RNA, 12 nt, Mycobacterium avium subsp. paratuberculosis
cgcugccccggc

SEQ ID NO: 824068 - RNA, 19 nt, Mycobacterium avium subsp. paratuberculosis
cgcugccgcccccgcuggc

SEQ ID NO: 824069 - RNA, 12 nt, Mycobacterium avium subsp. paratuberculosis
cgcugccgcacc

SEQ ID NO: 824070 - RNA, 14 nt, Mycobacterium avium subsp. paratuberculosis
cgcugccguagcgc

SEQ ID NO: 824071 - RNA, 12 nt, Mycobacterium avium subsp. paratuberculosis
cgcugccgucca

SEQ ID NO: 824072 - RNA, 18 nt, Mycobacterium avium subsp. paratuberculosis
cgcugccguccacccggc

SEQ ID NO: 824073 - RNA, 20 nt, Mycobacterium avium subsp. paratuberculosis
cgcugccguccacccggccc

SEQ ID NO: 824074 - RNA, 17 nt, Mycobacterium avium subsp. paratuberculosis
cgcugccguccggcggc

SEQ ID NO: 824075 - RNA, 18 nt, Mycobacterium avium subsp. paratuberculosis
cgcugccguccggcggca

SEQ ID NO: 824076 - RNA, 12 nt, Mycobacterium avium subsp. paratuberculosis
cgcugcccgccg

SEQ ID NO: 824077 - RNA, 16 nt, Mycobacterium avium subsp. paratuberculosis
cgcugcccgaugguga

SEQ ID NO: 824078 - RNA, 15 nt, Mycobacterium avium subsp. paratuberculosis
cgcugccccagccac

SEQ ID NO: 824079 - RNA, 14 nt, Mycobacterium avium subsp. paratuberculosis
cgcugcccgccgcg

SEQ ID NO: 824080 - RNA, 16 nt, Mycobacterium avium subsp. paratuberculosis
cgcugcccgccgcggu

SEQ ID NO: 824081 - RNA, 17 nt, Mycobacterium avium subsp. paratuberculosis
cgcugcccgccgcggug

SEQ ID NO: 824082 - RNA, 18 nt, Mycobacterium avium subsp. paratuberculosis
cgcugcccgccgcggugc

SEQ ID NO: 824083 - RNA, 20 nt, Mycobacterium avium subsp. paratuberculosis
cgcugcccgccgcguacagc

SEQ ID NO: 824084 - RNA, 15 nt, Mycobacterium avium subsp. paratuberculosis
cgcugcccggcgugu

SEQ ID NO: 824085 - RNA, 21 nt, Mycobacterium avium subsp. paratuberculosis
cgcugcccgggcaucccgccg

SEQ ID NO: 824086 - RNA, 16 nt, Mycobacterium avium subsp. paratuberculosis
cgcugcccucggucgc

SEQ ID NO: 824087 - RNA, 22 nt, Mycobacterium avium subsp. paratuberculosis
cgcugcccucggucgccgaauc

SEQ ID NO: 824088 - RNA, 14 nt, Mycobacterium avium subsp. paratuberculosis
cgcugcccgucgac

SEQ ID NO: 824089 - RNA, 15 nt, Mycobacterium avium subsp. paratuberculosis
cgcugcccgucgacc

SEQ ID NO: 824090 - RNA, 14 nt, Mycobacterium avium subsp. paratuberculosis
cgcugcccgugccg

SEQ ID NO: 824091 - RNA, 15 nt, Mycobacterium avium subsp. paratuberculosis
cgcugcccgugccgc

SEQ ID NO: 824092 - RNA, 17 nt, Mycobacterium avium subsp. paratuberculosis
cgcugcccgugccgcac

SEQ ID NO: 824093 - RNA, 18 nt, Mycobacterium avium subsp. paratuberculosis
cgcugcccgugccgcacc

SEQ ID NO: 824094 - RNA, 15 nt, Mycobacterium avium subsp. paratuberculosis
cgcugaucaccacgg

SEQ ID NO: 824095 - RNA, 22 nt, Mycobacterium avium subsp. paratuberculosis
cgcugauccagcagcgccucgg

SEQ ID NO: 824096 - RNA, 23 nt, Mycobacterium avium subsp. paratuberculosis
cgcugauccagcagcgccucggc

SEQ ID NO: 824097 - RNA, 22 nt, Mycobacterium avium subsp. paratuberculosis
cgcugaucuacgucggcuggcg

SEQ ID NO: 824098 - RNA, 17 nt, Mycobacterium avium subsp. paratuberculosis
cgcugaucgcgauccgg

SEQ ID NO: 824099 - RNA, 21 nt, Mycobacterium avium subsp. paratuberculosis
cgcugaucgcgauccgggcgc

SEQ ID NO: 824100 - RNA, 16 nt, Mycobacterium avium subsp. paratuberculosis
cgcugcggcacaccag

SEQ ID NO: 824101 - RNA, 17 nt, Mycobacterium avium subsp. paratuberculosis
cgcugcggcacaccagc

SEQ ID NO: 824102 - RNA, 16 nt, Mycobacterium avium subsp. paratuberculosis
cgcugcgcgcguuguc

SEQ ID NO: 824103 - RNA, 23 nt, Mycobacterium avium subsp. paratuberculosis
cgcugcgcgcguuguccagcagc

SEQ ID NO: 824104 - RNA, 17 nt, Mycobacterium avium subsp. paratuberculosis
cgcugcgcgcgcgaucg

SEQ ID NO: 824105 - RNA, 21 nt, Mycobacterium avium subsp. paratuberculosis
cgcugcgcgcgcgaucggugu

SEQ ID NO: 824106 - RNA, 12 nt, Mycobacterium avium subsp. paratuberculosis
cgcugcgcgggu

SEQ ID NO: 824107 - RNA, 17 nt, Mycobacterium avium subsp. paratuberculosis
cgcugcgcgggucggcg

SEQ ID NO: 824108 - RNA, 12 nt, Mycobacterium avium subsp. paratuberculosis
cgcugcgcucgc

SEQ ID NO: 824109 - RNA, 24 nt, Mycobacterium avium subsp. paratuberculosis
cgcugcgggccaucgacuccagca

SEQ ID NO: 824110 - RNA, 16 nt, Mycobacterium avium subsp. paratuberculosis
cgcugcgggcgggccg

SEQ ID NO: 824111 - RNA, 14 nt, Mycobacterium avium subsp. paratuberculosis
cgcugcggcgucgu

SEQ ID NO: 824112 - RNA, 15 nt, Mycobacterium avium subsp. paratuberculosis
cgcugcggcgucguc

SEQ ID NO: 824113 - RNA, 19 nt, Mycobacterium avium subsp. paratuberculosis
cgcugcgguacacguggcc

SEQ ID NO: 824114 - RNA, 13 nt, Mycobacterium avium subsp. paratuberculosis
cgcugcggcgcag

SEQ ID NO: 824115 - RNA, 13 nt, Mycobacterium avium subsp. paratuberculosis
cgcugcggcgccg

SEQ ID NO: 824116 - RNA, 17 nt, Mycobacterium avium subsp. paratuberculosis
cgcugcggcgccgggca

SEQ ID NO: 824117 - RNA, 12 nt, Mycobacterium avium subsp. paratuberculosis
cgcugcggcaca

SEQ ID NO: 824118 - RNA, 15 nt, Mycobacterium avium subsp. paratuberculosis
cgcugcucugcgcgc

SEQ ID NO: 824119 - RNA, 18 nt, Mycobacterium avium subsp. paratuberculosis
cgcugcucugcgcgcggu

SEQ ID NO: 824120 - RNA, 19 nt, Mycobacterium avium subsp. paratuberculosis
cgcugcucugcgcgcggug

SEQ ID NO: 824121 - RNA, 17 nt, Mycobacterium avium subsp. paratuberculosis
cgcugcucgaccucggc

SEQ ID NO: 824122 - RNA, 18 nt, Mycobacterium avium subsp. paratuberculosis
cgcugcgggaagccgagu

SEQ ID NO: 824123 - RNA, 13 nt, Mycobacterium avium subsp. paratuberculosis
cgcugcuccgggu

SEQ ID NO: 824124 - RNA, 15 nt, Mycobacterium avium subsp. paratuberculosis
cgcugcuccgggucc

SEQ ID NO: 824125 - RNA, 19 nt, Mycobacterium avium subsp. paratuberculosis
cgcugcuccggguccgcgg

SEQ ID NO: 824126 - RNA, 19 nt, Mycobacterium avium subsp. paratuberculosis
cgcucgcccagcgcggcgg

SEQ ID NO: 824127 - RNA, 20 nt, Mycobacterium avium subsp. paratuberculosis
cgcucgcccagcgcggcggc

SEQ ID NO: 824128 - RNA, 21 nt, Mycobacterium avium subsp. paratuberculosis
cgcucgcccagcgcggcggcc

SEQ ID NO: 824129 - RNA, 22 nt, Mycobacterium avium subsp. paratuberculosis
cgcucgccaugcgaccacgacc

SEQ ID NO: 824130 - RNA, 23 nt, Mycobacterium avium subsp. paratuberculosis
cgcucgccaugcgaccacgaccg

SEQ ID NO: 824131 - RNA, 16 nt, Mycobacterium avium subsp. paratuberculosis
cgcucggcgcgucguc

SEQ ID NO: 824132 - RNA, 14 nt, Mycobacterium avium subsp. paratuberculosis
cgcucggcggcgac

SEQ ID NO: 824133 - RNA, 15 nt, Mycobacterium avium subsp. paratuberculosis
cgcucggcggcgacg

SEQ ID NO: 824134 - RNA, 13 nt, Mycobacterium avium subsp. paratuberculosis
cgcucggcggcgc

SEQ ID NO: 824135 - RNA, 14 nt, Mycobacterium avium subsp. paratuberculosis
cgcucggcggcgcc

SEQ ID NO: 824136 - RNA, 15 nt, Mycobacterium avium subsp. paratuberculosis
cgcucggcggcgccg

SEQ ID NO: 824137 - RNA, 20 nt, Mycobacterium avium subsp. paratuberculosis
cgcucggcggcgccgucguc

SEQ ID NO: 824138 - RNA, 15 nt, Mycobacterium avium subsp. paratuberculosis
cgcucggcggcgcgc

SEQ ID NO: 824139 - RNA, 22 nt, Mycobacterium avium subsp. paratuberculosis
cgcucgauggaauucgucggcg

SEQ ID NO: 824140 - RNA, 18 nt, Mycobacterium avium subsp. paratuberculosis
cgcucgauggcgccgauc

SEQ ID NO: 824141 - RNA, 19 nt, Mycobacterium avium subsp. paratuberculosis
cgcucgauggcgccgaucg

SEQ ID NO: 824142 - RNA, 19 nt, Mycobacterium avium subsp. paratuberculosis
cgcucgauggguguggcgu

SEQ ID NO: 824143 - RNA, 20 nt, Mycobacterium avium subsp. paratuberculosis
cgcucgauggguguggcguc

SEQ ID NO: 824144 - RNA, 13 nt, Mycobacterium avium subsp. paratuberculosis
cgcucgcaccagc

SEQ ID NO: 824145 - RNA, 14 nt, Mycobacterium avium subsp. paratuberculosis
cgcucgcaccagcg

SEQ ID NO: 824146 - RNA, 17 nt, Mycobacterium avium subsp. paratuberculosis
cgcucgggcuucggcgu

SEQ ID NO: 824147 - RNA, 19 nt, Mycobacterium avium subsp. paratuberculosis
cgcucgggcuucggcguca

SEQ ID NO: 824148 - RNA, 14 nt, Mycobacterium avium subsp. paratuberculosis
cgcucgggcgugcg

SEQ ID NO: 824149 - RNA, 12 nt, Mycobacterium avium subsp. paratuberculosis
cgcucgggccau

SEQ ID NO: 824150 - RNA, 12 nt, Mycobacterium avium subsp. paratuberculosis
cgcucgggccgg

SEQ ID NO: 824151 - RNA, 15 nt, Mycobacterium avium subsp. paratuberculosis
cgcucgggccggcgc

SEQ ID NO: 824152 - RNA, 16 nt, Mycobacterium avium subsp. paratuberculosis
cgcucgggccggcgcc

SEQ ID NO: 824153 - RNA, 18 nt, Mycobacterium avium subsp. paratuberculosis
cgcucgggccggcgccga

SEQ ID NO: 824154 - RNA, 14 nt, Mycobacterium avium subsp. paratuberculosis
cgcucggcucgauc

SEQ ID NO: 824155 - RNA, 13 nt, Mycobacterium avium subsp. paratuberculosis
cgcucggcguugg

SEQ ID NO: 824156 - RNA, 20 nt, Mycobacterium avium subsp. paratuberculosis
cgcucggcguuggcguaguc

SEQ ID NO: 824157 - RNA, 13 nt, Mycobacterium avium subsp. paratuberculosis
cgcucggcggguc

SEQ ID NO: 824158 - RNA, 23 nt, Mycobacterium avium subsp. paratuberculosis
cgcucggcggguugcugagccgc

SEQ ID NO: 824159 - RNA, 18 nt, Mycobacterium avium subsp. paratuberculosis
cgcucgggggugcccggc

SEQ ID NO: 824160 - RNA, 20 nt, Mycobacterium avium subsp. paratuberculosis
cgcucgggugucgccgagcc

SEQ ID NO: 824161 - RNA, 22 nt, Mycobacterium avium subsp. paratuberculosis
cgcucgggugucgccgagccgc

SEQ ID NO: 824162 - RNA, 14 nt, Mycobacterium avium subsp. paratuberculosis
cgcucggucagcac

SEQ ID NO: 824163 - RNA, 17 nt, Mycobacterium avium subsp. paratuberculosis
cgcucggucgccacggc

SEQ ID NO: 824164 - RNA, 20 nt, Mycobacterium avium subsp. paratuberculosis
cgcucggucgccacggccgg

SEQ ID NO: 824165 - RNA, 20 nt, Mycobacterium avium subsp. paratuberculosis
cgcucggucgcggcgaucgg

SEQ ID NO: 824166 - RNA, 16 nt, Mycobacterium avium subsp. paratuberculosis
cgcucgguggacaggu

SEQ ID NO: 824167 - RNA, 18 nt, Mycobacterium avium subsp. paratuberculosis
cgcucguaacgccacggc

SEQ ID NO: 824168 - RNA, 20 nt, Mycobacterium avium subsp. paratuberculosis
cgcucguaacgccacggcgg

SEQ ID NO: 824169 - RNA, 23 nt, Mycobacterium avium subsp. paratuberculosis
cgcucguaacgccacggcggccg

SEQ ID NO: 824170 - RNA, 23 nt, Mycobacterium avium subsp. paratuberculosis
cgcugagucuacuuggccagcug

SEQ ID NO: 824171 - RNA, 16 nt, Mycobacterium avium subsp. paratuberculosis
cgcugacggucgccga

SEQ ID NO: 824172 - RNA, 17 nt, Mycobacterium avium subsp. paratuberculosis
cgcugacggucgccgac

SEQ ID NO: 824173 - RNA, 18 nt, Mycobacterium avium subsp. paratuberculosis
cgcugacggucgccgacu

SEQ ID NO: 824174 - RNA, 19 nt, Mycobacterium avium subsp. paratuberculosis
cgcugacgucgaugccggc

SEQ ID NO: 824175 - RNA, 21 nt, Mycobacterium avium subsp. paratuberculosis
cgcugacgucgaugccggcca

SEQ ID NO: 824176 - RNA, 20 nt, Mycobacterium avium subsp. paratuberculosis
cgcugacuccaucccgugcg

SEQ ID NO: 824177 - RNA, 19 nt, Mycobacterium avium subsp. paratuberculosis
cgcugagguagucccgcgc

SEQ ID NO: 824178 - RNA, 22 nt, Mycobacterium avium subsp. paratuberculosis
cgcugagguagucccgcgccug

SEQ ID NO: 824179 - RNA, 19 nt, Mycobacterium avium subsp. paratuberculosis
cgcugaccugugcgcccca

SEQ ID NO: 824180 - RNA, 20 nt, Mycobacterium avium subsp. paratuberculosis
cgcugaccuucuuggucagc

SEQ ID NO: 824181 - RNA, 18 nt, Mycobacterium avium subsp. paratuberculosis
cgcugacgaugcggccgg

SEQ ID NO: 824182 - RNA, 20 nt, Mycobacterium avium subsp. paratuberculosis
cgcugacgaugcggccggcg

SEQ ID NO: 824183 - RNA, 22 nt, Mycobacterium avium subsp. paratuberculosis
cgcugacgaugcggccggcggg

SEQ ID NO: 824184 - RNA, 23 nt, Mycobacterium avium subsp. paratuberculosis
cgcugacgaugcggccggcgggc

SEQ ID NO: 824185 - RNA, 14 nt, Mycobacterium avium subsp. paratuberculosis
cgcugacgccguug

SEQ ID NO: 824186 - RNA, 15 nt, Mycobacterium avium subsp. paratuberculosis
cgcugacgcggcggg

SEQ ID NO: 824187 - RNA, 16 nt, Mycobacterium avium subsp. paratuberculosis
cgcucugccgggccgc

SEQ ID NO: 824188 - RNA, 19 nt, Mycobacterium avium subsp. paratuberculosis
cgcucguaguuggggccgg

SEQ ID NO: 824189 - RNA, 14 nt, Mycobacterium avium subsp. paratuberculosis
cgcucgucggccag

SEQ ID NO: 824190 - RNA, 20 nt, Mycobacterium avium subsp. paratuberculosis
cgcucgucggcgcgggccag

SEQ ID NO: 824191 - RNA, 14 nt, Mycobacterium avium subsp. paratuberculosis
cgcucgucgagucc

SEQ ID NO: 824192 - RNA, 12 nt, Mycobacterium avium subsp. paratuberculosis
cgcucgucgauc

SEQ ID NO: 824193 - RNA, 15 nt, Mycobacterium avium subsp. paratuberculosis
cgcucuucagcgcga

SEQ ID NO: 824194 - RNA, 21 nt, Mycobacterium avium subsp. paratuberculosis
cgcucuucggucaucgugauc

SEQ ID NO: 824195 - RNA, 16 nt, Mycobacterium avium subsp. paratuberculosis
cgcucuugggcggccg

SEQ ID NO: 824196 - RNA, 18 nt, Mycobacterium avium subsp. paratuberculosis
cgcucgucgucgccgaug

SEQ ID NO: 824197 - RNA, 16 nt, Mycobacterium avium subsp. paratuberculosis
cgcucuguuggccguc

SEQ ID NO: 824198 - RNA, 18 nt, Mycobacterium avium subsp. paratuberculosis
cgcucuguuggccgucgc

SEQ ID NO: 824199 - RNA, 18 nt, Mycobacterium avium subsp. paratuberculosis
cgcucaucccgaugucgg

SEQ ID NO: 824200 - RNA, 15 nt, Mycobacterium avium subsp. paratuberculosis
cgcucaugcccgcca

SEQ ID NO: 824201 - RNA, 18 nt, Mycobacterium avium subsp. paratuberculosis
cgcucauguugugcaggc

SEQ ID NO: 824202 - RNA, 21 nt, Mycobacterium avium subsp. paratuberculosis
cgcucauguugugcaggcagc

SEQ ID NO: 824203 - RNA, 21 nt, Mycobacterium avium subsp. paratuberculosis
cgcuccauuuugaacgccucg

SEQ ID NO: 824204 - RNA, 16 nt, Mycobacterium avium subsp. paratuberculosis
cgcuccacaucugccg

SEQ ID NO: 824205 - RNA, 18 nt, Mycobacterium avium subsp. paratuberculosis
cgcuccaccagcgcggug

SEQ ID NO: 824206 - RNA, 22 nt, Mycobacterium avium subsp. paratuberculosis
cgcuccaccgaaaagcccgccg

SEQ ID NO: 824207 - RNA, 18 nt, Mycobacterium avium subsp. paratuberculosis
cgcuccagaugcgguggu

SEQ ID NO: 824208 - RNA, 22 nt, Mycobacterium avium subsp. paratuberculosis
cgcuccagaugcggugguggga

SEQ ID NO: 824209 - RNA, 18 nt, Mycobacterium avium subsp. paratuberculosis
cgcuccagcaggcuggcg

SEQ ID NO: 824210 - RNA, 14 nt, Mycobacterium avium subsp. paratuberculosis
cgcuccagcggcca

SEQ ID NO: 824211 - RNA, 18 nt, Mycobacterium avium subsp. paratuberculosis
cgcuccagcggccacacc

SEQ ID NO: 824212 - RNA, 20 nt, Mycobacterium avium subsp. paratuberculosis
cgcuccagcggccacaccgg

SEQ ID NO: 824213 - RNA, 18 nt, Mycobacterium avium subsp. paratuberculosis
cgcuccagcgggcggcgg

SEQ ID NO: 824214 - RNA, 21 nt, Mycobacterium avium subsp. paratuberculosis
cgcuccagcgggcggcggugg

SEQ ID NO: 824215 - RNA, 15 nt, Mycobacterium avium subsp. paratuberculosis
cgcucgacgaggcgg

SEQ ID NO: 824216 - RNA, 19 nt, Mycobacterium avium subsp. paratuberculosis
cgcucgacgaggcgggcga

SEQ ID NO: 824217 - RNA, 21 nt, Mycobacterium avium subsp. paratuberculosis
cgcucgacgaugucgacgccc

SEQ ID NO: 824218 - RNA, 14 nt, Mycobacterium avium subsp. paratuberculosis
cgcucgacggccgg

SEQ ID NO: 824219 - RNA, 16 nt, Mycobacterium avium subsp. paratuberculosis
cgcucgacggccggug

SEQ ID NO: 824220 - RNA, 17 nt, Mycobacterium avium subsp. paratuberculosis
cgcucgacggccgguga

SEQ ID NO: 824221 - RNA, 17 nt, Mycobacterium avium subsp. paratuberculosis
cgcucgacgcgucgaca

SEQ ID NO: 824222 - RNA, 16 nt, Mycobacterium avium subsp. paratuberculosis
cgcucgaccccucggc

SEQ ID NO: 824223 - RNA, 18 nt, Mycobacterium avium subsp. paratuberculosis
cgcucgaacucaccggug

SEQ ID NO: 824224 - RNA, 22 nt, Mycobacterium avium subsp. paratuberculosis
cgcuccguugggucucaucccg

SEQ ID NO: 824225 - RNA, 22 nt, Mycobacterium avium subsp. paratuberculosis
cgcuccucgaucaucgcgucgg

SEQ ID NO: 824226 - RNA, 13 nt, Mycobacterium avium subsp. paratuberculosis
cgcuccugcagcg

SEQ ID NO: 824227 - RNA, 21 nt, Mycobacterium avium subsp. paratuberculosis
cgcuccugcagcgcggcgauc

SEQ ID NO: 824228 - RNA, 22 nt, Mycobacterium avium subsp. paratuberculosis
cgcuccugcagcgcggcgauca

SEQ ID NO: 824229 - RNA, 13 nt, Mycobacterium avium subsp. paratuberculosis
cgcuccugcaggc

SEQ ID NO: 824230 - RNA, 15 nt, Mycobacterium avium subsp. paratuberculosis
cgcuccugcaggccg

SEQ ID NO: 824231 - RNA, 16 nt, Mycobacterium avium subsp. paratuberculosis
cgcuccugcaggccga

SEQ ID NO: 824232 - RNA, 22 nt, Mycobacterium avium subsp. paratuberculosis
cgcuccggcccgagcaccacca

SEQ ID NO: 824233 - RNA, 13 nt, Mycobacterium avium subsp. paratuberculosis
cgcuccuccucgc

SEQ ID NO: 824234 - RNA, 18 nt, Mycobacterium avium subsp. paratuberculosis
cgcuccuccucgcgccgc

SEQ ID NO: 824235 - RNA, 14 nt, Mycobacterium avium subsp. paratuberculosis
cgcuccggucgcgu

SEQ ID NO: 824236 - RNA, 23 nt, Mycobacterium avium subsp. paratuberculosis
cgcuccggucgcgucgugcggcc

SEQ ID NO: 824237 - RNA, 13 nt, Mycobacterium avium subsp. paratuberculosis
cgcuccgcggcgg

SEQ ID NO: 824238 - RNA, 20 nt, Mycobacterium avium subsp. paratuberculosis
cgcuccgcgggcagcgagca

SEQ ID NO: 824239 - RNA, 22 nt, Mycobacterium avium subsp. paratuberculosis
cgcuccgcgggcagcgagcaca

SEQ ID NO: 824240 - RNA, 12 nt, Mycobacterium avium subsp. paratuberculosis
cgcuccgcggug

SEQ ID NO: 824241 - RNA, 13 nt, Mycobacterium avium subsp. paratuberculosis
cgcucccggcgcc

SEQ ID NO: 824242 - RNA, 14 nt, Mycobacterium avium subsp. paratuberculosis
cgcucccggcgccg

SEQ ID NO: 824243 - RNA, 16 nt, Mycobacterium avium subsp. paratuberculosis
cgcucccgcgcgggca

SEQ ID NO: 824244 - RNA, 18 nt, Mycobacterium avium subsp. paratuberculosis
cgcgccgcauuggcaccg

SEQ ID NO: 824245 - RNA, 21 nt, Mycobacterium avium subsp. paratuberculosis
cgcgccgcauuggcaccgucg

SEQ ID NO: 824246 - RNA, 19 nt, Mycobacterium avium subsp. paratuberculosis
cgcgccgcaaccgucaguu

SEQ ID NO: 824247 - RNA, 17 nt, Mycobacterium avium subsp. paratuberculosis
cgcgccgcaccucgccg

SEQ ID NO: 824248 - RNA, 13 nt, Mycobacterium avium subsp. paratuberculosis
cgcgccgcagcgc

SEQ ID NO: 824249 - RNA, 15 nt, Mycobacterium avium subsp. paratuberculosis
cgcgccgcagcgcgc

SEQ ID NO: 824250 - RNA, 20 nt, Mycobacterium avium subsp. paratuberculosis
cgcgccgcagcgcgcgcucg

SEQ ID NO: 824251 - RNA, 22 nt, Mycobacterium avium subsp. paratuberculosis
cgcgccgcaggagaucggcgcg

SEQ ID NO: 824252 - RNA, 19 nt, Mycobacterium avium subsp. paratuberculosis
cgcgccgcccccgcggcgu

SEQ ID NO: 824253 - RNA, 17 nt, Mycobacterium avium subsp. paratuberculosis
cgcgccgcccagcggcc

SEQ ID NO: 824254 - RNA, 14 nt, Mycobacterium avium subsp. paratuberculosis
cgcgccgccacacc

SEQ ID NO: 824255 - RNA, 17 nt, Mycobacterium avium subsp. paratuberculosis
cgcgccgcucggccagc

SEQ ID NO: 824256 - RNA, 18 nt, Mycobacterium avium subsp. paratuberculosis
cgcgccgcucggccagca

SEQ ID NO: 824257 - RNA, 13 nt, Mycobacterium avium subsp. paratuberculosis
cgcgccgcugacu

SEQ ID NO: 824258 - RNA, 13 nt, Mycobacterium avium subsp. paratuberculosis
cgcgccgcgucgu

SEQ ID NO: 824259 - RNA, 14 nt, Mycobacterium avium subsp. paratuberculosis
cgcgccgcgucguc

SEQ ID NO: 824260 - RNA, 16 nt, Mycobacterium avium subsp. paratuberculosis
cgcgccgcgucgucgu

SEQ ID NO: 824261 - RNA, 21 nt, Mycobacterium avium subsp. paratuberculosis
cgcgccgcgucgucgucgacc

SEQ ID NO: 824262 - RNA, 23 nt, Mycobacterium avium subsp. paratuberculosis
cgcgccgcgguagaaccaacgcg

SEQ ID NO: 824263 - RNA, 17 nt, Mycobacterium avium subsp. paratuberculosis
cgcgccgcggcgcuuga

SEQ ID NO: 824264 - RNA, 14 nt, Mycobacterium avium subsp. paratuberculosis
cgcgccgcggccag

SEQ ID NO: 824265 - RNA, 15 nt, Mycobacterium avium subsp. paratuberculosis
cgcgccgcggccagc

SEQ ID NO: 824266 - RNA, 16 nt, Mycobacterium avium subsp. paratuberculosis
cgcgccgcggccagcg

SEQ ID NO: 824267 - RNA, 17 nt, Mycobacterium avium subsp. paratuberculosis
cgcgccgccacgcggcg

SEQ ID NO: 824268 - RNA, 15 nt, Mycobacterium avium subsp. paratuberculosis
cgcgccggaugcugc

SEQ ID NO: 824269 - RNA, 18 nt, Mycobacterium avium subsp. paratuberculosis
cgcgccggaugguccgca

SEQ ID NO: 824270 - RNA, 13 nt, Mycobacterium avium subsp. paratuberculosis
cgcgccggccagc

SEQ ID NO: 824271 - RNA, 14 nt, Mycobacterium avium subsp. paratuberculosis
cgcgccggccagca

SEQ ID NO: 824272 - RNA, 17 nt, Mycobacterium avium subsp. paratuberculosis
cgcgccggccagcagca

SEQ ID NO: 824273 - RNA, 18 nt, Mycobacterium avium subsp. paratuberculosis
cgcgccggcacucgucgu

SEQ ID NO: 824274 - RNA, 20 nt, Mycobacterium avium subsp. paratuberculosis
cgcgccggccgccgcgaucu

SEQ ID NO: 824275 - RNA, 13 nt, Mycobacterium avium subsp. paratuberculosis
cgcgccggccgga

SEQ ID NO: 824276 - RNA, 17 nt, Mycobacterium avium subsp. paratuberculosis
cgcgccggccggcacga

SEQ ID NO: 824277 - RNA, 23 nt, Mycobacterium avium subsp. paratuberculosis
cgcgccggccggcacgauggcgc

SEQ ID NO: 824278 - RNA, 13 nt, Mycobacterium avium subsp. paratuberculosis
cgcgccggcggcg

SEQ ID NO: 824279 - RNA, 12 nt, Mycobacterium avium subsp. paratuberculosis
cgcgccggcggu

SEQ ID NO: 824280 - RNA, 16 nt, Mycobacterium avium subsp. paratuberculosis
cgcgccgucgucggac

SEQ ID NO: 824281 - RNA, 23 nt, Mycobacterium avium subsp. paratuberculosis
cgcgccgucgucggacaccagca

SEQ ID NO: 824282 - RNA, 14 nt, Mycobacterium avium subsp. paratuberculosis
cgcgccgucgucgu

SEQ ID NO: 824283 - RNA, 16 nt, Mycobacterium avium subsp. paratuberculosis
cgcgccgucgucgucg

SEQ ID NO: 824284 - RNA, 17 nt, Mycobacterium avium subsp. paratuberculosis
cgcgccgucuccggcgu

SEQ ID NO: 824285 - RNA, 17 nt, Mycobacterium avium subsp. paratuberculosis
cgcgccgucuuccgggc

SEQ ID NO: 824286 - RNA, 18 nt, Mycobacterium avium subsp. paratuberculosis
cgcgccgucuuccgggcc

SEQ ID NO: 824287 - RNA, 22 nt, Mycobacterium avium subsp. paratuberculosis
cgcgccgugaacugugcggugc

SEQ ID NO: 824288 - RNA, 24 nt, Mycobacterium avium subsp. paratuberculosis
cgcgccggcgcgcagccagucgcc

SEQ ID NO: 824289 - RNA, 15 nt, Mycobacterium avium subsp. paratuberculosis
cgcgccggcggccgc

SEQ ID NO: 824290 - RNA, 17 nt, Mycobacterium avium subsp. paratuberculosis
cgcgccggcggccgccg

SEQ ID NO: 824291 - RNA, 14 nt, Mycobacterium avium subsp. paratuberculosis
cgcgccggcgcggg

SEQ ID NO: 824292 - RNA, 16 nt, Mycobacterium avium subsp. paratuberculosis
cgcgccggcgcgggca

SEQ ID NO: 824293 - RNA, 19 nt, Mycobacterium avium subsp. paratuberculosis
cgcgccggcgcgggcauga

SEQ ID NO: 824294 - RNA, 13 nt, Mycobacterium avium subsp. paratuberculosis
cgcgccggcgaua

SEQ ID NO: 824295 - RNA, 22 nt, Mycobacterium avium subsp. paratuberculosis
cgcgccggcgauaggcggccag

SEQ ID NO: 824296 - RNA, 15 nt, Mycobacterium avium subsp. paratuberculosis
cgcgccggcgcaacu

SEQ ID NO: 824297 - RNA, 13 nt, Mycobacterium avium subsp. paratuberculosis
cgcgccggcgcac

SEQ ID NO: 824298 - RNA, 14 nt, Mycobacterium avium subsp. paratuberculosis
cgcgccggcgcaca

SEQ ID NO: 824299 - RNA, 14 nt, Mycobacterium avium subsp. paratuberculosis
cgcgccggcgcagc

SEQ ID NO: 824300 - RNA, 19 nt, Mycobacterium avium subsp. paratuberculosis
cgcgccauuuccguugugc

SEQ ID NO: 824301 - RNA, 12 nt, Mycobacterium avium subsp. paratuberculosis
cgcgcccaggcc

SEQ ID NO: 824302 - RNA, 14 nt, Mycobacterium avium subsp. paratuberculosis
cgcgcccaggcccg

SEQ ID NO: 824303 - RNA, 16 nt, Mycobacterium avium subsp. paratuberculosis
cgcgcccagccccagc

SEQ ID NO: 824304 - RNA, 18 nt, Mycobacterium avium subsp. paratuberculosis
cgcgcccagccccagcac

SEQ ID NO: 824305 - RNA, 12 nt, Mycobacterium avium subsp. paratuberculosis
cgcgcccagcac

SEQ ID NO: 824306 - RNA, 14 nt, Mycobacterium avium subsp. paratuberculosis
cgcgcccagcacgu

SEQ ID NO: 824307 - RNA, 23 nt, Mycobacterium avium subsp. paratuberculosis
cgcgcccagcacgucaccgcuga

SEQ ID NO: 824308 - RNA, 22 nt, Mycobacterium avium subsp. paratuberculosis
cgcgcccacccgcgccggcaga

SEQ ID NO: 824309 - RNA, 14 nt, Mycobacterium avium subsp. paratuberculosis
cgcgcccaccugga

SEQ ID NO: 824310 - RNA, 23 nt, Mycobacterium avium subsp. paratuberculosis
cgcgccgaagauggccagcgcgg

SEQ ID NO: 824311 - RNA, 13 nt, Mycobacterium avium subsp. paratuberculosis
cgcgcccugcugg

SEQ ID NO: 824312 - RNA, 17 nt, Mycobacterium avium subsp. paratuberculosis
cgcgcccugcugggagc

SEQ ID NO: 824313 - RNA, 13 nt, Mycobacterium avium subsp. paratuberculosis
cgcgccgaacgca

SEQ ID NO: 824314 - RNA, 17 nt, Mycobacterium avium subsp. paratuberculosis
cgcgccgaacgcaccac

SEQ ID NO: 824315 - RNA, 19 nt, Mycobacterium avium subsp. paratuberculosis
cgcgccgaacgcaccaccg

SEQ ID NO: 824316 - RNA, 20 nt, Mycobacterium avium subsp. paratuberculosis
cgcgccgaacaccugcggcg

SEQ ID NO: 824317 - RNA, 24 nt, Mycobacterium avium subsp. paratuberculosis
cgcgccgaacaccugcggcggcag

SEQ ID NO: 824318 - RNA, 23 nt, Mycobacterium avium subsp. paratuberculosis
cgcgccgaugcauuggugcacgc

SEQ ID NO: 824319 - RNA, 13 nt, Mycobacterium avium subsp. paratuberculosis
cgcgccgaugccg

SEQ ID NO: 824320 - RNA, 20 nt, Mycobacterium avium subsp. paratuberculosis
cgcgccgaugccgaacguca

SEQ ID NO: 824321 - RNA, 12 nt, Mycobacterium avium subsp. paratuberculosis
cgcgccgacaga

SEQ ID NO: 824322 - RNA, 22 nt, Mycobacterium avium subsp. paratuberculosis
cgcgccgaucugaccgagcagc

SEQ ID NO: 824323 - RNA, 17 nt, Mycobacterium avium subsp. paratuberculosis
cgcgccgauguggccgg

SEQ ID NO: 824324 - RNA, 22 nt, Mycobacterium avium subsp. paratuberculosis
cgcgccgauguggccggcgaug

SEQ ID NO: 824325 - RNA, 13 nt, Mycobacterium avium subsp. paratuberculosis
cgcgccgcacagc

SEQ ID NO: 824326 - RNA, 15 nt, Mycobacterium avium subsp. paratuberculosis
cgcgccgcacagccg

SEQ ID NO: 824327 - RNA, 20 nt, Mycobacterium avium subsp. paratuberculosis
cgcgccgcacagccggcggc

SEQ ID NO: 824328 - RNA, 21 nt, Mycobacterium avium subsp. paratuberculosis
cgcgccgaacaacggcggacc

SEQ ID NO: 824329 - RNA, 22 nt, Mycobacterium avium subsp. paratuberculosis
cgcgccgaacaacggcggaccg

SEQ ID NO: 824330 - RNA, 17 nt, Mycobacterium avium subsp. paratuberculosis
cgcgccgaacaccacgc

SEQ ID NO: 824331 - RNA, 23 nt, Mycobacterium avium subsp. paratuberculosis
cgcgccgaacaccacgccgagca

SEQ ID NO: 824332 - RNA, 22 nt, Mycobacterium avium subsp. paratuberculosis
cgcgcccuggugcaacaccgaa

SEQ ID NO: 824333 - RNA, 14 nt, Mycobacterium avium subsp. paratuberculosis
cgcgcccggcuucg

SEQ ID NO: 824334 - RNA, 17 nt, Mycobacterium avium subsp. paratuberculosis
cgcgcccggcuucgccg

SEQ ID NO: 824335 - RNA, 15 nt, Mycobacterium avium subsp. paratuberculosis
cgcgcccggcgucgg

SEQ ID NO: 824336 - RNA, 17 nt, Mycobacterium avium subsp. paratuberculosis
cgcgcccggcgucggug

SEQ ID NO: 824337 - RNA, 13 nt, Mycobacterium avium subsp. paratuberculosis
cgcgcccaggcug

SEQ ID NO: 824338 - RNA, 19 nt, Mycobacterium avium subsp. paratuberculosis
cgcgcccaggcugaacacc

SEQ ID NO: 824339 - RNA, 13 nt, Mycobacterium avium subsp. paratuberculosis
cgcgcccgucgag

SEQ ID NO: 824340 - RNA, 23 nt, Mycobacterium avium subsp. paratuberculosis
cgcgcccgucgagcgucacgccg

SEQ ID NO: 824341 - RNA, 15 nt, Mycobacterium avium subsp. paratuberculosis
cgcgcccgucgucgg

SEQ ID NO: 824342 - RNA, 18 nt, Mycobacterium avium subsp. paratuberculosis
cgcgcccgucgucgguca

SEQ ID NO: 824343 - RNA, 16 nt, Mycobacterium avium subsp. paratuberculosis
cgcgcccuagucgacg

SEQ ID NO: 824344 - RNA, 19 nt, Mycobacterium avium subsp. paratuberculosis
cgcgcccuagucgacgccg

SEQ ID NO: 824345 - RNA, 13 nt, Mycobacterium avium subsp. paratuberculosis
cgcgccagcagcg

SEQ ID NO: 824346 - RNA, 22 nt, Mycobacterium avium subsp. paratuberculosis
cgcgccagcaccucggcgacca

SEQ ID NO: 824347 - RNA, 14 nt, Mycobacterium avium subsp. paratuberculosis
cgcgccagcagcgc

SEQ ID NO: 824348 - RNA, 14 nt, Mycobacterium avium subsp. paratuberculosis
cgcgccagccgccg

SEQ ID NO: 824349 - RNA, 17 nt, Mycobacterium avium subsp. paratuberculosis
cgcgccagccgccgccg

SEQ ID NO: 824350 - RNA, 20 nt, Mycobacterium avium subsp. paratuberculosis
cgcgccagccgccgccgacc

SEQ ID NO: 824351 - RNA, 21 nt, Mycobacterium avium subsp. paratuberculosis
cgcgccagcgguccagcguga

SEQ ID NO: 824352 - RNA, 12 nt, Mycobacterium avium subsp. paratuberculosis
cgcgccagcgcg

SEQ ID NO: 824353 - RNA, 17 nt, Mycobacterium avium subsp. paratuberculosis
cgcgccagcgcgugcgg

SEQ ID NO: 824354 - RNA, 19 nt, Mycobacterium avium subsp. paratuberculosis
cgcgccaggucgaagaggu

SEQ ID NO: 824355 - RNA, 15 nt, Mycobacterium avium subsp. paratuberculosis
cgcgccaggaccagc

SEQ ID NO: 824356 - RNA, 15 nt, Mycobacterium avium subsp. paratuberculosis
cgcgccagcucggcg

SEQ ID NO: 824357 - RNA, 16 nt, Mycobacterium avium subsp. paratuberculosis
cgcgccagcucggcgg

SEQ ID NO: 824358 - RNA, 18 nt, Mycobacterium avium subsp. paratuberculosis
cgcgccagcucggcggcc

SEQ ID NO: 824359 - RNA, 22 nt, Mycobacterium avium subsp. paratuberculosis
cgcgccagcucggcggccgggu

SEQ ID NO: 824360 - RNA, 13 nt, Mycobacterium avium subsp. paratuberculosis
cgcgccaccccga

SEQ ID NO: 824361 - RNA, 14 nt, Mycobacterium avium subsp. paratuberculosis
cgcgccaccccgag

SEQ ID NO: 824362 - RNA, 19 nt, Mycobacterium avium subsp. paratuberculosis
cgcgccaccccgagcucgg

SEQ ID NO: 824363 - RNA, 21 nt, Mycobacterium avium subsp. paratuberculosis
cgcgccaccccgagcucgggc

SEQ ID NO: 824364 - RNA, 21 nt, Mycobacterium avium subsp. paratuberculosis
cgcgccacccgacgaaaucgu

SEQ ID NO: 824365 - RNA, 21 nt, Mycobacterium avium subsp. paratuberculosis
cgcgccaccgaggccagcaga

SEQ ID NO: 824366 - RNA, 14 nt, Mycobacterium avium subsp. paratuberculosis
cgcgccacgcgcag

SEQ ID NO: 824367 - RNA, 20 nt, Mycobacterium avium subsp. paratuberculosis
cgcgccagacguccagcgcc

SEQ ID NO: 824368 - RNA, 23 nt, Mycobacterium avium subsp. paratuberculosis
cgcgccaccgcggggcugggcgc

SEQ ID NO: 824369 - RNA, 17 nt, Mycobacterium avium subsp. paratuberculosis
cgcgccacgacguaccc

SEQ ID NO: 824370 - RNA, 22 nt, Mycobacterium avium subsp. paratuberculosis
cgcgcaucguggcuuuggucgc

SEQ ID NO: 824371 - RNA, 12 nt, Mycobacterium avium subsp. paratuberculosis
cgcgcaucugcu

SEQ ID NO: 824372 - RNA, 17 nt, Mycobacterium avium subsp. paratuberculosis
cgcgcaucugcucggcg

SEQ ID NO: 824373 - RNA, 18 nt, Mycobacterium avium subsp. paratuberculosis
cgcgcaucugcucggcgu

SEQ ID NO: 824374 - RNA, 17 nt, Mycobacterium avium subsp. paratuberculosis
cgcgcaucgucgcggcg

SEQ ID NO: 824375 - RNA, 16 nt, Mycobacterium avium subsp. paratuberculosis
cgcgcaugcccuggac

SEQ ID NO: 824376 - RNA, 19 nt, Mycobacterium avium subsp. paratuberculosis
cgcgccaacgaggcacggc

SEQ ID NO: 824377 - RNA, 20 nt, Mycobacterium avium subsp. paratuberculosis
cgcgcauuguugaggauguc

SEQ ID NO: 824378 - RNA, 20 nt, Mycobacterium avium subsp. paratuberculosis
cgcgcauguuggugaucagc

SEQ ID NO: 824379 - RNA, 15 nt, Mycobacterium avium subsp. paratuberculosis
cgcgcauucaccagc

SEQ ID NO: 824380 - RNA, 17 nt, Mycobacterium avium subsp. paratuberculosis
cgcgcaucacccggcgc

SEQ ID NO: 824381 - RNA, 19 nt, Mycobacterium avium subsp. paratuberculosis
cgcgcaucacccggcgcgc

SEQ ID NO: 824382 - RNA, 22 nt, Mycobacterium avium subsp. paratuberculosis
cgcgcaucacccggcgcgcgga

SEQ ID NO: 824383 - RNA, 23 nt, Mycobacterium avium subsp. paratuberculosis
cgcgcagucgcaggccccggauc

SEQ ID NO: 824384 - RNA, 13 nt, Mycobacterium avium subsp. paratuberculosis
cgcgcagucggcg

SEQ ID NO: 824385 - RNA, 14 nt, Mycobacterium avium subsp. paratuberculosis
cgcgcagucggcgu

SEQ ID NO: 824386 - RNA, 17 nt, Mycobacterium avium subsp. paratuberculosis
cgcgcagucggcgucgc

SEQ ID NO: 824387 - RNA, 19 nt, Mycobacterium avium subsp. paratuberculosis
cgcgcagucggcgucgcgg

SEQ ID NO: 824388 - RNA, 17 nt, Mycobacterium avium subsp. paratuberculosis
cgcgcaguugcgcggcg

SEQ ID NO: 824389 - RNA, 20 nt, Mycobacterium avium subsp. paratuberculosis
cgcgcaguugcgcggcgggc

SEQ ID NO: 824390 - RNA, 21 nt, Mycobacterium avium subsp. paratuberculosis
cgcgcaguugcgcggcgggcg

SEQ ID NO: 824391 - RNA, 22 nt, Mycobacterium avium subsp. paratuberculosis
cgcgcaguugcgcggcgggcga

SEQ ID NO: 824392 - RNA, 22 nt, Mycobacterium avium subsp. paratuberculosis
cgcgcaggugaugcggcccgac

SEQ ID NO: 824393 - RNA, 23 nt, Mycobacterium avium subsp. paratuberculosis
cgcgcaggugaugcggcccgacc

SEQ ID NO: 824394 - RNA, 14 nt, Mycobacterium avium subsp. paratuberculosis
cgcgcaucccgucg

SEQ ID NO: 824395 - RNA, 18 nt, Mycobacterium avium subsp. paratuberculosis
cgcgcaucccgucgacca

SEQ ID NO: 824396 - RNA, 21 nt, Mycobacterium avium subsp. paratuberculosis
cgcgcaucccgucgaccagga

SEQ ID NO: 824397 - RNA, 15 nt, Mycobacterium avium subsp. paratuberculosis
cgcgcaucagcaccu

SEQ ID NO: 824398 - RNA, 14 nt, Mycobacterium avium subsp. paratuberculosis
cgcgcaucagcgga

SEQ ID NO: 824399 - RNA, 14 nt, Mycobacterium avium subsp. paratuberculosis
cgcgcaucaucgcc

SEQ ID NO: 824400 - RNA, 19 nt, Mycobacterium avium subsp. paratuberculosis
cgcgcaucgcgggccaccg

SEQ ID NO: 824401 - RNA, 24 nt, Mycobacterium avium subsp. paratuberculosis
cgcgcaucgcgggccaccggcgcc

SEQ ID NO: 824402 - RNA, 14 nt, Mycobacterium avium subsp. paratuberculosis
cgcgcaucgccguc

SEQ ID NO: 824403 - RNA, 18 nt, Mycobacterium avium subsp. paratuberculosis
cgcgcaucgccguccacg

SEQ ID NO: 824404 - RNA, 17 nt, Mycobacterium avium subsp. paratuberculosis
cgcgcaucgccucggcg

SEQ ID NO: 824405 - RNA, 21 nt, Mycobacterium avium subsp. paratuberculosis
cgcgcaucgccucggcggccg

SEQ ID NO: 824406 - RNA, 23 nt, Mycobacterium avium subsp. paratuberculosis
cgcgcaucgccucggcggccgcc

SEQ ID NO: 824407 - RNA, 14 nt, Mycobacterium avium subsp. paratuberculosis
cgcgcaggcggcga

SEQ ID NO: 824408 - RNA, 15 nt, Mycobacterium avium subsp. paratuberculosis
cgcgcaggcggcgac

SEQ ID NO: 824409 - RNA, 22 nt, Mycobacterium avium subsp. paratuberculosis
cgcgcaggcggcgacggccguc

SEQ ID NO: 824410 - RNA, 19 nt, Mycobacterium avium subsp. paratuberculosis
cgcgcagggacgggcguga

SEQ ID NO: 824411 - RNA, 20 nt, Mycobacterium avium subsp. paratuberculosis
cgcgcagggacgggcgugac

SEQ ID NO: 824412 - RNA, 21 nt, Mycobacterium avium subsp. paratuberculosis
cgcgcagggacgggcgugacg

SEQ ID NO: 824413 - RNA, 17 nt, Mycobacterium avium subsp. paratuberculosis
cgcgcagggccagcgcc

SEQ ID NO: 824414 - RNA, 16 nt, Mycobacterium avium subsp. paratuberculosis
cgcgcaggccgccgac

SEQ ID NO: 824415 - RNA, 17 nt, Mycobacterium avium subsp. paratuberculosis
cgcgcaggccgccgacg

SEQ ID NO: 824416 - RNA, 15 nt, Mycobacterium avium subsp. paratuberculosis
cgcgcaggccccggc

SEQ ID NO: 824417 - RNA, 14 nt, Mycobacterium avium subsp. paratuberculosis
cgcgcaggcgcacc

SEQ ID NO: 824418 - RNA, 18 nt, Mycobacterium avium subsp. paratuberculosis
cgcgcaggcgcgcggcca

SEQ ID NO: 824419 - RNA, 20 nt, Mycobacterium avium subsp. paratuberculosis
cgcgcaggcgcgcggccagc

SEQ ID NO: 824420 - RNA, 14 nt, Mycobacterium avium subsp. paratuberculosis
cgcgcaggccgucc

SEQ ID NO: 824421 - RNA, 20 nt, Mycobacterium avium subsp. paratuberculosis
cgcgcaggccguccagcagc

SEQ ID NO: 824422 - RNA, 17 nt, Mycobacterium avium subsp. paratuberculosis
cgcgcagggucagcgcu

SEQ ID NO: 824423 - RNA, 15 nt, Mycobacterium avium subsp. paratuberculosis
cgcgcagggcgaacg

SEQ ID NO: 824424 - RNA, 18 nt, Mycobacterium avium subsp. paratuberculosis
cgcgcagggcgaacggcg

SEQ ID NO: 824425 - RNA, 20 nt, Mycobacterium avium subsp. paratuberculosis
cgcgcagggcgaacggcgga

SEQ ID NO: 824426 - RNA, 16 nt, Mycobacterium avium subsp. paratuberculosis
cgcgcagguagccgcc

SEQ ID NO: 824427 - RNA, 21 nt, Mycobacterium avium subsp. paratuberculosis
cgcgcaggucacccuccucgc

SEQ ID NO: 824428 - RNA, 16 nt, Mycobacterium avium subsp. paratuberculosis
cgcgcagguccguggu

SEQ ID NO: 824429 - RNA, 17 nt, Mycobacterium avium subsp. paratuberculosis
cgcgcagguccguggug

SEQ ID NO: 824430 - RNA, 24 nt, Mycobacterium avium subsp. paratuberculosis
cgcgcagguccguggugaucgccg

SEQ ID NO: 824431 - RNA, 13 nt, Mycobacterium avium subsp. paratuberculosis
cgcgcaggucguc

SEQ ID NO: 824432 - RNA, 18 nt, Mycobacterium avium subsp. paratuberculosis
cgcgcaggaugcccagca

SEQ ID NO: 824433 - RNA, 20 nt, Mycobacterium avium subsp. paratuberculosis
cgcgcaggaugcccagcacc

SEQ ID NO: 824434 - RNA, 23 nt, Mycobacterium avium subsp. paratuberculosis
cgcgcaggaugcccagcaccacu

SEQ ID NO: 824435 - RNA, 15 nt, Mycobacterium avium subsp. paratuberculosis
cgcgcaggcacucgc

SEQ ID NO: 824436 - RNA, 20 nt, Mycobacterium avium subsp. paratuberculosis
cgcgcaggaacuccagcagc

SEQ ID NO: 824437 - RNA, 16 nt, Mycobacterium avium subsp. paratuberculosis
cgcgcagcugcgccgc

SEQ ID NO: 824438 - RNA, 14 nt, Mycobacterium avium subsp. paratuberculosis
cgcgcagcuggccg

SEQ ID NO: 824439 - RNA, 15 nt, Mycobacterium avium subsp. paratuberculosis
cgcgcagcuggccgu

SEQ ID NO: 824440 - RNA, 20 nt, Mycobacterium avium subsp. paratuberculosis
cgcgcagcgucuugcccagc

SEQ ID NO: 824441 - RNA, 13 nt, Mycobacterium avium subsp. paratuberculosis
cgcgcagcucggg

SEQ ID NO: 824442 - RNA, 15 nt, Mycobacterium avium subsp. paratuberculosis
cgcgcagcucggggu

SEQ ID NO: 824443 - RNA, 22 nt, Mycobacterium avium subsp. paratuberculosis
cgcgcagcucggggucggcguc

SEQ ID NO: 824444 - RNA, 17 nt, Mycobacterium avium subsp. paratuberculosis
cgcgcagcucugcucgu

SEQ ID NO: 824445 - RNA, 20 nt, Mycobacterium avium subsp. paratuberculosis
cgcgcagccaaugccggauc

SEQ ID NO: 824446 - RNA, 13 nt, Mycobacterium avium subsp. paratuberculosis
cgcgcagcgucau

SEQ ID NO: 824447 - RNA, 14 nt, Mycobacterium avium subsp. paratuberculosis
cgcgcagcgucauc

SEQ ID NO: 824448 - RNA, 13 nt, Mycobacterium avium subsp. paratuberculosis
cgcgcagcguguc

SEQ ID NO: 824449 - RNA, 14 nt, Mycobacterium avium subsp. paratuberculosis
cgcgcagcucgacg

SEQ ID NO: 824450 - RNA, 15 nt, Mycobacterium avium subsp. paratuberculosis
cgcgcagcucgacga

SEQ ID NO: 824451 - RNA, 23 nt, Mycobacterium avium subsp. paratuberculosis
cgcgcagcucgacgaccucgccg

SEQ ID NO: 824452 - RNA, 16 nt, Mycobacterium avium subsp. paratuberculosis
cgcgcagccgcggugg

SEQ ID NO: 824453 - RNA, 18 nt, Mycobacterium avium subsp. paratuberculosis
cgcgcagccagucgccgg

SEQ ID NO: 824454 - RNA, 15 nt, Mycobacterium avium subsp. paratuberculosis
cgcgcagcccccgga

SEQ ID NO: 824455 - RNA, 22 nt, Mycobacterium avium subsp. paratuberculosis
cgcgcagcccccggaccacguc

SEQ ID NO: 824456 - RNA, 13 nt, Mycobacterium avium subsp. paratuberculosis
cgcgcagccgccg

SEQ ID NO: 824457 - RNA, 15 nt, Mycobacterium avium subsp. paratuberculosis
cgcgcagccgccggg

SEQ ID NO: 824458 - RNA, 14 nt, Mycobacterium avium subsp. paratuberculosis
cgcgcagcauggcc

SEQ ID NO: 824459 - RNA, 14 nt, Mycobacterium avium subsp. paratuberculosis
cgcgcagccggccg

SEQ ID NO: 824460 - RNA, 17 nt, Mycobacterium avium subsp. paratuberculosis
cgcgcagccggccgucc

SEQ ID NO: 824461 - RNA, 22 nt, Mycobacterium avium subsp. paratuberculosis
cgcgcagccggccguccacggc

SEQ ID NO: 824462 - RNA, 23 nt, Mycobacterium avium subsp. paratuberculosis
cgcgcagccggccguccacggcg

SEQ ID NO: 824463 - RNA, 12 nt, Mycobacterium avium subsp. paratuberculosis
cgcgcagccggg

SEQ ID NO: 824464 - RNA, 13 nt, Mycobacterium avium subsp. paratuberculosis
cgcgcagccgggc

SEQ ID NO: 824465 - RNA, 18 nt, Mycobacterium avium subsp. paratuberculosis
cgcgcagccaccgcccga

SEQ ID NO: 824466 - RNA, 22 nt, Mycobacterium avium subsp. paratuberculosis
cgcgcagccaccgcccgaaccg

SEQ ID NO: 824467 - RNA, 14 nt, Mycobacterium avium subsp. paratuberculosis
cgcgcagccacgag

SEQ ID NO: 824468 - RNA, 20 nt, Mycobacterium avium subsp. paratuberculosis
cgcgcagccagaccucgccg

SEQ ID NO: 824469 - RNA, 22 nt, Mycobacterium avium subsp. paratuberculosis
cgcgcagccagaccucgccgac

SEQ ID NO: 824470 - RNA, 23 nt, Mycobacterium avium subsp. paratuberculosis
cgcgcagccagaccucgccgacg

SEQ ID NO: 824471 - RNA, 13 nt, Mycobacterium avium subsp. paratuberculosis
cgcgcagcauccg

SEQ ID NO: 824472 - RNA, 19 nt, Mycobacterium avium subsp. paratuberculosis
cgcgcagcauccgcaccag

SEQ ID NO: 824473 - RNA, 20 nt, Mycobacterium avium subsp. paratuberculosis
cgcgcagcauccgcaccagg

SEQ ID NO: 824474 - RNA, 21 nt, Mycobacterium avium subsp. paratuberculosis
cgcgcagcacgaugaucccga

SEQ ID NO: 824475 - RNA, 15 nt, Mycobacterium avium subsp. paratuberculosis
cgcgcagcaggcgcc

SEQ ID NO: 824476 - RNA, 20 nt, Mycobacterium avium subsp. paratuberculosis
cgcgcagcagcugcacccgc

SEQ ID NO: 824477 - RNA, 21 nt, Mycobacterium avium subsp. paratuberculosis
cgcgcagcaccuccuggguga

SEQ ID NO: 824478 - RNA, 15 nt, Mycobacterium avium subsp. paratuberculosis
cgcgcagcaccgcgu

SEQ ID NO: 824479 - RNA, 23 nt, Mycobacterium avium subsp. paratuberculosis
cgcgcagcaccgcgucggcgcug

SEQ ID NO: 824480 - RNA, 15 nt, Mycobacterium avium subsp. paratuberculosis
cgcgaccgcgcggcg

SEQ ID NO: 824481 - RNA, 16 nt, Mycobacterium avium subsp. paratuberculosis
cgcgaccgcgcggcga

SEQ ID NO: 824482 - RNA, 18 nt, Mycobacterium avium subsp. paratuberculosis
cgcgaccgcgcggcgagu

SEQ ID NO: 824483 - RNA, 19 nt, Mycobacterium avium subsp. paratuberculosis
cgcgaccgcgucgacggcg

SEQ ID NO: 824484 - RNA, 14 nt, Mycobacterium avium subsp. paratuberculosis
cgcgaccggcccga

SEQ ID NO: 824485 - RNA, 17 nt, Mycobacterium avium subsp. paratuberculosis
cgcgacccgcucgacgc

SEQ ID NO: 824486 - RNA, 18 nt, Mycobacterium avium subsp. paratuberculosis
cgcgacccgcucgacgcg

SEQ ID NO: 824487 - RNA, 12 nt, Mycobacterium avium subsp. paratuberculosis
cgcgacccggcc

SEQ ID NO: 824488 - RNA, 16 nt, Mycobacterium avium subsp. paratuberculosis
cgcgacccgggccgcc

SEQ ID NO: 824489 - RNA, 14 nt, Mycobacterium avium subsp. paratuberculosis
cgcgaccgaggucg

SEQ ID NO: 824490 - RNA, 17 nt, Mycobacterium avium subsp. paratuberculosis
cgcgaccgaggucgacg

SEQ ID NO: 824491 - RNA, 19 nt, Mycobacterium avium subsp. paratuberculosis
cgcgaccgaggucgacgcc

SEQ ID NO: 824492 - RNA, 20 nt, Mycobacterium avium subsp. paratuberculosis
cgcgaccgaggucgacgccc

SEQ ID NO: 824493 - RNA, 13 nt, Mycobacterium avium subsp. paratuberculosis
cgcgaccgcgcgg

SEQ ID NO: 824494 - RNA, 12 nt, Mycobacterium avium subsp. paratuberculosis
cgcgaccgccgg

SEQ ID NO: 824495 - RNA, 21 nt, Mycobacterium avium subsp. paratuberculosis
cgcgaccgcgaucagggccgc

SEQ ID NO: 824496 - RNA, 19 nt, Mycobacterium avium subsp. paratuberculosis
cgcgcaacuggguggucac

SEQ ID NO: 824497 - RNA, 19 nt, Mycobacterium avium subsp. paratuberculosis
cgcgcaauacccgaccagc

SEQ ID NO: 824498 - RNA, 22 nt, Mycobacterium avium subsp. paratuberculosis
cgcgcaauacccgaccagcacc

SEQ ID NO: 824499 - RNA, 23 nt, Mycobacterium avium subsp. paratuberculosis
cgcgcaauacccgaccagcaccg

SEQ ID NO: 824500 - RNA, 21 nt, Mycobacterium avium subsp. paratuberculosis
cgcgcacaacagccaugccgg

SEQ ID NO: 824501 - RNA, 15 nt, Mycobacterium avium subsp. paratuberculosis
cgcgcaauccugccc

SEQ ID NO: 824502 - RNA, 18 nt, Mycobacterium avium subsp. paratuberculosis
cgcgcaaugccaucguca

SEQ ID NO: 824503 - RNA, 19 nt, Mycobacterium avium subsp. paratuberculosis
cgcgcaaugccaucgucac

SEQ ID NO: 824504 - RNA, 15 nt, Mycobacterium avium subsp. paratuberculosis
cgcgcaaugccgccg

SEQ ID NO: 824505 - RNA, 20 nt, Mycobacterium avium subsp. paratuberculosis
cgcgcaaugccgccgcgacg

SEQ ID NO: 824506 - RNA, 20 nt, Mycobacterium avium subsp. paratuberculosis
cgcgcacaucacgguggccg

SEQ ID NO: 824507 - RNA, 24 nt, Mycobacterium avium subsp. paratuberculosis
cgcgcacaucacgguggccgccac

SEQ ID NO: 824508 - RNA, 18 nt, Mycobacterium avium subsp. paratuberculosis
cgcgcacaauucggucag

SEQ ID NO: 824509 - RNA, 23 nt, Mycobacterium avium subsp. paratuberculosis
cgcgcacaauucggucagcgcgu

SEQ ID NO: 824510 - RNA, 14 nt, Mycobacterium avium subsp. paratuberculosis
cgcgcaccagggcc

SEQ ID NO: 824511 - RNA, 14 nt, Mycobacterium avium subsp. paratuberculosis
cgcgcaccauccgc

SEQ ID NO: 824512 - RNA, 18 nt, Mycobacterium avium subsp. paratuberculosis
cgcgcaccauccgcgacg

SEQ ID NO: 824513 - RNA, 17 nt, Mycobacterium avium subsp. paratuberculosis
cgcgcaccaucgcgaug

SEQ ID NO: 824514 - RNA, 13 nt, Mycobacterium avium subsp. paratuberculosis
cgcgcaccagcuc

SEQ ID NO: 824515 - RNA, 21 nt, Mycobacterium avium subsp. paratuberculosis
cgcgcaccagcucgaggccgc

SEQ ID NO: 824516 - RNA, 14 nt, Mycobacterium avium subsp. paratuberculosis
cgcgcaccaggccg

SEQ ID NO: 824517 - RNA, 21 nt, Mycobacterium avium subsp. paratuberculosis
cgcgcaccacgguggcgccgc

SEQ ID NO: 824518 - RNA, 11 nt, Mycobacterium avium subsp. paratuberculosis
cgcgcaccacc

SEQ ID NO: 824519 - RNA, 12 nt, Mycobacterium avium subsp. paratuberculosis
cgcgcaccaccu

SEQ ID NO: 824520 - RNA, 17 nt, Mycobacterium avium subsp. paratuberculosis
cgcgcaccaccucggcg

SEQ ID NO: 824521 - RNA, 19 nt, Mycobacterium avium subsp. paratuberculosis
cgcgcagaucgagaucagg

SEQ ID NO: 824522 - RNA, 18 nt, Mycobacterium avium subsp. paratuberculosis
cgcgcagaucgccagcac

SEQ ID NO: 824523 - RNA, 19 nt, Mycobacterium avium subsp. paratuberculosis
cgcgcagaucgccagcacc

SEQ ID NO: 824524 - RNA, 22 nt, Mycobacterium avium subsp. paratuberculosis
cgcgcagaucgccagcaccggc

SEQ ID NO: 824525 - RNA, 19 nt, Mycobacterium avium subsp. paratuberculosis
cgcgcagcaauugacgccg

SEQ ID NO: 824526 - RNA, 12 nt, Mycobacterium avium subsp. paratuberculosis
cgcgcagcaccg

SEQ ID NO: 824527 - RNA, 20 nt, Mycobacterium avium subsp. paratuberculosis
cgcgcagaucgucgaacucg

SEQ ID NO: 824528 - RNA, 17 nt, Mycobacterium avium subsp. paratuberculosis
cgcgcagaucgucgacc

SEQ ID NO: 824529 - RNA, 16 nt, Mycobacterium avium subsp. paratuberculosis
cgcgcagauggugacc

SEQ ID NO: 824530 - RNA, 15 nt, Mycobacterium avium subsp. paratuberculosis
cgcgcacguuggcgg

SEQ ID NO: 824531 - RNA, 18 nt, Mycobacterium avium subsp. paratuberculosis
cgcgcacguuggcggcca

SEQ ID NO: 824532 - RNA, 14 nt, Mycobacterium avium subsp. paratuberculosis
cgcgcacgucgagg

SEQ ID NO: 824533 - RNA, 18 nt, Mycobacterium avium subsp. paratuberculosis
cgcgcacgucgaggucgg

SEQ ID NO: 824534 - RNA, 17 nt, Mycobacterium avium subsp. paratuberculosis
cgcgcagaacaccaccg

SEQ ID NO: 824535 - RNA, 21 nt, Mycobacterium avium subsp. paratuberculosis
cgcgcagaacaccaccgccag

SEQ ID NO: 824536 - RNA, 14 nt, Mycobacterium avium subsp. paratuberculosis
cgcgcagaaccgca

SEQ ID NO: 824537 - RNA, 16 nt, Mycobacterium avium subsp. paratuberculosis
cgcgcagaaccgcacc

SEQ ID NO: 824538 - RNA, 20 nt, Mycobacterium avium subsp. paratuberculosis
cgcgcagaaccgcaccccgu

SEQ ID NO: 824539 - RNA, 16 nt, Mycobacterium avium subsp. paratuberculosis
cgcgcacuucgcgggc

SEQ ID NO: 824540 - RNA, 18 nt, Mycobacterium avium subsp. paratuberculosis
cgcgcacuucgcgggcgg

SEQ ID NO: 824541 - RNA, 22 nt, Mycobacterium avium subsp. paratuberculosis
cgcgcacuucgcgggcggcgca

SEQ ID NO: 824542 - RNA, 14 nt, Mycobacterium avium subsp. paratuberculosis
cgcgcaccgggacc

SEQ ID NO: 824543 - RNA, 15 nt, Mycobacterium avium subsp. paratuberculosis
cgcgcaccgggacca

SEQ ID NO: 824544 - RNA, 11 nt, Mycobacterium avium subsp. paratuberculosis
cgcgcaccgcg

SEQ ID NO: 824545 - RNA, 14 nt, Mycobacterium avium subsp. paratuberculosis
cgcgcaccgcgaaa

SEQ ID NO: 824546 - RNA, 12 nt, Mycobacterium avium subsp. paratuberculosis
cgcgcaccgcca

SEQ ID NO: 824547 - RNA, 15 nt, Mycobacterium avium subsp. paratuberculosis
cgcgcaccgccaccg

SEQ ID NO: 824548 - RNA, 16 nt, Mycobacterium avium subsp. paratuberculosis
cgcgcaccgccaccgc

SEQ ID NO: 824549 - RNA, 18 nt, Mycobacterium avium subsp. paratuberculosis
cgcgcacccggccacgcc

SEQ ID NO: 824550 - RNA, 20 nt, Mycobacterium avium subsp. paratuberculosis
cgcgcacccggccacgccgg

SEQ ID NO: 824551 - RNA, 19 nt, Mycobacterium avium subsp. paratuberculosis
cgcgcacccguaacacgau

SEQ ID NO: 824552 - RNA, 17 nt, Mycobacterium avium subsp. paratuberculosis
cgcgcacccccuucucc

SEQ ID NO: 824553 - RNA, 23 nt, Mycobacterium avium subsp. paratuberculosis
cgcgcaccccgaaccgcccgccc

SEQ ID NO: 824554 - RNA, 14 nt, Mycobacterium avium subsp. paratuberculosis
cgcgcaccccggca

SEQ ID NO: 824555 - RNA, 17 nt, Mycobacterium avium subsp. paratuberculosis
cgcgcaccccggcauag

SEQ ID NO: 824556 - RNA, 12 nt, Mycobacterium avium subsp. paratuberculosis
cgcgcaccgguu

SEQ ID NO: 824557 - RNA, 20 nt, Mycobacterium avium subsp. paratuberculosis
cgcgcaccgguuugucggcg

SEQ ID NO: 824558 - RNA, 15 nt, Mycobacterium avium subsp. paratuberculosis
cgcgcaccgucaucg

SEQ ID NO: 824559 - RNA, 23 nt, Mycobacterium avium subsp. paratuberculosis
cgcgcaccgucaucgcggcgaac

SEQ ID NO: 824560 - RNA, 19 nt, Mycobacterium avium subsp. paratuberculosis
cgcgcaccuggucggucag

SEQ ID NO: 824561 - RNA, 15 nt, Mycobacterium avium subsp. paratuberculosis
cgcgcacggcagccc

SEQ ID NO: 824562 - RNA, 17 nt, Mycobacterium avium subsp. paratuberculosis
cgcgcacggcagcccga

SEQ ID NO: 824563 - RNA, 19 nt, Mycobacterium avium subsp. paratuberculosis
cgcgcacggcagcccgacg

SEQ ID NO: 824564 - RNA, 14 nt, Mycobacterium avium subsp. paratuberculosis
cgcgcacgccaucg

SEQ ID NO: 824565 - RNA, 20 nt, Mycobacterium avium subsp. paratuberculosis
cgcgcacgccaucgccucgg

SEQ ID NO: 824566 - RNA, 22 nt, Mycobacterium avium subsp. paratuberculosis
cgcggcaggaauuccagcgaca

SEQ ID NO: 824567 - RNA, 16 nt, Mycobacterium avium subsp. paratuberculosis
cgcggcaggcgcccca

SEQ ID NO: 824568 - RNA, 15 nt, Mycobacterium avium subsp. paratuberculosis
cgcggcagguugcgc

SEQ ID NO: 824569 - RNA, 18 nt, Mycobacterium avium subsp. paratuberculosis
cgcggcaguccgccggag

SEQ ID NO: 824570 - RNA, 16 nt, Mycobacterium avium subsp. paratuberculosis
cgcggcaucggcgacg

SEQ ID NO: 824571 - RNA, 20 nt, Mycobacterium avium subsp. paratuberculosis
cgcggcaucggcgacggcga

SEQ ID NO: 824572 - RNA, 16 nt, Mycobacterium avium subsp. paratuberculosis
cgcggcaucgucgggg

SEQ ID NO: 824573 - RNA, 15 nt, Mycobacterium avium subsp. paratuberculosis
cgcggcaucgugaug

SEQ ID NO: 824574 - RNA, 15 nt, Mycobacterium avium subsp. paratuberculosis
cgcggcaugaccggc

SEQ ID NO: 824575 - RNA, 18 nt, Mycobacterium avium subsp. paratuberculosis
cgcggcaugccgcccggg

SEQ ID NO: 824576 - RNA, 21 nt, Mycobacterium avium subsp. paratuberculosis
cgcggcaugccgcccgggccg

SEQ ID NO: 824577 - RNA, 19 nt, Mycobacterium avium subsp. paratuberculosis
cgcggcauggcuggcggca

SEQ ID NO: 824578 - RNA, 20 nt, Mycobacterium avium subsp. paratuberculosis
cgcggcauggcuggcggcaa

SEQ ID NO: 824579 - RNA, 22 nt, Mycobacterium avium subsp. paratuberculosis
cgcggcauggcuggcggcaacg

SEQ ID NO: 824580 - RNA, 18 nt, Mycobacterium avium subsp. paratuberculosis
cgcggccaacccgggcgc

SEQ ID NO: 824581 - RNA, 12 nt, Mycobacterium avium subsp. paratuberculosis
cgcggccagcac

SEQ ID NO: 824582 - RNA, 13 nt, Mycobacterium avium subsp. paratuberculosis
cgcggccaccagc

SEQ ID NO: 824583 - RNA, 16 nt, Mycobacterium avium subsp. paratuberculosis
cgcggccaccagcgcg

SEQ ID NO: 824584 - RNA, 22 nt, Mycobacterium avium subsp. paratuberculosis
cgcggccaccagcgcggccacc

SEQ ID NO: 824585 - RNA, 13 nt, Mycobacterium avium subsp. paratuberculosis
cgcggccaccugg

SEQ ID NO: 824586 - RNA, 14 nt, Mycobacterium avium subsp. paratuberculosis
cgcggccacgcucg

SEQ ID NO: 824587 - RNA, 14 nt, Mycobacterium avium subsp. paratuberculosis
cgcggccacgcccu

SEQ ID NO: 824588 - RNA, 20 nt, Mycobacterium avium subsp. paratuberculosis
cgcggccacgcccuggccgc

SEQ ID NO: 824589 - RNA, 22 nt, Mycobacterium avium subsp. paratuberculosis
cgcggccacgcccuggccgccg

SEQ ID NO: 824590 - RNA, 17 nt, Mycobacterium avium subsp. paratuberculosis
cgcggccaccaccggug

SEQ ID NO: 824591 - RNA, 19 nt, Mycobacterium avium subsp. paratuberculosis
cgcggccaccacgacgccg

SEQ ID NO: 824592 - RNA, 22 nt, Mycobacterium avium subsp. paratuberculosis
cgcggccaccacgacgccgggc

SEQ ID NO: 824593 - RNA, 19 nt, Mycobacterium avium subsp. paratuberculosis
cgcggccaccacgacgggg

SEQ ID NO: 824594 - RNA, 22 nt, Mycobacterium avium subsp. paratuberculosis
cgcggccaccacgacggggaac

SEQ ID NO: 824595 - RNA, 13 nt, Mycobacterium avium subsp. paratuberculosis
cgcggccaccgcg

SEQ ID NO: 824596 - RNA, 18 nt, Mycobacterium avium subsp. paratuberculosis
cgcggccaccgcgcgcug

SEQ ID NO: 824597 - RNA, 21 nt, Mycobacterium avium subsp. paratuberculosis
cgcggccaccgcgcgcugccg

SEQ ID NO: 824598 - RNA, 12 nt, Mycobacterium avium subsp. paratuberculosis
cgcggccaccgg

SEQ ID NO: 824599 - RNA, 13 nt, Mycobacterium avium subsp. paratuberculosis
cgcggccaccggg

SEQ ID NO: 824600 - RNA, 16 nt, Mycobacterium avium subsp. paratuberculosis
cgcggccaccgggacc

SEQ ID NO: 824601 - RNA, 20 nt, Mycobacterium avium subsp. paratuberculosis
cgcggccaccgggaccgucg

SEQ ID NO: 824602 - RNA, 22 nt, Mycobacterium avium subsp. paratuberculosis
cgcggccaccgggucguccgcg

SEQ ID NO: 824603 - RNA, 12 nt, Mycobacterium avium subsp. paratuberculosis
cgcggccacccc

SEQ ID NO: 824604 - RNA, 14 nt, Mycobacterium avium subsp. paratuberculosis
cgcggccaccccgg

SEQ ID NO: 824605 - RNA, 15 nt, Mycobacterium avium subsp. paratuberculosis
cgcggccaccccgga

SEQ ID NO: 824606 - RNA, 13 nt, Mycobacterium avium subsp. paratuberculosis
cgcggccacaccg

SEQ ID NO: 824607 - RNA, 14 nt, Mycobacterium avium subsp. paratuberculosis
cgcggccacaccga

SEQ ID NO: 824608 - RNA, 23 nt, Mycobacterium avium subsp. paratuberculosis
cgcggccacaccgaucagcaugc

SEQ ID NO: 824609 - RNA, 15 nt, Mycobacterium avium subsp. paratuberculosis
cgcggccaccaccac

SEQ ID NO: 824610 - RNA, 18 nt, Mycobacterium avium subsp. paratuberculosis
cgcggccaccaccacggc

SEQ ID NO: 824611 - RNA, 22 nt, Mycobacterium avium subsp. paratuberculosis
cgcggccaccaccacggccaug

SEQ ID NO: 824612 - RNA, 14 nt, Mycobacterium avium subsp. paratuberculosis
cgcggccaccaccg

SEQ ID NO: 824613 - RNA, 17 nt, Mycobacterium avium subsp. paratuberculosis
cgcggccaccaccgcca

SEQ ID NO: 824614 - RNA, 20 nt, Mycobacterium avium subsp. paratuberculosis
cgcggccaccaccgccacgg

SEQ ID NO: 824615 - RNA, 16 nt, Mycobacterium avium subsp. paratuberculosis
cgcggcacgccgcucg

SEQ ID NO: 824616 - RNA, 17 nt, Mycobacterium avium subsp. paratuberculosis
cgcggcacgccgcucgu

SEQ ID NO: 824617 - RNA, 19 nt, Mycobacterium avium subsp. paratuberculosis
cgcggcacgccgcucgucg

SEQ ID NO: 824618 - RNA, 23 nt, Mycobacterium avium subsp. paratuberculosis
cgcggcaccuucaccgaccagcu

SEQ ID NO: 824619 - RNA, 13 nt, Mycobacterium avium subsp. paratuberculosis
cgcggcacgcugc

SEQ ID NO: 824620 - RNA, 15 nt, Mycobacterium avium subsp. paratuberculosis
cgcggcacgcugcgc

SEQ ID NO: 824621 - RNA, 19 nt, Mycobacterium avium subsp. paratuberculosis
cgcggcacgcugcgccagc

SEQ ID NO: 824622 - RNA, 21 nt, Mycobacterium avium subsp. paratuberculosis
cgcggcacgcugcgccagccg

SEQ ID NO: 824623 - RNA, 22 nt, Mycobacterium avium subsp. paratuberculosis
cgcggcacgcugcgccagccgu

SEQ ID NO: 824624 - RNA, 23 nt, Mycobacterium avium subsp. paratuberculosis
cgcggcacgcugcgccagccguc

SEQ ID NO: 824625 - RNA, 17 nt, Mycobacterium avium subsp. paratuberculosis
cgcggcacgggccguuc

SEQ ID NO: 824626 - RNA, 18 nt, Mycobacterium avium subsp. paratuberculosis
cgcggcacgggccguucg

SEQ ID NO: 824627 - RNA, 13 nt, Mycobacterium avium subsp. paratuberculosis
cgcggcacggugg

SEQ ID NO: 824628 - RNA, 14 nt, Mycobacterium avium subsp. paratuberculosis
cgcggcagccgggc

SEQ ID NO: 824629 - RNA, 16 nt, Mycobacterium avium subsp. paratuberculosis
cgcggcagccgggcga

SEQ ID NO: 824630 - RNA, 23 nt, Mycobacterium avium subsp. paratuberculosis
cgcggcagccgggcgaucaucca

SEQ ID NO: 824631 - RNA, 17 nt, Mycobacterium avium subsp. paratuberculosis
cgcggcagccagccugg

SEQ ID NO: 824632 - RNA, 23 nt, Mycobacterium avium subsp. paratuberculosis
cgcggcagccagccuggcggcga

SEQ ID NO: 824633 - RNA, 22 nt, Mycobacterium avium subsp. paratuberculosis
cgcggcaaggcguuccaucugc

SEQ ID NO: 824634 - RNA, 16 nt, Mycobacterium avium subsp. paratuberculosis
cgcggcaacgccagcc

SEQ ID NO: 824635 - RNA, 20 nt, Mycobacterium avium subsp. paratuberculosis
cgcggaccgcacccccagcu

SEQ ID NO: 824636 - RNA, 22 nt, Mycobacterium avium subsp. paratuberculosis
cgcggaccgcacccccagcucg

SEQ ID NO: 824637 - RNA, 16 nt, Mycobacterium avium subsp. paratuberculosis
cgcggacagcgcggug

SEQ ID NO: 824638 - RNA, 16 nt, Mycobacterium avium subsp. paratuberculosis
cgcggacagcucgccg

SEQ ID NO: 824639 - RNA, 20 nt, Mycobacterium avium subsp. paratuberculosis
cgcggacagcucgccggccg

SEQ ID NO: 824640 - RNA, 13 nt, Mycobacterium avium subsp. paratuberculosis
cgcggacagggcg

SEQ ID NO: 824641 - RNA, 16 nt, Mycobacterium avium subsp. paratuberculosis
cgcggacagggcggcg

SEQ ID NO: 824642 - RNA, 19 nt, Mycobacterium avium subsp. paratuberculosis
cgcggacauucggacggcc

SEQ ID NO: 824643 - RNA, 17 nt, Mycobacterium avium subsp. paratuberculosis
cgcggaccaccgcgugc

SEQ ID NO: 824644 - RNA, 23 nt, Mycobacterium avium subsp. paratuberculosis
cgcggaccaccgcgugcgagccg

SEQ ID NO: 824645 - RNA, 16 nt, Mycobacterium avium subsp. paratuberculosis
cgcggaccccagcgug

SEQ ID NO: 824646 - RNA, 17 nt, Mycobacterium avium subsp. paratuberculosis
cgcggaccccagcguga

SEQ ID NO: 824647 - RNA, 19 nt, Mycobacterium avium subsp. paratuberculosis
cgcggaccccagugcaggc

SEQ ID NO: 824648 - RNA, 18 nt, Mycobacterium avium subsp. paratuberculosis
cgcggacccgacggucgg

SEQ ID NO: 824649 - RNA, 18 nt, Mycobacterium avium subsp. paratuberculosis
cgcggacccuggccagca

SEQ ID NO: 824650 - RNA, 20 nt, Mycobacterium avium subsp. paratuberculosis
cgcggacccuggccagcacc

SEQ ID NO: 824651 - RNA, 21 nt, Mycobacterium avium subsp. paratuberculosis
cgcggacccuggccagcaccg

SEQ ID NO: 824652 - RNA, 14 nt, Mycobacterium avium subsp. paratuberculosis
cgcggaccggcgau

SEQ ID NO: 824653 - RNA, 21 nt, Mycobacterium avium subsp. paratuberculosis
cgcggaccggcgauuucggcc

SEQ ID NO: 824654 - RNA, 14 nt, Mycobacterium avium subsp. paratuberculosis
cgcggcgcugccgc

SEQ ID NO: 824655 - RNA, 16 nt, Mycobacterium avium subsp. paratuberculosis
cgcggcgcugccgccg

SEQ ID NO: 824656 - RNA, 22 nt, Mycobacterium avium subsp. paratuberculosis
cgcggcgcugccgccggccucg

SEQ ID NO: 824657 - RNA, 17 nt, Mycobacterium avium subsp. paratuberculosis
cgcggcgcugccggugc

SEQ ID NO: 824658 - RNA, 19 nt, Mycobacterium avium subsp. paratuberculosis
cgcggcgcugccggugcug

SEQ ID NO: 824659 - RNA, 13 nt, Mycobacterium avium subsp. paratuberculosis
cgcggcgcugcgc

SEQ ID NO: 824660 - RNA, 15 nt, Mycobacterium avium subsp. paratuberculosis
cgcggcgcugcgccg

SEQ ID NO: 824661 - RNA, 17 nt, Mycobacterium avium subsp. paratuberculosis
cgcggcgcugcgccguu

SEQ ID NO: 824662 - RNA, 17 nt, Mycobacterium avium subsp. paratuberculosis
cgcggcgcgggucgcug

SEQ ID NO: 824663 - RNA, 13 nt, Mycobacterium avium subsp. paratuberculosis
cgcggcgccgggc

SEQ ID NO: 824664 - RNA, 20 nt, Mycobacterium avium subsp. paratuberculosis
cgcggcgccgggcggcccgc

SEQ ID NO: 824665 - RNA, 13 nt, Mycobacterium avium subsp. paratuberculosis
cgcggcgccggug

SEQ ID NO: 824666 - RNA, 14 nt, Mycobacterium avium subsp. paratuberculosis
cgcggcgccggaug

SEQ ID NO: 824667 - RNA, 21 nt, Mycobacterium avium subsp. paratuberculosis
cgcggcgccgccacggcacgu

SEQ ID NO: 824668 - RNA, 13 nt, Mycobacterium avium subsp. paratuberculosis
cgcggcgccgcgg

SEQ ID NO: 824669 - RNA, 16 nt, Mycobacterium avium subsp. paratuberculosis
cgcggcgccgcggcgg

SEQ ID NO: 824670 - RNA, 18 nt, Mycobacterium avium subsp. paratuberculosis
cgcggcgccgcggcggca

SEQ ID NO: 824671 - RNA, 19 nt, Mycobacterium avium subsp. paratuberculosis
cgcggcgccgcguaccagc

SEQ ID NO: 824672 - RNA, 22 nt, Mycobacterium avium subsp. paratuberculosis
cgcggcgccgcguaccagcgcc

SEQ ID NO: 824673 - RNA, 13 nt, Mycobacterium avium subsp. paratuberculosis
cgcggcgccgcca

SEQ ID NO: 824674 - RNA, 14 nt, Mycobacterium avium subsp. paratuberculosis
cgcggcgccgacgu

SEQ ID NO: 824675 - RNA, 13 nt, Mycobacterium avium subsp. paratuberculosis
cgcggcgccgaug

SEQ ID NO: 824676 - RNA, 14 nt, Mycobacterium avium subsp. paratuberculosis
cgcggcgccgaugg

SEQ ID NO: 824677 - RNA, 15 nt, Mycobacterium avium subsp. paratuberculosis
cgcggcgccgauggc

SEQ ID NO: 824678 - RNA, 19 nt, Mycobacterium avium subsp. paratuberculosis
cgcggcgcccucgccggcg

SEQ ID NO: 824679 - RNA, 23 nt, Mycobacterium avium subsp. paratuberculosis
cgcggcgcccucgccggcggcgc

SEQ ID NO: 824680 - RNA, 12 nt, Mycobacterium avium subsp. paratuberculosis
cgcggcgcccgg

SEQ ID NO: 824681 - RNA, 23 nt, Mycobacterium avium subsp. paratuberculosis
cgcggcgcccggcgcccggcgcg

SEQ ID NO: 824682 - RNA, 19 nt, Mycobacterium avium subsp. paratuberculosis
cgcggcgcccccgcgacgu

SEQ ID NO: 824683 - RNA, 20 nt, Mycobacterium avium subsp. paratuberculosis
cgcggcgcccccgcgacguc

SEQ ID NO: 824684 - RNA, 20 nt, Mycobacterium avium subsp. paratuberculosis
cgcggcgacgucgugcacgc

SEQ ID NO: 824685 - RNA, 16 nt, Mycobacterium avium subsp. paratuberculosis
cgcggcgacgugaugg

SEQ ID NO: 824686 - RNA, 12 nt, Mycobacterium avium subsp. paratuberculosis
cgcggcgagcag

SEQ ID NO: 824687 - RNA, 16 nt, Mycobacterium avium subsp. paratuberculosis
cgcggcgagcagcgcg

SEQ ID NO: 824688 - RNA, 17 nt, Mycobacterium avium subsp. paratuberculosis
cgcggcgagcagcgcga

SEQ ID NO: 824689 - RNA, 23 nt, Mycobacterium avium subsp. paratuberculosis
cgcggcgagcagcgcgaugccgg

SEQ ID NO: 824690 - RNA, 16 nt, Mycobacterium avium subsp. paratuberculosis
cgcggcgccagcggcc

SEQ ID NO: 824691 - RNA, 20 nt, Mycobacterium avium subsp. paratuberculosis
cgcggcgccagcggccgauc

SEQ ID NO: 824692 - RNA, 22 nt, Mycobacterium avium subsp. paratuberculosis
cgcggcgccagcggccgaucau

SEQ ID NO: 824693 - RNA, 22 nt, Mycobacterium avium subsp. paratuberculosis
cgcggcgacccgcuucgcccgg

SEQ ID NO: 824694 - RNA, 22 nt, Mycobacterium avium subsp. paratuberculosis
cgcggcgacauuggccgcgcgc

SEQ ID NO: 824695 - RNA, 16 nt, Mycobacterium avium subsp. paratuberculosis
cgcggcgaccaccacc

SEQ ID NO: 824696 - RNA, 19 nt, Mycobacterium avium subsp. paratuberculosis
cgcggcgaccaccaccgcc

SEQ ID NO: 824697 - RNA, 22 nt, Mycobacterium avium subsp. paratuberculosis
cgcggcgaccaccucggcgacg

SEQ ID NO: 824698 - RNA, 19 nt, Mycobacterium avium subsp. paratuberculosis
cgcggcgaccggggcggug

SEQ ID NO: 824699 - RNA, 16 nt, Mycobacterium avium subsp. paratuberculosis
cgcggcgaaggccagc

SEQ ID NO: 824700 - RNA, 20 nt, Mycobacterium avium subsp. paratuberculosis
cgcggcgaaggccagcgaua

SEQ ID NO: 824701 - RNA, 14 nt, Mycobacterium avium subsp. paratuberculosis
cgcggcgaaucggu

SEQ ID NO: 824702 - RNA, 18 nt, Mycobacterium avium subsp. paratuberculosis
cgcggcgaaucgguccgg

SEQ ID NO: 824703 - RNA, 20 nt, Mycobacterium avium subsp. paratuberculosis
cgcggcgaaucgguccggcg

SEQ ID NO: 824704 - RNA, 22 nt, Mycobacterium avium subsp. paratuberculosis
cgcggcgaaucgguccggcgaa

SEQ ID NO: 824705 - RNA, 13 nt, Mycobacterium avium subsp. paratuberculosis
cgcggcgacaccc

SEQ ID NO: 824706 - RNA, 19 nt, Mycobacterium avium subsp. paratuberculosis
cgcggcgacacccagcggc

SEQ ID NO: 824707 - RNA, 16 nt, Mycobacterium avium subsp. paratuberculosis
cgcggcgaagcaggcc

SEQ ID NO: 824708 - RNA, 16 nt, Mycobacterium avium subsp. paratuberculosis
cgcggcgaacaccucg

SEQ ID NO: 824709 - RNA, 17 nt, Mycobacterium avium subsp. paratuberculosis
cgcggcgaacaccucgg

SEQ ID NO: 824710 - RNA, 19 nt, Mycobacterium avium subsp. paratuberculosis
cgcggcgaacaccucggcg

SEQ ID NO: 824711 - RNA, 16 nt, Mycobacterium avium subsp. paratuberculosis
cgcggcgaaccagcau

SEQ ID NO: 824712 - RNA, 18 nt, Mycobacterium avium subsp. paratuberculosis
cgcggcgaaccagcaugc

SEQ ID NO: 824713 - RNA, 20 nt, Mycobacterium avium subsp. paratuberculosis
cgcggcgaaccagcaugcgc

SEQ ID NO: 824714 - RNA, 20 nt, Mycobacterium avium subsp. paratuberculosis
cgcggcgaacccgagcaccc

SEQ ID NO: 824715 - RNA, 17 nt, Mycobacterium avium subsp. paratuberculosis
cgcggccuugcgagccg

SEQ ID NO: 824716 - RNA, 20 nt, Mycobacterium avium subsp. paratuberculosis
cgcggccuugcgagccggag

SEQ ID NO: 824717 - RNA, 21 nt, Mycobacterium avium subsp. paratuberculosis
cgcggccuugcgagccggagc

SEQ ID NO: 824718 - RNA, 18 nt, Mycobacterium avium subsp. paratuberculosis
cgcggccuugcgcaccgg

SEQ ID NO: 824719 - RNA, 20 nt, Mycobacterium avium subsp. paratuberculosis
cgcggccuugcgcaccggag

SEQ ID NO: 824720 - RNA, 17 nt, Mycobacterium avium subsp. paratuberculosis
cgcggccuugcgggccg

SEQ ID NO: 824721 - RNA, 18 nt, Mycobacterium avium subsp. paratuberculosis
cgcggccuugcgggccgg

SEQ ID NO: 824722 - RNA, 20 nt, Mycobacterium avium subsp. paratuberculosis
cgcggccuugcgggccggag

SEQ ID NO: 824723 - RNA, 17 nt, Mycobacterium avium subsp. paratuberculosis
cgcggccuucuuggccg

SEQ ID NO: 824724 - RNA, 19 nt, Mycobacterium avium subsp. paratuberculosis
cgcggccuucuuggccgga

SEQ ID NO: 824725 - RNA, 20 nt, Mycobacterium avium subsp. paratuberculosis
cgcggccuucuuggccggag

SEQ ID NO: 824726 - RNA, 13 nt, Mycobacterium avium subsp. paratuberculosis
cgcggccugcagc

SEQ ID NO: 824727 - RNA, 14 nt, Mycobacterium avium subsp. paratuberculosis
cgcggccugcagca

SEQ ID NO: 824728 - RNA, 16 nt, Mycobacterium avium subsp. paratuberculosis
cgcggccugcagcacc

SEQ ID NO: 824729 - RNA, 23 nt, Mycobacterium avium subsp. paratuberculosis
cgcggccugcagcaccgaaccgg

SEQ ID NO: 824730 - RNA, 17 nt, Mycobacterium avium subsp. paratuberculosis
cgcggccgccgccgcgg

SEQ ID NO: 824731 - RNA, 18 nt, Mycobacterium avium subsp. paratuberculosis
cgcggccgccgccgcggc

SEQ ID NO: 824732 - RNA, 23 nt, Mycobacterium avium subsp. paratuberculosis
cgcggccgccgccgcggccgcgg

SEQ ID NO: 824733 - RNA, 15 nt, Mycobacterium avium subsp. paratuberculosis
cgcggccucgucgag

SEQ ID NO: 824734 - RNA, 17 nt, Mycobacterium avium subsp. paratuberculosis
cgcggccucgucgaggu

SEQ ID NO: 824735 - RNA, 20 nt, Mycobacterium avium subsp. paratuberculosis
cgcggccugcgggcgccggc

SEQ ID NO: 824736 - RNA, 21 nt, Mycobacterium avium subsp. paratuberculosis
cgcggccugcgggcgccggcu

SEQ ID NO: 824737 - RNA, 16 nt, Mycobacterium avium subsp. paratuberculosis
cgcggccgcccggucc

SEQ ID NO: 824738 - RNA, 17 nt, Mycobacterium avium subsp. paratuberculosis
cgcggccgcccgguccg

SEQ ID NO: 824739 - RNA, 19 nt, Mycobacterium avium subsp. paratuberculosis
cgcggccgcccgguccggg

SEQ ID NO: 824740 - RNA, 13 nt, Mycobacterium avium subsp. paratuberculosis
cgcggccgccgcc

SEQ ID NO: 824741 - RNA, 14 nt, Mycobacterium avium subsp. paratuberculosis
cgcggccgccgccg

SEQ ID NO: 824742 - RNA, 16 nt, Mycobacterium avium subsp. paratuberculosis
cgcggccgccagcgca

SEQ ID NO: 824743 - RNA, 21 nt, Mycobacterium avium subsp. paratuberculosis
cgcggccgccagcgcaccgag

SEQ ID NO: 824744 - RNA, 16 nt, Mycobacterium avium subsp. paratuberculosis
cgcggccgccaggucg

SEQ ID NO: 824745 - RNA, 14 nt, Mycobacterium avium subsp. paratuberculosis
cgcggccgcccagc

SEQ ID NO: 824746 - RNA, 15 nt, Mycobacterium avium subsp. paratuberculosis
cgcggccgcccagcc

SEQ ID NO: 824747 - RNA, 18 nt, Mycobacterium avium subsp. paratuberculosis
cgcggccgcccagcccgc

SEQ ID NO: 824748 - RNA, 23 nt, Mycobacterium avium subsp. paratuberculosis
cgcggccgagccgaggccgaugg

SEQ ID NO: 824749 - RNA, 16 nt, Mycobacterium avium subsp. paratuberculosis
cgcggccgauucggcg

SEQ ID NO: 824750 - RNA, 20 nt, Mycobacterium avium subsp. paratuberculosis
cgcggccgauucggcgccgc

SEQ ID NO: 824751 - RNA, 19 nt, Mycobacterium avium subsp. paratuberculosis
cgcggccgaaaucaacgcg

SEQ ID NO: 824752 - RNA, 20 nt, Mycobacterium avium subsp. paratuberculosis
cgcggccgaaaucaacgcgc

SEQ ID NO: 824753 - RNA, 23 nt, Mycobacterium avium subsp. paratuberculosis
cgcggccgaaaucaacgcgccga

SEQ ID NO: 824754 - RNA, 13 nt, Mycobacterium avium subsp. paratuberculosis
cgcggccgaaccg

SEQ ID NO: 824755 - RNA, 23 nt, Mycobacterium avium subsp. paratuberculosis
cgcggcccacccgcagggcgccg

SEQ ID NO: 824756 - RNA, 15 nt, Mycobacterium avium subsp. paratuberculosis
cgcggcccaccgcgu

SEQ ID NO: 824757 - RNA, 18 nt, Mycobacterium avium subsp. paratuberculosis
cgcggcccaccgcgucgc

SEQ ID NO: 824758 - RNA, 19 nt, Mycobacterium avium subsp. paratuberculosis
cgcggcccaccgcgucgca

SEQ ID NO: 824759 - RNA, 12 nt, Mycobacterium avium subsp. paratuberculosis
cgcggccagcgg

SEQ ID NO: 824760 - RNA, 17 nt, Mycobacterium avium subsp. paratuberculosis
cgcggccaggucgaggu

SEQ ID NO: 824761 - RNA, 15 nt, Mycobacterium avium subsp. paratuberculosis
cgcggccaggguaga

SEQ ID NO: 824762 - RNA, 23 nt, Mycobacterium avium subsp. paratuberculosis
cgcggccaggguagaggcggcga

SEQ ID NO: 824763 - RNA, 14 nt, Mycobacterium avium subsp. paratuberculosis
cgcggccagcggcg

SEQ ID NO: 824764 - RNA, 15 nt, Mycobacterium avium subsp. paratuberculosis
cgcggccagcggcgc

SEQ ID NO: 824765 - RNA, 16 nt, Mycobacterium avium subsp. paratuberculosis
cgcggccagcgggccg

SEQ ID NO: 824766 - RNA, 13 nt, Mycobacterium avium subsp. paratuberculosis
cgcggccagcgug

SEQ ID NO: 824767 - RNA, 19 nt, Mycobacterium avium subsp. paratuberculosis
cgcggccagcgugaacacc

SEQ ID NO: 824768 - RNA, 17 nt, Mycobacterium avium subsp. paratuberculosis
cgcggccagcuccgggu

SEQ ID NO: 824769 - RNA, 21 nt, Mycobacterium avium subsp. paratuberculosis
cgcggccagcucggucgcggu

SEQ ID NO: 824770 - RNA, 13 nt, Mycobacterium avium subsp. paratuberculosis
cgcggccagcuga

SEQ ID NO: 824771 - RNA, 23 nt, Mycobacterium avium subsp. paratuberculosis
cgcggccagcugaacacgaaccc

SEQ ID NO: 824772 - RNA, 21 nt, Mycobacterium avium subsp. paratuberculosis
cgcggccagcugcccgccgac

SEQ ID NO: 824773 - RNA, 23 nt, Mycobacterium avium subsp. paratuberculosis
cgcggccagcugcgacagcacgg

SEQ ID NO: 824774 - RNA, 13 nt, Mycobacterium avium subsp. paratuberculosis
cgcggccagcgcg

SEQ ID NO: 824775 - RNA, 14 nt, Mycobacterium avium subsp. paratuberculosis
cgcggccagccccg

SEQ ID NO: 824776 - RNA, 12 nt, Mycobacterium avium subsp. paratuberculosis
cgcggccagccg

SEQ ID NO: 824777 - RNA, 19 nt, Mycobacterium avium subsp. paratuberculosis
cgcggccagcgcgcgggcg

SEQ ID NO: 824778 - RNA, 13 nt, Mycobacterium avium subsp. paratuberculosis
cgcggccagccgg

SEQ ID NO: 824779 - RNA, 16 nt, Mycobacterium avium subsp. paratuberculosis
cgcggccagccggucg

SEQ ID NO: 824780 - RNA, 12 nt, Mycobacterium avium subsp. paratuberculosis
cgcggccagcga

SEQ ID NO: 824781 - RNA, 13 nt, Mycobacterium avium subsp. paratuberculosis
cgcggccagcgag

SEQ ID NO: 824782 - RNA, 14 nt, Mycobacterium avium subsp. paratuberculosis
cgcggccagcgccc

SEQ ID NO: 824783 - RNA, 22 nt, Mycobacterium avium subsp. paratuberculosis
cgcggccagcacggucagcggc

SEQ ID NO: 824784 - RNA, 23 nt, Mycobacterium avium subsp. paratuberculosis
cgcgcggaugcccaggccggcga

SEQ ID NO: 824785 - RNA, 13 nt, Mycobacterium avium subsp. paratuberculosis
cgcgcgcuggugc

SEQ ID NO: 824786 - RNA, 20 nt, Mycobacterium avium subsp. paratuberculosis
cgcgcgcuggugcgggccag

SEQ ID NO: 824787 - RNA, 20 nt, Mycobacterium avium subsp. paratuberculosis
cgcgcgcugcagcauccagg

SEQ ID NO: 824788 - RNA, 15 nt, Mycobacterium avium subsp. paratuberculosis
cgcgcgcugccgcgc

SEQ ID NO: 824789 - RNA, 14 nt, Mycobacterium avium subsp. paratuberculosis
cgcgcgcgucgacg

SEQ ID NO: 824790 - RNA, 13 nt, Mycobacterium avium subsp. paratuberculosis
cgcgcgcucgggg

SEQ ID NO: 824791 - RNA, 21 nt, Mycobacterium avium subsp. paratuberculosis
cgcgcgcucggucagcaccgg

SEQ ID NO: 824792 - RNA, 15 nt, Mycobacterium avium subsp. paratuberculosis
cgcgcgcggcgacgg

SEQ ID NO: 824793 - RNA, 15 nt, Mycobacterium avium subsp. paratuberculosis
cgcgcgcgcucggcg

SEQ ID NO: 824794 - RNA, 13 nt, Mycobacterium avium subsp. paratuberculosis
cgcgcgcggcccg

SEQ ID NO: 824795 - RNA, 14 nt, Mycobacterium avium subsp. paratuberculosis
cgcgcgcggguaga

SEQ ID NO: 824796 - RNA, 14 nt, Mycobacterium avium subsp. paratuberculosis
cgcgcgcggcggcc

SEQ ID NO: 824797 - RNA, 15 nt, Mycobacterium avium subsp. paratuberculosis
cgcgcgcggcggcca

SEQ ID NO: 824798 - RNA, 13 nt, Mycobacterium avium subsp. paratuberculosis
cgcgcgcggcguc

SEQ ID NO: 824799 - RNA, 14 nt, Mycobacterium avium subsp. paratuberculosis
cgcgcgcggcgugg

SEQ ID NO: 824800 - RNA, 15 nt, Mycobacterium avium subsp. paratuberculosis
cgcgcgcggcguggu

SEQ ID NO: 824801 - RNA, 13 nt, Mycobacterium avium subsp. paratuberculosis
cgcgcgcggcgac

SEQ ID NO: 824802 - RNA, 14 nt, Mycobacterium avium subsp. paratuberculosis
cgcgcgcggcgacg

SEQ ID NO: 824803 - RNA, 12 nt, Mycobacterium avium subsp. paratuberculosis
cgcgcgcgccgu

SEQ ID NO: 824804 - RNA, 13 nt, Mycobacterium avium subsp. paratuberculosis
cgcgcgcgccguc

SEQ ID NO: 824805 - RNA, 13 nt, Mycobacterium avium subsp. paratuberculosis
cgcgcgcggcacg

SEQ ID NO: 824806 - RNA, 14 nt, Mycobacterium avium subsp. paratuberculosis
cgcgcgcggcacgg

SEQ ID NO: 824807 - RNA, 14 nt, Mycobacterium avium subsp. paratuberculosis
cgcgcgcgccacga

SEQ ID NO: 824808 - RNA, 21 nt, Mycobacterium avium subsp. paratuberculosis
cgcgccguugguggucugcca

SEQ ID NO: 824809 - RNA, 22 nt, Mycobacterium avium subsp. paratuberculosis
cgcgccuccauucgggccagcg

SEQ ID NO: 824810 - RNA, 23 nt, Mycobacterium avium subsp. paratuberculosis
cgcgccuccauucgggccagcgc

SEQ ID NO: 824811 - RNA, 13 nt, Mycobacterium avium subsp. paratuberculosis
cgcgccuccgacg

SEQ ID NO: 824812 - RNA, 12 nt, Mycobacterium avium subsp. paratuberculosis
cgcgccgugggc

SEQ ID NO: 824813 - RNA, 14 nt, Mycobacterium avium subsp. paratuberculosis
cgcgccguugaccg

SEQ ID NO: 824814 - RNA, 20 nt, Mycobacterium avium subsp. paratuberculosis
cgcgccguugaccgcggcga

SEQ ID NO: 824815 - RNA, 13 nt, Mycobacterium avium subsp. paratuberculosis
cgcgccggcgguc

SEQ ID NO: 824816 - RNA, 23 nt, Mycobacterium avium subsp. paratuberculosis
cgcgccgugcgccagcgaccgca

SEQ ID NO: 824817 - RNA, 14 nt, Mycobacterium avium subsp. paratuberculosis
cgcgccguggccca

SEQ ID NO: 824818 - RNA, 18 nt, Mycobacterium avium subsp. paratuberculosis
cgcgcggcccgcgacguc

SEQ ID NO: 824819 - RNA, 13 nt, Mycobacterium avium subsp. paratuberculosis
cgcgcggcgaugg

SEQ ID NO: 824820 - RNA, 19 nt, Mycobacterium avium subsp. paratuberculosis
cgcgcggcgcagggcggcc

SEQ ID NO: 824821 - RNA, 12 nt, Mycobacterium avium subsp. paratuberculosis
cgcgcggcgcca

SEQ ID NO: 824822 - RNA, 16 nt, Mycobacterium avium subsp. paratuberculosis
cgcgcggcgccagcgg

SEQ ID NO: 824823 - RNA, 13 nt, Mycobacterium avium subsp. paratuberculosis
cgcgcggcgccgc

SEQ ID NO: 824824 - RNA, 19 nt, Mycobacterium avium subsp. paratuberculosis
cgcgcggcgacgguggcgg

SEQ ID NO: 824825 - RNA, 20 nt, Mycobacterium avium subsp. paratuberculosis
cgcgcggcgacgguggcggg

SEQ ID NO: 824826 - RNA, 13 nt, Mycobacterium avium subsp. paratuberculosis
cgcgcggccgggc

SEQ ID NO: 824827 - RNA, 15 nt, Mycobacterium avium subsp. paratuberculosis
cgcgcggccgggcuc

SEQ ID NO: 824828 - RNA, 14 nt, Mycobacterium avium subsp. paratuberculosis
cgcgcggccggcca

SEQ ID NO: 824829 - RNA, 15 nt, Mycobacterium avium subsp. paratuberculosis
cgcgcggccggccac

SEQ ID NO: 824830 - RNA, 17 nt, Mycobacterium avium subsp. paratuberculosis
cgcgcggccggccacgc

SEQ ID NO: 824831 - RNA, 20 nt, Mycobacterium avium subsp. paratuberculosis
cgcgcggccggccacgcucg

SEQ ID NO: 824832 - RNA, 16 nt, Mycobacterium avium subsp. paratuberculosis
cgcgcggccgccaggu

SEQ ID NO: 824833 - RNA, 15 nt, Mycobacterium avium subsp. paratuberculosis
cgcgcggccgccucc

SEQ ID NO: 824834 - RNA, 13 nt, Mycobacterium avium subsp. paratuberculosis
cgcgcggccgcga

SEQ ID NO: 824835 - RNA, 13 nt, Mycobacterium avium subsp. paratuberculosis
cgcgcggcccagc

SEQ ID NO: 824836 - RNA, 17 nt, Mycobacterium avium subsp. paratuberculosis
cgcgcggcccagcguca

SEQ ID NO: 824837 - RNA, 13 nt, Mycobacterium avium subsp. paratuberculosis
cgcgcggcaccac

SEQ ID NO: 824838 - RNA, 22 nt, Mycobacterium avium subsp. paratuberculosis
cgcgcggcaccaccagcgugug

SEQ ID NO: 824839 - RNA, 15 nt, Mycobacterium avium subsp. paratuberculosis
cgcgcggccagcggc

SEQ ID NO: 824840 - RNA, 18 nt, Mycobacterium avium subsp. paratuberculosis
cgcgcggccagcggcgcc

SEQ ID NO: 824841 - RNA, 13 nt, Mycobacterium avium subsp. paratuberculosis
cgcgcggccacca

SEQ ID NO: 824842 - RNA, 14 nt, Mycobacterium avium subsp. paratuberculosis
cgcgcggccaccgc

SEQ ID NO: 824843 - RNA, 15 nt, Mycobacterium avium subsp. paratuberculosis
cgcgcggccaccgcg

SEQ ID NO: 824844 - RNA, 13 nt, Mycobacterium avium subsp. paratuberculosis
cgcgcggccagcc

SEQ ID NO: 824845 - RNA, 14 nt, Mycobacterium avium subsp. paratuberculosis
cgcgcggccagccc

SEQ ID NO: 824846 - RNA, 15 nt, Mycobacterium avium subsp. paratuberculosis
cgcgcggccagcccc

SEQ ID NO: 824847 - RNA, 12 nt, Mycobacterium avium subsp. paratuberculosis
cgcgcggcaucg

SEQ ID NO: 824848 - RNA, 13 nt, Mycobacterium avium subsp. paratuberculosis
cgcgcggcaucgu

SEQ ID NO: 824849 - RNA, 14 nt, Mycobacterium avium subsp. paratuberculosis
cgcgcggcaucguc

SEQ ID NO: 824850 - RNA, 12 nt, Mycobacterium avium subsp. paratuberculosis
cgcgcggcucgc

SEQ ID NO: 824851 - RNA, 20 nt, Mycobacterium avium subsp. paratuberculosis
cgcgcggcuaguuggccggc

SEQ ID NO: 824852 - RNA, 20 nt, Mycobacterium avium subsp. paratuberculosis
cgcgcggcucacagcgcggc

SEQ ID NO: 824853 - RNA, 21 nt, Mycobacterium avium subsp. paratuberculosis
cgcgcggcgcggagccggccg

SEQ ID NO: 824854 - RNA, 22 nt, Mycobacterium avium subsp. paratuberculosis
cgcgcggcgcggagccggccgc

SEQ ID NO: 824855 - RNA, 18 nt, Mycobacterium avium subsp. paratuberculosis
cgcgcggcucgcgggcga

SEQ ID NO: 824856 - RNA, 17 nt, Mycobacterium avium subsp. paratuberculosis
cgcgcgggagcgcuggu

SEQ ID NO: 824857 - RNA, 20 nt, Mycobacterium avium subsp. paratuberculosis
cgcgcgggagcgcuggucgg

SEQ ID NO: 824858 - RNA, 23 nt, Mycobacterium avium subsp. paratuberculosis
cgcgcgggagcgcuggucggcga

SEQ ID NO: 824859 - RNA, 12 nt, Mycobacterium avium subsp. paratuberculosis
cgcgcggcggcc

SEQ ID NO: 824860 - RNA, 14 nt, Mycobacterium avium subsp. paratuberculosis
cgcgcggcggccac

SEQ ID NO: 824861 - RNA, 15 nt, Mycobacterium avium subsp. paratuberculosis
cgcgcggcggccacc

SEQ ID NO: 824862 - RNA, 18 nt, Mycobacterium avium subsp. paratuberculosis
cgcgcggcggccaccgcg

SEQ ID NO: 824863 - RNA, 23 nt, Mycobacterium avium subsp. paratuberculosis
cgcgcggcggccaccgcgccgug

SEQ ID NO: 824864 - RNA, 16 nt, Mycobacterium avium subsp. paratuberculosis
cgcgcggcgggcccgc

SEQ ID NO: 824865 - RNA, 14 nt, Mycobacterium avium subsp. paratuberculosis
cgcgcggcggucca

SEQ ID NO: 824866 - RNA, 13 nt, Mycobacterium avium subsp. paratuberculosis
cgcgcggcgguga

SEQ ID NO: 824867 - RNA, 21 nt, Mycobacterium avium subsp. paratuberculosis
cgcgcggcggugaccggaucg

SEQ ID NO: 824868 - RNA, 18 nt, Mycobacterium avium subsp. paratuberculosis
cgcgcggcgucggccggg

SEQ ID NO: 824869 - RNA, 20 nt, Mycobacterium avium subsp. paratuberculosis
cgcgcgguguuuggccgcgc

SEQ ID NO: 824870 - RNA, 14 nt, Mycobacterium avium subsp. paratuberculosis
cgcgcggucgucgc

SEQ ID NO: 824871 - RNA, 12 nt, Mycobacterium avium subsp. paratuberculosis
cgcgcggugcac

SEQ ID NO: 824872 - RNA, 17 nt, Mycobacterium avium subsp. paratuberculosis
cgcgcggugcacgguca

SEQ ID NO: 824873 - RNA, 23 nt, Mycobacterium avium subsp. paratuberculosis
cgcgcggugcacggucagcucgc

SEQ ID NO: 824874 - RNA, 16 nt, Mycobacterium avium subsp. paratuberculosis
cgcgcggugcccggaa

SEQ ID NO: 824875 - RNA, 16 nt, Mycobacterium avium subsp. paratuberculosis
cgcgcggugcgccagc

SEQ ID NO: 824876 - RNA, 20 nt, Mycobacterium avium subsp. paratuberculosis
cgcgcggugcgccagcgccg

SEQ ID NO: 824877 - RNA, 14 nt, Mycobacterium avium subsp. paratuberculosis
cgcgcgggccagcg

SEQ ID NO: 824878 - RNA, 15 nt, Mycobacterium avium subsp. paratuberculosis
cgcgcgggccagcgc

SEQ ID NO: 824879 - RNA, 16 nt, Mycobacterium avium subsp. paratuberculosis
cgcgcgggccagcgcc

SEQ ID NO: 824880 - RNA, 14 nt, Mycobacterium avium subsp. paratuberculosis
cgcgcgguuccggc

SEQ ID NO: 824881 - RNA, 15 nt, Mycobacterium avium subsp. paratuberculosis
cgcgcgguuccggcg

SEQ ID NO: 824882 - RNA, 18 nt, Mycobacterium avium subsp. paratuberculosis
cgcgcgguuccggcgugc

SEQ ID NO: 824883 - RNA, 15 nt, Mycobacterium avium subsp. paratuberculosis
cgcgcgucacgcugg

SEQ ID NO: 824884 - RNA, 19 nt, Mycobacterium avium subsp. paratuberculosis
cgcgcucauaucccgucag

SEQ ID NO: 824885 - RNA, 13 nt, Mycobacterium avium subsp. paratuberculosis
cgcgcgucgacgu

SEQ ID NO: 824886 - RNA, 14 nt, Mycobacterium avium subsp. paratuberculosis
cgcgcucgacgaug

SEQ ID NO: 824887 - RNA, 20 nt, Mycobacterium avium subsp. paratuberculosis
cgcgcucgacgaugucgacg

SEQ ID NO: 824888 - RNA, 15 nt, Mycobacterium avium subsp. paratuberculosis
cgcgcucccggcgcc

SEQ ID NO: 824889 - RNA, 18 nt, Mycobacterium avium subsp. paratuberculosis
cgcgcucccggcgccgcc

SEQ ID NO: 824890 - RNA, 19 nt, Mycobacterium avium subsp. paratuberculosis
cgcgcucccggcgccgccg

SEQ ID NO: 824891 - RNA, 14 nt, Mycobacterium avium subsp. paratuberculosis
cgcgcugcaggccc

SEQ ID NO: 824892 - RNA, 16 nt, Mycobacterium avium subsp. paratuberculosis
cgcgcugcaggcccgg

SEQ ID NO: 824893 - RNA, 15 nt, Mycobacterium avium subsp. paratuberculosis
cgcgcugcccagcgc

SEQ ID NO: 824894 - RNA, 17 nt, Mycobacterium avium subsp. paratuberculosis
cgcgcugcccagcgcgg

SEQ ID NO: 824895 - RNA, 18 nt, Mycobacterium avium subsp. paratuberculosis
cgcgcugcccagcgcggu

SEQ ID NO: 824896 - RNA, 20 nt, Mycobacterium avium subsp. paratuberculosis
cgcgcugcccagcgcggucg

SEQ ID NO: 824897 - RNA, 22 nt, Mycobacterium avium subsp. paratuberculosis
cgcgcugcccagcgcggucgcc

SEQ ID NO: 824898 - RNA, 15 nt, Mycobacterium avium subsp. paratuberculosis
cgcgcugccagggcc

SEQ ID NO: 824899 - RNA, 19 nt, Mycobacterium avium subsp. paratuberculosis
cgcgcugccagggccgggc

SEQ ID NO: 824900 - RNA, 14 nt, Mycobacterium avium subsp. paratuberculosis
cgcgcugccgcgcc

SEQ ID NO: 824901 - RNA, 20 nt, Mycobacterium avium subsp. paratuberculosis
cgcgcugccgcgcgccgaca

SEQ ID NO: 824902 - RNA, 13 nt, Mycobacterium avium subsp. paratuberculosis
cgcgcugagcagg

SEQ ID NO: 824903 - RNA, 18 nt, Mycobacterium avium subsp. paratuberculosis
cgcgcuccugccagcggc

SEQ ID NO: 824904 - RNA, 15 nt, Mycobacterium avium subsp. paratuberculosis
cgcgcugaccagcgu

SEQ ID NO: 824905 - RNA, 16 nt, Mycobacterium avium subsp. paratuberculosis
cgcgcugaccagcgug

SEQ ID NO: 824906 - RNA, 15 nt, Mycobacterium avium subsp. paratuberculosis
cgcgcugaccaggcc

SEQ ID NO: 824907 - RNA, 16 nt, Mycobacterium avium subsp. paratuberculosis
cgcgcugaagcgcgac

SEQ ID NO: 824908 - RNA, 18 nt, Mycobacterium avium subsp. paratuberculosis
cgcgcugaagcgcgaccc

SEQ ID NO: 824909 - RNA, 18 nt, Mycobacterium avium subsp. paratuberculosis
cgcggaacagcgucgccg

SEQ ID NO: 824910 - RNA, 21 nt, Mycobacterium avium subsp. paratuberculosis
cgcggaacagcgucgccgacg

SEQ ID NO: 824911 - RNA, 22 nt, Mycobacterium avium subsp. paratuberculosis
cgcggaacagcgucgccgacgg

SEQ ID NO: 824912 - RNA, 20 nt, Mycobacterium avium subsp. paratuberculosis
cgcggaaacuccuggccccg

SEQ ID NO: 824913 - RNA, 14 nt, Mycobacterium avium subsp. paratuberculosis
cgcggaaccggccg

SEQ ID NO: 824914 - RNA, 15 nt, Mycobacterium avium subsp. paratuberculosis
cgcggaaccggccgg

SEQ ID NO: 824915 - RNA, 22 nt, Mycobacterium avium subsp. paratuberculosis
cgcgcuuuggaccagggcggug

SEQ ID NO: 824916 - RNA, 15 nt, Mycobacterium avium subsp. paratuberculosis
cgcgcuugguggcga

SEQ ID NO: 824917 - RNA, 21 nt, Mycobacterium avium subsp. paratuberculosis
cgcgcuuguacaggucgacca

SEQ ID NO: 824918 - RNA, 16 nt, Mycobacterium avium subsp. paratuberculosis
cgcgcuugacggccgg

SEQ ID NO: 824919 - RNA, 17 nt, Mycobacterium avium subsp. paratuberculosis
cgcgcuugacggccggg

SEQ ID NO: 824920 - RNA, 15 nt, Mycobacterium avium subsp. paratuberculosis
cgcgcuugccgcgac

SEQ ID NO: 824921 - RNA, 19 nt, Mycobacterium avium subsp. paratuberculosis
cgcgcuugccgcgacccgg

SEQ ID NO: 824922 - RNA, 13 nt, Mycobacterium avium subsp. paratuberculosis
cgcgcuugcgcuc

SEQ ID NO: 824923 - RNA, 15 nt, Mycobacterium avium subsp. paratuberculosis
cgcgcuugcgcucgg

SEQ ID NO: 824924 - RNA, 21 nt, Mycobacterium avium subsp. paratuberculosis
cgcgcuugcgcucggucgcgg

SEQ ID NO: 824925 - RNA, 23 nt, Mycobacterium avium subsp. paratuberculosis
cgcgcuugcgcucggucgcggcg

SEQ ID NO: 824926 - RNA, 14 nt, Mycobacterium avium subsp. paratuberculosis
cgcgcuugcgaccg

SEQ ID NO: 824927 - RNA, 16 nt, Mycobacterium avium subsp. paratuberculosis
cgcgcuugcgaccgcc

SEQ ID NO: 824928 - RNA, 15 nt, Mycobacterium avium subsp. paratuberculosis
cgcgcuggccagcgu

SEQ ID NO: 824929 - RNA, 19 nt, Mycobacterium avium subsp. paratuberculosis
cgcgcuuaauacagcgcgu

SEQ ID NO: 824930 - RNA, 12 nt, Mycobacterium avium subsp. paratuberculosis
cgcgcuguccac

SEQ ID NO: 824931 - RNA, 14 nt, Mycobacterium avium subsp. paratuberculosis
cgcgcugucgacgc

SEQ ID NO: 824932 - RNA, 22 nt, Mycobacterium avium subsp. paratuberculosis
cgcgcugucgcccucgaucgcg

SEQ ID NO: 824933 - RNA, 21 nt, Mycobacterium avium subsp. paratuberculosis
cgcgcuggagauguugaucac

SEQ ID NO: 824934 - RNA, 22 nt, Mycobacterium avium subsp. paratuberculosis
cgcgcuggagauguugaucacg

SEQ ID NO: 824935 - RNA, 16 nt, Mycobacterium avium subsp. paratuberculosis
cgcgcugcgcgccgcc

SEQ ID NO: 824936 - RNA, 23 nt, Mycobacterium avium subsp. paratuberculosis
cgcgcugcgcgcguuguccagca

SEQ ID NO: 824937 - RNA, 12 nt, Mycobacterium avium subsp. paratuberculosis
cgcgcugcggcg

SEQ ID NO: 824938 - RNA, 22 nt, Mycobacterium avium subsp. paratuberculosis
gcauccucauagccggccgcgu

SEQ ID NO: 824939 - RNA, 20 nt, Mycobacterium avium subsp. paratuberculosis
gcauccgucggccuugcgcc

SEQ ID NO: 824940 - RNA, 19 nt, Mycobacterium avium subsp. paratuberculosis
gcauccucggcgcgucggu

SEQ ID NO: 824941 - RNA, 20 nt, Mycobacterium avium subsp. paratuberculosis
gcauccggugccgagcgcgc

SEQ ID NO: 824942 - RNA, 22 nt, Mycobacterium avium subsp. paratuberculosis
gcauccggucauccucgccgcg

SEQ ID NO: 824943 - RNA, 12 nt, Mycobacterium avium subsp. paratuberculosis
gcauccggccgu

SEQ ID NO: 824944 - RNA, 18 nt, Mycobacterium avium subsp. paratuberculosis
gcauccggccgucgucgg

SEQ ID NO: 824945 - RNA, 17 nt, Mycobacterium avium subsp. paratuberculosis
gcauccggcgcacggcg

SEQ ID NO: 824946 - RNA, 18 nt, Mycobacterium avium subsp. paratuberculosis
gcauccggcgcacggcgc

SEQ ID NO: 824947 - RNA, 19 nt, Mycobacterium avium subsp. paratuberculosis
gcauccggcgcacggcgcc

SEQ ID NO: 824948 - RNA, 19 nt, Mycobacterium avium subsp. paratuberculosis
gcauccggcucagaaggcg

SEQ ID NO: 824949 - RNA, 13 nt, Mycobacterium avium subsp. paratuberculosis
gcauccgggccgc

SEQ ID NO: 824950 - RNA, 17 nt, Mycobacterium avium subsp. paratuberculosis
gcauccgggccgccgcg

SEQ ID NO: 824951 - RNA, 17 nt, Mycobacterium avium subsp. paratuberculosis
gcauccagcacggccgc

SEQ ID NO: 824952 - RNA, 16 nt, Mycobacterium avium subsp. paratuberculosis
gcauccagcgccgcca

SEQ ID NO: 824953 - RNA, 17 nt, Mycobacterium avium subsp. paratuberculosis
gcauccagucggcgccg

SEQ ID NO: 824954 - RNA, 23 nt, Mycobacterium avium subsp. paratuberculosis
gcauccccagcugggccgccagc

SEQ ID NO: 824955 - RNA, 19 nt, Mycobacterium avium subsp. paratuberculosis
gccaacugguccugcggcu

SEQ ID NO: 824956 - RNA, 16 nt, Mycobacterium avium subsp. paratuberculosis
gccaagacguccgcgu

SEQ ID NO: 824957 - RNA, 21 nt, Mycobacterium avium subsp. paratuberculosis
gccaagacguccgcgucggcg

SEQ ID NO: 824958 - RNA, 22 nt, Mycobacterium avium subsp. paratuberculosis
gccaagacguccgcgucggcgc

SEQ ID NO: 824959 - RNA, 13 nt, Mycobacterium avium subsp. paratuberculosis
gccaagcaccggg

SEQ ID NO: 824960 - RNA, 17 nt, Mycobacterium avium subsp. paratuberculosis
gcaucgaaccgccgcgc

SEQ ID NO: 824961 - RNA, 18 nt, Mycobacterium avium subsp. paratuberculosis
gcaucgaaccgccgcgcu

SEQ ID NO: 824962 - RNA, 16 nt, Mycobacterium avium subsp. paratuberculosis
gcauccugcuggccgg

SEQ ID NO: 824963 - RNA, 19 nt, Mycobacterium avium subsp. paratuberculosis
gcauccugggcgucgagug

SEQ ID NO: 824964 - RNA, 17 nt, Mycobacterium avium subsp. paratuberculosis
gccaacugcaucgccag

SEQ ID NO: 824965 - RNA, 19 nt, Mycobacterium avium subsp. paratuberculosis
gccaacuccggcggcagcc

SEQ ID NO: 824966 - RNA, 14 nt, Mycobacterium avium subsp. paratuberculosis
gccaaucaccgcgg

SEQ ID NO: 824967 - RNA, 13 nt, Mycobacterium avium subsp. paratuberculosis
gccaaucgccgau

SEQ ID NO: 824968 - RNA, 17 nt, Mycobacterium avium subsp. paratuberculosis
gccaaucgccgaugacc

SEQ ID NO: 824969 - RNA, 14 nt, Mycobacterium avium subsp. paratuberculosis
gccaauccggcggg

SEQ ID NO: 824970 - RNA, 15 nt, Mycobacterium avium subsp. paratuberculosis
gccaauccggcgggc

SEQ ID NO: 824971 - RNA, 21 nt, Mycobacterium avium subsp. paratuberculosis
gccaaguagacucagcgucga

SEQ ID NO: 824972 - RNA, 19 nt, Mycobacterium avium subsp. paratuberculosis
gccaaggggaacaacgcgc

SEQ ID NO: 824973 - RNA, 14 nt, Mycobacterium avium subsp. paratuberculosis
gccaaggucgccgg

SEQ ID NO: 824974 - RNA, 16 nt, Mycobacterium avium subsp. paratuberculosis
gccaaggucgccggug

SEQ ID NO: 824975 - RNA, 20 nt, Mycobacterium avium subsp. paratuberculosis
gccaagccauuucagcagcg

SEQ ID NO: 824976 - RNA, 22 nt, Mycobacterium avium subsp. paratuberculosis
gccaagccauuucagcagcgcg

SEQ ID NO: 824977 - RNA, 22 nt, Mycobacterium avium subsp. paratuberculosis
gccaaggccagcaaccgccgug

SEQ ID NO: 824978 - RNA, 19 nt, Mycobacterium avium subsp. paratuberculosis
gccaagcgguuccagaccg

SEQ ID NO: 824979 - RNA, 21 nt, Mycobacterium avium subsp. paratuberculosis
gccaagcgguuccagaccggc

SEQ ID NO: 824980 - RNA, 20 nt, Mycobacterium avium subsp. paratuberculosis
gccaagcguauccggccagc

SEQ ID NO: 824981 - RNA, 19 nt, Mycobacterium avium subsp. paratuberculosis
gccaauuccucagcccggc

SEQ ID NO: 824982 - RNA, 20 nt, Mycobacterium avium subsp. paratuberculosis
gccaauuccucagcccggca

SEQ ID NO: 824983 - RNA, 20 nt, Mycobacterium avium subsp. paratuberculosis
gccaaucgcugugcgaacuc

SEQ ID NO: 824984 - RNA, 17 nt, Mycobacterium avium subsp. paratuberculosis
gccaaugaaauucaggc

SEQ ID NO: 824985 - RNA, 19 nt, Mycobacterium avium subsp. paratuberculosis
gccaaugaaauucaggcca

SEQ ID NO: 824986 - RNA, 18 nt, Mycobacterium avium subsp. paratuberculosis
gccacacacugcugcgca

SEQ ID NO: 824987 - RNA, 13 nt, Mycobacterium avium subsp. paratuberculosis
gccacaacuggcc

SEQ ID NO: 824988 - RNA, 23 nt, Mycobacterium avium subsp. paratuberculosis
gccacaacuggucgugcucgucg

SEQ ID NO: 824989 - RNA, 16 nt, Mycobacterium avium subsp. paratuberculosis
gccacaaacagcgcgg

SEQ ID NO: 824990 - RNA, 17 nt, Mycobacterium avium subsp. paratuberculosis
gccacaaacagcgcggc

SEQ ID NO: 824991 - RNA, 21 nt, Mycobacterium avium subsp. paratuberculosis
gccacaaacagcgcggccgga

SEQ ID NO: 824992 - RNA, 22 nt, Mycobacterium avium subsp. paratuberculosis
gccacaacaugucccgggcacg

SEQ ID NO: 824993 - RNA, 13 nt, Mycobacterium avium subsp. paratuberculosis
gccacaccgccgc

SEQ ID NO: 824994 - RNA, 14 nt, Mycobacterium avium subsp. paratuberculosis
gccacaccucggcg

SEQ ID NO: 824995 - RNA, 13 nt, Mycobacterium avium subsp. paratuberculosis
gccacacccgucg

SEQ ID NO: 824996 - RNA, 21 nt, Mycobacterium avium subsp. paratuberculosis
gccacacccgucgacucggcg

SEQ ID NO: 824997 - RNA, 14 nt, Mycobacterium avium subsp. paratuberculosis
gccacaccgccgcg

SEQ ID NO: 824998 - RNA, 16 nt, Mycobacterium avium subsp. paratuberculosis
gccacaccgccgcggc

SEQ ID NO: 824999 - RNA, 17 nt, Mycobacterium avium subsp. paratuberculosis
gccacaccgccgcggcg

SEQ ID NO: 825000 - RNA, 19 nt, Mycobacterium avium subsp. paratuberculosis
gccacaccgccgcggcggu

SEQ ID NO: 825001 - RNA, 21 nt, Mycobacterium avium subsp. paratuberculosis
gccacaccgccgcggcggugg

SEQ ID NO: 825002 - RNA, 14 nt, Mycobacterium avium subsp. paratuberculosis
gccacaccgccggc

SEQ ID NO: 825003 - RNA, 15 nt, Mycobacterium avium subsp. paratuberculosis
gccacaccgccggcg

SEQ ID NO: 825004 - RNA, 16 nt, Mycobacterium avium subsp. paratuberculosis
gccacaccgccggcgc

SEQ ID NO: 825005 - RNA, 22 nt, Mycobacterium avium subsp. paratuberculosis
gccacagccggggaucgcgcag

SEQ ID NO: 825006 - RNA, 12 nt, Mycobacterium avium subsp. paratuberculosis
gccacagccggu

SEQ ID NO: 825007 - RNA, 18 nt, Mycobacterium avium subsp. paratuberculosis
gccacagcgacagggugc

SEQ ID NO: 825008 - RNA, 20 nt, Mycobacterium avium subsp. paratuberculosis
gccacagcgacagggugccg

SEQ ID NO: 825009 - RNA, 21 nt, Mycobacterium avium subsp. paratuberculosis
gccacagcgacagggugccga

SEQ ID NO: 825010 - RNA, 15 nt, Mycobacterium avium subsp. paratuberculosis
gccacagcagcacca

SEQ ID NO: 825011 - RNA, 17 nt, Mycobacterium avium subsp. paratuberculosis
gccacagcagcaccagc

SEQ ID NO: 825012 - RNA, 14 nt, Mycobacterium avium subsp. paratuberculosis
gccacacuggccau

SEQ ID NO: 825013 - RNA, 12 nt, Mycobacterium avium subsp. paratuberculosis
gccacacuggcg

SEQ ID NO: 825014 - RNA, 22 nt, Mycobacterium avium subsp. paratuberculosis
gccacacuggcgugacgcucgg

SEQ ID NO: 825015 - RNA, 24 nt, Mycobacterium avium subsp. paratuberculosis
gccacacuggcgugacgcucggcc

SEQ ID NO: 825016 - RNA, 21 nt, Mycobacterium avium subsp. paratuberculosis
gccacaggccgaacagcagcg

SEQ ID NO: 825017 - RNA, 21 nt, Mycobacterium avium subsp. paratuberculosis
gccacagcggcgacagcggcc

SEQ ID NO: 825018 - RNA, 21 nt, Mycobacterium avium subsp. paratuberculosis
gccacagcgucucgaccgcgg

SEQ ID NO: 825019 - RNA, 13 nt, Mycobacterium avium subsp. paratuberculosis
gccacagcggcga

SEQ ID NO: 825020 - RNA, 12 nt, Mycobacterium avium subsp. paratuberculosis
gccacagcgccu

SEQ ID NO: 825021 - RNA, 18 nt, Mycobacterium avium subsp. paratuberculosis
gccacagcgccucgcggu

SEQ ID NO: 825022 - RNA, 20 nt, Mycobacterium avium subsp. paratuberculosis
gccacaucagcucggcggcc

SEQ ID NO: 825023 - RNA, 21 nt, Mycobacterium avium subsp. paratuberculosis
gccacaucagcucggcggccu

SEQ ID NO: 825024 - RNA, 19 nt, Mycobacterium avium subsp. paratuberculosis
gccacaugggccacggcgc

SEQ ID NO: 825025 - RNA, 22 nt, Mycobacterium avium subsp. paratuberculosis
gccacauguucuccucgucgcg

SEQ ID NO: 825026 - RNA, 19 nt, Mycobacterium avium subsp. paratuberculosis
gccaccaacaggucggcgu

SEQ ID NO: 825027 - RNA, 24 nt, Mycobacterium avium subsp. paratuberculosis
gccaccaacaggucggcgugcagc

SEQ ID NO: 825028 - RNA, 17 nt, Mycobacterium avium subsp. paratuberculosis
gccaccaacaucgacgu

SEQ ID NO: 825029 - RNA, 19 nt, Mycobacterium avium subsp. paratuberculosis
gccaccaacggcagcagca

SEQ ID NO: 825030 - RNA, 22 nt, Mycobacterium avium subsp. paratuberculosis
gccaccgucagcgucagcacgu

SEQ ID NO: 825031 - RNA, 18 nt, Mycobacterium avium subsp. paratuberculosis
gccaccgucccggugucg

SEQ ID NO: 825032 - RNA, 23 nt, Mycobacterium avium subsp. paratuberculosis
gccaccgucccggugucgccguc

SEQ ID NO: 825033 - RNA, 14 nt, Mycobacterium avium subsp. paratuberculosis
gccaccgucgccgg

SEQ ID NO: 825034 - RNA, 15 nt, Mycobacterium avium subsp. paratuberculosis
gccaccgucgccggc

SEQ ID NO: 825035 - RNA, 22 nt, Mycobacterium avium subsp. paratuberculosis
gccaccguggccccacgggcca

SEQ ID NO: 825036 - RNA, 21 nt, Mycobacterium avium subsp. paratuberculosis
gccaccgugccuuacgccggg

SEQ ID NO: 825037 - RNA, 22 nt, Mycobacterium avium subsp. paratuberculosis
gccaccgugccuuacgccgggg

SEQ ID NO: 825038 - RNA, 18 nt, Mycobacterium avium subsp. paratuberculosis
gccaccgucgucgagcgc

SEQ ID NO: 825039 - RNA, 15 nt, Mycobacterium avium subsp. paratuberculosis
gccaccuccagcccg

SEQ ID NO: 825040 - RNA, 18 nt, Mycobacterium avium subsp. paratuberculosis
gccaccuccuccgguccg

SEQ ID NO: 825041 - RNA, 22 nt, Mycobacterium avium subsp. paratuberculosis
gccaccuccuccgguccgggcu

SEQ ID NO: 825042 - RNA, 19 nt, Mycobacterium avium subsp. paratuberculosis
gccaccucgagcucaccga

SEQ ID NO: 825043 - RNA, 14 nt, Mycobacterium avium subsp. paratuberculosis
gccaccgcguccgc

SEQ ID NO: 825044 - RNA, 13 nt, Mycobacterium avium subsp. paratuberculosis
gccaccgcgucgc

SEQ ID NO: 825045 - RNA, 17 nt, Mycobacterium avium subsp. paratuberculosis
gccaccgcgucgcugcc

SEQ ID NO: 825046 - RNA, 18 nt, Mycobacterium avium subsp. paratuberculosis
gccaccgcugggcggcgc

SEQ ID NO: 825047 - RNA, 22 nt, Mycobacterium avium subsp. paratuberculosis
gccaccgcugggcggcgcggcg

SEQ ID NO: 825048 - RNA, 13 nt, Mycobacterium avium subsp. paratuberculosis
gccaccggcgcca

SEQ ID NO: 825049 - RNA, 15 nt, Mycobacterium avium subsp. paratuberculosis
gccaccggccggucc

SEQ ID NO: 825050 - RNA, 22 nt, Mycobacterium avium subsp. paratuberculosis
gccaccggccgguccgcccaga

SEQ ID NO: 825051 - RNA, 23 nt, Mycobacterium avium subsp. paratuberculosis
gccaccggccgguccgcccagac

SEQ ID NO: 825052 - RNA, 15 nt, Mycobacterium avium subsp. paratuberculosis
gccaccggcccggcc

SEQ ID NO: 825053 - RNA, 12 nt, Mycobacterium avium subsp. paratuberculosis
gccaccggccgg

SEQ ID NO: 825054 - RNA, 13 nt, Mycobacterium avium subsp. paratuberculosis
gccaccggcuccu

SEQ ID NO: 825055 - RNA, 22 nt, Mycobacterium avium subsp. paratuberculosis
gccaccggcuccuugcgccgca

SEQ ID NO: 825056 - RNA, 24 nt, Mycobacterium avium subsp. paratuberculosis
gccaccgggaccugcugcucgucg

SEQ ID NO: 825057 - RNA, 16 nt, Mycobacterium avium subsp. paratuberculosis
gccaccgggcguggcu

SEQ ID NO: 825058 - RNA, 20 nt, Mycobacterium avium subsp. paratuberculosis
gccaccggguaagugucgug

SEQ ID NO: 825059 - RNA, 21 nt, Mycobacterium avium subsp. paratuberculosis
gccaccgggucguccgcgacg

SEQ ID NO: 825060 - RNA, 24 nt, Mycobacterium avium subsp. paratuberculosis
gccaccgggucguccgcgacgcug

SEQ ID NO: 825061 - RNA, 18 nt, Mycobacterium avium subsp. paratuberculosis
gccaccgaggugacgucg

SEQ ID NO: 825062 - RNA, 21 nt, Mycobacterium avium subsp. paratuberculosis
gccaccgaggugacgucgcgc

SEQ ID NO: 825063 - RNA, 23 nt, Mycobacterium avium subsp. paratuberculosis
gccaccgaggugacgucgcgccg

SEQ ID NO: 825064 - RNA, 14 nt, Mycobacterium avium subsp. paratuberculosis
gccaccgagucgcg

SEQ ID NO: 825065 - RNA, 17 nt, Mycobacterium avium subsp. paratuberculosis
gccaccgagucgcgcga

SEQ ID NO: 825066 - RNA, 22 nt, Mycobacterium avium subsp. paratuberculosis
gccaccgaugcccgacaccgcc

SEQ ID NO: 825067 - RNA, 13 nt, Mycobacterium avium subsp. paratuberculosis
gccaccgaugcgg

SEQ ID NO: 825068 - RNA, 13 nt, Mycobacterium avium subsp. paratuberculosis
gccaccgacacca

SEQ ID NO: 825069 - RNA, 15 nt, Mycobacterium avium subsp. paratuberculosis
gccaccgacaccacc

SEQ ID NO: 825070 - RNA, 16 nt, Mycobacterium avium subsp. paratuberculosis
gccaccgacaccaccg

SEQ ID NO: 825071 - RNA, 17 nt, Mycobacterium avium subsp. paratuberculosis
gccaccgacaccaccgg

SEQ ID NO: 825072 - RNA, 19 nt, Mycobacterium avium subsp. paratuberculosis
gccaccgacaccaccggcc

SEQ ID NO: 825073 - RNA, 19 nt, Mycobacterium avium subsp. paratuberculosis
gccaccgaagccgacgucg

SEQ ID NO: 825074 - RNA, 20 nt, Mycobacterium avium subsp. paratuberculosis
gccaccgaagccgacgucga

SEQ ID NO: 825075 - RNA, 17 nt, Mycobacterium avium subsp. paratuberculosis
gccaccgagaucaugcc

SEQ ID NO: 825076 - RNA, 20 nt, Mycobacterium avium subsp. paratuberculosis
gccaccgagaucaugccggc

SEQ ID NO: 825077 - RNA, 21 nt, Mycobacterium avium subsp. paratuberculosis
gccaccgagaucaugccggcg

SEQ ID NO: 825078 - RNA, 12 nt, Mycobacterium avium subsp. paratuberculosis
gccacccgggcg

SEQ ID NO: 825079 - RNA, 13 nt, Mycobacterium avium subsp. paratuberculosis
gccacccgggcgc

SEQ ID NO: 825080 - RNA, 16 nt, Mycobacterium avium subsp. paratuberculosis
gccacccgggcgccgg

SEQ ID NO: 825081 - RNA, 18 nt, Mycobacterium avium subsp. paratuberculosis
gccacccgggcgccggcg

SEQ ID NO: 825082 - RNA, 19 nt, Mycobacterium avium subsp. paratuberculosis
gccacccgggcgccggcga

SEQ ID NO: 825083 - RNA, 15 nt, Mycobacterium avium subsp. paratuberculosis
gccacccucgccgcc

SEQ ID NO: 825084 - RNA, 17 nt, Mycobacterium avium subsp. paratuberculosis
gccacccucgccgccgc

SEQ ID NO: 825085 - RNA, 19 nt, Mycobacterium avium subsp. paratuberculosis
gccacccugcgcaccgcgg

SEQ ID NO: 825086 - RNA, 22 nt, Mycobacterium avium subsp. paratuberculosis
gccaccgcgcaaccgggccgca

SEQ ID NO: 825087 - RNA, 17 nt, Mycobacterium avium subsp. paratuberculosis
gccaccgcgccccggcg

SEQ ID NO: 825088 - RNA, 13 nt, Mycobacterium avium subsp. paratuberculosis
gccaccgcgacgc

SEQ ID NO: 825089 - RNA, 16 nt, Mycobacterium avium subsp. paratuberculosis
gccaccgcgccguggg

SEQ ID NO: 825090 - RNA, 18 nt, Mycobacterium avium subsp. paratuberculosis
gccaccgcgccgugggcg

SEQ ID NO: 825091 - RNA, 14 nt, Mycobacterium avium subsp. paratuberculosis
gccaccgcgcgcug

SEQ ID NO: 825092 - RNA, 17 nt, Mycobacterium avium subsp. paratuberculosis
gccaccgcgcgcugccg

SEQ ID NO: 825093 - RNA, 18 nt, Mycobacterium avium subsp. paratuberculosis
gccaccgcgcgcugccgc

SEQ ID NO: 825094 - RNA, 14 nt, Mycobacterium avium subsp. paratuberculosis
gccaccgcgcggcg

SEQ ID NO: 825095 - RNA, 15 nt, Mycobacterium avium subsp. paratuberculosis
gccaccgcgcggugc

SEQ ID NO: 825096 - RNA, 12 nt, Mycobacterium avium subsp. paratuberculosis
gccaccgcggcg

SEQ ID NO: 825097 - RNA, 13 nt, Mycobacterium avium subsp. paratuberculosis
gccaccgcggcca

SEQ ID NO: 825098 - RNA, 18 nt, Mycobacterium avium subsp. paratuberculosis
gccaccgcggccagcugc

SEQ ID NO: 825099 - RNA, 14 nt, Mycobacterium avium subsp. paratuberculosis
gccaccgcggcguu

SEQ ID NO: 825100 - RNA, 17 nt, Mycobacterium avium subsp. paratuberculosis
gccaccgcggggcuggg

SEQ ID NO: 825101 - RNA, 21 nt, Mycobacterium avium subsp. paratuberculosis
gccaccgcgaaagcgucggcu

SEQ ID NO: 825102 - RNA, 15 nt, Mycobacterium avium subsp. paratuberculosis
gccaccgcgacgcug

SEQ ID NO: 825103 - RNA, 18 nt, Mycobacterium avium subsp. paratuberculosis
gccaccgcgacgcugccg

SEQ ID NO: 825104 - RNA, 20 nt, Mycobacterium avium subsp. paratuberculosis
gccaccgcaucgccgagggc

SEQ ID NO: 825105 - RNA, 21 nt, Mycobacterium avium subsp. paratuberculosis
gccaccgcaucgccgagggcg

SEQ ID NO: 825106 - RNA, 13 nt, Mycobacterium avium subsp. paratuberculosis
gccaccgccugcg

SEQ ID NO: 825107 - RNA, 15 nt, Mycobacterium avium subsp. paratuberculosis
gccaccgccugcgcg

SEQ ID NO: 825108 - RNA, 16 nt, Mycobacterium avium subsp. paratuberculosis
gccaccgccugcgcga

SEQ ID NO: 825109 - RNA, 13 nt, Mycobacterium avium subsp. paratuberculosis
gccaccgcccgcu

SEQ ID NO: 825110 - RNA, 19 nt, Mycobacterium avium subsp. paratuberculosis
gccaccgccgauggcgacg

SEQ ID NO: 825111 - RNA, 12 nt, Mycobacterium avium subsp. paratuberculosis
gccaccgccgcc

SEQ ID NO: 825112 - RNA, 13 nt, Mycobacterium avium subsp. paratuberculosis
gccaccgccgcca

SEQ ID NO: 825113 - RNA, 12 nt, Mycobacterium avium subsp. paratuberculosis
gccaccgcccca

SEQ ID NO: 825114 - RNA, 14 nt, Mycobacterium avium subsp. paratuberculosis
gccaccaggucgca

SEQ ID NO: 825115 - RNA, 19 nt, Mycobacterium avium subsp. paratuberculosis
gccaccaggucgcacacca

SEQ ID NO: 825116 - RNA, 21 nt, Mycobacterium avium subsp. paratuberculosis
gccaccaggucgcacaccagc

SEQ ID NO: 825117 - RNA, 15 nt, Mycobacterium avium subsp. paratuberculosis
gccaccaucaggccg

SEQ ID NO: 825118 - RNA, 21 nt, Mycobacterium avium subsp. paratuberculosis
gccaccaucaggccggccugc

SEQ ID NO: 825119 - RNA, 14 nt, Mycobacterium avium subsp. paratuberculosis
gccaccaugccggc

SEQ ID NO: 825120 - RNA, 18 nt, Mycobacterium avium subsp. paratuberculosis
gccaccaucuccgcggcg

SEQ ID NO: 825121 - RNA, 21 nt, Mycobacterium avium subsp. paratuberculosis
gccaccaucuccgcggcgcgg

SEQ ID NO: 825122 - RNA, 22 nt, Mycobacterium avium subsp. paratuberculosis
gccaccaucuccgcggcgcggu

SEQ ID NO: 825123 - RNA, 19 nt, Mycobacterium avium subsp. paratuberculosis
gccaccaggcgguccgaca

SEQ ID NO: 825124 - RNA, 20 nt, Mycobacterium avium subsp. paratuberculosis
gccaccagggucucgcgcag

SEQ ID NO: 825125 - RNA, 22 nt, Mycobacterium avium subsp. paratuberculosis
gccaccagggucucgcgcagca

SEQ ID NO: 825126 - RNA, 12 nt, Mycobacterium avium subsp. paratuberculosis
gccaccagggcg

SEQ ID NO: 825127 - RNA, 13 nt, Mycobacterium avium subsp. paratuberculosis
gccaccagggcga

SEQ ID NO: 825128 - RNA, 17 nt, Mycobacterium avium subsp. paratuberculosis
gccaccagggcgaccgc

SEQ ID NO: 825129 - RNA, 21 nt, Mycobacterium avium subsp. paratuberculosis
gccaccagggcgaccgccgcg

SEQ ID NO: 825130 - RNA, 16 nt, Mycobacterium avium subsp. paratuberculosis
gccaccaggcgccguc

SEQ ID NO: 825131 - RNA, 18 nt, Mycobacterium avium subsp. paratuberculosis
gccaccaggcgccgucga

SEQ ID NO: 825132 - RNA, 14 nt, Mycobacterium avium subsp. paratuberculosis
gccaccccaggcga

SEQ ID NO: 825133 - RNA, 23 nt, Mycobacterium avium subsp. paratuberculosis
gccaccccaggcgaugccgccga

SEQ ID NO: 825134 - RNA, 16 nt, Mycobacterium avium subsp. paratuberculosis
gccaccccgcagaaca

SEQ ID NO: 825135 - RNA, 22 nt, Mycobacterium avium subsp. paratuberculosis
gccaccccgcagaacaccagcg

SEQ ID NO: 825136 - RNA, 22 nt, Mycobacterium avium subsp. paratuberculosis
gccaccccccaguuucccgucg

SEQ ID NO: 825137 - RNA, 18 nt, Mycobacterium avium subsp. paratuberculosis
gccaccccgaacccggcc

SEQ ID NO: 825138 - RNA, 17 nt, Mycobacterium avium subsp. paratuberculosis
gccaccaugucggcguc

SEQ ID NO: 825139 - RNA, 19 nt, Mycobacterium avium subsp. paratuberculosis
gccaccaugucggcgucgc

SEQ ID NO: 825140 - RNA, 24 nt, Mycobacterium avium subsp. paratuberculosis
gccaccaugucggcgucgccgagc

SEQ ID NO: 825141 - RNA, 12 nt, Mycobacterium avium subsp. paratuberculosis
gccacccgcgcc

SEQ ID NO: 825142 - RNA, 13 nt, Mycobacterium avium subsp. paratuberculosis
gccacccgcgccu

SEQ ID NO: 825143 - RNA, 16 nt, Mycobacterium avium subsp. paratuberculosis
gccacccgcgccucca

SEQ ID NO: 825144 - RNA, 14 nt, Mycobacterium avium subsp. paratuberculosis
gccacccgcaccuc

SEQ ID NO: 825145 - RNA, 17 nt, Mycobacterium avium subsp. paratuberculosis
gccaccccggugaccuc

SEQ ID NO: 825146 - RNA, 16 nt, Mycobacterium avium subsp. paratuberculosis
gccacccgcaugcuga

SEQ ID NO: 825147 - RNA, 12 nt, Mycobacterium avium subsp. paratuberculosis
gccaccagcgcc

SEQ ID NO: 825148 - RNA, 11 nt, Mycobacterium avium subsp. paratuberculosis
gccaccagcgc

SEQ ID NO: 825149 - RNA, 22 nt, Mycobacterium avium subsp. paratuberculosis
gccaccagcgcggccaccacca

SEQ ID NO: 825150 - RNA, 13 nt, Mycobacterium avium subsp. paratuberculosis
gccaccagcgccc

SEQ ID NO: 825151 - RNA, 16 nt, Mycobacterium avium subsp. paratuberculosis
gccaccagcgcccgcc

SEQ ID NO: 825152 - RNA, 16 nt, Mycobacterium avium subsp. paratuberculosis
gccaccaggccgaaga

SEQ ID NO: 825153 - RNA, 19 nt, Mycobacterium avium subsp. paratuberculosis
gccaccagcgcacacagca

SEQ ID NO: 825154 - RNA, 16 nt, Mycobacterium avium subsp. paratuberculosis
gccaccagcggccgga

SEQ ID NO: 825155 - RNA, 23 nt, Mycobacterium avium subsp. paratuberculosis
gccaccagcguuccagcacccgg

SEQ ID NO: 825156 - RNA, 13 nt, Mycobacterium avium subsp. paratuberculosis
gccaccagcuccu

SEQ ID NO: 825157 - RNA, 22 nt, Mycobacterium avium subsp. paratuberculosis
gccaccagaucguguccgcgcc

SEQ ID NO: 825158 - RNA, 17 nt, Mycobacterium avium subsp. paratuberculosis
gccaccagaugccgggc

SEQ ID NO: 825159 - RNA, 15 nt, Mycobacterium avium subsp. paratuberculosis
gccaccagcaccggg

SEQ ID NO: 825160 - RNA, 13 nt, Mycobacterium avium subsp. paratuberculosis
gccaccagcagca

SEQ ID NO: 825161 - RNA, 17 nt, Mycobacterium avium subsp. paratuberculosis
gccaccagcagcagguu

SEQ ID NO: 825162 - RNA, 16 nt, Mycobacterium avium subsp. paratuberculosis
gccaccagcagcgaga

SEQ ID NO: 825163 - RNA, 15 nt, Mycobacterium avium subsp. paratuberculosis
gccaccagaccggcg

SEQ ID NO: 825164 - RNA, 13 nt, Mycobacterium avium subsp. paratuberculosis
gccaccacugcgc

SEQ ID NO: 825165 - RNA, 16 nt, Mycobacterium avium subsp. paratuberculosis
gccaccacugcgccgu

SEQ ID NO: 825166 - RNA, 17 nt, Mycobacterium avium subsp. paratuberculosis
gccaccagccacaccgc

SEQ ID NO: 825167 - RNA, 22 nt, Mycobacterium avium subsp. paratuberculosis
gccaccagccacaccgccgcgg

SEQ ID NO: 825168 - RNA, 16 nt, Mycobacterium avium subsp. paratuberculosis
gccaccagccggccgg

SEQ ID NO: 825169 - RNA, 15 nt, Mycobacterium avium subsp. paratuberculosis
gccaccacggcgucg

SEQ ID NO: 825170 - RNA, 17 nt, Mycobacterium avium subsp. paratuberculosis
gccaccacggcgucgcu

SEQ ID NO: 825171 - RNA, 14 nt, Mycobacterium avium subsp. paratuberculosis
gccaccacgggucg

SEQ ID NO: 825172 - RNA, 19 nt, Mycobacterium avium subsp. paratuberculosis
gccaccacguacuccugcg

SEQ ID NO: 825173 - RNA, 22 nt, Mycobacterium avium subsp. paratuberculosis
gccaccacguacuccugcgcga

SEQ ID NO: 825174 - RNA, 15 nt, Mycobacterium avium subsp. paratuberculosis
gccaccacggcaccg

SEQ ID NO: 825175 - RNA, 16 nt, Mycobacterium avium subsp. paratuberculosis
gccaccacggcaccgc

SEQ ID NO: 825176 - RNA, 17 nt, Mycobacterium avium subsp. paratuberculosis
gccaccacggcaccgcc

SEQ ID NO: 825177 - RNA, 18 nt, Mycobacterium avium subsp. paratuberculosis
gccaccacggcaccgccg

SEQ ID NO: 825178 - RNA, 20 nt, Mycobacterium avium subsp. paratuberculosis
gccaccacggcaccgccgcg

SEQ ID NO: 825179 - RNA, 13 nt, Mycobacterium avium subsp. paratuberculosis
gccaccaccucgc

SEQ ID NO: 825180 - RNA, 12 nt, Mycobacterium avium subsp. paratuberculosis
gccaccacgcca

SEQ ID NO: 825181 - RNA, 15 nt, Mycobacterium avium subsp. paratuberculosis
gccaccacgccagcc

SEQ ID NO: 825182 - RNA, 21 nt, Mycobacterium avium subsp. paratuberculosis
gccaccacgcccuuguuguuc

SEQ ID NO: 825183 - RNA, 19 nt, Mycobacterium avium subsp. paratuberculosis
gccaccaccuucaucgccg

SEQ ID NO: 825184 - RNA, 16 nt, Mycobacterium avium subsp. paratuberculosis
gccaccacgacgccgg

SEQ ID NO: 825185 - RNA, 18 nt, Mycobacterium avium subsp. paratuberculosis
gccaccacgacgccgggc

SEQ ID NO: 825186 - RNA, 20 nt, Mycobacterium avium subsp. paratuberculosis
gccaccacgacgccgggcgc

SEQ ID NO: 825187 - RNA, 21 nt, Mycobacterium avium subsp. paratuberculosis
gccaccacgacgccgggcgcc

SEQ ID NO: 825188 - RNA, 14 nt, Mycobacterium avium subsp. paratuberculosis
gccaccaccacgga

SEQ ID NO: 825189 - RNA, 24 nt, Mycobacterium avium subsp. paratuberculosis
gccaccaccacggagcgcccggcc

SEQ ID NO: 825190 - RNA, 17 nt, Mycobacterium avium subsp. paratuberculosis
gccaccaccacggccgc

SEQ ID NO: 825191 - RNA, 21 nt, Mycobacterium avium subsp. paratuberculosis
gccaccaccacggccgccgag

SEQ ID NO: 825192 - RNA, 17 nt, Mycobacterium avium subsp. paratuberculosis
gccaccaccacggggcg

SEQ ID NO: 825193 - RNA, 12 nt, Mycobacterium avium subsp. paratuberculosis
gccaccaccagc

SEQ ID NO: 825194 - RNA, 14 nt, Mycobacterium avium subsp. paratuberculosis
gccaccaccagcgg

SEQ ID NO: 825195 - RNA, 17 nt, Mycobacterium avium subsp. paratuberculosis
gccaccaccagcgggcu

SEQ ID NO: 825196 - RNA, 23 nt, Mycobacterium avium subsp. paratuberculosis
gccaccaccagcgggcugugccg

SEQ ID NO: 825197 - RNA, 13 nt, Mycobacterium avium subsp. paratuberculosis
gccaccaccgagg

SEQ ID NO: 825198 - RNA, 21 nt, Mycobacterium avium subsp. paratuberculosis
gccaccaccgagguggcccag

SEQ ID NO: 825199 - RNA, 22 nt, Mycobacterium avium subsp. paratuberculosis
gccaccaccgagguggcccagc

SEQ ID NO: 825200 - RNA, 15 nt, Mycobacterium avium subsp. paratuberculosis
gccaccaccgcgccg

SEQ ID NO: 825201 - RNA, 20 nt, Mycobacterium avium subsp. paratuberculosis
gccaccaccgcgccgucguc

SEQ ID NO: 825202 - RNA, 17 nt, Mycobacterium avium subsp. paratuberculosis
gccacugggcgucggcg

SEQ ID NO: 825203 - RNA, 18 nt, Mycobacterium avium subsp. paratuberculosis
gccacugggcgucggcgc

SEQ ID NO: 825204 - RNA, 17 nt, Mycobacterium avium subsp. paratuberculosis
gccacugcgggaacguc

SEQ ID NO: 825205 - RNA, 15 nt, Mycobacterium avium subsp. paratuberculosis
gccacuggcgccacc

SEQ ID NO: 825206 - RNA, 16 nt, Mycobacterium avium subsp. paratuberculosis
gccacuggcgccaccu

SEQ ID NO: 825207 - RNA, 14 nt, Mycobacterium avium subsp. paratuberculosis
gccacugccgccgc

SEQ ID NO: 825208 - RNA, 16 nt, Mycobacterium avium subsp. paratuberculosis
gccacugccgccgccc

SEQ ID NO: 825209 - RNA, 21 nt, Mycobacterium avium subsp. paratuberculosis
gccacugccgccgcccaggcc

SEQ ID NO: 825210 - RNA, 20 nt, Mycobacterium avium subsp. paratuberculosis
gccacugccccggcgaacgc

SEQ ID NO: 825211 - RNA, 13 nt, Mycobacterium avium subsp. paratuberculosis
gccacucgccgcg

SEQ ID NO: 825212 - RNA, 15 nt, Mycobacterium avium subsp. paratuberculosis
gccacucgccgcgaa

SEQ ID NO: 825213 - RNA, 19 nt, Mycobacterium avium subsp. paratuberculosis
gccacucgccgcgaacgac

SEQ ID NO: 825214 - RNA, 16 nt, Mycobacterium avium subsp. paratuberculosis
gccacucgggcggccg

SEQ ID NO: 825215 - RNA, 20 nt, Mycobacterium avium subsp. paratuberculosis
gccacucgggcggccgcgga

SEQ ID NO: 825216 - RNA, 18 nt, Mycobacterium avium subsp. paratuberculosis
gccacucgucgacguucg

SEQ ID NO: 825217 - RNA, 13 nt, Mycobacterium avium subsp. paratuberculosis
gccacggcacguc

SEQ ID NO: 825218 - RNA, 15 nt, Mycobacterium avium subsp. paratuberculosis
gccacggcacgucga

SEQ ID NO: 825219 - RNA, 14 nt, Mycobacterium avium subsp. paratuberculosis
gccacggccaccgc

SEQ ID NO: 825220 - RNA, 12 nt, Mycobacterium avium subsp. paratuberculosis
gccacggccagc

SEQ ID NO: 825221 - RNA, 16 nt, Mycobacterium avium subsp. paratuberculosis
gccacggccagcaccg

SEQ ID NO: 825222 - RNA, 17 nt, Mycobacterium avium subsp. paratuberculosis
gccacggcagcugcagc

SEQ ID NO: 825223 - RNA, 18 nt, Mycobacterium avium subsp. paratuberculosis
gccacggcagcugcagcg

SEQ ID NO: 825224 - RNA, 16 nt, Mycobacterium avium subsp. paratuberculosis
gccacggggcccgcga

SEQ ID NO: 825225 - RNA, 12 nt, Mycobacterium avium subsp. paratuberculosis
gccacggggcgc

SEQ ID NO: 825226 - RNA, 16 nt, Mycobacterium avium subsp. paratuberculosis
gccacggggcgccgcu

SEQ ID NO: 825227 - RNA, 15 nt, Mycobacterium avium subsp. paratuberculosis
gccacgggcggucgg

SEQ ID NO: 825228 - RNA, 19 nt, Mycobacterium avium subsp. paratuberculosis
gccacgggcggucggacgc

SEQ ID NO: 825229 - RNA, 18 nt, Mycobacterium avium subsp. paratuberculosis
gccacggggcugcgggcc

SEQ ID NO: 825230 - RNA, 15 nt, Mycobacterium avium subsp. paratuberculosis
gccacggggucgaga

SEQ ID NO: 825231 - RNA, 16 nt, Mycobacterium avium subsp. paratuberculosis
gccacggggucgagaa

SEQ ID NO: 825232 - RNA, 18 nt, Mycobacterium avium subsp. paratuberculosis
gccacgguccuuggcgua

SEQ ID NO: 825233 - RNA, 22 nt, Mycobacterium avium subsp. paratuberculosis
gccacgguuucgccguacagcu

SEQ ID NO: 825234 - RNA, 19 nt, Mycobacterium avium subsp. paratuberculosis
gccacguacaccgggaucg

SEQ ID NO: 825235 - RNA, 21 nt, Mycobacterium avium subsp. paratuberculosis
gccacguacaccgggaucggg

SEQ ID NO: 825236 - RNA, 17 nt, Mycobacterium avium subsp. paratuberculosis
gccaccuuggacaggcc

SEQ ID NO: 825237 - RNA, 23 nt, Mycobacterium avium subsp. paratuberculosis
gccaccuuggacaggcccagcgg

SEQ ID NO: 825238 - RNA, 17 nt, Mycobacterium avium subsp. paratuberculosis
gccaccuucaccgcgcc

SEQ ID NO: 825239 - RNA, 21 nt, Mycobacterium avium subsp. paratuberculosis
gccacgaccagcggcagcacg

SEQ ID NO: 825240 - RNA, 12 nt, Mycobacterium avium subsp. paratuberculosis
gccacgcccacc

SEQ ID NO: 825241 - RNA, 14 nt, Mycobacterium avium subsp. paratuberculosis
gccacgcccaccgg

SEQ ID NO: 825242 - RNA, 15 nt, Mycobacterium avium subsp. paratuberculosis
gccacgcccaccggu

SEQ ID NO: 825243 - RNA, 19 nt, Mycobacterium avium subsp. paratuberculosis
gccacgcccaccgguggcc

SEQ ID NO: 825244 - RNA, 17 nt, Mycobacterium avium subsp. paratuberculosis
gccacgcccacgccgag

SEQ ID NO: 825245 - RNA, 17 nt, Mycobacterium avium subsp. paratuberculosis
gccacgacaccagcguc

SEQ ID NO: 825246 - RNA, 18 nt, Mycobacterium avium subsp. paratuberculosis
gccacgacaccagcgucg

SEQ ID NO: 825247 - RNA, 22 nt, Mycobacterium avium subsp. paratuberculosis
gccacgacaccagcgucgcgau

SEQ ID NO: 825248 - RNA, 17 nt, Mycobacterium avium subsp. paratuberculosis
gccaccuugucggcgcc

SEQ ID NO: 825249 - RNA, 16 nt, Mycobacterium avium subsp. paratuberculosis
gccacgacauccccgc

SEQ ID NO: 825250 - RNA, 23 nt, Mycobacterium avium subsp. paratuberculosis
gccacgacauccccgcaaacacg

SEQ ID NO: 825251 - RNA, 17 nt, Mycobacterium avium subsp. paratuberculosis
gccaccugggcggggcu

SEQ ID NO: 825252 - RNA, 18 nt, Mycobacterium avium subsp. paratuberculosis
gccaccugggcggggcug
